United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 66

SEQ ID NO: 2781743 - DNA, 18 bp, Homo sapiens
cctcaaataaaaagtgct

SEQ ID NO: 2781744 - DNA, 17 bp, Homo sapiens
cctcaagatgaaggcaa

SEQ ID NO: 2781745 - DNA, 23 bp, Homo sapiens
cctcaagtgattctcctgcctca

SEQ ID NO: 2781746 - DNA, 20 bp, Homo sapiens
cctcaatgtgaatcagaccc

SEQ ID NO: 2781747 - DNA, 15 bp, Homo sapiens
cctcaccaataactt

SEQ ID NO: 2781748 - DNA, 16 bp, Homo sapiens
cctcaccccctcccac

SEQ ID NO: 2781749 - DNA, 19 bp, Homo sapiens
cctcacccgaggctgccca

SEQ ID NO: 2781750 - DNA, 17 bp, Homo sapiens
cctcacctgcctgccct

SEQ ID NO: 2781751 - DNA, 16 bp, Homo sapiens
cctcacgcccagcctc

SEQ ID NO: 2781752 - DNA, 23 bp, Homo sapiens
cctcacgcccagcctcctcccac

SEQ ID NO: 2781753 - DNA, 23 bp, Homo sapiens
cctcactatgacactgagcaaga

SEQ ID NO: 2781754 - DNA, 17 bp, Homo sapiens
cctcactgaatgcctca

SEQ ID NO: 2781755 - DNA, 12 bp, Homo sapiens
cctcactgagga

SEQ ID NO: 2781756 - DNA, 12 bp, Homo sapiens
cctcactgcccc

SEQ ID NO: 2781757 - DNA, 15 bp, Homo sapiens
cctcactgccccacc

SEQ ID NO: 2781758 - DNA, 20 bp, Homo sapiens
cctcactgccccaccagcca

SEQ ID NO: 2781759 - DNA, 20 bp, Homo sapiens
cctcactgctggggagtccc

SEQ ID NO: 2781760 - DNA, 20 bp, Homo sapiens
cctcactggggtcctggggc

SEQ ID NO: 2781761 - DNA, 14 bp, Homo sapiens
cctcacttgaatgt

SEQ ID NO: 2781762 - DNA, 18 bp, Homo sapiens
cctcagaccaactctctc

SEQ ID NO: 2781763 - DNA, 14 bp, Homo sapiens
cctcagactgctca

SEQ ID NO: 2781764 - DNA, 21 bp, Homo sapiens
cctcagaggcagcaggaggct

SEQ ID NO: 2781765 - DNA, 11 bp, Homo sapiens
cctcagcctcc

SEQ ID NO: 2781766 - DNA, 22 bp, Homo sapiens
cctcagccttccccttgcccag

SEQ ID NO: 2781767 - DNA, 20 bp, Homo sapiens
cctcagccttgaaaaacaag

SEQ ID NO: 2781768 - DNA, 23 bp, Homo sapiens
cctcagggacagagacacctgca

SEQ ID NO: 2781769 - DNA, 23 bp, Homo sapiens
cctcagggatcttgcattcccag

SEQ ID NO: 2781770 - DNA, 17 bp, Homo sapiens
cctcaggtgatccaccc

SEQ ID NO: 2781771 - DNA, 19 bp, Homo sapiens
cctcaggtgatccacccac

SEQ ID NO: 2781772 - DNA, 22 bp, Homo sapiens
cctcaggttcctaagacttcag

SEQ ID NO: 2781773 - DNA, 19 bp, Homo sapiens
cctcagtgctcggcagtca

SEQ ID NO: 2781774 - DNA, 20 bp, Homo sapiens
cctcatagtatggtggctgg

SEQ ID NO: 2781775 - DNA, 21 bp, Homo sapiens
cctcatagtatggtggctggg

SEQ ID NO: 2781776 - DNA, 14 bp, Homo sapiens
cctcatccgaggca

SEQ ID NO: 2781777 - DNA, 17 bp, Homo sapiens
cctcatgacagccagag

SEQ ID NO: 2781778 - DNA, 17 bp, Homo sapiens
cctcatgcctggccccc

SEQ ID NO: 2781779 - DNA, 19 bp, Homo sapiens
cctcatgcctggcccccct

SEQ ID NO: 2781780 - DNA, 22 bp, Homo sapiens
cctcatgcctggcccccctcca

SEQ ID NO: 2781781 - DNA, 16 bp, Homo sapiens
cctcattcaggaaaac

SEQ ID NO: 2781782 - DNA, 19 bp, Homo sapiens
cctcatttatccctcaacc

SEQ ID NO: 2781783 - DNA, 20 bp, Homo sapiens
cctcatttatccctcaaccc

SEQ ID NO: 2781784 - DNA, 18 bp, Homo sapiens
cctccaacaataaagagc

SEQ ID NO: 2781785 - DNA, 22 bp, Homo sapiens
cctccaagctccatctccactc

SEQ ID NO: 2781786 - DNA, 18 bp, Homo sapiens
cctccacagtagcatttc

SEQ ID NO: 2781787 - DNA, 13 bp, Homo sapiens
cctggaggacctg

SEQ ID NO: 2781788 - DNA, 17 bp, Homo sapiens
cctggaggacctgagcc

SEQ ID NO: 2781789 - DNA, 22 bp, Homo sapiens
cctggaggacctgagcctgccg

SEQ ID NO: 2781790 - DNA, 14 bp, Homo sapiens
cctggagtgcagtt

SEQ ID NO: 2781791 - DNA, 19 bp, Homo sapiens
cctggatcagcgtggcctt

SEQ ID NO: 2781792 - DNA, 16 bp, Homo sapiens
cctggatgtgcccaca

SEQ ID NO: 2781793 - DNA, 17 bp, Homo sapiens
cctggatgtgcccacag

SEQ ID NO: 2781794 - DNA, 21 bp, Homo sapiens
cctggcacacatcaggagttc

SEQ ID NO: 2781795 - DNA, 21 bp, Homo sapiens
cctggcacccggcccctgctg

SEQ ID NO: 2781796 - DNA, 22 bp, Homo sapiens
cctggcacccggcccctgctgg

SEQ ID NO: 2781797 - DNA, 22 bp, Homo sapiens
cctggcacggtggctcaggcct

SEQ ID NO: 2781798 - DNA, 21 bp, Homo sapiens
cctggccagatgcaccagccc

SEQ ID NO: 2781799 - DNA, 23 bp, Homo sapiens
cctggccagatgcaccagccctt

SEQ ID NO: 2781800 - DNA, 15 bp, Homo sapiens
cctggccccatgtct

SEQ ID NO: 2781801 - DNA, 17 bp, Homo sapiens
cctggcccccctccagg

SEQ ID NO: 2781802 - DNA, 13 bp, Homo sapiens
cctggccggctcc

SEQ ID NO: 2781803 - DNA, 14 bp, Homo sapiens
cctggccggctcca

SEQ ID NO: 2781804 - DNA, 21 bp, Homo sapiens
cctggcctcacgcccagcctc

SEQ ID NO: 2781805 - DNA, 23 bp, Homo sapiens
cctggcctcacgcccagcctcct

SEQ ID NO: 2781806 - DNA, 15 bp, Homo sapiens
cctggcctcctgcct

SEQ ID NO: 2781807 - DNA, 16 bp, Homo sapiens
cctggcctcctgcctc

SEQ ID NO: 2781808 - DNA, 17 bp, Homo sapiens
cctggcctcctgcctct

SEQ ID NO: 2781809 - DNA, 13 bp, Homo sapiens
cctggcctggcac

SEQ ID NO: 2781810 - DNA, 19 bp, Homo sapiens
cctggcctggcacacatca

SEQ ID NO: 2781811 - DNA, 18 bp, Homo sapiens
cctggccttcagtgtacc

SEQ ID NO: 2781812 - DNA, 15 bp, Homo sapiens
cctggctctcctgta

SEQ ID NO: 2781813 - DNA, 15 bp, Homo sapiens
cctggcttcccatcc

SEQ ID NO: 2781814 - DNA, 17 bp, Homo sapiens
cctggcttctggagccc

SEQ ID NO: 2781815 - DNA, 23 bp, Homo sapiens
cctggcttctggagcccttgggt

SEQ ID NO: 2781816 - DNA, 16 bp, Homo sapiens
cctgggaccagggcat

SEQ ID NO: 2781817 - DNA, 23 bp, Homo sapiens
cctgggaccgctacaccactctg

SEQ ID NO: 2781818 - DNA, 14 bp, Homo sapiens
cctgggccccacca

SEQ ID NO: 2781819 - DNA, 23 bp, Homo sapiens
cctgggccccaccacctaggcca

SEQ ID NO: 2781820 - DNA, 22 bp, Homo sapiens
cctgggcccgctttgcctgctt

SEQ ID NO: 2781821 - DNA, 18 bp, Homo sapiens
cctgggccctggggcctg

SEQ ID NO: 2781822 - DNA, 22 bp, Homo sapiens
cctgggccctggggcctgtact

SEQ ID NO: 2781823 - DNA, 17 bp, Homo sapiens
cctgggcctatggagag

SEQ ID NO: 2781824 - DNA, 23 bp, Homo sapiens
cctgggcctatggagagccctgg

SEQ ID NO: 2781825 - DNA, 12 bp, Homo sapiens
cctgggctctgc

SEQ ID NO: 2781826 - DNA, 22 bp, Homo sapiens
cctggggccccttggcgggcag

SEQ ID NO: 2781827 - DNA, 12 bp, Homo sapiens
cctggggcctcg

SEQ ID NO: 2781828 - DNA, 13 bp, Homo sapiens
cctggggcctgta

SEQ ID NO: 2781829 - DNA, 23 bp, Homo sapiens
cctggggcctgtactgcctgctt

SEQ ID NO: 2781830 - DNA, 16 bp, Homo sapiens
cctggggctcctttct

SEQ ID NO: 2781831 - DNA, 20 bp, Homo sapiens
cctggggctcctttctccag

SEQ ID NO: 2781832 - DNA, 22 bp, Homo sapiens
cctggggctctaacgcctgagc

SEQ ID NO: 2781833 - DNA, 15 bp, Homo sapiens
cctggggctctgtgc

SEQ ID NO: 2781834 - DNA, 16 bp, Homo sapiens
cctgggggaagccctg

SEQ ID NO: 2781835 - DNA, 18 bp, Homo sapiens
cctgggggaagccctgga

SEQ ID NO: 2781836 - DNA, 19 bp, Homo sapiens
cctgggggaagccctggat

SEQ ID NO: 2781837 - DNA, 12 bp, Homo sapiens
cctgggggcctg

SEQ ID NO: 2781838 - DNA, 15 bp, Homo sapiens
cctgggggcctggct

SEQ ID NO: 2781839 - DNA, 15 bp, Homo sapiens
cctgggggctagcag

SEQ ID NO: 2781840 - DNA, 22 bp, Homo sapiens
cctgggggttctttcttcctct

SEQ ID NO: 2781841 - DNA, 18 bp, Homo sapiens
cctgggtctaaggggttg

SEQ ID NO: 2781842 - DNA, 15 bp, Homo sapiens
cctgggtggggctgc

SEQ ID NO: 2781843 - DNA, 16 bp, Homo sapiens
cctgggtggggctgct

SEQ ID NO: 2781844 - DNA, 20 bp, Homo sapiens
cctgggtggggctgctcctc

SEQ ID NO: 2781845 - DNA, 21 bp, Homo sapiens
cctgggtggggctgctcctcc

SEQ ID NO: 2781846 - DNA, 22 bp, Homo sapiens
cctgggtggggctgctcctcca

SEQ ID NO: 2781847 - DNA, 18 bp, Homo sapiens
cctggtactgcacatttt

SEQ ID NO: 2781848 - DNA, 22 bp, Homo sapiens
cctggtcacaggactctgcctc

SEQ ID NO: 2781849 - DNA, 16 bp, Homo sapiens
cctggtctgccctggg

SEQ ID NO: 2781850 - DNA, 16 bp, Homo sapiens
cctggtctgctcagga

SEQ ID NO: 2781851 - DNA, 17 bp, Homo sapiens
cctggtgcactggcccc

SEQ ID NO: 2781852 - DNA, 15 bp, Homo sapiens
cctggtgcagaggtg

SEQ ID NO: 2781853 - DNA, 21 bp, Homo sapiens
cctggtgcagaggtgagcaga

SEQ ID NO: 2781854 - DNA, 18 bp, Homo sapiens
cctggtggacagtcctgg

SEQ ID NO: 2781855 - DNA, 19 bp, Homo sapiens
cctggtggacagtcctggg

SEQ ID NO: 2781856 - DNA, 20 bp, Homo sapiens
cctggtggacagtcctggga

SEQ ID NO: 2781857 - DNA, 13 bp, Homo sapiens
cctggtggcagtg

SEQ ID NO: 2781858 - DNA, 17 bp, Homo sapiens
cctggttggccgtggtc

SEQ ID NO: 2781859 - DNA, 22 bp, Homo sapiens
cctgtaaatagttttaaatatg

SEQ ID NO: 2781860 - DNA, 20 bp, Homo sapiens
cctgtaacacaagccacaga

SEQ ID NO: 2781861 - DNA, 23 bp, Homo sapiens
cctgtaacacaagccacagaagc

SEQ ID NO: 2781862 - DNA, 20 bp, Homo sapiens
cctgtaatcatataataaat

SEQ ID NO: 2781863 - DNA, 14 bp, Homo sapiens
cctgtaatcccagc

SEQ ID NO: 2781864 - DNA, 15 bp, Homo sapiens
cctgtaatcccagca

SEQ ID NO: 2781865 - DNA, 16 bp, Homo sapiens
cctgtaatcccagcac

SEQ ID NO: 2781866 - DNA, 17 bp, Homo sapiens
cctgtaatcccagcact

SEQ ID NO: 2781867 - DNA, 15 bp, Homo sapiens
cctgtaatcccagct

SEQ ID NO: 2781868 - DNA, 16 bp, Homo sapiens
cctgtaatcccagcta

SEQ ID NO: 2781869 - DNA, 18 bp, Homo sapiens
cctgtacgaacccctccc

SEQ ID NO: 2781870 - DNA, 14 bp, Homo sapiens
cctgtactcaggag

SEQ ID NO: 2781871 - DNA, 23 bp, Homo sapiens
cctgtactcaggaggctgagggg

SEQ ID NO: 2781872 - DNA, 18 bp, Homo sapiens
cctgtagcatcttctgga

SEQ ID NO: 2781873 - DNA, 16 bp, Homo sapiens
cctgtagttaggaaat

SEQ ID NO: 2781874 - DNA, 17 bp, Homo sapiens
cctgtagttaggaaata

SEQ ID NO: 2781875 - DNA, 18 bp, Homo sapiens
cctgtagttaggaaataa

SEQ ID NO: 2781876 - DNA, 19 bp, Homo sapiens
cctgtagttaggaaataaa

SEQ ID NO: 2781877 - DNA, 19 bp, Homo sapiens
cggtcccttgagacctcag

SEQ ID NO: 2781878 - DNA, 12 bp, Homo sapiens
cggtcctggccc

SEQ ID NO: 2781879 - DNA, 21 bp, Homo sapiens
cggtcctggccccagccccca

SEQ ID NO: 2781880 - DNA, 20 bp, Homo sapiens
cggtgagaggggaacagact

SEQ ID NO: 2781881 - DNA, 21 bp, Homo sapiens
cggtgagaggggaacagactg

SEQ ID NO: 2781882 - DNA, 11 bp, Homo sapiens
cggtgcctggc

SEQ ID NO: 2781883 - DNA, 12 bp, Homo sapiens
cggtggccatgc

SEQ ID NO: 2781884 - DNA, 18 bp, Homo sapiens
cggtgtctggaaaagcac

SEQ ID NO: 2781885 - DNA, 15 bp, Homo sapiens
cggtgtgcctgcagc

SEQ ID NO: 2781886 - DNA, 17 bp, Homo sapiens
cggttaacttgtatatt

SEQ ID NO: 2781887 - DNA, 20 bp, Homo sapiens
cggttcaggaaaattgaatg

SEQ ID NO: 2781888 - DNA, 18 bp, Homo sapiens
cggttccacgtccccctg

SEQ ID NO: 2781889 - DNA, 16 bp, Homo sapiens
cgtaaaaatgatttca

SEQ ID NO: 2781890 - DNA, 12 bp, Homo sapiens
cgtaattttatt

SEQ ID NO: 2781891 - DNA, 14 bp, Homo sapiens
cgtaattttattat

SEQ ID NO: 2781892 - DNA, 18 bp, Homo sapiens
cgtacccccgtggtcttt

SEQ ID NO: 2781893 - DNA, 23 bp, Homo sapiens
cgtacccccgtggtctttgaata

SEQ ID NO: 2781894 - DNA, 19 bp, Homo sapiens
cgtagagcctggaagggaa

SEQ ID NO: 2781895 - DNA, 20 bp, Homo sapiens
cgtagccaaggtgggctgag

SEQ ID NO: 2781896 - DNA, 21 bp, Homo sapiens
cgtagtcagcgcagtttagca

SEQ ID NO: 2781897 - DNA, 23 bp, Homo sapiens
cgtatctttaaaaagcagtcctc

SEQ ID NO: 2781898 - DNA, 15 bp, Homo sapiens
cgtattggtccagct

SEQ ID NO: 2781899 - DNA, 16 bp, Homo sapiens
cgtatttatatttgga

SEQ ID NO: 2781900 - DNA, 21 bp, Homo sapiens
cgtatttatatttggaaagag

SEQ ID NO: 2781901 - DNA, 16 bp, Homo sapiens
cgtcatctcagggtcc

SEQ ID NO: 2781902 - DNA, 17 bp, Homo sapiens
cgtccccccccaacctt

SEQ ID NO: 2781903 - DNA, 13 bp, Homo sapiens
cgtccccctgggg

SEQ ID NO: 2781904 - DNA, 15 bp, Homo sapiens
cgtcctccccctgcc

SEQ ID NO: 2781905 - DNA, 22 bp, Homo sapiens
cgtcctccccctgccagtgcct

SEQ ID NO: 2781906 - DNA, 11 bp, Homo sapiens
cgtcctggaat

SEQ ID NO: 2781907 - DNA, 16 bp, Homo sapiens
cgtctatcaccaggat

SEQ ID NO: 2781908 - DNA, 20 bp, Homo sapiens
cgtctcacatttttacttgg

SEQ ID NO: 2781909 - DNA, 17 bp, Homo sapiens
cgtctccctaaaataaa

SEQ ID NO: 2781910 - DNA, 20 bp, Homo sapiens
cgtctgacaggcaatgctgg

SEQ ID NO: 2781911 - DNA, 21 bp, Homo sapiens
cgtctgacaggcaatgctggc

SEQ ID NO: 2781912 - DNA, 18 bp, Homo sapiens
cgtctggggttcagcccc

SEQ ID NO: 2781913 - DNA, 23 bp, Homo sapiens
cgtcttagaagtggaccaggaca

SEQ ID NO: 2781914 - DNA, 13 bp, Homo sapiens
cgtcttcagccta

SEQ ID NO: 2781915 - DNA, 14 bp, Homo sapiens
cgtcttcagcctag

SEQ ID NO: 2781916 - DNA, 15 bp, Homo sapiens
cgtcttgtattttct

SEQ ID NO: 2781917 - DNA, 15 bp, Homo sapiens
cgtgaagggcaccga

SEQ ID NO: 2781918 - DNA, 14 bp, Homo sapiens
cgtgacaacacttg

SEQ ID NO: 2781919 - DNA, 17 bp, Homo sapiens
cgtgactcacccaagca

SEQ ID NO: 2781920 - DNA, 20 bp, Homo sapiens
cgtgactgccccaactcctg

SEQ ID NO: 2781921 - DNA, 22 bp, Homo sapiens
cgtgagccactgcaccgggcca

SEQ ID NO: 2781922 - DNA, 21 bp, Homo sapiens
cgtgagccaggtaatgaggga

SEQ ID NO: 2781923 - DNA, 20 bp, Homo sapiens
cgtgcacacaccagagccca

SEQ ID NO: 2781924 - DNA, 21 bp, Homo sapiens
cgtgcacacaccagagcccac

SEQ ID NO: 2781925 - DNA, 22 bp, Homo sapiens
cgtgcacacaccagagcccacc

SEQ ID NO: 2781926 - DNA, 15 bp, Homo sapiens
cgtgcacctgtactc

SEQ ID NO: 2781927 - DNA, 21 bp, Homo sapiens
cgtgcagtggtgcgatctggg

SEQ ID NO: 2781928 - DNA, 13 bp, Homo sapiens
cgtgcatttgtga

SEQ ID NO: 2781929 - DNA, 15 bp, Homo sapiens
cgtgcatttgtgagc

SEQ ID NO: 2781930 - DNA, 21 bp, Homo sapiens
cgtgccaagtccaggtcctgg

SEQ ID NO: 2781931 - DNA, 19 bp, Homo sapiens
cgtgcccaggggcccacag

SEQ ID NO: 2781932 - DNA, 17 bp, Homo sapiens
cgtgccccgcctccccg

SEQ ID NO: 2781933 - DNA, 12 bp, Homo sapiens
cgtggacacctg

SEQ ID NO: 2781934 - DNA, 13 bp, Homo sapiens
cgtggacacctgc

SEQ ID NO: 2781935 - DNA, 14 bp, Homo sapiens
cgtggacacctgcc

SEQ ID NO: 2781936 - DNA, 13 bp, Homo sapiens
cgtggactctgca

SEQ ID NO: 2781937 - DNA, 18 bp, Homo sapiens
cgtggagagctaggagca

SEQ ID NO: 2781938 - DNA, 19 bp, Homo sapiens
cgtggagagctaggagcaa

SEQ ID NO: 2781939 - DNA, 20 bp, Homo sapiens
cgtggcagataatcagcctc

SEQ ID NO: 2781940 - DNA, 14 bp, Homo sapiens
cgtggtctttgaat

SEQ ID NO: 2781941 - DNA, 21 bp, Homo sapiens
cgtgtccagcacagaaggaat

SEQ ID NO: 2781942 - DNA, 17 bp, Homo sapiens
cgtgtccgactcttctg

SEQ ID NO: 2781943 - DNA, 15 bp, Homo sapiens
cgtgtcgtgggtgtg

SEQ ID NO: 2781944 - DNA, 21 bp, Homo sapiens
cgtgtctataatggaaacatt

SEQ ID NO: 2781945 - DNA, 13 bp, Homo sapiens
cgtgtgcagactg

SEQ ID NO: 2781946 - DNA, 17 bp, Homo sapiens
cgtgtgcagactgtggc

SEQ ID NO: 2781947 - DNA, 18 bp, Homo sapiens
cgttctgctgcccctgca

SEQ ID NO: 2781948 - DNA, 18 bp, Homo sapiens
cgttgaagaggaagggca

SEQ ID NO: 2781949 - DNA, 15 bp, Homo sapiens
cgtttggcatttctc

SEQ ID NO: 2781950 - DNA, 23 bp, Homo sapiens
cgttttgtgtggtggcacctcct

SEQ ID NO: 2781951 - DNA, 11 bp, Homo sapiens
ctaaaaataaa

SEQ ID NO: 2781952 - DNA, 14 bp, Homo sapiens
ctaaaaataaaatg

SEQ ID NO: 2781953 - DNA, 13 bp, Homo sapiens
ctaaaagaaactt

SEQ ID NO: 2781954 - DNA, 14 bp, Homo sapiens
ctaaaagaaacttt

SEQ ID NO: 2781955 - DNA, 12 bp, Homo sapiens
ctaaaataaaaa

SEQ ID NO: 2781956 - DNA, 14 bp, Homo sapiens
ctaaacccaaataa

SEQ ID NO: 2781957 - DNA, 19 bp, Homo sapiens
ctaaacccaaataaatgtg

SEQ ID NO: 2781958 - DNA, 12 bp, Homo sapiens
ctaaagacagaa

SEQ ID NO: 2781959 - DNA, 14 bp, Homo sapiens
ctaaagacagaaaa

SEQ ID NO: 2781960 - DNA, 18 bp, Homo sapiens
ctaaagcagtggacacca

SEQ ID NO: 2781961 - DNA, 21 bp, Homo sapiens
ctaaagctctgaacaaaagct

SEQ ID NO: 2781962 - DNA, 17 bp, Homo sapiens
ctaaagctggtttaatg

SEQ ID NO: 2781963 - DNA, 23 bp, Homo sapiens
ctaaataaagcttgcaacaaaat

SEQ ID NO: 2781964 - DNA, 14 bp, Homo sapiens
ctaaatccaaagaa

SEQ ID NO: 2781965 - DNA, 15 bp, Homo sapiens
ctaaatccaaagaaa

SEQ ID NO: 2781966 - DNA, 17 bp, Homo sapiens
ctaaatcctttactgtt

SEQ ID NO: 2781967 - DNA, 13 bp, Homo sapiens
ctaaatcttcctt

SEQ ID NO: 2781968 - DNA, 15 bp, Homo sapiens
ctaaatgaatgttta

SEQ ID NO: 2781969 - DNA, 15 bp, Homo sapiens
ctaaatgagctcctg

SEQ ID NO: 2781970 - DNA, 16 bp, Homo sapiens
ctaaatgagctcctgc

SEQ ID NO: 2781971 - DNA, 23 bp, Homo sapiens
ctaacactcagaagcctgggggc

SEQ ID NO: 2781972 - DNA, 16 bp, Homo sapiens
ctaacagggaaggcag

SEQ ID NO: 2781973 - DNA, 22 bp, Homo sapiens
ctaacatataatgttgttattt

SEQ ID NO: 2781974 - DNA, 18 bp, Homo sapiens
ctaacccccagtgccaca

SEQ ID NO: 2781975 - DNA, 20 bp, Homo sapiens
ctaacccccagtgccacaga

SEQ ID NO: 2781976 - DNA, 14 bp, Homo sapiens
ctaacccctttcct

SEQ ID NO: 2781977 - DNA, 14 bp, Homo sapiens
ctaacctaagcaaa

SEQ ID NO: 2781978 - DNA, 14 bp, Homo sapiens
ctaacgcctgagcc

SEQ ID NO: 2781979 - DNA, 15 bp, Homo sapiens
ctaactccttatgtt

SEQ ID NO: 2781980 - DNA, 17 bp, Homo sapiens
ctaactccttatgtttg

SEQ ID NO: 2781981 - DNA, 13 bp, Homo sapiens
ctaactggaagca

SEQ ID NO: 2781982 - DNA, 14 bp, Homo sapiens
ctaactgtatgtgt

SEQ ID NO: 2781983 - DNA, 13 bp, Homo sapiens
ctaagaagctctg

SEQ ID NO: 2781984 - DNA, 21 bp, Homo sapiens
ctaagacttcagtcctggtct

SEQ ID NO: 2781985 - DNA, 23 bp, Homo sapiens
ctaagaggcgacttcctctccag

SEQ ID NO: 2781986 - DNA, 12 bp, Homo sapiens
ctaagcaacaga

SEQ ID NO: 2781987 - DNA, 18 bp, Homo sapiens
ctaagcagtgcttgtaaa

SEQ ID NO: 2781988 - DNA, 20 bp, Homo sapiens
ctaagccctgtcgagacact

SEQ ID NO: 2781989 - DNA, 21 bp, Homo sapiens
ctaagccctgtcgagacactt

SEQ ID NO: 2781990 - DNA, 14 bp, Homo sapiens
ctaagcctcctttt

SEQ ID NO: 2781991 - DNA, 20 bp, Homo sapiens
ctaaggaaatggagaagctc

SEQ ID NO: 2781992 - DNA, 23 bp, Homo sapiens
ctaaggagtgtagcaactacagt

SEQ ID NO: 2781993 - DNA, 23 bp, Homo sapiens
ctaaggatctctcaggagcacag

SEQ ID NO: 2781994 - DNA, 18 bp, Homo sapiens
ctaagggtgtaagtaatt

SEQ ID NO: 2781995 - DNA, 15 bp, Homo sapiens
ctaaggtgtgctctg

SEQ ID NO: 2781996 - DNA, 16 bp, Homo sapiens
ctaagtagaataaaga

SEQ ID NO: 2781997 - DNA, 17 bp, Homo sapiens
ctaagtaggggcagtga

SEQ ID NO: 2781998 - DNA, 20 bp, Homo sapiens
ctaagtgatcctcccacctc

SEQ ID NO: 2781999 - DNA, 16 bp, Homo sapiens
ctaagtgttgaagaag

SEQ ID NO: 2782000 - DNA, 15 bp, Homo sapiens
ctaagttaatttaaa

SEQ ID NO: 2782001 - DNA, 16 bp, Homo sapiens
ctaagttatagtatat

SEQ ID NO: 2782002 - DNA, 20 bp, Homo sapiens
ctaagttatagtatatctgg

SEQ ID NO: 2782003 - DNA, 13 bp, Homo sapiens
ctaataaaagcat

SEQ ID NO: 2782004 - DNA, 13 bp, Homo sapiens
ctaatacctctgt

SEQ ID NO: 2782005 - DNA, 13 bp, Homo sapiens
ctaatagaactca

SEQ ID NO: 2782006 - DNA, 18 bp, Homo sapiens
ctaatatgtaacaagcca

SEQ ID NO: 2782007 - DNA, 22 bp, Homo sapiens
ctaatctgtagggctggaccta

SEQ ID NO: 2782008 - DNA, 13 bp, Homo sapiens
ctaatgggacact

SEQ ID NO: 2782009 - DNA, 15 bp, Homo sapiens
ctaattaaaaagtta

SEQ ID NO: 2782010 - DNA, 17 bp, Homo sapiens
ctaattcccattttgca

SEQ ID NO: 2782011 - DNA, 19 bp, Homo sapiens
ctaattggcctctttaaga

SEQ ID NO: 2782012 - DNA, 16 bp, Homo sapiens
ctaatttaaaccagca

SEQ ID NO: 2782013 - DNA, 17 bp, Homo sapiens
ctaatttaaaccagcag

SEQ ID NO: 2782014 - DNA, 18 bp, Homo sapiens
ctaatttaaaccagcaga

SEQ ID NO: 2782015 - DNA, 15 bp, Homo sapiens
ctaatttatacaaaa

SEQ ID NO: 2782016 - DNA, 19 bp, Homo sapiens
ctaatttatacaaaataat

SEQ ID NO: 2782017 - DNA, 21 bp, Homo sapiens
ctaatttatacaaaataattt

SEQ ID NO: 2782018 - DNA, 22 bp, Homo sapiens
ctaatttatacaaaataattta

SEQ ID NO: 2782019 - DNA, 23 bp, Homo sapiens
ctaatttatcctgaaatttcaga

SEQ ID NO: 2782020 - DNA, 21 bp, Homo sapiens
ctaatttttttgtattttagc

SEQ ID NO: 2782021 - DNA, 17 bp, Homo sapiens
ctacaaaatttgaaatt

SEQ ID NO: 2782022 - DNA, 18 bp, Homo sapiens
ctacaaaatttgaaattt

SEQ ID NO: 2782023 - DNA, 19 bp, Homo sapiens
ctacaaccagagcccccca

SEQ ID NO: 2782024 - DNA, 22 bp, Homo sapiens
ctacaaccagagccccccacaa

SEQ ID NO: 2782025 - DNA, 19 bp, Homo sapiens
ctacacatatatgtatatg

SEQ ID NO: 2782026 - DNA, 13 bp, Homo sapiens
ctacaccactctg

SEQ ID NO: 2782027 - DNA, 14 bp, Homo sapiens
ctacactccagcct

SEQ ID NO: 2782028 - DNA, 15 bp, Homo sapiens
ctacagaacaaagaa

SEQ ID NO: 2782029 - DNA, 21 bp, Homo sapiens
ctacagacttctccagaccca

SEQ ID NO: 2782030 - DNA, 17 bp, Homo sapiens
ctacagaggccatgggc

SEQ ID NO: 2782031 - DNA, 15 bp, Homo sapiens
ctacagccagaagcc

SEQ ID NO: 2782032 - DNA, 18 bp, Homo sapiens
ctacaggagagggaagag

SEQ ID NO: 2782033 - DNA, 15 bp, Homo sapiens
ctacaggagtgagca

SEQ ID NO: 2782034 - DNA, 20 bp, Homo sapiens
ctacagttgttttttgaaaa

SEQ ID NO: 2782035 - DNA, 10 bp, Homo sapiens
ctacatgaaa

SEQ ID NO: 2782036 - DNA, 16 bp, Homo sapiens
ctacatgaaacagaaa

SEQ ID NO: 2782037 - DNA, 22 bp, Homo sapiens
ctacatggtattgtaatgaata

SEQ ID NO: 2782038 - DNA, 14 bp, Homo sapiens
ctacattccctggc

SEQ ID NO: 2782039 - DNA, 16 bp, Homo sapiens
ctacattccctggcct

SEQ ID NO: 2782040 - DNA, 13 bp, Homo sapiens
ctaccaaatataa

SEQ ID NO: 2782041 - DNA, 16 bp, Homo sapiens
ctaccaaatataaact

SEQ ID NO: 2782042 - DNA, 18 bp, Homo sapiens
ctaccaaatataaacttg

SEQ ID NO: 2782043 - DNA, 15 bp, Homo sapiens
ctaccacagtgtctg

SEQ ID NO: 2782044 - DNA, 16 bp, Homo sapiens
ctaccaccccttcctg

SEQ ID NO: 2782045 - DNA, 17 bp, Homo sapiens
ctaccaccccttcctgt

SEQ ID NO: 2782046 - DNA, 16 bp, Homo sapiens
ctacccacttctaaat

SEQ ID NO: 2782047 - DNA, 20 bp, Homo sapiens
ctacccagagccttctcctg

SEQ ID NO: 2782048 - DNA, 15 bp, Homo sapiens
ctacccagcgagccc

SEQ ID NO: 2782049 - DNA, 17 bp, Homo sapiens
ctacccagcgagccctg

SEQ ID NO: 2782050 - DNA, 13 bp, Homo sapiens
ctaccccaccacg

SEQ ID NO: 2782051 - DNA, 14 bp, Homo sapiens
ctaccccaccacga

SEQ ID NO: 2782052 - DNA, 13 bp, Homo sapiens
ctaccccctgaaa

SEQ ID NO: 2782053 - DNA, 16 bp, Homo sapiens
ctacccggcccagaga

SEQ ID NO: 2782054 - DNA, 18 bp, Homo sapiens
ctaccgttcccaaattgg

SEQ ID NO: 2782055 - DNA, 11 bp, Homo sapiens
ctacctgtgtg

SEQ ID NO: 2782056 - DNA, 17 bp, Homo sapiens
ctacctgtgtggacagg

SEQ ID NO: 2782057 - DNA, 14 bp, Homo sapiens
ctaccttatcaggc

SEQ ID NO: 2782058 - DNA, 16 bp, Homo sapiens
ctacgtataaatatga

SEQ ID NO: 2782059 - DNA, 19 bp, Homo sapiens
ctcagcttcatttccgtga

SEQ ID NO: 2782060 - DNA, 15 bp, Homo sapiens
ctcaggacacaggcc

SEQ ID NO: 2782061 - DNA, 21 bp, Homo sapiens
ctcaggacacaggcctgtgta

SEQ ID NO: 2782062 - DNA, 12 bp, Homo sapiens
ctcaggagcaca

SEQ ID NO: 2782063 - DNA, 13 bp, Homo sapiens
ctcaggaggctga

SEQ ID NO: 2782064 - DNA, 15 bp, Homo sapiens
ctcaggaggctgagg

SEQ ID NO: 2782065 - DNA, 18 bp, Homo sapiens
ctcaggaggctgaggcag

SEQ ID NO: 2782066 - DNA, 16 bp, Homo sapiens
ctcaggaggctgaggg

SEQ ID NO: 2782067 - DNA, 19 bp, Homo sapiens
ctcaggccaacaagccaac

SEQ ID NO: 2782068 - DNA, 22 bp, Homo sapiens
ctcaggcccccacctggctcac

SEQ ID NO: 2782069 - DNA, 23 bp, Homo sapiens
ctcaggcctataaccccagctcc

SEQ ID NO: 2782070 - DNA, 19 bp, Homo sapiens
ctcagggacagagacacct

SEQ ID NO: 2782071 - DNA, 21 bp, Homo sapiens
ctcagggacagagacacctgc

SEQ ID NO: 2782072 - DNA, 14 bp, Homo sapiens
ctcagggccccagc

SEQ ID NO: 2782073 - DNA, 13 bp, Homo sapiens
ctcagggtccaga

SEQ ID NO: 2782074 - DNA, 20 bp, Homo sapiens
ctcaggtgatccacccacct

SEQ ID NO: 2782075 - DNA, 22 bp, Homo sapiens
ctcaggtgatccacccacctca

SEQ ID NO: 2782076 - DNA, 15 bp, Homo sapiens
ctcaggtgtccctgc

SEQ ID NO: 2782077 - DNA, 23 bp, Homo sapiens
ctcaggtgtccctgcacttgcag

SEQ ID NO: 2782078 - DNA, 17 bp, Homo sapiens
ctcaggttcctaagact

SEQ ID NO: 2782079 - DNA, 21 bp, Homo sapiens
ctcaggttcctaagacttcag

SEQ ID NO: 2782080 - DNA, 19 bp, Homo sapiens
ctcagtaatttagaaatca

SEQ ID NO: 2782081 - DNA, 21 bp, Homo sapiens
ctcagtcccccaccacactga

SEQ ID NO: 2782082 - DNA, 14 bp, Homo sapiens
ctcagtcctggaag

SEQ ID NO: 2782083 - DNA, 14 bp, Homo sapiens
ctcagtctcaggag

SEQ ID NO: 2782084 - DNA, 18 bp, Homo sapiens
ctcagtgaagaatacttc

SEQ ID NO: 2782085 - DNA, 22 bp, Homo sapiens
ctcagtgaggccgcccggcaca

SEQ ID NO: 2782086 - DNA, 20 bp, Homo sapiens
ctcagtgtcctcaggggcct

SEQ ID NO: 2782087 - DNA, 20 bp, Homo sapiens
ctcagttaaaatgtctgttt

SEQ ID NO: 2782088 - DNA, 11 bp, Homo sapiens
ctcagtttctc

SEQ ID NO: 2782089 - DNA, 13 bp, Homo sapiens
ctcagtttgtcag

SEQ ID NO: 2782090 - DNA, 17 bp, Homo sapiens
ctcagttttatcatttt

SEQ ID NO: 2782091 - DNA, 18 bp, Homo sapiens
ctcagttttatcattttc

SEQ ID NO: 2782092 - DNA, 17 bp, Homo sapiens
ctcataagttggaccag

SEQ ID NO: 2782093 - DNA, 23 bp, Homo sapiens
ctcataagttggaccagaggaag

SEQ ID NO: 2782094 - DNA, 15 bp, Homo sapiens
ctcatcaacaaagaa

SEQ ID NO: 2782095 - DNA, 14 bp, Homo sapiens
ctcatcataaaata

SEQ ID NO: 2782096 - DNA, 17 bp, Homo sapiens
ctcatccgaggcagggt

SEQ ID NO: 2782097 - DNA, 12 bp, Homo sapiens
ctcatgaacctc

SEQ ID NO: 2782098 - DNA, 13 bp, Homo sapiens
ctcatgacagcca

SEQ ID NO: 2782099 - DNA, 14 bp, Homo sapiens
ctcatgacagccag

SEQ ID NO: 2782100 - DNA, 18 bp, Homo sapiens
ctcatgacagccagagcc

SEQ ID NO: 2782101 - DNA, 16 bp, Homo sapiens
ctcatgaccctcctgt

SEQ ID NO: 2782102 - DNA, 22 bp, Homo sapiens
ctcatgcctggcccccctccag

SEQ ID NO: 2782103 - DNA, 18 bp, Homo sapiens
ctcatggaaactggccag

SEQ ID NO: 2782104 - DNA, 21 bp, Homo sapiens
ctcatggaaactggccagggg

SEQ ID NO: 2782105 - DNA, 16 bp, Homo sapiens
ctcatgtgatcctttt

SEQ ID NO: 2782106 - DNA, 13 bp, Homo sapiens
ctcattccccagg

SEQ ID NO: 2782107 - DNA, 14 bp, Homo sapiens
ctcattccccaggt

SEQ ID NO: 2782108 - DNA, 13 bp, Homo sapiens
ctcattcttctgt

SEQ ID NO: 2782109 - DNA, 23 bp, Homo sapiens
ctcattcttctgtacgtctgaca

SEQ ID NO: 2782110 - DNA, 16 bp, Homo sapiens
ctcatttaagggaaaa

SEQ ID NO: 2782111 - DNA, 13 bp, Homo sapiens
ctcatttcatctc

SEQ ID NO: 2782112 - DNA, 17 bp, Homo sapiens
ctcatttgtcacacact

SEQ ID NO: 2782113 - DNA, 18 bp, Homo sapiens
ctccaaaggccctaccag

SEQ ID NO: 2782114 - DNA, 20 bp, Homo sapiens
ctccaaaggccctaccagag

SEQ ID NO: 2782115 - DNA, 15 bp, Homo sapiens
ctccaaatgagatct

SEQ ID NO: 2782116 - DNA, 14 bp, Homo sapiens
ctccaacctggaca

SEQ ID NO: 2782117 - DNA, 20 bp, Homo sapiens
ctccaagaatacagaaaatg

SEQ ID NO: 2782118 - DNA, 14 bp, Homo sapiens
ctccaagctccatc

SEQ ID NO: 2782119 - DNA, 19 bp, Homo sapiens
ctccaagcttcaagtgata

SEQ ID NO: 2782120 - DNA, 12 bp, Homo sapiens
ctccaaggacca

SEQ ID NO: 2782121 - DNA, 15 bp, Homo sapiens
ctccaaggtggggtc

SEQ ID NO: 2782122 - DNA, 13 bp, Homo sapiens
ctccaattgtaaa

SEQ ID NO: 2782123 - DNA, 15 bp, Homo sapiens
ctccaattgtaaaaa

SEQ ID NO: 2782124 - DNA, 15 bp, Homo sapiens
ctccacagcggagga

SEQ ID NO: 2782125 - DNA, 20 bp, Homo sapiens
ctccaccaacccatcagaag

SEQ ID NO: 2782126 - DNA, 13 bp, Homo sapiens
ctccaccacccaa

SEQ ID NO: 2782127 - DNA, 14 bp, Homo sapiens
ctccaccacccaaa

SEQ ID NO: 2782128 - DNA, 13 bp, Homo sapiens
ctccaccccagga

SEQ ID NO: 2782129 - DNA, 15 bp, Homo sapiens
ctccacctcagcctt

SEQ ID NO: 2782130 - DNA, 19 bp, Homo sapiens
ctccactaaatgagctcct

SEQ ID NO: 2782131 - DNA, 20 bp, Homo sapiens
ctccactgctctcagcctcc

SEQ ID NO: 2782132 - DNA, 15 bp, Homo sapiens
ctccactttgttgga

SEQ ID NO: 2782133 - DNA, 17 bp, Homo sapiens
ctccagacccaccacac

SEQ ID NO: 2782134 - DNA, 12 bp, Homo sapiens
ctccagccagca

SEQ ID NO: 2782135 - DNA, 13 bp, Homo sapiens
ctccagccagcaa

SEQ ID NO: 2782136 - DNA, 16 bp, Homo sapiens
ctccagccagcaatga

SEQ ID NO: 2782137 - DNA, 20 bp, Homo sapiens
ctccagccagcgcctccctc

SEQ ID NO: 2782138 - DNA, 21 bp, Homo sapiens
ctccagccagcgcctccctcc

SEQ ID NO: 2782139 - DNA, 22 bp, Homo sapiens
ctccagccagcgcctccctcca

SEQ ID NO: 2782140 - DNA, 19 bp, Homo sapiens
ctccagccttctctctctg

SEQ ID NO: 2782141 - DNA, 20 bp, Homo sapiens
ctccagccttctctctctgg

SEQ ID NO: 2782142 - DNA, 15 bp, Homo sapiens
ctccagctcaccagc

SEQ ID NO: 2782143 - DNA, 20 bp, Homo sapiens
ctccagctcaccagccccag

SEQ ID NO: 2782144 - DNA, 20 bp, Homo sapiens
ctccagctggaattgctgct

SEQ ID NO: 2782145 - DNA, 19 bp, Homo sapiens
ctccagcttcccctcgctg

SEQ ID NO: 2782146 - DNA, 13 bp, Homo sapiens
ctccagctttcct

SEQ ID NO: 2782147 - DNA, 21 bp, Homo sapiens
ctccaggaaggtagcccagca

SEQ ID NO: 2782148 - DNA, 20 bp, Homo sapiens
ctccaggaatgcctcctccc

SEQ ID NO: 2782149 - DNA, 17 bp, Homo sapiens
ctccaggagcctacccc

SEQ ID NO: 2782150 - DNA, 14 bp, Homo sapiens
ctctagtgccctcc

SEQ ID NO: 2782151 - DNA, 21 bp, Homo sapiens
ctctagtgccctccacagccg

SEQ ID NO: 2782152 - DNA, 13 bp, Homo sapiens
ctctatatataca

SEQ ID NO: 2782153 - DNA, 20 bp, Homo sapiens
ctctatatatacatgtatag

SEQ ID NO: 2782154 - DNA, 11 bp, Homo sapiens
ctctatattta

SEQ ID NO: 2782155 - DNA, 22 bp, Homo sapiens
ctctatatttagattgttaaaa

SEQ ID NO: 2782156 - DNA, 18 bp, Homo sapiens
ctctcaatattcaataaa

SEQ ID NO: 2782157 - DNA, 23 bp, Homo sapiens
ctctcagccaacgagtaatttat

SEQ ID NO: 2782158 - DNA, 22 bp, Homo sapiens
ctctcagcctcccaaccccagg

SEQ ID NO: 2782159 - DNA, 16 bp, Homo sapiens
ctctcaggagcacagg

SEQ ID NO: 2782160 - DNA, 21 bp, Homo sapiens
ctctcaggagcacaggcagct

SEQ ID NO: 2782161 - DNA, 11 bp, Homo sapiens
ctctcattccc

SEQ ID NO: 2782162 - DNA, 19 bp, Homo sapiens
ctctccaaaggccctacca

SEQ ID NO: 2782163 - DNA, 15 bp, Homo sapiens
ctctccaattgtaaa

SEQ ID NO: 2782164 - DNA, 13 bp, Homo sapiens
ctctccacctcag

SEQ ID NO: 2782165 - DNA, 14 bp, Homo sapiens
ctctccagccttct

SEQ ID NO: 2782166 - DNA, 22 bp, Homo sapiens
ctctccaggaaggtagcccagc

SEQ ID NO: 2782167 - DNA, 21 bp, Homo sapiens
ctctccaggctgtttcttttt

SEQ ID NO: 2782168 - DNA, 14 bp, Homo sapiens
ctctcccaggcccc

SEQ ID NO: 2782169 - DNA, 19 bp, Homo sapiens
ctctcccaggccccatgac

SEQ ID NO: 2782170 - DNA, 21 bp, Homo sapiens
ctctcccaggccccatgacct

SEQ ID NO: 2782171 - DNA, 13 bp, Homo sapiens
ctctccccagcaa

SEQ ID NO: 2782172 - DNA, 17 bp, Homo sapiens
ctctcccctccctcttc

SEQ ID NO: 2782173 - DNA, 19 bp, Homo sapiens
ctctccctctggccctgcc

SEQ ID NO: 2782174 - DNA, 22 bp, Homo sapiens
ctctccctctggccctgccttc

SEQ ID NO: 2782175 - DNA, 16 bp, Homo sapiens
ctctccgaccagacac

SEQ ID NO: 2782176 - DNA, 22 bp, Homo sapiens
ctctcctaccccacctcatgcc

SEQ ID NO: 2782177 - DNA, 14 bp, Homo sapiens
ctctcctcagactg

SEQ ID NO: 2782178 - DNA, 15 bp, Homo sapiens
ctctcctcagactgc

SEQ ID NO: 2782179 - DNA, 20 bp, Homo sapiens
ctctcctcggccccctccat

SEQ ID NO: 2782180 - DNA, 17 bp, Homo sapiens
ctctcctcttgccactg

SEQ ID NO: 2782181 - DNA, 22 bp, Homo sapiens
ctctcctcttgccactgcctct

SEQ ID NO: 2782182 - DNA, 21 bp, Homo sapiens
ctctcctgagaggtgctgcag

SEQ ID NO: 2782183 - DNA, 12 bp, Homo sapiens
ctctcctgccta

SEQ ID NO: 2782184 - DNA, 22 bp, Homo sapiens
ctctcctgtataaccccacctt

SEQ ID NO: 2782185 - DNA, 21 bp, Homo sapiens
ctctcctgtccaacctaaccc

SEQ ID NO: 2782186 - DNA, 23 bp, Homo sapiens
ctctcgatgccactcctgcttct

SEQ ID NO: 2782187 - DNA, 16 bp, Homo sapiens
ctctcggaaggctggc

SEQ ID NO: 2782188 - DNA, 22 bp, Homo sapiens
ctctcggggcgacccctcagtg

SEQ ID NO: 2782189 - DNA, 19 bp, Homo sapiens
ctctcgggttgtgtgtctg

SEQ ID NO: 2782190 - DNA, 17 bp, Homo sapiens
ctctcgtaactggtttc

SEQ ID NO: 2782191 - DNA, 19 bp, Homo sapiens
ctctctacaaactcccact

SEQ ID NO: 2782192 - DNA, 20 bp, Homo sapiens
ctctctacccggcccagaga

SEQ ID NO: 2782193 - DNA, 15 bp, Homo sapiens
ctctctatatataca

SEQ ID NO: 2782194 - DNA, 15 bp, Homo sapiens
ctctctcctgtccaa

SEQ ID NO: 2782195 - DNA, 19 bp, Homo sapiens
ctctctcctgtccaaccta

SEQ ID NO: 2782196 - DNA, 13 bp, Homo sapiens
ctctctctatata

SEQ ID NO: 2782197 - DNA, 15 bp, Homo sapiens
ctctctctatatata

SEQ ID NO: 2782198 - DNA, 17 bp, Homo sapiens
ctctctctatatataca

SEQ ID NO: 2782199 - DNA, 20 bp, Homo sapiens
ctctctctatatatacatgt

SEQ ID NO: 2782200 - DNA, 13 bp, Homo sapiens
ctctctgagactg

SEQ ID NO: 2782201 - DNA, 11 bp, Homo sapiens
ctctctgaggg

SEQ ID NO: 2782202 - DNA, 18 bp, Homo sapiens
ctctctgagggagaggct

SEQ ID NO: 2782203 - DNA, 18 bp, Homo sapiens
ctctctgcagccagccca

SEQ ID NO: 2782204 - DNA, 19 bp, Homo sapiens
ctctctgcagccagcccag

SEQ ID NO: 2782205 - DNA, 21 bp, Homo sapiens
ctctctgcagccagcccagcc

SEQ ID NO: 2782206 - DNA, 18 bp, Homo sapiens
ctctcttatagaatattt

SEQ ID NO: 2782207 - DNA, 21 bp, Homo sapiens
ctctcttatagaatatttatt

SEQ ID NO: 2782208 - DNA, 23 bp, Homo sapiens
ctctcttatagaatatttattac

SEQ ID NO: 2782209 - DNA, 13 bp, Homo sapiens
ctctcttccctat

SEQ ID NO: 2782210 - DNA, 13 bp, Homo sapiens
ctctcttgccttt

SEQ ID NO: 2782211 - DNA, 15 bp, Homo sapiens
ctctgaaggacattg

SEQ ID NO: 2782212 - DNA, 22 bp, Homo sapiens
ctctgaaggacattgcggacag

SEQ ID NO: 2782213 - DNA, 23 bp, Homo sapiens
ctctgaagtcacatcacaggaca

SEQ ID NO: 2782214 - DNA, 17 bp, Homo sapiens
ctctgacacacagctct

SEQ ID NO: 2782215 - DNA, 13 bp, Homo sapiens
ctctgacctgcag

SEQ ID NO: 2782216 - DNA, 16 bp, Homo sapiens
ctctgacctgcaggcc

SEQ ID NO: 2782217 - DNA, 16 bp, Homo sapiens
ctctgactcttgcctt

SEQ ID NO: 2782218 - DNA, 18 bp, Homo sapiens
ctctgagaattccaagga

SEQ ID NO: 2782219 - DNA, 16 bp, Homo sapiens
ctctgagactgctaag

SEQ ID NO: 2782220 - DNA, 15 bp, Homo sapiens
ctctgagaggccctg

SEQ ID NO: 2782221 - DNA, 16 bp, Homo sapiens
ctctgagaggccctgg

SEQ ID NO: 2782222 - DNA, 16 bp, Homo sapiens
ctctgagcaaatgtgg

SEQ ID NO: 2782223 - DNA, 19 bp, Homo sapiens
ctctgaggcgccccaaccc

SEQ ID NO: 2782224 - DNA, 15 bp, Homo sapiens
ctctgaggcttccag

SEQ ID NO: 2782225 - DNA, 18 bp, Homo sapiens
ctctgaggcttccagaga

SEQ ID NO: 2782226 - DNA, 17 bp, Homo sapiens
ctctgatacccagagca

SEQ ID NO: 2782227 - DNA, 15 bp, Homo sapiens
ctctgatgcatcaga

SEQ ID NO: 2782228 - DNA, 15 bp, Homo sapiens
ctctgattttcaaag

SEQ ID NO: 2782229 - DNA, 19 bp, Homo sapiens
ctctgattttcaaagcttt

SEQ ID NO: 2782230 - DNA, 15 bp, Homo sapiens
ctctgcacatgtctt

SEQ ID NO: 2782231 - DNA, 16 bp, Homo sapiens
ctctgcagccagccca

SEQ ID NO: 2782232 - DNA, 19 bp, Homo sapiens
ctctgcagccagcccagcc

SEQ ID NO: 2782233 - DNA, 12 bp, Homo sapiens
ctctgccacctc

SEQ ID NO: 2782234 - DNA, 18 bp, Homo sapiens
ctctgccacctcccctat

SEQ ID NO: 2782235 - DNA, 14 bp, Homo sapiens
ctctgccagccaca

SEQ ID NO: 2782236 - DNA, 12 bp, Homo sapiens
ctctgccccagc

SEQ ID NO: 2782237 - DNA, 18 bp, Homo sapiens
ctctgccccagctctggc

SEQ ID NO: 2782238 - DNA, 14 bp, Homo sapiens
ctctgccctccctg

SEQ ID NO: 2782239 - DNA, 15 bp, Homo sapiens
ctctgccctccctgg

SEQ ID NO: 2782240 - DNA, 19 bp, Homo sapiens
ctctgccctccctggcctc

SEQ ID NO: 2782241 - DNA, 24 bp, Homo sapiens
ctgcagcccggcgccaccatcctg

SEQ ID NO: 2782242 - DNA, 16 bp, Homo sapiens
ctgcagcctcctcctg

SEQ ID NO: 2782243 - DNA, 23 bp, Homo sapiens
ctgcagcttcggggcaagtgaga

SEQ ID NO: 2782244 - DNA, 11 bp, Homo sapiens
ctgcagcttgt

SEQ ID NO: 2782245 - DNA, 16 bp, Homo sapiens
ctgcagcttgtagcca

SEQ ID NO: 2782246 - DNA, 22 bp, Homo sapiens
ctgcagcttgtagccagccggg

SEQ ID NO: 2782247 - DNA, 19 bp, Homo sapiens
ctgcaggacttctgcctga

SEQ ID NO: 2782248 - DNA, 23 bp, Homo sapiens
ctgcaggccaagagcagaggcag

SEQ ID NO: 2782249 - DNA, 24 bp, Homo sapiens
ctgcaggccaagagcagaggcagc

SEQ ID NO: 2782250 - DNA, 11 bp, Homo sapiens
ctgcaggcccc

SEQ ID NO: 2782251 - DNA, 23 bp, Homo sapiens
ctgcagggggtgtgtctgctcag

SEQ ID NO: 2782252 - DNA, 16 bp, Homo sapiens
ctgcagtagtctctgt

SEQ ID NO: 2782253 - DNA, 23 bp, Homo sapiens
ctgcagtagtctctgtgctttga

SEQ ID NO: 2782254 - DNA, 17 bp, Homo sapiens
ctgcagtatggccatgg

SEQ ID NO: 2782255 - DNA, 20 bp, Homo sapiens
ctgcagtatggccatgggct

SEQ ID NO: 2782256 - DNA, 21 bp, Homo sapiens
ctgcagtcagtcatgatggca

SEQ ID NO: 2782257 - DNA, 20 bp, Homo sapiens
ctgcatccgtagttccctga

SEQ ID NO: 2782258 - DNA, 20 bp, Homo sapiens
ctgcatctagaggcttcctt

SEQ ID NO: 2782259 - DNA, 16 bp, Homo sapiens
ctgcatctcaaaaaaa

SEQ ID NO: 2782260 - DNA, 21 bp, Homo sapiens
ctgcatggagtgagcagtaga

SEQ ID NO: 2782261 - DNA, 15 bp, Homo sapiens
ctgcattagaaatta

SEQ ID NO: 2782262 - DNA, 18 bp, Homo sapiens
ctgcatttataaatgtgt

SEQ ID NO: 2782263 - DNA, 20 bp, Homo sapiens
ctgcatttataaatgtgtgg

SEQ ID NO: 2782264 - DNA, 12 bp, Homo sapiens
ctgcattttacg

SEQ ID NO: 2782265 - DNA, 23 bp, Homo sapiens
ctgcattttacgtctttggagga

SEQ ID NO: 2782266 - DNA, 12 bp, Homo sapiens
ctgccaaaacaa

SEQ ID NO: 2782267 - DNA, 20 bp, Homo sapiens
ctgccaaattttggccaaag

SEQ ID NO: 2782268 - DNA, 18 bp, Homo sapiens
ctgccacaccctccccat

SEQ ID NO: 2782269 - DNA, 23 bp, Homo sapiens
ctgccacactcagtcccccacca

SEQ ID NO: 2782270 - DNA, 19 bp, Homo sapiens
ctgccaccatcctgctgct

SEQ ID NO: 2782271 - DNA, 22 bp, Homo sapiens
ctgccacccaggcaggccctgc

SEQ ID NO: 2782272 - DNA, 14 bp, Homo sapiens
ctgccaccctgggg

SEQ ID NO: 2782273 - DNA, 11 bp, Homo sapiens
ctgccacctcc

SEQ ID NO: 2782274 - DNA, 12 bp, Homo sapiens
ctgccacctccc

SEQ ID NO: 2782275 - DNA, 22 bp, Homo sapiens
ctgccacctcccctatccaccc

SEQ ID NO: 2782276 - DNA, 14 bp, Homo sapiens
ctgccacctgtctg

SEQ ID NO: 2782277 - DNA, 17 bp, Homo sapiens
ctgccacctgtctgtct

SEQ ID NO: 2782278 - DNA, 18 bp, Homo sapiens
ctgccacctgtctgtctg

SEQ ID NO: 2782279 - DNA, 20 bp, Homo sapiens
ctgccagccagcagccagct

SEQ ID NO: 2782280 - DNA, 12 bp, Homo sapiens
ctgccagcctgg

SEQ ID NO: 2782281 - DNA, 14 bp, Homo sapiens
ctgccagcctggct

SEQ ID NO: 2782282 - DNA, 16 bp, Homo sapiens
ctgccagcctggcttc

SEQ ID NO: 2782283 - DNA, 19 bp, Homo sapiens
ctgccagcctggcttctgg

SEQ ID NO: 2782284 - DNA, 13 bp, Homo sapiens
ctgccaggaggga

SEQ ID NO: 2782285 - DNA, 18 bp, Homo sapiens
ctgccaggagggacaaag

SEQ ID NO: 2782286 - DNA, 15 bp, Homo sapiens
ctgccaggcccccgc

SEQ ID NO: 2782287 - DNA, 17 bp, Homo sapiens
ctgccagtccccctgcc

SEQ ID NO: 2782288 - DNA, 14 bp, Homo sapiens
ctgccagtgcctta

SEQ ID NO: 2782289 - DNA, 22 bp, Homo sapiens
ctgccagtgccttacctcctgc

SEQ ID NO: 2782290 - DNA, 21 bp, Homo sapiens
ctgccatattctgttggccag

SEQ ID NO: 2782291 - DNA, 22 bp, Homo sapiens
ctgccatattctgttggccagt

SEQ ID NO: 2782292 - DNA, 12 bp, Homo sapiens
ctgccatccagg

SEQ ID NO: 2782293 - DNA, 16 bp, Homo sapiens
ctgccatccaggttca

SEQ ID NO: 2782294 - DNA, 21 bp, Homo sapiens
ctgccatttgcaccctccgcc

SEQ ID NO: 2782295 - DNA, 19 bp, Homo sapiens
ctgcccaacctgctctcct

SEQ ID NO: 2782296 - DNA, 17 bp, Homo sapiens
ctgcccacattggaccc

SEQ ID NO: 2782297 - DNA, 17 bp, Homo sapiens
ctgcccagcctcgcatg

SEQ ID NO: 2782298 - DNA, 11 bp, Homo sapiens
ctgcccaggag

SEQ ID NO: 2782299 - DNA, 18 bp, Homo sapiens
ctgcccaggagagccagc

SEQ ID NO: 2782300 - DNA, 19 bp, Homo sapiens
ctgcccaggagagccagcc

SEQ ID NO: 2782301 - DNA, 23 bp, Homo sapiens
ctgcccaggagagccagccctcc

SEQ ID NO: 2782302 - DNA, 14 bp, Homo sapiens
ctgcccaggcccct

SEQ ID NO: 2782303 - DNA, 19 bp, Homo sapiens
ctgcccaggcccctgccac

SEQ ID NO: 2782304 - DNA, 16 bp, Homo sapiens
ctgcccagtgcacttg

SEQ ID NO: 2782305 - DNA, 14 bp, Homo sapiens
ctgccccaactcct

SEQ ID NO: 2782306 - DNA, 20 bp, Homo sapiens
ctgccccaactcctggaagc

SEQ ID NO: 2782307 - DNA, 24 bp, Homo sapiens
ctgccccaactccttccagctagt

SEQ ID NO: 2782308 - DNA, 14 bp, Homo sapiens
ctgccccaccagcc

SEQ ID NO: 2782309 - DNA, 16 bp, Homo sapiens
ctgccccaccagccac

SEQ ID NO: 2782310 - DNA, 18 bp, Homo sapiens
ctgccccaccagccacct

SEQ ID NO: 2782311 - DNA, 20 bp, Homo sapiens
ctgccccaccagccacctct

SEQ ID NO: 2782312 - DNA, 16 bp, Homo sapiens
ctgccccagctctggc

SEQ ID NO: 2782313 - DNA, 19 bp, Homo sapiens
ctgccccagggctcccggc

SEQ ID NO: 2782314 - DNA, 17 bp, Homo sapiens
ctgcccccagcactcct

SEQ ID NO: 2782315 - DNA, 18 bp, Homo sapiens
ctgcccccagcctctgtc

SEQ ID NO: 2782316 - DNA, 21 bp, Homo sapiens
ctgcccccgtcttctctccat

SEQ ID NO: 2782317 - DNA, 12 bp, Homo sapiens
ctgccccctggt

SEQ ID NO: 2782318 - DNA, 13 bp, Homo sapiens
ctgccccctggtg

SEQ ID NO: 2782319 - DNA, 17 bp, Homo sapiens
ctgccccgcccagctgc

SEQ ID NO: 2782320 - DNA, 17 bp, Homo sapiens
ctgccccgggtccccag

SEQ ID NO: 2782321 - DNA, 23 bp, Homo sapiens
ctgccccgggtccccagctcccc

SEQ ID NO: 2782322 - DNA, 18 bp, Homo sapiens
ctgcccctcttcccggga

SEQ ID NO: 2782323 - DNA, 13 bp, Homo sapiens
ctgcccctgtagg

SEQ ID NO: 2782324 - DNA, 15 bp, Homo sapiens
ctgcccggctgcgga

SEQ ID NO: 2782325 - DNA, 15 bp, Homo sapiens
ctgccctagagcaca

SEQ ID NO: 2782326 - DNA, 13 bp, Homo sapiens
ctgccctcaggga

SEQ ID NO: 2782327 - DNA, 16 bp, Homo sapiens
ctgccctccctggcct

SEQ ID NO: 2782328 - DNA, 13 bp, Homo sapiens
ctgccctgccacc

SEQ ID NO: 2782329 - DNA, 14 bp, Homo sapiens
ctgccctgccacct

SEQ ID NO: 2782330 - DNA, 16 bp, Homo sapiens
ctgccctgccacctgt

SEQ ID NO: 2782331 - DNA, 24 bp, Homo sapiens
ctgggccccaaacgggctgccctg

SEQ ID NO: 2782332 - DNA, 18 bp, Homo sapiens
ctgggccccaccacctag

SEQ ID NO: 2782333 - DNA, 16 bp, Homo sapiens
ctgggcccgctttgcc

SEQ ID NO: 2782334 - DNA, 13 bp, Homo sapiens
ctgggccctgggg

SEQ ID NO: 2782335 - DNA, 18 bp, Homo sapiens
ctgggccctggggcctgt

SEQ ID NO: 2782336 - DNA, 17 bp, Homo sapiens
ctgggcctatggagagc

SEQ ID NO: 2782337 - DNA, 15 bp, Homo sapiens
ctgggctaccccacc

SEQ ID NO: 2782338 - DNA, 14 bp, Homo sapiens
ctgggctctccacc

SEQ ID NO: 2782339 - DNA, 13 bp, Homo sapiens
ctgggctctgccc

SEQ ID NO: 2782340 - DNA, 19 bp, Homo sapiens
ctgggctgctacccagaaa

SEQ ID NO: 2782341 - DNA, 17 bp, Homo sapiens
ctgggcttcagtggcag

SEQ ID NO: 2782342 - DNA, 19 bp, Homo sapiens
ctgggcttcagtggcagct

SEQ ID NO: 2782343 - DNA, 20 bp, Homo sapiens
ctgggcttcagtggcagctg

SEQ ID NO: 2782344 - DNA, 22 bp, Homo sapiens
ctgggcttcagtggcagctgct

SEQ ID NO: 2782345 - DNA, 19 bp, Homo sapiens
ctgggcttggggcttccta

SEQ ID NO: 2782346 - DNA, 14 bp, Homo sapiens
ctggggagaaagta

SEQ ID NO: 2782347 - DNA, 16 bp, Homo sapiens
ctggggcaagtccctg

SEQ ID NO: 2782348 - DNA, 21 bp, Homo sapiens
ctggggcaagtccctgactct

SEQ ID NO: 2782349 - DNA, 23 bp, Homo sapiens
ctggggcctcggagcctcatccg

SEQ ID NO: 2782350 - DNA, 21 bp, Homo sapiens
ctggggcctgtactgcctgct

SEQ ID NO: 2782351 - DNA, 23 bp, Homo sapiens
ctggggctcctttctccagccag

SEQ ID NO: 2782352 - DNA, 21 bp, Homo sapiens
ctggggctctaacgcctgagc

SEQ ID NO: 2782353 - DNA, 17 bp, Homo sapiens
ctggggctctgtgcagg

SEQ ID NO: 2782354 - DNA, 19 bp, Homo sapiens
ctggggctctgtgcaggga

SEQ ID NO: 2782355 - DNA, 17 bp, Homo sapiens
ctgggggaagccctgga

SEQ ID NO: 2782356 - DNA, 18 bp, Homo sapiens
ctgggggcctcagtgcca

SEQ ID NO: 2782357 - DNA, 16 bp, Homo sapiens
ctgggggcctggctgg

SEQ ID NO: 2782358 - DNA, 17 bp, Homo sapiens
ctgggggcctggctggc

SEQ ID NO: 2782359 - DNA, 23 bp, Homo sapiens
ctgggggcctggctggctgaggg

SEQ ID NO: 2782360 - DNA, 19 bp, Homo sapiens
ctgggggcgggggagccaa

SEQ ID NO: 2782361 - DNA, 23 bp, Homo sapiens
ctgggggttctttcttcctctgc

SEQ ID NO: 2782362 - DNA, 18 bp, Homo sapiens
ctggggtcctggggcctc

SEQ ID NO: 2782363 - DNA, 17 bp, Homo sapiens
ctggggttcagcccctc

SEQ ID NO: 2782364 - DNA, 20 bp, Homo sapiens
ctggggttcagcccctcctc

SEQ ID NO: 2782365 - DNA, 18 bp, Homo sapiens
ctgggtaatgaaacaaag

SEQ ID NO: 2782366 - DNA, 16 bp, Homo sapiens
ctgggtacaagagcca

SEQ ID NO: 2782367 - DNA, 14 bp, Homo sapiens
ctgggtacttgtgg

SEQ ID NO: 2782368 - DNA, 21 bp, Homo sapiens
ctgggtacttgtggacacagc

SEQ ID NO: 2782369 - DNA, 17 bp, Homo sapiens
ctgggtggctactctgt

SEQ ID NO: 2782370 - DNA, 21 bp, Homo sapiens
ctgggtggctactctgtgcca

SEQ ID NO: 2782371 - DNA, 22 bp, Homo sapiens
ctgggtggctactctgtgccag

SEQ ID NO: 2782372 - DNA, 13 bp, Homo sapiens
ctgggtggggctg

SEQ ID NO: 2782373 - DNA, 17 bp, Homo sapiens
ctgggtggggctgctcc

SEQ ID NO: 2782374 - DNA, 18 bp, Homo sapiens
ctgggtggggctgctcct

SEQ ID NO: 2782375 - DNA, 21 bp, Homo sapiens
ctgggtggggctgctcctcca

SEQ ID NO: 2782376 - DNA, 22 bp, Homo sapiens
ctgggtggggctgctcctccag

SEQ ID NO: 2782377 - DNA, 15 bp, Homo sapiens
ctgggtggtgaagga

SEQ ID NO: 2782378 - DNA, 23 bp, Homo sapiens
ctgggtttgtttttcaaagcctg

SEQ ID NO: 2782379 - DNA, 18 bp, Homo sapiens
ctggtatgaacttgagga

SEQ ID NO: 2782380 - DNA, 18 bp, Homo sapiens
ctggtcacaggactctgc

SEQ ID NO: 2782381 - DNA, 22 bp, Homo sapiens
ctggtcacaggactctgcctcc

SEQ ID NO: 2782382 - DNA, 17 bp, Homo sapiens
ctggtcaggcccactgc

SEQ ID NO: 2782383 - DNA, 13 bp, Homo sapiens
ctggtcccactca

SEQ ID NO: 2782384 - DNA, 23 bp, Homo sapiens
ctggtctcaaactcttgacctca

SEQ ID NO: 2782385 - DNA, 14 bp, Homo sapiens
ctggtctccctcca

SEQ ID NO: 2782386 - DNA, 20 bp, Homo sapiens
ctggtctccctccagctgga

SEQ ID NO: 2782387 - DNA, 13 bp, Homo sapiens
ctggtctgccctg

SEQ ID NO: 2782388 - DNA, 15 bp, Homo sapiens
ctggtctgccctggg

SEQ ID NO: 2782389 - DNA, 16 bp, Homo sapiens
ctggtctgccctgggc

SEQ ID NO: 2782390 - DNA, 17 bp, Homo sapiens
ctggtctgccctgggct

SEQ ID NO: 2782391 - DNA, 15 bp, Homo sapiens
ctggtctgctcagga

SEQ ID NO: 2782392 - DNA, 20 bp, Homo sapiens
ctggtcttgtggaattggga

SEQ ID NO: 2782393 - DNA, 21 bp, Homo sapiens
ctggtgactgcgatcttcaga

SEQ ID NO: 2782394 - DNA, 19 bp, Homo sapiens
ctggtgcagaggtgagcag

SEQ ID NO: 2782395 - DNA, 20 bp, Homo sapiens
ctggtgcagaggtgagcaga

SEQ ID NO: 2782396 - DNA, 20 bp, Homo sapiens
ctggtgctataggctggaga

SEQ ID NO: 2782397 - DNA, 22 bp, Homo sapiens
ctggtgctataggctggagaag

SEQ ID NO: 2782398 - DNA, 19 bp, Homo sapiens
ctggtggccatgtcgcctg

SEQ ID NO: 2782399 - DNA, 13 bp, Homo sapiens
ctggtgggaggca

SEQ ID NO: 2782400 - DNA, 13 bp, Homo sapiens
ctggtgggccacg

SEQ ID NO: 2782401 - DNA, 14 bp, Homo sapiens
ctggtggggcagct

SEQ ID NO: 2782402 - DNA, 16 bp, Homo sapiens
ctggtggggcagctcc

SEQ ID NO: 2782403 - DNA, 23 bp, Homo sapiens
ctggtttcatttctactgtgact

SEQ ID NO: 2782404 - DNA, 18 bp, Homo sapiens
ctgtaaacatagatagtg

SEQ ID NO: 2782405 - DNA, 21 bp, Homo sapiens
ctgtaaacatagatagtgctt

SEQ ID NO: 2782406 - DNA, 22 bp, Homo sapiens
ctgtaaatacaaaataaaatta

SEQ ID NO: 2782407 - DNA, 15 bp, Homo sapiens
ctgtaaatacatgtg

SEQ ID NO: 2782408 - DNA, 17 bp, Homo sapiens
ctgtaaatacatgtgtg

SEQ ID NO: 2782409 - DNA, 23 bp, Homo sapiens
ctgtaaatagttttaaatatgaa

SEQ ID NO: 2782410 - DNA, 18 bp, Homo sapiens
ctgtaacacaagccacag

SEQ ID NO: 2782411 - DNA, 21 bp, Homo sapiens
ctgtaacacaagccacagaag

SEQ ID NO: 2782412 - DNA, 17 bp, Homo sapiens
ctgtaaggaactggaac

SEQ ID NO: 2782413 - DNA, 16 bp, Homo sapiens
ctgtaagtttattttt

SEQ ID NO: 2782414 - DNA, 15 bp, Homo sapiens
ctgtaatcccagcac

SEQ ID NO: 2782415 - DNA, 21 bp, Homo sapiens
ctgtaattaagtaaaccaaaa

SEQ ID NO: 2782416 - DNA, 19 bp, Homo sapiens
ctgtaattttgtagtagtt

SEQ ID NO: 2782417 - DNA, 19 bp, Homo sapiens
ctgtaattttgtttgtaat

SEQ ID NO: 2782418 - DNA, 15 bp, Homo sapiens
ctgtacaatatttaa

SEQ ID NO: 2782419 - DNA, 17 bp, Homo sapiens
ctgtacaatatttaaaa

SEQ ID NO: 2782420 - DNA, 18 bp, Homo sapiens
ctgtacacgtgtcctgta

SEQ ID NO: 2782421 - DNA, 13 bp, Homo sapiens
cttcagtggcagc

SEQ ID NO: 2782422 - DNA, 14 bp, Homo sapiens
cttcagtggcagct

SEQ ID NO: 2782423 - DNA, 16 bp, Homo sapiens
cttcagtggcagctgc

SEQ ID NO: 2782424 - DNA, 18 bp, Homo sapiens
cttcagtgggagaaaaca

SEQ ID NO: 2782425 - DNA, 20 bp, Homo sapiens
cttcagtgtatggaaataaa

SEQ ID NO: 2782426 - DNA, 19 bp, Homo sapiens
cttcatgctcagccctgac

SEQ ID NO: 2782427 - DNA, 21 bp, Homo sapiens
cttcattcttgaaagctgtgg

SEQ ID NO: 2782428 - DNA, 18 bp, Homo sapiens
cttcatttgggatgctac

SEQ ID NO: 2782429 - DNA, 14 bp, Homo sapiens
cttcattttcagag

SEQ ID NO: 2782430 - DNA, 15 bp, Homo sapiens
cttcattttcagagt

SEQ ID NO: 2782431 - DNA, 19 bp, Homo sapiens
cttcattttcagagtgaca

SEQ ID NO: 2782432 - DNA, 19 bp, Homo sapiens
cttccaagggttgaattct

SEQ ID NO: 2782433 - DNA, 21 bp, Homo sapiens
cttccacattaattagatttt

SEQ ID NO: 2782434 - DNA, 20 bp, Homo sapiens
cttccagagagtcctctgga

SEQ ID NO: 2782435 - DNA, 16 bp, Homo sapiens
cttccagctagtgacc

SEQ ID NO: 2782436 - DNA, 22 bp, Homo sapiens
cttccagctagtgacccacatg

SEQ ID NO: 2782437 - DNA, 20 bp, Homo sapiens
cttccaggtatctccaggat

SEQ ID NO: 2782438 - DNA, 14 bp, Homo sapiens
cttccagtgcatgt

SEQ ID NO: 2782439 - DNA, 21 bp, Homo sapiens
cttccagtggtaccagctcac

SEQ ID NO: 2782440 - DNA, 22 bp, Homo sapiens
cttccagtggtaccagctcact

SEQ ID NO: 2782441 - DNA, 11 bp, Homo sapiens
cttccataatt

SEQ ID NO: 2782442 - DNA, 14 bp, Homo sapiens
cttcccactggagg

SEQ ID NO: 2782443 - DNA, 11 bp, Homo sapiens
cttcccatcac

SEQ ID NO: 2782444 - DNA, 16 bp, Homo sapiens
cttcccatcactggag

SEQ ID NO: 2782445 - DNA, 23 bp, Homo sapiens
cttcccatgatgccgctcttctg

SEQ ID NO: 2782446 - DNA, 14 bp, Homo sapiens
cttcccatttgtaa

SEQ ID NO: 2782447 - DNA, 15 bp, Homo sapiens
cttcccatttgtaat

SEQ ID NO: 2782448 - DNA, 16 bp, Homo sapiens
cttccccaaataatat

SEQ ID NO: 2782449 - DNA, 14 bp, Homo sapiens
cttccccacagaac

SEQ ID NO: 2782450 - DNA, 16 bp, Homo sapiens
cttccccacagaactg

SEQ ID NO: 2782451 - DNA, 17 bp, Homo sapiens
cttccccacagaactgc

SEQ ID NO: 2782452 - DNA, 23 bp, Homo sapiens
cttccccagactcagctccagaa

SEQ ID NO: 2782453 - DNA, 21 bp, Homo sapiens
cttcccccatcccctttcctc

SEQ ID NO: 2782454 - DNA, 19 bp, Homo sapiens
cttcccctcgctgtcctgc

SEQ ID NO: 2782455 - DNA, 21 bp, Homo sapiens
cttcccctcgctgtcctgctg

SEQ ID NO: 2782456 - DNA, 16 bp, Homo sapiens
cttccccttgcccagg

SEQ ID NO: 2782457 - DNA, 13 bp, Homo sapiens
cttcccctttcct

SEQ ID NO: 2782458 - DNA, 11 bp, Homo sapiens
cttccctgctt

SEQ ID NO: 2782459 - DNA, 10 bp, Homo sapiens
cttccctggc

SEQ ID NO: 2782460 - DNA, 17 bp, Homo sapiens
cttcctagttttctcct

SEQ ID NO: 2782461 - DNA, 23 bp, Homo sapiens
cttcctagttttctcctcccagg

SEQ ID NO: 2782462 - DNA, 22 bp, Homo sapiens
cttcctcactatgacactgagc

SEQ ID NO: 2782463 - DNA, 16 bp, Homo sapiens
cttcctcagtcctgga

SEQ ID NO: 2782464 - DNA, 18 bp, Homo sapiens
cttcctccgtctgcaatg

SEQ ID NO: 2782465 - DNA, 16 bp, Homo sapiens
cttcctcctcctttgc

SEQ ID NO: 2782466 - DNA, 18 bp, Homo sapiens
cttcctcctcctttgcct

SEQ ID NO: 2782467 - DNA, 12 bp, Homo sapiens
cttcctctccag

SEQ ID NO: 2782468 - DNA, 13 bp, Homo sapiens
cttcctctccagc

SEQ ID NO: 2782469 - DNA, 14 bp, Homo sapiens
cttcctctccagcc

SEQ ID NO: 2782470 - DNA, 13 bp, Homo sapiens
cttcctgcaagga

SEQ ID NO: 2782471 - DNA, 15 bp, Homo sapiens
cttcctgcaaggact

SEQ ID NO: 2782472 - DNA, 15 bp, Homo sapiens
cttcctgccaagcca

SEQ ID NO: 2782473 - DNA, 16 bp, Homo sapiens
cttcctgccaccagtc

SEQ ID NO: 2782474 - DNA, 21 bp, Homo sapiens
cttcctgccccaactccttcc

SEQ ID NO: 2782475 - DNA, 13 bp, Homo sapiens
cttcctggacagc

SEQ ID NO: 2782476 - DNA, 14 bp, Homo sapiens
cttcctggacagct

SEQ ID NO: 2782477 - DNA, 16 bp, Homo sapiens
cttcctggacagctgt

SEQ ID NO: 2782478 - DNA, 20 bp, Homo sapiens
cttcctggacagctgtgcct

SEQ ID NO: 2782479 - DNA, 21 bp, Homo sapiens
cttcctggacagctgtgcctc

SEQ ID NO: 2782480 - DNA, 22 bp, Homo sapiens
cttcctggacagctgtgcctcg

SEQ ID NO: 2782481 - DNA, 24 bp, Homo sapiens
cttcctggacagctgtgcctcgct

SEQ ID NO: 2782482 - DNA, 22 bp, Homo sapiens
cttcctgtaacacaagccacag

SEQ ID NO: 2782483 - DNA, 23 bp, Homo sapiens
cttcctgtaacacaagccacaga

SEQ ID NO: 2782484 - DNA, 13 bp, Homo sapiens
cttcctgtgactt

SEQ ID NO: 2782485 - DNA, 15 bp, Homo sapiens
cttccttcatttcct

SEQ ID NO: 2782486 - DNA, 16 bp, Homo sapiens
cttccttcatttcctc

SEQ ID NO: 2782487 - DNA, 17 bp, Homo sapiens
cttccttgctgtcctag

SEQ ID NO: 2782488 - DNA, 20 bp, Homo sapiens
cttccttgctgtcctaggcc

SEQ ID NO: 2782489 - DNA, 11 bp, Homo sapiens
cttcctttcct

SEQ ID NO: 2782490 - DNA, 17 bp, Homo sapiens
cttcctttcctctgcag

SEQ ID NO: 2782491 - DNA, 15 bp, Homo sapiens
cttcgactcaggatc

SEQ ID NO: 2782492 - DNA, 17 bp, Homo sapiens
cttcgctcctgtgtctt

SEQ ID NO: 2782493 - DNA, 18 bp, Homo sapiens
cttcggggaactcctgga

SEQ ID NO: 2782494 - DNA, 17 bp, Homo sapiens
cttctaaaatgctttta

SEQ ID NO: 2782495 - DNA, 20 bp, Homo sapiens
cttctaaatgttggaatttt

SEQ ID NO: 2782496 - DNA, 16 bp, Homo sapiens
cttctacaaccagagc

SEQ ID NO: 2782497 - DNA, 17 bp, Homo sapiens
cttctacaaccagagcc

SEQ ID NO: 2782498 - DNA, 18 bp, Homo sapiens
cttctacaaccagagccc

SEQ ID NO: 2782499 - DNA, 19 bp, Homo sapiens
cttctattatagccacatc

SEQ ID NO: 2782500 - DNA, 17 bp, Homo sapiens
cttctatttaaaaaata

SEQ ID NO: 2782501 - DNA, 22 bp, Homo sapiens
cttctatttaaaaaataaaaaa

SEQ ID NO: 2782502 - DNA, 15 bp, Homo sapiens
cttctattttgtaaa

SEQ ID NO: 2782503 - DNA, 17 bp, Homo sapiens
cttctcaggacacaggc

SEQ ID NO: 2782504 - DNA, 21 bp, Homo sapiens
cttctcaggacacaggcctgt

SEQ ID NO: 2782505 - DNA, 23 bp, Homo sapiens
cttctcaggacacaggcctgtgt

SEQ ID NO: 2782506 - DNA, 18 bp, Homo sapiens
cttctccaccctgctctc

SEQ ID NO: 2782507 - DNA, 17 bp, Homo sapiens
cttctccaggctgtatc

SEQ ID NO: 2782508 - DNA, 17 bp, Homo sapiens
cttctccatctggcagg

SEQ ID NO: 2782509 - DNA, 15 bp, Homo sapiens
cttctcgcattttct

SEQ ID NO: 2782510 - DNA, 13 bp, Homo sapiens
cttctctacagac

SEQ ID NO: 2782511 - DNA, 18 bp, Homo sapiens
cttctctacccatctccc

SEQ ID NO: 2782512 - DNA, 22 bp, Homo sapiens
gaaaaaattaagagatacattc

SEQ ID NO: 2782513 - DNA, 18 bp, Homo sapiens
gaaaaacatctgaaagcc

SEQ ID NO: 2782514 - DNA, 23 bp, Homo sapiens
gaaaaactctgggaaataagaga

SEQ ID NO: 2782515 - DNA, 20 bp, Homo sapiens
gaaaaacttccatgaggcca

SEQ ID NO: 2782516 - DNA, 12 bp, Homo sapiens
gaaaaagaaatg

SEQ ID NO: 2782517 - DNA, 14 bp, Homo sapiens
gaaaaagaagaatc

SEQ ID NO: 2782518 - DNA, 12 bp, Homo sapiens
gaaaaagaagca

SEQ ID NO: 2782519 - DNA, 11 bp, Homo sapiens
gaaaaatatga

SEQ ID NO: 2782520 - DNA, 18 bp, Homo sapiens
gaaaaatccagaaagaaa

SEQ ID NO: 2782521 - DNA, 19 bp, Homo sapiens
gaaaacagtcgatcaaggg

SEQ ID NO: 2782522 - DNA, 13 bp, Homo sapiens
gaaaacccagaga

SEQ ID NO: 2782523 - DNA, 15 bp, Homo sapiens
gaaaacccagagagg

SEQ ID NO: 2782524 - DNA, 22 bp, Homo sapiens
gaaaacccagagaggaatcaga

SEQ ID NO: 2782525 - DNA, 23 bp, Homo sapiens
gaaaacctcacttgaaggcccag

SEQ ID NO: 2782526 - DNA, 15 bp, Homo sapiens
gaaaacctttcttca

SEQ ID NO: 2782527 - DNA, 12 bp, Homo sapiens
gaaaactggaaa

SEQ ID NO: 2782528 - DNA, 19 bp, Homo sapiens
gaaaacttagaaataagaa

SEQ ID NO: 2782529 - DNA, 16 bp, Homo sapiens
gaaaagaatacagaaa

SEQ ID NO: 2782530 - DNA, 17 bp, Homo sapiens
gaaaagcacctgccgac

SEQ ID NO: 2782531 - DNA, 23 bp, Homo sapiens
gaaaagctagaattgagtgttta

SEQ ID NO: 2782532 - DNA, 14 bp, Homo sapiens
gaaaagtagaatta

SEQ ID NO: 2782533 - DNA, 17 bp, Homo sapiens
gaaaagtagaattatat

SEQ ID NO: 2782534 - DNA, 21 bp, Homo sapiens
gaaaagtagaattatatctaa

SEQ ID NO: 2782535 - DNA, 16 bp, Homo sapiens
gaaaagtgaatgctca

SEQ ID NO: 2782536 - DNA, 23 bp, Homo sapiens
gaaaagtgcttagaaagttattg

SEQ ID NO: 2782537 - DNA, 15 bp, Homo sapiens
gaaaatataaatgca

SEQ ID NO: 2782538 - DNA, 19 bp, Homo sapiens
gaaaatataaatgcatgat

SEQ ID NO: 2782539 - DNA, 16 bp, Homo sapiens
gaaaatgcaaaatgaa

SEQ ID NO: 2782540 - DNA, 15 bp, Homo sapiens
gaaaatgcattatgt

SEQ ID NO: 2782541 - DNA, 23 bp, Homo sapiens
gaaaatgtcagaaaccagttatg

SEQ ID NO: 2782542 - DNA, 18 bp, Homo sapiens
gaaaatgtgtcagcatgc

SEQ ID NO: 2782543 - DNA, 15 bp, Homo sapiens
gaaaattaacactgc

SEQ ID NO: 2782544 - DNA, 13 bp, Homo sapiens
gaaaattatttaa

SEQ ID NO: 2782545 - DNA, 23 bp, Homo sapiens
gaaaattatttaaaccgctaaaa

SEQ ID NO: 2782546 - DNA, 23 bp, Homo sapiens
gaaacaaaaacactaaaaataaa

SEQ ID NO: 2782547 - DNA, 14 bp, Homo sapiens
gaaacaaataatca

SEQ ID NO: 2782548 - DNA, 19 bp, Homo sapiens
gaaacaaataatcacattg

SEQ ID NO: 2782549 - DNA, 17 bp, Homo sapiens
gaaacaaatttttttct

SEQ ID NO: 2782550 - DNA, 15 bp, Homo sapiens
gaaacacaatatttt

SEQ ID NO: 2782551 - DNA, 15 bp, Homo sapiens
gaaacacctcccagg

SEQ ID NO: 2782552 - DNA, 15 bp, Homo sapiens
gaaacagagaaccct

SEQ ID NO: 2782553 - DNA, 19 bp, Homo sapiens
gaaacagagacaggcccaa

SEQ ID NO: 2782554 - DNA, 18 bp, Homo sapiens
gaaacagctaatgggaca

SEQ ID NO: 2782555 - DNA, 22 bp, Homo sapiens
gaaacaggaccacaaaaatgaa

SEQ ID NO: 2782556 - DNA, 20 bp, Homo sapiens
gaaacatgactcgtatatgt

SEQ ID NO: 2782557 - DNA, 22 bp, Homo sapiens
gaaaccaaagatatatacacag

SEQ ID NO: 2782558 - DNA, 19 bp, Homo sapiens
gaaaccagtgtagccttgc

SEQ ID NO: 2782559 - DNA, 21 bp, Homo sapiens
gaaaccattatgaagaagaga

SEQ ID NO: 2782560 - DNA, 21 bp, Homo sapiens
gaaacccaccagcctaagaag

SEQ ID NO: 2782561 - DNA, 18 bp, Homo sapiens
gaaacctgtccataaagt

SEQ ID NO: 2782562 - DNA, 19 bp, Homo sapiens
gaaacctgtccataaagta

SEQ ID NO: 2782563 - DNA, 17 bp, Homo sapiens
gaaaccttattgtacct

SEQ ID NO: 2782564 - DNA, 17 bp, Homo sapiens
gaaactcaccatgtaaa

SEQ ID NO: 2782565 - DNA, 18 bp, Homo sapiens
gaaactccgtcttagaag

SEQ ID NO: 2782566 - DNA, 23 bp, Homo sapiens
gaaactgaaaactgtaaatacaa

SEQ ID NO: 2782567 - DNA, 16 bp, Homo sapiens
gaaactttctttctca

SEQ ID NO: 2782568 - DNA, 17 bp, Homo sapiens
gaaacttttttatttaa

SEQ ID NO: 2782569 - DNA, 11 bp, Homo sapiens
gaaagaagaga

SEQ ID NO: 2782570 - DNA, 11 bp, Homo sapiens
gaaagaaggaa

SEQ ID NO: 2782571 - DNA, 21 bp, Homo sapiens
gaaagaattatttttgtgttt

SEQ ID NO: 2782572 - DNA, 14 bp, Homo sapiens
gaaagactgaaaga

SEQ ID NO: 2782573 - DNA, 14 bp, Homo sapiens
gaaagaggtgaccc

SEQ ID NO: 2782574 - DNA, 20 bp, Homo sapiens
gaaagaggtgaccccagggc

SEQ ID NO: 2782575 - DNA, 23 bp, Homo sapiens
gaaagaggtgaccccagggcaca

SEQ ID NO: 2782576 - DNA, 19 bp, Homo sapiens
gaaagcaccgcagcatgtg

SEQ ID NO: 2782577 - DNA, 16 bp, Homo sapiens
gaaagcatcacctcag

SEQ ID NO: 2782578 - DNA, 20 bp, Homo sapiens
gaaagccagggtcctgagtg

SEQ ID NO: 2782579 - DNA, 14 bp, Homo sapiens
gaaagccccagcac

SEQ ID NO: 2782580 - DNA, 16 bp, Homo sapiens
gaaagcctctgctgcc

SEQ ID NO: 2782581 - DNA, 13 bp, Homo sapiens
gaaagctagagat

SEQ ID NO: 2782582 - DNA, 20 bp, Homo sapiens
gaaaggatgtaaacagtgcc

SEQ ID NO: 2782583 - DNA, 22 bp, Homo sapiens
gaaaggatgtaaacagtgcctg

SEQ ID NO: 2782584 - DNA, 22 bp, Homo sapiens
gaaaggctcagtctcaggagca

SEQ ID NO: 2782585 - DNA, 22 bp, Homo sapiens
gaaagggacttggaagctccgc

SEQ ID NO: 2782586 - DNA, 14 bp, Homo sapiens
gaaagggagggctc

SEQ ID NO: 2782587 - DNA, 20 bp, Homo sapiens
gaaagggagggctctgaggc

SEQ ID NO: 2782588 - DNA, 13 bp, Homo sapiens
gaaagggcccaga

SEQ ID NO: 2782589 - DNA, 15 bp, Homo sapiens
gaaagggcccagaga

SEQ ID NO: 2782590 - DNA, 23 bp, Homo sapiens
gaaagggtctgataaacacagag

SEQ ID NO: 2782591 - DNA, 18 bp, Homo sapiens
gaaaggttaccctgtaac

SEQ ID NO: 2782592 - DNA, 18 bp, Homo sapiens
gaaagtatgtgatatctg

SEQ ID NO: 2782593 - DNA, 19 bp, Homo sapiens
gaaagtatgtgatatctga

SEQ ID NO: 2782594 - DNA, 20 bp, Homo sapiens
gaaagtcagatgcccagagg

SEQ ID NO: 2782595 - DNA, 18 bp, Homo sapiens
gaaagtgaataaacttca

SEQ ID NO: 2782596 - DNA, 21 bp, Homo sapiens
gaaagtgaataaacttcagca

SEQ ID NO: 2782597 - DNA, 16 bp, Homo sapiens
gaaagtgtaaaataga

SEQ ID NO: 2782598 - DNA, 15 bp, Homo sapiens
gaaagttattgtgtt

SEQ ID NO: 2782599 - DNA, 17 bp, Homo sapiens
gaaataaaacctttcaa

SEQ ID NO: 2782600 - DNA, 23 bp, Homo sapiens
gaaataaattggtgataagtgga

SEQ ID NO: 2782601 - DNA, 24 bp, Homo sapiens
gaaataagaaacacaaatgtaaaa

SEQ ID NO: 2782602 - DNA, 19 bp, Homo sapiens
gaagtttgatattaaagga

SEQ ID NO: 2782603 - DNA, 21 bp, Homo sapiens
gaataaaaaacatttgtacat

SEQ ID NO: 2782604 - DNA, 15 bp, Homo sapiens
gaataaaaaccctgt

SEQ ID NO: 2782605 - DNA, 11 bp, Homo sapiens
gaataaacttc

SEQ ID NO: 2782606 - DNA, 17 bp, Homo sapiens
gaataaagcctgctttt

SEQ ID NO: 2782607 - DNA, 13 bp, Homo sapiens
gaataaagtctga

SEQ ID NO: 2782608 - DNA, 16 bp, Homo sapiens
gaataaagtctgagtg

SEQ ID NO: 2782609 - DNA, 19 bp, Homo sapiens
gaataaagtctgagtgggc

SEQ ID NO: 2782610 - DNA, 12 bp, Homo sapiens
gaataaggcctt

SEQ ID NO: 2782611 - DNA, 17 bp, Homo sapiens
gaataagtattcttcat

SEQ ID NO: 2782612 - DNA, 19 bp, Homo sapiens
gaataagtgctgtttgaga

SEQ ID NO: 2782613 - DNA, 15 bp, Homo sapiens
gaataatctttgggt

SEQ ID NO: 2782614 - DNA, 13 bp, Homo sapiens
gaataattgtgta

SEQ ID NO: 2782615 - DNA, 16 bp, Homo sapiens
gaatacaaacatattt

SEQ ID NO: 2782616 - DNA, 12 bp, Homo sapiens
gaataccctttt

SEQ ID NO: 2782617 - DNA, 14 bp, Homo sapiens
gaatagctgggact

SEQ ID NO: 2782618 - DNA, 19 bp, Homo sapiens
gaatataattgttttatct

SEQ ID NO: 2782619 - DNA, 15 bp, Homo sapiens
gaatataggaagcat

SEQ ID NO: 2782620 - DNA, 11 bp, Homo sapiens
gaatatattat

SEQ ID NO: 2782621 - DNA, 17 bp, Homo sapiens
gaatatgactgttttta

SEQ ID NO: 2782622 - DNA, 11 bp, Homo sapiens
gaatattcagg

SEQ ID NO: 2782623 - DNA, 14 bp, Homo sapiens
gaatattgttaaaa

SEQ ID NO: 2782624 - DNA, 17 bp, Homo sapiens
gaatatttattacctct

SEQ ID NO: 2782625 - DNA, 15 bp, Homo sapiens
gaatcaaaaattgaa

SEQ ID NO: 2782626 - DNA, 13 bp, Homo sapiens
gaatcaaaactct

SEQ ID NO: 2782627 - DNA, 16 bp, Homo sapiens
gaatcaaagacatgga

SEQ ID NO: 2782628 - DNA, 21 bp, Homo sapiens
gaatcaagatgtcagactggc

SEQ ID NO: 2782629 - DNA, 20 bp, Homo sapiens
gaatcaagctagaaggccac

SEQ ID NO: 2782630 - DNA, 13 bp, Homo sapiens
gaatcagaaacag

SEQ ID NO: 2782631 - DNA, 22 bp, Homo sapiens
gaatcagaccctaccccaccac

SEQ ID NO: 2782632 - DNA, 13 bp, Homo sapiens
gaatcataatttt

SEQ ID NO: 2782633 - DNA, 17 bp, Homo sapiens
gaatcataattttcaag

SEQ ID NO: 2782634 - DNA, 19 bp, Homo sapiens
gaatcatacttagcaaagt

SEQ ID NO: 2782635 - DNA, 18 bp, Homo sapiens
gaatccagacccggctgc

SEQ ID NO: 2782636 - DNA, 14 bp, Homo sapiens
gaatccatgcttgg

SEQ ID NO: 2782637 - DNA, 12 bp, Homo sapiens
gaatccctgcag

SEQ ID NO: 2782638 - DNA, 18 bp, Homo sapiens
gaatcgatctgtactgta

SEQ ID NO: 2782639 - DNA, 22 bp, Homo sapiens
gaatcggagcgaagcagagagg

SEQ ID NO: 2782640 - DNA, 16 bp, Homo sapiens
gaatctacagaacaaa

SEQ ID NO: 2782641 - DNA, 17 bp, Homo sapiens
gaatctatatttaacaa

SEQ ID NO: 2782642 - DNA, 19 bp, Homo sapiens
gaatctcccctcctcacag

SEQ ID NO: 2782643 - DNA, 15 bp, Homo sapiens
gaatctgtgcagatg

SEQ ID NO: 2782644 - DNA, 16 bp, Homo sapiens
gaatgaaaattgtatg

SEQ ID NO: 2782645 - DNA, 18 bp, Homo sapiens
gaatgaaccacatcttgc

SEQ ID NO: 2782646 - DNA, 23 bp, Homo sapiens
gaatgaaccacatcttgctctgc

SEQ ID NO: 2782647 - DNA, 16 bp, Homo sapiens
gaatgaagcatgtagc

SEQ ID NO: 2782648 - DNA, 15 bp, Homo sapiens
gaatgaggtcccagg

SEQ ID NO: 2782649 - DNA, 17 bp, Homo sapiens
gaatgaggtcccaggca

SEQ ID NO: 2782650 - DNA, 22 bp, Homo sapiens
gaatgattccctcttgctattg

SEQ ID NO: 2782651 - DNA, 14 bp, Homo sapiens
gaatgatttcatgc

SEQ ID NO: 2782652 - DNA, 20 bp, Homo sapiens
gaatgatttccaaagagaaa

SEQ ID NO: 2782653 - DNA, 20 bp, Homo sapiens
gaatgcacactagcctctcc

SEQ ID NO: 2782654 - DNA, 17 bp, Homo sapiens
gaatgcccacaggcaaa

SEQ ID NO: 2782655 - DNA, 20 bp, Homo sapiens
gaatgcctcaatgtgaccag

SEQ ID NO: 2782656 - DNA, 22 bp, Homo sapiens
gaatgcctcaatgtgaccaggg

SEQ ID NO: 2782657 - DNA, 15 bp, Homo sapiens
gaatggcagctggaa

SEQ ID NO: 2782658 - DNA, 14 bp, Homo sapiens
gaatggtccagggt

SEQ ID NO: 2782659 - DNA, 19 bp, Homo sapiens
gaatggttccatgcctgag

SEQ ID NO: 2782660 - DNA, 15 bp, Homo sapiens
gaatgtagctggttt

SEQ ID NO: 2782661 - DNA, 22 bp, Homo sapiens
gaatgtctttgttggaaaagaa

SEQ ID NO: 2782662 - DNA, 22 bp, Homo sapiens
gaatgtggcccctgaacaagaa

SEQ ID NO: 2782663 - DNA, 20 bp, Homo sapiens
gaatgttacattgtttgtct

SEQ ID NO: 2782664 - DNA, 20 bp, Homo sapiens
gaatgtttgaactgccaaga

SEQ ID NO: 2782665 - DNA, 15 bp, Homo sapiens
gaatgtttgcctctg

SEQ ID NO: 2782666 - DNA, 18 bp, Homo sapiens
gaatgtttgcctctgcct

SEQ ID NO: 2782667 - DNA, 18 bp, Homo sapiens
gaattaagttagggaatg

SEQ ID NO: 2782668 - DNA, 16 bp, Homo sapiens
gaattatatctaattt

SEQ ID NO: 2782669 - DNA, 21 bp, Homo sapiens
gaattatatctaatttataca

SEQ ID NO: 2782670 - DNA, 22 bp, Homo sapiens
gaattatatctaatttatacaa

SEQ ID NO: 2782671 - DNA, 17 bp, Homo sapiens
gaattattatgtctcaa

SEQ ID NO: 2782672 - DNA, 20 bp, Homo sapiens
gaattatttttgtgtttcta

SEQ ID NO: 2782673 - DNA, 12 bp, Homo sapiens
gaattccaagga

SEQ ID NO: 2782674 - DNA, 18 bp, Homo sapiens
gaattctaagattgtaca

SEQ ID NO: 2782675 - DNA, 14 bp, Homo sapiens
gaattctagaaaat

SEQ ID NO: 2782676 - DNA, 20 bp, Homo sapiens
gaattctctctaaaaataaa

SEQ ID NO: 2782677 - DNA, 14 bp, Homo sapiens
gaattctggaggaa

SEQ ID NO: 2782678 - DNA, 17 bp, Homo sapiens
gaattctgtgaagaatg

SEQ ID NO: 2782679 - DNA, 18 bp, Homo sapiens
gaattgaacccaggaggt

SEQ ID NO: 2782680 - DNA, 22 bp, Homo sapiens
gaattgaagataggagagatac

SEQ ID NO: 2782681 - DNA, 20 bp, Homo sapiens
gaattgcctgcagagagaag

SEQ ID NO: 2782682 - DNA, 13 bp, Homo sapiens
gaattgctgctct

SEQ ID NO: 2782683 - DNA, 15 bp, Homo sapiens
gaattgctgctctct

SEQ ID NO: 2782684 - DNA, 16 bp, Homo sapiens
gaattgggaagctggg

SEQ ID NO: 2782685 - DNA, 17 bp, Homo sapiens
gaattgggagcttggga

SEQ ID NO: 2782686 - DNA, 14 bp, Homo sapiens
gaattgtatcattt

SEQ ID NO: 2782687 - DNA, 20 bp, Homo sapiens
gaatttaaattctttttcaa

SEQ ID NO: 2782688 - DNA, 17 bp, Homo sapiens
gaatttattcaattcct

SEQ ID NO: 2782689 - DNA, 20 bp, Homo sapiens
gaatttctttgtcattcaag

SEQ ID NO: 2782690 - DNA, 13 bp, Homo sapiens
gaatttgtatttt

SEQ ID NO: 2782691 - DNA, 23 bp, Homo sapiens
gaattttcagaccccagcggctg

SEQ ID NO: 2782692 - DNA, 21 bp, Homo sapiens
gaattttctttgtgtagcttt

SEQ ID NO: 2782693 - DNA, 21 bp, Homo sapiens
gagaaattttactgacagaaa

SEQ ID NO: 2782694 - DNA, 14 bp, Homo sapiens
gagaacctcaggct

SEQ ID NO: 2782695 - DNA, 13 bp, Homo sapiens
gagaacctggcct

SEQ ID NO: 2782696 - DNA, 16 bp, Homo sapiens
gagaacctggccttca

SEQ ID NO: 2782697 - DNA, 20 bp, Homo sapiens
gagaactcgaagcccttcca

SEQ ID NO: 2782698 - DNA, 13 bp, Homo sapiens
gagaactgggatt

SEQ ID NO: 2782699 - DNA, 21 bp, Homo sapiens
gagaagaattttcagacccca

SEQ ID NO: 2782700 - DNA, 14 bp, Homo sapiens
gagaagagggcctg

SEQ ID NO: 2782701 - DNA, 23 bp, Homo sapiens
gagaaggcaggaatgtgtggcag

SEQ ID NO: 2782702 - DNA, 15 bp, Homo sapiens
gagaagggggattgg

SEQ ID NO: 2782703 - DNA, 23 bp, Homo sapiens
gagaagttaagcagcctttctgt

SEQ ID NO: 2782704 - DNA, 21 bp, Homo sapiens
gagaagtttctggccctggct

SEQ ID NO: 2782705 - DNA, 18 bp, Homo sapiens
gagaataagagaaagaaa

SEQ ID NO: 2782706 - DNA, 14 bp, Homo sapiens
gagaataattgtgt

SEQ ID NO: 2782707 - DNA, 15 bp, Homo sapiens
gagaataattgtgta

SEQ ID NO: 2782708 - DNA, 18 bp, Homo sapiens
gagaataattgtgtacaa

SEQ ID NO: 2782709 - DNA, 15 bp, Homo sapiens
gagaatgaaagggcc

SEQ ID NO: 2782710 - DNA, 19 bp, Homo sapiens
gagacaaacacctcccagg

SEQ ID NO: 2782711 - DNA, 17 bp, Homo sapiens
gagacaatcacagctcc

SEQ ID NO: 2782712 - DNA, 19 bp, Homo sapiens
gagacaatcacagctcctc

SEQ ID NO: 2782713 - DNA, 17 bp, Homo sapiens
gagacacctgcacctcc

SEQ ID NO: 2782714 - DNA, 19 bp, Homo sapiens
gagacacctgcacctcccc

SEQ ID NO: 2782715 - DNA, 20 bp, Homo sapiens
gagacagcgaactagaagaa

SEQ ID NO: 2782716 - DNA, 21 bp, Homo sapiens
gagacaggaaaatcctctggc

SEQ ID NO: 2782717 - DNA, 17 bp, Homo sapiens
gagacaggtggcctagc

SEQ ID NO: 2782718 - DNA, 19 bp, Homo sapiens
gagacaggtggcctagcag

SEQ ID NO: 2782719 - DNA, 22 bp, Homo sapiens
gagacaggtggcctagcaggca

SEQ ID NO: 2782720 - DNA, 18 bp, Homo sapiens
gagacagttcaagaaagc

SEQ ID NO: 2782721 - DNA, 22 bp, Homo sapiens
gagacattaactcattagactg

SEQ ID NO: 2782722 - DNA, 16 bp, Homo sapiens
gagaccaacctgacca

SEQ ID NO: 2782723 - DNA, 22 bp, Homo sapiens
gagaccaagactctgaaatctc

SEQ ID NO: 2782724 - DNA, 19 bp, Homo sapiens
gagaccagctcagaggccc

SEQ ID NO: 2782725 - DNA, 22 bp, Homo sapiens
gagaccagctcagaggcccagg

SEQ ID NO: 2782726 - DNA, 17 bp, Homo sapiens
gagaccccttcctttcc

SEQ ID NO: 2782727 - DNA, 20 bp, Homo sapiens
gagaccccttcctttcctct

SEQ ID NO: 2782728 - DNA, 17 bp, Homo sapiens
gagacccttgcattaga

SEQ ID NO: 2782729 - DNA, 19 bp, Homo sapiens
gagacccttgcattagaaa

SEQ ID NO: 2782730 - DNA, 19 bp, Homo sapiens
gagacggagtcccaccttg

SEQ ID NO: 2782731 - DNA, 14 bp, Homo sapiens
gagactaagccctg

SEQ ID NO: 2782732 - DNA, 17 bp, Homo sapiens
gagactcacctctgcct

SEQ ID NO: 2782733 - DNA, 18 bp, Homo sapiens
gagactcacctctgcctc

SEQ ID NO: 2782734 - DNA, 20 bp, Homo sapiens
gagactcacctctgcctcaa

SEQ ID NO: 2782735 - DNA, 14 bp, Homo sapiens
gagactgctaagta

SEQ ID NO: 2782736 - DNA, 20 bp, Homo sapiens
gagactggagcatctgactc

SEQ ID NO: 2782737 - DNA, 19 bp, Homo sapiens
gagagacccaaggaggaaa

SEQ ID NO: 2782738 - DNA, 20 bp, Homo sapiens
gagagacccaaggaggaaaa

SEQ ID NO: 2782739 - DNA, 20 bp, Homo sapiens
gagagccagccctccctgtc

SEQ ID NO: 2782740 - DNA, 12 bp, Homo sapiens
gagagccagctc

SEQ ID NO: 2782741 - DNA, 13 bp, Homo sapiens
gagagccagctct

SEQ ID NO: 2782742 - DNA, 10 bp, Homo sapiens
gagagcccag

SEQ ID NO: 2782743 - DNA, 13 bp, Homo sapiens
gagagcccagcca

SEQ ID NO: 2782744 - DNA, 15 bp, Homo sapiens
gagagccctgggacc

SEQ ID NO: 2782745 - DNA, 19 bp, Homo sapiens
gagagctaggagcaaagcc

SEQ ID NO: 2782746 - DNA, 22 bp, Homo sapiens
gagagctaggagcaaagcctgt

SEQ ID NO: 2782747 - DNA, 23 bp, Homo sapiens
gagaggaaaggacatgggtagca

SEQ ID NO: 2782748 - DNA, 12 bp, Homo sapiens
gagaggccctgg

SEQ ID NO: 2782749 - DNA, 13 bp, Homo sapiens
gagaggccctgga

SEQ ID NO: 2782750 - DNA, 18 bp, Homo sapiens
gagaggccttttggaatg

SEQ ID NO: 2782751 - DNA, 18 bp, Homo sapiens
gagaggggaacagactgg

SEQ ID NO: 2782752 - DNA, 17 bp, Homo sapiens
gagaggggaagggccag

SEQ ID NO: 2782753 - DNA, 18 bp, Homo sapiens
gagaggggaagggccagt

SEQ ID NO: 2782754 - DNA, 15 bp, Homo sapiens
gagaggggacatttc

SEQ ID NO: 2782755 - DNA, 14 bp, Homo sapiens
gagaggtgggcagc

SEQ ID NO: 2782756 - DNA, 20 bp, Homo sapiens
gagagtagccgagagcctgc

SEQ ID NO: 2782757 - DNA, 21 bp, Homo sapiens
gagagtagccgagagcctgct

SEQ ID NO: 2782758 - DNA, 13 bp, Homo sapiens
gagagtgagaata

SEQ ID NO: 2782759 - DNA, 13 bp, Homo sapiens
gagagtgctgaga

SEQ ID NO: 2782760 - DNA, 20 bp, Homo sapiens
gagagtgtgaaatagacatt

SEQ ID NO: 2782761 - DNA, 13 bp, Homo sapiens
gagatataaaatc

SEQ ID NO: 2782762 - DNA, 23 bp, Homo sapiens
gagatcaaccccttcgctcctgt

SEQ ID NO: 2782763 - DNA, 19 bp, Homo sapiens
gagatcacgccactgcact

SEQ ID NO: 2782764 - DNA, 16 bp, Homo sapiens
gagatcgctggcagag

SEQ ID NO: 2782765 - DNA, 19 bp, Homo sapiens
gagatctaagcctttccat

SEQ ID NO: 2782766 - DNA, 14 bp, Homo sapiens
gagatgcagaggta

SEQ ID NO: 2782767 - DNA, 16 bp, Homo sapiens
gagatgcagaggtaaa

SEQ ID NO: 2782768 - DNA, 20 bp, Homo sapiens
gagatggcgctattgcactc

SEQ ID NO: 2782769 - DNA, 17 bp, Homo sapiens
gagatgtaaaaggtatt

SEQ ID NO: 2782770 - DNA, 14 bp, Homo sapiens
gagatgtaattgtt

SEQ ID NO: 2782771 - DNA, 18 bp, Homo sapiens
gagatgtaccatgttaaa

SEQ ID NO: 2782772 - DNA, 13 bp, Homo sapiens
gagattaatttgt

SEQ ID NO: 2782773 - DNA, 15 bp, Homo sapiens
gagattatgttcttt

SEQ ID NO: 2782774 - DNA, 15 bp, Homo sapiens
gagatttgtatttat

SEQ ID NO: 2782775 - DNA, 12 bp, Homo sapiens
gagcaaaataat

SEQ ID NO: 2782776 - DNA, 13 bp, Homo sapiens
gagcaaagcctgt

SEQ ID NO: 2782777 - DNA, 16 bp, Homo sapiens
gagcaaatgtttctgc

SEQ ID NO: 2782778 - DNA, 16 bp, Homo sapiens
gagcaaccgtggccct

SEQ ID NO: 2782779 - DNA, 14 bp, Homo sapiens
gagcaagactctgt

SEQ ID NO: 2782780 - DNA, 12 bp, Homo sapiens
gagcaagagctg

SEQ ID NO: 2782781 - DNA, 13 bp, Homo sapiens
gagcacactgtag

SEQ ID NO: 2782782 - DNA, 15 bp, Homo sapiens
gagcacactgtagca

SEQ ID NO: 2782783 - DNA, 13 bp, Homo sapiens
gagcaccaggcac

SEQ ID NO: 2782784 - DNA, 21 bp, Homo sapiens
gatcccatccatcagctccct

SEQ ID NO: 2782785 - DNA, 15 bp, Homo sapiens
gatccctagctgtga

SEQ ID NO: 2782786 - DNA, 19 bp, Homo sapiens
gatccctagctgtgacctc

SEQ ID NO: 2782787 - DNA, 18 bp, Homo sapiens
gatccctgttacccagag

SEQ ID NO: 2782788 - DNA, 18 bp, Homo sapiens
gatcctcccacctcagcc

SEQ ID NO: 2782789 - DNA, 19 bp, Homo sapiens
gatcctcccacctcagcct

SEQ ID NO: 2782790 - DNA, 19 bp, Homo sapiens
gatcctgtctttaaggaaa

SEQ ID NO: 2782791 - DNA, 17 bp, Homo sapiens
gatcggagcctcctctc

SEQ ID NO: 2782792 - DNA, 20 bp, Homo sapiens
gatcggagcctcctctctca

SEQ ID NO: 2782793 - DNA, 21 bp, Homo sapiens
gatcgtattaattatctgatc

SEQ ID NO: 2782794 - DNA, 18 bp, Homo sapiens
gatcgtgctaaattttca

SEQ ID NO: 2782795 - DNA, 16 bp, Homo sapiens
gatctagaatgtgttt

SEQ ID NO: 2782796 - DNA, 15 bp, Homo sapiens
gatctatgcaatttt

SEQ ID NO: 2782797 - DNA, 16 bp, Homo sapiens
gatctatgcaattttt

SEQ ID NO: 2782798 - DNA, 20 bp, Homo sapiens
gatctcagataaagtgacca

SEQ ID NO: 2782799 - DNA, 12 bp, Homo sapiens
gatctcaggagc

SEQ ID NO: 2782800 - DNA, 13 bp, Homo sapiens
gatctcaggagct

SEQ ID NO: 2782801 - DNA, 20 bp, Homo sapiens
gatctcatggaaactggcca

SEQ ID NO: 2782802 - DNA, 16 bp, Homo sapiens
gatctccaaggaccag

SEQ ID NO: 2782803 - DNA, 19 bp, Homo sapiens
gatctccaaggaccaggtt

SEQ ID NO: 2782804 - DNA, 14 bp, Homo sapiens
gatctccctgccgc

SEQ ID NO: 2782805 - DNA, 18 bp, Homo sapiens
gatctccctgccgcctca

SEQ ID NO: 2782806 - DNA, 13 bp, Homo sapiens
gatctctcaggag

SEQ ID NO: 2782807 - DNA, 21 bp, Homo sapiens
gatctctcaggagcacaggca

SEQ ID NO: 2782808 - DNA, 19 bp, Homo sapiens
gatctgactttaattgtgt

SEQ ID NO: 2782809 - DNA, 20 bp, Homo sapiens
gatctgcagggggtgtgtct

SEQ ID NO: 2782810 - DNA, 17 bp, Homo sapiens
gatctgggaccctttcc

SEQ ID NO: 2782811 - DNA, 23 bp, Homo sapiens
gatctgggaccctttccttcctt

SEQ ID NO: 2782812 - DNA, 17 bp, Homo sapiens
gatctggggctctggga

SEQ ID NO: 2782813 - DNA, 20 bp, Homo sapiens
gatctgggttcactgcaacc

SEQ ID NO: 2782814 - DNA, 23 bp, Homo sapiens
gatctgtttttaaaaatcataaa

SEQ ID NO: 2782815 - DNA, 14 bp, Homo sapiens
gatcttctgaaatg

SEQ ID NO: 2782816 - DNA, 16 bp, Homo sapiens
gatcttctgaaatgaa

SEQ ID NO: 2782817 - DNA, 16 bp, Homo sapiens
gatctttgcagacagg

SEQ ID NO: 2782818 - DNA, 16 bp, Homo sapiens
gatcttttcaagttaa

SEQ ID NO: 2782819 - DNA, 19 bp, Homo sapiens
gatctttttgtgaaattca

SEQ ID NO: 2782820 - DNA, 14 bp, Homo sapiens
gatgaaagaggagg

SEQ ID NO: 2782821 - DNA, 21 bp, Homo sapiens
gatgaaatgaggtcagagcct

SEQ ID NO: 2782822 - DNA, 12 bp, Homo sapiens
gatgacagctct

SEQ ID NO: 2782823 - DNA, 20 bp, Homo sapiens
gatgagattccctctcctcc

SEQ ID NO: 2782824 - DNA, 14 bp, Homo sapiens
gatgagggcagcag

SEQ ID NO: 2782825 - DNA, 15 bp, Homo sapiens
gatgagggcagcagc

SEQ ID NO: 2782826 - DNA, 20 bp, Homo sapiens
gatgagggcagcagccagcc

SEQ ID NO: 2782827 - DNA, 20 bp, Homo sapiens
gatgatcagctgtttgtcat

SEQ ID NO: 2782828 - DNA, 21 bp, Homo sapiens
gatgatctttgcagacaggca

SEQ ID NO: 2782829 - DNA, 20 bp, Homo sapiens
gatgatttgctatcaaaata

SEQ ID NO: 2782830 - DNA, 13 bp, Homo sapiens
gatgcaccagccc

SEQ ID NO: 2782831 - DNA, 19 bp, Homo sapiens
gatgccaaaaaaaaataca

SEQ ID NO: 2782832 - DNA, 23 bp, Homo sapiens
gatgccagccgggtacctcagtt

SEQ ID NO: 2782833 - DNA, 13 bp, Homo sapiens
gatgcctccaccg

SEQ ID NO: 2782834 - DNA, 17 bp, Homo sapiens
gatgcctggtggcagct

SEQ ID NO: 2782835 - DNA, 16 bp, Homo sapiens
gatgctgcctgagtca

SEQ ID NO: 2782836 - DNA, 15 bp, Homo sapiens
gatggaaagaaagca

SEQ ID NO: 2782837 - DNA, 15 bp, Homo sapiens
gatggagagagggga

SEQ ID NO: 2782838 - DNA, 16 bp, Homo sapiens
gatggagcgcacctgc

SEQ ID NO: 2782839 - DNA, 19 bp, Homo sapiens
gatggagttcttgtgccat

SEQ ID NO: 2782840 - DNA, 15 bp, Homo sapiens
gatggatttgaagca

SEQ ID NO: 2782841 - DNA, 15 bp, Homo sapiens
gatggcaccagaggc

SEQ ID NO: 2782842 - DNA, 20 bp, Homo sapiens
gatgggcaacccccagcctg

SEQ ID NO: 2782843 - DNA, 14 bp, Homo sapiens
gatggggtgggcag

SEQ ID NO: 2782844 - DNA, 22 bp, Homo sapiens
gatgggtattaaacttgtcaga

SEQ ID NO: 2782845 - DNA, 13 bp, Homo sapiens
gatggtcctgggg

SEQ ID NO: 2782846 - DNA, 21 bp, Homo sapiens
gatggtcctggggctctgtgc

SEQ ID NO: 2782847 - DNA, 14 bp, Homo sapiens
gatggtgctcccct

SEQ ID NO: 2782848 - DNA, 19 bp, Homo sapiens
gatgtaaacagtgcctgct

SEQ ID NO: 2782849 - DNA, 19 bp, Homo sapiens
gatgtagggtaaggtgcct

SEQ ID NO: 2782850 - DNA, 18 bp, Homo sapiens
gatgtatttttgtaccct

SEQ ID NO: 2782851 - DNA, 17 bp, Homo sapiens
gatgtcccaacttgtaa

SEQ ID NO: 2782852 - DNA, 18 bp, Homo sapiens
gatgtcccaacttgtaaa

SEQ ID NO: 2782853 - DNA, 21 bp, Homo sapiens
gatgtgaattgcctgcagaga

SEQ ID NO: 2782854 - DNA, 23 bp, Homo sapiens
gatgtgaattgcctgcagagaga

SEQ ID NO: 2782855 - DNA, 17 bp, Homo sapiens
gatgtggagctcctgct

SEQ ID NO: 2782856 - DNA, 12 bp, Homo sapiens
gatgtggccctg

SEQ ID NO: 2782857 - DNA, 13 bp, Homo sapiens
gatgtggccctgg

SEQ ID NO: 2782858 - DNA, 20 bp, Homo sapiens
gatgtggccctggcctgctg

SEQ ID NO: 2782859 - DNA, 23 bp, Homo sapiens
gatgttacatcacagtgtttgca

SEQ ID NO: 2782860 - DNA, 16 bp, Homo sapiens
gatgttttagaatgat

SEQ ID NO: 2782861 - DNA, 21 bp, Homo sapiens
gatgttttgtcccatttcctt

SEQ ID NO: 2782862 - DNA, 16 bp, Homo sapiens
gatgtttttcatgaaa

SEQ ID NO: 2782863 - DNA, 14 bp, Homo sapiens
gattaaaggaagga

SEQ ID NO: 2782864 - DNA, 15 bp, Homo sapiens
gattaaaggaaggaa

SEQ ID NO: 2782865 - DNA, 23 bp, Homo sapiens
gattaatttgtgtagattgtgta

SEQ ID NO: 2782866 - DNA, 13 bp, Homo sapiens
gattacaagcgtg

SEQ ID NO: 2782867 - DNA, 21 bp, Homo sapiens
gattacaagcgtgagccactg

SEQ ID NO: 2782868 - DNA, 22 bp, Homo sapiens
gattacaagcgtgagccactgc

SEQ ID NO: 2782869 - DNA, 23 bp, Homo sapiens
gattacaagcgtgagccactgca

SEQ ID NO: 2782870 - DNA, 20 bp, Homo sapiens
gattacaggtgtgaaccacc

SEQ ID NO: 2782871 - DNA, 12 bp, Homo sapiens
gattagctctgg

SEQ ID NO: 2782872 - DNA, 13 bp, Homo sapiens
gattagctctgga

SEQ ID NO: 2782873 - DNA, 14 bp, Homo sapiens
gattagctctggac

SEQ ID NO: 2782874 - DNA, 19 bp, Homo sapiens
gcactcctctgtctctgct

SEQ ID NO: 2782875 - DNA, 21 bp, Homo sapiens
gcactctagcctggcaacaga

SEQ ID NO: 2782876 - DNA, 12 bp, Homo sapiens
gcactgacattg

SEQ ID NO: 2782877 - DNA, 15 bp, Homo sapiens
gcactgagatattta

SEQ ID NO: 2782878 - DNA, 17 bp, Homo sapiens
gcactgaggaccagcca

SEQ ID NO: 2782879 - DNA, 14 bp, Homo sapiens
gcactgagggccac

SEQ ID NO: 2782880 - DNA, 16 bp, Homo sapiens
gcactgccaggaggga

SEQ ID NO: 2782881 - DNA, 17 bp, Homo sapiens
gcactgccaggagggac

SEQ ID NO: 2782882 - DNA, 23 bp, Homo sapiens
gcactgccaggagggacaaagga

SEQ ID NO: 2782883 - DNA, 22 bp, Homo sapiens
gcactgcgtagagcctggaagg

SEQ ID NO: 2782884 - DNA, 20 bp, Homo sapiens
gcactgctaggcgagtgcca

SEQ ID NO: 2782885 - DNA, 18 bp, Homo sapiens
gcactgctgcccagcctc

SEQ ID NO: 2782886 - DNA, 20 bp, Homo sapiens
gcactgctgcccagcctcca

SEQ ID NO: 2782887 - DNA, 13 bp, Homo sapiens
gcactgctgtgtc

SEQ ID NO: 2782888 - DNA, 16 bp, Homo sapiens
gcactggagtgcaggg

SEQ ID NO: 2782889 - DNA, 16 bp, Homo sapiens
gcactgtatgctggac

SEQ ID NO: 2782890 - DNA, 21 bp, Homo sapiens
gcactgtgaagacccagcagg

SEQ ID NO: 2782891 - DNA, 14 bp, Homo sapiens
gcacttgcagactc

SEQ ID NO: 2782892 - DNA, 18 bp, Homo sapiens
gcacttggagacttgtat

SEQ ID NO: 2782893 - DNA, 21 bp, Homo sapiens
gcactttgggaggctgaggcg

SEQ ID NO: 2782894 - DNA, 18 bp, Homo sapiens
gcactttttaaaaagtac

SEQ ID NO: 2782895 - DNA, 20 bp, Homo sapiens
gcagaaaaaaaaaaagaaac

SEQ ID NO: 2782896 - DNA, 22 bp, Homo sapiens
gcagaaaacggagagtgcttgg

SEQ ID NO: 2782897 - DNA, 12 bp, Homo sapiens
gcagaaaagtgc

SEQ ID NO: 2782898 - DNA, 13 bp, Homo sapiens
gcagaaaagtgct

SEQ ID NO: 2782899 - DNA, 19 bp, Homo sapiens
gcagaaaagtgcttagaaa

SEQ ID NO: 2782900 - DNA, 18 bp, Homo sapiens
gcagaacagccgctcctg

SEQ ID NO: 2782901 - DNA, 21 bp, Homo sapiens
gcagaacgtattggtccagct

SEQ ID NO: 2782902 - DNA, 21 bp, Homo sapiens
gcagaagaattgaacccagga

SEQ ID NO: 2782903 - DNA, 14 bp, Homo sapiens
gcagaaggccaaga

SEQ ID NO: 2782904 - DNA, 15 bp, Homo sapiens
gcagaaggccaagaa

SEQ ID NO: 2782905 - DNA, 13 bp, Homo sapiens
gcagaagggagaa

SEQ ID NO: 2782906 - DNA, 14 bp, Homo sapiens
gcagacaggcaagc

SEQ ID NO: 2782907 - DNA, 19 bp, Homo sapiens
gcagacaggcaagcacctc

SEQ ID NO: 2782908 - DNA, 17 bp, Homo sapiens
gcagaccttttttagga

SEQ ID NO: 2782909 - DNA, 13 bp, Homo sapiens
gcagactcactgt

SEQ ID NO: 2782910 - DNA, 18 bp, Homo sapiens
gcagactctacagaggcc

SEQ ID NO: 2782911 - DNA, 22 bp, Homo sapiens
gcagactctacagaggccatgg

SEQ ID NO: 2782912 - DNA, 14 bp, Homo sapiens
gcagactgtggctg

SEQ ID NO: 2782913 - DNA, 22 bp, Homo sapiens
gcagagaaagaagagacaggag

SEQ ID NO: 2782914 - DNA, 12 bp, Homo sapiens
gcagagaaggct

SEQ ID NO: 2782915 - DNA, 20 bp, Homo sapiens
gcagagaatgaaagggccca

SEQ ID NO: 2782916 - DNA, 12 bp, Homo sapiens
gcagagacaata

SEQ ID NO: 2782917 - DNA, 16 bp, Homo sapiens
gcagagagaagcctgt

SEQ ID NO: 2782918 - DNA, 14 bp, Homo sapiens
gcagagcaggggca

SEQ ID NO: 2782919 - DNA, 16 bp, Homo sapiens
gcagagggcagaggct

SEQ ID NO: 2782920 - DNA, 19 bp, Homo sapiens
gcagagggcagaggctgga

SEQ ID NO: 2782921 - DNA, 16 bp, Homo sapiens
gcagaggggctttctg

SEQ ID NO: 2782922 - DNA, 19 bp, Homo sapiens
gcagaggggctttctggag

SEQ ID NO: 2782923 - DNA, 20 bp, Homo sapiens
gcagaggggctttctggaga

SEQ ID NO: 2782924 - DNA, 21 bp, Homo sapiens
gcagaggggctttctggagag

SEQ ID NO: 2782925 - DNA, 16 bp, Homo sapiens
gcagaggtgagcagag

SEQ ID NO: 2782926 - DNA, 22 bp, Homo sapiens
gcagagtgattcaggggctccc

SEQ ID NO: 2782927 - DNA, 19 bp, Homo sapiens
gcagataatcagcctctta

SEQ ID NO: 2782928 - DNA, 22 bp, Homo sapiens
gcagatacaggaaaagctgctg

SEQ ID NO: 2782929 - DNA, 15 bp, Homo sapiens
gcagatctttttgtg

SEQ ID NO: 2782930 - DNA, 23 bp, Homo sapiens
gcagatctttttgtgaaattcaa

SEQ ID NO: 2782931 - DNA, 13 bp, Homo sapiens
gcagatgtaggag

SEQ ID NO: 2782932 - DNA, 19 bp, Homo sapiens
gcagatgtaggagggactg

SEQ ID NO: 2782933 - DNA, 19 bp, Homo sapiens
gcagattcatttttctttc

SEQ ID NO: 2782934 - DNA, 20 bp, Homo sapiens
gcagattcatttttctttct

SEQ ID NO: 2782935 - DNA, 18 bp, Homo sapiens
gcagcactttaaccctct

SEQ ID NO: 2782936 - DNA, 21 bp, Homo sapiens
gcagcactttaaccctctctt

SEQ ID NO: 2782937 - DNA, 12 bp, Homo sapiens
gcagcagccagc

SEQ ID NO: 2782938 - DNA, 13 bp, Homo sapiens
gcagcagccagcc

SEQ ID NO: 2782939 - DNA, 17 bp, Homo sapiens
gcagcagccagccctgc

SEQ ID NO: 2782940 - DNA, 18 bp, Homo sapiens
gcagcagccagccctgcc

SEQ ID NO: 2782941 - DNA, 19 bp, Homo sapiens
gcagcagccagccctgcct

SEQ ID NO: 2782942 - DNA, 23 bp, Homo sapiens
gcagcagccagccctgcctggag

SEQ ID NO: 2782943 - DNA, 15 bp, Homo sapiens
gcagcatcttcaaac

SEQ ID NO: 2782944 - DNA, 21 bp, Homo sapiens
gcagccacacttctcaggaca

SEQ ID NO: 2782945 - DNA, 12 bp, Homo sapiens
gcagccaccctg

SEQ ID NO: 2782946 - DNA, 15 bp, Homo sapiens
gcagccagcccagcc

SEQ ID NO: 2782947 - DNA, 17 bp, Homo sapiens
gcagccagcccagccca

SEQ ID NO: 2782948 - DNA, 14 bp, Homo sapiens
gcagccagccctgc

SEQ ID NO: 2782949 - DNA, 19 bp, Homo sapiens
gcagccagccctgcctgga

SEQ ID NO: 2782950 - DNA, 22 bp, Homo sapiens
gcagccagccctgcctggagga

SEQ ID NO: 2782951 - DNA, 18 bp, Homo sapiens
gcagccagccggtgcctg

SEQ ID NO: 2782952 - DNA, 18 bp, Homo sapiens
gcagccagctctcagcca

SEQ ID NO: 2782953 - DNA, 19 bp, Homo sapiens
gcagccccattctgcctgc

SEQ ID NO: 2782954 - DNA, 21 bp, Homo sapiens
gcagccccattctgcctgccc

SEQ ID NO: 2782955 - DNA, 24 bp, Homo sapiens
gcagccccattctgcctgcccagg

SEQ ID NO: 2782956 - DNA, 15 bp, Homo sapiens
gcagccctcctcacc

SEQ ID NO: 2782957 - DNA, 20 bp, Homo sapiens
gcagcctcaacctcctgggc

SEQ ID NO: 2782958 - DNA, 22 bp, Homo sapiens
gcagcctccctctgacctgcag

SEQ ID NO: 2782959 - DNA, 22 bp, Homo sapiens
gcagcctggtagaattgggaag

SEQ ID NO: 2782960 - DNA, 15 bp, Homo sapiens
gcagcctttctgtgg

SEQ ID NO: 2782961 - DNA, 23 bp, Homo sapiens
gcagcctttctgtggagagtgag

SEQ ID NO: 2782962 - DNA, 17 bp, Homo sapiens
gcagctcagcctccccc

SEQ ID NO: 2782963 - DNA, 16 bp, Homo sapiens
gcagctcctctgtctc

SEQ ID NO: 2782964 - DNA, 19 bp, Homo sapiens
gccagagcctggggctcta

SEQ ID NO: 2782965 - DNA, 13 bp, Homo sapiens
gccagatttttta

SEQ ID NO: 2782966 - DNA, 21 bp, Homo sapiens
gccagcaatgatgtccagaag

SEQ ID NO: 2782967 - DNA, 12 bp, Homo sapiens
gccagcagccag

SEQ ID NO: 2782968 - DNA, 15 bp, Homo sapiens
gccagcagccagctc

SEQ ID NO: 2782969 - DNA, 18 bp, Homo sapiens
gccagcagccagctctca

SEQ ID NO: 2782970 - DNA, 12 bp, Homo sapiens
gccagccagcag

SEQ ID NO: 2782971 - DNA, 13 bp, Homo sapiens
gccagccagcagc

SEQ ID NO: 2782972 - DNA, 17 bp, Homo sapiens
gccagccctccctgtcc

SEQ ID NO: 2782973 - DNA, 15 bp, Homo sapiens
gccagccctgcctgg

SEQ ID NO: 2782974 - DNA, 18 bp, Homo sapiens
gccagccctgcctggagg

SEQ ID NO: 2782975 - DNA, 23 bp, Homo sapiens
gccagccggggcgagtggcacgt

SEQ ID NO: 2782976 - DNA, 20 bp, Homo sapiens
gccagccgggtacctcagtt

SEQ ID NO: 2782977 - DNA, 16 bp, Homo sapiens
gccagccggtgcctgg

SEQ ID NO: 2782978 - DNA, 21 bp, Homo sapiens
gccagccgtgatgctcaggct

SEQ ID NO: 2782979 - DNA, 16 bp, Homo sapiens
gccagcctggcctcct

SEQ ID NO: 2782980 - DNA, 19 bp, Homo sapiens
gccagcctggcttctggag

SEQ ID NO: 2782981 - DNA, 20 bp, Homo sapiens
gccagcctggcttctggagc

SEQ ID NO: 2782982 - DNA, 14 bp, Homo sapiens
gccagcgcctccct

SEQ ID NO: 2782983 - DNA, 20 bp, Homo sapiens
gccagcgcctccctccaccc

SEQ ID NO: 2782984 - DNA, 21 bp, Homo sapiens
gccagcgcctccctccacccc

SEQ ID NO: 2782985 - DNA, 17 bp, Homo sapiens
gccagctcctgggcagc

SEQ ID NO: 2782986 - DNA, 21 bp, Homo sapiens
gccagctcctgggcagcttga

SEQ ID NO: 2782987 - DNA, 17 bp, Homo sapiens
gccagctctctctaccc

SEQ ID NO: 2782988 - DNA, 19 bp, Homo sapiens
gccagctgcatctactcag

SEQ ID NO: 2782989 - DNA, 19 bp, Homo sapiens
gccaggagggacaaaggag

SEQ ID NO: 2782990 - DNA, 21 bp, Homo sapiens
gccaggagggacaaaggagcc

SEQ ID NO: 2782991 - DNA, 13 bp, Homo sapiens
gccaggccagagg

SEQ ID NO: 2782992 - DNA, 22 bp, Homo sapiens
gccaggccagagggagtgacag

SEQ ID NO: 2782993 - DNA, 16 bp, Homo sapiens
gccaggcccggggctg

SEQ ID NO: 2782994 - DNA, 19 bp, Homo sapiens
gccaggctagactaggagg

SEQ ID NO: 2782995 - DNA, 13 bp, Homo sapiens
gccagggcccctg

SEQ ID NO: 2782996 - DNA, 18 bp, Homo sapiens
gccaggggtctccctgga

SEQ ID NO: 2782997 - DNA, 17 bp, Homo sapiens
gccagggtcctgagtgg

SEQ ID NO: 2782998 - DNA, 15 bp, Homo sapiens
gccagggtgagagct

SEQ ID NO: 2782999 - DNA, 23 bp, Homo sapiens
gccagggtgagagctgctctgga

SEQ ID NO: 2783000 - DNA, 14 bp, Homo sapiens
gccaggtgcagtgg

SEQ ID NO: 2783001 - DNA, 19 bp, Homo sapiens
gccaggttatgcctcatgc

SEQ ID NO: 2783002 - DNA, 14 bp, Homo sapiens
gccagtctgggctg

SEQ ID NO: 2783003 - DNA, 15 bp, Homo sapiens
gccagtctgggctgc

SEQ ID NO: 2783004 - DNA, 19 bp, Homo sapiens
gccagtgccttacctcctg

SEQ ID NO: 2783005 - DNA, 22 bp, Homo sapiens
gccagtgccttacctcctgccc

SEQ ID NO: 2783006 - DNA, 23 bp, Homo sapiens
gccagtgccttacctcctgccca

SEQ ID NO: 2783007 - DNA, 24 bp, Homo sapiens
gccagtgtttagaagagcctgact

SEQ ID NO: 2783008 - DNA, 19 bp, Homo sapiens
gccatattctgttggccag

SEQ ID NO: 2783009 - DNA, 20 bp, Homo sapiens
gccatattctgttggccagt

SEQ ID NO: 2783010 - DNA, 15 bp, Homo sapiens
gccatcaagagactg

SEQ ID NO: 2783011 - DNA, 22 bp, Homo sapiens
gccatcagggtgggccactctc

SEQ ID NO: 2783012 - DNA, 21 bp, Homo sapiens
gccatctccaccctgagcctg

SEQ ID NO: 2783013 - DNA, 14 bp, Homo sapiens
gccatgctgaaggg

SEQ ID NO: 2783014 - DNA, 14 bp, Homo sapiens
gccatgcttcttgc

SEQ ID NO: 2783015 - DNA, 20 bp, Homo sapiens
gccatgcttcttgccccttg

SEQ ID NO: 2783016 - DNA, 22 bp, Homo sapiens
gccatgcttcttgccccttggg

SEQ ID NO: 2783017 - DNA, 23 bp, Homo sapiens
gccatgcttcttgccccttgggc

SEQ ID NO: 2783018 - DNA, 18 bp, Homo sapiens
gccatggacagaagaagg

SEQ ID NO: 2783019 - DNA, 16 bp, Homo sapiens
gccatggcgtgtccct

SEQ ID NO: 2783020 - DNA, 22 bp, Homo sapiens
gccatggcgtgtccctctcgga

SEQ ID NO: 2783021 - DNA, 15 bp, Homo sapiens
gccatgtcttgttca

SEQ ID NO: 2783022 - DNA, 14 bp, Homo sapiens
gccatgtgccaggt

SEQ ID NO: 2783023 - DNA, 22 bp, Homo sapiens
gccatgttggccaggctggtct

SEQ ID NO: 2783024 - DNA, 14 bp, Homo sapiens
gccattccaacagc

SEQ ID NO: 2783025 - DNA, 15 bp, Homo sapiens
gcccaaatggctctg

SEQ ID NO: 2783026 - DNA, 13 bp, Homo sapiens
gcccaacctcctg

SEQ ID NO: 2783027 - DNA, 14 bp, Homo sapiens
gcccaacctcctga

SEQ ID NO: 2783028 - DNA, 14 bp, Homo sapiens
gcccaacctgctct

SEQ ID NO: 2783029 - DNA, 21 bp, Homo sapiens
gcccaaggcagtgttcctcac

SEQ ID NO: 2783030 - DNA, 12 bp, Homo sapiens
gcccaatattat

SEQ ID NO: 2783031 - DNA, 22 bp, Homo sapiens
gcccaattcttacaaacatgtg

SEQ ID NO: 2783032 - DNA, 14 bp, Homo sapiens
gcccacagctccca

SEQ ID NO: 2783033 - DNA, 16 bp, Homo sapiens
gcccacagctcccacc

SEQ ID NO: 2783034 - DNA, 13 bp, Homo sapiens
gcccacaggatca

SEQ ID NO: 2783035 - DNA, 18 bp, Homo sapiens
gcccacaggatcagtctg

SEQ ID NO: 2783036 - DNA, 15 bp, Homo sapiens
gcccacatcccaggc

SEQ ID NO: 2783037 - DNA, 15 bp, Homo sapiens
gcccacgctggagtg

SEQ ID NO: 2783038 - DNA, 22 bp, Homo sapiens
gcccacgtgtgcagactgtggc

SEQ ID NO: 2783039 - DNA, 13 bp, Homo sapiens
gcccacttctgcc

SEQ ID NO: 2783040 - DNA, 18 bp, Homo sapiens
gcccagaattcccagctg

SEQ ID NO: 2783041 - DNA, 23 bp, Homo sapiens
gcccagaattcccagctgtctgt

SEQ ID NO: 2783042 - DNA, 14 bp, Homo sapiens
gcccagaattgcat

SEQ ID NO: 2783043 - DNA, 23 bp, Homo sapiens
gcccagagaccccttcctttcct

SEQ ID NO: 2783044 - DNA, 18 bp, Homo sapiens
gcccagagatgcctccac

SEQ ID NO: 2783045 - DNA, 16 bp, Homo sapiens
gcccagagggcccagg

SEQ ID NO: 2783046 - DNA, 14 bp, Homo sapiens
gcccagcactgtga

SEQ ID NO: 2783047 - DNA, 23 bp, Homo sapiens
gcccagccattaccatggagaca

SEQ ID NO: 2783048 - DNA, 14 bp, Homo sapiens
gcccagcccagctg

SEQ ID NO: 2783049 - DNA, 16 bp, Homo sapiens
gcccagcccagctggt

SEQ ID NO: 2783050 - DNA, 17 bp, Homo sapiens
gcccagcctcctcccac

SEQ ID NO: 2783051 - DNA, 15 bp, Homo sapiens
gcccagctgcacctg

SEQ ID NO: 2783052 - DNA, 17 bp, Homo sapiens
gcccagctggtgggaag

SEQ ID NO: 2783053 - DNA, 18 bp, Homo sapiens
gcccaggagagccagccc

SEQ ID NO: 2783054 - DNA, 15 bp, Homo sapiens
gcctgctcccagcag

SEQ ID NO: 2783055 - DNA, 17 bp, Homo sapiens
gcctgctcccagcagcc

SEQ ID NO: 2783056 - DNA, 20 bp, Homo sapiens
gcctgctcccagcagcccta

SEQ ID NO: 2783057 - DNA, 15 bp, Homo sapiens
gcctgctcccccacc

SEQ ID NO: 2783058 - DNA, 23 bp, Homo sapiens
gcctgctgaatgatttccaaaga

SEQ ID NO: 2783059 - DNA, 13 bp, Homo sapiens
gcctgctgctgag

SEQ ID NO: 2783060 - DNA, 15 bp, Homo sapiens
gcctgctgctgagaa

SEQ ID NO: 2783061 - DNA, 17 bp, Homo sapiens
gcctgctgctgagaacc

SEQ ID NO: 2783062 - DNA, 22 bp, Homo sapiens
gcctgctgctgagaacctggcc

SEQ ID NO: 2783063 - DNA, 23 bp, Homo sapiens
gcctgctgctgagaacctggcct

SEQ ID NO: 2783064 - DNA, 18 bp, Homo sapiens
gcctgctgggctctccac

SEQ ID NO: 2783065 - DNA, 23 bp, Homo sapiens
gcctgctgggctctccacctcag

SEQ ID NO: 2783066 - DNA, 24 bp, Homo sapiens
gcctgctgggctctccacctcagc

SEQ ID NO: 2783067 - DNA, 15 bp, Homo sapiens
gcctggaaattaaac

SEQ ID NO: 2783068 - DNA, 16 bp, Homo sapiens
gcctggaggacctgag

SEQ ID NO: 2783069 - DNA, 19 bp, Homo sapiens
gcctggaggacctgagcct

SEQ ID NO: 2783070 - DNA, 12 bp, Homo sapiens
gcctggatctcc

SEQ ID NO: 2783071 - DNA, 18 bp, Homo sapiens
gcctggcaagtgggtgaa

SEQ ID NO: 2783072 - DNA, 13 bp, Homo sapiens
gcctggcacacat

SEQ ID NO: 2783073 - DNA, 16 bp, Homo sapiens
gcctggcacacatcag

SEQ ID NO: 2783074 - DNA, 20 bp, Homo sapiens
gcctggccagatgcaccagc

SEQ ID NO: 2783075 - DNA, 21 bp, Homo sapiens
gcctggccagatgcaccagcc

SEQ ID NO: 2783076 - DNA, 15 bp, Homo sapiens
gcctggcccccctcc

SEQ ID NO: 2783077 - DNA, 20 bp, Homo sapiens
gcctggcccccctccaggca

SEQ ID NO: 2783078 - DNA, 16 bp, Homo sapiens
gcctggccccttctcc

SEQ ID NO: 2783079 - DNA, 14 bp, Homo sapiens
gcctggccggctcc

SEQ ID NO: 2783080 - DNA, 16 bp, Homo sapiens
gcctggcctggcacac

SEQ ID NO: 2783081 - DNA, 15 bp, Homo sapiens
gcctggctctcctgt

SEQ ID NO: 2783082 - DNA, 14 bp, Homo sapiens
gcctggctggctga

SEQ ID NO: 2783083 - DNA, 15 bp, Homo sapiens
gcctggctggctgag

SEQ ID NO: 2783084 - DNA, 16 bp, Homo sapiens
gcctggctggctgagg

SEQ ID NO: 2783085 - DNA, 18 bp, Homo sapiens
gcctggctggctgagggc

SEQ ID NO: 2783086 - DNA, 20 bp, Homo sapiens
gcctggctggctgagggcag

SEQ ID NO: 2783087 - DNA, 17 bp, Homo sapiens
gcctggcttctggagcc

SEQ ID NO: 2783088 - DNA, 18 bp, Homo sapiens
gcctggcttctggagccc

SEQ ID NO: 2783089 - DNA, 16 bp, Homo sapiens
gcctgggaccagggca

SEQ ID NO: 2783090 - DNA, 17 bp, Homo sapiens
gcctgggaccagggcat

SEQ ID NO: 2783091 - DNA, 19 bp, Homo sapiens
gcctgggcaacagagcaag

SEQ ID NO: 2783092 - DNA, 13 bp, Homo sapiens
gcctgggcagcat

SEQ ID NO: 2783093 - DNA, 19 bp, Homo sapiens
gcctgggcagcatagcaag

SEQ ID NO: 2783094 - DNA, 18 bp, Homo sapiens
gcctgggcctatggagag

SEQ ID NO: 2783095 - DNA, 21 bp, Homo sapiens
gcctgggcctatggagagccc

SEQ ID NO: 2783096 - DNA, 18 bp, Homo sapiens
gcctgggggcctggctgg

SEQ ID NO: 2783097 - DNA, 19 bp, Homo sapiens
gcctgggggcctggctggc

SEQ ID NO: 2783098 - DNA, 16 bp, Homo sapiens
gcctgggtggggctgc

SEQ ID NO: 2783099 - DNA, 23 bp, Homo sapiens
gcctgggtggggctgctcctcca

SEQ ID NO: 2783100 - DNA, 13 bp, Homo sapiens
gcctggtggcagc

SEQ ID NO: 2783101 - DNA, 15 bp, Homo sapiens
gcctggtggcagctg

SEQ ID NO: 2783102 - DNA, 17 bp, Homo sapiens
gcctggtggcagctgcg

SEQ ID NO: 2783103 - DNA, 19 bp, Homo sapiens
gcctggtggcagctgcggt

SEQ ID NO: 2783104 - DNA, 21 bp, Homo sapiens
gcctggtggcagctgcggtcc

SEQ ID NO: 2783105 - DNA, 13 bp, Homo sapiens
gcctggtgggcct

SEQ ID NO: 2783106 - DNA, 15 bp, Homo sapiens
gcctggtgggcctcc

SEQ ID NO: 2783107 - DNA, 17 bp, Homo sapiens
gcctgtaatcccagcac

SEQ ID NO: 2783108 - DNA, 18 bp, Homo sapiens
gcctgtaatcccagcagt

SEQ ID NO: 2783109 - DNA, 16 bp, Homo sapiens
gcctgtaatcccagct

SEQ ID NO: 2783110 - DNA, 14 bp, Homo sapiens
gcctgtactgcctg

SEQ ID NO: 2783111 - DNA, 19 bp, Homo sapiens
gcctgtactgcctgcttgg

SEQ ID NO: 2783112 - DNA, 20 bp, Homo sapiens
gcctgtagccccagtgacag

SEQ ID NO: 2783113 - DNA, 18 bp, Homo sapiens
gcctgtagttaggaaata

SEQ ID NO: 2783114 - DNA, 13 bp, Homo sapiens
gcctgtccccctg

SEQ ID NO: 2783115 - DNA, 14 bp, Homo sapiens
gcctgtctttcagc

SEQ ID NO: 2783116 - DNA, 20 bp, Homo sapiens
gcctgtctttcagcattcag

SEQ ID NO: 2783117 - DNA, 19 bp, Homo sapiens
gcctgtgaacccaggacaa

SEQ ID NO: 2783118 - DNA, 21 bp, Homo sapiens
gcctgtgaacccaggacaagc

SEQ ID NO: 2783119 - DNA, 15 bp, Homo sapiens
gcctgtgtagctgtg

SEQ ID NO: 2783120 - DNA, 14 bp, Homo sapiens
gcctgttcagctcc

SEQ ID NO: 2783121 - DNA, 19 bp, Homo sapiens
gcctgttcagctccagctc

SEQ ID NO: 2783122 - DNA, 20 bp, Homo sapiens
gcctgttcagctccagctca

SEQ ID NO: 2783123 - DNA, 23 bp, Homo sapiens
gcctgttcccattcttgcatggc

SEQ ID NO: 2783124 - DNA, 17 bp, Homo sapiens
gccttaattttcagtat

SEQ ID NO: 2783125 - DNA, 16 bp, Homo sapiens
gccttacctcctgccc

SEQ ID NO: 2783126 - DNA, 17 bp, Homo sapiens
gccttagaagtcacaca

SEQ ID NO: 2783127 - DNA, 20 bp, Homo sapiens
gccttagaagtcacacagta

SEQ ID NO: 2783128 - DNA, 20 bp, Homo sapiens
gccttcactccggtgtgcct

SEQ ID NO: 2783129 - DNA, 15 bp, Homo sapiens
gccttccataattat

SEQ ID NO: 2783130 - DNA, 23 bp, Homo sapiens
gccttctcctgcctacattccct

SEQ ID NO: 2783131 - DNA, 14 bp, Homo sapiens
gccttctctctctg

SEQ ID NO: 2783132 - DNA, 15 bp, Homo sapiens
gccttctctctctgg

SEQ ID NO: 2783133 - DNA, 16 bp, Homo sapiens
gccttctctgttcatt

SEQ ID NO: 2783134 - DNA, 20 bp, Homo sapiens
gccttcttattctcactcca

SEQ ID NO: 2783135 - DNA, 21 bp, Homo sapiens
gccttgccacatctgtgtctc

SEQ ID NO: 2783136 - DNA, 12 bp, Homo sapiens
gccttgcccaga

SEQ ID NO: 2783137 - DNA, 14 bp, Homo sapiens
gccttgcccagaga

SEQ ID NO: 2783138 - DNA, 22 bp, Homo sapiens
gccttggagcagaaagccaggg

SEQ ID NO: 2783139 - DNA, 21 bp, Homo sapiens
gccttggataatgctgttgcc

SEQ ID NO: 2783140 - DNA, 19 bp, Homo sapiens
gccttggtgtccacctggc

SEQ ID NO: 2783141 - DNA, 21 bp, Homo sapiens
gccttggtgtccacctggccc

SEQ ID NO: 2783142 - DNA, 12 bp, Homo sapiens
gccttgtgtaca

SEQ ID NO: 2783143 - DNA, 18 bp, Homo sapiens
gcctttccccagtgtggc

SEQ ID NO: 2783144 - DNA, 13 bp, Homo sapiens
gctgagccctggc

SEQ ID NO: 2783145 - DNA, 17 bp, Homo sapiens
gctgagctctgagaggc

SEQ ID NO: 2783146 - DNA, 18 bp, Homo sapiens
gctgagctctgagaggcc

SEQ ID NO: 2783147 - DNA, 18 bp, Homo sapiens
gctgaggatttcaagcct

SEQ ID NO: 2783148 - DNA, 14 bp, Homo sapiens
gctgaggcaattct

SEQ ID NO: 2783149 - DNA, 18 bp, Homo sapiens
gctgaggcaggagaattg

SEQ ID NO: 2783150 - DNA, 20 bp, Homo sapiens
gctgagggcagttcgcagcc

SEQ ID NO: 2783151 - DNA, 23 bp, Homo sapiens
gctgaggggggccgtgcccaggg

SEQ ID NO: 2783152 - DNA, 17 bp, Homo sapiens
gctgaggtgcccaggag

SEQ ID NO: 2783153 - DNA, 20 bp, Homo sapiens
gctgaggtgcccaggagaag

SEQ ID NO: 2783154 - DNA, 21 bp, Homo sapiens
gctgaggtgtcttaagccttt

SEQ ID NO: 2783155 - DNA, 23 bp, Homo sapiens
gctgagtcatgatctccctgccg

SEQ ID NO: 2783156 - DNA, 17 bp, Homo sapiens
gctgagtctgcagatga

SEQ ID NO: 2783157 - DNA, 17 bp, Homo sapiens
gctgagtgagccacaga

SEQ ID NO: 2783158 - DNA, 13 bp, Homo sapiens
gctgataatttta

SEQ ID NO: 2783159 - DNA, 15 bp, Homo sapiens
gctgataattttaaa

SEQ ID NO: 2783160 - DNA, 19 bp, Homo sapiens
gctgataattttaaattct

SEQ ID NO: 2783161 - DNA, 16 bp, Homo sapiens
gctgatcgtgctaaat

SEQ ID NO: 2783162 - DNA, 13 bp, Homo sapiens
gctgatttctagg

SEQ ID NO: 2783163 - DNA, 19 bp, Homo sapiens
gctgcacctgccagcctgg

SEQ ID NO: 2783164 - DNA, 16 bp, Homo sapiens
gctgcagaaggccaag

SEQ ID NO: 2783165 - DNA, 16 bp, Homo sapiens
gctgcaggaatcaaaa

SEQ ID NO: 2783166 - DNA, 22 bp, Homo sapiens
gctgcaggaatcaaaaattgaa

SEQ ID NO: 2783167 - DNA, 22 bp, Homo sapiens
gctgcagtcaacagttcaaaga

SEQ ID NO: 2783168 - DNA, 23 bp, Homo sapiens
gctgcagtcaacagttcaaagaa

SEQ ID NO: 2783169 - DNA, 17 bp, Homo sapiens
gctgcatatgagtcttt

SEQ ID NO: 2783170 - DNA, 22 bp, Homo sapiens
gctgcatctgggattcccacca

SEQ ID NO: 2783171 - DNA, 15 bp, Homo sapiens
gctgccaaattttgg

SEQ ID NO: 2783172 - DNA, 14 bp, Homo sapiens
gctgccccagcccc

SEQ ID NO: 2783173 - DNA, 21 bp, Homo sapiens
gctgccccgcttccccacaga

SEQ ID NO: 2783174 - DNA, 23 bp, Homo sapiens
gctgccccgggtccccagctccc

SEQ ID NO: 2783175 - DNA, 13 bp, Homo sapiens
gctgcccctgcag

SEQ ID NO: 2783176 - DNA, 21 bp, Homo sapiens
gctgcccgtcttcagcctagc

SEQ ID NO: 2783177 - DNA, 17 bp, Homo sapiens
gctgccgaccagagccc

SEQ ID NO: 2783178 - DNA, 15 bp, Homo sapiens
gctgccgcaccccag

SEQ ID NO: 2783179 - DNA, 15 bp, Homo sapiens
gctgcctgtagttag

SEQ ID NO: 2783180 - DNA, 20 bp, Homo sapiens
gctgcctgtagttaggaaat

SEQ ID NO: 2783181 - DNA, 14 bp, Homo sapiens
gctgcggtccaccc

SEQ ID NO: 2783182 - DNA, 22 bp, Homo sapiens
gctgcggtgtcactgggctacc

SEQ ID NO: 2783183 - DNA, 22 bp, Homo sapiens
gctgcgtttattaatgcctctc

SEQ ID NO: 2783184 - DNA, 14 bp, Homo sapiens
gctgctcctccagg

SEQ ID NO: 2783185 - DNA, 18 bp, Homo sapiens
gctgctcctccagggcca

SEQ ID NO: 2783186 - DNA, 23 bp, Homo sapiens
gctgctcctccagggccacgtgc

SEQ ID NO: 2783187 - DNA, 18 bp, Homo sapiens
gctgctcggggtgcacag

SEQ ID NO: 2783188 - DNA, 23 bp, Homo sapiens
gctgctctattgtagcatttctt

SEQ ID NO: 2783189 - DNA, 14 bp, Homo sapiens
gctgctctggaaaa

SEQ ID NO: 2783190 - DNA, 18 bp, Homo sapiens
gctgctgagaacctggcc

SEQ ID NO: 2783191 - DNA, 19 bp, Homo sapiens
gctgctgagaacctggcct

SEQ ID NO: 2783192 - DNA, 20 bp, Homo sapiens
gctgctgagaacctggcctt

SEQ ID NO: 2783193 - DNA, 19 bp, Homo sapiens
gctgctgtgtagctctgtc

SEQ ID NO: 2783194 - DNA, 20 bp, Homo sapiens
gctgctgtgtagctctgtcc

SEQ ID NO: 2783195 - DNA, 22 bp, Homo sapiens
gctgcttttgtctatgggactc

SEQ ID NO: 2783196 - DNA, 17 bp, Homo sapiens
gctggaattgctgctct

SEQ ID NO: 2783197 - DNA, 13 bp, Homo sapiens
gctggacaaccca

SEQ ID NO: 2783198 - DNA, 16 bp, Homo sapiens
gctggacaacccagaa

SEQ ID NO: 2783199 - DNA, 19 bp, Homo sapiens
gctggacaagaagctgcta

SEQ ID NO: 2783200 - DNA, 23 bp, Homo sapiens
gctggacctatgtcctaaggaca

SEQ ID NO: 2783201 - DNA, 23 bp, Homo sapiens
gctggagcctcggtggccatgct

SEQ ID NO: 2783202 - DNA, 13 bp, Homo sapiens
gctggaggcaggg

SEQ ID NO: 2783203 - DNA, 21 bp, Homo sapiens
gctggaggcagggccttgccc

SEQ ID NO: 2783204 - DNA, 15 bp, Homo sapiens
gctggagtgcagtga

SEQ ID NO: 2783205 - DNA, 17 bp, Homo sapiens
gctggagtgcagtgagc

SEQ ID NO: 2783206 - DNA, 20 bp, Homo sapiens
gctggatgagacttccaaac

SEQ ID NO: 2783207 - DNA, 12 bp, Homo sapiens
gctggcactccc

SEQ ID NO: 2783208 - DNA, 18 bp, Homo sapiens
gctggcagagaaggcttc

SEQ ID NO: 2783209 - DNA, 14 bp, Homo sapiens
gctggcagcactca

SEQ ID NO: 2783210 - DNA, 18 bp, Homo sapiens
gctggcagcactcagtga

SEQ ID NO: 2783211 - DNA, 23 bp, Homo sapiens
gctggcagctgtcattcaggacc

SEQ ID NO: 2783212 - DNA, 23 bp, Homo sapiens
gctggcctcccaataaagctgga

SEQ ID NO: 2783213 - DNA, 16 bp, Homo sapiens
gctggctcctccaggc

SEQ ID NO: 2783214 - DNA, 13 bp, Homo sapiens
gctggctgaaaat

SEQ ID NO: 2783215 - DNA, 17 bp, Homo sapiens
gctggctgttggctggg

SEQ ID NO: 2783216 - DNA, 19 bp, Homo sapiens
gctggctgttggctggggg

SEQ ID NO: 2783217 - DNA, 20 bp, Homo sapiens
gctggctgttggctgggggc

SEQ ID NO: 2783218 - DNA, 13 bp, Homo sapiens
gctgggactacag

SEQ ID NO: 2783219 - DNA, 18 bp, Homo sapiens
gctgggactacaggcacc

SEQ ID NO: 2783220 - DNA, 19 bp, Homo sapiens
gctgggactacaggtgtga

SEQ ID NO: 2783221 - DNA, 16 bp, Homo sapiens
gctgggagctctgcag

SEQ ID NO: 2783222 - DNA, 18 bp, Homo sapiens
gctgggcttcagtggcag

SEQ ID NO: 2783223 - DNA, 21 bp, Homo sapiens
gctgggcttctgtccaaggca

SEQ ID NO: 2783224 - DNA, 17 bp, Homo sapiens
gctggggcaagtccctg

SEQ ID NO: 2783225 - DNA, 16 bp, Homo sapiens
gctgggggaggcggca

SEQ ID NO: 2783226 - DNA, 23 bp, Homo sapiens
gctgggggaggcggcacattggc

SEQ ID NO: 2783227 - DNA, 19 bp, Homo sapiens
gctgggggcctcagtgcca

SEQ ID NO: 2783228 - DNA, 15 bp, Homo sapiens
gctggggtacaggtt

SEQ ID NO: 2783229 - DNA, 19 bp, Homo sapiens
gctggtcccactcagtcca

SEQ ID NO: 2783230 - DNA, 19 bp, Homo sapiens
gctggtgctgtggccaggg

SEQ ID NO: 2783231 - DNA, 14 bp, Homo sapiens
gctggtgtcacctg

SEQ ID NO: 2783232 - DNA, 15 bp, Homo sapiens
gctggttcagggttg

SEQ ID NO: 2783233 - DNA, 15 bp, Homo sapiens
gctggtttaatgttt

SEQ ID NO: 2783234 - DNA, 17 bp, Homo sapiens
ggactccccaggccagg

SEQ ID NO: 2783235 - DNA, 14 bp, Homo sapiens
ggactcctctgtcc

SEQ ID NO: 2783236 - DNA, 11 bp, Homo sapiens
ggactctgagg

SEQ ID NO: 2783237 - DNA, 15 bp, Homo sapiens
ggactctgcacatga

SEQ ID NO: 2783238 - DNA, 18 bp, Homo sapiens
ggactggaaccagggaga

SEQ ID NO: 2783239 - DNA, 22 bp, Homo sapiens
ggactggcgagtccagagagga

SEQ ID NO: 2783240 - DNA, 17 bp, Homo sapiens
ggacttaacggctccag

SEQ ID NO: 2783241 - DNA, 14 bp, Homo sapiens
ggacttggaagctc

SEQ ID NO: 2783242 - DNA, 13 bp, Homo sapiens
ggagaaaacactt

SEQ ID NO: 2783243 - DNA, 13 bp, Homo sapiens
ggagaaacagaga

SEQ ID NO: 2783244 - DNA, 15 bp, Homo sapiens
ggagaaacagagaca

SEQ ID NO: 2783245 - DNA, 19 bp, Homo sapiens
ggagaactttccatctgct

SEQ ID NO: 2783246 - DNA, 16 bp, Homo sapiens
ggagaagcagtgagcc

SEQ ID NO: 2783247 - DNA, 13 bp, Homo sapiens
ggagaagccgcag

SEQ ID NO: 2783248 - DNA, 15 bp, Homo sapiens
ggagaagctctgttt

SEQ ID NO: 2783249 - DNA, 16 bp, Homo sapiens
ggagaagctgatgctt

SEQ ID NO: 2783250 - DNA, 17 bp, Homo sapiens
ggagaaggaaggagact

SEQ ID NO: 2783251 - DNA, 12 bp, Homo sapiens
ggagaaggatct

SEQ ID NO: 2783252 - DNA, 20 bp, Homo sapiens
ggagaaggatctagaatgtg

SEQ ID NO: 2783253 - DNA, 16 bp, Homo sapiens
ggagaaggccgctgcc

SEQ ID NO: 2783254 - DNA, 22 bp, Homo sapiens
ggagaaggccgctgccccagcc

SEQ ID NO: 2783255 - DNA, 17 bp, Homo sapiens
ggagaatcaataaaaat

SEQ ID NO: 2783256 - DNA, 12 bp, Homo sapiens
ggagacagcgaa

SEQ ID NO: 2783257 - DNA, 18 bp, Homo sapiens
ggagacagtgatctccat

SEQ ID NO: 2783258 - DNA, 15 bp, Homo sapiens
ggagaccagctcaga

SEQ ID NO: 2783259 - DNA, 16 bp, Homo sapiens
ggagactaagccctgt

SEQ ID NO: 2783260 - DNA, 17 bp, Homo sapiens
ggagactatgtgtcatg

SEQ ID NO: 2783261 - DNA, 17 bp, Homo sapiens
ggagactcacctctgcc

SEQ ID NO: 2783262 - DNA, 13 bp, Homo sapiens
ggagactctgtgg

SEQ ID NO: 2783263 - DNA, 20 bp, Homo sapiens
ggagactctgtggggccttg

SEQ ID NO: 2783264 - DNA, 14 bp, Homo sapiens
ggagagaggggaat

SEQ ID NO: 2783265 - DNA, 17 bp, Homo sapiens
ggagagagttgaaccta

SEQ ID NO: 2783266 - DNA, 15 bp, Homo sapiens
ggagagccagccctc

SEQ ID NO: 2783267 - DNA, 12 bp, Homo sapiens
ggagagccctgg

SEQ ID NO: 2783268 - DNA, 14 bp, Homo sapiens
ggagagccctggga

SEQ ID NO: 2783269 - DNA, 22 bp, Homo sapiens
ggagagctaggagcaaagcctg

SEQ ID NO: 2783270 - DNA, 16 bp, Homo sapiens
ggagaggcgccctccc

SEQ ID NO: 2783271 - DNA, 14 bp, Homo sapiens
ggagagggtctgga

SEQ ID NO: 2783272 - DNA, 18 bp, Homo sapiens
ggagagggtctggagaag

SEQ ID NO: 2783273 - DNA, 20 bp, Homo sapiens
ggagagggtctggagaagca

SEQ ID NO: 2783274 - DNA, 17 bp, Homo sapiens
ggagagtacagtgagcc

SEQ ID NO: 2783275 - DNA, 21 bp, Homo sapiens
ggagatcagggcgacctgcac

SEQ ID NO: 2783276 - DNA, 20 bp, Homo sapiens
ggagatggaagttgcagtga

SEQ ID NO: 2783277 - DNA, 13 bp, Homo sapiens
ggagcagtgtctt

SEQ ID NO: 2783278 - DNA, 16 bp, Homo sapiens
ggagcatctgactcac

SEQ ID NO: 2783279 - DNA, 16 bp, Homo sapiens
ggagccccgaggcctt

SEQ ID NO: 2783280 - DNA, 18 bp, Homo sapiens
ggagcctcgcaacccgtg

SEQ ID NO: 2783281 - DNA, 17 bp, Homo sapiens
ggagcctgtgaacccag

SEQ ID NO: 2783282 - DNA, 18 bp, Homo sapiens
ggagcctgtgaacccagg

SEQ ID NO: 2783283 - DNA, 20 bp, Homo sapiens
ggagcctgtgaacccaggac

SEQ ID NO: 2783284 - DNA, 22 bp, Homo sapiens
ggagcctgtgaacccaggacaa

SEQ ID NO: 2783285 - DNA, 19 bp, Homo sapiens
ggagctacctgtgtggaca

SEQ ID NO: 2783286 - DNA, 23 bp, Homo sapiens
ggagctacctgtgtggacaggac

SEQ ID NO: 2783287 - DNA, 14 bp, Homo sapiens
ggagctgggaggaa

SEQ ID NO: 2783288 - DNA, 15 bp, Homo sapiens
ggagctgggaggaaa

SEQ ID NO: 2783289 - DNA, 13 bp, Homo sapiens
ggagcttccagtg

SEQ ID NO: 2783290 - DNA, 16 bp, Homo sapiens
ggagcttccagtgcat

SEQ ID NO: 2783291 - DNA, 14 bp, Homo sapiens
ggaggaagaagaca

SEQ ID NO: 2783292 - DNA, 19 bp, Homo sapiens
ggaggaagcaggttgaggg

SEQ ID NO: 2783293 - DNA, 13 bp, Homo sapiens
ggaggagaatgag

SEQ ID NO: 2783294 - DNA, 14 bp, Homo sapiens
ggaggagaccagct

SEQ ID NO: 2783295 - DNA, 19 bp, Homo sapiens
ggaggatcactggagccca

SEQ ID NO: 2783296 - DNA, 21 bp, Homo sapiens
ggaggatggagagaggggaat

SEQ ID NO: 2783297 - DNA, 13 bp, Homo sapiens
ggaggcagggcct

SEQ ID NO: 2783298 - DNA, 23 bp, Homo sapiens
ggaggccaccgggacagacctgg

SEQ ID NO: 2783299 - DNA, 12 bp, Homo sapiens
ggaggcggagag

SEQ ID NO: 2783300 - DNA, 12 bp, Homo sapiens
ggaggctgaggc

SEQ ID NO: 2783301 - DNA, 15 bp, Homo sapiens
ggaggctgaggcaga

SEQ ID NO: 2783302 - DNA, 16 bp, Homo sapiens
ggaggctgaggcagaa

SEQ ID NO: 2783303 - DNA, 22 bp, Homo sapiens
ggaggctgctcggggtgcacag

SEQ ID NO: 2783304 - DNA, 22 bp, Homo sapiens
ggaggctggtctccctccagct

SEQ ID NO: 2783305 - DNA, 19 bp, Homo sapiens
ggagggacaaaggagcctg

SEQ ID NO: 2783306 - DNA, 21 bp, Homo sapiens
ggagggcaagggccatgctga

SEQ ID NO: 2783307 - DNA, 13 bp, Homo sapiens
ggagggctctgag

SEQ ID NO: 2783308 - DNA, 18 bp, Homo sapiens
ggagggctctgaggcgcc

SEQ ID NO: 2783309 - DNA, 22 bp, Homo sapiens
ggagggtcgccacacccggctc

SEQ ID NO: 2783310 - DNA, 17 bp, Homo sapiens
ggaggtagctcccagca

SEQ ID NO: 2783311 - DNA, 19 bp, Homo sapiens
ggaggtcacattcaggaag

SEQ ID NO: 2783312 - DNA, 19 bp, Homo sapiens
ggaggtggaggttgcagtg

SEQ ID NO: 2783313 - DNA, 17 bp, Homo sapiens
ggaggtggcagccctgt

SEQ ID NO: 2783314 - DNA, 14 bp, Homo sapiens
ggagtagctgagct

SEQ ID NO: 2783315 - DNA, 16 bp, Homo sapiens
ggagtagctgagctca

SEQ ID NO: 2783316 - DNA, 17 bp, Homo sapiens
ggagtcccaaggaaagc

SEQ ID NO: 2783317 - DNA, 22 bp, Homo sapiens
ggagtcccaccttggctgcagg

SEQ ID NO: 2783318 - DNA, 21 bp, Homo sapiens
ggagtctccagtggttgctgt

SEQ ID NO: 2783319 - DNA, 23 bp, Homo sapiens
ggagtctgaggtcctgagcactg

SEQ ID NO: 2783320 - DNA, 19 bp, Homo sapiens
ggagtgacagaggcagccc

SEQ ID NO: 2783321 - DNA, 21 bp, Homo sapiens
ggagtgacagaggcagcccca

SEQ ID NO: 2783322 - DNA, 14 bp, Homo sapiens
ggagtgagctggtt

SEQ ID NO: 2783323 - DNA, 15 bp, Homo sapiens
ggagtgcagggagga

SEQ ID NO: 2783324 - DNA, 18 bp, Homo sapiens
ggagtgcagggaggagag

SEQ ID NO: 2783325 - DNA, 20 bp, Homo sapiens
ggcagcagccagccctgcct

SEQ ID NO: 2783326 - DNA, 22 bp, Homo sapiens
ggcagcagccagccctgcctgg

SEQ ID NO: 2783327 - DNA, 22 bp, Homo sapiens
ggcagcagctcagcctcccccc

SEQ ID NO: 2783328 - DNA, 20 bp, Homo sapiens
ggcagccacacttctcagga

SEQ ID NO: 2783329 - DNA, 14 bp, Homo sapiens
ggcagcccagcctc

SEQ ID NO: 2783330 - DNA, 19 bp, Homo sapiens
ggcagcccagcctctgtcc

SEQ ID NO: 2783331 - DNA, 22 bp, Homo sapiens
ggcagcccagcctctgtccctc

SEQ ID NO: 2783332 - DNA, 22 bp, Homo sapiens
ggcagccccattctgcctgccc

SEQ ID NO: 2783333 - DNA, 23 bp, Homo sapiens
ggcagccccattctgcctgccca

SEQ ID NO: 2783334 - DNA, 19 bp, Homo sapiens
ggcagcgggatctcgtatc

SEQ ID NO: 2783335 - DNA, 13 bp, Homo sapiens
ggcagctcctctg

SEQ ID NO: 2783336 - DNA, 21 bp, Homo sapiens
ggcagctcctctgtctcgagc

SEQ ID NO: 2783337 - DNA, 19 bp, Homo sapiens
ggcagctgcggtccaccca

SEQ ID NO: 2783338 - DNA, 23 bp, Homo sapiens
ggcagctggtctttattcctccc

SEQ ID NO: 2783339 - DNA, 14 bp, Homo sapiens
ggcagcttgagcct

SEQ ID NO: 2783340 - DNA, 14 bp, Homo sapiens
ggcaggaccaggac

SEQ ID NO: 2783341 - DNA, 15 bp, Homo sapiens
ggcaggcagggctct

SEQ ID NO: 2783342 - DNA, 16 bp, Homo sapiens
ggcaggctggctggcc

SEQ ID NO: 2783343 - DNA, 18 bp, Homo sapiens
ggcagggctctcctggct

SEQ ID NO: 2783344 - DNA, 13 bp, Homo sapiens
ggcagggctggga

SEQ ID NO: 2783345 - DNA, 15 bp, Homo sapiens
ggcaggggtgggaga

SEQ ID NO: 2783346 - DNA, 16 bp, Homo sapiens
ggcaggggtgggagag

SEQ ID NO: 2783347 - DNA, 21 bp, Homo sapiens
ggcagggtgggatggaggaga

SEQ ID NO: 2783348 - DNA, 23 bp, Homo sapiens
ggcaggtcttgaactcctggcct

SEQ ID NO: 2783349 - DNA, 16 bp, Homo sapiens
ggcagtccagccagct

SEQ ID NO: 2783350 - DNA, 21 bp, Homo sapiens
ggcagtgatggttgccaggac

SEQ ID NO: 2783351 - DNA, 14 bp, Homo sapiens
ggcagtgggagctg

SEQ ID NO: 2783352 - DNA, 20 bp, Homo sapiens
ggcagtggtaagctctggct

SEQ ID NO: 2783353 - DNA, 22 bp, Homo sapiens
ggcagtgtgtcacactgagctg

SEQ ID NO: 2783354 - DNA, 13 bp, Homo sapiens
ggcatcacagggc

SEQ ID NO: 2783355 - DNA, 17 bp, Homo sapiens
ggcatcacagggcagag

SEQ ID NO: 2783356 - DNA, 17 bp, Homo sapiens
ggcatctacacagcctg

SEQ ID NO: 2783357 - DNA, 22 bp, Homo sapiens
ggcatctgcaccctcgatgaag

SEQ ID NO: 2783358 - DNA, 15 bp, Homo sapiens
ggcatgaccatcctg

SEQ ID NO: 2783359 - DNA, 17 bp, Homo sapiens
ggcatgaccatcctgtc

SEQ ID NO: 2783360 - DNA, 22 bp, Homo sapiens
ggcatgcaccagtgccgcctgt

SEQ ID NO: 2783361 - DNA, 13 bp, Homo sapiens
ggcatgctggggc

SEQ ID NO: 2783362 - DNA, 14 bp, Homo sapiens
ggcatgctggggca

SEQ ID NO: 2783363 - DNA, 16 bp, Homo sapiens
ggcatgctggggcaag

SEQ ID NO: 2783364 - DNA, 14 bp, Homo sapiens
ggcatgcttaaata

SEQ ID NO: 2783365 - DNA, 20 bp, Homo sapiens
ggcatgttctctgaggacac

SEQ ID NO: 2783366 - DNA, 13 bp, Homo sapiens
ggcattcctgctt

SEQ ID NO: 2783367 - DNA, 16 bp, Homo sapiens
ggcatttcctgggtgg

SEQ ID NO: 2783368 - DNA, 23 bp, Homo sapiens
ggccaacatggtgaaaccctgta

SEQ ID NO: 2783369 - DNA, 15 bp, Homo sapiens
ggccaagctgaggtg

SEQ ID NO: 2783370 - DNA, 14 bp, Homo sapiens
ggccactccttcct

SEQ ID NO: 2783371 - DNA, 17 bp, Homo sapiens
ggccactccttcctgcc

SEQ ID NO: 2783372 - DNA, 20 bp, Homo sapiens
ggccactccttcctgcccca

SEQ ID NO: 2783373 - DNA, 19 bp, Homo sapiens
ggccactctcccctccctc

SEQ ID NO: 2783374 - DNA, 21 bp, Homo sapiens
ggccactctcccctccctctt

SEQ ID NO: 2783375 - DNA, 22 bp, Homo sapiens
ggccagagggagtgacagaggc

SEQ ID NO: 2783376 - DNA, 17 bp, Homo sapiens
ggccagatgcaccagcc

SEQ ID NO: 2783377 - DNA, 11 bp, Homo sapiens
ggccagcctgg

SEQ ID NO: 2783378 - DNA, 13 bp, Homo sapiens
ggccagcctggcc

SEQ ID NO: 2783379 - DNA, 14 bp, Homo sapiens
ggccagcctggcct

SEQ ID NO: 2783380 - DNA, 20 bp, Homo sapiens
ggccagcctggcctcctgcc

SEQ ID NO: 2783381 - DNA, 20 bp, Homo sapiens
ggccagctgcatctactcag

SEQ ID NO: 2783382 - DNA, 19 bp, Homo sapiens
ggccaggagtttgagacca

SEQ ID NO: 2783383 - DNA, 15 bp, Homo sapiens
ggccaggccaccagg

SEQ ID NO: 2783384 - DNA, 16 bp, Homo sapiens
ggccagggccctgcag

SEQ ID NO: 2783385 - DNA, 17 bp, Homo sapiens
ggccatgcttcttgccc

SEQ ID NO: 2783386 - DNA, 19 bp, Homo sapiens
ggccatgcttcttgcccct

SEQ ID NO: 2783387 - DNA, 16 bp, Homo sapiens
ggccatgggcctcctg

SEQ ID NO: 2783388 - DNA, 20 bp, Homo sapiens
ggcccaaatccagtgtgcac

SEQ ID NO: 2783389 - DNA, 19 bp, Homo sapiens
ggcccaagagatgaagagt

SEQ ID NO: 2783390 - DNA, 14 bp, Homo sapiens
ggcccacagctccc

SEQ ID NO: 2783391 - DNA, 22 bp, Homo sapiens
ggcccagagctggaacactctc

SEQ ID NO: 2783392 - DNA, 12 bp, Homo sapiens
ggcccaggaatc

SEQ ID NO: 2783393 - DNA, 15 bp, Homo sapiens
ggcccaggcaggcca

SEQ ID NO: 2783394 - DNA, 14 bp, Homo sapiens
ggccccaccaccta

SEQ ID NO: 2783395 - DNA, 21 bp, Homo sapiens
ggccccagcactaaagcagtg

SEQ ID NO: 2783396 - DNA, 21 bp, Homo sapiens
ggccccatcagaggctggggg

SEQ ID NO: 2783397 - DNA, 12 bp, Homo sapiens
ggcccccacagg

SEQ ID NO: 2783398 - DNA, 17 bp, Homo sapiens
ggcccccacctggctca

SEQ ID NO: 2783399 - DNA, 16 bp, Homo sapiens
ggccccccgcagcacc

SEQ ID NO: 2783400 - DNA, 23 bp, Homo sapiens
ggcccccctccaggcatgctggc

SEQ ID NO: 2783401 - DNA, 19 bp, Homo sapiens
ggcccccgctggctcctcc

SEQ ID NO: 2783402 - DNA, 19 bp, Homo sapiens
ggccccgcttgtccagcgc

SEQ ID NO: 2783403 - DNA, 13 bp, Homo sapiens
ggcccctgccacc

SEQ ID NO: 2783404 - DNA, 13 bp, Homo sapiens
ggcccctgcccgg

SEQ ID NO: 2783405 - DNA, 14 bp, Homo sapiens
ggcccctgctggtt

SEQ ID NO: 2783406 - DNA, 18 bp, Homo sapiens
ggcccctgtgtgagttga

SEQ ID NO: 2783407 - DNA, 19 bp, Homo sapiens
ggccccttggcgggcagcc

SEQ ID NO: 2783408 - DNA, 14 bp, Homo sapiens
ggcccgagcagctg

SEQ ID NO: 2783409 - DNA, 18 bp, Homo sapiens
ggcccgagcagctgagca

SEQ ID NO: 2783410 - DNA, 22 bp, Homo sapiens
ggcccgagcagctgagcagggc

SEQ ID NO: 2783411 - DNA, 13 bp, Homo sapiens
ggcccgctttgcc

SEQ ID NO: 2783412 - DNA, 16 bp, Homo sapiens
ggcccgctttgcctgc

SEQ ID NO: 2783413 - DNA, 15 bp, Homo sapiens
ggccctctatttctc

SEQ ID NO: 2783414 - DNA, 21 bp, Homo sapiens
ggccctgagctcggtggaccc

SEQ ID NO: 2783415 - DNA, 23 bp, Homo sapiens
gggtaccttgaacactgggggag

SEQ ID NO: 2783416 - DNA, 23 bp, Homo sapiens
gggtacttgtggacacagctctt

SEQ ID NO: 2783417 - DNA, 12 bp, Homo sapiens
gggtcaaggaat

SEQ ID NO: 2783418 - DNA, 14 bp, Homo sapiens
gggtcaggagaggg

SEQ ID NO: 2783419 - DNA, 12 bp, Homo sapiens
gggtcaggctcc

SEQ ID NO: 2783420 - DNA, 13 bp, Homo sapiens
gggtccccagctc

SEQ ID NO: 2783421 - DNA, 17 bp, Homo sapiens
gggtccccagctcccca

SEQ ID NO: 2783422 - DNA, 17 bp, Homo sapiens
gggtccccatcatccca

SEQ ID NO: 2783423 - DNA, 22 bp, Homo sapiens
gggtccccatcatcccagctgc

SEQ ID NO: 2783424 - DNA, 20 bp, Homo sapiens
gggtcgtcaccacctctcct

SEQ ID NO: 2783425 - DNA, 14 bp, Homo sapiens
gggtctagggagag

SEQ ID NO: 2783426 - DNA, 12 bp, Homo sapiens
gggtctgaggaa

SEQ ID NO: 2783427 - DNA, 20 bp, Homo sapiens
gggtctgccaccatcctgct

SEQ ID NO: 2783428 - DNA, 18 bp, Homo sapiens
gggtgatgagggcagcag

SEQ ID NO: 2783429 - DNA, 18 bp, Homo sapiens
gggtgatgatgaccaaga

SEQ ID NO: 2783430 - DNA, 23 bp, Homo sapiens
gggtgcgagagaggtgggcagca

SEQ ID NO: 2783431 - DNA, 22 bp, Homo sapiens
gggtggatcaccagaggtcagg

SEQ ID NO: 2783432 - DNA, 19 bp, Homo sapiens
gggtggctactctgtgcca

SEQ ID NO: 2783433 - DNA, 14 bp, Homo sapiens
gggtgggagagccc

SEQ ID NO: 2783434 - DNA, 17 bp, Homo sapiens
gggtgggatggaggaga

SEQ ID NO: 2783435 - DNA, 15 bp, Homo sapiens
gggtgggcagggctg

SEQ ID NO: 2783436 - DNA, 15 bp, Homo sapiens
gggtgggccactctc

SEQ ID NO: 2783437 - DNA, 13 bp, Homo sapiens
gggttcagcccct

SEQ ID NO: 2783438 - DNA, 16 bp, Homo sapiens
gggttcagcccctcct

SEQ ID NO: 2783439 - DNA, 16 bp, Homo sapiens
gggttctttcttcctc

SEQ ID NO: 2783440 - DNA, 17 bp, Homo sapiens
gggttctttcttcctct

SEQ ID NO: 2783441 - DNA, 19 bp, Homo sapiens
gggttctttcttcctctgc

SEQ ID NO: 2783442 - DNA, 16 bp, Homo sapiens
gggttctttggaagga

SEQ ID NO: 2783443 - DNA, 16 bp, Homo sapiens
gggttggcccctgccc

SEQ ID NO: 2783444 - DNA, 16 bp, Homo sapiens
gggttttccaccctgg

SEQ ID NO: 2783445 - DNA, 23 bp, Homo sapiens
ggtaaaagtgtgagcagtgagtt

SEQ ID NO: 2783446 - DNA, 13 bp, Homo sapiens
ggtaaaatacttc

SEQ ID NO: 2783447 - DNA, 14 bp, Homo sapiens
ggtaacaggcagat

SEQ ID NO: 2783448 - DNA, 20 bp, Homo sapiens
ggtaacaggcagatacagga

SEQ ID NO: 2783449 - DNA, 23 bp, Homo sapiens
ggtaagaagccgggaacagacaa

SEQ ID NO: 2783450 - DNA, 13 bp, Homo sapiens
ggtaaggtgcctt

SEQ ID NO: 2783451 - DNA, 13 bp, Homo sapiens
ggtacaagagcca

SEQ ID NO: 2783452 - DNA, 14 bp, Homo sapiens
ggtaccagctcact

SEQ ID NO: 2783453 - DNA, 19 bp, Homo sapiens
ggtaccagctcactccctg

SEQ ID NO: 2783454 - DNA, 11 bp, Homo sapiens
ggtacccactg

SEQ ID NO: 2783455 - DNA, 16 bp, Homo sapiens
ggtacccactgctctg

SEQ ID NO: 2783456 - DNA, 20 bp, Homo sapiens
ggtacctcagtttctccttt

SEQ ID NO: 2783457 - DNA, 16 bp, Homo sapiens
ggtacttgtggacaca

SEQ ID NO: 2783458 - DNA, 20 bp, Homo sapiens
ggtacttgtggacacagctc

SEQ ID NO: 2783459 - DNA, 11 bp, Homo sapiens
ggtagaacaca

SEQ ID NO: 2783460 - DNA, 15 bp, Homo sapiens
ggtagaatgtaaagc

SEQ ID NO: 2783461 - DNA, 13 bp, Homo sapiens
ggtagcccagcac

SEQ ID NO: 2783462 - DNA, 20 bp, Homo sapiens
ggtagcccagcactgtgaag

SEQ ID NO: 2783463 - DNA, 16 bp, Homo sapiens
ggtagctcccagcact

SEQ ID NO: 2783464 - DNA, 12 bp, Homo sapiens
ggtaggaaatgt

SEQ ID NO: 2783465 - DNA, 22 bp, Homo sapiens
ggtagtactcctgcaaaatttt

SEQ ID NO: 2783466 - DNA, 17 bp, Homo sapiens
ggtataatggttgactg

SEQ ID NO: 2783467 - DNA, 15 bp, Homo sapiens
ggtatcaagaaagtc

SEQ ID NO: 2783468 - DNA, 13 bp, Homo sapiens
ggtatctccagga

SEQ ID NO: 2783469 - DNA, 16 bp, Homo sapiens
ggtatctccaggattg

SEQ ID NO: 2783470 - DNA, 16 bp, Homo sapiens
ggtatgaacttgagga

SEQ ID NO: 2783471 - DNA, 21 bp, Homo sapiens
ggtatgaccttctaggaagct

SEQ ID NO: 2783472 - DNA, 14 bp, Homo sapiens
ggtatgagctgagg

SEQ ID NO: 2783473 - DNA, 14 bp, Homo sapiens
ggtattagaaagtg

SEQ ID NO: 2783474 - DNA, 19 bp, Homo sapiens
ggtattccttttgtgtaca

SEQ ID NO: 2783475 - DNA, 20 bp, Homo sapiens
ggtattttcgtgcatttgtg

SEQ ID NO: 2783476 - DNA, 21 bp, Homo sapiens
ggtattttcgtgcatttgtga

SEQ ID NO: 2783477 - DNA, 14 bp, Homo sapiens
ggtcaacagagaag

SEQ ID NO: 2783478 - DNA, 19 bp, Homo sapiens
ggtcaacggccctgtttat

SEQ ID NO: 2783479 - DNA, 17 bp, Homo sapiens
ggtcagagatgggctga

SEQ ID NO: 2783480 - DNA, 19 bp, Homo sapiens
ggtcagagatgggctgaac

SEQ ID NO: 2783481 - DNA, 13 bp, Homo sapiens
ggtcagagcctgc

SEQ ID NO: 2783482 - DNA, 14 bp, Homo sapiens
ggtcagagcctgca

SEQ ID NO: 2783483 - DNA, 12 bp, Homo sapiens
ggtcagccaggg

SEQ ID NO: 2783484 - DNA, 22 bp, Homo sapiens
ggtcaggagaggggcagaacag

SEQ ID NO: 2783485 - DNA, 19 bp, Homo sapiens
ggtcaggcggggtgctgtg

SEQ ID NO: 2783486 - DNA, 22 bp, Homo sapiens
ggtcatcgattcaaactgctcc

SEQ ID NO: 2783487 - DNA, 23 bp, Homo sapiens
ggtcatcgattcaaactgctcca

SEQ ID NO: 2783488 - DNA, 12 bp, Homo sapiens
ggtccacccagg

SEQ ID NO: 2783489 - DNA, 17 bp, Homo sapiens
ggtccacccaggagccc

SEQ ID NO: 2783490 - DNA, 22 bp, Homo sapiens
ggtccacccaggagccccgagg

SEQ ID NO: 2783491 - DNA, 14 bp, Homo sapiens
ggtccagctcttgg

SEQ ID NO: 2783492 - DNA, 17 bp, Homo sapiens
ggtccagcttgctcttc

SEQ ID NO: 2783493 - DNA, 13 bp, Homo sapiens
ggtccagggttga

SEQ ID NO: 2783494 - DNA, 14 bp, Homo sapiens
ggtcccaggcagag

SEQ ID NO: 2783495 - DNA, 13 bp, Homo sapiens
ggtccccagctcc

SEQ ID NO: 2783496 - DNA, 14 bp, Homo sapiens
ggtccccagctccc

SEQ ID NO: 2783497 - DNA, 17 bp, Homo sapiens
ggtccccagctccccag

SEQ ID NO: 2783498 - DNA, 21 bp, Homo sapiens
ggtccccatcatcccagctgc

SEQ ID NO: 2783499 - DNA, 12 bp, Homo sapiens
ggtccctgccag

SEQ ID NO: 2783500 - DNA, 21 bp, Homo sapiens
ggtcctctgatacccagagca

SEQ ID NO: 2783501 - DNA, 15 bp, Homo sapiens
ggtcctgagcactgc

SEQ ID NO: 2783502 - DNA, 18 bp, Homo sapiens
ggtcctgagcactgccag

SEQ ID NO: 2783503 - DNA, 13 bp, Homo sapiens
ggtcctgagtggc

SEQ ID NO: 2783504 - DNA, 16 bp, Homo sapiens
ggtcctgagtggctga

SEQ ID NO: 2783505 - DNA, 23 bp, Homo sapiens
ggtcctgcaatctccagggctgc

SEQ ID NO: 2783506 - DNA, 12 bp, Homo sapiens
gtatttattgtc

SEQ ID NO: 2783507 - DNA, 18 bp, Homo sapiens
gtatttgttaatttagaa

SEQ ID NO: 2783508 - DNA, 23 bp, Homo sapiens
gtatttgttaatttagaaaactt

SEQ ID NO: 2783509 - DNA, 16 bp, Homo sapiens
gtatttgttcccaaga

SEQ ID NO: 2783510 - DNA, 23 bp, Homo sapiens
gtattttccatacacatccccag

SEQ ID NO: 2783511 - DNA, 19 bp, Homo sapiens
gtattttcgtgcatttgtg

SEQ ID NO: 2783512 - DNA, 16 bp, Homo sapiens
gtattttcttcccatt

SEQ ID NO: 2783513 - DNA, 19 bp, Homo sapiens
gtattttcttcccatttgt

SEQ ID NO: 2783514 - DNA, 14 bp, Homo sapiens
gtattttgagataa

SEQ ID NO: 2783515 - DNA, 13 bp, Homo sapiens
gtatttttagaga

SEQ ID NO: 2783516 - DNA, 14 bp, Homo sapiens
gtatttttagagat

SEQ ID NO: 2783517 - DNA, 18 bp, Homo sapiens
gtatttttagagattaat

SEQ ID NO: 2783518 - DNA, 15 bp, Homo sapiens
gtcaaaacagattgt

SEQ ID NO: 2783519 - DNA, 18 bp, Homo sapiens
gtcaaaatagtgccacta

SEQ ID NO: 2783520 - DNA, 17 bp, Homo sapiens
gtcaaaatcatgaatat

SEQ ID NO: 2783521 - DNA, 16 bp, Homo sapiens
gtcaaaccataaactt

SEQ ID NO: 2783522 - DNA, 19 bp, Homo sapiens
gtcaacacttaagggtttt

SEQ ID NO: 2783523 - DNA, 22 bp, Homo sapiens
gtcaacacttaagggttttaga

SEQ ID NO: 2783524 - DNA, 19 bp, Homo sapiens
gtcaacagagaaggcagga

SEQ ID NO: 2783525 - DNA, 23 bp, Homo sapiens
gtcaacagagaaggcaggaatgt

SEQ ID NO: 2783526 - DNA, 17 bp, Homo sapiens
gtcaacagttcaaagaa

SEQ ID NO: 2783527 - DNA, 14 bp, Homo sapiens
gtcaaccaggaaca

SEQ ID NO: 2783528 - DNA, 19 bp, Homo sapiens
gtcaacggccctgtttata

SEQ ID NO: 2783529 - DNA, 19 bp, Homo sapiens
gtcaagagggtctgaggaa

SEQ ID NO: 2783530 - DNA, 14 bp, Homo sapiens
gtcaagtataaagt

SEQ ID NO: 2783531 - DNA, 20 bp, Homo sapiens
gtcaatattaaatacagaca

SEQ ID NO: 2783532 - DNA, 22 bp, Homo sapiens
gtcaatattaaatacagacact

SEQ ID NO: 2783533 - DNA, 16 bp, Homo sapiens
gtcaatcccctcattc

SEQ ID NO: 2783534 - DNA, 17 bp, Homo sapiens
gtcaatcccctcattca

SEQ ID NO: 2783535 - DNA, 17 bp, Homo sapiens
gtcaatgaaatatttgc

SEQ ID NO: 2783536 - DNA, 22 bp, Homo sapiens
gtcaatgaaatatttgcttatt

SEQ ID NO: 2783537 - DNA, 13 bp, Homo sapiens
gtcacacagacac

SEQ ID NO: 2783538 - DNA, 14 bp, Homo sapiens
gtcacacagacaca

SEQ ID NO: 2783539 - DNA, 15 bp, Homo sapiens
gtcacacagacacac

SEQ ID NO: 2783540 - DNA, 21 bp, Homo sapiens
gtcacaccctccccattagta

SEQ ID NO: 2783541 - DNA, 18 bp, Homo sapiens
gtcacactgagctgggca

SEQ ID NO: 2783542 - DNA, 22 bp, Homo sapiens
gtcacactgttactccacagcg

SEQ ID NO: 2783543 - DNA, 18 bp, Homo sapiens
gtcacaggactctgcctc

SEQ ID NO: 2783544 - DNA, 15 bp, Homo sapiens
gtcaccaagcccagt

SEQ ID NO: 2783545 - DNA, 11 bp, Homo sapiens
gtcaccacctt

SEQ ID NO: 2783546 - DNA, 14 bp, Homo sapiens
gtcaccaccttccc

SEQ ID NO: 2783547 - DNA, 15 bp, Homo sapiens
gtcaccaccttccca

SEQ ID NO: 2783548 - DNA, 17 bp, Homo sapiens
gtcaccaccttcccagc

SEQ ID NO: 2783549 - DNA, 23 bp, Homo sapiens
gtcaccaggaatgttaaagtcag

SEQ ID NO: 2783550 - DNA, 19 bp, Homo sapiens
gtcaccgtggaccttcctg

SEQ ID NO: 2783551 - DNA, 20 bp, Homo sapiens
gtcaccgtggaccttcctgc

SEQ ID NO: 2783552 - DNA, 14 bp, Homo sapiens
gtcactactcacag

SEQ ID NO: 2783553 - DNA, 15 bp, Homo sapiens
gtcactagcagctgc

SEQ ID NO: 2783554 - DNA, 19 bp, Homo sapiens
gtcactgaccctggagcgg

SEQ ID NO: 2783555 - DNA, 21 bp, Homo sapiens
gtcactggtagaccaaaataa

SEQ ID NO: 2783556 - DNA, 17 bp, Homo sapiens
gtcactgttccttgtca

SEQ ID NO: 2783557 - DNA, 20 bp, Homo sapiens
gtcacttacctagatttaca

SEQ ID NO: 2783558 - DNA, 15 bp, Homo sapiens
gtcacttatttcata

SEQ ID NO: 2783559 - DNA, 16 bp, Homo sapiens
gtcacttatttcataa

SEQ ID NO: 2783560 - DNA, 15 bp, Homo sapiens
gtcagactgctggga

SEQ ID NO: 2783561 - DNA, 14 bp, Homo sapiens
gtcagactggctgg

SEQ ID NO: 2783562 - DNA, 22 bp, Homo sapiens
gtcagactggctggctgcagtg

SEQ ID NO: 2783563 - DNA, 15 bp, Homo sapiens
gtcagagcctgcagt

SEQ ID NO: 2783564 - DNA, 18 bp, Homo sapiens
gtcagatgggaagacatg

SEQ ID NO: 2783565 - DNA, 18 bp, Homo sapiens
gtcagccacacctgtcag

SEQ ID NO: 2783566 - DNA, 16 bp, Homo sapiens
gtcagccagggccagg

SEQ ID NO: 2783567 - DNA, 18 bp, Homo sapiens
gtcaggcggggtgctgtg

SEQ ID NO: 2783568 - DNA, 18 bp, Homo sapiens
gtcaggtggggcagcttg

SEQ ID NO: 2783569 - DNA, 18 bp, Homo sapiens
gtcagttggagaaaatga

SEQ ID NO: 2783570 - DNA, 13 bp, Homo sapiens
gtcatagaaatta

SEQ ID NO: 2783571 - DNA, 20 bp, Homo sapiens
gtcatatattcatgtaataa

SEQ ID NO: 2783572 - DNA, 21 bp, Homo sapiens
gtcatatattcatgtaataaa

SEQ ID NO: 2783573 - DNA, 23 bp, Homo sapiens
gtcatatattcatgtaataaatc

SEQ ID NO: 2783574 - DNA, 18 bp, Homo sapiens
gtcatatgtaggtgtctg

SEQ ID NO: 2783575 - DNA, 17 bp, Homo sapiens
gtcatattaaacttctg

SEQ ID NO: 2783576 - DNA, 23 bp, Homo sapiens
gtcatcaattaaaggcaaaggca

SEQ ID NO: 2783577 - DNA, 18 bp, Homo sapiens
gtcatcccgctcctgctg

SEQ ID NO: 2783578 - DNA, 19 bp, Homo sapiens
gtcatcccgctcctgctga

SEQ ID NO: 2783579 - DNA, 22 bp, Homo sapiens
gtcatcgattcaaactgctcca

SEQ ID NO: 2783580 - DNA, 12 bp, Homo sapiens
gtcatctcaggg

SEQ ID NO: 2783581 - DNA, 14 bp, Homo sapiens
gtcatgatctccct

SEQ ID NO: 2783582 - DNA, 19 bp, Homo sapiens
gtcatgatctccctgccgc

SEQ ID NO: 2783583 - DNA, 22 bp, Homo sapiens
gtcatgatctccctgccgcctc

SEQ ID NO: 2783584 - DNA, 15 bp, Homo sapiens
gtcatgatggcacca

SEQ ID NO: 2783585 - DNA, 14 bp, Homo sapiens
gtcattactgcctt

SEQ ID NO: 2783586 - DNA, 18 bp, Homo sapiens
gtcattcaagcctgtgaa

SEQ ID NO: 2783587 - DNA, 19 bp, Homo sapiens
gtcatttgagcagggctca

SEQ ID NO: 2783588 - DNA, 22 bp, Homo sapiens
gtccaaggaaacttgaatcaaa

SEQ ID NO: 2783589 - DNA, 16 bp, Homo sapiens
gtccacccaggagccc

SEQ ID NO: 2783590 - DNA, 17 bp, Homo sapiens
gtccagaagaatattca

SEQ ID NO: 2783591 - DNA, 19 bp, Homo sapiens
gtccagcaggtagtgggtg

SEQ ID NO: 2783592 - DNA, 23 bp, Homo sapiens
gtccagccagctcctgggcagct

SEQ ID NO: 2783593 - DNA, 17 bp, Homo sapiens
gtccagggcgggagtgg

SEQ ID NO: 2783594 - DNA, 16 bp, Homo sapiens
gtccaggtcctggtgg

SEQ ID NO: 2783595 - DNA, 21 bp, Homo sapiens
gtccaggtcctggtggggcag

SEQ ID NO: 2783596 - DNA, 18 bp, Homo sapiens
gtctccctaaaataaaaa

SEQ ID NO: 2783597 - DNA, 14 bp, Homo sapiens
gtctccctctcctg

SEQ ID NO: 2783598 - DNA, 18 bp, Homo sapiens
gtctccctctcctgccta

SEQ ID NO: 2783599 - DNA, 20 bp, Homo sapiens
gtctccctctcctgcctact

SEQ ID NO: 2783600 - DNA, 14 bp, Homo sapiens
gtctcctctctgag

SEQ ID NO: 2783601 - DNA, 23 bp, Homo sapiens
gtctcctcttaaaaaataaaaac

SEQ ID NO: 2783602 - DNA, 15 bp, Homo sapiens
gtctcctttgcactg

SEQ ID NO: 2783603 - DNA, 16 bp, Homo sapiens
gtctcctttgcactga

SEQ ID NO: 2783604 - DNA, 22 bp, Homo sapiens
gtctcctttgcactgagggcca

SEQ ID NO: 2783605 - DNA, 17 bp, Homo sapiens
gtctcgagcgccctgca

SEQ ID NO: 2783606 - DNA, 19 bp, Homo sapiens
gtctcgagcgccctgcaga

SEQ ID NO: 2783607 - DNA, 23 bp, Homo sapiens
gtctcgggtggctagtcagagag

SEQ ID NO: 2783608 - DNA, 11 bp, Homo sapiens
gtctctacatg

SEQ ID NO: 2783609 - DNA, 13 bp, Homo sapiens
gtctctccactgc

SEQ ID NO: 2783610 - DNA, 15 bp, Homo sapiens
gtctctctctctcta

SEQ ID NO: 2783611 - DNA, 12 bp, Homo sapiens
gtctctgagaac

SEQ ID NO: 2783612 - DNA, 19 bp, Homo sapiens
gtctctgctcttgcctgca

SEQ ID NO: 2783613 - DNA, 14 bp, Homo sapiens
gtctctgctgcatt

SEQ ID NO: 2783614 - DNA, 17 bp, Homo sapiens
gtctctgtccctcactg

SEQ ID NO: 2783615 - DNA, 11 bp, Homo sapiens
gtctcttcaga

SEQ ID NO: 2783616 - DNA, 17 bp, Homo sapiens
gtctctttaatcttcag

SEQ ID NO: 2783617 - DNA, 18 bp, Homo sapiens
gtctctttaatcttcagt

SEQ ID NO: 2783618 - DNA, 22 bp, Homo sapiens
gtctctttaatgtcacaggcag

SEQ ID NO: 2783619 - DNA, 23 bp, Homo sapiens
gtctctttaatgtcacaggcagg

SEQ ID NO: 2783620 - DNA, 23 bp, Homo sapiens
gtctgacaggcaatgctggctgt

SEQ ID NO: 2783621 - DNA, 14 bp, Homo sapiens
gtctgacccactgc

SEQ ID NO: 2783622 - DNA, 15 bp, Homo sapiens
gtctgagcaccccct

SEQ ID NO: 2783623 - DNA, 14 bp, Homo sapiens
gtctgaggtcctga

SEQ ID NO: 2783624 - DNA, 17 bp, Homo sapiens
gtctgaggtcctgagca

SEQ ID NO: 2783625 - DNA, 18 bp, Homo sapiens
gtctgaggtcctgagcac

SEQ ID NO: 2783626 - DNA, 22 bp, Homo sapiens
gtctgatttcaggatactctgt

SEQ ID NO: 2783627 - DNA, 17 bp, Homo sapiens
gtctgcacccaggggtg

SEQ ID NO: 2783628 - DNA, 18 bp, Homo sapiens
gtctgcagcccggcgcca

SEQ ID NO: 2783629 - DNA, 18 bp, Homo sapiens
gtctgccaccatcctgct

SEQ ID NO: 2783630 - DNA, 15 bp, Homo sapiens
gtctgccagccagca

SEQ ID NO: 2783631 - DNA, 23 bp, Homo sapiens
gtctgcccccgtcttctctccat

SEQ ID NO: 2783632 - DNA, 17 bp, Homo sapiens
gtctggagaagcagtga

SEQ ID NO: 2783633 - DNA, 20 bp, Homo sapiens
gtctgtatcggagacagtga

SEQ ID NO: 2783634 - DNA, 11 bp, Homo sapiens
gtctgtcatcc

SEQ ID NO: 2783635 - DNA, 15 bp, Homo sapiens
gtctgtcccaccagc

SEQ ID NO: 2783636 - DNA, 14 bp, Homo sapiens
gtctgtctgtctgt

SEQ ID NO: 2783637 - DNA, 21 bp, Homo sapiens
gtctgtgaattggaccatcct

SEQ ID NO: 2783638 - DNA, 13 bp, Homo sapiens
gtctgtgcagctg

SEQ ID NO: 2783639 - DNA, 13 bp, Homo sapiens
gtctgtggatttt

SEQ ID NO: 2783640 - DNA, 22 bp, Homo sapiens
gtctgtgttgcgtgtcgtgggt

SEQ ID NO: 2783641 - DNA, 21 bp, Homo sapiens
gtctgttccccatggccactt

SEQ ID NO: 2783642 - DNA, 22 bp, Homo sapiens
gtctgtttcaatgacctgtatt

SEQ ID NO: 2783643 - DNA, 23 bp, Homo sapiens
gtcttaagccttttgctcacaaa

SEQ ID NO: 2783644 - DNA, 17 bp, Homo sapiens
gtcttatggcgttgcag

SEQ ID NO: 2783645 - DNA, 14 bp, Homo sapiens
gtcttatttattat

SEQ ID NO: 2783646 - DNA, 13 bp, Homo sapiens
gtcttcagcctag

SEQ ID NO: 2783647 - DNA, 15 bp, Homo sapiens
gtcttcagcctagcc

SEQ ID NO: 2783648 - DNA, 13 bp, Homo sapiens
gtcttccataatg

SEQ ID NO: 2783649 - DNA, 17 bp, Homo sapiens
gtcttccataatgtata

SEQ ID NO: 2783650 - DNA, 18 bp, Homo sapiens
gtcttgaactcctggcct

SEQ ID NO: 2783651 - DNA, 17 bp, Homo sapiens
gtcttgcaatggcagcc

SEQ ID NO: 2783652 - DNA, 18 bp, Homo sapiens
gtcttgcaatggcagcct

SEQ ID NO: 2783653 - DNA, 20 bp, Homo sapiens
gtcttgcaatggcagccttg

SEQ ID NO: 2783654 - DNA, 14 bp, Homo sapiens
gtcttgccagccag

SEQ ID NO: 2783655 - DNA, 19 bp, Homo sapiens
gtcttgccagccagaagcc

SEQ ID NO: 2783656 - DNA, 13 bp, Homo sapiens
gtcttgcctgcca

SEQ ID NO: 2783657 - DNA, 14 bp, Homo sapiens
gtctttcagcattc

SEQ ID NO: 2783658 - DNA, 16 bp, Homo sapiens
gtctttctccaaagtt

SEQ ID NO: 2783659 - DNA, 13 bp, Homo sapiens
gtctttgaataaa

SEQ ID NO: 2783660 - DNA, 14 bp, Homo sapiens
gtctttgaataaag

SEQ ID NO: 2783661 - DNA, 21 bp, Homo sapiens
gtctttgaataaagtctgagt

SEQ ID NO: 2783662 - DNA, 23 bp, Homo sapiens
gtctttgaataaagtctgagtgg

SEQ ID NO: 2783663 - DNA, 16 bp, Homo sapiens
gtctttgtaatgtcac

SEQ ID NO: 2783664 - DNA, 18 bp, Homo sapiens
gtctttgtaatgtcacca

SEQ ID NO: 2783665 - DNA, 15 bp, Homo sapiens
gtctttttaagctta

SEQ ID NO: 2783666 - DNA, 20 bp, Homo sapiens
gtctttttaagcttatttaa

SEQ ID NO: 2783667 - DNA, 19 bp, Homo sapiens
gtgaaagatgcaagcacct

SEQ ID NO: 2783668 - DNA, 21 bp, Homo sapiens
gtgaaagtcagatgcccagag

SEQ ID NO: 2783669 - DNA, 13 bp, Homo sapiens
gtgaaagtgtaaa

SEQ ID NO: 2783670 - DNA, 15 bp, Homo sapiens
gtgaaagtgtaaaat

SEQ ID NO: 2783671 - DNA, 22 bp, Homo sapiens
gtgaaattcaacctgtgtctta

SEQ ID NO: 2783672 - DNA, 13 bp, Homo sapiens
gtgaacccaggac

SEQ ID NO: 2783673 - DNA, 12 bp, Homo sapiens
gtgaacctggag

SEQ ID NO: 2783674 - DNA, 16 bp, Homo sapiens
gtgaagacccagcagg

SEQ ID NO: 2783675 - DNA, 20 bp, Homo sapiens
gtgaaggaccctggctcttc

SEQ ID NO: 2783676 - DNA, 13 bp, Homo sapiens
gtgaagggcaccg

SEQ ID NO: 2783677 - DNA, 14 bp, Homo sapiens
gtgaagggcaccga

SEQ ID NO: 2783678 - DNA, 15 bp, Homo sapiens
gtgaatctaaaagct

SEQ ID NO: 2783679 - DNA, 18 bp, Homo sapiens
gtgacaacctttgtgtaa

SEQ ID NO: 2783680 - DNA, 19 bp, Homo sapiens
gtgacaacctttgtgtaat

SEQ ID NO: 2783681 - DNA, 15 bp, Homo sapiens
gtgacagaggcagcc

SEQ ID NO: 2783682 - DNA, 16 bp, Homo sapiens
gtgacagaggcagccc

SEQ ID NO: 2783683 - DNA, 19 bp, Homo sapiens
gtgacagaggcagccccat

SEQ ID NO: 2783684 - DNA, 22 bp, Homo sapiens
gtgacagagtgagactctgtct

SEQ ID NO: 2783685 - DNA, 23 bp, Homo sapiens
gtgacaggaagcccaaggcagtg

SEQ ID NO: 2783686 - DNA, 19 bp, Homo sapiens
gtgaccaagttataaatca

SEQ ID NO: 2783687 - DNA, 15 bp, Homo sapiens
gtgggctgcatctgg

SEQ ID NO: 2783688 - DNA, 23 bp, Homo sapiens
gtggggaagcaagacgtcctgga

SEQ ID NO: 2783689 - DNA, 13 bp, Homo sapiens
gtggggagacctg

SEQ ID NO: 2783690 - DNA, 17 bp, Homo sapiens
gtggggagacctggttg

SEQ ID NO: 2783691 - DNA, 13 bp, Homo sapiens
gtggggcagcttg

SEQ ID NO: 2783692 - DNA, 14 bp, Homo sapiens
gtggggccccagag

SEQ ID NO: 2783693 - DNA, 12 bp, Homo sapiens
gtggggctgctc

SEQ ID NO: 2783694 - DNA, 14 bp, Homo sapiens
gtgggggcggctgt

SEQ ID NO: 2783695 - DNA, 17 bp, Homo sapiens
gtggggtctccctctcc

SEQ ID NO: 2783696 - DNA, 19 bp, Homo sapiens
gtggggtctccctctcctg

SEQ ID NO: 2783697 - DNA, 14 bp, Homo sapiens
gtgggtcaaggaat

SEQ ID NO: 2783698 - DNA, 24 bp, Homo sapiens
gtgggtctgtaagaccttggtagg

SEQ ID NO: 2783699 - DNA, 16 bp, Homo sapiens
gtgggttttcttccca

SEQ ID NO: 2783700 - DNA, 16 bp, Homo sapiens
gtggtaccagctcact

SEQ ID NO: 2783701 - DNA, 22 bp, Homo sapiens
gtggtaccagctcactccctgg

SEQ ID NO: 2783702 - DNA, 12 bp, Homo sapiens
gtggtatgtgtg

SEQ ID NO: 2783703 - DNA, 23 bp, Homo sapiens
gtggtccagctcttggcccctgt

SEQ ID NO: 2783704 - DNA, 15 bp, Homo sapiens
gtggtcctgagacct

SEQ ID NO: 2783705 - DNA, 19 bp, Homo sapiens
gtggtgatcaattaaatgt

SEQ ID NO: 2783706 - DNA, 20 bp, Homo sapiens
gtggtggatctgtccaagga

SEQ ID NO: 2783707 - DNA, 18 bp, Homo sapiens
gtggtgggacagggaccc

SEQ ID NO: 2783708 - DNA, 16 bp, Homo sapiens
gtggtgggtgcctgta

SEQ ID NO: 2783709 - DNA, 22 bp, Homo sapiens
gtggtgggttctttggaaggag

SEQ ID NO: 2783710 - DNA, 20 bp, Homo sapiens
gtggttctaatatttttagc

SEQ ID NO: 2783711 - DNA, 15 bp, Homo sapiens
gtgtaaagaataaat

SEQ ID NO: 2783712 - DNA, 16 bp, Homo sapiens
gtgtaaagaataaatg

SEQ ID NO: 2783713 - DNA, 23 bp, Homo sapiens
gtgtaacactgcaagaagtcttg

SEQ ID NO: 2783714 - DNA, 19 bp, Homo sapiens
gtgtaacaggtctcctctt

SEQ ID NO: 2783715 - DNA, 18 bp, Homo sapiens
gtgtaattgagaaggaaa

SEQ ID NO: 2783716 - DNA, 19 bp, Homo sapiens
gtgtacaaagtagagaagt

SEQ ID NO: 2783717 - DNA, 20 bp, Homo sapiens
gtgtactatggctgtatttt

SEQ ID NO: 2783718 - DNA, 17 bp, Homo sapiens
gtgtagccttgcccgga

SEQ ID NO: 2783719 - DNA, 20 bp, Homo sapiens
gtgtagctgtgacctgctga

SEQ ID NO: 2783720 - DNA, 14 bp, Homo sapiens
gtgtatatgtatgt

SEQ ID NO: 2783721 - DNA, 14 bp, Homo sapiens
gtgtatgatccaag

SEQ ID NO: 2783722 - DNA, 22 bp, Homo sapiens
gtgtatgggtgtgtgtttgtgt

SEQ ID NO: 2783723 - DNA, 14 bp, Homo sapiens
gtgtcacctgaaga

SEQ ID NO: 2783724 - DNA, 23 bp, Homo sapiens
gtgtcactactcacagtctcttt

SEQ ID NO: 2783725 - DNA, 14 bp, Homo sapiens
gtgtcaggtggggc

SEQ ID NO: 2783726 - DNA, 20 bp, Homo sapiens
gtgtcatctaattaagggaa

SEQ ID NO: 2783727 - DNA, 18 bp, Homo sapiens
gtgtcatttatgaaaaga

SEQ ID NO: 2783728 - DNA, 13 bp, Homo sapiens
gtgtccacctggc

SEQ ID NO: 2783729 - DNA, 12 bp, Homo sapiens
gtgtccagcaca

SEQ ID NO: 2783730 - DNA, 13 bp, Homo sapiens
gtgtccctgcact

SEQ ID NO: 2783731 - DNA, 18 bp, Homo sapiens
gtgtccttgcacctgcat

SEQ ID NO: 2783732 - DNA, 19 bp, Homo sapiens
gtgtccttgcacctgcatc

SEQ ID NO: 2783733 - DNA, 15 bp, Homo sapiens
gtgtcgtagccaagg

SEQ ID NO: 2783734 - DNA, 17 bp, Homo sapiens
gtgtctaaaaacaccaa

SEQ ID NO: 2783735 - DNA, 21 bp, Homo sapiens
gtgtctcggagggattcccct

SEQ ID NO: 2783736 - DNA, 14 bp, Homo sapiens
gtgtctgcacccag

SEQ ID NO: 2783737 - DNA, 15 bp, Homo sapiens
gtgtcttccataatg

SEQ ID NO: 2783738 - DNA, 19 bp, Homo sapiens
gtgtcttgcaatggcagcc

SEQ ID NO: 2783739 - DNA, 18 bp, Homo sapiens
gtgtcttttttcactaca

SEQ ID NO: 2783740 - DNA, 23 bp, Homo sapiens
gtgtgaaccaccacacccagccc

SEQ ID NO: 2783741 - DNA, 13 bp, Homo sapiens
gtgtgaagaaatg

SEQ ID NO: 2783742 - DNA, 20 bp, Homo sapiens
gtgtgagtcaccaagcccag

SEQ ID NO: 2783743 - DNA, 18 bp, Homo sapiens
gtgtgcctgcagccccgc

SEQ ID NO: 2783744 - DNA, 12 bp, Homo sapiens
gtgtgctctgat

SEQ ID NO: 2783745 - DNA, 13 bp, Homo sapiens
gtgtgggaaggga

SEQ ID NO: 2783746 - DNA, 23 bp, Homo sapiens
gtgtggtgggttctttggaagga

SEQ ID NO: 2783747 - DNA, 22 bp, Homo sapiens
gtgtgtctgttcacttttcctc

SEQ ID NO: 2783748 - DNA, 14 bp, Homo sapiens
gtgtgttatttaaa

SEQ ID NO: 2783749 - DNA, 21 bp, Homo sapiens
gtgtgttgtctgtgcagctgc

SEQ ID NO: 2783750 - DNA, 15 bp, Homo sapiens
gtgttaatttttgat

SEQ ID NO: 2783751 - DNA, 16 bp, Homo sapiens
gtgttactaaagtcac

SEQ ID NO: 2783752 - DNA, 20 bp, Homo sapiens
gtgttataatgggtaatata

SEQ ID NO: 2783753 - DNA, 23 bp, Homo sapiens
gtgttccctgagaaacccaccag

SEQ ID NO: 2783754 - DNA, 22 bp, Homo sapiens
gtgttctgagtacttgatttca

SEQ ID NO: 2783755 - DNA, 17 bp, Homo sapiens
gtgttctttttaaaaag

SEQ ID NO: 2783756 - DNA, 21 bp, Homo sapiens
gtgttggctctgctggtcact

SEQ ID NO: 2783757 - DNA, 18 bp, Homo sapiens
gtgttgggaattgcatgc

SEQ ID NO: 2783758 - DNA, 14 bp, Homo sapiens
gtgttgtctgtgca

SEQ ID NO: 2783759 - DNA, 17 bp, Homo sapiens
gtgttgtctgtgcagct

SEQ ID NO: 2783760 - DNA, 12 bp, Homo sapiens
gtgtttcccata

SEQ ID NO: 2783761 - DNA, 20 bp, Homo sapiens
gtgtttggcaggagaatcaa

SEQ ID NO: 2783762 - DNA, 18 bp, Homo sapiens
gtgttttctgaataacat

SEQ ID NO: 2783763 - DNA, 14 bp, Homo sapiens
gttaaaatgtacac

SEQ ID NO: 2783764 - DNA, 17 bp, Homo sapiens
gttaactttaagactga

SEQ ID NO: 2783765 - DNA, 23 bp, Homo sapiens
gttaactttaagactgagcacct

SEQ ID NO: 2783766 - DNA, 17 bp, Homo sapiens
gttaagacttgacagtg

SEQ ID NO: 2783767 - DNA, 22 bp, Homo sapiens
gttaagggaaggaactctggct

SEQ ID NO: 2783768 - DNA, 24 bp, Homo sapiens
gttaataacttgtcctatgtcaat

SEQ ID NO: 2783769 - DNA, 21 bp, Homo sapiens
gttaataataagataatgatg

SEQ ID NO: 2783770 - DNA, 22 bp, Homo sapiens
gttaataataagataatgatga

SEQ ID NO: 2783771 - DNA, 16 bp, Homo sapiens
gttaatgaaaatgtca

SEQ ID NO: 2783772 - DNA, 18 bp, Homo sapiens
gttaatgatagctactgt

SEQ ID NO: 2783773 - DNA, 23 bp, Homo sapiens
gttaatgttgggatttatatcta

SEQ ID NO: 2783774 - DNA, 23 bp, Homo sapiens
gttaatttaaagttgtttgtgcc

SEQ ID NO: 2783775 - DNA, 19 bp, Homo sapiens
gttaatttagaaaacttta

SEQ ID NO: 2783776 - DNA, 12 bp, Homo sapiens
gttaatttttga

SEQ ID NO: 2783777 - DNA, 12 bp, Homo sapiens
gttgagacagag

SEQ ID NO: 2783778 - DNA, 13 bp, Homo sapiens
gttgagctgtttt

SEQ ID NO: 2783779 - DNA, 23 bp, Homo sapiens
gttgagggaacagacaggagaaa

SEQ ID NO: 2783780 - DNA, 17 bp, Homo sapiens
gttgaggggctcctgga

SEQ ID NO: 2783781 - DNA, 18 bp, Homo sapiens
gttgataaattccactgg

SEQ ID NO: 2783782 - DNA, 15 bp, Homo sapiens
gttgatgaggcctct

SEQ ID NO: 2783783 - DNA, 23 bp, Homo sapiens
gttgcaaggccgctgttcaccca

SEQ ID NO: 2783784 - DNA, 13 bp, Homo sapiens
gttgcaataaaat

SEQ ID NO: 2783785 - DNA, 16 bp, Homo sapiens
gttgcagtgagctgag

SEQ ID NO: 2783786 - DNA, 19 bp, Homo sapiens
gttgccatgaggcctttcc

SEQ ID NO: 2783787 - DNA, 14 bp, Homo sapiens
gttgcccaggcagg

SEQ ID NO: 2783788 - DNA, 15 bp, Homo sapiens
gttgcccaggcaggt

SEQ ID NO: 2783789 - DNA, 18 bp, Homo sapiens
gttgcccaggcaggtctt

SEQ ID NO: 2783790 - DNA, 15 bp, Homo sapiens
gttgcccaggctggc

SEQ ID NO: 2783791 - DNA, 16 bp, Homo sapiens
gttgcctaataaacat

SEQ ID NO: 2783792 - DNA, 22 bp, Homo sapiens
gttgctaagaagcgagcactga

SEQ ID NO: 2783793 - DNA, 23 bp, Homo sapiens
gttgctgatgaactcttaatcaa

SEQ ID NO: 2783794 - DNA, 23 bp, Homo sapiens
gttgctttaaagtacctgtagtg

SEQ ID NO: 2783795 - DNA, 21 bp, Homo sapiens
gttgcttttctaatcttgtta

SEQ ID NO: 2783796 - DNA, 14 bp, Homo sapiens
gttggaaccgtgtc

SEQ ID NO: 2783797 - DNA, 17 bp, Homo sapiens
gttggaccagaggaagc

SEQ ID NO: 2783798 - DNA, 17 bp, Homo sapiens
gttggacccgctctgga

SEQ ID NO: 2783799 - DNA, 13 bp, Homo sapiens
gttggccaggctg

SEQ ID NO: 2783800 - DNA, 13 bp, Homo sapiens
gttggcccctgcc

SEQ ID NO: 2783801 - DNA, 14 bp, Homo sapiens
gttggcccctgccc

SEQ ID NO: 2783802 - DNA, 20 bp, Homo sapiens
gttggcccctgcccggctgc

SEQ ID NO: 2783803 - DNA, 19 bp, Homo sapiens
gttggccgtggtccagctc

SEQ ID NO: 2783804 - DNA, 20 bp, Homo sapiens
gttggccgtggtccagctct

SEQ ID NO: 2783805 - DNA, 14 bp, Homo sapiens
gttgggagcactgg

SEQ ID NO: 2783806 - DNA, 13 bp, Homo sapiens
gttgggctggtgt

SEQ ID NO: 2783807 - DNA, 20 bp, Homo sapiens
gttgtaaatatttatgtaaa

SEQ ID NO: 2783808 - DNA, 15 bp, Homo sapiens
gttgtcaatattaaa

SEQ ID NO: 2783809 - DNA, 17 bp, Homo sapiens
gttgtcaatattaaata

SEQ ID NO: 2783810 - DNA, 23 bp, Homo sapiens
gttgtcaatattaaatacagaca

SEQ ID NO: 2783811 - DNA, 19 bp, Homo sapiens
gttgtggaaagcctctgct

SEQ ID NO: 2783812 - DNA, 14 bp, Homo sapiens
gttgtgtatagatg

SEQ ID NO: 2783813 - DNA, 20 bp, Homo sapiens
gttgtgttaacaatgcagta

SEQ ID NO: 2783814 - DNA, 17 bp, Homo sapiens
gttgttaatgaaaatgt

SEQ ID NO: 2783815 - DNA, 13 bp, Homo sapiens
gttgtttgtgcct

SEQ ID NO: 2783816 - DNA, 19 bp, Homo sapiens
gtttaaaaaaagtatatat

SEQ ID NO: 2783817 - DNA, 20 bp, Homo sapiens
gtttaaaaaaagtatatatt

SEQ ID NO: 2783818 - DNA, 14 bp, Homo sapiens
gtttaagtctctga

SEQ ID NO: 2783819 - DNA, 13 bp, Homo sapiens
gtttaatgttttg

SEQ ID NO: 2783820 - DNA, 22 bp, Homo sapiens
gtttacaaaaggcagccctttg

SEQ ID NO: 2783821 - DNA, 17 bp, Homo sapiens
gtttacaggtggacaca

SEQ ID NO: 2783822 - DNA, 14 bp, Homo sapiens
gtttacttcatgag

SEQ ID NO: 2783823 - DNA, 17 bp, Homo sapiens
gtttacttttcagggca

SEQ ID NO: 2783824 - DNA, 22 bp, Homo sapiens
gtttatggtattttcgtgcatt

SEQ ID NO: 2783825 - DNA, 18 bp, Homo sapiens
gtttattaacaaattatg

SEQ ID NO: 2783826 - DNA, 17 bp, Homo sapiens
gtttatttattctgcat

SEQ ID NO: 2783827 - DNA, 12 bp, Homo sapiens
gtttcaaaagtg

SEQ ID NO: 2783828 - DNA, 13 bp, Homo sapiens
gtttcactatgat

SEQ ID NO: 2783829 - DNA, 11 bp, Homo sapiens
gtttcattgac

SEQ ID NO: 2783830 - DNA, 21 bp, Homo sapiens
gtttccaaagggcagtaaagt

SEQ ID NO: 2783831 - DNA, 14 bp, Homo sapiens
gtttccagaaaata

SEQ ID NO: 2783832 - DNA, 16 bp, Homo sapiens
gtttccagaaaatata

SEQ ID NO: 2783833 - DNA, 22 bp, Homo sapiens
gtttccagaaaatataaatgca

SEQ ID NO: 2783834 - DNA, 13 bp, Homo sapiens
gtttctaaaacta

SEQ ID NO: 2783835 - DNA, 16 bp, Homo sapiens
gtttctcagaatccaa

SEQ ID NO: 2783836 - DNA, 14 bp, Homo sapiens
gtttctccccctgg

SEQ ID NO: 2783837 - DNA, 15 bp, Homo sapiens
gtttctccccctggg

SEQ ID NO: 2783838 - DNA, 18 bp, Homo sapiens
gtttctgaatgacatcaa

SEQ ID NO: 2783839 - DNA, 13 bp, Homo sapiens
gtttcttccaaag

SEQ ID NO: 2783840 - DNA, 22 bp, Homo sapiens
gtttcttgcctcatttttttcc

SEQ ID NO: 2783841 - DNA, 17 bp, Homo sapiens
gtttctttaagaaagta

SEQ ID NO: 2783842 - DNA, 19 bp, Homo sapiens
gtttgaatataaacactat

SEQ ID NO: 2783843 - DNA, 22 bp, Homo sapiens
gtttgagcgcagagtaaaataa

SEQ ID NO: 2783844 - DNA, 13 bp, Homo sapiens
gtttgagctcaga

SEQ ID NO: 2783845 - DNA, 15 bp, Homo sapiens
gtttgatttcattaa

SEQ ID NO: 2783846 - DNA, 22 bp, Homo sapiens
gtttgcagaaaagcacctgccg

SEQ ID NO: 2783847 - DNA, 20 bp, Homo sapiens
gtttgctttgcccttctttc

SEQ ID NO: 2783848 - DNA, 20 bp, Homo sapiens
gtttggatatgtaaaacatt

SEQ ID NO: 2783849 - DNA, 15 bp, Homo sapiens
gtttgtctgtcttca

SEQ ID NO: 2783850 - DNA, 20 bp, Homo sapiens
gtttgtttctccccctgggc

SEQ ID NO: 2783851 - DNA, 19 bp, Homo sapiens
gttttaactagaatttatt

SEQ ID NO: 2783852 - DNA, 13 bp, Homo sapiens
gttttagaaaaca

SEQ ID NO: 2783853 - DNA, 20 bp, Homo sapiens
gttttagctccttgactcct

SEQ ID NO: 2783854 - DNA, 10 bp, Homo sapiens
gttttctgat

SEQ ID NO: 2783855 - DNA, 22 bp, Homo sapiens
gttttgaactaataaaagcata

SEQ ID NO: 2783856 - DNA, 23 bp, Homo sapiens
gttttgaactaataaaagcataa

SEQ ID NO: 2783857 - DNA, 17 bp, Homo sapiens
gttttgctacataatta

SEQ ID NO: 2783858 - DNA, 21 bp, Homo sapiens
gttttgtcccatttccttgga

SEQ ID NO: 2783859 - DNA, 21 bp, Homo sapiens
gttttgtcctttgagaaagaa

SEQ ID NO: 2783860 - DNA, 21 bp, Homo sapiens
gtttttaacaactaatcaaga

SEQ ID NO: 2783861 - DNA, 14 bp, Homo sapiens
gtttttaagctgtt

SEQ ID NO: 2783862 - DNA, 19 bp, Homo sapiens
gtttttaagctgtttccat

SEQ ID NO: 2783863 - DNA, 21 bp, Homo sapiens
gtttttaagggtttgtggaaa

SEQ ID NO: 2783864 - DNA, 18 bp, Homo sapiens
gtttttaatgtatagtaa

SEQ ID NO: 2783865 - DNA, 21 bp, Homo sapiens
gtttttacctaccacagtgtc

SEQ ID NO: 2783866 - DNA, 22 bp, Homo sapiens
gtttttacctaccacagtgtct

SEQ ID NO: 2783867 - DNA, 14 bp, Homo sapiens
gtttttactccagt

SEQ ID NO: 2783868 - DNA, 19 bp, Homo sapiens
tatgtcttggacactgtac

SEQ ID NO: 2783869 - DNA, 21 bp, Homo sapiens
tatgtcttggacactgtacaa

SEQ ID NO: 2783870 - DNA, 16 bp, Homo sapiens
tatgtgaaagtgtaaa

SEQ ID NO: 2783871 - DNA, 22 bp, Homo sapiens
tatgtgaatatggactcagttt

SEQ ID NO: 2783872 - DNA, 22 bp, Homo sapiens
tatgtgaatgatctctctgaat

SEQ ID NO: 2783873 - DNA, 17 bp, Homo sapiens
tatgtgacaacctttgt

SEQ ID NO: 2783874 - DNA, 21 bp, Homo sapiens
tatgtgacaacctttgtgtaa

SEQ ID NO: 2783875 - DNA, 15 bp, Homo sapiens
tatgtgcctttttgt

SEQ ID NO: 2783876 - DNA, 13 bp, Homo sapiens
tatgtgtgtgtat

SEQ ID NO: 2783877 - DNA, 19 bp, Homo sapiens
tatgttaacctcagtgtca

SEQ ID NO: 2783878 - DNA, 22 bp, Homo sapiens
tatgttaacctcagtgtcattt

SEQ ID NO: 2783879 - DNA, 18 bp, Homo sapiens
tatgttaagctctttatg

SEQ ID NO: 2783880 - DNA, 19 bp, Homo sapiens
tatgttaagctctttatga

SEQ ID NO: 2783881 - DNA, 15 bp, Homo sapiens
tatgttaagttactt

SEQ ID NO: 2783882 - DNA, 16 bp, Homo sapiens
tatgttgcccaggcag

SEQ ID NO: 2783883 - DNA, 20 bp, Homo sapiens
tatgttgcccaggcaggtct

SEQ ID NO: 2783884 - DNA, 21 bp, Homo sapiens
tatgttgcccaggcaggtctt

SEQ ID NO: 2783885 - DNA, 13 bp, Homo sapiens
tatgtttttaatg

SEQ ID NO: 2783886 - DNA, 18 bp, Homo sapiens
tatgtttttgtgtatttg

SEQ ID NO: 2783887 - DNA, 12 bp, Homo sapiens
tattaaatacag

SEQ ID NO: 2783888 - DNA, 22 bp, Homo sapiens
tattaactggctactgggaaat

SEQ ID NO: 2783889 - DNA, 19 bp, Homo sapiens
tattaatgaactgtgacag

SEQ ID NO: 2783890 - DNA, 16 bp, Homo sapiens
tattacatggcagtgt

SEQ ID NO: 2783891 - DNA, 21 bp, Homo sapiens
tattaccaaaaaagtattttt

SEQ ID NO: 2783892 - DNA, 15 bp, Homo sapiens
tattaccatgagaag

SEQ ID NO: 2783893 - DNA, 11 bp, Homo sapiens
tattacctctg

SEQ ID NO: 2783894 - DNA, 14 bp, Homo sapiens
tattacctctgata

SEQ ID NO: 2783895 - DNA, 19 bp, Homo sapiens
tattacctctgatacctca

SEQ ID NO: 2783896 - DNA, 14 bp, Homo sapiens
tattacttctgcta

SEQ ID NO: 2783897 - DNA, 16 bp, Homo sapiens
tattagagtgccctta

SEQ ID NO: 2783898 - DNA, 18 bp, Homo sapiens
tattagatgttttacaaa

SEQ ID NO: 2783899 - DNA, 13 bp, Homo sapiens
tattataaataaa

SEQ ID NO: 2783900 - DNA, 14 bp, Homo sapiens
tattataaataaat

SEQ ID NO: 2783901 - DNA, 15 bp, Homo sapiens
tattataaataaatg

SEQ ID NO: 2783902 - DNA, 17 bp, Homo sapiens
tattataaataaatgcc

SEQ ID NO: 2783903 - DNA, 15 bp, Homo sapiens
tattataactgcata

SEQ ID NO: 2783904 - DNA, 15 bp, Homo sapiens
tattataacttaaaa

SEQ ID NO: 2783905 - DNA, 15 bp, Homo sapiens
tattatcaacaatag

SEQ ID NO: 2783906 - DNA, 15 bp, Homo sapiens
tattattagattctc

SEQ ID NO: 2783907 - DNA, 15 bp, Homo sapiens
tattatttacaatgc

SEQ ID NO: 2783908 - DNA, 12 bp, Homo sapiens
tattcaataaag

SEQ ID NO: 2783909 - DNA, 15 bp, Homo sapiens
tattcactgtaagtt

SEQ ID NO: 2783910 - DNA, 22 bp, Homo sapiens
tattcagacaagcaacaggttt

SEQ ID NO: 2783911 - DNA, 14 bp, Homo sapiens
tattcatgtaataa

SEQ ID NO: 2783912 - DNA, 19 bp, Homo sapiens
tattccaccattcacattt

SEQ ID NO: 2783913 - DNA, 14 bp, Homo sapiens
tattccatatatta

SEQ ID NO: 2783914 - DNA, 20 bp, Homo sapiens
tattcctatatagtttattg

SEQ ID NO: 2783915 - DNA, 17 bp, Homo sapiens
tattcctgcatttgtga

SEQ ID NO: 2783916 - DNA, 20 bp, Homo sapiens
tattcctgcatttgtgaaat

SEQ ID NO: 2783917 - DNA, 21 bp, Homo sapiens
tattccttttgtgtacagtgt

SEQ ID NO: 2783918 - DNA, 14 bp, Homo sapiens
tattctaattttat

SEQ ID NO: 2783919 - DNA, 16 bp, Homo sapiens
tattctacacatatat

SEQ ID NO: 2783920 - DNA, 18 bp, Homo sapiens
tattctacacatatatgt

SEQ ID NO: 2783921 - DNA, 22 bp, Homo sapiens
tattctcactccaccacccaaa

SEQ ID NO: 2783922 - DNA, 22 bp, Homo sapiens
tattctgggctcctggaaccaa

SEQ ID NO: 2783923 - DNA, 15 bp, Homo sapiens
tattctgttaaaatc

SEQ ID NO: 2783924 - DNA, 14 bp, Homo sapiens
tattcttggagaac

SEQ ID NO: 2783925 - DNA, 22 bp, Homo sapiens
tattgaaaaggttaacagatac

SEQ ID NO: 2783926 - DNA, 20 bp, Homo sapiens
tattgaagaaaagcactttt

SEQ ID NO: 2783927 - DNA, 18 bp, Homo sapiens
tattgagaattttaaatt

SEQ ID NO: 2783928 - DNA, 14 bp, Homo sapiens
tattgatgtttcca

SEQ ID NO: 2783929 - DNA, 17 bp, Homo sapiens
tattgatgtttccagaa

SEQ ID NO: 2783930 - DNA, 15 bp, Homo sapiens
tattgcccacgctgg

SEQ ID NO: 2783931 - DNA, 13 bp, Homo sapiens
tattgcttaatcc

SEQ ID NO: 2783932 - DNA, 21 bp, Homo sapiens
tattgcttgatacttttgaca

SEQ ID NO: 2783933 - DNA, 22 bp, Homo sapiens
tattggtccagcttgctcttca

SEQ ID NO: 2783934 - DNA, 14 bp, Homo sapiens
tattgtaatgaata

SEQ ID NO: 2783935 - DNA, 11 bp, Homo sapiens
tattgtacctc

SEQ ID NO: 2783936 - DNA, 14 bp, Homo sapiens
tattgtacctctct

SEQ ID NO: 2783937 - DNA, 17 bp, Homo sapiens
tattgtagcatttcttg

SEQ ID NO: 2783938 - DNA, 19 bp, Homo sapiens
tattgtgtgttatttaaat

SEQ ID NO: 2783939 - DNA, 14 bp, Homo sapiens
tatttaaaaaacta

SEQ ID NO: 2783940 - DNA, 21 bp, Homo sapiens
tatttaaaaaactaaaaacta

SEQ ID NO: 2783941 - DNA, 14 bp, Homo sapiens
tatttaaaaaataa

SEQ ID NO: 2783942 - DNA, 21 bp, Homo sapiens
tatttaaaatagcaaaagaag

SEQ ID NO: 2783943 - DNA, 22 bp, Homo sapiens
tatttaaatattaaatatgtta

SEQ ID NO: 2783944 - DNA, 15 bp, Homo sapiens
tatttaacaagatct

SEQ ID NO: 2783945 - DNA, 16 bp, Homo sapiens
tatttaactctcttta

SEQ ID NO: 2783946 - DNA, 17 bp, Homo sapiens
tatttaagtatatagta

SEQ ID NO: 2783947 - DNA, 13 bp, Homo sapiens
tatttaatagcaa

SEQ ID NO: 2783948 - DNA, 22 bp, Homo sapiens
tatttaatagcaaagaattgac

SEQ ID NO: 2783949 - DNA, 15 bp, Homo sapiens
tatttaatgttatgt

SEQ ID NO: 2783950 - DNA, 17 bp, Homo sapiens
tatttaattttcctgga

SEQ ID NO: 2783951 - DNA, 16 bp, Homo sapiens
tatttactaaaagaat

SEQ ID NO: 2783952 - DNA, 21 bp, Homo sapiens
tatttactgagcttctctgtg

SEQ ID NO: 2783953 - DNA, 22 bp, Homo sapiens
tatttagattgttaaaataact

SEQ ID NO: 2783954 - DNA, 18 bp, Homo sapiens
tatttatagcaatccatg

SEQ ID NO: 2783955 - DNA, 19 bp, Homo sapiens
tatttatatatttataact

SEQ ID NO: 2783956 - DNA, 16 bp, Homo sapiens
tatttatatatttgaa

SEQ ID NO: 2783957 - DNA, 13 bp, Homo sapiens
tatttatatttgg

SEQ ID NO: 2783958 - DNA, 15 bp, Homo sapiens
tatttatatttggaa

SEQ ID NO: 2783959 - DNA, 15 bp, Homo sapiens
tcagaccataatgtt

SEQ ID NO: 2783960 - DNA, 12 bp, Homo sapiens
tcagacccccac

SEQ ID NO: 2783961 - DNA, 14 bp, Homo sapiens
tcagacccccactc

SEQ ID NO: 2783962 - DNA, 18 bp, Homo sapiens
tcagaccctaccccacca

SEQ ID NO: 2783963 - DNA, 12 bp, Homo sapiens
tcagacctctga

SEQ ID NO: 2783964 - DNA, 13 bp, Homo sapiens
tcagacctctgat

SEQ ID NO: 2783965 - DNA, 14 bp, Homo sapiens
tcagactagtgaca

SEQ ID NO: 2783966 - DNA, 21 bp, Homo sapiens
tcagactggctggctgcagtg

SEQ ID NO: 2783967 - DNA, 14 bp, Homo sapiens
tcagactgtttagt

SEQ ID NO: 2783968 - DNA, 15 bp, Homo sapiens
tcagacttacttact

SEQ ID NO: 2783969 - DNA, 15 bp, Homo sapiens
tcagacttttatcaa

SEQ ID NO: 2783970 - DNA, 19 bp, Homo sapiens
tcagacttttatcaaaatc

SEQ ID NO: 2783971 - DNA, 11 bp, Homo sapiens
tcagagaagtc

SEQ ID NO: 2783972 - DNA, 13 bp, Homo sapiens
tcagagaagtcag

SEQ ID NO: 2783973 - DNA, 22 bp, Homo sapiens
tcagagaagtcagttggagaaa

SEQ ID NO: 2783974 - DNA, 23 bp, Homo sapiens
tcagagaatttctaccatttcag

SEQ ID NO: 2783975 - DNA, 19 bp, Homo sapiens
tcagagactcagggcccca

SEQ ID NO: 2783976 - DNA, 15 bp, Homo sapiens
tcagagatgggctga

SEQ ID NO: 2783977 - DNA, 14 bp, Homo sapiens
tcagagatgtacca

SEQ ID NO: 2783978 - DNA, 14 bp, Homo sapiens
tcagagcaggggtc

SEQ ID NO: 2783979 - DNA, 14 bp, Homo sapiens
tcagagcctgcagt

SEQ ID NO: 2783980 - DNA, 21 bp, Homo sapiens
tcagagtagagggcttgggaa

SEQ ID NO: 2783981 - DNA, 16 bp, Homo sapiens
tcagatatatttttca

SEQ ID NO: 2783982 - DNA, 23 bp, Homo sapiens
tcagatatatttttcacagtttt

SEQ ID NO: 2783983 - DNA, 21 bp, Homo sapiens
tcagatattttttcagaaata

SEQ ID NO: 2783984 - DNA, 16 bp, Homo sapiens
tcagatcgtattaatt

SEQ ID NO: 2783985 - DNA, 14 bp, Homo sapiens
tcagatgcccagag

SEQ ID NO: 2783986 - DNA, 21 bp, Homo sapiens
tcagatgcccagagggcccag

SEQ ID NO: 2783987 - DNA, 22 bp, Homo sapiens
tcagatgcccagagggcccagg

SEQ ID NO: 2783988 - DNA, 15 bp, Homo sapiens
tcagatgggaagaca

SEQ ID NO: 2783989 - DNA, 22 bp, Homo sapiens
tcagattcccagagcaaaataa

SEQ ID NO: 2783990 - DNA, 18 bp, Homo sapiens
tcagcagccctcctcacc

SEQ ID NO: 2783991 - DNA, 15 bp, Homo sapiens
tcagcatcctggcac

SEQ ID NO: 2783992 - DNA, 18 bp, Homo sapiens
tcagcatcctggcacccg

SEQ ID NO: 2783993 - DNA, 20 bp, Homo sapiens
tcagcatgcatagtgctaag

SEQ ID NO: 2783994 - DNA, 12 bp, Homo sapiens
tcagccagggcc

SEQ ID NO: 2783995 - DNA, 18 bp, Homo sapiens
tcagccagggccaggggt

SEQ ID NO: 2783996 - DNA, 18 bp, Homo sapiens
tcagccatcaacaagagt

SEQ ID NO: 2783997 - DNA, 23 bp, Homo sapiens
tcagccatgaggagttgctgttt

SEQ ID NO: 2783998 - DNA, 14 bp, Homo sapiens
tcagcccctcctct

SEQ ID NO: 2783999 - DNA, 15 bp, Homo sapiens
tcagcccctcctctg

SEQ ID NO: 2784000 - DNA, 16 bp, Homo sapiens
tcagcccctcctctgc

SEQ ID NO: 2784001 - DNA, 19 bp, Homo sapiens
tcagcccctcctctgccac

SEQ ID NO: 2784002 - DNA, 20 bp, Homo sapiens
tcagcccctcctctgccacc

SEQ ID NO: 2784003 - DNA, 18 bp, Homo sapiens
tcagccctgggccccacc

SEQ ID NO: 2784004 - DNA, 18 bp, Homo sapiens
tcagccgagccgggcctg

SEQ ID NO: 2784005 - DNA, 20 bp, Homo sapiens
tcagccgagccgggcctggg

SEQ ID NO: 2784006 - DNA, 21 bp, Homo sapiens
tcagccgagccgggcctgggg

SEQ ID NO: 2784007 - DNA, 18 bp, Homo sapiens
tcagcctagccgacctca

SEQ ID NO: 2784008 - DNA, 23 bp, Homo sapiens
tcagcctagccgacctcagcctt

SEQ ID NO: 2784009 - DNA, 19 bp, Homo sapiens
tcagcctcccaaagtgctg

SEQ ID NO: 2784010 - DNA, 19 bp, Homo sapiens
tcagcctcccaaccccagg

SEQ ID NO: 2784011 - DNA, 22 bp, Homo sapiens
tcagcctcccaaccccagggcc

SEQ ID NO: 2784012 - DNA, 13 bp, Homo sapiens
tcagcctcccccc

SEQ ID NO: 2784013 - DNA, 20 bp, Homo sapiens
tcagcctcccgagtagctgg

SEQ ID NO: 2784014 - DNA, 22 bp, Homo sapiens
tcagcctcccgagtagctggga

SEQ ID NO: 2784015 - DNA, 17 bp, Homo sapiens
tcagcctggtgggcctc

SEQ ID NO: 2784016 - DNA, 23 bp, Homo sapiens
tcagccttccccttgcccagggc

SEQ ID NO: 2784017 - DNA, 15 bp, Homo sapiens
tcagccttgaaaaac

SEQ ID NO: 2784018 - DNA, 18 bp, Homo sapiens
tcagccttgaaaaacaag

SEQ ID NO: 2784019 - DNA, 22 bp, Homo sapiens
tcagccttggataatgctgttg

SEQ ID NO: 2784020 - DNA, 23 bp, Homo sapiens
tcagcggggacagctccttctgt

SEQ ID NO: 2784021 - DNA, 17 bp, Homo sapiens
tcagcgtggccttgttc

SEQ ID NO: 2784022 - DNA, 23 bp, Homo sapiens
tcagctaagccccctactgagaa

SEQ ID NO: 2784023 - DNA, 12 bp, Homo sapiens
tcagctccagct

SEQ ID NO: 2784024 - DNA, 16 bp, Homo sapiens
tcagctctgacattct

SEQ ID NO: 2784025 - DNA, 22 bp, Homo sapiens
tcagctctgacattctgattcg

SEQ ID NO: 2784026 - DNA, 17 bp, Homo sapiens
tcagctgacacataatt

SEQ ID NO: 2784027 - DNA, 18 bp, Homo sapiens
tcagctgctcgcacagat

SEQ ID NO: 2784028 - DNA, 17 bp, Homo sapiens
tcagctgtctgtggctt

SEQ ID NO: 2784029 - DNA, 21 bp, Homo sapiens
tcagcttgtaaatagctcagg

SEQ ID NO: 2784030 - DNA, 22 bp, Homo sapiens
tcagcttgtaaatagctcaggt

SEQ ID NO: 2784031 - DNA, 17 bp, Homo sapiens
tcagcttttaataaaat

SEQ ID NO: 2784032 - DNA, 21 bp, Homo sapiens
tcaggaaaactgacagaggag

SEQ ID NO: 2784033 - DNA, 22 bp, Homo sapiens
tcaggaaaactgacagaggagg

SEQ ID NO: 2784034 - DNA, 15 bp, Homo sapiens
tcaggaaaaggcctg

SEQ ID NO: 2784035 - DNA, 12 bp, Homo sapiens
tcaggaaaattg

SEQ ID NO: 2784036 - DNA, 20 bp, Homo sapiens
tcaggaagggaaagccagaa

SEQ ID NO: 2784037 - DNA, 15 bp, Homo sapiens
tcaggaattgaagat

SEQ ID NO: 2784038 - DNA, 19 bp, Homo sapiens
tcaggacacaggcctgtgt

SEQ ID NO: 2784039 - DNA, 13 bp, Homo sapiens
tcaggacactaat

SEQ ID NO: 2784040 - DNA, 15 bp, Homo sapiens
tcaggacctggcttg

SEQ ID NO: 2784041 - DNA, 15 bp, Homo sapiens
tcaggacttggtctg

SEQ ID NO: 2784042 - DNA, 20 bp, Homo sapiens
tcaggagagagttgaaccta

SEQ ID NO: 2784043 - DNA, 12 bp, Homo sapiens
tcaggaggctga

SEQ ID NO: 2784044 - DNA, 20 bp, Homo sapiens
tcaggaggctgaggcagaag

SEQ ID NO: 2784045 - DNA, 15 bp, Homo sapiens
tcaggaggctgaggg

SEQ ID NO: 2784046 - DNA, 12 bp, Homo sapiens
tcaggagttcct

SEQ ID NO: 2784047 - DNA, 20 bp, Homo sapiens
tcaggatactctgtcagatg

SEQ ID NO: 2784048 - DNA, 16 bp, Homo sapiens
tcaggatcaagaaagt

SEQ ID NO: 2784049 - DNA, 13 bp, Homo sapiens
tccacccagccca

SEQ ID NO: 2784050 - DNA, 14 bp, Homo sapiens
tccacccaggagcc

SEQ ID NO: 2784051 - DNA, 17 bp, Homo sapiens
tccacccaggagccccg

SEQ ID NO: 2784052 - DNA, 12 bp, Homo sapiens
tccaccccagga

SEQ ID NO: 2784053 - DNA, 19 bp, Homo sapiens
tccaccccaggacgccact

SEQ ID NO: 2784054 - DNA, 19 bp, Homo sapiens
tccaccctgagcctgacct

SEQ ID NO: 2784055 - DNA, 21 bp, Homo sapiens
tccaccctgctctccgaccag

SEQ ID NO: 2784056 - DNA, 12 bp, Homo sapiens
tccacctcagcc

SEQ ID NO: 2784057 - DNA, 13 bp, Homo sapiens
tccacctcagcct

SEQ ID NO: 2784058 - DNA, 16 bp, Homo sapiens
tccacctcagccttgg

SEQ ID NO: 2784059 - DNA, 22 bp, Homo sapiens
tccacctgcctatccatcctgc

SEQ ID NO: 2784060 - DNA, 23 bp, Homo sapiens
tccacctgcctatccatcctgcg

SEQ ID NO: 2784061 - DNA, 19 bp, Homo sapiens
tccacctgctttctcctgg

SEQ ID NO: 2784062 - DNA, 18 bp, Homo sapiens
tccacctgttcaggagct

SEQ ID NO: 2784063 - DNA, 15 bp, Homo sapiens
tccaccttcccatgc

SEQ ID NO: 2784064 - DNA, 20 bp, Homo sapiens
tccactaaatgagctcctgc

SEQ ID NO: 2784065 - DNA, 18 bp, Homo sapiens
tccactgccaaaacaatg

SEQ ID NO: 2784066 - DNA, 18 bp, Homo sapiens
tccactgctctcagcctc

SEQ ID NO: 2784067 - DNA, 10 bp, Homo sapiens
tccactggac

SEQ ID NO: 2784068 - DNA, 17 bp, Homo sapiens
tccactggacttgagct

SEQ ID NO: 2784069 - DNA, 21 bp, Homo sapiens
tccactgtgccatgtgccagg

SEQ ID NO: 2784070 - DNA, 18 bp, Homo sapiens
tccacttcttaatgcttt

SEQ ID NO: 2784071 - DNA, 21 bp, Homo sapiens
tccacttcttaatgctttcct

SEQ ID NO: 2784072 - DNA, 16 bp, Homo sapiens
tccagaaaatataaat

SEQ ID NO: 2784073 - DNA, 17 bp, Homo sapiens
tccagaaaatgtgtcag

SEQ ID NO: 2784074 - DNA, 11 bp, Homo sapiens
tccagaaagaa

SEQ ID NO: 2784075 - DNA, 23 bp, Homo sapiens
tccagaaagaaggacacttgtat

SEQ ID NO: 2784076 - DNA, 20 bp, Homo sapiens
tccagaacaaacctctatat

SEQ ID NO: 2784077 - DNA, 14 bp, Homo sapiens
tccagacccggctg

SEQ ID NO: 2784078 - DNA, 16 bp, Homo sapiens
tccagacctgaagaat

SEQ ID NO: 2784079 - DNA, 22 bp, Homo sapiens
tccagactgcttccaattttct

SEQ ID NO: 2784080 - DNA, 18 bp, Homo sapiens
tccagagagtcctctgga

SEQ ID NO: 2784081 - DNA, 21 bp, Homo sapiens
tccagccagcgcctccctcca

SEQ ID NO: 2784082 - DNA, 16 bp, Homo sapiens
tccagccagctcctgg

SEQ ID NO: 2784083 - DNA, 21 bp, Homo sapiens
tccagccatcaagagactgag

SEQ ID NO: 2784084 - DNA, 20 bp, Homo sapiens
tccagcctgggcaacagagc

SEQ ID NO: 2784085 - DNA, 15 bp, Homo sapiens
tccagctagtgaccc

SEQ ID NO: 2784086 - DNA, 17 bp, Homo sapiens
tccagctcaccagcccc

SEQ ID NO: 2784087 - DNA, 13 bp, Homo sapiens
tccagctcttggc

SEQ ID NO: 2784088 - DNA, 21 bp, Homo sapiens
tccagctggaattgctgctct

SEQ ID NO: 2784089 - DNA, 22 bp, Homo sapiens
tccagctggaattgctgctctc

SEQ ID NO: 2784090 - DNA, 22 bp, Homo sapiens
tccagcttcccctcgctgtcct

SEQ ID NO: 2784091 - DNA, 15 bp, Homo sapiens
tccagcttgctcttc

SEQ ID NO: 2784092 - DNA, 19 bp, Homo sapiens
tccagcttgctcttcagtg

SEQ ID NO: 2784093 - DNA, 23 bp, Homo sapiens
tccaggaaggtagcccagcactg

SEQ ID NO: 2784094 - DNA, 13 bp, Homo sapiens
tccaggagcctgg

SEQ ID NO: 2784095 - DNA, 23 bp, Homo sapiens
tccaggagcctggctccgtccag

SEQ ID NO: 2784096 - DNA, 16 bp, Homo sapiens
tccaggattccaaagt

SEQ ID NO: 2784097 - DNA, 21 bp, Homo sapiens
tccaggcacccttctttcctc

SEQ ID NO: 2784098 - DNA, 22 bp, Homo sapiens
tccaggcagagacaataaaaca

SEQ ID NO: 2784099 - DNA, 10 bp, Homo sapiens
tccaggctcc

SEQ ID NO: 2784100 - DNA, 15 bp, Homo sapiens
tccaggctgtttctt

SEQ ID NO: 2784101 - DNA, 17 bp, Homo sapiens
tccagggccacgtgcca

SEQ ID NO: 2784102 - DNA, 17 bp, Homo sapiens
tccagggccctgagctc

SEQ ID NO: 2784103 - DNA, 20 bp, Homo sapiens
tccagggccctgagctcggt

SEQ ID NO: 2784104 - DNA, 17 bp, Homo sapiens
tccaggtatctccagga

SEQ ID NO: 2784105 - DNA, 18 bp, Homo sapiens
tccaggtatctccaggat

SEQ ID NO: 2784106 - DNA, 22 bp, Homo sapiens
tccaggtcctggtggggcagct

SEQ ID NO: 2784107 - DNA, 16 bp, Homo sapiens
tccaggttcagcttgt

SEQ ID NO: 2784108 - DNA, 20 bp, Homo sapiens
tccagtagtggacaacaggt

SEQ ID NO: 2784109 - DNA, 18 bp, Homo sapiens
tccagtgagcttatcatg

SEQ ID NO: 2784110 - DNA, 14 bp, Homo sapiens
tccagtgcatgttg

SEQ ID NO: 2784111 - DNA, 15 bp, Homo sapiens
tccagtgcatgttgc

SEQ ID NO: 2784112 - DNA, 16 bp, Homo sapiens
tccagtggtaccagct

SEQ ID NO: 2784113 - DNA, 17 bp, Homo sapiens
tccagtggtaccagctc

SEQ ID NO: 2784114 - DNA, 18 bp, Homo sapiens
tccagtggtaccagctca

SEQ ID NO: 2784115 - DNA, 19 bp, Homo sapiens
tccagtggtaccagctcac

SEQ ID NO: 2784116 - DNA, 23 bp, Homo sapiens
tccagttcacaggccagaaaaca

SEQ ID NO: 2784117 - DNA, 19 bp, Homo sapiens
tccagttcatgagaatcta

SEQ ID NO: 2784118 - DNA, 18 bp, Homo sapiens
tccagttgcaataaaata

SEQ ID NO: 2784119 - DNA, 20 bp, Homo sapiens
tccagttgcaataaaatagt

SEQ ID NO: 2784120 - DNA, 13 bp, Homo sapiens
tccagtttcccac

SEQ ID NO: 2784121 - DNA, 22 bp, Homo sapiens
tccagtttccccatggggctgc

SEQ ID NO: 2784122 - DNA, 12 bp, Homo sapiens
tccataaagtaa

SEQ ID NO: 2784123 - DNA, 21 bp, Homo sapiens
tccataaagtaattttgtgaa

SEQ ID NO: 2784124 - DNA, 16 bp, Homo sapiens
tccataaggaatgtag

SEQ ID NO: 2784125 - DNA, 19 bp, Homo sapiens
tccataattatgacagtta

SEQ ID NO: 2784126 - DNA, 14 bp, Homo sapiens
tccatcaggccact

SEQ ID NO: 2784127 - DNA, 20 bp, Homo sapiens
tccatcccgaaaatctctcg

SEQ ID NO: 2784128 - DNA, 14 bp, Homo sapiens
tccatgattttaca

SEQ ID NO: 2784129 - DNA, 15 bp, Homo sapiens
tccatgcctgagggt

SEQ ID NO: 2784130 - DNA, 16 bp, Homo sapiens
tccatgcctgagggtg

SEQ ID NO: 2784131 - DNA, 22 bp, Homo sapiens
tccatgtattcacacacccctc

SEQ ID NO: 2784132 - DNA, 23 bp, Homo sapiens
tccatgtattcacacacccctca

SEQ ID NO: 2784133 - DNA, 20 bp, Homo sapiens
tccatgtgggctagttgggc

SEQ ID NO: 2784134 - DNA, 18 bp, Homo sapiens
tccatgttagtttttact

SEQ ID NO: 2784135 - DNA, 19 bp, Homo sapiens
tccatgttagtttttactt

SEQ ID NO: 2784136 - DNA, 20 bp, Homo sapiens
tccattaacttagcatgtgt

SEQ ID NO: 2784137 - DNA, 16 bp, Homo sapiens
tccattactaaagaca

SEQ ID NO: 2784138 - DNA, 12 bp, Homo sapiens
tccattcctcag

SEQ ID NO: 2784139 - DNA, 23 bp, Homo sapiens
tcctgtacgaacccctcccctcc

SEQ ID NO: 2784140 - DNA, 14 bp, Homo sapiens
tcctgtatattatg

SEQ ID NO: 2784141 - DNA, 23 bp, Homo sapiens
tcctgtatattatggtgtaatgc

SEQ ID NO: 2784142 - DNA, 17 bp, Homo sapiens
tcctgtatttgttccca

SEQ ID NO: 2784143 - DNA, 20 bp, Homo sapiens
tcctgtatttgttcccaaga

SEQ ID NO: 2784144 - DNA, 21 bp, Homo sapiens
tcctgtatttgttcccaagag

SEQ ID NO: 2784145 - DNA, 18 bp, Homo sapiens
tcctgtccaacctaaccc

SEQ ID NO: 2784146 - DNA, 21 bp, Homo sapiens
tcctgtctgccagccagcagc

SEQ ID NO: 2784147 - DNA, 17 bp, Homo sapiens
tcctgtgcccacatccc

SEQ ID NO: 2784148 - DNA, 13 bp, Homo sapiens
tcctgtgggagcc

SEQ ID NO: 2784149 - DNA, 14 bp, Homo sapiens
tcctgtgggagcct

SEQ ID NO: 2784150 - DNA, 13 bp, Homo sapiens
tcctgtgtgtgcg

SEQ ID NO: 2784151 - DNA, 22 bp, Homo sapiens
tcctgttaggtattagaaagtg

SEQ ID NO: 2784152 - DNA, 21 bp, Homo sapiens
tcctgttcaccttatgtatta

SEQ ID NO: 2784153 - DNA, 19 bp, Homo sapiens
tcctgttgttgttaatgaa

SEQ ID NO: 2784154 - DNA, 16 bp, Homo sapiens
tccttactcctgtggg

SEQ ID NO: 2784155 - DNA, 17 bp, Homo sapiens
tccttactcctgtggga

SEQ ID NO: 2784156 - DNA, 18 bp, Homo sapiens
tccttagcttagacctca

SEQ ID NO: 2784157 - DNA, 20 bp, Homo sapiens
tccttagcttagacctcagc

SEQ ID NO: 2784158 - DNA, 21 bp, Homo sapiens
tccttcaaagtttaataaatt

SEQ ID NO: 2784159 - DNA, 18 bp, Homo sapiens
tccttcaacaattctaaa

SEQ ID NO: 2784160 - DNA, 20 bp, Homo sapiens
tccttcaagaactctgggct

SEQ ID NO: 2784161 - DNA, 21 bp, Homo sapiens
tccttcaagaactctgggctg

SEQ ID NO: 2784162 - DNA, 18 bp, Homo sapiens
tccttcaagttagctcag

SEQ ID NO: 2784163 - DNA, 20 bp, Homo sapiens
tccttcaagttagctcagga

SEQ ID NO: 2784164 - DNA, 15 bp, Homo sapiens
tccttcaccagagcc

SEQ ID NO: 2784165 - DNA, 13 bp, Homo sapiens
tccttccaggccc

SEQ ID NO: 2784166 - DNA, 12 bp, Homo sapiens
tccttcctgccc

SEQ ID NO: 2784167 - DNA, 14 bp, Homo sapiens
tccttcctgcccca

SEQ ID NO: 2784168 - DNA, 15 bp, Homo sapiens
tccttccttccctgg

SEQ ID NO: 2784169 - DNA, 14 bp, Homo sapiens
tccttgcacctgca

SEQ ID NO: 2784170 - DNA, 19 bp, Homo sapiens
tccttgctgtcctaggcca

SEQ ID NO: 2784171 - DNA, 20 bp, Homo sapiens
tccttggcatcacagggcag

SEQ ID NO: 2784172 - DNA, 14 bp, Homo sapiens
tccttggtgcctgg

SEQ ID NO: 2784173 - DNA, 19 bp, Homo sapiens
tccttgtggtttatgtcat

SEQ ID NO: 2784174 - DNA, 15 bp, Homo sapiens
tcctttcaccacatg

SEQ ID NO: 2784175 - DNA, 22 bp, Homo sapiens
tcctttcagggaatttcaggaa

SEQ ID NO: 2784176 - DNA, 18 bp, Homo sapiens
tcctttcatccccacctt

SEQ ID NO: 2784177 - DNA, 15 bp, Homo sapiens
tcctttcctctgcag

SEQ ID NO: 2784178 - DNA, 23 bp, Homo sapiens
tcctttctcagccgcttctgact

SEQ ID NO: 2784179 - DNA, 17 bp, Homo sapiens
tcctttctccagccagc

SEQ ID NO: 2784180 - DNA, 15 bp, Homo sapiens
tcctttctttctaac

SEQ ID NO: 2784181 - DNA, 20 bp, Homo sapiens
tcctttgaatcctctctctg

SEQ ID NO: 2784182 - DNA, 21 bp, Homo sapiens
tcctttgaatcctctctctgt

SEQ ID NO: 2784183 - DNA, 22 bp, Homo sapiens
tcctttgacttattgtccccac

SEQ ID NO: 2784184 - DNA, 17 bp, Homo sapiens
tcctttgagaaagaaat

SEQ ID NO: 2784185 - DNA, 14 bp, Homo sapiens
tcctttgcactgag

SEQ ID NO: 2784186 - DNA, 17 bp, Homo sapiens
tcctttgcattccatga

SEQ ID NO: 2784187 - DNA, 15 bp, Homo sapiens
tcctttgtttttatg

SEQ ID NO: 2784188 - DNA, 14 bp, Homo sapiens
tccttttatgttat

SEQ ID NO: 2784189 - DNA, 21 bp, Homo sapiens
tccttttgcaacaagacaaag

SEQ ID NO: 2784190 - DNA, 20 bp, Homo sapiens
tcgaaacctgtccataaagt

SEQ ID NO: 2784191 - DNA, 21 bp, Homo sapiens
tcgaaatgaatttatctgaat

SEQ ID NO: 2784192 - DNA, 13 bp, Homo sapiens
tcgaactggctgc

SEQ ID NO: 2784193 - DNA, 17 bp, Homo sapiens
tcgaatgaaattaactg

SEQ ID NO: 2784194 - DNA, 15 bp, Homo sapiens
tcgaatgacactgtt

SEQ ID NO: 2784195 - DNA, 14 bp, Homo sapiens
tcgaccccaaagcc

SEQ ID NO: 2784196 - DNA, 15 bp, Homo sapiens
tcgagaccagcccag

SEQ ID NO: 2784197 - DNA, 13 bp, Homo sapiens
tcgagaccagcct

SEQ ID NO: 2784198 - DNA, 16 bp, Homo sapiens
tcgagcgccctgcaga

SEQ ID NO: 2784199 - DNA, 17 bp, Homo sapiens
tcgagcgccctgcagac

SEQ ID NO: 2784200 - DNA, 14 bp, Homo sapiens
tcgaggacagggag

SEQ ID NO: 2784201 - DNA, 21 bp, Homo sapiens
tcgaggtagagtttgaaggag

SEQ ID NO: 2784202 - DNA, 16 bp, Homo sapiens
tcgagtctacctcttc

SEQ ID NO: 2784203 - DNA, 21 bp, Homo sapiens
tcgatctgtactgtaattttg

SEQ ID NO: 2784204 - DNA, 20 bp, Homo sapiens
tcgatgccactcctgcttct

SEQ ID NO: 2784205 - DNA, 22 bp, Homo sapiens
tcgatgccactcctgcttctct

SEQ ID NO: 2784206 - DNA, 14 bp, Homo sapiens
tcgattagactgga

SEQ ID NO: 2784207 - DNA, 20 bp, Homo sapiens
tcgcaacccgtgccaagtcc

SEQ ID NO: 2784208 - DNA, 22 bp, Homo sapiens
tcgcacagattacttcagggct

SEQ ID NO: 2784209 - DNA, 14 bp, Homo sapiens
tcgcagccaccctg

SEQ ID NO: 2784210 - DNA, 17 bp, Homo sapiens
tcgcagccaccctgagg

SEQ ID NO: 2784211 - DNA, 18 bp, Homo sapiens
tcgcagccaccctgagga

SEQ ID NO: 2784212 - DNA, 21 bp, Homo sapiens
tcgcagccaccctgaggagtc

SEQ ID NO: 2784213 - DNA, 23 bp, Homo sapiens
tcgcagccaccctgaggagtctg

SEQ ID NO: 2784214 - DNA, 22 bp, Homo sapiens
tcgccacacccggctccccctg

SEQ ID NO: 2784215 - DNA, 20 bp, Homo sapiens
tcgccatcaccccctacccc

SEQ ID NO: 2784216 - DNA, 11 bp, Homo sapiens
tcgcccaggag

SEQ ID NO: 2784217 - DNA, 18 bp, Homo sapiens
tcgccccagatcaccagc

SEQ ID NO: 2784218 - DNA, 20 bp, Homo sapiens
tcgccccagatcaccagccc

SEQ ID NO: 2784219 - DNA, 12 bp, Homo sapiens
tcgcctgccccc

SEQ ID NO: 2784220 - DNA, 20 bp, Homo sapiens
tcgcctgcccccagcactcc

SEQ ID NO: 2784221 - DNA, 18 bp, Homo sapiens
tcgctccccactctgctc

SEQ ID NO: 2784222 - DNA, 21 bp, Homo sapiens
tcgctccccactctgctctga

SEQ ID NO: 2784223 - DNA, 14 bp, Homo sapiens
tcgctcctgtgtct

SEQ ID NO: 2784224 - DNA, 14 bp, Homo sapiens
tcgctggacaaccc

SEQ ID NO: 2784225 - DNA, 17 bp, Homo sapiens
tcgctggcagagaaggc

SEQ ID NO: 2784226 - DNA, 20 bp, Homo sapiens
tcgctggcagagaaggcttc

SEQ ID NO: 2784227 - DNA, 14 bp, Homo sapiens
tcgctgtcctgctg

SEQ ID NO: 2784228 - DNA, 13 bp, Homo sapiens
tcggaagcagtgc

SEQ ID NO: 2784229 - DNA, 18 bp, Homo sapiens
tctgcagccagcccagcc

SEQ ID NO: 2784230 - DNA, 19 bp, Homo sapiens
tctgcagggggtgtgtctg

SEQ ID NO: 2784231 - DNA, 16 bp, Homo sapiens
tctgcagtagtctctg

SEQ ID NO: 2784232 - DNA, 19 bp, Homo sapiens
tctgcagtagtctctgtgc

SEQ ID NO: 2784233 - DNA, 12 bp, Homo sapiens
tctgcatggaaa

SEQ ID NO: 2784234 - DNA, 17 bp, Homo sapiens
tctgcatttataaatgt

SEQ ID NO: 2784235 - DNA, 23 bp, Homo sapiens
tctgcatttataaatgtgtggtg

SEQ ID NO: 2784236 - DNA, 17 bp, Homo sapiens
tctgccaccatcctgct

SEQ ID NO: 2784237 - DNA, 15 bp, Homo sapiens
tctgccacctcccct

SEQ ID NO: 2784238 - DNA, 15 bp, Homo sapiens
tctgccagccagcag

SEQ ID NO: 2784239 - DNA, 17 bp, Homo sapiens
tctgccagccagcagcc

SEQ ID NO: 2784240 - DNA, 16 bp, Homo sapiens
tctgccccagctctgg

SEQ ID NO: 2784241 - DNA, 17 bp, Homo sapiens
tctgccctccctggcct

SEQ ID NO: 2784242 - DNA, 21 bp, Homo sapiens
tctgcctcaatgtgaatcaga

SEQ ID NO: 2784243 - DNA, 21 bp, Homo sapiens
tctgcctctgacacacagctc

SEQ ID NO: 2784244 - DNA, 16 bp, Homo sapiens
tctgcctgaacctggg

SEQ ID NO: 2784245 - DNA, 20 bp, Homo sapiens
tctgcctgaacctggggtca

SEQ ID NO: 2784246 - DNA, 14 bp, Homo sapiens
tctgcctgcccagg

SEQ ID NO: 2784247 - DNA, 15 bp, Homo sapiens
tctgcctgcccaggc

SEQ ID NO: 2784248 - DNA, 21 bp, Homo sapiens
tctgcctgcccaggcccctgc

SEQ ID NO: 2784249 - DNA, 22 bp, Homo sapiens
tctgcctgcccaggcccctgcc

SEQ ID NO: 2784250 - DNA, 22 bp, Homo sapiens
tctgcgtggttcctttctcagc

SEQ ID NO: 2784251 - DNA, 17 bp, Homo sapiens
tctgctacctcactggg

SEQ ID NO: 2784252 - DNA, 22 bp, Homo sapiens
tctgctcagacagaacccctac

SEQ ID NO: 2784253 - DNA, 18 bp, Homo sapiens
tctgctcctctccaggca

SEQ ID NO: 2784254 - DNA, 20 bp, Homo sapiens
tctgctcctctccaggcacc

SEQ ID NO: 2784255 - DNA, 21 bp, Homo sapiens
tctgctcctctccccagcaag

SEQ ID NO: 2784256 - DNA, 19 bp, Homo sapiens
tctgctctgaggcttccag

SEQ ID NO: 2784257 - DNA, 11 bp, Homo sapiens
tctgctctgat

SEQ ID NO: 2784258 - DNA, 17 bp, Homo sapiens
tctgctgacagacacag

SEQ ID NO: 2784259 - DNA, 13 bp, Homo sapiens
tctgctgcccctg

SEQ ID NO: 2784260 - DNA, 17 bp, Homo sapiens
tctgctgcccctgcagt

SEQ ID NO: 2784261 - DNA, 16 bp, Homo sapiens
tctgctggataaaatg

SEQ ID NO: 2784262 - DNA, 14 bp, Homo sapiens
tctgctggcctgga

SEQ ID NO: 2784263 - DNA, 15 bp, Homo sapiens
tctgctggcctggat

SEQ ID NO: 2784264 - DNA, 16 bp, Homo sapiens
tctgctggcctggatc

SEQ ID NO: 2784265 - DNA, 15 bp, Homo sapiens
tctgctggcctggcc

SEQ ID NO: 2784266 - DNA, 13 bp, Homo sapiens
tctggaaaagagg

SEQ ID NO: 2784267 - DNA, 15 bp, Homo sapiens
tctggaatgcagtgg

SEQ ID NO: 2784268 - DNA, 22 bp, Homo sapiens
tctggaatgtaatcaatgtttc

SEQ ID NO: 2784269 - DNA, 21 bp, Homo sapiens
tctggacaagccaacttgtaa

SEQ ID NO: 2784270 - DNA, 13 bp, Homo sapiens
tctggacctcagg

SEQ ID NO: 2784271 - DNA, 15 bp, Homo sapiens
tctggactcctctgt

SEQ ID NO: 2784272 - DNA, 12 bp, Homo sapiens
tctggagccctt

SEQ ID NO: 2784273 - DNA, 14 bp, Homo sapiens
tctggagctgctgt

SEQ ID NO: 2784274 - DNA, 21 bp, Homo sapiens
tctggagctgctgttccaaca

SEQ ID NO: 2784275 - DNA, 21 bp, Homo sapiens
tctggagtctcacttgtctca

SEQ ID NO: 2784276 - DNA, 14 bp, Homo sapiens
tctggatctgggac

SEQ ID NO: 2784277 - DNA, 21 bp, Homo sapiens
tctggatttttacaaataaag

SEQ ID NO: 2784278 - DNA, 22 bp, Homo sapiens
tctggatttttacaaataaaga

SEQ ID NO: 2784279 - DNA, 18 bp, Homo sapiens
tctggcaaagttatattt

SEQ ID NO: 2784280 - DNA, 11 bp, Homo sapiens
tctggcagcca

SEQ ID NO: 2784281 - DNA, 21 bp, Homo sapiens
tctggcagccacacttctcag

SEQ ID NO: 2784282 - DNA, 22 bp, Homo sapiens
tctggcagccacacttctcagg

SEQ ID NO: 2784283 - DNA, 15 bp, Homo sapiens
tctggccctgccttc

SEQ ID NO: 2784284 - DNA, 20 bp, Homo sapiens
tctggcctcagaccaactct

SEQ ID NO: 2784285 - DNA, 15 bp, Homo sapiens
tctggctgagctgaa

SEQ ID NO: 2784286 - DNA, 15 bp, Homo sapiens
tctggcttccaggta

SEQ ID NO: 2784287 - DNA, 24 bp, Homo sapiens
tctggcttccaggtatctccagga

SEQ ID NO: 2784288 - DNA, 13 bp, Homo sapiens
tctgggaggctgg

SEQ ID NO: 2784289 - DNA, 15 bp, Homo sapiens
tctgggagttccctg

SEQ ID NO: 2784290 - DNA, 12 bp, Homo sapiens
tctgggccaagt

SEQ ID NO: 2784291 - DNA, 23 bp, Homo sapiens
tctgggccaagttcctctagtgc

SEQ ID NO: 2784292 - DNA, 17 bp, Homo sapiens
tctggggaccctgtaga

SEQ ID NO: 2784293 - DNA, 18 bp, Homo sapiens
tctggggttcagcccctc

SEQ ID NO: 2784294 - DNA, 16 bp, Homo sapiens
tctgggttcactgcaa

SEQ ID NO: 2784295 - DNA, 18 bp, Homo sapiens
tctggtcaggcccactgc

SEQ ID NO: 2784296 - DNA, 21 bp, Homo sapiens
tctggtcaggcccactgcaga

SEQ ID NO: 2784297 - DNA, 15 bp, Homo sapiens
tctggtgttctgagt

SEQ ID NO: 2784298 - DNA, 18 bp, Homo sapiens
tctgtaaggaactggaac

SEQ ID NO: 2784299 - DNA, 14 bp, Homo sapiens
tctgtaatttatta

SEQ ID NO: 2784300 - DNA, 18 bp, Homo sapiens
tctgtacgtctgacaggc

SEQ ID NO: 2784301 - DNA, 14 bp, Homo sapiens
tctgtagggctgga

SEQ ID NO: 2784302 - DNA, 16 bp, Homo sapiens
tctgtagggctggacc

SEQ ID NO: 2784303 - DNA, 17 bp, Homo sapiens
tctgtagggctggacct

SEQ ID NO: 2784304 - DNA, 14 bp, Homo sapiens
tctgtatactgtgg

SEQ ID NO: 2784305 - DNA, 15 bp, Homo sapiens
tctgtatatacaata

SEQ ID NO: 2784306 - DNA, 21 bp, Homo sapiens
tctgtatcggagacagtgatc

SEQ ID NO: 2784307 - DNA, 13 bp, Homo sapiens
tctgtattttcat

SEQ ID NO: 2784308 - DNA, 19 bp, Homo sapiens
tctgtcagatgggaagaca

SEQ ID NO: 2784309 - DNA, 11 bp, Homo sapiens
tctgtcatcca

SEQ ID NO: 2784310 - DNA, 13 bp, Homo sapiens
tctgtccactctg

SEQ ID NO: 2784311 - DNA, 20 bp, Homo sapiens
tctgtccctcactgccttcc

SEQ ID NO: 2784312 - DNA, 15 bp, Homo sapiens
tctgtccctctttgc

SEQ ID NO: 2784313 - DNA, 18 bp, Homo sapiens
tctgtccctctttgcctg

SEQ ID NO: 2784314 - DNA, 19 bp, Homo sapiens
tctgtcctactctgtgtca

SEQ ID NO: 2784315 - DNA, 20 bp, Homo sapiens
tctgtcctactctgtgtcag

SEQ ID NO: 2784316 - DNA, 21 bp, Homo sapiens
tctgtctctgctcttgcctgc

SEQ ID NO: 2784317 - DNA, 22 bp, Homo sapiens
tctgtctctgctcttgcctgca

SEQ ID NO: 2784318 - DNA, 16 bp, Homo sapiens
tctgtctgtcccaaag

SEQ ID NO: 2784319 - DNA, 18 bp, Homo sapiens
tctgtctgtctgtcccaa

SEQ ID NO: 2784320 - DNA, 20 bp, Homo sapiens
tgaacaagttgtttcattga

SEQ ID NO: 2784321 - DNA, 22 bp, Homo sapiens
tgaacaagttgtttcattgact

SEQ ID NO: 2784322 - DNA, 15 bp, Homo sapiens
tgaacacagcctggg

SEQ ID NO: 2784323 - DNA, 16 bp, Homo sapiens
tgaacactgggggagg

SEQ ID NO: 2784324 - DNA, 17 bp, Homo sapiens
tgaacatctcactttgc

SEQ ID NO: 2784325 - DNA, 22 bp, Homo sapiens
tgaaccacatcttgctctgctg

SEQ ID NO: 2784326 - DNA, 23 bp, Homo sapiens
tgaaccacatcttgctctgctga

SEQ ID NO: 2784327 - DNA, 19 bp, Homo sapiens
tgaaccatccttcccatga

SEQ ID NO: 2784328 - DNA, 13 bp, Homo sapiens
tgaacccaggaca

SEQ ID NO: 2784329 - DNA, 12 bp, Homo sapiens
tgaacccaggag

SEQ ID NO: 2784330 - DNA, 19 bp, Homo sapiens
tgaacccaggaggtggagg

SEQ ID NO: 2784331 - DNA, 13 bp, Homo sapiens
tgaacccctgtgt

SEQ ID NO: 2784332 - DNA, 22 bp, Homo sapiens
tgaacctgggaaccatgaagct

SEQ ID NO: 2784333 - DNA, 15 bp, Homo sapiens
tgaacggggagaaaa

SEQ ID NO: 2784334 - DNA, 12 bp, Homo sapiens
tgaactcctggc

SEQ ID NO: 2784335 - DNA, 16 bp, Homo sapiens
tgaactcctggcctca

SEQ ID NO: 2784336 - DNA, 21 bp, Homo sapiens
tgaactcttaatcaaatagca

SEQ ID NO: 2784337 - DNA, 17 bp, Homo sapiens
tgaactgattcacatct

SEQ ID NO: 2784338 - DNA, 22 bp, Homo sapiens
tgaactgccaagaaaaggcatg

SEQ ID NO: 2784339 - DNA, 22 bp, Homo sapiens
tgaacttgaggacacatgtcca

SEQ ID NO: 2784340 - DNA, 15 bp, Homo sapiens
tgaagaaaaaataca

SEQ ID NO: 2784341 - DNA, 17 bp, Homo sapiens
tgaagaaaaaatacatt

SEQ ID NO: 2784342 - DNA, 21 bp, Homo sapiens
tgaagaaaccttcagatttgt

SEQ ID NO: 2784343 - DNA, 15 bp, Homo sapiens
tgaagaacagtaact

SEQ ID NO: 2784344 - DNA, 22 bp, Homo sapiens
tgaagaagctaaatcctttact

SEQ ID NO: 2784345 - DNA, 19 bp, Homo sapiens
tgaagaatacttctcattt

SEQ ID NO: 2784346 - DNA, 11 bp, Homo sapiens
tgaagaatatt

SEQ ID NO: 2784347 - DNA, 20 bp, Homo sapiens
tgaagaccacatccacacac

SEQ ID NO: 2784348 - DNA, 21 bp, Homo sapiens
tgaagacccagtgtaaagaat

SEQ ID NO: 2784349 - DNA, 16 bp, Homo sapiens
tgaagagtgagagggc

SEQ ID NO: 2784350 - DNA, 18 bp, Homo sapiens
tgaagagtgagagggcat

SEQ ID NO: 2784351 - DNA, 19 bp, Homo sapiens
tgaagatcgttagtatcta

SEQ ID NO: 2784352 - DNA, 11 bp, Homo sapiens
tgaagatctca

SEQ ID NO: 2784353 - DNA, 16 bp, Homo sapiens
tgaagatgtctaatag

SEQ ID NO: 2784354 - DNA, 17 bp, Homo sapiens
tgaagcaaagcaccagc

SEQ ID NO: 2784355 - DNA, 16 bp, Homo sapiens
tgaagcccaagtgaaa

SEQ ID NO: 2784356 - DNA, 15 bp, Homo sapiens
tgaagctaagattta

SEQ ID NO: 2784357 - DNA, 15 bp, Homo sapiens
tgaagctattgatgt

SEQ ID NO: 2784358 - DNA, 15 bp, Homo sapiens
tgaagctggaagcac

SEQ ID NO: 2784359 - DNA, 17 bp, Homo sapiens
tgaaggaccctggctct

SEQ ID NO: 2784360 - DNA, 14 bp, Homo sapiens
tgaaggctgtacac

SEQ ID NO: 2784361 - DNA, 15 bp, Homo sapiens
tgaagggcaggtgct

SEQ ID NO: 2784362 - DNA, 15 bp, Homo sapiens
tgaaggtcttgcctg

SEQ ID NO: 2784363 - DNA, 19 bp, Homo sapiens
tgaataaaaaacatttgta

SEQ ID NO: 2784364 - DNA, 20 bp, Homo sapiens
tgaataaaaaacatttgtac

SEQ ID NO: 2784365 - DNA, 21 bp, Homo sapiens
tgaataaaaaacatttgtaca

SEQ ID NO: 2784366 - DNA, 22 bp, Homo sapiens
tgaataaaaaacatttgtacat

SEQ ID NO: 2784367 - DNA, 13 bp, Homo sapiens
tgaataaacttca

SEQ ID NO: 2784368 - DNA, 16 bp, Homo sapiens
tgaataaacttcagca

SEQ ID NO: 2784369 - DNA, 20 bp, Homo sapiens
tgaataaagcctgcttttta

SEQ ID NO: 2784370 - DNA, 15 bp, Homo sapiens
tgaataaagtctgag

SEQ ID NO: 2784371 - DNA, 20 bp, Homo sapiens
tgaataaagtctgagtgggc

SEQ ID NO: 2784372 - DNA, 22 bp, Homo sapiens
tgaataaagtctgagtgggcgg

SEQ ID NO: 2784373 - DNA, 16 bp, Homo sapiens
tgaataaataaatgta

SEQ ID NO: 2784374 - DNA, 17 bp, Homo sapiens
tgaataagtattcttca

SEQ ID NO: 2784375 - DNA, 13 bp, Homo sapiens
tgaataatttctt

SEQ ID NO: 2784376 - DNA, 14 bp, Homo sapiens
tgaatataaacact

SEQ ID NO: 2784377 - DNA, 15 bp, Homo sapiens
tgaatataaacacta

SEQ ID NO: 2784378 - DNA, 22 bp, Homo sapiens
tgaatcctaagggctggtctct

SEQ ID NO: 2784379 - DNA, 14 bp, Homo sapiens
tgaatcctctctct

SEQ ID NO: 2784380 - DNA, 19 bp, Homo sapiens
tgaatctcccctcctcaca

SEQ ID NO: 2784381 - DNA, 14 bp, Homo sapiens
tgaatgaaatatca

SEQ ID NO: 2784382 - DNA, 18 bp, Homo sapiens
tgaatgaggtcccaggca

SEQ ID NO: 2784383 - DNA, 15 bp, Homo sapiens
tgaatgatctctctg

SEQ ID NO: 2784384 - DNA, 19 bp, Homo sapiens
tgaatgatgttttagaatg

SEQ ID NO: 2784385 - DNA, 12 bp, Homo sapiens
tgaatggcctgc

SEQ ID NO: 2784386 - DNA, 13 bp, Homo sapiens
tgaatggtatgga

SEQ ID NO: 2784387 - DNA, 20 bp, Homo sapiens
tgaatggtatggaactctct

SEQ ID NO: 2784388 - DNA, 14 bp, Homo sapiens
tgaatggtccaggg

SEQ ID NO: 2784389 - DNA, 23 bp, Homo sapiens
tgaatggttccatgcctgagggt

SEQ ID NO: 2784390 - DNA, 21 bp, Homo sapiens
tgaatgttgtctgtttgttct

SEQ ID NO: 2784391 - DNA, 13 bp, Homo sapiens
tgaattcccaggt

SEQ ID NO: 2784392 - DNA, 14 bp, Homo sapiens
tgaattctggagga

SEQ ID NO: 2784393 - DNA, 16 bp, Homo sapiens
tgaattgcctgcagag

SEQ ID NO: 2784394 - DNA, 16 bp, Homo sapiens
tgaattttgttgctgt

SEQ ID NO: 2784395 - DNA, 19 bp, Homo sapiens
tgaatttttaaacaagtat

SEQ ID NO: 2784396 - DNA, 23 bp, Homo sapiens
tgaatttttaaacaagtatttgt

SEQ ID NO: 2784397 - DNA, 18 bp, Homo sapiens
tgacaaaataacatttga

SEQ ID NO: 2784398 - DNA, 23 bp, Homo sapiens
tgacaaaatatataatggtttac

SEQ ID NO: 2784399 - DNA, 22 bp, Homo sapiens
tgacaaacccaggagtttgtgt

SEQ ID NO: 2784400 - DNA, 19 bp, Homo sapiens
tgacaaagaaacccaagtg

SEQ ID NO: 2784401 - DNA, 16 bp, Homo sapiens
tgacaacatttctata

SEQ ID NO: 2784402 - DNA, 23 bp, Homo sapiens
tgacaacatttctatagccaaaa

SEQ ID NO: 2784403 - DNA, 19 bp, Homo sapiens
tgacaaccatgagaccact

SEQ ID NO: 2784404 - DNA, 15 bp, Homo sapiens
tgacaacctttgtgt

SEQ ID NO: 2784405 - DNA, 21 bp, Homo sapiens
tgacaacctttgtgtaataaa

SEQ ID NO: 2784406 - DNA, 22 bp, Homo sapiens
tgacaagctcctggtcttgaga

SEQ ID NO: 2784407 - DNA, 14 bp, Homo sapiens
tgacaagtcatttt

SEQ ID NO: 2784408 - DNA, 19 bp, Homo sapiens
tgacacacagcactctcta

SEQ ID NO: 2784409 - DNA, 16 bp, Homo sapiens
tgacacacagctctgt

SEQ ID NO: 2784410 - DNA, 13 bp, Homo sapiens
tgaggctgcagcg

SEQ ID NO: 2784411 - DNA, 12 bp, Homo sapiens
tgaggctgggaa

SEQ ID NO: 2784412 - DNA, 15 bp, Homo sapiens
tgaggcttccagaga

SEQ ID NO: 2784413 - DNA, 16 bp, Homo sapiens
tgaggcttccagagag

SEQ ID NO: 2784414 - DNA, 17 bp, Homo sapiens
tgagggaacagacagga

SEQ ID NO: 2784415 - DNA, 20 bp, Homo sapiens
tgagggaacagacaggagaa

SEQ ID NO: 2784416 - DNA, 17 bp, Homo sapiens
tgagggatcacagggcc

SEQ ID NO: 2784417 - DNA, 18 bp, Homo sapiens
tgagggatcacagggccc

SEQ ID NO: 2784418 - DNA, 12 bp, Homo sapiens
tgagggcagcag

SEQ ID NO: 2784419 - DNA, 13 bp, Homo sapiens
tgagggcagcagc

SEQ ID NO: 2784420 - DNA, 15 bp, Homo sapiens
tgagggcagcagcca

SEQ ID NO: 2784421 - DNA, 21 bp, Homo sapiens
tgagggcagcagccagccctg

SEQ ID NO: 2784422 - DNA, 18 bp, Homo sapiens
tgagggccaagaaagagt

SEQ ID NO: 2784423 - DNA, 13 bp, Homo sapiens
tgaggtcagagcc

SEQ ID NO: 2784424 - DNA, 14 bp, Homo sapiens
tgaggtcagagcct

SEQ ID NO: 2784425 - DNA, 16 bp, Homo sapiens
tgaggtcaggagttcc

SEQ ID NO: 2784426 - DNA, 17 bp, Homo sapiens
tgaggtcctgagcactg

SEQ ID NO: 2784427 - DNA, 18 bp, Homo sapiens
tgaggtcctgagcactgc

SEQ ID NO: 2784428 - DNA, 21 bp, Homo sapiens
tgaggtcctgagcactgccag

SEQ ID NO: 2784429 - DNA, 15 bp, Homo sapiens
tgaggtctgaaatgg

SEQ ID NO: 2784430 - DNA, 14 bp, Homo sapiens
tgaggtgctgatga

SEQ ID NO: 2784431 - DNA, 18 bp, Homo sapiens
tgaggtgctgatgagtga

SEQ ID NO: 2784432 - DNA, 18 bp, Homo sapiens
tgaggtgtcttaagcctt

SEQ ID NO: 2784433 - DNA, 21 bp, Homo sapiens
tgagtactagaatttgtattt

SEQ ID NO: 2784434 - DNA, 18 bp, Homo sapiens
tgagtcaagttgttcctt

SEQ ID NO: 2784435 - DNA, 17 bp, Homo sapiens
tgagtcaccaagcccag

SEQ ID NO: 2784436 - DNA, 18 bp, Homo sapiens
tgagtcaccaagcccagt

SEQ ID NO: 2784437 - DNA, 16 bp, Homo sapiens
tgagtcacccatgaag

SEQ ID NO: 2784438 - DNA, 20 bp, Homo sapiens
tgagtcatgatctccctgcc

SEQ ID NO: 2784439 - DNA, 14 bp, Homo sapiens
tgagtcgaggacag

SEQ ID NO: 2784440 - DNA, 16 bp, Homo sapiens
tgagtctcctctctga

SEQ ID NO: 2784441 - DNA, 18 bp, Homo sapiens
tgagtctcctctctgaga

SEQ ID NO: 2784442 - DNA, 20 bp, Homo sapiens
tgagtgatcctccaacttca

SEQ ID NO: 2784443 - DNA, 15 bp, Homo sapiens
tgagttacttcctat

SEQ ID NO: 2784444 - DNA, 20 bp, Homo sapiens
tgagttggtgttgacatgtg

SEQ ID NO: 2784445 - DNA, 22 bp, Homo sapiens
tgagtttaagtctctgactctt

SEQ ID NO: 2784446 - DNA, 18 bp, Homo sapiens
tgagtttttatggggctg

SEQ ID NO: 2784447 - DNA, 18 bp, Homo sapiens
tgagtttttgatagcttt

SEQ ID NO: 2784448 - DNA, 21 bp, Homo sapiens
tgataaacattaaacactgta

SEQ ID NO: 2784449 - DNA, 18 bp, Homo sapiens
tgataaagattttttaat

SEQ ID NO: 2784450 - DNA, 18 bp, Homo sapiens
tgataagtggaaaaaaga

SEQ ID NO: 2784451 - DNA, 16 bp, Homo sapiens
tgataatgaacagaac

SEQ ID NO: 2784452 - DNA, 20 bp, Homo sapiens
tgataatgaacagaacatag

SEQ ID NO: 2784453 - DNA, 14 bp, Homo sapiens
tgataattttaaat

SEQ ID NO: 2784454 - DNA, 18 bp, Homo sapiens
tgatacccatagcttcca

SEQ ID NO: 2784455 - DNA, 11 bp, Homo sapiens
tgatagcttta

SEQ ID NO: 2784456 - DNA, 14 bp, Homo sapiens
tgatagctttattt

SEQ ID NO: 2784457 - DNA, 18 bp, Homo sapiens
tgataggaaataaatgat

SEQ ID NO: 2784458 - DNA, 22 bp, Homo sapiens
tgatatatgtatttattgtcat

SEQ ID NO: 2784459 - DNA, 15 bp, Homo sapiens
tgatatgtaaacata

SEQ ID NO: 2784460 - DNA, 16 bp, Homo sapiens
tgatattaaaggagtt

SEQ ID NO: 2784461 - DNA, 23 bp, Homo sapiens
tgatattaaaggagttaagagta

SEQ ID NO: 2784462 - DNA, 14 bp, Homo sapiens
tgatcaattaaatg

SEQ ID NO: 2784463 - DNA, 15 bp, Homo sapiens
tgatcaattaaatgt

SEQ ID NO: 2784464 - DNA, 14 bp, Homo sapiens
tgatcacggctcac

SEQ ID NO: 2784465 - DNA, 18 bp, Homo sapiens
tgatcacggctcactgca

SEQ ID NO: 2784466 - DNA, 20 bp, Homo sapiens
tgatcacggctcactgcagc

SEQ ID NO: 2784467 - DNA, 18 bp, Homo sapiens
tgatcactggcaatgaaa

SEQ ID NO: 2784468 - DNA, 15 bp, Homo sapiens
tgatcagaattttac

SEQ ID NO: 2784469 - DNA, 18 bp, Homo sapiens
tgatcagctgtttgtcat

SEQ ID NO: 2784470 - DNA, 19 bp, Homo sapiens
tgatcagtatgctgtttta

SEQ ID NO: 2784471 - DNA, 23 bp, Homo sapiens
tgatcagtatgctgttttaataa

SEQ ID NO: 2784472 - DNA, 24 bp, Homo sapiens
tgatcatccactgtgccatgtgcc

SEQ ID NO: 2784473 - DNA, 16 bp, Homo sapiens
tgatcatgtaaatgat

SEQ ID NO: 2784474 - DNA, 21 bp, Homo sapiens
tgatcatgtaaatgattatct

SEQ ID NO: 2784475 - DNA, 17 bp, Homo sapiens
tgatccaagctggtccc

SEQ ID NO: 2784476 - DNA, 15 bp, Homo sapiens
tgatccacccacctc

SEQ ID NO: 2784477 - DNA, 17 bp, Homo sapiens
tgatccacccacctcag

SEQ ID NO: 2784478 - DNA, 19 bp, Homo sapiens
tgatcccaagtgccagtct

SEQ ID NO: 2784479 - DNA, 12 bp, Homo sapiens
tgatcccagcac

SEQ ID NO: 2784480 - DNA, 13 bp, Homo sapiens
tgatcccagcact

SEQ ID NO: 2784481 - DNA, 22 bp, Homo sapiens
tgatccgttccattgcaagctt

SEQ ID NO: 2784482 - DNA, 16 bp, Homo sapiens
tgatcctcccacctca

SEQ ID NO: 2784483 - DNA, 19 bp, Homo sapiens
tgatcctcccacctcagcc

SEQ ID NO: 2784484 - DNA, 14 bp, Homo sapiens
tgatctcaggagct

SEQ ID NO: 2784485 - DNA, 16 bp, Homo sapiens
tgatctccctgccgcc

SEQ ID NO: 2784486 - DNA, 18 bp, Homo sapiens
tgatctttgcagacaggc

SEQ ID NO: 2784487 - DNA, 19 bp, Homo sapiens
tgatctttgcagacaggca

SEQ ID NO: 2784488 - DNA, 23 bp, Homo sapiens
tgatctttgcagacaggcaagca

SEQ ID NO: 2784489 - DNA, 23 bp, Homo sapiens
tgatgaaaatgaatagagagtat

SEQ ID NO: 2784490 - DNA, 19 bp, Homo sapiens
tgatgaccaatctctgtga

SEQ ID NO: 2784491 - DNA, 13 bp, Homo sapiens
tgatgagggcagc

SEQ ID NO: 2784492 - DNA, 21 bp, Homo sapiens
tgatgatcagctgtttgtcat

SEQ ID NO: 2784493 - DNA, 20 bp, Homo sapiens
tgatgatgaaatgaggtcag

SEQ ID NO: 2784494 - DNA, 16 bp, Homo sapiens
tgatgatgaccaagaa

SEQ ID NO: 2784495 - DNA, 21 bp, Homo sapiens
tgatgattaaacacctgacac

SEQ ID NO: 2784496 - DNA, 22 bp, Homo sapiens
tgatggcaccactgcactccag

SEQ ID NO: 2784497 - DNA, 22 bp, Homo sapiens
tgatgggcaacccccagcctgc

SEQ ID NO: 2784498 - DNA, 16 bp, Homo sapiens
tgatggggtgggcagg

SEQ ID NO: 2784499 - DNA, 18 bp, Homo sapiens
tgatggggtgggcagggc

SEQ ID NO: 2784500 - DNA, 11 bp, Homo sapiens
tgatgtacatg

SEQ ID NO: 2784501 - DNA, 16 bp, Homo sapiens
tgccttcctgtttaaa

SEQ ID NO: 2784502 - DNA, 14 bp, Homo sapiens
tgccttgaagccac

SEQ ID NO: 2784503 - DNA, 18 bp, Homo sapiens
tgcctttccacctgcttt

SEQ ID NO: 2784504 - DNA, 20 bp, Homo sapiens
tgcctttccacctgctttct

SEQ ID NO: 2784505 - DNA, 15 bp, Homo sapiens
tgccttttaaaagaa

SEQ ID NO: 2784506 - DNA, 16 bp, Homo sapiens
tgccttttaaaagaaa

SEQ ID NO: 2784507 - DNA, 15 bp, Homo sapiens
tgccttttccctctg

SEQ ID NO: 2784508 - DNA, 22 bp, Homo sapiens
tgcctttttatttttgttttta

SEQ ID NO: 2784509 - DNA, 18 bp, Homo sapiens
tgcctttttgtttttgta

SEQ ID NO: 2784510 - DNA, 18 bp, Homo sapiens
tgcgaaggggccctggtc

SEQ ID NO: 2784511 - DNA, 20 bp, Homo sapiens
tgcgagagaggtgggcagca

SEQ ID NO: 2784512 - DNA, 18 bp, Homo sapiens
tgcgagatcgctggcaga

SEQ ID NO: 2784513 - DNA, 15 bp, Homo sapiens
tgcgatctgggttca

SEQ ID NO: 2784514 - DNA, 20 bp, Homo sapiens
tgcgatctgggttcactgca

SEQ ID NO: 2784515 - DNA, 17 bp, Homo sapiens
tgcgatcttcagagcag

SEQ ID NO: 2784516 - DNA, 22 bp, Homo sapiens
tgcgcgcatgtaatcccagcta

SEQ ID NO: 2784517 - DNA, 21 bp, Homo sapiens
tgcgctggtggaccacaggca

SEQ ID NO: 2784518 - DNA, 17 bp, Homo sapiens
tgcggacagccacggcc

SEQ ID NO: 2784519 - DNA, 21 bp, Homo sapiens
tgcgggaccggtacagaaagg

SEQ ID NO: 2784520 - DNA, 17 bp, Homo sapiens
tgcgggcttttccccgg

SEQ ID NO: 2784521 - DNA, 15 bp, Homo sapiens
tgcggtccacccagg

SEQ ID NO: 2784522 - DNA, 18 bp, Homo sapiens
tgcggtccacccaggagc

SEQ ID NO: 2784523 - DNA, 21 bp, Homo sapiens
tgcggtggctcacgcctgtaa

SEQ ID NO: 2784524 - DNA, 23 bp, Homo sapiens
tgcgtacgtttcctgagaagtgt

SEQ ID NO: 2784525 - DNA, 16 bp, Homo sapiens
tgcgtggactctgcac

SEQ ID NO: 2784526 - DNA, 18 bp, Homo sapiens
tgcgtggactctgcacat

SEQ ID NO: 2784527 - DNA, 22 bp, Homo sapiens
tgcgtggactctgcacatgtct

SEQ ID NO: 2784528 - DNA, 13 bp, Homo sapiens
tgcgtgtcgtggg

SEQ ID NO: 2784529 - DNA, 13 bp, Homo sapiens
tgcgttactaatt

SEQ ID NO: 2784530 - DNA, 19 bp, Homo sapiens
tgctaaatgcaaacactgt

SEQ ID NO: 2784531 - DNA, 21 bp, Homo sapiens
tgctaaatggtcgcccaggag

SEQ ID NO: 2784532 - DNA, 22 bp, Homo sapiens
tgctaagaagcgagcactgacc

SEQ ID NO: 2784533 - DNA, 22 bp, Homo sapiens
tgctaatcagggaggtcatttt

SEQ ID NO: 2784534 - DNA, 23 bp, Homo sapiens
tgctaatcagggaggtcattttg

SEQ ID NO: 2784535 - DNA, 20 bp, Homo sapiens
tgctaatcttcttatgcaat

SEQ ID NO: 2784536 - DNA, 22 bp, Homo sapiens
tgctaatcttcttatgcaattt

SEQ ID NO: 2784537 - DNA, 17 bp, Homo sapiens
tgctaattaaaaagtta

SEQ ID NO: 2784538 - DNA, 18 bp, Homo sapiens
tgctagcacttggagcca

SEQ ID NO: 2784539 - DNA, 20 bp, Homo sapiens
tgctagcacttggagccaag

SEQ ID NO: 2784540 - DNA, 13 bp, Homo sapiens
tgctagctgtaga

SEQ ID NO: 2784541 - DNA, 16 bp, Homo sapiens
tgctagctgtagaaat

SEQ ID NO: 2784542 - DNA, 21 bp, Homo sapiens
tgctaggcgagtgccaggact

SEQ ID NO: 2784543 - DNA, 23 bp, Homo sapiens
tgctataggctggagaagctcac

SEQ ID NO: 2784544 - DNA, 14 bp, Homo sapiens
tgctatcacacagt

SEQ ID NO: 2784545 - DNA, 22 bp, Homo sapiens
tgctatcgcaccactgtgtatt

SEQ ID NO: 2784546 - DNA, 21 bp, Homo sapiens
tgctatctctgtgtgcacaaa

SEQ ID NO: 2784547 - DNA, 21 bp, Homo sapiens
tgctcaaatctattcagacaa

SEQ ID NO: 2784548 - DNA, 15 bp, Homo sapiens
tgctcaaccactgtg

SEQ ID NO: 2784549 - DNA, 19 bp, Homo sapiens
tgctcaacctctctccttc

SEQ ID NO: 2784550 - DNA, 20 bp, Homo sapiens
tgctcaacctctctccttct

SEQ ID NO: 2784551 - DNA, 21 bp, Homo sapiens
tgctcaacctctctccttctg

SEQ ID NO: 2784552 - DNA, 15 bp, Homo sapiens
tgctcaagaagacat

SEQ ID NO: 2784553 - DNA, 19 bp, Homo sapiens
tgctcaccaagctgttcca

SEQ ID NO: 2784554 - DNA, 13 bp, Homo sapiens
tgctcagacagaa

SEQ ID NO: 2784555 - DNA, 21 bp, Homo sapiens
tgctcagaggggccccggtcc

SEQ ID NO: 2784556 - DNA, 19 bp, Homo sapiens
tgctcagcccttcctagaa

SEQ ID NO: 2784557 - DNA, 17 bp, Homo sapiens
tgctcagtaatttgagg

SEQ ID NO: 2784558 - DNA, 20 bp, Homo sapiens
tgctcccagcagccctaagg

SEQ ID NO: 2784559 - DNA, 11 bp, Homo sapiens
tgctcctccag

SEQ ID NO: 2784560 - DNA, 13 bp, Homo sapiens
tgctcctccaggg

SEQ ID NO: 2784561 - DNA, 16 bp, Homo sapiens
tgctcctccagggcca

SEQ ID NO: 2784562 - DNA, 13 bp, Homo sapiens
tgctcctcccatt

SEQ ID NO: 2784563 - DNA, 19 bp, Homo sapiens
tgctcctccttggtgcctg

SEQ ID NO: 2784564 - DNA, 15 bp, Homo sapiens
tgctcctctccaggc

SEQ ID NO: 2784565 - DNA, 14 bp, Homo sapiens
tgctcctctcccca

SEQ ID NO: 2784566 - DNA, 17 bp, Homo sapiens
tgctcctctccccagca

SEQ ID NO: 2784567 - DNA, 19 bp, Homo sapiens
tgctcctctccccagcaag

SEQ ID NO: 2784568 - DNA, 15 bp, Homo sapiens
tgctctcccctgccc

SEQ ID NO: 2784569 - DNA, 22 bp, Homo sapiens
tgctctcctaccccacctcatg

SEQ ID NO: 2784570 - DNA, 12 bp, Homo sapiens
tgctctctgagg

SEQ ID NO: 2784571 - DNA, 17 bp, Homo sapiens
tgctctgaggcttccag

SEQ ID NO: 2784572 - DNA, 15 bp, Homo sapiens
tgctctgctgacaga

SEQ ID NO: 2784573 - DNA, 17 bp, Homo sapiens
tgctctggacaggcatg

SEQ ID NO: 2784574 - DNA, 22 bp, Homo sapiens
tgctcttctacgtataaatatg

SEQ ID NO: 2784575 - DNA, 23 bp, Homo sapiens
tgctgaaggaataaattgctcct

SEQ ID NO: 2784576 - DNA, 22 bp, Homo sapiens
tgctgaagggaccttgaagggt

SEQ ID NO: 2784577 - DNA, 19 bp, Homo sapiens
tgctgacagacacaggccc

SEQ ID NO: 2784578 - DNA, 21 bp, Homo sapiens
tgctgagagacccaaggagga

SEQ ID NO: 2784579 - DNA, 21 bp, Homo sapiens
tgctgagctctgagaggccct

SEQ ID NO: 2784580 - DNA, 21 bp, Homo sapiens
tgctgagtatgttaagctctt

SEQ ID NO: 2784581 - DNA, 15 bp, Homo sapiens
tgctgagttggtgtt

SEQ ID NO: 2784582 - DNA, 15 bp, Homo sapiens
tgctgcaaagtgcaa

SEQ ID NO: 2784583 - DNA, 17 bp, Homo sapiens
tgctgcaaagtgcaaat

SEQ ID NO: 2784584 - DNA, 13 bp, Homo sapiens
tgctgcagccagg

SEQ ID NO: 2784585 - DNA, 19 bp, Homo sapiens
tgctgcatttgtgtcatct

SEQ ID NO: 2784586 - DNA, 22 bp, Homo sapiens
tgctgccccgcttccccacaga

SEQ ID NO: 2784587 - DNA, 21 bp, Homo sapiens
tgctgcccctgcagttggcag

SEQ ID NO: 2784588 - DNA, 20 bp, Homo sapiens
tgctgcccgtcttcagccta

SEQ ID NO: 2784589 - DNA, 17 bp, Homo sapiens
tgctgccgcctcccagc

SEQ ID NO: 2784590 - DNA, 13 bp, Homo sapiens
tgctgctctctga

SEQ ID NO: 2784591 - DNA, 22 bp, Homo sapiens
tgggtactactgctgcaaagtg

SEQ ID NO: 2784592 - DNA, 18 bp, Homo sapiens
tgggtacttgtggacaca

SEQ ID NO: 2784593 - DNA, 20 bp, Homo sapiens
tgggtacttgtggacacagc

SEQ ID NO: 2784594 - DNA, 20 bp, Homo sapiens
tgggtagcaattctacccag

SEQ ID NO: 2784595 - DNA, 22 bp, Homo sapiens
tgggtcctgcaatctccagggc

SEQ ID NO: 2784596 - DNA, 23 bp, Homo sapiens
tgggtcctgcaatctccagggct

SEQ ID NO: 2784597 - DNA, 14 bp, Homo sapiens
tgggtcctgcaatt

SEQ ID NO: 2784598 - DNA, 22 bp, Homo sapiens
tgggtggaggaagatccaaaca

SEQ ID NO: 2784599 - DNA, 22 bp, Homo sapiens
tgggtggatcaccagaggtcag

SEQ ID NO: 2784600 - DNA, 23 bp, Homo sapiens
tgggtggctactctgtgccagag

SEQ ID NO: 2784601 - DNA, 13 bp, Homo sapiens
tgggtggggctgc

SEQ ID NO: 2784602 - DNA, 14 bp, Homo sapiens
tgggtggtggatct

SEQ ID NO: 2784603 - DNA, 16 bp, Homo sapiens
tgggtgtgccaggcta

SEQ ID NO: 2784604 - DNA, 18 bp, Homo sapiens
tgggtgtgtgtagccaag

SEQ ID NO: 2784605 - DNA, 21 bp, Homo sapiens
tgggttcctcttccccactcc

SEQ ID NO: 2784606 - DNA, 17 bp, Homo sapiens
tgggttctttggaagga

SEQ ID NO: 2784607 - DNA, 14 bp, Homo sapiens
tgggttgactttca

SEQ ID NO: 2784608 - DNA, 19 bp, Homo sapiens
tgggtttgtttttcaaagc

SEQ ID NO: 2784609 - DNA, 14 bp, Homo sapiens
tgggttttcttccc

SEQ ID NO: 2784610 - DNA, 15 bp, Homo sapiens
tgggtttttgttacc

SEQ ID NO: 2784611 - DNA, 22 bp, Homo sapiens
tgggtttttgttacctttatgg

SEQ ID NO: 2784612 - DNA, 17 bp, Homo sapiens
tgggttttttcacataa

SEQ ID NO: 2784613 - DNA, 22 bp, Homo sapiens
tggtaagaagccgggaacagac

SEQ ID NO: 2784614 - DNA, 15 bp, Homo sapiens
tggtaagctctggct

SEQ ID NO: 2784615 - DNA, 15 bp, Homo sapiens
tggtaggcttatcaa

SEQ ID NO: 2784616 - DNA, 20 bp, Homo sapiens
tggtaggcttatcaaaatct

SEQ ID NO: 2784617 - DNA, 19 bp, Homo sapiens
tggtatgtgtgtgtatgct

SEQ ID NO: 2784618 - DNA, 20 bp, Homo sapiens
tggtattttcgtgcatttgt

SEQ ID NO: 2784619 - DNA, 14 bp, Homo sapiens
tggtcaaaccgcac

SEQ ID NO: 2784620 - DNA, 17 bp, Homo sapiens
tggtcaaaccgcactca

SEQ ID NO: 2784621 - DNA, 21 bp, Homo sapiens
tggtcaaaccgcactcaccca

SEQ ID NO: 2784622 - DNA, 14 bp, Homo sapiens
tggtcaacacttaa

SEQ ID NO: 2784623 - DNA, 19 bp, Homo sapiens
tggtcaaggcccggcccca

SEQ ID NO: 2784624 - DNA, 22 bp, Homo sapiens
tggtccagcttgctcttcagtg

SEQ ID NO: 2784625 - DNA, 23 bp, Homo sapiens
tggtcccaagtagtagtgtcttc

SEQ ID NO: 2784626 - DNA, 17 bp, Homo sapiens
tggtcccacatccctgg

SEQ ID NO: 2784627 - DNA, 19 bp, Homo sapiens
tggtcccacatccctgggc

SEQ ID NO: 2784628 - DNA, 23 bp, Homo sapiens
tggtcccacatccctgggcctgc

SEQ ID NO: 2784629 - DNA, 14 bp, Homo sapiens
tggtcctgagacct

SEQ ID NO: 2784630 - DNA, 16 bp, Homo sapiens
tggtcctggggctctg

SEQ ID NO: 2784631 - DNA, 23 bp, Homo sapiens
tggtccttccaggcccccaccac

SEQ ID NO: 2784632 - DNA, 15 bp, Homo sapiens
tggtcgcccaggaga

SEQ ID NO: 2784633 - DNA, 16 bp, Homo sapiens
tggtcggcaagagtga

SEQ ID NO: 2784634 - DNA, 22 bp, Homo sapiens
tggtcggggagctggggtacag

SEQ ID NO: 2784635 - DNA, 12 bp, Homo sapiens
tggtctgccctg

SEQ ID NO: 2784636 - DNA, 14 bp, Homo sapiens
tggtctgccctggg

SEQ ID NO: 2784637 - DNA, 23 bp, Homo sapiens
tggtctgctcaggaattgaagat

SEQ ID NO: 2784638 - DNA, 17 bp, Homo sapiens
tggtcttgagatgtctt

SEQ ID NO: 2784639 - DNA, 16 bp, Homo sapiens
tggtcttgtggaattg

SEQ ID NO: 2784640 - DNA, 16 bp, Homo sapiens
tggtctttgaataaag

SEQ ID NO: 2784641 - DNA, 21 bp, Homo sapiens
tggtctttgaataaagtctga

SEQ ID NO: 2784642 - DNA, 23 bp, Homo sapiens
tggtctttgaataaagtctgagt

SEQ ID NO: 2784643 - DNA, 13 bp, Homo sapiens
tggtgacctctgc

SEQ ID NO: 2784644 - DNA, 16 bp, Homo sapiens
tggtgacctctgcctg

SEQ ID NO: 2784645 - DNA, 17 bp, Homo sapiens
tggtgacctctgcctga

SEQ ID NO: 2784646 - DNA, 23 bp, Homo sapiens
tggtgacttcctcgcctctccca

SEQ ID NO: 2784647 - DNA, 14 bp, Homo sapiens
tggtgcaaatccta

SEQ ID NO: 2784648 - DNA, 20 bp, Homo sapiens
tggtgcagaaaaaaaaaaag

SEQ ID NO: 2784649 - DNA, 20 bp, Homo sapiens
tggtgcagaggtgagcagag

SEQ ID NO: 2784650 - DNA, 19 bp, Homo sapiens
tggtgcctggcctggcaca

SEQ ID NO: 2784651 - DNA, 22 bp, Homo sapiens
tggtgcctggcctggcacacat

SEQ ID NO: 2784652 - DNA, 16 bp, Homo sapiens
tggtgcgatctgggtt

SEQ ID NO: 2784653 - DNA, 12 bp, Homo sapiens
tggtgctaactg

SEQ ID NO: 2784654 - DNA, 18 bp, Homo sapiens
tggtgctataggctggag

SEQ ID NO: 2784655 - DNA, 22 bp, Homo sapiens
tggtgctataggctggagaagc

SEQ ID NO: 2784656 - DNA, 12 bp, Homo sapiens
tggtgctgtggc

SEQ ID NO: 2784657 - DNA, 20 bp, Homo sapiens
tggtgctgtggccagggtga

SEQ ID NO: 2784658 - DNA, 16 bp, Homo sapiens
tggtggacagtcctgg

SEQ ID NO: 2784659 - DNA, 18 bp, Homo sapiens
tggtggacagtcctggga

SEQ ID NO: 2784660 - DNA, 12 bp, Homo sapiens
tggtggcagctg

SEQ ID NO: 2784661 - DNA, 17 bp, Homo sapiens
tggtggcagctgggcag

SEQ ID NO: 2784662 - DNA, 12 bp, Homo sapiens
tggtggcagtgg

SEQ ID NO: 2784663 - DNA, 13 bp, Homo sapiens
tggtggcagtggg

SEQ ID NO: 2784664 - DNA, 17 bp, Homo sapiens
tggtggcgcaagcctgt

SEQ ID NO: 2784665 - DNA, 14 bp, Homo sapiens
tggtggctgtctct

SEQ ID NO: 2784666 - DNA, 16 bp, Homo sapiens
tggtggggagaggcat

SEQ ID NO: 2784667 - DNA, 14 bp, Homo sapiens
tggtggggcagctc

SEQ ID NO: 2784668 - DNA, 13 bp, Homo sapiens
tggtgtccacctg

SEQ ID NO: 2784669 - DNA, 18 bp, Homo sapiens
tggtgtccacctggcccc

SEQ ID NO: 2784670 - DNA, 16 bp, Homo sapiens
tggtgttactaaagtc

SEQ ID NO: 2784671 - DNA, 14 bp, Homo sapiens
tggttagaaatgca

SEQ ID NO: 2784672 - DNA, 16 bp, Homo sapiens
tggttcagctaagcta

SEQ ID NO: 2784673 - DNA, 15 bp, Homo sapiens
tggttccatgcctga

SEQ ID NO: 2784674 - DNA, 22 bp, Homo sapiens
tggttccatgcctgagggtgga

SEQ ID NO: 2784675 - DNA, 16 bp, Homo sapiens
tggttcccaataaaag

SEQ ID NO: 2784676 - DNA, 15 bp, Homo sapiens
tggttctctccagga

SEQ ID NO: 2784677 - DNA, 18 bp, Homo sapiens
tggttgatgccaaaaaaa

SEQ ID NO: 2784678 - DNA, 15 bp, Homo sapiens
tggttgtcaatatta

SEQ ID NO: 2784679 - DNA, 19 bp, Homo sapiens
tggtttagcacaatttata

SEQ ID NO: 2784680 - DNA, 11 bp, Homo sapiens
tggtttatgtc

SEQ ID NO: 2784681 - DNA, 21 bp, Homo sapiens
tgttatttctatttttgtaga

SEQ ID NO: 2784682 - DNA, 22 bp, Homo sapiens
tgttatttctatttttgtagaa

SEQ ID NO: 2784683 - DNA, 18 bp, Homo sapiens
tgttattttttaattatt

SEQ ID NO: 2784684 - DNA, 20 bp, Homo sapiens
tgttattttttatttccaca

SEQ ID NO: 2784685 - DNA, 17 bp, Homo sapiens
tgttcaccttatgtatt

SEQ ID NO: 2784686 - DNA, 22 bp, Homo sapiens
tgttcagaaggttgctctagat

SEQ ID NO: 2784687 - DNA, 14 bp, Homo sapiens
tgttcagcttcaga

SEQ ID NO: 2784688 - DNA, 13 bp, Homo sapiens
tgttcaggagctg

SEQ ID NO: 2784689 - DNA, 17 bp, Homo sapiens
tgttcattaaattttct

SEQ ID NO: 2784690 - DNA, 15 bp, Homo sapiens
tgttcattcactgca

SEQ ID NO: 2784691 - DNA, 14 bp, Homo sapiens
tgttcatttcctca

SEQ ID NO: 2784692 - DNA, 21 bp, Homo sapiens
tgttcccccgctggcagccac

SEQ ID NO: 2784693 - DNA, 19 bp, Homo sapiens
tgttccttaagtcagaaca

SEQ ID NO: 2784694 - DNA, 16 bp, Homo sapiens
tgttctggagctgctg

SEQ ID NO: 2784695 - DNA, 17 bp, Homo sapiens
tgttctggagctgctgt

SEQ ID NO: 2784696 - DNA, 16 bp, Homo sapiens
tgttctggcctcagac

SEQ ID NO: 2784697 - DNA, 18 bp, Homo sapiens
tgttctggcctcagacca

SEQ ID NO: 2784698 - DNA, 13 bp, Homo sapiens
tgttctgggacac

SEQ ID NO: 2784699 - DNA, 20 bp, Homo sapiens
tgttctgtccagtttccaaa

SEQ ID NO: 2784700 - DNA, 21 bp, Homo sapiens
tgttctgtccagtttccaaag

SEQ ID NO: 2784701 - DNA, 17 bp, Homo sapiens
tgttcttacctgtatgt

SEQ ID NO: 2784702 - DNA, 13 bp, Homo sapiens
tgttgaaaatgag

SEQ ID NO: 2784703 - DNA, 17 bp, Homo sapiens
tgttgaaaatgttcaga

SEQ ID NO: 2784704 - DNA, 17 bp, Homo sapiens
tgttgacagttcatatg

SEQ ID NO: 2784705 - DNA, 15 bp, Homo sapiens
tgttgagagtgtgac

SEQ ID NO: 2784706 - DNA, 16 bp, Homo sapiens
tgttgatcccaagaca

SEQ ID NO: 2784707 - DNA, 14 bp, Homo sapiens
tgttgattaaaaca

SEQ ID NO: 2784708 - DNA, 17 bp, Homo sapiens
tgttgatttgagaaatt

SEQ ID NO: 2784709 - DNA, 19 bp, Homo sapiens
tgttgcaagtactgctgta

SEQ ID NO: 2784710 - DNA, 20 bp, Homo sapiens
tgttgccatgaggcctttcc

SEQ ID NO: 2784711 - DNA, 20 bp, Homo sapiens
tgttgcccaggctggcgtgc

SEQ ID NO: 2784712 - DNA, 23 bp, Homo sapiens
tgttgctcaaatctattcagaca

SEQ ID NO: 2784713 - DNA, 16 bp, Homo sapiens
tgttgcttagtcactt

SEQ ID NO: 2784714 - DNA, 12 bp, Homo sapiens
tgttggaatgaa

SEQ ID NO: 2784715 - DNA, 13 bp, Homo sapiens
tgttggacccgct

SEQ ID NO: 2784716 - DNA, 18 bp, Homo sapiens
tgttggacccgctctgga

SEQ ID NO: 2784717 - DNA, 23 bp, Homo sapiens
tgttggataataactagatctcc

SEQ ID NO: 2784718 - DNA, 16 bp, Homo sapiens
tgttggccaggctggt

SEQ ID NO: 2784719 - DNA, 19 bp, Homo sapiens
tgttggctgggggcctcag

SEQ ID NO: 2784720 - DNA, 15 bp, Homo sapiens
tgttggggcagtggt

SEQ ID NO: 2784721 - DNA, 21 bp, Homo sapiens
tgttgtaaatatttatgtaaa

SEQ ID NO: 2784722 - DNA, 14 bp, Homo sapiens
tgttgtcaagtata

SEQ ID NO: 2784723 - DNA, 12 bp, Homo sapiens
tgttgtgattaa

SEQ ID NO: 2784724 - DNA, 15 bp, Homo sapiens
tgttgttaaacacgt

SEQ ID NO: 2784725 - DNA, 18 bp, Homo sapiens
tgttgttaatgaaaatgt

SEQ ID NO: 2784726 - DNA, 16 bp, Homo sapiens
tgttgtttcttaaata

SEQ ID NO: 2784727 - DNA, 17 bp, Homo sapiens
tgttgtttcttaaataa

SEQ ID NO: 2784728 - DNA, 20 bp, Homo sapiens
tgtttaaaaacattccccaa

SEQ ID NO: 2784729 - DNA, 14 bp, Homo sapiens
tgtttaaacctttt

SEQ ID NO: 2784730 - DNA, 23 bp, Homo sapiens
tgtttaaagttcaacatgttatt

SEQ ID NO: 2784731 - DNA, 21 bp, Homo sapiens
tgtttaagtgttgtaaatatt

SEQ ID NO: 2784732 - DNA, 17 bp, Homo sapiens
tgtttagaagagcctga

SEQ ID NO: 2784733 - DNA, 15 bp, Homo sapiens
tgtttatataatttt

SEQ ID NO: 2784734 - DNA, 18 bp, Homo sapiens
tgtttatataattttgca

SEQ ID NO: 2784735 - DNA, 23 bp, Homo sapiens
tgtttatttataagcagatttaa

SEQ ID NO: 2784736 - DNA, 20 bp, Homo sapiens
tgtttatttattcactgtaa

SEQ ID NO: 2784737 - DNA, 16 bp, Homo sapiens
tgtttcactatgattt

SEQ ID NO: 2784738 - DNA, 19 bp, Homo sapiens
tgtttcattttcattaaaa

SEQ ID NO: 2784739 - DNA, 16 bp, Homo sapiens
tgtttccagaaaatat

SEQ ID NO: 2784740 - DNA, 23 bp, Homo sapiens
tgtttccagaaaatataaatgca

SEQ ID NO: 2784741 - DNA, 21 bp, Homo sapiens
tgtttctgcagtagtctctgt

SEQ ID NO: 2784742 - DNA, 15 bp, Homo sapiens
tgtttcttgcctcat

SEQ ID NO: 2784743 - DNA, 21 bp, Homo sapiens
tgtttctttttttatgactgt

SEQ ID NO: 2784744 - DNA, 19 bp, Homo sapiens
tgtttgaactgccaagaaa

SEQ ID NO: 2784745 - DNA, 21 bp, Homo sapiens
tgtttgacaaagaaacccaag

SEQ ID NO: 2784746 - DNA, 22 bp, Homo sapiens
tgtttgacaaagaaacccaagt

SEQ ID NO: 2784747 - DNA, 17 bp, Homo sapiens
tgtttgagatgtgatgc

SEQ ID NO: 2784748 - DNA, 18 bp, Homo sapiens
tgtttgagatgtgatgct

SEQ ID NO: 2784749 - DNA, 14 bp, Homo sapiens
tgtttgagctcaga

SEQ ID NO: 2784750 - DNA, 13 bp, Homo sapiens
tgtttgatagatt

SEQ ID NO: 2784751 - DNA, 23 bp, Homo sapiens
tgtttgcacctttctagttgaaa

SEQ ID NO: 2784752 - DNA, 15 bp, Homo sapiens
tgtttggggatgaga

SEQ ID NO: 2784753 - DNA, 15 bp, Homo sapiens
tgtttggggcaggag

SEQ ID NO: 2784754 - DNA, 22 bp, Homo sapiens
tgtttgtttctccccctgggct

SEQ ID NO: 2784755 - DNA, 16 bp, Homo sapiens
tgttttaagaggcagg

SEQ ID NO: 2784756 - DNA, 17 bp, Homo sapiens
tgttttaagaggcaggg

SEQ ID NO: 2784757 - DNA, 22 bp, Homo sapiens
tgttttaagaggcagggtctca

SEQ ID NO: 2784758 - DNA, 12 bp, Homo sapiens
tgttttccctga

SEQ ID NO: 2784759 - DNA, 16 bp, Homo sapiens
tgttttccctgacctc

SEQ ID NO: 2784760 - DNA, 17 bp, Homo sapiens
tgttttctgatgacata

SEQ ID NO: 2784761 - DNA, 11 bp, Homo sapiens
tgttttcttct

SEQ ID NO: 2784762 - DNA, 18 bp, Homo sapiens
tgttttgtcccatttcct

SEQ ID NO: 2784763 - DNA, 20 bp, Homo sapiens
tgttttgtcctttgagaaag

SEQ ID NO: 2784764 - DNA, 22 bp, Homo sapiens
tgtttttaagctgtttccatag

SEQ ID NO: 2784765 - DNA, 20 bp, Homo sapiens
tgtttttatgaagaaaaaat

SEQ ID NO: 2784766 - DNA, 22 bp, Homo sapiens
ttaaaaaaagtatatattctac

SEQ ID NO: 2784767 - DNA, 23 bp, Homo sapiens
ttaaaaaaatcacactctaagtt

SEQ ID NO: 2784768 - DNA, 14 bp, Homo sapiens
ttaaaaaaatgaca

SEQ ID NO: 2784769 - DNA, 13 bp, Homo sapiens
ttaaaaaacttgt

SEQ ID NO: 2784770 - DNA, 21 bp, Homo sapiens
ttaaaaaagcttaaaactttg

SEQ ID NO: 2784771 - DNA, 14 bp, Homo sapiens
ttcagaagaaaaag

SEQ ID NO: 2784772 - DNA, 22 bp, Homo sapiens
ttcagaagacacaggggagcag

SEQ ID NO: 2784773 - DNA, 16 bp, Homo sapiens
ttcagaagacactgca

SEQ ID NO: 2784774 - DNA, 21 bp, Homo sapiens
ttcagacaagcaacaggtttt

SEQ ID NO: 2784775 - DNA, 18 bp, Homo sapiens
ttcagacttttatcaaaa

SEQ ID NO: 2784776 - DNA, 21 bp, Homo sapiens
ttcagacttttatcaaaatcc

SEQ ID NO: 2784777 - DNA, 11 bp, Homo sapiens
ttcagagaagt

SEQ ID NO: 2784778 - DNA, 15 bp, Homo sapiens
ttcagagactcaggg

SEQ ID NO: 2784779 - DNA, 14 bp, Homo sapiens
ttcagaggctgcag

SEQ ID NO: 2784780 - DNA, 16 bp, Homo sapiens
ttcagatatatttttc

SEQ ID NO: 2784781 - DNA, 16 bp, Homo sapiens
ttcagatcgtattaat

SEQ ID NO: 2784782 - DNA, 17 bp, Homo sapiens
ttcagatcgtattaatt

SEQ ID NO: 2784783 - DNA, 14 bp, Homo sapiens
ttcagattcccaga

SEQ ID NO: 2784784 - DNA, 21 bp, Homo sapiens
ttcagattcccagagcaaaat

SEQ ID NO: 2784785 - DNA, 13 bp, Homo sapiens
ttcagcccctcct

SEQ ID NO: 2784786 - DNA, 23 bp, Homo sapiens
ttcagcccctcctctgccacctc

SEQ ID NO: 2784787 - DNA, 20 bp, Homo sapiens
ttcagcctagccgacctcag

SEQ ID NO: 2784788 - DNA, 21 bp, Homo sapiens
ttcagcctagccgacctcagc

SEQ ID NO: 2784789 - DNA, 18 bp, Homo sapiens
ttcagcgagacccttgca

SEQ ID NO: 2784790 - DNA, 12 bp, Homo sapiens
ttcagctccagc

SEQ ID NO: 2784791 - DNA, 16 bp, Homo sapiens
ttcaggaaaaggcctg

SEQ ID NO: 2784792 - DNA, 17 bp, Homo sapiens
ttcaggaaaaggcctgg

SEQ ID NO: 2784793 - DNA, 21 bp, Homo sapiens
ttcaggacttaacggctccag

SEQ ID NO: 2784794 - DNA, 21 bp, Homo sapiens
ttcaggagagagttgaaccta

SEQ ID NO: 2784795 - DNA, 15 bp, Homo sapiens
ttcaggagctgaagc

SEQ ID NO: 2784796 - DNA, 17 bp, Homo sapiens
ttcaggagtcccaagga

SEQ ID NO: 2784797 - DNA, 17 bp, Homo sapiens
ttcaggtaacaggcaga

SEQ ID NO: 2784798 - DNA, 15 bp, Homo sapiens
ttcaggttttgtaaa

SEQ ID NO: 2784799 - DNA, 18 bp, Homo sapiens
ttcagtataaattgtcgt

SEQ ID NO: 2784800 - DNA, 16 bp, Homo sapiens
ttcagtataatttaac

SEQ ID NO: 2784801 - DNA, 23 bp, Homo sapiens
ttcagtcctggtctgctcaggaa

SEQ ID NO: 2784802 - DNA, 16 bp, Homo sapiens
ttcagtgaaagcatca

SEQ ID NO: 2784803 - DNA, 14 bp, Homo sapiens
ttcagtgcccacca

SEQ ID NO: 2784804 - DNA, 18 bp, Homo sapiens
ttcagtgccttggagcag

SEQ ID NO: 2784805 - DNA, 15 bp, Homo sapiens
ttcagtggcagctgc

SEQ ID NO: 2784806 - DNA, 16 bp, Homo sapiens
ttcagtggcagctgct

SEQ ID NO: 2784807 - DNA, 20 bp, Homo sapiens
ttcagtgtatggaaataaat

SEQ ID NO: 2784808 - DNA, 19 bp, Homo sapiens
ttcagttggctgacttcca

SEQ ID NO: 2784809 - DNA, 19 bp, Homo sapiens
ttcagtttcaattcagtgc

SEQ ID NO: 2784810 - DNA, 13 bp, Homo sapiens
ttcataacaatgt

SEQ ID NO: 2784811 - DNA, 14 bp, Homo sapiens
ttcataactttcat

SEQ ID NO: 2784812 - DNA, 13 bp, Homo sapiens
ttcataattagaa

SEQ ID NO: 2784813 - DNA, 16 bp, Homo sapiens
ttcataattagaacaa

SEQ ID NO: 2784814 - DNA, 21 bp, Homo sapiens
ttcataattagaacaatagct

SEQ ID NO: 2784815 - DNA, 14 bp, Homo sapiens
ttcatataaagtat

SEQ ID NO: 2784816 - DNA, 16 bp, Homo sapiens
ttcatataaagtatca

SEQ ID NO: 2784817 - DNA, 16 bp, Homo sapiens
ttcatcaatttttata

SEQ ID NO: 2784818 - DNA, 18 bp, Homo sapiens
ttcatcaatttttataca

SEQ ID NO: 2784819 - DNA, 23 bp, Homo sapiens
ttcatccagttgcaataaaatag

SEQ ID NO: 2784820 - DNA, 23 bp, Homo sapiens
ttcatctatggcagtccagccag

SEQ ID NO: 2784821 - DNA, 23 bp, Homo sapiens
ttcatctcatttaagggaaaaat

SEQ ID NO: 2784822 - DNA, 21 bp, Homo sapiens
ttcatgcaatgacatcttcaa

SEQ ID NO: 2784823 - DNA, 23 bp, Homo sapiens
ttcatgtaataaatctgagccta

SEQ ID NO: 2784824 - DNA, 16 bp, Homo sapiens
ttcattaaattttcta

SEQ ID NO: 2784825 - DNA, 15 bp, Homo sapiens
ttcatttcaactgtt

SEQ ID NO: 2784826 - DNA, 16 bp, Homo sapiens
ttcatttcctcaaaaa

SEQ ID NO: 2784827 - DNA, 15 bp, Homo sapiens
ttcatttcctgtgtc

SEQ ID NO: 2784828 - DNA, 16 bp, Homo sapiens
ttcatttcctgtgtct

SEQ ID NO: 2784829 - DNA, 17 bp, Homo sapiens
ttccaaatgaatgttgt

SEQ ID NO: 2784830 - DNA, 21 bp, Homo sapiens
ttccaattttctggaatacat

SEQ ID NO: 2784831 - DNA, 18 bp, Homo sapiens
ttccacagtctctgggag

SEQ ID NO: 2784832 - DNA, 13 bp, Homo sapiens
ttccacattaatt

SEQ ID NO: 2784833 - DNA, 20 bp, Homo sapiens
ttccacctgctttctcctgg

SEQ ID NO: 2784834 - DNA, 19 bp, Homo sapiens
ttccacgatgaaaaacttc

SEQ ID NO: 2784835 - DNA, 12 bp, Homo sapiens
ttccactggact

SEQ ID NO: 2784836 - DNA, 14 bp, Homo sapiens
ttccacttctctag

SEQ ID NO: 2784837 - DNA, 21 bp, Homo sapiens
ttccagaaaaccccagcatcc

SEQ ID NO: 2784838 - DNA, 17 bp, Homo sapiens
ttccagaaaatataaat

SEQ ID NO: 2784839 - DNA, 21 bp, Homo sapiens
ttccagaaaatataaatgcat

SEQ ID NO: 2784840 - DNA, 18 bp, Homo sapiens
ttccaggtatctccagga

SEQ ID NO: 2784841 - DNA, 18 bp, Homo sapiens
ttccagtacctttgtcac

SEQ ID NO: 2784842 - DNA, 22 bp, Homo sapiens
ttccagttcatctatggcagtc

SEQ ID NO: 2784843 - DNA, 19 bp, Homo sapiens
ttccataaggaatgtagct

SEQ ID NO: 2784844 - DNA, 19 bp, Homo sapiens
ttccataatctggactcct

SEQ ID NO: 2784845 - DNA, 14 bp, Homo sapiens
ttccataattatga

SEQ ID NO: 2784846 - DNA, 12 bp, Homo sapiens
ttccatctgatt

SEQ ID NO: 2784847 - DNA, 13 bp, Homo sapiens
ttccatgcctgag

SEQ ID NO: 2784848 - DNA, 16 bp, Homo sapiens
ttccatgtcgcctctg

SEQ ID NO: 2784849 - DNA, 16 bp, Homo sapiens
ttccatttggtgacca

SEQ ID NO: 2784850 - DNA, 22 bp, Homo sapiens
ttcccaagagcatcatgcctct

SEQ ID NO: 2784851 - DNA, 13 bp, Homo sapiens
ttcccaagctctg

SEQ ID NO: 2784852 - DNA, 14 bp, Homo sapiens
ttcccaagctctgc

SEQ ID NO: 2784853 - DNA, 18 bp, Homo sapiens
ttcccagagcaaaataat

SEQ ID NO: 2784854 - DNA, 16 bp, Homo sapiens
ttcccagctctccctc

SEQ ID NO: 2784855 - DNA, 20 bp, Homo sapiens
ttcccagctctccctctggc

SEQ ID NO: 2784856 - DNA, 23 bp, Homo sapiens
ttcccagctctccctctggccct

SEQ ID NO: 2784857 - DNA, 11 bp, Homo sapiens
ttcccataatt

SEQ ID NO: 2784858 - DNA, 13 bp, Homo sapiens
ttcccatccccag

SEQ ID NO: 2784859 - DNA, 14 bp, Homo sapiens
ttcccatccccagc

SEQ ID NO: 2784860 - DNA, 20 bp, Homo sapiens
ttcccatgctgaattatttt

SEQ ID NO: 2784861 - DNA, 20 bp, Homo sapiens
ttcccatttgtaatgtatct

SEQ ID NO: 2784862 - DNA, 16 bp, Homo sapiens
ttgcaatggcagcctt

SEQ ID NO: 2784863 - DNA, 18 bp, Homo sapiens
ttgcacaagcttgtatat

SEQ ID NO: 2784864 - DNA, 19 bp, Homo sapiens
ttgcacaagcttgtatata

SEQ ID NO: 2784865 - DNA, 9 bp, Homo sapiens
ttgcacaat

SEQ ID NO: 2784866 - DNA, 12 bp, Homo sapiens
ttgcacaatttg

SEQ ID NO: 2784867 - DNA, 22 bp, Homo sapiens
ttgcacaatttgagcaattcat

SEQ ID NO: 2784868 - DNA, 12 bp, Homo sapiens
ttgcactgaggg

SEQ ID NO: 2784869 - DNA, 16 bp, Homo sapiens
ttgcactgagggccac

SEQ ID NO: 2784870 - DNA, 17 bp, Homo sapiens
ttgcagaaaagcacctg

SEQ ID NO: 2784871 - DNA, 18 bp, Homo sapiens
ttgcagaaaagcacctgc

SEQ ID NO: 2784872 - DNA, 22 bp, Homo sapiens
ttgcagaaacattttgtggtca

SEQ ID NO: 2784873 - DNA, 16 bp, Homo sapiens
ttgcagacaggcaagc

SEQ ID NO: 2784874 - DNA, 19 bp, Homo sapiens
ttgcagattattttagtct

SEQ ID NO: 2784875 - DNA, 18 bp, Homo sapiens
ttgcagattcatttttct

SEQ ID NO: 2784876 - DNA, 14 bp, Homo sapiens
ttgcagcagaagcc

SEQ ID NO: 2784877 - DNA, 12 bp, Homo sapiens
ttgcagcagtga

SEQ ID NO: 2784878 - DNA, 17 bp, Homo sapiens
ttgcagtcatcagaagt

SEQ ID NO: 2784879 - DNA, 21 bp, Homo sapiens
ttgcagtttttttatggcatt

SEQ ID NO: 2784880 - DNA, 16 bp, Homo sapiens
ttgcataagattaaag

SEQ ID NO: 2784881 - DNA, 18 bp, Homo sapiens
ttgcataagattaaagga

SEQ ID NO: 2784882 - DNA, 23 bp, Homo sapiens
ttgcataagattaaaggaaggaa

SEQ ID NO: 2784883 - DNA, 14 bp, Homo sapiens
ttgcatgatgtatt

SEQ ID NO: 2784884 - DNA, 16 bp, Homo sapiens
ttgcatgtaaaatgca

SEQ ID NO: 2784885 - DNA, 23 bp, Homo sapiens
ttgcatgtaaaatgcagtccaga

SEQ ID NO: 2784886 - DNA, 11 bp, Homo sapiens
ttgcattagaa

SEQ ID NO: 2784887 - DNA, 16 bp, Homo sapiens
ttgcattagaaactga

SEQ ID NO: 2784888 - DNA, 14 bp, Homo sapiens
ttgcattccatgat

SEQ ID NO: 2784889 - DNA, 17 bp, Homo sapiens
ttgcattccatgatttt

SEQ ID NO: 2784890 - DNA, 14 bp, Homo sapiens
ttgcattgaatata

SEQ ID NO: 2784891 - DNA, 13 bp, Homo sapiens
ttgcatttctgct

SEQ ID NO: 2784892 - DNA, 18 bp, Homo sapiens
ttgccaaggcagcgggat

SEQ ID NO: 2784893 - DNA, 15 bp, Homo sapiens
ttgccacaaccctgt

SEQ ID NO: 2784894 - DNA, 22 bp, Homo sapiens
ttgccaccaccagatgagaagt

SEQ ID NO: 2784895 - DNA, 15 bp, Homo sapiens
ttgccagaaagcata

SEQ ID NO: 2784896 - DNA, 17 bp, Homo sapiens
ttgccagaaagcataaa

SEQ ID NO: 2784897 - DNA, 13 bp, Homo sapiens
ttgccagccagaa

SEQ ID NO: 2784898 - DNA, 21 bp, Homo sapiens
ttgccagccagaagcctctgc

SEQ ID NO: 2784899 - DNA, 20 bp, Homo sapiens
ttgccatgttggccaggctg

SEQ ID NO: 2784900 - DNA, 16 bp, Homo sapiens
ttgcccagagatgcct

SEQ ID NO: 2784901 - DNA, 17 bp, Homo sapiens
ttgcccagagatgcctc

SEQ ID NO: 2784902 - DNA, 16 bp, Homo sapiens
ttgcccaggcaggtct

SEQ ID NO: 2784903 - DNA, 12 bp, Homo sapiens
ttgcccaggctg

SEQ ID NO: 2784904 - DNA, 20 bp, Homo sapiens
ttgcccagggctcagcctgg

SEQ ID NO: 2784905 - DNA, 21 bp, Homo sapiens
ttgccccaaggctgctcagag

SEQ ID NO: 2784906 - DNA, 17 bp, Homo sapiens
ttgccccttgggcctcc

SEQ ID NO: 2784907 - DNA, 17 bp, Homo sapiens
ttgcccggattctggga

SEQ ID NO: 2784908 - DNA, 14 bp, Homo sapiens
ttgcccttcacagt

SEQ ID NO: 2784909 - DNA, 17 bp, Homo sapiens
ttgcccttcacagtgtt

SEQ ID NO: 2784910 - DNA, 18 bp, Homo sapiens
ttgcccttcacagtgttt

SEQ ID NO: 2784911 - DNA, 18 bp, Homo sapiens
ttgcccttgccctgacct

SEQ ID NO: 2784912 - DNA, 20 bp, Homo sapiens
ttgcctaaatccaaagaaaa

SEQ ID NO: 2784913 - DNA, 18 bp, Homo sapiens
ttgcctctgcctctgaca

SEQ ID NO: 2784914 - DNA, 19 bp, Homo sapiens
ttgcctgcagagagaagcc

SEQ ID NO: 2784915 - DNA, 14 bp, Homo sapiens
ttgcctgtgtgagc

SEQ ID NO: 2784916 - DNA, 14 bp, Homo sapiens
ttgccttagcactt

SEQ ID NO: 2784917 - DNA, 18 bp, Homo sapiens
ttgccttagcacttcttt

SEQ ID NO: 2784918 - DNA, 14 bp, Homo sapiens
ttgcggttcaggaa

SEQ ID NO: 2784919 - DNA, 21 bp, Homo sapiens
ttgcgtggaattgtgctgagt

SEQ ID NO: 2784920 - DNA, 15 bp, Homo sapiens
ttgcgtggactctgc

SEQ ID NO: 2784921 - DNA, 21 bp, Homo sapiens
ttgctatcaaaataaattgaa

SEQ ID NO: 2784922 - DNA, 16 bp, Homo sapiens
ttgctcaaaaatctgt

SEQ ID NO: 2784923 - DNA, 20 bp, Homo sapiens
ttgctcaccaagctgttcca

SEQ ID NO: 2784924 - DNA, 21 bp, Homo sapiens
ttgctcaccaagctgttccac

SEQ ID NO: 2784925 - DNA, 21 bp, Homo sapiens
ttgctctcccctgccctgctg

SEQ ID NO: 2784926 - DNA, 15 bp, Homo sapiens
ttgctgtcctaggcc

SEQ ID NO: 2784927 - DNA, 22 bp, Homo sapiens
ttgcttaaaattttacttttgt

SEQ ID NO: 2784928 - DNA, 24 bp, Homo sapiens
ttgcttaggatgtttttcatgaaa

SEQ ID NO: 2784929 - DNA, 22 bp, Homo sapiens
ttgcttagtcacttatttcata

SEQ ID NO: 2784930 - DNA, 13 bp, Homo sapiens
ttgcttatgacat

SEQ ID NO: 2784931 - DNA, 14 bp, Homo sapiens
ttgcttgagcccag

SEQ ID NO: 2784932 - DNA, 23 bp, Homo sapiens
ttgctttaatgtgtattgaagaa

SEQ ID NO: 2784933 - DNA, 20 bp, Homo sapiens
ttggaaagcatcacctcagg

SEQ ID NO: 2784934 - DNA, 22 bp, Homo sapiens
ttggaacatgtcggagtagaaa

SEQ ID NO: 2784935 - DNA, 21 bp, Homo sapiens
ttggaaccgtgtccagcacag

SEQ ID NO: 2784936 - DNA, 17 bp, Homo sapiens
ttggaactgaagggggc

SEQ ID NO: 2784937 - DNA, 17 bp, Homo sapiens
ttggaagctctgaagtc

SEQ ID NO: 2784938 - DNA, 16 bp, Homo sapiens
ttggaataataatttt

SEQ ID NO: 2784939 - DNA, 19 bp, Homo sapiens
ttggaataataattttcct

SEQ ID NO: 2784940 - DNA, 23 bp, Homo sapiens
ttggaataataattttcctccta

SEQ ID NO: 2784941 - DNA, 15 bp, Homo sapiens
ttggaatataattgt

SEQ ID NO: 2784942 - DNA, 13 bp, Homo sapiens
ttggacctctgct

SEQ ID NO: 2784943 - DNA, 15 bp, Homo sapiens
ttggacctctgctct

SEQ ID NO: 2784944 - DNA, 14 bp, Homo sapiens
ttggactgacattt

SEQ ID NO: 2784945 - DNA, 12 bp, Homo sapiens
ttggagaaaatg

SEQ ID NO: 2784946 - DNA, 13 bp, Homo sapiens
ttggagagtaaaa

SEQ ID NO: 2784947 - DNA, 17 bp, Homo sapiens
ttggagagtaaaaactg

SEQ ID NO: 2784948 - DNA, 18 bp, Homo sapiens
ttggagagtaaaaactga

SEQ ID NO: 2784949 - DNA, 23 bp, Homo sapiens
ttggagggtgggagagcccagcc

SEQ ID NO: 2784950 - DNA, 19 bp, Homo sapiens
ttggatatgtaaaacattt

SEQ ID NO: 2784951 - DNA, 20 bp, Homo sapiens
ttggatgggagtgagacaga

SEQ ID NO: 2784952 - DNA, 23 bp, Homo sapiens
ttggcacagaaacacaatatttt

SEQ ID NO: 2784953 - DNA, 19 bp, Homo sapiens
tttccacctgctttctcct

SEQ ID NO: 2784954 - DNA, 14 bp, Homo sapiens
tttccagaaaatat

SEQ ID NO: 2784955 - DNA, 15 bp, Homo sapiens
tttccagaaaatata

SEQ ID NO: 2784956 - DNA, 16 bp, Homo sapiens
tttccagaaaatataa

SEQ ID NO: 2784957 - DNA, 17 bp, Homo sapiens
tttccagaaaatataaa

SEQ ID NO: 2784958 - DNA, 19 bp, Homo sapiens
tttccagaggctattattt

SEQ ID NO: 2784959 - DNA, 19 bp, Homo sapiens
tttccagtgagcttatcat

SEQ ID NO: 2784960 - DNA, 17 bp, Homo sapiens
tttccatgaaaatgcaa

SEQ ID NO: 2784961 - DNA, 18 bp, Homo sapiens
tttccatttcttcctcac

SEQ ID NO: 2784962 - DNA, 19 bp, Homo sapiens
tttcccaccaccttggact

SEQ ID NO: 2784963 - DNA, 19 bp, Homo sapiens
tttcccatgctgaattatt

SEQ ID NO: 2784964 - DNA, 14 bp, Homo sapiens
tttccccaaagtct

SEQ ID NO: 2784965 - DNA, 23 bp, Homo sapiens
tttccccatttaggtttctgagt

SEQ ID NO: 2784966 - DNA, 19 bp, Homo sapiens
tttccctcaccccctccca

SEQ ID NO: 2784967 - DNA, 15 bp, Homo sapiens
tttccctcctgggag

SEQ ID NO: 2784968 - DNA, 14 bp, Homo sapiens
tttccctgactcct

SEQ ID NO: 2784969 - DNA, 19 bp, Homo sapiens
tttccgtctccctaaaata

SEQ ID NO: 2784970 - DNA, 15 bp, Homo sapiens
tttcctaaatgcagt

SEQ ID NO: 2784971 - DNA, 13 bp, Homo sapiens
tttcctaaatgtt

SEQ ID NO: 2784972 - DNA, 14 bp, Homo sapiens
tttcctaaatgttt

SEQ ID NO: 2784973 - DNA, 23 bp, Homo sapiens
tttcctagccctctcacatttat

SEQ ID NO: 2784974 - DNA, 19 bp, Homo sapiens
tttcctattttaaaaccat

SEQ ID NO: 2784975 - DNA, 12 bp, Homo sapiens
tttcctccccac

SEQ ID NO: 2784976 - DNA, 13 bp, Homo sapiens
tttcctccctcag

SEQ ID NO: 2784977 - DNA, 22 bp, Homo sapiens
tttcctccgtcacctcagagac

SEQ ID NO: 2784978 - DNA, 22 bp, Homo sapiens
tttcctctccaattgtaaaaaa

SEQ ID NO: 2784979 - DNA, 16 bp, Homo sapiens
tttccttttttgttat

SEQ ID NO: 2784980 - DNA, 18 bp, Homo sapiens
tttcggacagtttatttg

SEQ ID NO: 2784981 - DNA, 14 bp, Homo sapiens
tttcgtgcatttgt

SEQ ID NO: 2784982 - DNA, 15 bp, Homo sapiens
tttcgtgcatttgtg

SEQ ID NO: 2784983 - DNA, 19 bp, Homo sapiens
tttctacacagtaaaaact

SEQ ID NO: 2784984 - DNA, 16 bp, Homo sapiens
tttctaccatttcaga

SEQ ID NO: 2784985 - DNA, 15 bp, Homo sapiens
tttctacccagcgag

SEQ ID NO: 2784986 - DNA, 16 bp, Homo sapiens
tttctagacttgtgct

SEQ ID NO: 2784987 - DNA, 14 bp, Homo sapiens
tttctccccctggg

SEQ ID NO: 2784988 - DNA, 15 bp, Homo sapiens
tttctccccctgggc

SEQ ID NO: 2784989 - DNA, 19 bp, Homo sapiens
tttctctagctgatcagaa

SEQ ID NO: 2784990 - DNA, 15 bp, Homo sapiens
tttctctttaaaaga

SEQ ID NO: 2784991 - DNA, 19 bp, Homo sapiens
tttctgaaaattaacactg

SEQ ID NO: 2784992 - DNA, 22 bp, Homo sapiens
tttctgatgacataataaagac

SEQ ID NO: 2784993 - DNA, 18 bp, Homo sapiens
tttctggaatacatgaaa

SEQ ID NO: 2784994 - DNA, 21 bp, Homo sapiens
tttctggaatacatgaaatat

SEQ ID NO: 2784995 - DNA, 24 bp, Homo sapiens
tttctgtggagagtgagaataatt

SEQ ID NO: 2784996 - DNA, 14 bp, Homo sapiens
tttctgttgccaca

SEQ ID NO: 2784997 - DNA, 13 bp, Homo sapiens
tttcttaaaatgt

SEQ ID NO: 2784998 - DNA, 23 bp, Homo sapiens
tttcttaccttaaaaagtaattg

SEQ ID NO: 2784999 - DNA, 15 bp, Homo sapiens
tttcttatttgcaat

SEQ ID NO: 2785000 - DNA, 21 bp, Homo sapiens
tttcttattttgtaataaact

SEQ ID NO: 2785001 - DNA, 23 bp, Homo sapiens
tttcttattttgtaataaactct

SEQ ID NO: 2785002 - DNA, 18 bp, Homo sapiens
tttcttcaccaaatcttg

SEQ ID NO: 2785003 - DNA, 19 bp, Homo sapiens
tttcttcatgcaatgacat

SEQ ID NO: 2785004 - DNA, 15 bp, Homo sapiens
tttcttcccatttgt

SEQ ID NO: 2785005 - DNA, 16 bp, Homo sapiens
tttcttcccatttgta

SEQ ID NO: 2785006 - DNA, 16 bp, Homo sapiens
tttcttcctctgctga

SEQ ID NO: 2785007 - DNA, 18 bp, Homo sapiens
tttcttctacaaccagag

SEQ ID NO: 2785008 - DNA, 21 bp, Homo sapiens
tttcttctacaaccagagccc

SEQ ID NO: 2785009 - DNA, 12 bp, Homo sapiens
tttcttctattt

SEQ ID NO: 2785010 - DNA, 16 bp, Homo sapiens
tttcttgcagatcaaa

SEQ ID NO: 2785011 - DNA, 16 bp, Homo sapiens
tttctttaagaaagta

SEQ ID NO: 2785012 - DNA, 23 bp, Homo sapiens
tttgaaaaagcgaaaaaatcagg

SEQ ID NO: 2785013 - DNA, 19 bp, Homo sapiens
tttgaaagtgaataaactt

SEQ ID NO: 2785014 - DNA, 15 bp, Homo sapiens
tttgaacccctgtgt

SEQ ID NO: 2785015 - DNA, 21 bp, Homo sapiens
tttgaagaagggaaattcaca

SEQ ID NO: 2785016 - DNA, 13 bp, Homo sapiens
tttgaagtgtaat

SEQ ID NO: 2785017 - DNA, 17 bp, Homo sapiens
tttgaataaaaaacatt

SEQ ID NO: 2785018 - DNA, 23 bp, Homo sapiens
tttgaataaaaaacatttgtaca

SEQ ID NO: 2785019 - DNA, 17 bp, Homo sapiens
tttgaatataaacacta

SEQ ID NO: 2785020 - DNA, 16 bp, Homo sapiens
tttgacatgaaaagat

SEQ ID NO: 2785021 - DNA, 20 bp, Homo sapiens
tttgacatttccttctttgt

SEQ ID NO: 2785022 - DNA, 23 bp, Homo sapiens
tttgagaatatgatcatgtaaat

SEQ ID NO: 2785023 - DNA, 14 bp, Homo sapiens
tttgagcaattcat

SEQ ID NO: 2785024 - DNA, 16 bp, Homo sapiens
tttgagcaattcattt

SEQ ID NO: 2785025 - DNA, 23 bp, Homo sapiens
tttgagcaattcatttcacttta

SEQ ID NO: 2785026 - DNA, 15 bp, Homo sapiens
tttgagcagggctca

SEQ ID NO: 2785027 - DNA, 15 bp, Homo sapiens
tttgagttcaaattt

SEQ ID NO: 2785028 - DNA, 22 bp, Homo sapiens
tttgataaattatgtttgtact

SEQ ID NO: 2785029 - DNA, 21 bp, Homo sapiens
tttgatactaagcattgaatg

SEQ ID NO: 2785030 - DNA, 19 bp, Homo sapiens
tttgatattaaaggagtta

SEQ ID NO: 2785031 - DNA, 15 bp, Homo sapiens
tttgatgggaagaaa

SEQ ID NO: 2785032 - DNA, 18 bp, Homo sapiens
tttgatgtacatgtgtag

SEQ ID NO: 2785033 - DNA, 14 bp, Homo sapiens
tttgatttcattaa

SEQ ID NO: 2785034 - DNA, 21 bp, Homo sapiens
tttgcaaggaagccacagctg

SEQ ID NO: 2785035 - DNA, 18 bp, Homo sapiens
tttgcaataaaaggtatt

SEQ ID NO: 2785036 - DNA, 18 bp, Homo sapiens
tttgcaattattctaatt

SEQ ID NO: 2785037 - DNA, 16 bp, Homo sapiens
tttgcacagctctccg

SEQ ID NO: 2785038 - DNA, 20 bp, Homo sapiens
tttgcacctttctagttgaa

SEQ ID NO: 2785039 - DNA, 12 bp, Homo sapiens
tttgcactgagg

SEQ ID NO: 2785040 - DNA, 17 bp, Homo sapiens
tttgcattccatgattt

SEQ ID NO: 2785041 - DNA, 14 bp, Homo sapiens
tttgcattcctaca

SEQ ID NO: 2785042 - DNA, 21 bp, Homo sapiens
tttgccagaacagtttgtaca

SEQ ID NO: 2785043 - DNA, 19 bp, Homo sapiens
tgcagctgcttgttgtcaa

SEQ ID NO: 2785044 - DNA, 19 bp, Homo sapiens
tgcaggccccgcttgtcca

SEQ ID NO: 2785045 - DNA, 13 bp, Homo sapiens
tgcagggagtccg

SEQ ID NO: 2785046 - DNA, 19 bp, Homo sapiens
tgcagggggtgtgtctgct

SEQ ID NO: 2785047 - DNA, 18 bp, Homo sapiens
tgcagtagtctctgtgct

SEQ ID NO: 2785048 - DNA, 17 bp, Homo sapiens
tgcagtatggccatggg

SEQ ID NO: 2785049 - DNA, 15 bp, Homo sapiens
tgcagtcatcagaag

SEQ ID NO: 2785050 - DNA, 12 bp, Homo sapiens
tgcagtccagaa

SEQ ID NO: 2785051 - DNA, 17 bp, Homo sapiens
tgcagtccagaataagt

SEQ ID NO: 2785052 - DNA, 19 bp, Homo sapiens
tgcagtccagaataagtgc

SEQ ID NO: 2785053 - DNA, 21 bp, Homo sapiens
tgcagtccagaataagtgctg

SEQ ID NO: 2785054 - DNA, 13 bp, Homo sapiens
tgcagtgaattgt

SEQ ID NO: 2785055 - DNA, 18 bp, Homo sapiens
tgcagtgacgtgcacctg

SEQ ID NO: 2785056 - DNA, 19 bp, Homo sapiens
tgcagtgacgtgcacctgt

SEQ ID NO: 2785057 - DNA, 22 bp, Homo sapiens
tgcagtggtatgatcacggctc

SEQ ID NO: 2785058 - DNA, 18 bp, Homo sapiens
tgcataagattaaaggaa

SEQ ID NO: 2785059 - DNA, 21 bp, Homo sapiens
tgcataagattaaaggaagga

SEQ ID NO: 2785060 - DNA, 23 bp, Homo sapiens
tgcataagattaaaggaaggaaa

SEQ ID NO: 2785061 - DNA, 16 bp, Homo sapiens
tgcatagtgctaagaa

SEQ ID NO: 2785062 - DNA, 15 bp, Homo sapiens
tgcctgcagccccgc

SEQ ID NO: 2785063 - DNA, 22 bp, Homo sapiens
tgcctgcagccccgcgcctcct

SEQ ID NO: 2785064 - DNA, 15 bp, Homo sapiens
tgcctgccagggccc

SEQ ID NO: 2785065 - DNA, 20 bp, Homo sapiens
tgcctgcccaggcccctgcc

SEQ ID NO: 2785066 - DNA, 22 bp, Homo sapiens
tgcctgcccaggcccctgccac

SEQ ID NO: 2785067 - DNA, 23 bp, Homo sapiens
tgcctgcccaggcccctgccacc

SEQ ID NO: 2785068 - DNA, 19 bp, Homo sapiens
tgcctggaggacctgagcc

SEQ ID NO: 2785069 - DNA, 12 bp, Homo sapiens
tgcctggccccc

SEQ ID NO: 2785070 - DNA, 18 bp, Homo sapiens
tgcctggcccccctccag

SEQ ID NO: 2785071 - DNA, 20 bp, Homo sapiens
tgcctggcccccctccaggc

SEQ ID NO: 2785072 - DNA, 17 bp, Homo sapiens
tgcctggcctggcacac

SEQ ID NO: 2785073 - DNA, 19 bp, Homo sapiens
tgcctgggtggggctgctc

SEQ ID NO: 2785074 - DNA, 22 bp, Homo sapiens
tgcctgggtggggctgctcctc

SEQ ID NO: 2785075 - DNA, 14 bp, Homo sapiens
tgcctggtggcagc

SEQ ID NO: 2785076 - DNA, 17 bp, Homo sapiens
tgcctggtgggccacgt

SEQ ID NO: 2785077 - DNA, 16 bp, Homo sapiens
tgcctgtagttaggaa

SEQ ID NO: 2785078 - DNA, 17 bp, Homo sapiens
tgcctgtagttaggaaa

SEQ ID NO: 2785079 - DNA, 23 bp, Homo sapiens
tgcctgtagttaggaaataaaac

SEQ ID NO: 2785080 - DNA, 14 bp, Homo sapiens
tgcctgttcccatt

SEQ ID NO: 2785081 - DNA, 14 bp, Homo sapiens
tgccttacctcctg

SEQ ID NO: 2785082 - DNA, 15 bp, Homo sapiens
tgccttacctcctgc

SEQ ID NO: 2785083 - DNA, 16 bp, Homo sapiens
tgccttacctcctgcc

SEQ ID NO: 2785084 - DNA, 18 bp, Homo sapiens
tgccttacctcctgccca

SEQ ID NO: 2785085 - DNA, 23 bp, Homo sapiens
tgccttacctcctgcccaggaga

SEQ ID NO: 2785086 - DNA, 14 bp, Homo sapiens
tgccttagcacttc

SEQ ID NO: 2785087 - DNA, 24 bp, Homo sapiens
tgccttcatggaactcagctgtct

SEQ ID NO: 2785088 - DNA, 17 bp, Homo sapiens
tgccttccaggagcaat

SEQ ID NO: 2785089 - DNA, 17 bp, Homo sapiens
tgccttccataattatg

SEQ ID NO: 2785090 - DNA, 14 bp, Homo sapiens
tgccttcttcaccc

SEQ ID NO: 2785091 - DNA, 16 bp, Homo sapiens
tgccttcttcacccag

SEQ ID NO: 2785092 - DNA, 18 bp, Homo sapiens
tgcctttcttatttgcaa

SEQ ID NO: 2785093 - DNA, 14 bp, Homo sapiens
tgcgaccatgtgta

SEQ ID NO: 2785094 - DNA, 19 bp, Homo sapiens
tgcgagagaggtgggcagc

SEQ ID NO: 2785095 - DNA, 20 bp, Homo sapiens
tgcgagcatttccctcccgg

SEQ ID NO: 2785096 - DNA, 22 bp, Homo sapiens
tgcgagcatttccctcccggga

SEQ ID NO: 2785097 - DNA, 14 bp, Homo sapiens
tgcgatctgggttc

SEQ ID NO: 2785098 - DNA, 21 bp, Homo sapiens
tgcgatctgggttcactgcaa

SEQ ID NO: 2785099 - DNA, 16 bp, Homo sapiens
tgcgatcttcagagca

SEQ ID NO: 2785100 - DNA, 16 bp, Homo sapiens
tgcgcctacaggagtg

SEQ ID NO: 2785101 - DNA, 22 bp, Homo sapiens
tgcgcctacaggagtgagcact

SEQ ID NO: 2785102 - DNA, 21 bp, Homo sapiens
tgcgcgcatgtaatcccagct

SEQ ID NO: 2785103 - DNA, 19 bp, Homo sapiens
tgcgctggtggaccacagg

SEQ ID NO: 2785104 - DNA, 20 bp, Homo sapiens
tgcggacagccacggccagg

SEQ ID NO: 2785105 - DNA, 21 bp, Homo sapiens
tgcggacagccacggccaggc

SEQ ID NO: 2785106 - DNA, 22 bp, Homo sapiens
tgcggacagccacggccaggcc

SEQ ID NO: 2785107 - DNA, 18 bp, Homo sapiens
tgcggccgcattccctga

SEQ ID NO: 2785108 - DNA, 19 bp, Homo sapiens
tgcgggatggtcctggggc

SEQ ID NO: 2785109 - DNA, 15 bp, Homo sapiens
tgcgtacgtttcctg

SEQ ID NO: 2785110 - DNA, 22 bp, Homo sapiens
tgcgtgccctgacccctgcacc

SEQ ID NO: 2785111 - DNA, 17 bp, Homo sapiens
tgcgtggactctgcaca

SEQ ID NO: 2785112 - DNA, 13 bp, Homo sapiens
tgcgttttggaag

SEQ ID NO: 2785113 - DNA, 15 bp, Homo sapiens
tgctaaattttcagt

SEQ ID NO: 2785114 - DNA, 20 bp, Homo sapiens
tgctaactagcttggaaact

SEQ ID NO: 2785115 - DNA, 19 bp, Homo sapiens
tgctaactgtatgtgtctt

SEQ ID NO: 2785116 - DNA, 13 bp, Homo sapiens
tgctaagagaagt

SEQ ID NO: 2785117 - DNA, 16 bp, Homo sapiens
tgctaagagaagtaga

SEQ ID NO: 2785118 - DNA, 22 bp, Homo sapiens
tgctaagagaagtagaaatcat

SEQ ID NO: 2785119 - DNA, 21 bp, Homo sapiens
tgctacaccttagcagctctt

SEQ ID NO: 2785120 - DNA, 15 bp, Homo sapiens
tgctacctcactggg

SEQ ID NO: 2785121 - DNA, 16 bp, Homo sapiens
tgctacctcactgggg

SEQ ID NO: 2785122 - DNA, 12 bp, Homo sapiens
tgctaggaagtg

SEQ ID NO: 2785123 - DNA, 18 bp, Homo sapiens
tgctaggcgagtgccagg

SEQ ID NO: 2785124 - DNA, 22 bp, Homo sapiens
tgctaggcgagtgccaggactc

SEQ ID NO: 2785125 - DNA, 20 bp, Homo sapiens
tgctataggctggagaagct

SEQ ID NO: 2785126 - DNA, 20 bp, Homo sapiens
tgctatcaaaataaattgaa

SEQ ID NO: 2785127 - DNA, 21 bp, Homo sapiens
tgctatcaaaataaattgaaa

SEQ ID NO: 2785128 - DNA, 19 bp, Homo sapiens
tgctatccagctattttta

SEQ ID NO: 2785129 - DNA, 16 bp, Homo sapiens
tgctatctctgtgtgc

SEQ ID NO: 2785130 - DNA, 16 bp, Homo sapiens
tgctattgacaagtca

SEQ ID NO: 2785131 - DNA, 19 bp, Homo sapiens
tgctatttgttgtttttaa

SEQ ID NO: 2785132 - DNA, 14 bp, Homo sapiens
tgctcaaccactgt

SEQ ID NO: 2785133 - DNA, 16 bp, Homo sapiens
tgctcaaccactgtgg

SEQ ID NO: 2785134 - DNA, 18 bp, Homo sapiens
tgctcaaccactgtggcg

SEQ ID NO: 2785135 - DNA, 22 bp, Homo sapiens
tgctcaagaagacatggagact

SEQ ID NO: 2785136 - DNA, 15 bp, Homo sapiens
tgctcacatatctgt

SEQ ID NO: 2785137 - DNA, 22 bp, Homo sapiens
tgctcatcattccttgagaaaa

SEQ ID NO: 2785138 - DNA, 17 bp, Homo sapiens
tgctcccagcagcccta

SEQ ID NO: 2785139 - DNA, 23 bp, Homo sapiens
tgctcccccaccccctccccagg

SEQ ID NO: 2785140 - DNA, 17 bp, Homo sapiens
tgctcggggtgcacagg

SEQ ID NO: 2785141 - DNA, 20 bp, Homo sapiens
tgctcggggtgcacaggagg

SEQ ID NO: 2785142 - DNA, 22 bp, Homo sapiens
tgctcggggtgcacaggagggg

SEQ ID NO: 2785143 - DNA, 12 bp, Homo sapiens
tgctctattgta

SEQ ID NO: 2785144 - DNA, 14 bp, Homo sapiens
tgctctcagcctcc

SEQ ID NO: 2785145 - DNA, 14 bp, Homo sapiens
tgctctcccctgcc

SEQ ID NO: 2785146 - DNA, 16 bp, Homo sapiens
tgctctcccctgccct

SEQ ID NO: 2785147 - DNA, 17 bp, Homo sapiens
tgctctcccctgccctg

SEQ ID NO: 2785148 - DNA, 20 bp, Homo sapiens
tgctctcccctgccctgctg

SEQ ID NO: 2785149 - DNA, 12 bp, Homo sapiens
tgctctcctctt

SEQ ID NO: 2785150 - DNA, 18 bp, Homo sapiens
tgctctcctcttgccact

SEQ ID NO: 2785151 - DNA, 21 bp, Homo sapiens
tgctctctgcagccagcccag

SEQ ID NO: 2785152 - DNA, 23 bp, Homo sapiens
tggaaaaacatctgaaagccacg

SEQ ID NO: 2785153 - DNA, 19 bp, Homo sapiens
tggaaaaatccagaaagaa

SEQ ID NO: 2785154 - DNA, 22 bp, Homo sapiens
tggaaaagaatccctgcagcct

SEQ ID NO: 2785155 - DNA, 23 bp, Homo sapiens
tggaaaagaatccctgcagcctg

SEQ ID NO: 2785156 - DNA, 16 bp, Homo sapiens
tggaaaagtcacacag

SEQ ID NO: 2785157 - DNA, 21 bp, Homo sapiens
tggaaaagtcacacagacaca

SEQ ID NO: 2785158 - DNA, 23 bp, Homo sapiens
tggaaacatttacaataaatatt

SEQ ID NO: 2785159 - DNA, 21 bp, Homo sapiens
tggaaagcatcacctcaggcc

SEQ ID NO: 2785160 - DNA, 14 bp, Homo sapiens
tggaaagcctctgc

SEQ ID NO: 2785161 - DNA, 20 bp, Homo sapiens
tggaaaggtcattgtggcta

SEQ ID NO: 2785162 - DNA, 21 bp, Homo sapiens
tggaacaaaagttcgaaagaa

SEQ ID NO: 2785163 - DNA, 21 bp, Homo sapiens
tggaaccgtgtccagcacaga

SEQ ID NO: 2785164 - DNA, 23 bp, Homo sapiens
tggaactcagctgtctgtggctt

SEQ ID NO: 2785165 - DNA, 16 bp, Homo sapiens
tggaactgaagggggc

SEQ ID NO: 2785166 - DNA, 21 bp, Homo sapiens
tggaactgaagggggcggcct

SEQ ID NO: 2785167 - DNA, 22 bp, Homo sapiens
tggaactgaagggggcggccta

SEQ ID NO: 2785168 - DNA, 16 bp, Homo sapiens
tggaacttgaactgat

SEQ ID NO: 2785169 - DNA, 17 bp, Homo sapiens
tggaagacgcaagggcc

SEQ ID NO: 2785170 - DNA, 23 bp, Homo sapiens
tggaagacgcaagggcctgatgg

SEQ ID NO: 2785171 - DNA, 16 bp, Homo sapiens
tggaagattttaaatt

SEQ ID NO: 2785172 - DNA, 16 bp, Homo sapiens
tggaagcacagcttca

SEQ ID NO: 2785173 - DNA, 13 bp, Homo sapiens
tggaagctccgct

SEQ ID NO: 2785174 - DNA, 17 bp, Homo sapiens
tggaagctgccctgccc

SEQ ID NO: 2785175 - DNA, 15 bp, Homo sapiens
tggaagctgtgtcct

SEQ ID NO: 2785176 - DNA, 16 bp, Homo sapiens
tggaagggaagtgaga

SEQ ID NO: 2785177 - DNA, 18 bp, Homo sapiens
tggaataataattttcct

SEQ ID NO: 2785178 - DNA, 14 bp, Homo sapiens
tggaatacagtgtt

SEQ ID NO: 2785179 - DNA, 14 bp, Homo sapiens
tggaatacatgaaa

SEQ ID NO: 2785180 - DNA, 22 bp, Homo sapiens
tggaatactaaaaatcatgaga

SEQ ID NO: 2785181 - DNA, 17 bp, Homo sapiens
tggaatcagcttttaat

SEQ ID NO: 2785182 - DNA, 23 bp, Homo sapiens
tggaatcagcttttaataaaatt

SEQ ID NO: 2785183 - DNA, 22 bp, Homo sapiens
tggaatcgatctgtactgtaat

SEQ ID NO: 2785184 - DNA, 13 bp, Homo sapiens
tggaatgaagcat

SEQ ID NO: 2785185 - DNA, 22 bp, Homo sapiens
tggaatgactataaacattaaa

SEQ ID NO: 2785186 - DNA, 14 bp, Homo sapiens
tggaatgtaatcaa

SEQ ID NO: 2785187 - DNA, 21 bp, Homo sapiens
tggaatgtggcccctgaacaa

SEQ ID NO: 2785188 - DNA, 17 bp, Homo sapiens
tggaattgggagcttgg

SEQ ID NO: 2785189 - DNA, 12 bp, Homo sapiens
tggaatttttca

SEQ ID NO: 2785190 - DNA, 16 bp, Homo sapiens
tggacaagaagctgct

SEQ ID NO: 2785191 - DNA, 17 bp, Homo sapiens
tggacaagaagctgcta

SEQ ID NO: 2785192 - DNA, 14 bp, Homo sapiens
tggacacagctctt

SEQ ID NO: 2785193 - DNA, 16 bp, Homo sapiens
tggacacagctcttct

SEQ ID NO: 2785194 - DNA, 21 bp, Homo sapiens
tggacacagctcttctccagg

SEQ ID NO: 2785195 - DNA, 20 bp, Homo sapiens
tggacaccccttatccagga

SEQ ID NO: 2785196 - DNA, 21 bp, Homo sapiens
tggacaccccttatccaggac

SEQ ID NO: 2785197 - DNA, 12 bp, Homo sapiens
tggacacctgcc

SEQ ID NO: 2785198 - DNA, 18 bp, Homo sapiens
tggacacctgccctgccc

SEQ ID NO: 2785199 - DNA, 12 bp, Homo sapiens
tggacagaagaa

SEQ ID NO: 2785200 - DNA, 14 bp, Homo sapiens
tggacagctgtgcc

SEQ ID NO: 2785201 - DNA, 18 bp, Homo sapiens
tggacagctgtgcctcgc

SEQ ID NO: 2785202 - DNA, 12 bp, Homo sapiens
tggacaggcatg

SEQ ID NO: 2785203 - DNA, 16 bp, Homo sapiens
tggacaggcatgttct

SEQ ID NO: 2785204 - DNA, 17 bp, Homo sapiens
tggacaggcatgttctc

SEQ ID NO: 2785205 - DNA, 18 bp, Homo sapiens
tggacaggcatgttctct

SEQ ID NO: 2785206 - DNA, 21 bp, Homo sapiens
tggaccaaccctgtttcctga

SEQ ID NO: 2785207 - DNA, 12 bp, Homo sapiens
tggaccaagaat

SEQ ID NO: 2785208 - DNA, 15 bp, Homo sapiens
tggaccaccagcccc

SEQ ID NO: 2785209 - DNA, 20 bp, Homo sapiens
tggaccaccagccccagcaa

SEQ ID NO: 2785210 - DNA, 21 bp, Homo sapiens
tggaccaccagccccagcaag

SEQ ID NO: 2785211 - DNA, 15 bp, Homo sapiens
tggaccactgggcaa

SEQ ID NO: 2785212 - DNA, 13 bp, Homo sapiens
tggaccaggacag

SEQ ID NO: 2785213 - DNA, 20 bp, Homo sapiens
tggacccagggatgacatgt

SEQ ID NO: 2785214 - DNA, 22 bp, Homo sapiens
tggacctatgtcctaaggacac

SEQ ID NO: 2785215 - DNA, 22 bp, Homo sapiens
tggacctcaggttcctaagact

SEQ ID NO: 2785216 - DNA, 17 bp, Homo sapiens
tggacctctgctctgag

SEQ ID NO: 2785217 - DNA, 13 bp, Homo sapiens
tggactcctctgt

SEQ ID NO: 2785218 - DNA, 14 bp, Homo sapiens
tggactcctctgtc

SEQ ID NO: 2785219 - DNA, 18 bp, Homo sapiens
tggactctgcacatgtct

SEQ ID NO: 2785220 - DNA, 17 bp, Homo sapiens
tggacttgagcttggca

SEQ ID NO: 2785221 - DNA, 17 bp, Homo sapiens
tggacttgttcgtgccc

SEQ ID NO: 2785222 - DNA, 17 bp, Homo sapiens
tggagaaaatgaagaaa

SEQ ID NO: 2785223 - DNA, 16 bp, Homo sapiens
tggagaaaccctgtct

SEQ ID NO: 2785224 - DNA, 21 bp, Homo sapiens
tggagaaataaaaatacctct

SEQ ID NO: 2785225 - DNA, 22 bp, Homo sapiens
tggagaactttccatctgcttg

SEQ ID NO: 2785226 - DNA, 17 bp, Homo sapiens
tggagaagaccctcccc

SEQ ID NO: 2785227 - DNA, 16 bp, Homo sapiens
tggagaagctcaccca

SEQ ID NO: 2785228 - DNA, 14 bp, Homo sapiens
tggagaagctctgt

SEQ ID NO: 2785229 - DNA, 15 bp, Homo sapiens
tggagacagcgaact

SEQ ID NO: 2785230 - DNA, 13 bp, Homo sapiens
tggagactcctgc

SEQ ID NO: 2785231 - DNA, 14 bp, Homo sapiens
tggagactctgtgg

SEQ ID NO: 2785232 - DNA, 17 bp, Homo sapiens
tggagacttggaagagt

SEQ ID NO: 2785233 - DNA, 12 bp, Homo sapiens
tggagagagggg

SEQ ID NO: 2785234 - DNA, 15 bp, Homo sapiens
tggagagccctggga

SEQ ID NO: 2785235 - DNA, 20 bp, Homo sapiens
tggagagccctgggaccgct

SEQ ID NO: 2785236 - DNA, 15 bp, Homo sapiens
tggagagctaggagc

SEQ ID NO: 2785237 - DNA, 22 bp, Homo sapiens
tggagagctaggagcaaagcct

SEQ ID NO: 2785238 - DNA, 23 bp, Homo sapiens
tggagagctaggagcaaagcctg

SEQ ID NO: 2785239 - DNA, 23 bp, Homo sapiens
tggagaggagggatgctgcctga

SEQ ID NO: 2785240 - DNA, 20 bp, Homo sapiens
tggagagggacgaagaaagg

SEQ ID NO: 2785241 - DNA, 15 bp, Homo sapiens
tggagagtaaaaact

SEQ ID NO: 2785242 - DNA, 21 bp, Homo sapiens
tggcctcacgcccagcctcct

SEQ ID NO: 2785243 - DNA, 20 bp, Homo sapiens
tggcctcccaataaagctgg

SEQ ID NO: 2785244 - DNA, 16 bp, Homo sapiens
tggcctgcactaattt

SEQ ID NO: 2785245 - DNA, 20 bp, Homo sapiens
tggcctgctgggctctccac

SEQ ID NO: 2785246 - DNA, 16 bp, Homo sapiens
tggcctggcacacatc

SEQ ID NO: 2785247 - DNA, 16 bp, Homo sapiens
tggcctggccggcaac

SEQ ID NO: 2785248 - DNA, 16 bp, Homo sapiens
tggcctgtgtcactca

SEQ ID NO: 2785249 - DNA, 14 bp, Homo sapiens
tggccttgttctgt

SEQ ID NO: 2785250 - DNA, 19 bp, Homo sapiens
tggccttgttctgtcacca

SEQ ID NO: 2785251 - DNA, 12 bp, Homo sapiens
tggcctttatta

SEQ ID NO: 2785252 - DNA, 22 bp, Homo sapiens
tggcctttattaaaaactgagt

SEQ ID NO: 2785253 - DNA, 19 bp, Homo sapiens
tggcctttgaggcaaaggc

SEQ ID NO: 2785254 - DNA, 14 bp, Homo sapiens
tggcgcaagcctgt

SEQ ID NO: 2785255 - DNA, 13 bp, Homo sapiens
tggcggtgcctgg

SEQ ID NO: 2785256 - DNA, 20 bp, Homo sapiens
tggctaaatgcctaataaac

SEQ ID NO: 2785257 - DNA, 19 bp, Homo sapiens
tggctactctgtgccagag

SEQ ID NO: 2785258 - DNA, 20 bp, Homo sapiens
tggctactctgtgccagagc

SEQ ID NO: 2785259 - DNA, 23 bp, Homo sapiens
tggctatctgcatttataaatgt

SEQ ID NO: 2785260 - DNA, 18 bp, Homo sapiens
tggctatgtttttaatgt

SEQ ID NO: 2785261 - DNA, 12 bp, Homo sapiens
tggctattttat

SEQ ID NO: 2785262 - DNA, 15 bp, Homo sapiens
tggctcacccaagca

SEQ ID NO: 2785263 - DNA, 17 bp, Homo sapiens
tggctctcccatttcct

SEQ ID NO: 2785264 - DNA, 15 bp, Homo sapiens
tggctgaaaatcact

SEQ ID NO: 2785265 - DNA, 16 bp, Homo sapiens
tggctgaaaatcacta

SEQ ID NO: 2785266 - DNA, 20 bp, Homo sapiens
tggctgaaataaaagcctct

SEQ ID NO: 2785267 - DNA, 22 bp, Homo sapiens
tggctgaaataaaagcctctgg

SEQ ID NO: 2785268 - DNA, 23 bp, Homo sapiens
tggctgaaataaaagcctctggt

SEQ ID NO: 2785269 - DNA, 16 bp, Homo sapiens
tggctgacccagtccc

SEQ ID NO: 2785270 - DNA, 17 bp, Homo sapiens
tggctgacccagtccct

SEQ ID NO: 2785271 - DNA, 19 bp, Homo sapiens
tggctgacccagtccctgg

SEQ ID NO: 2785272 - DNA, 20 bp, Homo sapiens
tggctgaggatttcaagcct

SEQ ID NO: 2785273 - DNA, 22 bp, Homo sapiens
tggctgagggcagttcgcagcc

SEQ ID NO: 2785274 - DNA, 23 bp, Homo sapiens
tggctgcaaagggtatcaggtgc

SEQ ID NO: 2785275 - DNA, 14 bp, Homo sapiens
tggctgcagggagt

SEQ ID NO: 2785276 - DNA, 15 bp, Homo sapiens
tggctgcctgcatct

SEQ ID NO: 2785277 - DNA, 13 bp, Homo sapiens
tggctgctagcac

SEQ ID NO: 2785278 - DNA, 17 bp, Homo sapiens
tggctggcccgtcatgt

SEQ ID NO: 2785279 - DNA, 22 bp, Homo sapiens
tggctggctaactggaagcatg

SEQ ID NO: 2785280 - DNA, 14 bp, Homo sapiens
tggctggctgcagt

SEQ ID NO: 2785281 - DNA, 12 bp, Homo sapiens
tggctgggggcc

SEQ ID NO: 2785282 - DNA, 16 bp, Homo sapiens
tggctgggggcctcag

SEQ ID NO: 2785283 - DNA, 20 bp, Homo sapiens
tggctgggggcctcagtgcc

SEQ ID NO: 2785284 - DNA, 21 bp, Homo sapiens
tggctgggggcctcagtgcca

SEQ ID NO: 2785285 - DNA, 13 bp, Homo sapiens
tggctgtattttt

SEQ ID NO: 2785286 - DNA, 14 bp, Homo sapiens
tggctgtctctgtc

SEQ ID NO: 2785287 - DNA, 16 bp, Homo sapiens
tggcttatttgtataa

SEQ ID NO: 2785288 - DNA, 21 bp, Homo sapiens
tggcttattttttaaaataat

SEQ ID NO: 2785289 - DNA, 22 bp, Homo sapiens
tggcttccagaaaaccccagca

SEQ ID NO: 2785290 - DNA, 14 bp, Homo sapiens
tggcttccaggtat

SEQ ID NO: 2785291 - DNA, 20 bp, Homo sapiens
tggcttccaggtatctccag

SEQ ID NO: 2785292 - DNA, 14 bp, Homo sapiens
tggcttcccatccc

SEQ ID NO: 2785293 - DNA, 20 bp, Homo sapiens
tggcttcccatccccagcga

SEQ ID NO: 2785294 - DNA, 21 bp, Homo sapiens
tggcttcccatccccagcgat

SEQ ID NO: 2785295 - DNA, 14 bp, Homo sapiens
tggcttctggagcc

SEQ ID NO: 2785296 - DNA, 21 bp, Homo sapiens
tggctttaaccgtttttcaag

SEQ ID NO: 2785297 - DNA, 22 bp, Homo sapiens
tggctttctccgactgctaggg

SEQ ID NO: 2785298 - DNA, 20 bp, Homo sapiens
tggcttttgcggttcaggaa

SEQ ID NO: 2785299 - DNA, 18 bp, Homo sapiens
tgggaacccgactgtgaa

SEQ ID NO: 2785300 - DNA, 13 bp, Homo sapiens
tgggaattgcatg

SEQ ID NO: 2785301 - DNA, 22 bp, Homo sapiens
tgggaccccagctagggctgga

SEQ ID NO: 2785302 - DNA, 13 bp, Homo sapiens
tgggaccctttcc

SEQ ID NO: 2785303 - DNA, 20 bp, Homo sapiens
tgggaccgctacaccactct

SEQ ID NO: 2785304 - DNA, 21 bp, Homo sapiens
tgggaccgctacaccactctg

SEQ ID NO: 2785305 - DNA, 22 bp, Homo sapiens
tgggaccgctacaccactctgg

SEQ ID NO: 2785306 - DNA, 23 bp, Homo sapiens
tgggacctcagttttatcatttt

SEQ ID NO: 2785307 - DNA, 15 bp, Homo sapiens
tgggactacaggcac

SEQ ID NO: 2785308 - DNA, 18 bp, Homo sapiens
tgggactcaatgcactga

SEQ ID NO: 2785309 - DNA, 23 bp, Homo sapiens
tgggactggccaggtttctgccc

SEQ ID NO: 2785310 - DNA, 14 bp, Homo sapiens
tgggagaacctcag

SEQ ID NO: 2785311 - DNA, 18 bp, Homo sapiens
tgggagacctgtaatcat

SEQ ID NO: 2785312 - DNA, 17 bp, Homo sapiens
tgggagagccagctctc

SEQ ID NO: 2785313 - DNA, 18 bp, Homo sapiens
tgggagagcccagccatt

SEQ ID NO: 2785314 - DNA, 17 bp, Homo sapiens
tgggagctgcctgttca

SEQ ID NO: 2785315 - DNA, 12 bp, Homo sapiens
tgggaggaaaag

SEQ ID NO: 2785316 - DNA, 17 bp, Homo sapiens
tgggaggctggtctccc

SEQ ID NO: 2785317 - DNA, 19 bp, Homo sapiens
tgggaggtgagaccacctc

SEQ ID NO: 2785318 - DNA, 23 bp, Homo sapiens
tgggatctgtaaggaactggaac

SEQ ID NO: 2785319 - DNA, 23 bp, Homo sapiens
tgggattcaggaaaaggcctggg

SEQ ID NO: 2785320 - DNA, 23 bp, Homo sapiens
tgggattgacagaagcttctgcc

SEQ ID NO: 2785321 - DNA, 18 bp, Homo sapiens
tgggatttatatctatag

SEQ ID NO: 2785322 - DNA, 12 bp, Homo sapiens
tgggcaacagag

SEQ ID NO: 2785323 - DNA, 16 bp, Homo sapiens
tgggcaacagagcaag

SEQ ID NO: 2785324 - DNA, 15 bp, Homo sapiens
tgggcaagtgattga

SEQ ID NO: 2785325 - DNA, 18 bp, Homo sapiens
tgggcacccccagcctgg

SEQ ID NO: 2785326 - DNA, 20 bp, Homo sapiens
tgggcacccccagcctgggc

SEQ ID NO: 2785327 - DNA, 22 bp, Homo sapiens
tgggcacccccagcctgggcct

SEQ ID NO: 2785328 - DNA, 17 bp, Homo sapiens
tgggcagaagggagaag

SEQ ID NO: 2785329 - DNA, 15 bp, Homo sapiens
tgggcagcagctcag

SEQ ID NO: 2785330 - DNA, 21 bp, Homo sapiens
tgggcaggtctcctctgggag

SEQ ID NO: 2785331 - DNA, 21 bp, Homo sapiens
tgggccaattaaaatatatat

SEQ ID NO: 2785332 - DNA, 22 bp, Homo sapiens
tggtccagctcttggcccctgt

SEQ ID NO: 2785333 - DNA, 13 bp, Homo sapiens
tggtcccacatcc

SEQ ID NO: 2785334 - DNA, 16 bp, Homo sapiens
tggtcccacatccctg

SEQ ID NO: 2785335 - DNA, 13 bp, Homo sapiens
tggtcccactcag

SEQ ID NO: 2785336 - DNA, 15 bp, Homo sapiens
tggtccggtgtcctt

SEQ ID NO: 2785337 - DNA, 14 bp, Homo sapiens
tggtcctggggctc

SEQ ID NO: 2785338 - DNA, 13 bp, Homo sapiens
tggtcgcccagga

SEQ ID NO: 2785339 - DNA, 16 bp, Homo sapiens
tggtctcaaactcttg

SEQ ID NO: 2785340 - DNA, 13 bp, Homo sapiens
tggtctcagcttc

SEQ ID NO: 2785341 - DNA, 16 bp, Homo sapiens
tggtctgacccactgc

SEQ ID NO: 2785342 - DNA, 18 bp, Homo sapiens
tggtctgagcaccccctc

SEQ ID NO: 2785343 - DNA, 20 bp, Homo sapiens
tggtctgagcaccccctcat

SEQ ID NO: 2785344 - DNA, 16 bp, Homo sapiens
tggtctgatttcagga

SEQ ID NO: 2785345 - DNA, 10 bp, Homo sapiens
tggtctttga

SEQ ID NO: 2785346 - DNA, 12 bp, Homo sapiens
tggtctttgaat

SEQ ID NO: 2785347 - DNA, 13 bp, Homo sapiens
tggtctttgaata

SEQ ID NO: 2785348 - DNA, 15 bp, Homo sapiens
tggtctttgaataaa

SEQ ID NO: 2785349 - DNA, 13 bp, Homo sapiens
tggtgaaattatg

SEQ ID NO: 2785350 - DNA, 22 bp, Homo sapiens
tggtgaccatctgtttgagaat

SEQ ID NO: 2785351 - DNA, 15 bp, Homo sapiens
tggtgacctctgcct

SEQ ID NO: 2785352 - DNA, 18 bp, Homo sapiens
tggtgactgcgatcttca

SEQ ID NO: 2785353 - DNA, 12 bp, Homo sapiens
tggtgacttcct

SEQ ID NO: 2785354 - DNA, 17 bp, Homo sapiens
tggtgataagtggaaaa

SEQ ID NO: 2785355 - DNA, 18 bp, Homo sapiens
tggtgcagaggtgagcag

SEQ ID NO: 2785356 - DNA, 13 bp, Homo sapiens
tggtgcctggcct

SEQ ID NO: 2785357 - DNA, 14 bp, Homo sapiens
tggtgcctggcctg

SEQ ID NO: 2785358 - DNA, 17 bp, Homo sapiens
tggtgctgtggccaggg

SEQ ID NO: 2785359 - DNA, 15 bp, Homo sapiens
tggtggcagctgcgg

SEQ ID NO: 2785360 - DNA, 20 bp, Homo sapiens
tggtggcagtgggagctgcc

SEQ ID NO: 2785361 - DNA, 20 bp, Homo sapiens
tggtggccatgtcgcctgcc

SEQ ID NO: 2785362 - DNA, 13 bp, Homo sapiens
tggtggctgggtt

SEQ ID NO: 2785363 - DNA, 17 bp, Homo sapiens
tggtggctgtctctgtc

SEQ ID NO: 2785364 - DNA, 21 bp, Homo sapiens
tggtgggaagcgtctgtccgt

SEQ ID NO: 2785365 - DNA, 23 bp, Homo sapiens
tggtgtaatgcacaatttagaaa

SEQ ID NO: 2785366 - DNA, 14 bp, Homo sapiens
tggtgtccacctgg

SEQ ID NO: 2785367 - DNA, 17 bp, Homo sapiens
tggtgtccacctggccc

SEQ ID NO: 2785368 - DNA, 13 bp, Homo sapiens
tggttagaaatgc

SEQ ID NO: 2785369 - DNA, 15 bp, Homo sapiens
tggttcacactgacc

SEQ ID NO: 2785370 - DNA, 22 bp, Homo sapiens
tggttcagggttggcccctgcc

SEQ ID NO: 2785371 - DNA, 17 bp, Homo sapiens
tggttccatgcctgagg

SEQ ID NO: 2785372 - DNA, 19 bp, Homo sapiens
tggttcccaataaaagtga

SEQ ID NO: 2785373 - DNA, 20 bp, Homo sapiens
tggttcccaataaaagtgac

SEQ ID NO: 2785374 - DNA, 15 bp, Homo sapiens
tggttgaggtggaag

SEQ ID NO: 2785375 - DNA, 18 bp, Homo sapiens
tggttgatgatctttgca

SEQ ID NO: 2785376 - DNA, 23 bp, Homo sapiens
tggttggccgtggtccagctctt

SEQ ID NO: 2785377 - DNA, 16 bp, Homo sapiens
tggtttctagacttgt

SEQ ID NO: 2785378 - DNA, 23 bp, Homo sapiens
tggtttgaagaatgttaagactt

SEQ ID NO: 2785379 - DNA, 21 bp, Homo sapiens
tggtttgtcatatattcatgt

SEQ ID NO: 2785380 - DNA, 16 bp, Homo sapiens
tggttttcctaaatgc

SEQ ID NO: 2785381 - DNA, 19 bp, Homo sapiens
tggttttctccaagagcta

SEQ ID NO: 2785382 - DNA, 13 bp, Homo sapiens
tgtaaaaaaaaaa

SEQ ID NO: 2785383 - DNA, 22 bp, Homo sapiens
tgtaaaccatcgcgtgcaatga

SEQ ID NO: 2785384 - DNA, 15 bp, Homo sapiens
tgtaaactcaaaata

SEQ ID NO: 2785385 - DNA, 15 bp, Homo sapiens
tgtaaatacatgtgt

SEQ ID NO: 2785386 - DNA, 16 bp, Homo sapiens
tgtaaatacatgtgtg

SEQ ID NO: 2785387 - DNA, 18 bp, Homo sapiens
tgtaaatacatgtgtgga

SEQ ID NO: 2785388 - DNA, 15 bp, Homo sapiens
tgtaaatagctcagg

SEQ ID NO: 2785389 - DNA, 19 bp, Homo sapiens
tgtaaatagttttaaatat

SEQ ID NO: 2785390 - DNA, 20 bp, Homo sapiens
tgtaaatagttttaaatatg

SEQ ID NO: 2785391 - DNA, 21 bp, Homo sapiens
tgtaaatagttttaaatatga

SEQ ID NO: 2785392 - DNA, 12 bp, Homo sapiens
tgtaaatattta

SEQ ID NO: 2785393 - DNA, 12 bp, Homo sapiens
tgtaaatccttt

SEQ ID NO: 2785394 - DNA, 22 bp, Homo sapiens
tgtaaatcctttttctttataa

SEQ ID NO: 2785395 - DNA, 22 bp, Homo sapiens
tgtaaatgctgtcaactatgat

SEQ ID NO: 2785396 - DNA, 18 bp, Homo sapiens
tgtaacaagccagatttt

SEQ ID NO: 2785397 - DNA, 24 bp, Homo sapiens
tgtaacacaagccacagaagccag

SEQ ID NO: 2785398 - DNA, 17 bp, Homo sapiens
tgtaacactgcaagaag

SEQ ID NO: 2785399 - DNA, 20 bp, Homo sapiens
tgtaacaggtctcctcttaa

SEQ ID NO: 2785400 - DNA, 21 bp, Homo sapiens
tgtaacaggtctcctcttaaa

SEQ ID NO: 2785401 - DNA, 21 bp, Homo sapiens
tgtaacattaattctactaaa

SEQ ID NO: 2785402 - DNA, 14 bp, Homo sapiens
tgtaacgcctgctt

SEQ ID NO: 2785403 - DNA, 20 bp, Homo sapiens
tgtaagacaaaggttttcct

SEQ ID NO: 2785404 - DNA, 21 bp, Homo sapiens
tgtaagacaaaggttttcctc

SEQ ID NO: 2785405 - DNA, 21 bp, Homo sapiens
tgtaaggaactggaacacaca

SEQ ID NO: 2785406 - DNA, 13 bp, Homo sapiens
tgtaaggaattga

SEQ ID NO: 2785407 - DNA, 22 bp, Homo sapiens
tgtaaggtaatttctgtgtatt

SEQ ID NO: 2785408 - DNA, 22 bp, Homo sapiens
tgtaagtttattttttctacac

SEQ ID NO: 2785409 - DNA, 14 bp, Homo sapiens
tgtaataaactctc

SEQ ID NO: 2785410 - DNA, 16 bp, Homo sapiens
tgtaataaactctcta

SEQ ID NO: 2785411 - DNA, 11 bp, Homo sapiens
tgtaataaatc

SEQ ID NO: 2785412 - DNA, 20 bp, Homo sapiens
tgtaatcaatgtttcttcta

SEQ ID NO: 2785413 - DNA, 22 bp, Homo sapiens
tgtaatcccagcactttgggag

SEQ ID NO: 2785414 - DNA, 22 bp, Homo sapiens
tgtaatcccagctacttgggag

SEQ ID NO: 2785415 - DNA, 20 bp, Homo sapiens
tgtaatcctcagctgacaca

SEQ ID NO: 2785416 - DNA, 21 bp, Homo sapiens
tgtaatcctgtatattatggt

SEQ ID NO: 2785417 - DNA, 21 bp, Homo sapiens
tgtaatcgttatgtgtgtata

SEQ ID NO: 2785418 - DNA, 17 bp, Homo sapiens
tgtaatgaatatctgct

SEQ ID NO: 2785419 - DNA, 23 bp, Homo sapiens
tgtaatgcacaatttagaaaaca

SEQ ID NO: 2785420 - DNA, 18 bp, Homo sapiens
tgtaattggtgacaatgt

SEQ ID NO: 2785421 - DNA, 23 bp, Homo sapiens
tgtaatttctaactccttatgtt

SEQ ID NO: 2785422 - DNA, 18 bp, Homo sapiens
tgtatgtgtctttatcag

SEQ ID NO: 2785423 - DNA, 21 bp, Homo sapiens
tgtattaatattcattgtata

SEQ ID NO: 2785424 - DNA, 17 bp, Homo sapiens
tgtattattttctatag

SEQ ID NO: 2785425 - DNA, 19 bp, Homo sapiens
tgtattcagatcgtattaa

SEQ ID NO: 2785426 - DNA, 22 bp, Homo sapiens
tgtattgaacttggaaagaaat

SEQ ID NO: 2785427 - DNA, 19 bp, Homo sapiens
tgtattgcatatatacata

SEQ ID NO: 2785428 - DNA, 13 bp, Homo sapiens
tgtatttaaatat

SEQ ID NO: 2785429 - DNA, 21 bp, Homo sapiens
tgtatttataaatatatttaa

SEQ ID NO: 2785430 - DNA, 13 bp, Homo sapiens
tgtatttattgtc

SEQ ID NO: 2785431 - DNA, 14 bp, Homo sapiens
tgtatttattgtca

SEQ ID NO: 2785432 - DNA, 22 bp, Homo sapiens
tgtattttcttcccatttgtaa

SEQ ID NO: 2785433 - DNA, 16 bp, Homo sapiens
tgtcaaatatctcaga

SEQ ID NO: 2785434 - DNA, 14 bp, Homo sapiens
tgtcaatattaaat

SEQ ID NO: 2785435 - DNA, 17 bp, Homo sapiens
tgtcaatattaaataca

SEQ ID NO: 2785436 - DNA, 19 bp, Homo sapiens
tgtcaatttccctgactcc

SEQ ID NO: 2785437 - DNA, 16 bp, Homo sapiens
tgtcaatttgtatatc

SEQ ID NO: 2785438 - DNA, 17 bp, Homo sapiens
tgtcaatttgtatatca

SEQ ID NO: 2785439 - DNA, 19 bp, Homo sapiens
tgtcacaatcctaacacat

SEQ ID NO: 2785440 - DNA, 17 bp, Homo sapiens
tgtcacacactttggct

SEQ ID NO: 2785441 - DNA, 12 bp, Homo sapiens
tgtcacaggcag

SEQ ID NO: 2785442 - DNA, 16 bp, Homo sapiens
tgtcacaggcaggtcc

SEQ ID NO: 2785443 - DNA, 23 bp, Homo sapiens
tgtcaccaatgtacccaccgggc

SEQ ID NO: 2785444 - DNA, 23 bp, Homo sapiens
tgtcaccaccttcccagctctcc

SEQ ID NO: 2785445 - DNA, 23 bp, Homo sapiens
tgtcaccgtgagcagctttggaa

SEQ ID NO: 2785446 - DNA, 20 bp, Homo sapiens
tgtcaccgtggaccttcctg

SEQ ID NO: 2785447 - DNA, 17 bp, Homo sapiens
tgtcacgtgaaatattt

SEQ ID NO: 2785448 - DNA, 19 bp, Homo sapiens
tgtcacgtgaaatatttaa

SEQ ID NO: 2785449 - DNA, 18 bp, Homo sapiens
tgtcactagcagctgcag

SEQ ID NO: 2785450 - DNA, 18 bp, Homo sapiens
tgtcagaatttctttgtc

SEQ ID NO: 2785451 - DNA, 12 bp, Homo sapiens
tgtcagacttta

SEQ ID NO: 2785452 - DNA, 23 bp, Homo sapiens
tgtcagatattttttcagaaata

SEQ ID NO: 2785453 - DNA, 20 bp, Homo sapiens
tgtcagccgagccgggcctg

SEQ ID NO: 2785454 - DNA, 23 bp, Homo sapiens
tgtcagccgagccgggcctgggg

SEQ ID NO: 2785455 - DNA, 13 bp, Homo sapiens
tgtcagcgtttct

SEQ ID NO: 2785456 - DNA, 18 bp, Homo sapiens
tgtcaggaacagaaggat

SEQ ID NO: 2785457 - DNA, 16 bp, Homo sapiens
tgtcaggtggggcagc

SEQ ID NO: 2785458 - DNA, 16 bp, Homo sapiens
tgtcatagaaattaca

SEQ ID NO: 2785459 - DNA, 17 bp, Homo sapiens
tgtcatatattcatgta

SEQ ID NO: 2785460 - DNA, 20 bp, Homo sapiens
tgtcatatattcatgtaata

SEQ ID NO: 2785461 - DNA, 21 bp, Homo sapiens
tgtcatatattcatgtaataa

SEQ ID NO: 2785462 - DNA, 23 bp, Homo sapiens
tgtcatatattcatgtaataaat

SEQ ID NO: 2785463 - DNA, 14 bp, Homo sapiens
tgtcatcaaatatt

SEQ ID NO: 2785464 - DNA, 19 bp, Homo sapiens
tgtcatcccgctcctgctg

SEQ ID NO: 2785465 - DNA, 20 bp, Homo sapiens
tgtcatcccgctcctgctga

SEQ ID NO: 2785466 - DNA, 20 bp, Homo sapiens
tgtcatgatttcaatgattg

SEQ ID NO: 2785467 - DNA, 13 bp, Homo sapiens
tgtcattaaaata

SEQ ID NO: 2785468 - DNA, 20 bp, Homo sapiens
tgtcattactgcctttggaa

SEQ ID NO: 2785469 - DNA, 23 bp, Homo sapiens
tgtcattcaagcctgtgaataaa

SEQ ID NO: 2785470 - DNA, 13 bp, Homo sapiens
tgtcattgtccat

SEQ ID NO: 2785471 - DNA, 14 bp, Homo sapiens
tgtcattgtccatg

SEQ ID NO: 2785472 - DNA, 19 bp, Homo sapiens
tgtcatttgagcagggctc

SEQ ID NO: 2785473 - DNA, 13 bp, Homo sapiens
tgtccacctggcc

SEQ ID NO: 2785474 - DNA, 23 bp, Homo sapiens
tgtccactctgaataccaagtgt

SEQ ID NO: 2785475 - DNA, 20 bp, Homo sapiens
tgtccagaagaatattcagg

SEQ ID NO: 2785476 - DNA, 21 bp, Homo sapiens
tgtccagaagaatattcagga

SEQ ID NO: 2785477 - DNA, 13 bp, Homo sapiens
tgtccagggccct

SEQ ID NO: 2785478 - DNA, 19 bp, Homo sapiens
tgtccagggccctgagctc

SEQ ID NO: 2785479 - DNA, 12 bp, Homo sapiens
tgtccataaagt

SEQ ID NO: 2785480 - DNA, 14 bp, Homo sapiens
tgtccatgcctaca

SEQ ID NO: 2785481 - DNA, 21 bp, Homo sapiens
tgtccatgcctacagataatt

SEQ ID NO: 2785482 - DNA, 13 bp, Homo sapiens
tgtcccacctctt

SEQ ID NO: 2785483 - DNA, 21 bp, Homo sapiens
tgtcccacctcttctcttcct

SEQ ID NO: 2785484 - DNA, 15 bp, Homo sapiens
tgtcccatttccttg

SEQ ID NO: 2785485 - DNA, 17 bp, Homo sapiens
tgtcccatttccttgga

SEQ ID NO: 2785486 - DNA, 19 bp, Homo sapiens
tgtccccagtttgcagaaa

SEQ ID NO: 2785487 - DNA, 14 bp, Homo sapiens
tgtccccctgagat

SEQ ID NO: 2785488 - DNA, 20 bp, Homo sapiens
tgtccccctgagatcagagt

SEQ ID NO: 2785489 - DNA, 20 bp, Homo sapiens
tgtccctctttgcctgtgtg

SEQ ID NO: 2785490 - DNA, 21 bp, Homo sapiens
tgtccctctttgcctgtgtga

SEQ ID NO: 2785491 - DNA, 15 bp, Homo sapiens
tgtcctaaggacaca

SEQ ID NO: 2785492 - DNA, 18 bp, Homo sapiens
tgtcctaaggacacacta

SEQ ID NO: 2785493 - DNA, 20 bp, Homo sapiens
tgtcctaaggacacactaat

SEQ ID NO: 2785494 - DNA, 20 bp, Homo sapiens
tgtcctacccaccctccttt

SEQ ID NO: 2785495 - DNA, 12 bp, Homo sapiens
tgtcctactctg

SEQ ID NO: 2785496 - DNA, 17 bp, Homo sapiens
tgtcctactctgtgtca

SEQ ID NO: 2785497 - DNA, 20 bp, Homo sapiens
tgtcctatgtcaatttgtat

SEQ ID NO: 2785498 - DNA, 23 bp, Homo sapiens
tgtcctccaacaataaagagctc

SEQ ID NO: 2785499 - DNA, 24 bp, Homo sapiens
tgtcctccagcttcccctcgctgt

SEQ ID NO: 2785500 - DNA, 21 bp, Homo sapiens
tgtcctcctcggatcaccgag

SEQ ID NO: 2785501 - DNA, 19 bp, Homo sapiens
tgtcctgggagtgagctgg

SEQ ID NO: 2785502 - DNA, 24 bp, Homo sapiens
tgtcctgtagttgcgtggactctg

SEQ ID NO: 2785503 - DNA, 13 bp, Homo sapiens
tgtccttgcacct

SEQ ID NO: 2785504 - DNA, 19 bp, Homo sapiens
tgtcctttgagaaagaaat

SEQ ID NO: 2785505 - DNA, 22 bp, Homo sapiens
tgtcctttgagaaagaaataat

SEQ ID NO: 2785506 - DNA, 23 bp, Homo sapiens
tgtcctttgttattatcctgcat

SEQ ID NO: 2785507 - DNA, 20 bp, Homo sapiens
tgtcgattagactggacagc

SEQ ID NO: 2785508 - DNA, 13 bp, Homo sapiens
tgtcgcctctgca

SEQ ID NO: 2785509 - DNA, 24 bp, Homo sapiens
tgtcgcctgcccccagcactcctc

SEQ ID NO: 2785510 - DNA, 19 bp, Homo sapiens
tgtcgctctgctggcctgg

SEQ ID NO: 2785511 - DNA, 12 bp, Homo sapiens
tgtcgctgcttc

SEQ ID NO: 2785512 - DNA, 15 bp, Homo sapiens
tgttggctaatgaag

SEQ ID NO: 2785513 - DNA, 16 bp, Homo sapiens
tgttgggaattgcatg

SEQ ID NO: 2785514 - DNA, 14 bp, Homo sapiens
tgttgtaaatattt

SEQ ID NO: 2785515 - DNA, 11 bp, Homo sapiens
tgttgttattt

SEQ ID NO: 2785516 - DNA, 20 bp, Homo sapiens
tgtttaaaaaaagtatatat

SEQ ID NO: 2785517 - DNA, 13 bp, Homo sapiens
tgtttacaaaagg

SEQ ID NO: 2785518 - DNA, 16 bp, Homo sapiens
tgtttacactctttgt

SEQ ID NO: 2785519 - DNA, 18 bp, Homo sapiens
tgtttacactctttgtaa

SEQ ID NO: 2785520 - DNA, 18 bp, Homo sapiens
tgtttagaagagcctgac

SEQ ID NO: 2785521 - DNA, 16 bp, Homo sapiens
tgtttagtagcagtga

SEQ ID NO: 2785522 - DNA, 14 bp, Homo sapiens
tgtttagttgcaga

SEQ ID NO: 2785523 - DNA, 16 bp, Homo sapiens
tgtttattaacaaatt

SEQ ID NO: 2785524 - DNA, 19 bp, Homo sapiens
tgtttattaacaaattatg

SEQ ID NO: 2785525 - DNA, 22 bp, Homo sapiens
tgtttatttataagcagattta

SEQ ID NO: 2785526 - DNA, 18 bp, Homo sapiens
tgtttcacgaagtttgtt

SEQ ID NO: 2785527 - DNA, 16 bp, Homo sapiens
tgtttcatctgttcat

SEQ ID NO: 2785528 - DNA, 15 bp, Homo sapiens
tgtttccagaaaata

SEQ ID NO: 2785529 - DNA, 19 bp, Homo sapiens
tgtttccagaaaatataaa

SEQ ID NO: 2785530 - DNA, 20 bp, Homo sapiens
tgtttccagaaaatataaat

SEQ ID NO: 2785531 - DNA, 12 bp, Homo sapiens
tgtttccttcag

SEQ ID NO: 2785532 - DNA, 15 bp, Homo sapiens
tgtttccttcagtgc

SEQ ID NO: 2785533 - DNA, 16 bp, Homo sapiens
tgtttctccccctggg

SEQ ID NO: 2785534 - DNA, 18 bp, Homo sapiens
tgtttgaactgccaagaa

SEQ ID NO: 2785535 - DNA, 22 bp, Homo sapiens
tgtttgggcagaagggagaagg

SEQ ID NO: 2785536 - DNA, 19 bp, Homo sapiens
tgtttggggatgagaaagg

SEQ ID NO: 2785537 - DNA, 23 bp, Homo sapiens
tgtttggggtgtttcaaaagtgg

SEQ ID NO: 2785538 - DNA, 19 bp, Homo sapiens
tgtttgtctgtcttcatag

SEQ ID NO: 2785539 - DNA, 17 bp, Homo sapiens
tgtttgtttcctttgtt

SEQ ID NO: 2785540 - DNA, 12 bp, Homo sapiens
tgttttctgaat

SEQ ID NO: 2785541 - DNA, 17 bp, Homo sapiens
tgttttctgaataacat

SEQ ID NO: 2785542 - DNA, 11 bp, Homo sapiens
tgttttctgat

SEQ ID NO: 2785543 - DNA, 16 bp, Homo sapiens
tgtttttaaaaatcat

SEQ ID NO: 2785544 - DNA, 14 bp, Homo sapiens
tgtttttaagctgt

SEQ ID NO: 2785545 - DNA, 13 bp, Homo sapiens
tgtttttcatgaa

SEQ ID NO: 2785546 - DNA, 14 bp, Homo sapiens
tgtttttcatgaaa

SEQ ID NO: 2785547 - DNA, 20 bp, Homo sapiens
tgtttttccttgtatttaaa

SEQ ID NO: 2785548 - DNA, 14 bp, Homo sapiens
tgtttttgaagaag

SEQ ID NO: 2785549 - DNA, 19 bp, Homo sapiens
tgttttttgaaaacatggt

SEQ ID NO: 2785550 - DNA, 13 bp, Homo sapiens
ttaaaaaactaaa

SEQ ID NO: 2785551 - DNA, 11 bp, Homo sapiens
ttaaaaaataa

SEQ ID NO: 2785552 - DNA, 12 bp, Homo sapiens
ttaaaaaataaa

SEQ ID NO: 2785553 - DNA, 14 bp, Homo sapiens
ttaaaaaataaaaa

SEQ ID NO: 2785554 - DNA, 13 bp, Homo sapiens
ttaaaaaatacac

SEQ ID NO: 2785555 - DNA, 18 bp, Homo sapiens
ttaaaaacatgagaaatg

SEQ ID NO: 2785556 - DNA, 19 bp, Homo sapiens
ttaaaaccatgcagcttca

SEQ ID NO: 2785557 - DNA, 18 bp, Homo sapiens
ttaaaaggttgactcaag

SEQ ID NO: 2785558 - DNA, 15 bp, Homo sapiens
ttaaaataactagtg

SEQ ID NO: 2785559 - DNA, 12 bp, Homo sapiens
ttaaaataatat

SEQ ID NO: 2785560 - DNA, 16 bp, Homo sapiens
ttaaaatatatataaa

SEQ ID NO: 2785561 - DNA, 17 bp, Homo sapiens
ttaaaatatatataaat

SEQ ID NO: 2785562 - DNA, 16 bp, Homo sapiens
ttaaaatattcctgca

SEQ ID NO: 2785563 - DNA, 19 bp, Homo sapiens
ttaaaatattcctgcattt

SEQ ID NO: 2785564 - DNA, 12 bp, Homo sapiens
ttaaaatatttt

SEQ ID NO: 2785565 - DNA, 23 bp, Homo sapiens
ttaaaatcaggattttagtgctt

SEQ ID NO: 2785566 - DNA, 17 bp, Homo sapiens
ttaaaatcattcaatat

SEQ ID NO: 2785567 - DNA, 13 bp, Homo sapiens
ttaaaattagtga

SEQ ID NO: 2785568 - DNA, 17 bp, Homo sapiens
ttaaacacctgacacat

SEQ ID NO: 2785569 - DNA, 16 bp, Homo sapiens
ttaaacactgtaatct

SEQ ID NO: 2785570 - DNA, 23 bp, Homo sapiens
ttaaacagtgagcctgaattttg

SEQ ID NO: 2785571 - DNA, 15 bp, Homo sapiens
ttaaaccagcagaaa

SEQ ID NO: 2785572 - DNA, 18 bp, Homo sapiens
ttaaaccagcagaaaagt

SEQ ID NO: 2785573 - DNA, 20 bp, Homo sapiens
ttaaaccagcagaaaagtgc

SEQ ID NO: 2785574 - DNA, 21 bp, Homo sapiens
ttaaaccagcagaaaagtgct

SEQ ID NO: 2785575 - DNA, 14 bp, Homo sapiens
ttaaaccttttttg

SEQ ID NO: 2785576 - DNA, 13 bp, Homo sapiens
ttaaacttctgat

SEQ ID NO: 2785577 - DNA, 22 bp, Homo sapiens
ttaaagaggcgtcttgtatttt

SEQ ID NO: 2785578 - DNA, 15 bp, Homo sapiens
ttaaagcaccaaatt

SEQ ID NO: 2785579 - DNA, 14 bp, Homo sapiens
ttaaagctgttatt

SEQ ID NO: 2785580 - DNA, 12 bp, Homo sapiens
ttaaaggaagga

SEQ ID NO: 2785581 - DNA, 21 bp, Homo sapiens
ttaaaggggcagaaaaactct

SEQ ID NO: 2785582 - DNA, 13 bp, Homo sapiens
ttaaagtatatat

SEQ ID NO: 2785583 - DNA, 15 bp, Homo sapiens
ttaaagttgtttgtg

SEQ ID NO: 2785584 - DNA, 21 bp, Homo sapiens
ttaaataaatgtcattaaaat

SEQ ID NO: 2785585 - DNA, 13 bp, Homo sapiens
ttaaataaattca

SEQ ID NO: 2785586 - DNA, 16 bp, Homo sapiens
ttaaataaattcaaac

SEQ ID NO: 2785587 - DNA, 21 bp, Homo sapiens
ttaaataaattcaaaccattt

SEQ ID NO: 2785588 - DNA, 23 bp, Homo sapiens
ttaaataaattcaaaccatttaa

SEQ ID NO: 2785589 - DNA, 16 bp, Homo sapiens
ttaaatacagacacta

SEQ ID NO: 2785590 - DNA, 19 bp, Homo sapiens
ttaaatacagacactaagt

SEQ ID NO: 2785591 - DNA, 12 bp, Homo sapiens
ttaaatcaaaag

SEQ ID NO: 2785592 - DNA, 23 bp, Homo sapiens
ttaaattctctctcttgcaggaa

SEQ ID NO: 2785593 - DNA, 22 bp, Homo sapiens
ttaaattctttttcaaaaatta

SEQ ID NO: 2785594 - DNA, 16 bp, Homo sapiens
ttaaattttaaggtag

SEQ ID NO: 2785595 - DNA, 12 bp, Homo sapiens
ttaaattttcta

SEQ ID NO: 2785596 - DNA, 20 bp, Homo sapiens
ttaacaaaacaagaaagaaa

SEQ ID NO: 2785597 - DNA, 14 bp, Homo sapiens
ttaacaacttgtct

SEQ ID NO: 2785598 - DNA, 14 bp, Homo sapiens
ttaacagagacaga

SEQ ID NO: 2785599 - DNA, 16 bp, Homo sapiens
ttaaccctctcttccc

SEQ ID NO: 2785600 - DNA, 17 bp, Homo sapiens
ttaaccctctcttccct

SEQ ID NO: 2785601 - DNA, 15 bp, Homo sapiens
ttaaccgtttttcaa

SEQ ID NO: 2785602 - DNA, 15 bp, Homo sapiens
ttaacctcagtgtca

SEQ ID NO: 2785603 - DNA, 16 bp, Homo sapiens
ttaacctgaattattc

SEQ ID NO: 2785604 - DNA, 14 bp, Homo sapiens
ttcacaaaatgcaa

SEQ ID NO: 2785605 - DNA, 18 bp, Homo sapiens
ttcacaaccagccacaca

SEQ ID NO: 2785606 - DNA, 22 bp, Homo sapiens
ttcacaaccagccacacagagc

SEQ ID NO: 2785607 - DNA, 21 bp, Homo sapiens
ttcacacacaggcaactgagg

SEQ ID NO: 2785608 - DNA, 14 bp, Homo sapiens
ttcacacacccctc

SEQ ID NO: 2785609 - DNA, 19 bp, Homo sapiens
ttcacagcctataaccaga

SEQ ID NO: 2785610 - DNA, 13 bp, Homo sapiens
ttcacagtttttc

SEQ ID NO: 2785611 - DNA, 18 bp, Homo sapiens
ttcacatttgatgtacat

SEQ ID NO: 2785612 - DNA, 18 bp, Homo sapiens
ttcaccagatttgctaat

SEQ ID NO: 2785613 - DNA, 23 bp, Homo sapiens
ttcacctgtttttaagctgtttc

SEQ ID NO: 2785614 - DNA, 14 bp, Homo sapiens
ttcaccttatgtat

SEQ ID NO: 2785615 - DNA, 20 bp, Homo sapiens
ttcaccttatgtattatttt

SEQ ID NO: 2785616 - DNA, 16 bp, Homo sapiens
ttcacgcaacttgaaa

SEQ ID NO: 2785617 - DNA, 22 bp, Homo sapiens
ttcacgcaacttgaaattatat

SEQ ID NO: 2785618 - DNA, 17 bp, Homo sapiens
ttcactatgattttcta

SEQ ID NO: 2785619 - DNA, 23 bp, Homo sapiens
ttcactccggtgtgcctgcagcc

SEQ ID NO: 2785620 - DNA, 22 bp, Homo sapiens
ttcactgaagaaaccttcagat

SEQ ID NO: 2785621 - DNA, 12 bp, Homo sapiens
ttcactttaaag

SEQ ID NO: 2785622 - DNA, 15 bp, Homo sapiens
ttcactttaaagtct

SEQ ID NO: 2785623 - DNA, 13 bp, Homo sapiens
ttcagaaatatgt

SEQ ID NO: 2785624 - DNA, 16 bp, Homo sapiens
ttcagaacatcctcca

SEQ ID NO: 2785625 - DNA, 12 bp, Homo sapiens
ttcagaagaaaa

SEQ ID NO: 2785626 - DNA, 22 bp, Homo sapiens
ttcagaattgaaggagaaaatg

SEQ ID NO: 2785627 - DNA, 13 bp, Homo sapiens
ttcagaccccagc

SEQ ID NO: 2785628 - DNA, 20 bp, Homo sapiens
ttcagagagggcagaggggt

SEQ ID NO: 2785629 - DNA, 17 bp, Homo sapiens
ttcagagggaaagtaaa

SEQ ID NO: 2785630 - DNA, 13 bp, Homo sapiens
ttcagatcgtatt

SEQ ID NO: 2785631 - DNA, 22 bp, Homo sapiens
ttcagattcccagagcaaaata

SEQ ID NO: 2785632 - DNA, 21 bp, Homo sapiens
ttcagccatcaacaagagttg

SEQ ID NO: 2785633 - DNA, 14 bp, Homo sapiens
ttcagcccctcctc

SEQ ID NO: 2785634 - DNA, 16 bp, Homo sapiens
ttcagcccctcctctg

SEQ ID NO: 2785635 - DNA, 17 bp, Homo sapiens
ttcagcccctcctctgc

SEQ ID NO: 2785636 - DNA, 14 bp, Homo sapiens
ttcagctaagctag

SEQ ID NO: 2785637 - DNA, 20 bp, Homo sapiens
ttcagctaagctaggaatga

SEQ ID NO: 2785638 - DNA, 23 bp, Homo sapiens
ttcagctccagctcaccagcccc

SEQ ID NO: 2785639 - DNA, 22 bp, Homo sapiens
ttcagcttgtaaatagctcagg

SEQ ID NO: 2785640 - DNA, 18 bp, Homo sapiens
ttcaggaaaaggcctggg

SEQ ID NO: 2785641 - DNA, 21 bp, Homo sapiens
ttcaggatactctgtcagatg

SEQ ID NO: 2785642 - DNA, 22 bp, Homo sapiens
ttcaggggggttgtgaggcctg

SEQ ID NO: 2785643 - DNA, 17 bp, Homo sapiens
ttcagggttggcccctg

SEQ ID NO: 2785644 - DNA, 16 bp, Homo sapiens
ttcaggtaacaggcag

SEQ ID NO: 2785645 - DNA, 14 bp, Homo sapiens
ttcaggtactaaat

SEQ ID NO: 2785646 - DNA, 20 bp, Homo sapiens
ttcaggtgtttagttgcaga

SEQ ID NO: 2785647 - DNA, 19 bp, Homo sapiens
ttcaggttttgtaaagatg

SEQ ID NO: 2785648 - DNA, 15 bp, Homo sapiens
ttcagtaaaaaacaa

SEQ ID NO: 2785649 - DNA, 20 bp, Homo sapiens
ttcagtataatttaacttca

SEQ ID NO: 2785650 - DNA, 23 bp, Homo sapiens
ttcagtataatttaacttcagag

SEQ ID NO: 2785651 - DNA, 12 bp, Homo sapiens
ttcagtccgcct

SEQ ID NO: 2785652 - DNA, 15 bp, Homo sapiens
ttcagtcctggtctg

SEQ ID NO: 2785653 - DNA, 21 bp, Homo sapiens
ttcagtcctggtctgctcagg

SEQ ID NO: 2785654 - DNA, 13 bp, Homo sapiens
ttcagtgccttgg

SEQ ID NO: 2785655 - DNA, 14 bp, Homo sapiens
ttcagtggcagctg

SEQ ID NO: 2785656 - DNA, 18 bp, Homo sapiens
ttcagttgatcactggca

SEQ ID NO: 2785657 - DNA, 20 bp, Homo sapiens
ttcatatgtaccatgtacat

SEQ ID NO: 2785658 - DNA, 14 bp, Homo sapiens
ttcatcaattttta

SEQ ID NO: 2785659 - DNA, 20 bp, Homo sapiens
ttcatcaatttttatacata

SEQ ID NO: 2785660 - DNA, 16 bp, Homo sapiens
ttcatccagttgcaat

SEQ ID NO: 2785661 - DNA, 22 bp, Homo sapiens
ttcatccagttgcaataaaata

SEQ ID NO: 2785662 - DNA, 17 bp, Homo sapiens
ttcatctatttctgaga

SEQ ID NO: 2785663 - DNA, 19 bp, Homo sapiens
ttcatctcatttaagggaa

SEQ ID NO: 2785664 - DNA, 22 bp, Homo sapiens
ttcatgaaaatagctctttcag

SEQ ID NO: 2785665 - DNA, 17 bp, Homo sapiens
ttcatgatttcatttca

SEQ ID NO: 2785666 - DNA, 14 bp, Homo sapiens
ttcatgcaatgaca

SEQ ID NO: 2785667 - DNA, 17 bp, Homo sapiens
ttcatgctatctctgtg

SEQ ID NO: 2785668 - DNA, 18 bp, Homo sapiens
ttcatgctatctctgtgt

SEQ ID NO: 2785669 - DNA, 23 bp, Homo sapiens
ttcatggcagatgtaggagggac

SEQ ID NO: 2785670 - DNA, 15 bp, Homo sapiens
ttcatgtaataaatc

SEQ ID NO: 2785671 - DNA, 16 bp, Homo sapiens
ttcatgtaataaatct

SEQ ID NO: 2785672 - DNA, 16 bp, Homo sapiens
ttcatgtacagcatgc

SEQ ID NO: 2785673 - DNA, 13 bp, Homo sapiens
ttcattaaagcat

SEQ ID NO: 2785674 - DNA, 15 bp, Homo sapiens
ttcattaaattttct

SEQ ID NO: 2785675 - DNA, 16 bp, Homo sapiens
ttcattgactatcaaa

SEQ ID NO: 2785676 - DNA, 13 bp, Homo sapiens
ttcattgtataaa

SEQ ID NO: 2785677 - DNA, 17 bp, Homo sapiens
ttcattgtataaaaata

SEQ ID NO: 2785678 - DNA, 12 bp, Homo sapiens
ttcatttcactt

SEQ ID NO: 2785679 - DNA, 15 bp, Homo sapiens
ttcatttcactttaa

SEQ ID NO: 2785680 - DNA, 13 bp, Homo sapiens
ttcatttcctcaa

SEQ ID NO: 2785681 - DNA, 16 bp, Homo sapiens
ttcatttgatgctaaa

SEQ ID NO: 2785682 - DNA, 16 bp, Homo sapiens
ttcattttcagagtga

SEQ ID NO: 2785683 - DNA, 17 bp, Homo sapiens
ttcattttgaaaaacac

SEQ ID NO: 2785684 - DNA, 20 bp, Homo sapiens
ttccaaagcacattgaaaga

SEQ ID NO: 2785685 - DNA, 21 bp, Homo sapiens
ttccaaatgaatgttgtctgt

SEQ ID NO: 2785686 - DNA, 23 bp, Homo sapiens
ttccaacagctcaagtcttccct

SEQ ID NO: 2785687 - DNA, 12 bp, Homo sapiens
ttccaagagctg

SEQ ID NO: 2785688 - DNA, 16 bp, Homo sapiens
ttccaaggagttccat

SEQ ID NO: 2785689 - DNA, 11 bp, Homo sapiens
ttccaataaaa

SEQ ID NO: 2785690 - DNA, 13 bp, Homo sapiens
ttccaataaaatt

SEQ ID NO: 2785691 - DNA, 21 bp, Homo sapiens
ttccacaagattcccagagac

SEQ ID NO: 2785692 - DNA, 20 bp, Homo sapiens
ttccacattaattagatttt

SEQ ID NO: 2785693 - DNA, 11 bp, Homo sapiens
ttccaccctgg

SEQ ID NO: 2785694 - DNA, 13 bp, Homo sapiens
ttccaccctggaa

SEQ ID NO: 2785695 - DNA, 18 bp, Homo sapiens
ttctcttacgctctctgt

SEQ ID NO: 2785696 - DNA, 12 bp, Homo sapiens
ttctcttcctgt

SEQ ID NO: 2785697 - DNA, 13 bp, Homo sapiens
ttctcttcctgta

SEQ ID NO: 2785698 - DNA, 16 bp, Homo sapiens
ttctcttttcaaaaca

SEQ ID NO: 2785699 - DNA, 21 bp, Homo sapiens
ttctgaaacttcataaatgtt

SEQ ID NO: 2785700 - DNA, 22 bp, Homo sapiens
ttctgaactcaagctgcgttta

SEQ ID NO: 2785701 - DNA, 14 bp, Homo sapiens
ttctgaagatctca

SEQ ID NO: 2785702 - DNA, 16 bp, Homo sapiens
ttctgaagatctcaga

SEQ ID NO: 2785703 - DNA, 17 bp, Homo sapiens
ttctgaataacatttgt

SEQ ID NO: 2785704 - DNA, 16 bp, Homo sapiens
ttctgaataatttctt

SEQ ID NO: 2785705 - DNA, 14 bp, Homo sapiens
ttctgaccatttca

SEQ ID NO: 2785706 - DNA, 23 bp, Homo sapiens
ttctgagtacttgatttcaggtc

SEQ ID NO: 2785707 - DNA, 23 bp, Homo sapiens
ttctgagtgacatgggtgtgcca

SEQ ID NO: 2785708 - DNA, 14 bp, Homo sapiens
ttctgagtgttttt

SEQ ID NO: 2785709 - DNA, 12 bp, Homo sapiens
ttctgagttcct

SEQ ID NO: 2785710 - DNA, 16 bp, Homo sapiens
ttctgataatgaaaat

SEQ ID NO: 2785711 - DNA, 18 bp, Homo sapiens
ttctgatgggtcccaaaa

SEQ ID NO: 2785712 - DNA, 21 bp, Homo sapiens
ttctgcagtagtctctgtgct

SEQ ID NO: 2785713 - DNA, 23 bp, Homo sapiens
ttctgcattttattctggatgga

SEQ ID NO: 2785714 - DNA, 19 bp, Homo sapiens
ttctgcccacattggaccc

SEQ ID NO: 2785715 - DNA, 15 bp, Homo sapiens
ttctgcctgcccagg

SEQ ID NO: 2785716 - DNA, 16 bp, Homo sapiens
ttctgcctgcccaggc

SEQ ID NO: 2785717 - DNA, 18 bp, Homo sapiens
ttctgcctgcccaggccc

SEQ ID NO: 2785718 - DNA, 21 bp, Homo sapiens
ttctgcctgcccaggcccctg

SEQ ID NO: 2785719 - DNA, 15 bp, Homo sapiens
ttctgctacctcact

SEQ ID NO: 2785720 - DNA, 13 bp, Homo sapiens
ttctgctgcccct

SEQ ID NO: 2785721 - DNA, 15 bp, Homo sapiens
ttctgctggcctgga

SEQ ID NO: 2785722 - DNA, 16 bp, Homo sapiens
ttctgcttcagcctcc

SEQ ID NO: 2785723 - DNA, 15 bp, Homo sapiens
ttctggaatgtaatc

SEQ ID NO: 2785724 - DNA, 16 bp, Homo sapiens
ttctggaatgtaatca

SEQ ID NO: 2785725 - DNA, 20 bp, Homo sapiens
ttctggaatgtaatcaatgt

SEQ ID NO: 2785726 - DNA, 19 bp, Homo sapiens
ttctggacccgttcaactt

SEQ ID NO: 2785727 - DNA, 18 bp, Homo sapiens
ttctggagctgctgttcc

SEQ ID NO: 2785728 - DNA, 22 bp, Homo sapiens
ttctggagctgctgttccaaca

SEQ ID NO: 2785729 - DNA, 15 bp, Homo sapiens
ttctggagtctccag

SEQ ID NO: 2785730 - DNA, 11 bp, Homo sapiens
ttctgggacac

SEQ ID NO: 2785731 - DNA, 16 bp, Homo sapiens
ttctgggaggaagcag

SEQ ID NO: 2785732 - DNA, 18 bp, Homo sapiens
ttctgtccagtttccaaa

SEQ ID NO: 2785733 - DNA, 22 bp, Homo sapiens
ttctgtccttttggcactgaga

SEQ ID NO: 2785734 - DNA, 13 bp, Homo sapiens
ttctgtgaagaat

SEQ ID NO: 2785735 - DNA, 19 bp, Homo sapiens
ttctgtggagagtgagaat

SEQ ID NO: 2785736 - DNA, 21 bp, Homo sapiens
ttctgttggccagtgtgacaa

SEQ ID NO: 2785737 - DNA, 19 bp, Homo sapiens
ttcttaaaatgtttcattt

SEQ ID NO: 2785738 - DNA, 19 bp, Homo sapiens
ttcttaaataagaaacttt

SEQ ID NO: 2785739 - DNA, 15 bp, Homo sapiens
ttcttacaaacatgt

SEQ ID NO: 2785740 - DNA, 15 bp, Homo sapiens
ttcttacctgtatgt

SEQ ID NO: 2785741 - DNA, 19 bp, Homo sapiens
ttcttactgttttgtatca

SEQ ID NO: 2785742 - DNA, 23 bp, Homo sapiens
ttcttagactagttgaacatctc

SEQ ID NO: 2785743 - DNA, 14 bp, Homo sapiens
ttcttatttgcaat

SEQ ID NO: 2785744 - DNA, 22 bp, Homo sapiens
ttcttattttgtaataaactct

SEQ ID NO: 2785745 - DNA, 14 bp, Homo sapiens
ttcttcacccagct

SEQ ID NO: 2785746 - DNA, 17 bp, Homo sapiens
ttcttcagatcagtgct

SEQ ID NO: 2785747 - DNA, 23 bp, Homo sapiens
ttcttcagccacctctctttttc

SEQ ID NO: 2785748 - DNA, 13 bp, Homo sapiens
ttcttccatctga

SEQ ID NO: 2785749 - DNA, 20 bp, Homo sapiens
ttcttcccatttgtaatgta

SEQ ID NO: 2785750 - DNA, 21 bp, Homo sapiens
ttcttcccatttgtaatgtat

SEQ ID NO: 2785751 - DNA, 15 bp, Homo sapiens
ttcttcctcactatg

SEQ ID NO: 2785752 - DNA, 11 bp, Homo sapiens
ttcttcctctg

SEQ ID NO: 2785753 - DNA, 23 bp, Homo sapiens
ttcttcgaggtggatcacagagg

SEQ ID NO: 2785754 - DNA, 18 bp, Homo sapiens
ttcttcgctgctagagaa

SEQ ID NO: 2785755 - DNA, 19 bp, Homo sapiens
ttcttctacaaccagagcc

SEQ ID NO: 2785756 - DNA, 20 bp, Homo sapiens
ttcttctacaaccagagccc

SEQ ID NO: 2785757 - DNA, 21 bp, Homo sapiens
ttcttctaggttctaaaaatt

SEQ ID NO: 2785758 - DNA, 13 bp, Homo sapiens
ttcttctgcttca

SEQ ID NO: 2785759 - DNA, 16 bp, Homo sapiens
ttcttgccaatgaggt

SEQ ID NO: 2785760 - DNA, 18 bp, Homo sapiens
ttcttgccccttgggcct

SEQ ID NO: 2785761 - DNA, 13 bp, Homo sapiens
ttctttaaatcaa

SEQ ID NO: 2785762 - DNA, 16 bp, Homo sapiens
ttctttaaatcaaaag

SEQ ID NO: 2785763 - DNA, 18 bp, Homo sapiens
ttctttaggtgcctcctg

SEQ ID NO: 2785764 - DNA, 20 bp, Homo sapiens
ttctttaggtgcctcctgtc

SEQ ID NO: 2785765 - DNA, 14 bp, Homo sapiens
ttctttataaactt

SEQ ID NO: 2785766 - DNA, 10 bp, Homo sapiens
ttctttcaag

SEQ ID NO: 2785767 - DNA, 22 bp, Homo sapiens
ttctttcctcttccccttgccc

SEQ ID NO: 2785768 - DNA, 18 bp, Homo sapiens
ttctttcttttgtgttgg

SEQ ID NO: 2785769 - DNA, 13 bp, Homo sapiens
ttcttttactgta

SEQ ID NO: 2785770 - DNA, 22 bp, Homo sapiens
ttcttttgtgttggatttgttt

SEQ ID NO: 2785771 - DNA, 16 bp, Homo sapiens
ttctttttattttctt

SEQ ID NO: 2785772 - DNA, 14 bp, Homo sapiens
ttctttttttgtga

SEQ ID NO: 2785773 - DNA, 17 bp, Homo sapiens
ttgaaagagaaccagtt

SEQ ID NO: 2785774 - DNA, 16 bp, Homo sapiens
ttgaaatataatgcaa

SEQ ID NO: 2785775 - DNA, 21 bp, Homo sapiens
ttgaaatcagaagcctacttt

SEQ ID NO: 2785776 - DNA, 17 bp, Homo sapiens
ttgaaattatatctgtg

SEQ ID NO: 2785777 - DNA, 13 bp, Homo sapiens
ttgaacccaggag

SEQ ID NO: 2785778 - DNA, 18 bp, Homo sapiens
ttgaacttaaataaatgt

SEQ ID NO: 2785779 - DNA, 16 bp, Homo sapiens
ttgaagaaaagcactt

SEQ ID NO: 2785780 - DNA, 17 bp, Homo sapiens
ttgaagccactgaagct

SEQ ID NO: 2785781 - DNA, 18 bp, Homo sapiens
ttgaaggaggtgagggat

SEQ ID NO: 2785782 - DNA, 22 bp, Homo sapiens
ttgaagttgtgttaacaatgca

SEQ ID NO: 2785783 - DNA, 18 bp, Homo sapiens
ttgaataaagtctgagtg

SEQ ID NO: 2785784 - DNA, 14 bp, Homo sapiens
ttgaataagtattc

SEQ ID NO: 2785785 - DNA, 15 bp, Homo sapiens
ttgaatataaacact

SEQ ID NO: 2785786 - DNA, 19 bp, Homo sapiens
ttgtacacaccttatattt

SEQ ID NO: 2785787 - DNA, 13 bp, Homo sapiens
ttgtacactatct

SEQ ID NO: 2785788 - DNA, 12 bp, Homo sapiens
ttgtacagaatt

SEQ ID NO: 2785789 - DNA, 16 bp, Homo sapiens
ttgtacagaattttta

SEQ ID NO: 2785790 - DNA, 19 bp, Homo sapiens
ttgtacagacgtatgctta

SEQ ID NO: 2785791 - DNA, 21 bp, Homo sapiens
ttgtacagacgtatgcttatt

SEQ ID NO: 2785792 - DNA, 17 bp, Homo sapiens
ttgtacatatggaaatc

SEQ ID NO: 2785793 - DNA, 16 bp, Homo sapiens
ttgtacatattggaaa

SEQ ID NO: 2785794 - DNA, 11 bp, Homo sapiens
ttgtactatgt

SEQ ID NO: 2785795 - DNA, 22 bp, Homo sapiens
ttgtagaagtaggaagtgaaaa

SEQ ID NO: 2785796 - DNA, 15 bp, Homo sapiens
ttgtagagccagggt

SEQ ID NO: 2785797 - DNA, 19 bp, Homo sapiens
ttgtagagtggcccagaat

SEQ ID NO: 2785798 - DNA, 19 bp, Homo sapiens
ttgtaggtcaatgaaatat

SEQ ID NO: 2785799 - DNA, 20 bp, Homo sapiens
ttgtagtagttgatgaccaa

SEQ ID NO: 2785800 - DNA, 21 bp, Homo sapiens
ttgtataagattagaatgaaa

SEQ ID NO: 2785801 - DNA, 14 bp, Homo sapiens
ttgtatagtaaagt

SEQ ID NO: 2785802 - DNA, 18 bp, Homo sapiens
ttgtatatacatattata

SEQ ID NO: 2785803 - DNA, 20 bp, Homo sapiens
ttgtatatacatattataaa

SEQ ID NO: 2785804 - DNA, 22 bp, Homo sapiens
ttgtatattccaccattcacat

SEQ ID NO: 2785805 - DNA, 23 bp, Homo sapiens
ttgtattgttaatgcatcatcat

SEQ ID NO: 2785806 - DNA, 23 bp, Homo sapiens
ttgtattttcttcccatttgtaa

SEQ ID NO: 2785807 - DNA, 18 bp, Homo sapiens
ttgtcaatattaaataca

SEQ ID NO: 2785808 - DNA, 23 bp, Homo sapiens
ttgtcacaatcctaacacattat

SEQ ID NO: 2785809 - DNA, 18 bp, Homo sapiens
ttgtcacacactttggct

SEQ ID NO: 2785810 - DNA, 18 bp, Homo sapiens
ttgtcactagcagctgca

SEQ ID NO: 2785811 - DNA, 20 bp, Homo sapiens
ttgtcagactttaaagaata

SEQ ID NO: 2785812 - DNA, 16 bp, Homo sapiens
ttgtcatgtaccatca

SEQ ID NO: 2785813 - DNA, 18 bp, Homo sapiens
ttgtcatgtaccatcaat

SEQ ID NO: 2785814 - DNA, 20 bp, Homo sapiens
ttgtcattcaagcctgtgaa

SEQ ID NO: 2785815 - DNA, 13 bp, Homo sapiens
ttgtccagcgcct

SEQ ID NO: 2785816 - DNA, 18 bp, Homo sapiens
ttgtccatatcagacctc

SEQ ID NO: 2785817 - DNA, 17 bp, Homo sapiens
ttgtccatgcctacaga

SEQ ID NO: 2785818 - DNA, 21 bp, Homo sapiens
ttgtccatgcctacagataat

SEQ ID NO: 2785819 - DNA, 14 bp, Homo sapiens
ttgtcccctcttga

SEQ ID NO: 2785820 - DNA, 17 bp, Homo sapiens
ttgtcctttgagaaaga

SEQ ID NO: 2785821 - DNA, 19 bp, Homo sapiens
ttgtcctttgagaaagaaa

SEQ ID NO: 2785822 - DNA, 14 bp, Homo sapiens
ttgtctatgggact

SEQ ID NO: 2785823 - DNA, 18 bp, Homo sapiens
ttgtctattacctgttag

SEQ ID NO: 2785824 - DNA, 23 bp, Homo sapiens
ttgtctccactaaatgagctcct

SEQ ID NO: 2785825 - DNA, 17 bp, Homo sapiens
ttgtcttaatattgtgg

SEQ ID NO: 2785826 - DNA, 11 bp, Homo sapiens
ttgtgaagagg

SEQ ID NO: 2785827 - DNA, 16 bp, Homo sapiens
ttgtgagccaaagaga

SEQ ID NO: 2785828 - DNA, 18 bp, Homo sapiens
ttgtgatgtcccaacttg

SEQ ID NO: 2785829 - DNA, 16 bp, Homo sapiens
ttgtgattttgtacag

SEQ ID NO: 2785830 - DNA, 18 bp, Homo sapiens
ttgtggaaagcctctgct

SEQ ID NO: 2785831 - DNA, 22 bp, Homo sapiens
ttgtggaggagctcaggacact

SEQ ID NO: 2785832 - DNA, 16 bp, Homo sapiens
ttgtggcaagtgaatt

SEQ ID NO: 2785833 - DNA, 14 bp, Homo sapiens
ttgtggtaaaaaga

SEQ ID NO: 2785834 - DNA, 20 bp, Homo sapiens
ttgtgtacaaagtagagaag

SEQ ID NO: 2785835 - DNA, 22 bp, Homo sapiens
ttgtgtacaaagtagagaagta

SEQ ID NO: 2785836 - DNA, 23 bp, Homo sapiens
ttgtgtacaaagtagagaagtat

SEQ ID NO: 2785837 - DNA, 18 bp, Homo sapiens
ttgtgtagattgtgtaaa

SEQ ID NO: 2785838 - DNA, 13 bp, Homo sapiens
ttgtgtctgtaca

SEQ ID NO: 2785839 - DNA, 13 bp, Homo sapiens
ttgtgttctaata

SEQ ID NO: 2785840 - DNA, 13 bp, Homo sapiens
ttgtgtttagatt

SEQ ID NO: 2785841 - DNA, 15 bp, Homo sapiens
ttgtgtttagatttt

SEQ ID NO: 2785842 - DNA, 17 bp, Homo sapiens
ttgttaaaaatattttc

SEQ ID NO: 2785843 - DNA, 12 bp, Homo sapiens
ttgttaaacacg

SEQ ID NO: 2785844 - DNA, 12 bp, Homo sapiens
ttgttaatgcat

SEQ ID NO: 2785845 - DNA, 17 bp, Homo sapiens
ttgttcagttgacttac

SEQ ID NO: 2785846 - DNA, 20 bp, Homo sapiens
ttgttctagttagcaggaaa

SEQ ID NO: 2785847 - DNA, 22 bp, Homo sapiens
ttgttctagttagcaggaaata

SEQ ID NO: 2785848 - DNA, 14 bp, Homo sapiens
ttgttctgtcacca

SEQ ID NO: 2785849 - DNA, 20 bp, Homo sapiens
ttgttgataaattccactgg

SEQ ID NO: 2785850 - DNA, 13 bp, Homo sapiens
ttgttggaatgaa

SEQ ID NO: 2785851 - DNA, 21 bp, Homo sapiens
ttgttgtgattttgtacagaa

SEQ ID NO: 2785852 - DNA, 12 bp, Homo sapiens
ttgtttaaagtt

SEQ ID NO: 2785853 - DNA, 14 bp, Homo sapiens
ttgtttcttaaata

SEQ ID NO: 2785854 - DNA, 13 bp, Homo sapiens
ttgtttcttccaa

SEQ ID NO: 2785855 - DNA, 15 bp, Homo sapiens
tttaaaaaactaaaa

SEQ ID NO: 2785856 - DNA, 13 bp, Homo sapiens
tttaaaaaagctt

SEQ ID NO: 2785857 - DNA, 14 bp, Homo sapiens
tttaaaaaagctta

SEQ ID NO: 2785858 - DNA, 21 bp, Homo sapiens
tttaaaaaagcttaaaacttt

SEQ ID NO: 2785859 - DNA, 23 bp, Homo sapiens
tttaaaaaagcttaaaactttga

SEQ ID NO: 2785860 - DNA, 16 bp, Homo sapiens
tttaaaaaataaatat

SEQ ID NO: 2785861 - DNA, 19 bp, Homo sapiens
tttaaaaaataaatataat

SEQ ID NO: 2785862 - DNA, 14 bp, Homo sapiens
tttaaaaaatacac

SEQ ID NO: 2785863 - DNA, 19 bp, Homo sapiens
tttaaaaacatgagaaatg

SEQ ID NO: 2785864 - DNA, 21 bp, Homo sapiens
tttaaaaacatgagaaatgtg

SEQ ID NO: 2785865 - DNA, 13 bp, Homo sapiens
tttaaaaatcata

SEQ ID NO: 2785866 - DNA, 19 bp, Homo sapiens
tttaaaaatcataaactgt

SEQ ID NO: 2785867 - DNA, 14 bp, Homo sapiens
tttaaaaccatgca

SEQ ID NO: 2785868 - DNA, 15 bp, Homo sapiens
tttaaaaccatgcag

SEQ ID NO: 2785869 - DNA, 12 bp, Homo sapiens
tttaaaatagca

SEQ ID NO: 2785870 - DNA, 17 bp, Homo sapiens
tttaaaattttatctct

SEQ ID NO: 2785871 - DNA, 15 bp, Homo sapiens
tttaaacaagtattt

SEQ ID NO: 2785872 - DNA, 23 bp, Homo sapiens
tttaaaccagcagaaaagtgctt

SEQ ID NO: 2785873 - DNA, 11 bp, Homo sapiens
tttaaaccttt

SEQ ID NO: 2785874 - DNA, 17 bp, Homo sapiens
tttaaagtacctgtagt

SEQ ID NO: 2785875 - DNA, 17 bp, Homo sapiens
tttaaagttgtttgtgc

SEQ ID NO: 2785876 - DNA, 14 bp, Homo sapiens
tttaaatatgaaca

SEQ ID NO: 2785877 - DNA, 18 bp, Homo sapiens
tttcttggtctcagcttc

SEQ ID NO: 2785878 - DNA, 21 bp, Homo sapiens
tttcttggtctcagcttcatt

SEQ ID NO: 2785879 - DNA, 15 bp, Homo sapiens
tttctttgtgtagct

SEQ ID NO: 2785880 - DNA, 22 bp, Homo sapiens
tttgaacccccgccatccttca

SEQ ID NO: 2785881 - DNA, 18 bp, Homo sapiens
tttgaactgccaagaaaa

SEQ ID NO: 2785882 - DNA, 16 bp, Homo sapiens
tttgaagttagcttta

SEQ ID NO: 2785883 - DNA, 17 bp, Homo sapiens
tttgaagttagctttaa

SEQ ID NO: 2785884 - DNA, 10 bp, Homo sapiens
tttgaataaa

SEQ ID NO: 2785885 - DNA, 16 bp, Homo sapiens
tttgaataaagtctga

SEQ ID NO: 2785886 - DNA, 19 bp, Homo sapiens
tttgaataaagtctgagtg

SEQ ID NO: 2785887 - DNA, 17 bp, Homo sapiens
tttgaatccatgcttgg

SEQ ID NO: 2785888 - DNA, 19 bp, Homo sapiens
tttgaatcctctctctgtg

SEQ ID NO: 2785889 - DNA, 15 bp, Homo sapiens
tttgacaacaaatta

SEQ ID NO: 2785890 - DNA, 15 bp, Homo sapiens
tttgagaaagaaata

SEQ ID NO: 2785891 - DNA, 21 bp, Homo sapiens
tttgagcgcagagtaaaataa

SEQ ID NO: 2785892 - DNA, 12 bp, Homo sapiens
tttgagtaattc

SEQ ID NO: 2785893 - DNA, 14 bp, Homo sapiens
tttgagtgttttaa

SEQ ID NO: 2785894 - DNA, 14 bp, Homo sapiens
tttgagttatagtt

SEQ ID NO: 2785895 - DNA, 18 bp, Homo sapiens
tttgatagtattgtgcat

SEQ ID NO: 2785896 - DNA, 13 bp, Homo sapiens
tttgatcaaatct

SEQ ID NO: 2785897 - DNA, 15 bp, Homo sapiens
tttgatccaagctgg

SEQ ID NO: 2785898 - DNA, 12 bp, Homo sapiens
tttgatgtacat

SEQ ID NO: 2785899 - DNA, 17 bp, Homo sapiens
tttgcacctttctagtt

SEQ ID NO: 2785900 - DNA, 21 bp, Homo sapiens
tttgcacctttctagttgaaa

SEQ ID NO: 2785901 - DNA, 14 bp, Homo sapiens
tttgcagacaggca

SEQ ID NO: 2785902 - DNA, 18 bp, Homo sapiens
tttgcagcagaagccaaa

SEQ ID NO: 2785903 - DNA, 21 bp, Homo sapiens
tttgcagcagtgagtctcttc

SEQ ID NO: 2785904 - DNA, 23 bp, Homo sapiens
tttgcatagtaccaatcatttta

SEQ ID NO: 2785905 - DNA, 14 bp, Homo sapiens
tttgcattccatga

SEQ ID NO: 2785906 - DNA, 14 bp, Homo sapiens
tttgcattgtgtga

SEQ ID NO: 2785907 - DNA, 18 bp, Homo sapiens
tttgccatgttggccagg

SEQ ID NO: 2785908 - DNA, 22 bp, Homo sapiens
tttgccatgttggccaggctgg

SEQ ID NO: 2785909 - DNA, 19 bp, Homo sapiens
tttgcctaaatccaaagaa

SEQ ID NO: 2785910 - DNA, 19 bp, Homo sapiens
tttgcctaggaggccttct

SEQ ID NO: 2785911 - DNA, 23 bp, Homo sapiens
tttgcctcaaataaaaagtgctt

SEQ ID NO: 2785912 - DNA, 12 bp, Homo sapiens
tttgcctgtaac

SEQ ID NO: 2785913 - DNA, 13 bp, Homo sapiens
tttgcctgtaaca

SEQ ID NO: 2785914 - DNA, 20 bp, Homo sapiens
tttgctattgacaagtcatt

SEQ ID NO: 2785915 - DNA, 13 bp, Homo sapiens
tttgctctttctt

SEQ ID NO: 2785916 - DNA, 13 bp, Homo sapiens
tttgcttatttat

SEQ ID NO: 2785917 - DNA, 19 bp, Homo sapiens
tttggatgggagtgagaca

SEQ ID NO: 2785918 - DNA, 19 bp, Homo sapiens
tttggatttacgactgaag

SEQ ID NO: 2785919 - DNA, 13 bp, Homo sapiens
tttggcatttctc

SEQ ID NO: 2785920 - DNA, 17 bp, Homo sapiens
tttggcctgcactaatt

SEQ ID NO: 2785921 - DNA, 17 bp, Homo sapiens
tttgggaggctgaggcg

SEQ ID NO: 2785922 - DNA, 21 bp, Homo sapiens
tttggggtacccactgctctg

SEQ ID NO: 2785923 - DNA, 17 bp, Homo sapiens
tttgggttgtgacccag

SEQ ID NO: 2785924 - DNA, 13 bp, Homo sapiens
tttggttctaata

SEQ ID NO: 2785925 - DNA, 17 bp, Homo sapiens
tttggttctctccagga

SEQ ID NO: 2785926 - DNA, 12 bp, Homo sapiens
tttgtaataaac

SEQ ID NO: 2785927 - DNA, 23 bp, Homo sapiens
tttgtaatgtcaccaccttccca

SEQ ID NO: 2785928 - DNA, 15 bp, Homo sapiens
tttgtaccagtgtga

SEQ ID NO: 2785929 - DNA, 14 bp, Homo sapiens
tttgtaccatggtg

SEQ ID NO: 2785930 - DNA, 18 bp, Homo sapiens
tttgtactagttgatgaa

SEQ ID NO: 2785931 - DNA, 14 bp, Homo sapiens
tttgtactgaaaaa

SEQ ID NO: 2785932 - DNA, 13 bp, Homo sapiens
tttgtagagccag

SEQ ID NO: 2785933 - DNA, 23 bp, Homo sapiens
tttgtatatcatgaaacacttct

SEQ ID NO: 2785934 - DNA, 12 bp, Homo sapiens
tttgtatattgt

SEQ ID NO: 2785935 - DNA, 18 bp, Homo sapiens
tttgtatttatattagag

SEQ ID NO: 2785936 - DNA, 14 bp, Homo sapiens
tttgtatttttgaa

SEQ ID NO: 2785937 - DNA, 16 bp, Homo sapiens
tttgtatttttgaata

SEQ ID NO: 2785938 - DNA, 18 bp, Homo sapiens
tttgtatttttgaataaa

SEQ ID NO: 2785939 - DNA, 17 bp, Homo sapiens
tttgtcatatattcatg

SEQ ID NO: 2785940 - DNA, 21 bp, Homo sapiens
tttgtcatatattcatgtaat

SEQ ID NO: 2785941 - DNA, 19 bp, Homo sapiens
tttgtcctttgagaaagaa

SEQ ID NO: 2785942 - DNA, 17 bp, Homo sapiens
tttgtctgtcttcatag

SEQ ID NO: 2785943 - DNA, 18 bp, Homo sapiens
tttgtgagccaaagagaa

SEQ ID NO: 2785944 - DNA, 11 bp, Homo sapiens
tttgtggaaaa

SEQ ID NO: 2785945 - DNA, 14 bp, Homo sapiens
tttgtgtacagtgt

SEQ ID NO: 2785946 - DNA, 13 bp, Homo sapiens
tttgtgtgattga

SEQ ID NO: 2785947 - DNA, 14 bp, Homo sapiens
tttgtgtgattgaa

SEQ ID NO: 2785948 - DNA, 12 bp, Homo sapiens
tttgtgtttcta

SEQ ID NO: 2785949 - DNA, 20 bp, Homo sapiens
tttgttaaaaatattttctg

SEQ ID NO: 2785950 - DNA, 18 bp, Homo sapiens
tttgttaataataagata

SEQ ID NO: 2785951 - DNA, 20 bp, Homo sapiens
tttgttgtgattttgtacag

SEQ ID NO: 2785952 - DNA, 14 bp, Homo sapiens
tttgtttcctttgt

SEQ ID NO: 2785953 - DNA, 19 bp, Homo sapiens
tttgttttctgatgacata

SEQ ID NO: 2785954 - DNA, 14 bp, Homo sapiens
ttttaaaaaagctt

SEQ ID NO: 2785955 - DNA, 15 bp, Homo sapiens
ttttaaaaaggcagt

SEQ ID NO: 2785956 - DNA, 19 bp, Homo sapiens
ttttaaaaagttgcacatt

SEQ ID NO: 2785957 - DNA, 12 bp, Homo sapiens
ttttaaaaccat

SEQ ID NO: 2785958 - DNA, 17 bp, Homo sapiens
ttttaaaaccatgcagc

SEQ ID NO: 2785959 - DNA, 11 bp, Homo sapiens
ttttaaaagaa

SEQ ID NO: 2785960 - DNA, 23 bp, Homo sapiens
ttttaaaaggttgactcaagttt

SEQ ID NO: 2785961 - DNA, 14 bp, Homo sapiens
ttttaaatatgaac

SEQ ID NO: 2785962 - DNA, 18 bp, Homo sapiens
ttttaaatatgaacaaag

SEQ ID NO: 2785963 - DNA, 21 bp, Homo sapiens
ttttaaattataacttaaaat

SEQ ID NO: 2785964 - DNA, 16 bp, Homo sapiens
ttttaacaaaagcaag

SEQ ID NO: 2785965 - DNA, 13 bp, Homo sapiens
ttttaactcaata

SEQ ID NO: 2785966 - DNA, 16 bp, Homo sapiens
ttttaagaggcagggt

SEQ ID NO: 2785967 - DNA, 12 bp, Homo sapiens
ttttaagctgtt

SEQ ID NO: 2785968 - DNA, 17 bp, Homo sapiens
ttttaagtatttatata

SEQ ID NO: 2785969 - DNA, 14 bp, Homo sapiens
aactgttgattgca

SEQ ID NO: 2785970 - DNA, 17 bp, Homo sapiens
aactgttggataataac

SEQ ID NO: 2785971 - DNA, 10 bp, Homo sapiens
aactgtttat

SEQ ID NO: 2785972 - DNA, 15 bp, Homo sapiens
aactgtttttgaaga

SEQ ID NO: 2785973 - DNA, 15 bp, Homo sapiens
aacttaaaagattca

SEQ ID NO: 2785974 - DNA, 19 bp, Homo sapiens
aacttaaataaatgtcatt

SEQ ID NO: 2785975 - DNA, 16 bp, Homo sapiens
aacttaaatcactgag

SEQ ID NO: 2785976 - DNA, 17 bp, Homo sapiens
aacttaacattctgtaa

SEQ ID NO: 2785977 - DNA, 18 bp, Homo sapiens
aacttaatagtatttatg

SEQ ID NO: 2785978 - DNA, 23 bp, Homo sapiens
aacttatatcatcagcatacctt

SEQ ID NO: 2785979 - DNA, 16 bp, Homo sapiens
aacttcagagaagtca

SEQ ID NO: 2785980 - DNA, 12 bp, Homo sapiens
aacttcagcacc

SEQ ID NO: 2785981 - DNA, 20 bp, Homo sapiens
aacttcatatatgaggactt

SEQ ID NO: 2785982 - DNA, 18 bp, Homo sapiens
aacttcctttgagaattg

SEQ ID NO: 2785983 - DNA, 24 bp, Homo sapiens
aacttctttgtaatcgttatgtgt

SEQ ID NO: 2785984 - DNA, 13 bp, Homo sapiens
aacttgaggacac

SEQ ID NO: 2785985 - DNA, 12 bp, Homo sapiens
aacttgatatag

SEQ ID NO: 2785986 - DNA, 23 bp, Homo sapiens
aacttggaaaaatccagaaagaa

SEQ ID NO: 2785987 - DNA, 16 bp, Homo sapiens
aacttggttttgctac

SEQ ID NO: 2785988 - DNA, 18 bp, Homo sapiens
aacttgtaaatgctgtca

SEQ ID NO: 2785989 - DNA, 15 bp, Homo sapiens
aacttgtactatgtt

SEQ ID NO: 2785990 - DNA, 14 bp, Homo sapiens
aacttgtatattcc

SEQ ID NO: 2785991 - DNA, 19 bp, Homo sapiens
aacttgtatattccaccat

SEQ ID NO: 2785992 - DNA, 14 bp, Homo sapiens
aacttgtatctgaa

SEQ ID NO: 2785993 - DNA, 21 bp, Homo sapiens
aacttgtcctatgtcaatttg

SEQ ID NO: 2785994 - DNA, 17 bp, Homo sapiens
aacttttaatgccttcc

SEQ ID NO: 2785995 - DNA, 17 bp, Homo sapiens
aacttttagtaaagtca

SEQ ID NO: 2785996 - DNA, 11 bp, Homo sapiens
aacttttgtaa

SEQ ID NO: 2785997 - DNA, 17 bp, Homo sapiens
aagaaaaaaaagaaagc

SEQ ID NO: 2785998 - DNA, 22 bp, Homo sapiens
aagaaaagtaggtttacattca

SEQ ID NO: 2785999 - DNA, 14 bp, Homo sapiens
aagaaacaggggat

SEQ ID NO: 2786000 - DNA, 21 bp, Homo sapiens
aagaaacaggggatcaaagtt

SEQ ID NO: 2786001 - DNA, 22 bp, Homo sapiens
aagaaacgtacttaactgtgtg

SEQ ID NO: 2786002 - DNA, 21 bp, Homo sapiens
aagaaactgaggaattttctt

SEQ ID NO: 2786003 - DNA, 11 bp, Homo sapiens
aagaaactttc

SEQ ID NO: 2786004 - DNA, 23 bp, Homo sapiens
aagaaactttctttctcactaaa

SEQ ID NO: 2786005 - DNA, 14 bp, Homo sapiens
aagaaagaaggaag

SEQ ID NO: 2786006 - DNA, 19 bp, Homo sapiens
aagaaagttaggttataag

SEQ ID NO: 2786007 - DNA, 21 bp, Homo sapiens
aagaacaccctatattttgca

SEQ ID NO: 2786008 - DNA, 20 bp, Homo sapiens
aagaacttgatatatttcat

SEQ ID NO: 2786009 - DNA, 21 bp, Homo sapiens
aagaagaccagactgtggaga

SEQ ID NO: 2786010 - DNA, 11 bp, Homo sapiens
aagaagagaca

SEQ ID NO: 2786011 - DNA, 17 bp, Homo sapiens
aagaagccgggaacaga

SEQ ID NO: 2786012 - DNA, 17 bp, Homo sapiens
aagaaggaaaaggcagg

SEQ ID NO: 2786013 - DNA, 20 bp, Homo sapiens
aagaaggcacaggtgtaaat

SEQ ID NO: 2786014 - DNA, 17 bp, Homo sapiens
aagaagggaaattcaca

SEQ ID NO: 2786015 - DNA, 15 bp, Homo sapiens
aagaagtttcatcat

SEQ ID NO: 2786016 - DNA, 18 bp, Homo sapiens
aagaagtttcatcatttt

SEQ ID NO: 2786017 - DNA, 16 bp, Homo sapiens
aagaataaatgaatct

SEQ ID NO: 2786018 - DNA, 13 bp, Homo sapiens
aagaatacagaaa

SEQ ID NO: 2786019 - DNA, 12 bp, Homo sapiens
aagaatctcatc

SEQ ID NO: 2786020 - DNA, 22 bp, Homo sapiens
aagaatgctggttttcctaaat

SEQ ID NO: 2786021 - DNA, 13 bp, Homo sapiens
aagaatgcttaat

SEQ ID NO: 2786022 - DNA, 19 bp, Homo sapiens
aagaatgttaagacttgac

SEQ ID NO: 2786023 - DNA, 14 bp, Homo sapiens
aagaattatttttg

SEQ ID NO: 2786024 - DNA, 20 bp, Homo sapiens
aagaattgaacccaggaggt

SEQ ID NO: 2786025 - DNA, 22 bp, Homo sapiens
aagaatttaaattctttttcaa

SEQ ID NO: 2786026 - DNA, 23 bp, Homo sapiens
aagaatttcttggtaagaagccg

SEQ ID NO: 2786027 - DNA, 15 bp, Homo sapiens
aagacagagctggga

SEQ ID NO: 2786028 - DNA, 17 bp, Homo sapiens
aagacagtggatcatga

SEQ ID NO: 2786029 - DNA, 19 bp, Homo sapiens
aagacatggagactcctgc

SEQ ID NO: 2786030 - DNA, 16 bp, Homo sapiens
aagaccgaattttatt

SEQ ID NO: 2786031 - DNA, 21 bp, Homo sapiens
aagaccttctccaaatgagat

SEQ ID NO: 2786032 - DNA, 20 bp, Homo sapiens
aagaccttctccccattctg

SEQ ID NO: 2786033 - DNA, 14 bp, Homo sapiens
aagaccttctgaag

SEQ ID NO: 2786034 - DNA, 19 bp, Homo sapiens
aagaccttctgaagatctc

SEQ ID NO: 2786035 - DNA, 13 bp, Homo sapiens
aagacttcatgtt

SEQ ID NO: 2786036 - DNA, 13 bp, Homo sapiens
aagacttgacagt

SEQ ID NO: 2786037 - DNA, 14 bp, Homo sapiens
aagacttgacagtg

SEQ ID NO: 2786038 - DNA, 22 bp, Homo sapiens
aagagaaaaaaagtttgccaga

SEQ ID NO: 2786039 - DNA, 19 bp, Homo sapiens
aagagaaaaaccaatgatt

SEQ ID NO: 2786040 - DNA, 20 bp, Homo sapiens
aagagaaaaaccaatgattc

SEQ ID NO: 2786041 - DNA, 13 bp, Homo sapiens
aagagaagtagaa

SEQ ID NO: 2786042 - DNA, 21 bp, Homo sapiens
aagagacaaacacctcccagg

SEQ ID NO: 2786043 - DNA, 15 bp, Homo sapiens
aagagagaaacattt

SEQ ID NO: 2786044 - DNA, 14 bp, Homo sapiens
aagagagaaagaag

SEQ ID NO: 2786045 - DNA, 16 bp, Homo sapiens
aagagagatatatctg

SEQ ID NO: 2786046 - DNA, 20 bp, Homo sapiens
aagagcatcatgcctctgag

SEQ ID NO: 2786047 - DNA, 14 bp, Homo sapiens
aagagcctggagaa

SEQ ID NO: 2786048 - DNA, 17 bp, Homo sapiens
aagagcctggagaagct

SEQ ID NO: 2786049 - DNA, 20 bp, Homo sapiens
aagagccttggtgtccacct

SEQ ID NO: 2786050 - DNA, 21 bp, Homo sapiens
aagagccttggtgtccacctg

SEQ ID NO: 2786051 - DNA, 22 bp, Homo sapiens
aagagccttggtgtccacctgg

SEQ ID NO: 2786052 - DNA, 16 bp, Homo sapiens
aagagctacataattt

SEQ ID NO: 2786053 - DNA, 14 bp, Homo sapiens
aagaggcagggtct

SEQ ID NO: 2786054 - DNA, 15 bp, Homo sapiens
aagaggcgacttcct

SEQ ID NO: 2786055 - DNA, 16 bp, Homo sapiens
aagaggcgacttcctc

SEQ ID NO: 2786056 - DNA, 14 bp, Homo sapiens
aagagggcctgtgg

SEQ ID NO: 2786057 - DNA, 22 bp, Homo sapiens
aagagggtctgaggaatccaga

SEQ ID NO: 2786058 - DNA, 19 bp, Homo sapiens
aagaggtgaccccagggca

SEQ ID NO: 2786059 - DNA, 22 bp, Homo sapiens
aagaggtgaccccagggcacag

SEQ ID NO: 2786060 - DNA, 17 bp, Homo sapiens
aataaaaaaatacagta

SEQ ID NO: 2786061 - DNA, 18 bp, Homo sapiens
aataaaaaaatacagtaa

SEQ ID NO: 2786062 - DNA, 17 bp, Homo sapiens
aataaaaaacatttgta

SEQ ID NO: 2786063 - DNA, 18 bp, Homo sapiens
aataaaaaacatttgtac

SEQ ID NO: 2786064 - DNA, 19 bp, Homo sapiens
aataaaaaacatttgtaca

SEQ ID NO: 2786065 - DNA, 13 bp, Homo sapiens
aataaaaaatgga

SEQ ID NO: 2786066 - DNA, 15 bp, Homo sapiens
aataaaaaccagaat

SEQ ID NO: 2786067 - DNA, 19 bp, Homo sapiens
aataaaaactgactcctta

SEQ ID NO: 2786068 - DNA, 21 bp, Homo sapiens
aataaaaactgactccttaga

SEQ ID NO: 2786069 - DNA, 16 bp, Homo sapiens
aataaaaataaatttg

SEQ ID NO: 2786070 - DNA, 17 bp, Homo sapiens
aataaaaatttgtttaa

SEQ ID NO: 2786071 - DNA, 21 bp, Homo sapiens
aataaaaatttgtttaaagtt

SEQ ID NO: 2786072 - DNA, 12 bp, Homo sapiens
aataaaaccttt

SEQ ID NO: 2786073 - DNA, 18 bp, Homo sapiens
aataaaagcagcatctgc

SEQ ID NO: 2786074 - DNA, 12 bp, Homo sapiens
aataaaagtgac

SEQ ID NO: 2786075 - DNA, 11 bp, Homo sapiens
aataaaatcat

SEQ ID NO: 2786076 - DNA, 16 bp, Homo sapiens
aataaaatcttgaaaa

SEQ ID NO: 2786077 - DNA, 18 bp, Homo sapiens
aataaaatgaaagggtca

SEQ ID NO: 2786078 - DNA, 13 bp, Homo sapiens
aataaacatcctt

SEQ ID NO: 2786079 - DNA, 12 bp, Homo sapiens
aataaactctct

SEQ ID NO: 2786080 - DNA, 13 bp, Homo sapiens
aataaagaaaaac

SEQ ID NO: 2786081 - DNA, 12 bp, Homo sapiens
aataaagagctc

SEQ ID NO: 2786082 - DNA, 13 bp, Homo sapiens
aataaagctggac

SEQ ID NO: 2786083 - DNA, 22 bp, Homo sapiens
aataaagctggacaagaagctg

SEQ ID NO: 2786084 - DNA, 15 bp, Homo sapiens
aataaaggttaaaaa

SEQ ID NO: 2786085 - DNA, 16 bp, Homo sapiens
aataaagtctgagtgg

SEQ ID NO: 2786086 - DNA, 16 bp, Homo sapiens
aataaatattctgcat

SEQ ID NO: 2786087 - DNA, 21 bp, Homo sapiens
aataaatcattaatactcttc

SEQ ID NO: 2786088 - DNA, 18 bp, Homo sapiens
aataaatctgagcctaaa

SEQ ID NO: 2786089 - DNA, 21 bp, Homo sapiens
aataaatctgagcctaaatct

SEQ ID NO: 2786090 - DNA, 17 bp, Homo sapiens
aataaatgtcattaaaa

SEQ ID NO: 2786091 - DNA, 15 bp, Homo sapiens
aataaatgtgtaaat

SEQ ID NO: 2786092 - DNA, 18 bp, Homo sapiens
aataaattggtgataagt

SEQ ID NO: 2786093 - DNA, 23 bp, Homo sapiens
aataaattggtgataagtggaaa

SEQ ID NO: 2786094 - DNA, 21 bp, Homo sapiens
aataaatttggttctaataga

SEQ ID NO: 2786095 - DNA, 15 bp, Homo sapiens
aataactagatctcc

SEQ ID NO: 2786096 - DNA, 21 bp, Homo sapiens
aataacttgtcctatgtcaat

SEQ ID NO: 2786097 - DNA, 13 bp, Homo sapiens
aataagaaacttt

SEQ ID NO: 2786098 - DNA, 15 bp, Homo sapiens
aataagaagcaaata

SEQ ID NO: 2786099 - DNA, 14 bp, Homo sapiens
aataagtgctgttt

SEQ ID NO: 2786100 - DNA, 13 bp, Homo sapiens
aataatcggccca

SEQ ID NO: 2786101 - DNA, 14 bp, Homo sapiens
aataatctttgggt

SEQ ID NO: 2786102 - DNA, 11 bp, Homo sapiens
aataatgattt

SEQ ID NO: 2786103 - DNA, 12 bp, Homo sapiens
aataatgattta

SEQ ID NO: 2786104 - DNA, 14 bp, Homo sapiens
aataatgttctgtc

SEQ ID NO: 2786105 - DNA, 21 bp, Homo sapiens
aataattaggatctatgcaat

SEQ ID NO: 2786106 - DNA, 18 bp, Homo sapiens
aataattatccagagttt

SEQ ID NO: 2786107 - DNA, 17 bp, Homo sapiens
aataatttaactaattt

SEQ ID NO: 2786108 - DNA, 18 bp, Homo sapiens
aataatttaactaattta

SEQ ID NO: 2786109 - DNA, 21 bp, Homo sapiens
aataatttaactaatttaaac

SEQ ID NO: 2786110 - DNA, 15 bp, Homo sapiens
aataattttcctcct

SEQ ID NO: 2786111 - DNA, 12 bp, Homo sapiens
aatacaaaataa

SEQ ID NO: 2786112 - DNA, 17 bp, Homo sapiens
aatacacaagtaaacat

SEQ ID NO: 2786113 - DNA, 22 bp, Homo sapiens
aatacaccacctcactcctgtt

SEQ ID NO: 2786114 - DNA, 16 bp, Homo sapiens
aatacagggcattttg

SEQ ID NO: 2786115 - DNA, 21 bp, Homo sapiens
aatacagtaaagtttaaaaaa

SEQ ID NO: 2786116 - DNA, 20 bp, Homo sapiens
aatacatgtgtggatgtgta

SEQ ID NO: 2786117 - DNA, 20 bp, Homo sapiens
aataccagtgaaccaaagag

SEQ ID NO: 2786118 - DNA, 17 bp, Homo sapiens
aatactccaagcttcaa

SEQ ID NO: 2786119 - DNA, 22 bp, Homo sapiens
aatactccaagcttcaagtgat

SEQ ID NO: 2786120 - DNA, 22 bp, Homo sapiens
aatactgcctagaaaatgcaaa

SEQ ID NO: 2786121 - DNA, 18 bp, Homo sapiens
aatacttaacattgattt

SEQ ID NO: 2786122 - DNA, 15 bp, Homo sapiens
aatagaagaacatcc

SEQ ID NO: 2786123 - DNA, 20 bp, Homo sapiens
aatagaatataattatcgga

SEQ ID NO: 2786124 - DNA, 20 bp, Homo sapiens
aatagacagtatatttatag

SEQ ID NO: 2786125 - DNA, 23 bp, Homo sapiens
aatagactgtacttattttccaa

SEQ ID NO: 2786126 - DNA, 19 bp, Homo sapiens
aatagatcacggcatgttt

SEQ ID NO: 2786127 - DNA, 19 bp, Homo sapiens
aatagatgtttgatagatt

SEQ ID NO: 2786128 - DNA, 16 bp, Homo sapiens
aatagcaaaagaagaa

SEQ ID NO: 2786129 - DNA, 14 bp, Homo sapiens
aatagcaaagaatt

SEQ ID NO: 2786130 - DNA, 15 bp, Homo sapiens
aatagcaaagaattg

SEQ ID NO: 2786131 - DNA, 20 bp, Homo sapiens
aatagctattgcatgtaaaa

SEQ ID NO: 2786132 - DNA, 22 bp, Homo sapiens
aatagctattgcatgtaaaatg

SEQ ID NO: 2786133 - DNA, 22 bp, Homo sapiens
aatagtaaaagataacaagatc

SEQ ID NO: 2786134 - DNA, 16 bp, Homo sapiens
aatagtatttcccatt

SEQ ID NO: 2786135 - DNA, 16 bp, Homo sapiens
aatagtgttcttttta

SEQ ID NO: 2786136 - DNA, 13 bp, Homo sapiens
aatagttggctag

SEQ ID NO: 2786137 - DNA, 22 bp, Homo sapiens
aatagttttaaatatgaacaaa

SEQ ID NO: 2786138 - DNA, 12 bp, Homo sapiens
aatataaacttg

SEQ ID NO: 2786139 - DNA, 14 bp, Homo sapiens
aatataaatgcatg

SEQ ID NO: 2786140 - DNA, 15 bp, Homo sapiens
aatataaatgcatga

SEQ ID NO: 2786141 - DNA, 15 bp, Homo sapiens
aatataattgtttta

SEQ ID NO: 2786142 - DNA, 14 bp, Homo sapiens
aatatacaaacatg

SEQ ID NO: 2786143 - DNA, 15 bp, Homo sapiens
aatatacaaacatgt

SEQ ID NO: 2786144 - DNA, 16 bp, Homo sapiens
aatatagctatcattt

SEQ ID NO: 2786145 - DNA, 13 bp, Homo sapiens
aatatagctattt

SEQ ID NO: 2786146 - DNA, 15 bp, Homo sapiens
aatatagctattttt

SEQ ID NO: 2786147 - DNA, 14 bp, Homo sapiens
aatatatatttttc

SEQ ID NO: 2786148 - DNA, 15 bp, Homo sapiens
aatatatatttttca

SEQ ID NO: 2786149 - DNA, 19 bp, Homo sapiens
aatatatatttttcaacca

SEQ ID NO: 2786150 - DNA, 13 bp, Homo sapiens
aatatattataat

SEQ ID NO: 2786151 - DNA, 14 bp, Homo sapiens
aatttagaaaacat

SEQ ID NO: 2786152 - DNA, 12 bp, Homo sapiens
aatttagtttca

SEQ ID NO: 2786153 - DNA, 14 bp, Homo sapiens
aatttagtttcata

SEQ ID NO: 2786154 - DNA, 21 bp, Homo sapiens
aatttagtttcatataaagta

SEQ ID NO: 2786155 - DNA, 14 bp, Homo sapiens
aatttatacaaaat

SEQ ID NO: 2786156 - DNA, 19 bp, Homo sapiens
aatttatacaaaataattt

SEQ ID NO: 2786157 - DNA, 22 bp, Homo sapiens
aatttatacaaaataatttaac

SEQ ID NO: 2786158 - DNA, 19 bp, Homo sapiens
aatttatgagtttttgata

SEQ ID NO: 2786159 - DNA, 20 bp, Homo sapiens
aatttatgagtttttgatag

SEQ ID NO: 2786160 - DNA, 13 bp, Homo sapiens
aatttattttgta

SEQ ID NO: 2786161 - DNA, 22 bp, Homo sapiens
aatttctaaaaaacagaggcca

SEQ ID NO: 2786162 - DNA, 16 bp, Homo sapiens
aatttctaccatttca

SEQ ID NO: 2786163 - DNA, 18 bp, Homo sapiens
aatttctaccatttcaga

SEQ ID NO: 2786164 - DNA, 13 bp, Homo sapiens
aatttgaggacaa

SEQ ID NO: 2786165 - DNA, 21 bp, Homo sapiens
aatttgcactgttacttttta

SEQ ID NO: 2786166 - DNA, 22 bp, Homo sapiens
aatttgcctgtaacaagccaga

SEQ ID NO: 2786167 - DNA, 20 bp, Homo sapiens
aatttggatttacgactgaa

SEQ ID NO: 2786168 - DNA, 18 bp, Homo sapiens
aatttggcctgcactaat

SEQ ID NO: 2786169 - DNA, 21 bp, Homo sapiens
aatttgggggacttacatgat

SEQ ID NO: 2786170 - DNA, 21 bp, Homo sapiens
aatttggtgtggctgtattca

SEQ ID NO: 2786171 - DNA, 13 bp, Homo sapiens
aatttgtgtagat

SEQ ID NO: 2786172 - DNA, 20 bp, Homo sapiens
aattttaaaagttgggaaaa

SEQ ID NO: 2786173 - DNA, 22 bp, Homo sapiens
aattttaagtgctttgtaatgg

SEQ ID NO: 2786174 - DNA, 21 bp, Homo sapiens
aattttacttttgttctgtat

SEQ ID NO: 2786175 - DNA, 12 bp, Homo sapiens
aattttattcct

SEQ ID NO: 2786176 - DNA, 14 bp, Homo sapiens
aattttcttcatgc

SEQ ID NO: 2786177 - DNA, 19 bp, Homo sapiens
aattttcttcatgcaatga

SEQ ID NO: 2786178 - DNA, 13 bp, Homo sapiens
aattttgtttgta

SEQ ID NO: 2786179 - DNA, 15 bp, Homo sapiens
aatttttaaacaagt

SEQ ID NO: 2786180 - DNA, 17 bp, Homo sapiens
aatttttaaactagtaa

SEQ ID NO: 2786181 - DNA, 13 bp, Homo sapiens
aatttttaaagta

SEQ ID NO: 2786182 - DNA, 20 bp, Homo sapiens
aatttttaaagtatatattt

SEQ ID NO: 2786183 - DNA, 11 bp, Homo sapiens
aatttttaatg

SEQ ID NO: 2786184 - DNA, 12 bp, Homo sapiens
aatttttataca

SEQ ID NO: 2786185 - DNA, 19 bp, Homo sapiens
aatttttatacatatcaga

SEQ ID NO: 2786186 - DNA, 13 bp, Homo sapiens
aatttttgcaatt

SEQ ID NO: 2786187 - DNA, 14 bp, Homo sapiens
aattttttgtatat

SEQ ID NO: 2786188 - DNA, 15 bp, Homo sapiens
aatttttttattact

SEQ ID NO: 2786189 - DNA, 15 bp, Homo sapiens
aatttttttcaatat

SEQ ID NO: 2786190 - DNA, 19 bp, Homo sapiens
aatttttttcaatatttat

SEQ ID NO: 2786191 - DNA, 19 bp, Homo sapiens
aatttttttttcctagccc

SEQ ID NO: 2786192 - DNA, 24 bp, Homo sapiens
acaaaaaacttttaatgccttcca

SEQ ID NO: 2786193 - DNA, 15 bp, Homo sapiens
acaaaacaagaaaga

SEQ ID NO: 2786194 - DNA, 15 bp, Homo sapiens
acaaaaccagctgct

SEQ ID NO: 2786195 - DNA, 13 bp, Homo sapiens
acaaaacttcctg

SEQ ID NO: 2786196 - DNA, 16 bp, Homo sapiens
acaaaataacatttga

SEQ ID NO: 2786197 - DNA, 12 bp, Homo sapiens
acaaaataattt

SEQ ID NO: 2786198 - DNA, 17 bp, Homo sapiens
acaaaataatttaacta

SEQ ID NO: 2786199 - DNA, 19 bp, Homo sapiens
acaaaataatttaactaat

SEQ ID NO: 2786200 - DNA, 21 bp, Homo sapiens
acaaaataatttaactaattt

SEQ ID NO: 2786201 - DNA, 22 bp, Homo sapiens
acaaaataatttaactaattta

SEQ ID NO: 2786202 - DNA, 15 bp, Homo sapiens
acaaaatatttaatt

SEQ ID NO: 2786203 - DNA, 23 bp, Homo sapiens
acaaaatcacaagcaataattag

SEQ ID NO: 2786204 - DNA, 19 bp, Homo sapiens
acaaaatcgattggcttta

SEQ ID NO: 2786205 - DNA, 22 bp, Homo sapiens
acaaacatatttgttaaatatt

SEQ ID NO: 2786206 - DNA, 18 bp, Homo sapiens
acaaacctctatatgttg

SEQ ID NO: 2786207 - DNA, 18 bp, Homo sapiens
acaaagaaaaaaatatat

SEQ ID NO: 2786208 - DNA, 12 bp, Homo sapiens
acaaagaaatat

SEQ ID NO: 2786209 - DNA, 23 bp, Homo sapiens
acaaagagaataaagacttcatg

SEQ ID NO: 2786210 - DNA, 16 bp, Homo sapiens
acaaagagttcaagaa

SEQ ID NO: 2786211 - DNA, 21 bp, Homo sapiens
acaaagagttcaagaaataag

SEQ ID NO: 2786212 - DNA, 22 bp, Homo sapiens
acaaagatgtttgtcagatatg

SEQ ID NO: 2786213 - DNA, 19 bp, Homo sapiens
acaaagccaaactctgcca

SEQ ID NO: 2786214 - DNA, 17 bp, Homo sapiens
acaaagccaacagtcaa

SEQ ID NO: 2786215 - DNA, 22 bp, Homo sapiens
acaaagctcaagatgacagctc

SEQ ID NO: 2786216 - DNA, 15 bp, Homo sapiens
acaaaggagcctgtg

SEQ ID NO: 2786217 - DNA, 16 bp, Homo sapiens
acaaaggagcctgtga

SEQ ID NO: 2786218 - DNA, 18 bp, Homo sapiens
acaaagggattctccagg

SEQ ID NO: 2786219 - DNA, 19 bp, Homo sapiens
acaaaggtataattttatg

SEQ ID NO: 2786220 - DNA, 13 bp, Homo sapiens
acaaagtagagaa

SEQ ID NO: 2786221 - DNA, 13 bp, Homo sapiens
acaaagtttgttc

SEQ ID NO: 2786222 - DNA, 14 bp, Homo sapiens
acaaataaagatgg

SEQ ID NO: 2786223 - DNA, 17 bp, Homo sapiens
acaaataaagatggcta

SEQ ID NO: 2786224 - DNA, 16 bp, Homo sapiens
acaaataataagcaaa

SEQ ID NO: 2786225 - DNA, 12 bp, Homo sapiens
acaaataatcac

SEQ ID NO: 2786226 - DNA, 13 bp, Homo sapiens
acaaataatcaca

SEQ ID NO: 2786227 - DNA, 17 bp, Homo sapiens
acaaatatatttaattg

SEQ ID NO: 2786228 - DNA, 12 bp, Homo sapiens
acaaatatttat

SEQ ID NO: 2786229 - DNA, 23 bp, Homo sapiens
acaaatatttattttctttctgt

SEQ ID NO: 2786230 - DNA, 17 bp, Homo sapiens
acaaatttaattttgca

SEQ ID NO: 2786231 - DNA, 19 bp, Homo sapiens
acaacaggttttcaccata

SEQ ID NO: 2786232 - DNA, 22 bp, Homo sapiens
acaacatgtataatatttttaa

SEQ ID NO: 2786233 - DNA, 14 bp, Homo sapiens
acaacatttctata

SEQ ID NO: 2786234 - DNA, 12 bp, Homo sapiens
acaacattttat

SEQ ID NO: 2786235 - DNA, 13 bp, Homo sapiens
acaacattttatt

SEQ ID NO: 2786236 - DNA, 21 bp, Homo sapiens
acaaccacctaatcaggctga

SEQ ID NO: 2786237 - DNA, 13 bp, Homo sapiens
acaaccagccaca

SEQ ID NO: 2786238 - DNA, 15 bp, Homo sapiens
acaaccagccacaca

SEQ ID NO: 2786239 - DNA, 18 bp, Homo sapiens
acaaccagccacacagag

SEQ ID NO: 2786240 - DNA, 15 bp, Homo sapiens
acaacctttgtgtaa

SEQ ID NO: 2786241 - DNA, 16 bp, Homo sapiens
acaacctttgtgtaat

SEQ ID NO: 2786242 - DNA, 18 bp, Homo sapiens
acattatcgggagcagtg

SEQ ID NO: 2786243 - DNA, 19 bp, Homo sapiens
acattatcgggagcagtgt

SEQ ID NO: 2786244 - DNA, 21 bp, Homo sapiens
acattatcgggagcagtgtct

SEQ ID NO: 2786245 - DNA, 22 bp, Homo sapiens
acattatcgggagcagtgtctt

SEQ ID NO: 2786246 - DNA, 13 bp, Homo sapiens
acattatttgcat

SEQ ID NO: 2786247 - DNA, 13 bp, Homo sapiens
acattcaaggcat

SEQ ID NO: 2786248 - DNA, 12 bp, Homo sapiens
acattcaatgtt

SEQ ID NO: 2786249 - DNA, 15 bp, Homo sapiens
acattccctatcaaa

SEQ ID NO: 2786250 - DNA, 14 bp, Homo sapiens
acattccctggcct

SEQ ID NO: 2786251 - DNA, 15 bp, Homo sapiens
acattcctctgcagc

SEQ ID NO: 2786252 - DNA, 14 bp, Homo sapiens
acattctgtaaaat

SEQ ID NO: 2786253 - DNA, 16 bp, Homo sapiens
acattgatttattttt

SEQ ID NO: 2786254 - DNA, 22 bp, Homo sapiens
acattggtatatttccattcat

SEQ ID NO: 2786255 - DNA, 17 bp, Homo sapiens
acatttacaataaatat

SEQ ID NO: 2786256 - DNA, 15 bp, Homo sapiens
acatttataatgttt

SEQ ID NO: 2786257 - DNA, 15 bp, Homo sapiens
acatttattctgctc

SEQ ID NO: 2786258 - DNA, 12 bp, Homo sapiens
acatttctagaa

SEQ ID NO: 2786259 - DNA, 20 bp, Homo sapiens
acatttctatagccaaaaat

SEQ ID NO: 2786260 - DNA, 12 bp, Homo sapiens
acatttgatgta

SEQ ID NO: 2786261 - DNA, 18 bp, Homo sapiens
acatttgatgtacatgtg

SEQ ID NO: 2786262 - DNA, 18 bp, Homo sapiens
acattttatatctggatt

SEQ ID NO: 2786263 - DNA, 16 bp, Homo sapiens
acattttatttattag

SEQ ID NO: 2786264 - DNA, 23 bp, Homo sapiens
accaaaagttacatgtttgcacc

SEQ ID NO: 2786265 - DNA, 18 bp, Homo sapiens
accaaagagactggagca

SEQ ID NO: 2786266 - DNA, 22 bp, Homo sapiens
accaaagatatatacacaggat

SEQ ID NO: 2786267 - DNA, 23 bp, Homo sapiens
accaaagatatatacacaggatc

SEQ ID NO: 2786268 - DNA, 20 bp, Homo sapiens
accaaagcaccttagctggc

SEQ ID NO: 2786269 - DNA, 23 bp, Homo sapiens
accaacataaaaatgatctaaac

SEQ ID NO: 2786270 - DNA, 21 bp, Homo sapiens
accaacatcccattgccctgg

SEQ ID NO: 2786271 - DNA, 15 bp, Homo sapiens
accaacatggagaaa

SEQ ID NO: 2786272 - DNA, 14 bp, Homo sapiens
accaaccctgtttc

SEQ ID NO: 2786273 - DNA, 17 bp, Homo sapiens
accaaccctgtttcctg

SEQ ID NO: 2786274 - DNA, 22 bp, Homo sapiens
accaacctccccgcagagctcc

SEQ ID NO: 2786275 - DNA, 20 bp, Homo sapiens
accaagaattacaagtagaa

SEQ ID NO: 2786276 - DNA, 21 bp, Homo sapiens
accaagaattacaagtagaat

SEQ ID NO: 2786277 - DNA, 21 bp, Homo sapiens
accaagatacttaagtgctgc

SEQ ID NO: 2786278 - DNA, 19 bp, Homo sapiens
accaagctcacagttcctc

SEQ ID NO: 2786279 - DNA, 13 bp, Homo sapiens
accaatcatttta

SEQ ID NO: 2786280 - DNA, 22 bp, Homo sapiens
accaatgattcataacaatgta

SEQ ID NO: 2786281 - DNA, 14 bp, Homo sapiens
accacaaaaatgaa

SEQ ID NO: 2786282 - DNA, 17 bp, Homo sapiens
accacaccaaacctctc

SEQ ID NO: 2786283 - DNA, 21 bp, Homo sapiens
accacacccagcccacttctg

SEQ ID NO: 2786284 - DNA, 15 bp, Homo sapiens
accacacctccctga

SEQ ID NO: 2786285 - DNA, 22 bp, Homo sapiens
accacacctccctgaaccatcc

SEQ ID NO: 2786286 - DNA, 17 bp, Homo sapiens
accacaggcatctacac

SEQ ID NO: 2786287 - DNA, 21 bp, Homo sapiens
accacaggcatctacacagcc

SEQ ID NO: 2786288 - DNA, 22 bp, Homo sapiens
accacaggcatctacacagcct

SEQ ID NO: 2786289 - DNA, 23 bp, Homo sapiens
accacaggcatctacacagcctg

SEQ ID NO: 2786290 - DNA, 13 bp, Homo sapiens
accacaggctgcc

SEQ ID NO: 2786291 - DNA, 12 bp, Homo sapiens
accacagtgtct

SEQ ID NO: 2786292 - DNA, 19 bp, Homo sapiens
accacatcttgctctgctg

SEQ ID NO: 2786293 - DNA, 16 bp, Homo sapiens
accaccagatgagaag

SEQ ID NO: 2786294 - DNA, 18 bp, Homo sapiens
accaccagatgagaagtt

SEQ ID NO: 2786295 - DNA, 15 bp, Homo sapiens
accaccagccccagc

SEQ ID NO: 2786296 - DNA, 15 bp, Homo sapiens
accacctcactcctg

SEQ ID NO: 2786297 - DNA, 16 bp, Homo sapiens
accacctcactcctgt

SEQ ID NO: 2786298 - DNA, 23 bp, Homo sapiens
accacctctcaatattcaataaa

SEQ ID NO: 2786299 - DNA, 13 bp, Homo sapiens
accacctgcttct

SEQ ID NO: 2786300 - DNA, 15 bp, Homo sapiens
accacctgcttctga

SEQ ID NO: 2786301 - DNA, 17 bp, Homo sapiens
accaccttggactcctc

SEQ ID NO: 2786302 - DNA, 20 bp, Homo sapiens
accaccttggactcctccca

SEQ ID NO: 2786303 - DNA, 14 bp, Homo sapiens
accacggaaaagag

SEQ ID NO: 2786304 - DNA, 21 bp, Homo sapiens
accacggacgtttccatcagg

SEQ ID NO: 2786305 - DNA, 20 bp, Homo sapiens
accactagaactctccatct

SEQ ID NO: 2786306 - DNA, 17 bp, Homo sapiens
accactaggactctgag

SEQ ID NO: 2786307 - DNA, 20 bp, Homo sapiens
accactctggcagccacact

SEQ ID NO: 2786308 - DNA, 14 bp, Homo sapiens
accagaagccaaag

SEQ ID NO: 2786309 - DNA, 14 bp, Homo sapiens
accagaatcataat

SEQ ID NO: 2786310 - DNA, 15 bp, Homo sapiens
accagaatcataatt

SEQ ID NO: 2786311 - DNA, 15 bp, Homo sapiens
accagagcagagagc

SEQ ID NO: 2786312 - DNA, 17 bp, Homo sapiens
accagagcccaccttgg

SEQ ID NO: 2786313 - DNA, 19 bp, Homo sapiens
accagagcccaccttggct

SEQ ID NO: 2786314 - DNA, 15 bp, Homo sapiens
accagagccccccac

SEQ ID NO: 2786315 - DNA, 20 bp, Homo sapiens
accagataagaatgctggtt

SEQ ID NO: 2786316 - DNA, 21 bp, Homo sapiens
accagatgagaagttaagcag

SEQ ID NO: 2786317 - DNA, 16 bp, Homo sapiens
accagcacatttctcc

SEQ ID NO: 2786318 - DNA, 20 bp, Homo sapiens
accagcatgtcactcccaga

SEQ ID NO: 2786319 - DNA, 13 bp, Homo sapiens
accagcattttac

SEQ ID NO: 2786320 - DNA, 14 bp, Homo sapiens
accagcattttact

SEQ ID NO: 2786321 - DNA, 15 bp, Homo sapiens
accagcattttacta

SEQ ID NO: 2786322 - DNA, 17 bp, Homo sapiens
accagcattttactact

SEQ ID NO: 2786323 - DNA, 18 bp, Homo sapiens
accagccacacagagcct

SEQ ID NO: 2786324 - DNA, 21 bp, Homo sapiens
accagccacacagagcctgcc

SEQ ID NO: 2786325 - DNA, 18 bp, Homo sapiens
accagccccagcaagagc

SEQ ID NO: 2786326 - DNA, 20 bp, Homo sapiens
accagccccagtgcccacag

SEQ ID NO: 2786327 - DNA, 15 bp, Homo sapiens
accagcccttccctg

SEQ ID NO: 2786328 - DNA, 14 bp, Homo sapiens
accagcctccatgc

SEQ ID NO: 2786329 - DNA, 11 bp, Homo sapiens
accagcctggc

SEQ ID NO: 2786330 - DNA, 14 bp, Homo sapiens
accagcctgttgga

SEQ ID NO: 2786331 - DNA, 14 bp, Homo sapiens
accagctcactccc

SEQ ID NO: 2786332 - DNA, 15 bp, Homo sapiens
accagctcactccct

SEQ ID NO: 2786333 - DNA, 21 bp, Homo sapiens
acctgtttatataattttgca

SEQ ID NO: 2786334 - DNA, 13 bp, Homo sapiens
accttaaaaagta

SEQ ID NO: 2786335 - DNA, 20 bp, Homo sapiens
accttacttaaagcttgttt

SEQ ID NO: 2786336 - DNA, 18 bp, Homo sapiens
accttagattagctctgg

SEQ ID NO: 2786337 - DNA, 19 bp, Homo sapiens
accttagattagctctgga

SEQ ID NO: 2786338 - DNA, 17 bp, Homo sapiens
accttagcagctcttcc

SEQ ID NO: 2786339 - DNA, 14 bp, Homo sapiens
accttattgtacct

SEQ ID NO: 2786340 - DNA, 17 bp, Homo sapiens
accttattgtacctctc

SEQ ID NO: 2786341 - DNA, 18 bp, Homo sapiens
accttattgtacctctct

SEQ ID NO: 2786342 - DNA, 22 bp, Homo sapiens
accttattgtacctctcttata

SEQ ID NO: 2786343 - DNA, 14 bp, Homo sapiens
accttcaataaagt

SEQ ID NO: 2786344 - DNA, 12 bp, Homo sapiens
accttcccagct

SEQ ID NO: 2786345 - DNA, 15 bp, Homo sapiens
accttccccagactc

SEQ ID NO: 2786346 - DNA, 20 bp, Homo sapiens
accttccccagactcagctc

SEQ ID NO: 2786347 - DNA, 17 bp, Homo sapiens
accttctccccattctg

SEQ ID NO: 2786348 - DNA, 20 bp, Homo sapiens
accttctctacccatctccc

SEQ ID NO: 2786349 - DNA, 19 bp, Homo sapiens
accttcttcagccacctct

SEQ ID NO: 2786350 - DNA, 21 bp, Homo sapiens
accttcttcgctgctagagaa

SEQ ID NO: 2786351 - DNA, 21 bp, Homo sapiens
accttgaacactgggggaggg

SEQ ID NO: 2786352 - DNA, 15 bp, Homo sapiens
accttgacagggcac

SEQ ID NO: 2786353 - DNA, 16 bp, Homo sapiens
accttgacagggcaca

SEQ ID NO: 2786354 - DNA, 15 bp, Homo sapiens
accttggactcctcc

SEQ ID NO: 2786355 - DNA, 12 bp, Homo sapiens
accttggctcaa

SEQ ID NO: 2786356 - DNA, 14 bp, Homo sapiens
accttggctgcagg

SEQ ID NO: 2786357 - DNA, 16 bp, Homo sapiens
accttgtcatgtacca

SEQ ID NO: 2786358 - DNA, 22 bp, Homo sapiens
accttgttgcatgatgtatttt

SEQ ID NO: 2786359 - DNA, 16 bp, Homo sapiens
acctttattgtgatct

SEQ ID NO: 2786360 - DNA, 17 bp, Homo sapiens
acctttcaaatttcaca

SEQ ID NO: 2786361 - DNA, 17 bp, Homo sapiens
acctttccctcaccccc

SEQ ID NO: 2786362 - DNA, 18 bp, Homo sapiens
acctttccctcaccccct

SEQ ID NO: 2786363 - DNA, 19 bp, Homo sapiens
acctttccctcaccccctc

SEQ ID NO: 2786364 - DNA, 15 bp, Homo sapiens
acctttctagttgaa

SEQ ID NO: 2786365 - DNA, 15 bp, Homo sapiens
accttttatccactt

SEQ ID NO: 2786366 - DNA, 13 bp, Homo sapiens
acgaaatgttatt

SEQ ID NO: 2786367 - DNA, 15 bp, Homo sapiens
acgaacccacctgct

SEQ ID NO: 2786368 - DNA, 22 bp, Homo sapiens
acgacaaagccaaactctgcca

SEQ ID NO: 2786369 - DNA, 17 bp, Homo sapiens
acgagtcaatcccctca

SEQ ID NO: 2786370 - DNA, 14 bp, Homo sapiens
acgatgtggccctg

SEQ ID NO: 2786371 - DNA, 18 bp, Homo sapiens
acgatgtggccctggcct

SEQ ID NO: 2786372 - DNA, 19 bp, Homo sapiens
acgatgtggccctggcctg

SEQ ID NO: 2786373 - DNA, 18 bp, Homo sapiens
acgatttagaaagaagcc

SEQ ID NO: 2786374 - DNA, 22 bp, Homo sapiens
acgcacacgtacttaaatgaaa

SEQ ID NO: 2786375 - DNA, 22 bp, Homo sapiens
acgcaccaccatgccaggctaa

SEQ ID NO: 2786376 - DNA, 12 bp, Homo sapiens
acgccactcatt

SEQ ID NO: 2786377 - DNA, 17 bp, Homo sapiens
acgccactcatttcatc

SEQ ID NO: 2786378 - DNA, 19 bp, Homo sapiens
acgcccagcctcctcccac

SEQ ID NO: 2786379 - DNA, 13 bp, Homo sapiens
acgccgtggagca

SEQ ID NO: 2786380 - DNA, 15 bp, Homo sapiens
acgcctgagcccagg

SEQ ID NO: 2786381 - DNA, 18 bp, Homo sapiens
acgcctgagcccagggag

SEQ ID NO: 2786382 - DNA, 16 bp, Homo sapiens
acgcctgcccagcctc

SEQ ID NO: 2786383 - DNA, 16 bp, Homo sapiens
acgcctgtaatcccag

SEQ ID NO: 2786384 - DNA, 17 bp, Homo sapiens
acgcctgtaatcccagc

SEQ ID NO: 2786385 - DNA, 18 bp, Homo sapiens
acgcctgtaatcccagca

SEQ ID NO: 2786386 - DNA, 16 bp, Homo sapiens
acgcctgtagtcctag

SEQ ID NO: 2786387 - DNA, 23 bp, Homo sapiens
acgcgtgcacacaccagagccca

SEQ ID NO: 2786388 - DNA, 22 bp, Homo sapiens
acgctctcctttctttctaact

SEQ ID NO: 2786389 - DNA, 13 bp, Homo sapiens
acgctggaccttg

SEQ ID NO: 2786390 - DNA, 15 bp, Homo sapiens
acgctggagtgcagt

SEQ ID NO: 2786391 - DNA, 17 bp, Homo sapiens
acgctggagtgcagtga

SEQ ID NO: 2786392 - DNA, 18 bp, Homo sapiens
acgctggagtgcagtgag

SEQ ID NO: 2786393 - DNA, 15 bp, Homo sapiens
acggaatagttggct

SEQ ID NO: 2786394 - DNA, 16 bp, Homo sapiens
acggacgtttccatca

SEQ ID NO: 2786395 - DNA, 22 bp, Homo sapiens
acggagagtgcttgggtggtgg

SEQ ID NO: 2786396 - DNA, 21 bp, Homo sapiens
acggcagcttgagcctgtcac

SEQ ID NO: 2786397 - DNA, 13 bp, Homo sapiens
acggccaggccag

SEQ ID NO: 2786398 - DNA, 21 bp, Homo sapiens
acggccttcaactgaaaagac

SEQ ID NO: 2786399 - DNA, 14 bp, Homo sapiens
acggctcactgcag

SEQ ID NO: 2786400 - DNA, 23 bp, Homo sapiens
acggcttagacttcgactcagga

SEQ ID NO: 2786401 - DNA, 18 bp, Homo sapiens
acggttaacttgtatatt

SEQ ID NO: 2786402 - DNA, 18 bp, Homo sapiens
acgtataaatatgaaatg

SEQ ID NO: 2786403 - DNA, 20 bp, Homo sapiens
acgtatgtttttgtgtattt

SEQ ID NO: 2786404 - DNA, 17 bp, Homo sapiens
acgtatttatatttgga

SEQ ID NO: 2786405 - DNA, 21 bp, Homo sapiens
acgtatttatatttggaaaga

SEQ ID NO: 2786406 - DNA, 22 bp, Homo sapiens
acgtatttatatttggaaagag

SEQ ID NO: 2786407 - DNA, 12 bp, Homo sapiens
acgtcatctcag

SEQ ID NO: 2786408 - DNA, 13 bp, Homo sapiens
acgtccccctggg

SEQ ID NO: 2786409 - DNA, 13 bp, Homo sapiens
acgtctgacaggc

SEQ ID NO: 2786410 - DNA, 15 bp, Homo sapiens
acgtctgacaggcaa

SEQ ID NO: 2786411 - DNA, 23 bp, Homo sapiens
acgtctgacaggcaatgctggct

SEQ ID NO: 2786412 - DNA, 15 bp, Homo sapiens
acgtgagccaggtaa

SEQ ID NO: 2786413 - DNA, 21 bp, Homo sapiens
acgtgcacctgtactcaggag

SEQ ID NO: 2786414 - DNA, 19 bp, Homo sapiens
acgtgccaggcccggggct

SEQ ID NO: 2786415 - DNA, 21 bp, Homo sapiens
acgtgccaggcccggggctgg

SEQ ID NO: 2786416 - DNA, 15 bp, Homo sapiens
acgtgtgcagactgt

SEQ ID NO: 2786417 - DNA, 16 bp, Homo sapiens
acgttaaaagacagtg

SEQ ID NO: 2786418 - DNA, 21 bp, Homo sapiens
acgttaagggaaggaactctg

SEQ ID NO: 2786419 - DNA, 18 bp, Homo sapiens
acgttccttactgcagaa

SEQ ID NO: 2786420 - DNA, 20 bp, Homo sapiens
acgttccttactgcagaata

SEQ ID NO: 2786421 - DNA, 23 bp, Homo sapiens
acgttcgaggcggtttccaggaa

SEQ ID NO: 2786422 - DNA, 14 bp, Homo sapiens
acgttcggggcatg

SEQ ID NO: 2786423 - DNA, 14 bp, Homo sapiens
actaaaagaatttg

SEQ ID NO: 2786424 - DNA, 17 bp, Homo sapiens
actttgaagttagcttt

SEQ ID NO: 2786425 - DNA, 21 bp, Homo sapiens
actttgccccagttacaaaaa

SEQ ID NO: 2786426 - DNA, 19 bp, Homo sapiens
actttgggaggccaaggtg

SEQ ID NO: 2786427 - DNA, 18 bp, Homo sapiens
actttgtgttcaccttgt

SEQ ID NO: 2786428 - DNA, 18 bp, Homo sapiens
acttttcctttgaatcct

SEQ ID NO: 2786429 - DNA, 22 bp, Homo sapiens
acttttctaaagctctgaacaa

SEQ ID NO: 2786430 - DNA, 12 bp, Homo sapiens
acttttggtttt

SEQ ID NO: 2786431 - DNA, 17 bp, Homo sapiens
actttttagtcttttac

SEQ ID NO: 2786432 - DNA, 12 bp, Homo sapiens
actttttataat

SEQ ID NO: 2786433 - DNA, 21 bp, Homo sapiens
actttttatactccatacata

SEQ ID NO: 2786434 - DNA, 15 bp, Homo sapiens
acttttttatttaaa

SEQ ID NO: 2786435 - DNA, 16 bp, Homo sapiens
agaaaaaaaaaaagaa

SEQ ID NO: 2786436 - DNA, 21 bp, Homo sapiens
agaaaaaaagtttgccagaag

SEQ ID NO: 2786437 - DNA, 16 bp, Homo sapiens
agaaaaaatacatttt

SEQ ID NO: 2786438 - DNA, 22 bp, Homo sapiens
agaaaaaatacattttatatta

SEQ ID NO: 2786439 - DNA, 21 bp, Homo sapiens
agaaaaaattaagagatacat

SEQ ID NO: 2786440 - DNA, 20 bp, Homo sapiens
agaaaaaccaatgattcata

SEQ ID NO: 2786441 - DNA, 16 bp, Homo sapiens
agaaaacctttcttca

SEQ ID NO: 2786442 - DNA, 16 bp, Homo sapiens
agaaaacgcacctcca

SEQ ID NO: 2786443 - DNA, 21 bp, Homo sapiens
agaaaactcctttagcaggtg

SEQ ID NO: 2786444 - DNA, 14 bp, Homo sapiens
agaaaactggaaat

SEQ ID NO: 2786445 - DNA, 21 bp, Homo sapiens
agaaaagattaaaattagtga

SEQ ID NO: 2786446 - DNA, 21 bp, Homo sapiens
agaaaagctataaaatgaata

SEQ ID NO: 2786447 - DNA, 14 bp, Homo sapiens
agaaaagctttgaa

SEQ ID NO: 2786448 - DNA, 14 bp, Homo sapiens
agaaaaggcatgga

SEQ ID NO: 2786449 - DNA, 17 bp, Homo sapiens
agaaaagtgcaaagtta

SEQ ID NO: 2786450 - DNA, 20 bp, Homo sapiens
agaaaagtgcttagaaagtt

SEQ ID NO: 2786451 - DNA, 21 bp, Homo sapiens
agaaaagtgcttagaaagtta

SEQ ID NO: 2786452 - DNA, 22 bp, Homo sapiens
agaaaagtgcttagaaagttat

SEQ ID NO: 2786453 - DNA, 19 bp, Homo sapiens
agaaacagagacaggccca

SEQ ID NO: 2786454 - DNA, 19 bp, Homo sapiens
agaaacaggggatcaaagt

SEQ ID NO: 2786455 - DNA, 20 bp, Homo sapiens
agaaacagttaactttcaga

SEQ ID NO: 2786456 - DNA, 22 bp, Homo sapiens
agaaacccaccagcctaagaag

SEQ ID NO: 2786457 - DNA, 13 bp, Homo sapiens
agaaaccctgtct

SEQ ID NO: 2786458 - DNA, 14 bp, Homo sapiens
agaaaccctgtctc

SEQ ID NO: 2786459 - DNA, 19 bp, Homo sapiens
agaaactgaaaactgtaaa

SEQ ID NO: 2786460 - DNA, 15 bp, Homo sapiens
agaaacttttttatt

SEQ ID NO: 2786461 - DNA, 11 bp, Homo sapiens
agaaagaaata

SEQ ID NO: 2786462 - DNA, 13 bp, Homo sapiens
agaaagaagagac

SEQ ID NO: 2786463 - DNA, 21 bp, Homo sapiens
agaaagaaggacacttgtatg

SEQ ID NO: 2786464 - DNA, 19 bp, Homo sapiens
agaaagaggtgaccccagg

SEQ ID NO: 2786465 - DNA, 16 bp, Homo sapiens
agaaagcattacattt

SEQ ID NO: 2786466 - DNA, 16 bp, Homo sapiens
agaaagggagggctct

SEQ ID NO: 2786467 - DNA, 17 bp, Homo sapiens
agaaagggagggctctg

SEQ ID NO: 2786468 - DNA, 14 bp, Homo sapiens
agaaagggcaagaa

SEQ ID NO: 2786469 - DNA, 19 bp, Homo sapiens
agaaagtgacctatttttt

SEQ ID NO: 2786470 - DNA, 12 bp, Homo sapiens
agaaagttattg

SEQ ID NO: 2786471 - DNA, 18 bp, Homo sapiens
agaaatagacagtatatt

SEQ ID NO: 2786472 - DNA, 20 bp, Homo sapiens
agaaatagcctgcgctgttt

SEQ ID NO: 2786473 - DNA, 21 bp, Homo sapiens
agaaatatgcacaatagcagt

SEQ ID NO: 2786474 - DNA, 14 bp, Homo sapiens
agaaatatgtggtt

SEQ ID NO: 2786475 - DNA, 17 bp, Homo sapiens
agaaatatttataaact

SEQ ID NO: 2786476 - DNA, 13 bp, Homo sapiens
agaaattcctgta

SEQ ID NO: 2786477 - DNA, 16 bp, Homo sapiens
agaaattcctgtagca

SEQ ID NO: 2786478 - DNA, 20 bp, Homo sapiens
agaaattcctgtagcatctt

SEQ ID NO: 2786479 - DNA, 20 bp, Homo sapiens
agaaatttaaactataagca

SEQ ID NO: 2786480 - DNA, 20 bp, Homo sapiens
agaaattttactgacagaaa

SEQ ID NO: 2786481 - DNA, 21 bp, Homo sapiens
agaacaatagctattgcatgt

SEQ ID NO: 2786482 - DNA, 16 bp, Homo sapiens
agaacacaaggtcatt

SEQ ID NO: 2786483 - DNA, 18 bp, Homo sapiens
agaacagcagactcagct

SEQ ID NO: 2786484 - DNA, 18 bp, Homo sapiens
agaacagcagaggttctt

SEQ ID NO: 2786485 - DNA, 23 bp, Homo sapiens
agaacagcagggtagtctggttt

SEQ ID NO: 2786486 - DNA, 18 bp, Homo sapiens
agaacagccgctcctgtc

SEQ ID NO: 2786487 - DNA, 20 bp, Homo sapiens
agaacagccgctcctgtctg

SEQ ID NO: 2786488 - DNA, 22 bp, Homo sapiens
agaacagccgctcctgtctgcc

SEQ ID NO: 2786489 - DNA, 23 bp, Homo sapiens
agaacagccgctcctgtctgcca

SEQ ID NO: 2786490 - DNA, 19 bp, Homo sapiens
agaacatagacagaagaaa

SEQ ID NO: 2786491 - DNA, 21 bp, Homo sapiens
agaacatagacagaagaaaca

SEQ ID NO: 2786492 - DNA, 18 bp, Homo sapiens
agaaccagtttcaggtgt

SEQ ID NO: 2786493 - DNA, 19 bp, Homo sapiens
agaacctaattcaattcaa

SEQ ID NO: 2786494 - DNA, 22 bp, Homo sapiens
agaacctggccttcagtgtacc

SEQ ID NO: 2786495 - DNA, 23 bp, Homo sapiens
agaactcgaagcccttccagtgg

SEQ ID NO: 2786496 - DNA, 20 bp, Homo sapiens
agaactgaacgtcctgcagc

SEQ ID NO: 2786497 - DNA, 18 bp, Homo sapiens
agaactggacgcccagct

SEQ ID NO: 2786498 - DNA, 23 bp, Homo sapiens
agaactgggatttgaacccccgc

SEQ ID NO: 2786499 - DNA, 12 bp, Homo sapiens
agaacttaaaaa

SEQ ID NO: 2786500 - DNA, 22 bp, Homo sapiens
agaactttgtacagtggagaaa

SEQ ID NO: 2786501 - DNA, 23 bp, Homo sapiens
agaactttgtacagtggagaaat

SEQ ID NO: 2786502 - DNA, 16 bp, Homo sapiens
agaagaaagaggtgac

SEQ ID NO: 2786503 - DNA, 22 bp, Homo sapiens
agaagaagtttcatcatttttt

SEQ ID NO: 2786504 - DNA, 20 bp, Homo sapiens
agaagaatacaaacatattt

SEQ ID NO: 2786505 - DNA, 13 bp, Homo sapiens
agaagaatataaa

SEQ ID NO: 2786506 - DNA, 14 bp, Homo sapiens
agaagaatattcag

SEQ ID NO: 2786507 - DNA, 19 bp, Homo sapiens
agaagaatattcaggactt

SEQ ID NO: 2786508 - DNA, 19 bp, Homo sapiens
agaagaatgcttaatcaga

SEQ ID NO: 2786509 - DNA, 22 bp, Homo sapiens
agaagaattttcagaccccagc

SEQ ID NO: 2786510 - DNA, 21 bp, Homo sapiens
agaagacactgatgggcaacc

SEQ ID NO: 2786511 - DNA, 14 bp, Homo sapiens
agaagacatggaga

SEQ ID NO: 2786512 - DNA, 20 bp, Homo sapiens
agaagagatgggcttgtttt

SEQ ID NO: 2786513 - DNA, 17 bp, Homo sapiens
agaagaggctggtgctg

SEQ ID NO: 2786514 - DNA, 22 bp, Homo sapiens
agaagaggctggtgctgtggcc

SEQ ID NO: 2786515 - DNA, 14 bp, Homo sapiens
agaagagggcctgt

SEQ ID NO: 2786516 - DNA, 17 bp, Homo sapiens
agaagagtcaggaaggg

SEQ ID NO: 2786517 - DNA, 14 bp, Homo sapiens
agaagagtttgcaa

SEQ ID NO: 2786518 - DNA, 15 bp, Homo sapiens
agaagagtttgcaaa

SEQ ID NO: 2786519 - DNA, 23 bp, Homo sapiens
agaagcaacctcagtaatttaga

SEQ ID NO: 2786520 - DNA, 14 bp, Homo sapiens
agaagcagtgagcc

SEQ ID NO: 2786521 - DNA, 14 bp, Homo sapiens
agaagccaggagca

SEQ ID NO: 2786522 - DNA, 14 bp, Homo sapiens
agaagcccatggag

SEQ ID NO: 2786523 - DNA, 15 bp, Homo sapiens
agaagccgcagggac

SEQ ID NO: 2786524 - DNA, 14 bp, Homo sapiens
agaagccgggaaca

SEQ ID NO: 2786525 - DNA, 18 bp, Homo sapiens
agaagccgggaacagaca

SEQ ID NO: 2786526 - DNA, 20 bp, Homo sapiens
agaagcctgggggcctggct

SEQ ID NO: 2786527 - DNA, 14 bp, Homo sapiens
agaagcgagcactg

SEQ ID NO: 2786528 - DNA, 16 bp, Homo sapiens
agaaggaaaaggcagg

SEQ ID NO: 2786529 - DNA, 22 bp, Homo sapiens
agaaggaaggagactcacctct

SEQ ID NO: 2786530 - DNA, 22 bp, Homo sapiens
agaaggaattctaggcatccca

SEQ ID NO: 2786531 - DNA, 15 bp, Homo sapiens
agaaggacattttct

SEQ ID NO: 2786532 - DNA, 21 bp, Homo sapiens
agaaggatgaatgaggtccca

SEQ ID NO: 2786533 - DNA, 19 bp, Homo sapiens
agaaggcacaggtgtaaat

SEQ ID NO: 2786534 - DNA, 22 bp, Homo sapiens
agaaggcacaggtgtaaatata

SEQ ID NO: 2786535 - DNA, 14 bp, Homo sapiens
agaaggccacatgt

SEQ ID NO: 2786536 - DNA, 22 bp, Homo sapiens
agaaggccgctgccccagcccc

SEQ ID NO: 2786537 - DNA, 22 bp, Homo sapiens
agaagggaaattcacactgtgc

SEQ ID NO: 2786538 - DNA, 19 bp, Homo sapiens
agaaggggacagcgccacc

SEQ ID NO: 2786539 - DNA, 20 bp, Homo sapiens
agaaggggacagcgccacct

SEQ ID NO: 2786540 - DNA, 19 bp, Homo sapiens
agaaggggcacgcctgccc

SEQ ID NO: 2786541 - DNA, 20 bp, Homo sapiens
agaagggttttccaccctgg

SEQ ID NO: 2786542 - DNA, 14 bp, Homo sapiens
agaaggtccttaat

SEQ ID NO: 2786543 - DNA, 20 bp, Homo sapiens
agaaggtccttaatgatccg

SEQ ID NO: 2786544 - DNA, 21 bp, Homo sapiens
agaaggtccttaatgatccgt

SEQ ID NO: 2786545 - DNA, 16 bp, Homo sapiens
agaagtaaaagctaat

SEQ ID NO: 2786546 - DNA, 23 bp, Homo sapiens
agaagtatccaattatgtgacaa

SEQ ID NO: 2786547 - DNA, 20 bp, Homo sapiens
agaagtcagttggagaaaat

SEQ ID NO: 2786548 - DNA, 17 bp, Homo sapiens
agaagtcatgaagccca

SEQ ID NO: 2786549 - DNA, 20 bp, Homo sapiens
agaagtcatgaagcccaagt

SEQ ID NO: 2786550 - DNA, 16 bp, Homo sapiens
agaagtgcaaaggtgt

SEQ ID NO: 2786551 - DNA, 17 bp, Homo sapiens
agaagtggaccaggaca

SEQ ID NO: 2786552 - DNA, 18 bp, Homo sapiens
agaagtggaccaggacag

SEQ ID NO: 2786553 - DNA, 19 bp, Homo sapiens
agaagtggaccaggacagg

SEQ ID NO: 2786554 - DNA, 23 bp, Homo sapiens
agaagtggaccaggacaggacca

SEQ ID NO: 2786555 - DNA, 23 bp, Homo sapiens
agaagtgggccaggacaggcccg

SEQ ID NO: 2786556 - DNA, 14 bp, Homo sapiens
agaagttaagcagc

SEQ ID NO: 2786557 - DNA, 15 bp, Homo sapiens
agaagttaagcagcc

SEQ ID NO: 2786558 - DNA, 15 bp, Homo sapiens
agaagttgccaagag

SEQ ID NO: 2786559 - DNA, 23 bp, Homo sapiens
agaagtttcatcattttttactt

SEQ ID NO: 2786560 - DNA, 20 bp, Homo sapiens
agaagtttgatattaaagga

SEQ ID NO: 2786561 - DNA, 15 bp, Homo sapiens
agaagtttgtcaagt

SEQ ID NO: 2786562 - DNA, 12 bp, Homo sapiens
agaataagtgct

SEQ ID NO: 2786563 - DNA, 13 bp, Homo sapiens
agaataagtgctg

SEQ ID NO: 2786564 - DNA, 21 bp, Homo sapiens
agaataagtgctgtttgagat

SEQ ID NO: 2786565 - DNA, 13 bp, Homo sapiens
agaataatctttg

SEQ ID NO: 2786566 - DNA, 17 bp, Homo sapiens
agaataattgtgtacaa

SEQ ID NO: 2786567 - DNA, 15 bp, Homo sapiens
agaatacaaacatat

SEQ ID NO: 2786568 - DNA, 16 bp, Homo sapiens
agaatacaaacatatt

SEQ ID NO: 2786569 - DNA, 18 bp, Homo sapiens
agaatacagaaagatgga

SEQ ID NO: 2786570 - DNA, 22 bp, Homo sapiens
agaatacagtaagctgctctat

SEQ ID NO: 2786571 - DNA, 19 bp, Homo sapiens
agaatacttctcatttttt

SEQ ID NO: 2786572 - DNA, 14 bp, Homo sapiens
agaatataaataaa

SEQ ID NO: 2786573 - DNA, 15 bp, Homo sapiens
agaatataattatcg

SEQ ID NO: 2786574 - DNA, 17 bp, Homo sapiens
agaatataattatcgga

SEQ ID NO: 2786575 - DNA, 16 bp, Homo sapiens
agaatatatttttgat

SEQ ID NO: 2786576 - DNA, 19 bp, Homo sapiens
agaatatgatcatgtaaat

SEQ ID NO: 2786577 - DNA, 15 bp, Homo sapiens
agaatattgttaaaa

SEQ ID NO: 2786578 - DNA, 18 bp, Homo sapiens
agaatattgttaaaacct

SEQ ID NO: 2786579 - DNA, 11 bp, Homo sapiens
agaatatttat

SEQ ID NO: 2786580 - DNA, 19 bp, Homo sapiens
agaatatttattacctctg

SEQ ID NO: 2786581 - DNA, 16 bp, Homo sapiens
agaatcataattttca

SEQ ID NO: 2786582 - DNA, 12 bp, Homo sapiens
agaatccaaaga

SEQ ID NO: 2786583 - DNA, 21 bp, Homo sapiens
agaatcctaggctccacccca

SEQ ID NO: 2786584 - DNA, 17 bp, Homo sapiens
agaatcgacctcactgt

SEQ ID NO: 2786585 - DNA, 18 bp, Homo sapiens
agaatctatatttaacaa

SEQ ID NO: 2786586 - DNA, 18 bp, Homo sapiens
agaatctgaagctattga

SEQ ID NO: 2786587 - DNA, 20 bp, Homo sapiens
agaatctgaagctattgatg

SEQ ID NO: 2786588 - DNA, 15 bp, Homo sapiens
agaatgagctggttt

SEQ ID NO: 2786589 - DNA, 16 bp, Homo sapiens
agaatgtaaagcttgt

SEQ ID NO: 2786590 - DNA, 16 bp, Homo sapiens
agaatgtcattttggt

SEQ ID NO: 2786591 - DNA, 14 bp, Homo sapiens
agaatgttaagact

SEQ ID NO: 2786592 - DNA, 16 bp, Homo sapiens
agaattatatctaatt

SEQ ID NO: 2786593 - DNA, 19 bp, Homo sapiens
agaattatatctaatttat

SEQ ID NO: 2786594 - DNA, 14 bp, Homo sapiens
agaattatttttgt

SEQ ID NO: 2786595 - DNA, 16 bp, Homo sapiens
agaattctaagattgt

SEQ ID NO: 2786596 - DNA, 21 bp, Homo sapiens
agaattctaagattgtacata

SEQ ID NO: 2786597 - DNA, 14 bp, Homo sapiens
agaattctttcaag

SEQ ID NO: 2786598 - DNA, 19 bp, Homo sapiens
agaattgaacccaggaggt

SEQ ID NO: 2786599 - DNA, 22 bp, Homo sapiens
agaattgaacccaggaggtgga

SEQ ID NO: 2786600 - DNA, 21 bp, Homo sapiens
agaattgcttgaaccggggag

SEQ ID NO: 2786601 - DNA, 21 bp, Homo sapiens
agaattgtgcgacttcacaaa

SEQ ID NO: 2786602 - DNA, 14 bp, Homo sapiens
agaatttattcaat

SEQ ID NO: 2786603 - DNA, 20 bp, Homo sapiens
agaatttctaccatttcaga

SEQ ID NO: 2786604 - DNA, 19 bp, Homo sapiens
agatcaaggagcccagaaa

SEQ ID NO: 2786605 - DNA, 20 bp, Homo sapiens
agatcaattaattcttaata

SEQ ID NO: 2786606 - DNA, 22 bp, Homo sapiens
agatcacgccactgcactccag

SEQ ID NO: 2786607 - DNA, 15 bp, Homo sapiens
agatccacacacaga

SEQ ID NO: 2786608 - DNA, 19 bp, Homo sapiens
agatcccatccatcagctc

SEQ ID NO: 2786609 - DNA, 15 bp, Homo sapiens
agatcccgcctcttc

SEQ ID NO: 2786610 - DNA, 21 bp, Homo sapiens
agatcctgtctttaaggaaaa

SEQ ID NO: 2786611 - DNA, 20 bp, Homo sapiens
agatcgcgccactgcactcc

SEQ ID NO: 2786612 - DNA, 17 bp, Homo sapiens
agatcgtattaattatc

SEQ ID NO: 2786613 - DNA, 20 bp, Homo sapiens
agatcgtattaattatctga

SEQ ID NO: 2786614 - DNA, 22 bp, Homo sapiens
agatctcagataaagtgaccag

SEQ ID NO: 2786615 - DNA, 20 bp, Homo sapiens
agatctcctatttttcagaa

SEQ ID NO: 2786616 - DNA, 15 bp, Homo sapiens
agatctcctgtaatt

SEQ ID NO: 2786617 - DNA, 21 bp, Homo sapiens
agatctgcagggggtgtgtct

SEQ ID NO: 2786618 - DNA, 15 bp, Homo sapiens
agatcttctgaaatg

SEQ ID NO: 2786619 - DNA, 13 bp, Homo sapiens
agatcttgtctcc

SEQ ID NO: 2786620 - DNA, 12 bp, Homo sapiens
agatcttttaaa

SEQ ID NO: 2786621 - DNA, 20 bp, Homo sapiens
agatctttttgtgaaattca

SEQ ID NO: 2786622 - DNA, 17 bp, Homo sapiens
agatgaaagaggaggtt

SEQ ID NO: 2786623 - DNA, 20 bp, Homo sapiens
agatgaagagtgagagggca

SEQ ID NO: 2786624 - DNA, 13 bp, Homo sapiens
agatgacagctct

SEQ ID NO: 2786625 - DNA, 15 bp, Homo sapiens
agatgacagctcttc

SEQ ID NO: 2786626 - DNA, 14 bp, Homo sapiens
agatgactgagtcc

SEQ ID NO: 2786627 - DNA, 15 bp, Homo sapiens
agatgactgagtcct

SEQ ID NO: 2786628 - DNA, 19 bp, Homo sapiens
agatgagcagtcacactgt

SEQ ID NO: 2786629 - DNA, 21 bp, Homo sapiens
agatgattcggatttgacaaa

SEQ ID NO: 2786630 - DNA, 14 bp, Homo sapiens
agatgcaccagccc

SEQ ID NO: 2786631 - DNA, 16 bp, Homo sapiens
agatgccacacctgct

SEQ ID NO: 2786632 - DNA, 13 bp, Homo sapiens
agatgcctccacc

SEQ ID NO: 2786633 - DNA, 15 bp, Homo sapiens
agatgcctccaccgc

SEQ ID NO: 2786634 - DNA, 21 bp, Homo sapiens
agatggccgggacatgcagct

SEQ ID NO: 2786635 - DNA, 17 bp, Homo sapiens
agatggctgtgcctctg

SEQ ID NO: 2786636 - DNA, 17 bp, Homo sapiens
agatgggcttgttttct

SEQ ID NO: 2786637 - DNA, 19 bp, Homo sapiens
agatgggcttgttttcttg

SEQ ID NO: 2786638 - DNA, 14 bp, Homo sapiens
agatgtaaggaatt

SEQ ID NO: 2786639 - DNA, 13 bp, Homo sapiens
agatgtcaaatat

SEQ ID NO: 2786640 - DNA, 19 bp, Homo sapiens
agatgtcaaatatctcaga

SEQ ID NO: 2786641 - DNA, 18 bp, Homo sapiens
agatgtctaatagttatt

SEQ ID NO: 2786642 - DNA, 13 bp, Homo sapiens
agatgtctttagg

SEQ ID NO: 2786643 - DNA, 17 bp, Homo sapiens
agatgtgataaggatca

SEQ ID NO: 2786644 - DNA, 15 bp, Homo sapiens
agatgtttgtcagat

SEQ ID NO: 2786645 - DNA, 19 bp, Homo sapiens
agatgtttgtcagatatga

SEQ ID NO: 2786646 - DNA, 20 bp, Homo sapiens
agattaaaattagtgagatt

SEQ ID NO: 2786647 - DNA, 12 bp, Homo sapiens
agattaaaggaa

SEQ ID NO: 2786648 - DNA, 16 bp, Homo sapiens
agattaaaggaaggaa

SEQ ID NO: 2786649 - DNA, 19 bp, Homo sapiens
agattaatttgtgtagatt

SEQ ID NO: 2786650 - DNA, 17 bp, Homo sapiens
agattagaagtgtttta

SEQ ID NO: 2786651 - DNA, 12 bp, Homo sapiens
agattcccagag

SEQ ID NO: 2786652 - DNA, 19 bp, Homo sapiens
agattctacatattcttta

SEQ ID NO: 2786653 - DNA, 19 bp, Homo sapiens
agattctagccaaactatt

SEQ ID NO: 2786654 - DNA, 22 bp, Homo sapiens
agattgaggcctgccctcaggg

SEQ ID NO: 2786655 - DNA, 17 bp, Homo sapiens
agattgcaacaggctgg

SEQ ID NO: 2786656 - DNA, 19 bp, Homo sapiens
agattgcaacaggctgggc

SEQ ID NO: 2786657 - DNA, 21 bp, Homo sapiens
agattgcaacaggctgggctt

SEQ ID NO: 2786658 - DNA, 23 bp, Homo sapiens
agattgcaacaggctgggcttca

SEQ ID NO: 2786659 - DNA, 16 bp, Homo sapiens
agattgcgtggacccc

SEQ ID NO: 2786660 - DNA, 20 bp, Homo sapiens
agattgtgtaaattcctgtt

SEQ ID NO: 2786661 - DNA, 15 bp, Homo sapiens
agattgttaaaataa

SEQ ID NO: 2786662 - DNA, 18 bp, Homo sapiens
agatttagtgaaagctag

SEQ ID NO: 2786663 - DNA, 13 bp, Homo sapiens
agatttcaacata

SEQ ID NO: 2786664 - DNA, 12 bp, Homo sapiens
agatttgtattt

SEQ ID NO: 2786665 - DNA, 18 bp, Homo sapiens
agatttgtatttatatta

SEQ ID NO: 2786666 - DNA, 13 bp, Homo sapiens
agattttaaattc

SEQ ID NO: 2786667 - DNA, 22 bp, Homo sapiens
agattttaaattcacaatagaa

SEQ ID NO: 2786668 - DNA, 13 bp, Homo sapiens
agattttcttgca

SEQ ID NO: 2786669 - DNA, 13 bp, Homo sapiens
agattttttaata

SEQ ID NO: 2786670 - DNA, 16 bp, Homo sapiens
agattttttaataatt

SEQ ID NO: 2786671 - DNA, 16 bp, Homo sapiens
agcaaagagtgggctg

SEQ ID NO: 2786672 - DNA, 22 bp, Homo sapiens
agcaaagcaccagcttctccag

SEQ ID NO: 2786673 - DNA, 19 bp, Homo sapiens
agcaaagccacattttgca

SEQ ID NO: 2786674 - DNA, 21 bp, Homo sapiens
agcaaagcctgttcatggcag

SEQ ID NO: 2786675 - DNA, 17 bp, Homo sapiens
agcaaatcgaatgaaat

SEQ ID NO: 2786676 - DNA, 20 bp, Homo sapiens
agcaaatcgaatgaaattaa

SEQ ID NO: 2786677 - DNA, 13 bp, Homo sapiens
agcaaatgtttct

SEQ ID NO: 2786678 - DNA, 20 bp, Homo sapiens
agcaacacaagctggaagca

SEQ ID NO: 2786679 - DNA, 17 bp, Homo sapiens
agcaacaggaatctcag

SEQ ID NO: 2786680 - DNA, 22 bp, Homo sapiens
agcaacaggaatctcagagaca

SEQ ID NO: 2786681 - DNA, 18 bp, Homo sapiens
agcaacaggttttataat

SEQ ID NO: 2786682 - DNA, 19 bp, Homo sapiens
agcaacaggttttataatt

SEQ ID NO: 2786683 - DNA, 16 bp, Homo sapiens
agcaaccgtggccctt

SEQ ID NO: 2786684 - DNA, 20 bp, Homo sapiens
agcaaccgtggcccttcctg

SEQ ID NO: 2786685 - DNA, 21 bp, Homo sapiens
agcaagacttctctttgcctc

SEQ ID NO: 2786686 - DNA, 17 bp, Homo sapiens
agcaagatcttgtctcc

SEQ ID NO: 2786687 - DNA, 18 bp, Homo sapiens
agcaagcattcagaagaa

SEQ ID NO: 2786688 - DNA, 18 bp, Homo sapiens
agcaaggcccgagcagct

SEQ ID NO: 2786689 - DNA, 18 bp, Homo sapiens
agcaagtgagagctgggt

SEQ ID NO: 2786690 - DNA, 17 bp, Homo sapiens
agcaagttctagagaag

SEQ ID NO: 2786691 - DNA, 21 bp, Homo sapiens
agcaagttctagagaagaggc

SEQ ID NO: 2786692 - DNA, 13 bp, Homo sapiens
agcaataattagg

SEQ ID NO: 2786693 - DNA, 18 bp, Homo sapiens
agcaataattaggatcta

SEQ ID NO: 2786694 - DNA, 22 bp, Homo sapiens
agcaataattaggatctatgca

SEQ ID NO: 2786695 - DNA, 18 bp, Homo sapiens
agcctgggggcctggctg

SEQ ID NO: 2786696 - DNA, 21 bp, Homo sapiens
agcctgggggcctggctggct

SEQ ID NO: 2786697 - DNA, 11 bp, Homo sapiens
agcctggtggg

SEQ ID NO: 2786698 - DNA, 14 bp, Homo sapiens
agcctggtgggcct

SEQ ID NO: 2786699 - DNA, 16 bp, Homo sapiens
agcctgtaatcccagc

SEQ ID NO: 2786700 - DNA, 17 bp, Homo sapiens
agcctgtaatcccagct

SEQ ID NO: 2786701 - DNA, 18 bp, Homo sapiens
agcctgtaatcccagcta

SEQ ID NO: 2786702 - DNA, 15 bp, Homo sapiens
agcctgtctttcagc

SEQ ID NO: 2786703 - DNA, 19 bp, Homo sapiens
agcctgtgaacccaggaca

SEQ ID NO: 2786704 - DNA, 19 bp, Homo sapiens
agcctgtggcggtgcctgg

SEQ ID NO: 2786705 - DNA, 16 bp, Homo sapiens
agcctgttcatggcag

SEQ ID NO: 2786706 - DNA, 17 bp, Homo sapiens
agcctgttcatggcaga

SEQ ID NO: 2786707 - DNA, 18 bp, Homo sapiens
agcctgttcatggcagat

SEQ ID NO: 2786708 - DNA, 22 bp, Homo sapiens
agcctgttggacccgctctgga

SEQ ID NO: 2786709 - DNA, 18 bp, Homo sapiens
agcctgttttgttggaag

SEQ ID NO: 2786710 - DNA, 22 bp, Homo sapiens
agccttagaagtcacacagtat

SEQ ID NO: 2786711 - DNA, 23 bp, Homo sapiens
agccttcacaaccagccacacag

SEQ ID NO: 2786712 - DNA, 13 bp, Homo sapiens
agccttctctctc

SEQ ID NO: 2786713 - DNA, 15 bp, Homo sapiens
agccttctctctctg

SEQ ID NO: 2786714 - DNA, 16 bp, Homo sapiens
agccttctctctctgg

SEQ ID NO: 2786715 - DNA, 22 bp, Homo sapiens
agccttctctgttcatttcctc

SEQ ID NO: 2786716 - DNA, 14 bp, Homo sapiens
agccttgaaaaaca

SEQ ID NO: 2786717 - DNA, 21 bp, Homo sapiens
agccttgcccggattctggga

SEQ ID NO: 2786718 - DNA, 20 bp, Homo sapiens
agccttgccttttaaaagaa

SEQ ID NO: 2786719 - DNA, 16 bp, Homo sapiens
agccttggggattctt

SEQ ID NO: 2786720 - DNA, 21 bp, Homo sapiens
agccttggtgtccacctggcc

SEQ ID NO: 2786721 - DNA, 14 bp, Homo sapiens
agcctttccataag

SEQ ID NO: 2786722 - DNA, 13 bp, Homo sapiens
agcctttctgtgg

SEQ ID NO: 2786723 - DNA, 23 bp, Homo sapiens
agcctttctgtggagagtgagaa

SEQ ID NO: 2786724 - DNA, 18 bp, Homo sapiens
agcctttggatgaccaga

SEQ ID NO: 2786725 - DNA, 23 bp, Homo sapiens
agcgaaaaaatcaggtggctttt

SEQ ID NO: 2786726 - DNA, 23 bp, Homo sapiens
agcgagacccttgcattagaaac

SEQ ID NO: 2786727 - DNA, 16 bp, Homo sapiens
agcgagagtctgtctc

SEQ ID NO: 2786728 - DNA, 23 bp, Homo sapiens
agcgaggtcaacagagaaggcag

SEQ ID NO: 2786729 - DNA, 21 bp, Homo sapiens
agcgagttgtggaaagcctct

SEQ ID NO: 2786730 - DNA, 19 bp, Homo sapiens
agcgatgaatttggagact

SEQ ID NO: 2786731 - DNA, 19 bp, Homo sapiens
agcgattccctctcccagg

SEQ ID NO: 2786732 - DNA, 20 bp, Homo sapiens
agcgattccctctcccaggc

SEQ ID NO: 2786733 - DNA, 15 bp, Homo sapiens
agcgattcttctgct

SEQ ID NO: 2786734 - DNA, 18 bp, Homo sapiens
agcgcacctgccccctgg

SEQ ID NO: 2786735 - DNA, 19 bp, Homo sapiens
agcgcacctgccccctggt

SEQ ID NO: 2786736 - DNA, 14 bp, Homo sapiens
agcgcccagttggg

SEQ ID NO: 2786737 - DNA, 22 bp, Homo sapiens
agcgcccagttgggtggatgcc

SEQ ID NO: 2786738 - DNA, 12 bp, Homo sapiens
agcgccctgcag

SEQ ID NO: 2786739 - DNA, 17 bp, Homo sapiens
agcgccctgcagaccct

SEQ ID NO: 2786740 - DNA, 23 bp, Homo sapiens
agcgccctgcagaccctgccctt

SEQ ID NO: 2786741 - DNA, 23 bp, Homo sapiens
agcgcctagtggggtctccctct

SEQ ID NO: 2786742 - DNA, 14 bp, Homo sapiens
agcgcctccctcca

SEQ ID NO: 2786743 - DNA, 16 bp, Homo sapiens
agcgctttctggaaaa

SEQ ID NO: 2786744 - DNA, 17 bp, Homo sapiens
agcgctttctggaaaag

SEQ ID NO: 2786745 - DNA, 19 bp, Homo sapiens
agcggctgagtcatgatct

SEQ ID NO: 2786746 - DNA, 20 bp, Homo sapiens
agcggctgggtggtgaagga

SEQ ID NO: 2786747 - DNA, 16 bp, Homo sapiens
agcggggacagctcct

SEQ ID NO: 2786748 - DNA, 17 bp, Homo sapiens
agcggggacagctcctt

SEQ ID NO: 2786749 - DNA, 21 bp, Homo sapiens
agcggggccccagggctaccc

SEQ ID NO: 2786750 - DNA, 18 bp, Homo sapiens
agctaaattacaattgtc

SEQ ID NO: 2786751 - DNA, 13 bp, Homo sapiens
agctaacagggaa

SEQ ID NO: 2786752 - DNA, 16 bp, Homo sapiens
agctaacagggaaggc

SEQ ID NO: 2786753 - DNA, 18 bp, Homo sapiens
agctaacagggaaggcag

SEQ ID NO: 2786754 - DNA, 19 bp, Homo sapiens
agctaagtgaaaaggtcat

SEQ ID NO: 2786755 - DNA, 13 bp, Homo sapiens
agctaatctgtag

SEQ ID NO: 2786756 - DNA, 23 bp, Homo sapiens
agctaatctgtagggctggacct

SEQ ID NO: 2786757 - DNA, 14 bp, Homo sapiens
agctaatgggacac

SEQ ID NO: 2786758 - DNA, 15 bp, Homo sapiens
agctaatgggacact

SEQ ID NO: 2786759 - DNA, 19 bp, Homo sapiens
agctacacctgaggctgag

SEQ ID NO: 2786760 - DNA, 18 bp, Homo sapiens
agctacctgtgtggacag

SEQ ID NO: 2786761 - DNA, 20 bp, Homo sapiens
agctacctgtgtggacagga

SEQ ID NO: 2786762 - DNA, 16 bp, Homo sapiens
agctacttgggaggct

SEQ ID NO: 2786763 - DNA, 17 bp, Homo sapiens
agctacttgggaggctg

SEQ ID NO: 2786764 - DNA, 14 bp, Homo sapiens
agctagaattgagt

SEQ ID NO: 2786765 - DNA, 14 bp, Homo sapiens
agctagcgctgccg

SEQ ID NO: 2786766 - DNA, 16 bp, Homo sapiens
agctagcgctgccgca

SEQ ID NO: 2786767 - DNA, 21 bp, Homo sapiens
agctagcgctgccgcacccca

SEQ ID NO: 2786768 - DNA, 12 bp, Homo sapiens
agctaggaatga

SEQ ID NO: 2786769 - DNA, 20 bp, Homo sapiens
agctaggagcaaagcctgtt

SEQ ID NO: 2786770 - DNA, 18 bp, Homo sapiens
agctagtgacccacatgc

SEQ ID NO: 2786771 - DNA, 19 bp, Homo sapiens
agctatcatttcttttcca

SEQ ID NO: 2786772 - DNA, 13 bp, Homo sapiens
agctattgatgtt

SEQ ID NO: 2786773 - DNA, 14 bp, Homo sapiens
agctattgcatgta

SEQ ID NO: 2786774 - DNA, 16 bp, Homo sapiens
agctattgcatgtaaa

SEQ ID NO: 2786775 - DNA, 17 bp, Homo sapiens
agctattgcatgtaaaa

SEQ ID NO: 2786776 - DNA, 20 bp, Homo sapiens
agctcaagatgacagctctt

SEQ ID NO: 2786777 - DNA, 14 bp, Homo sapiens
agctcacaaggcag

SEQ ID NO: 2786778 - DNA, 19 bp, Homo sapiens
agctcacaaggcagcaagg

SEQ ID NO: 2786779 - DNA, 20 bp, Homo sapiens
agctcacaaggcagcaaggc

SEQ ID NO: 2786780 - DNA, 15 bp, Homo sapiens
agctcaccagcccca

SEQ ID NO: 2786781 - DNA, 22 bp, Homo sapiens
agctcaccagccccagtgccca

SEQ ID NO: 2786782 - DNA, 21 bp, Homo sapiens
agctcacccaataaacattaa

SEQ ID NO: 2786783 - DNA, 12 bp, Homo sapiens
agctcactccct

SEQ ID NO: 2786784 - DNA, 20 bp, Homo sapiens
agctcagacccccactctca

SEQ ID NO: 2786785 - DNA, 16 bp, Homo sapiens
aggactatagcccagg

SEQ ID NO: 2786786 - DNA, 12 bp, Homo sapiens
aggactcaccct

SEQ ID NO: 2786787 - DNA, 17 bp, Homo sapiens
aggactccccaggccag

SEQ ID NO: 2786788 - DNA, 20 bp, Homo sapiens
aggactccccaggccaggcc

SEQ ID NO: 2786789 - DNA, 13 bp, Homo sapiens
aggactctgaggc

SEQ ID NO: 2786790 - DNA, 14 bp, Homo sapiens
aggactctgaggct

SEQ ID NO: 2786791 - DNA, 17 bp, Homo sapiens
aggactctgaggctctt

SEQ ID NO: 2786792 - DNA, 18 bp, Homo sapiens
aggactctgcctcctctt

SEQ ID NO: 2786793 - DNA, 17 bp, Homo sapiens
aggacttaacggctcca

SEQ ID NO: 2786794 - DNA, 21 bp, Homo sapiens
aggacttaacggctccaggat

SEQ ID NO: 2786795 - DNA, 16 bp, Homo sapiens
aggacttgagcctcca

SEQ ID NO: 2786796 - DNA, 20 bp, Homo sapiens
aggacttggtctgatttcag

SEQ ID NO: 2786797 - DNA, 22 bp, Homo sapiens
aggacttttctttgtggcttcc

SEQ ID NO: 2786798 - DNA, 13 bp, Homo sapiens
aggagaaaaacaa

SEQ ID NO: 2786799 - DNA, 12 bp, Homo sapiens
aggagaaatgca

SEQ ID NO: 2786800 - DNA, 16 bp, Homo sapiens
aggagaaatgcatcca

SEQ ID NO: 2786801 - DNA, 18 bp, Homo sapiens
aggagaatccaagcgagg

SEQ ID NO: 2786802 - DNA, 13 bp, Homo sapiens
aggagactcacct

SEQ ID NO: 2786803 - DNA, 14 bp, Homo sapiens
aggagactcacctc

SEQ ID NO: 2786804 - DNA, 16 bp, Homo sapiens
aggagagccagccctc

SEQ ID NO: 2786805 - DNA, 19 bp, Homo sapiens
aggagaggggaagggccag

SEQ ID NO: 2786806 - DNA, 22 bp, Homo sapiens
aggagaggggaagggccagtct

SEQ ID NO: 2786807 - DNA, 16 bp, Homo sapiens
aggagcaaagcctgtt

SEQ ID NO: 2786808 - DNA, 11 bp, Homo sapiens
aggagcctggc

SEQ ID NO: 2786809 - DNA, 17 bp, Homo sapiens
aggagcctgtgaaccca

SEQ ID NO: 2786810 - DNA, 22 bp, Homo sapiens
aggagcctgtgaacccaggaca

SEQ ID NO: 2786811 - DNA, 12 bp, Homo sapiens
aggagctacctg

SEQ ID NO: 2786812 - DNA, 14 bp, Homo sapiens
aggagctacctgtg

SEQ ID NO: 2786813 - DNA, 16 bp, Homo sapiens
aggagctgggaggaaa

SEQ ID NO: 2786814 - DNA, 14 bp, Homo sapiens
aggagcttccagtg

SEQ ID NO: 2786815 - DNA, 17 bp, Homo sapiens
aggagcttccagtgcat

SEQ ID NO: 2786816 - DNA, 20 bp, Homo sapiens
aggagcttccagtgcatgtt

SEQ ID NO: 2786817 - DNA, 21 bp, Homo sapiens
aggaggattgcttgagcccag

SEQ ID NO: 2786818 - DNA, 16 bp, Homo sapiens
aggaggctagcaaagc

SEQ ID NO: 2786819 - DNA, 13 bp, Homo sapiens
aggaggctgaggg

SEQ ID NO: 2786820 - DNA, 19 bp, Homo sapiens
aggagggacaaaggagcct

SEQ ID NO: 2786821 - DNA, 20 bp, Homo sapiens
aggagggacaaaggagcctg

SEQ ID NO: 2786822 - DNA, 23 bp, Homo sapiens
aggagggacaaaggagcctgtga

SEQ ID NO: 2786823 - DNA, 16 bp, Homo sapiens
aggagggcaagggcca

SEQ ID NO: 2786824 - DNA, 17 bp, Homo sapiens
aggagggcgtgactcac

SEQ ID NO: 2786825 - DNA, 22 bp, Homo sapiens
aggagggcgtgactcacccaag

SEQ ID NO: 2786826 - DNA, 13 bp, Homo sapiens
aggaggtgaggga

SEQ ID NO: 2786827 - DNA, 17 bp, Homo sapiens
aggaggtggcagccctg

SEQ ID NO: 2786828 - DNA, 23 bp, Homo sapiens
aggaggtggcagccctgtaggga

SEQ ID NO: 2786829 - DNA, 14 bp, Homo sapiens
aggagtagctgagc

SEQ ID NO: 2786830 - DNA, 15 bp, Homo sapiens
aggagtagctgagct

SEQ ID NO: 2786831 - DNA, 17 bp, Homo sapiens
aggagtcccaaggaaag

SEQ ID NO: 2786832 - DNA, 12 bp, Homo sapiens
aggagtccctgg

SEQ ID NO: 2786833 - DNA, 17 bp, Homo sapiens
aggagtctgaggtcctg

SEQ ID NO: 2786834 - DNA, 20 bp, Homo sapiens
aggagtctgaggtcctgagc

SEQ ID NO: 2786835 - DNA, 21 bp, Homo sapiens
aggagtctgaggtcctgagca

SEQ ID NO: 2786836 - DNA, 12 bp, Homo sapiens
aggagtgagcac

SEQ ID NO: 2786837 - DNA, 23 bp, Homo sapiens
aggagtggccggggaagctggca

SEQ ID NO: 2786838 - DNA, 16 bp, Homo sapiens
aggagtgtgagaatca

SEQ ID NO: 2786839 - DNA, 16 bp, Homo sapiens
aggagttaagagtagc

SEQ ID NO: 2786840 - DNA, 21 bp, Homo sapiens
aggagttgctgtttgtttgac

SEQ ID NO: 2786841 - DNA, 16 bp, Homo sapiens
aggagtttgagaccag

SEQ ID NO: 2786842 - DNA, 15 bp, Homo sapiens
aggagtttgtgtgtc

SEQ ID NO: 2786843 - DNA, 18 bp, Homo sapiens
aggatctatgcaattttt

SEQ ID NO: 2786844 - DNA, 14 bp, Homo sapiens
aggatctctcagga

SEQ ID NO: 2786845 - DNA, 19 bp, Homo sapiens
aggatctctcaggagcaca

SEQ ID NO: 2786846 - DNA, 20 bp, Homo sapiens
aggatctctcaggagcacag

SEQ ID NO: 2786847 - DNA, 22 bp, Homo sapiens
aggatctctcaggagcacaggc

SEQ ID NO: 2786848 - DNA, 21 bp, Homo sapiens
aggatgaatgaggtcccaggc

SEQ ID NO: 2786849 - DNA, 22 bp, Homo sapiens
aggatgaggaacctcaaactgg

SEQ ID NO: 2786850 - DNA, 13 bp, Homo sapiens
aggatggagagag

SEQ ID NO: 2786851 - DNA, 17 bp, Homo sapiens
aggatggagccagctct

SEQ ID NO: 2786852 - DNA, 16 bp, Homo sapiens
aggatgttctgggaca

SEQ ID NO: 2786853 - DNA, 14 bp, Homo sapiens
aggattccaaagtt

SEQ ID NO: 2786854 - DNA, 14 bp, Homo sapiens
aggattgaagagca

SEQ ID NO: 2786855 - DNA, 12 bp, Homo sapiens
aggatttcaagc

SEQ ID NO: 2786856 - DNA, 14 bp, Homo sapiens
aggatttcaagcct

SEQ ID NO: 2786857 - DNA, 15 bp, Homo sapiens
aggatttcaagcctg

SEQ ID NO: 2786858 - DNA, 19 bp, Homo sapiens
aggatttcatgatttcatt

SEQ ID NO: 2786859 - DNA, 19 bp, Homo sapiens
aggattttaacaaaagcaa

SEQ ID NO: 2786860 - DNA, 17 bp, Homo sapiens
aggattttgtgtttttt

SEQ ID NO: 2786861 - DNA, 16 bp, Homo sapiens
aggcaactgaggcaga

SEQ ID NO: 2786862 - DNA, 19 bp, Homo sapiens
aggcaactgaggcagacag

SEQ ID NO: 2786863 - DNA, 12 bp, Homo sapiens
aggcaagagaat

SEQ ID NO: 2786864 - DNA, 17 bp, Homo sapiens
aggcaagcacctcctgc

SEQ ID NO: 2786865 - DNA, 17 bp, Homo sapiens
aggcaatgtcaggaaca

SEQ ID NO: 2786866 - DNA, 23 bp, Homo sapiens
aggcaatgtcaggaacagaagga

SEQ ID NO: 2786867 - DNA, 20 bp, Homo sapiens
aggcacacttcttcttggtc

SEQ ID NO: 2786868 - DNA, 17 bp, Homo sapiens
aggcacaggtgtaaata

SEQ ID NO: 2786869 - DNA, 17 bp, Homo sapiens
aggcaccaaaagaagta

SEQ ID NO: 2786870 - DNA, 20 bp, Homo sapiens
aggcaccaaaagaagtaaaa

SEQ ID NO: 2786871 - DNA, 15 bp, Homo sapiens
aggcacccaccatca

SEQ ID NO: 2786872 - DNA, 20 bp, Homo sapiens
aggcaccccctggagagaag

SEQ ID NO: 2786873 - DNA, 17 bp, Homo sapiens
aggcacgaacccacctg

SEQ ID NO: 2786874 - DNA, 19 bp, Homo sapiens
aggcacgaacccacctgct

SEQ ID NO: 2786875 - DNA, 23 bp, Homo sapiens
aggcacgccagtttcaccatttc

SEQ ID NO: 2786876 - DNA, 13 bp, Homo sapiens
agggcaagggcca

SEQ ID NO: 2786877 - DNA, 14 bp, Homo sapiens
agggcaagggccat

SEQ ID NO: 2786878 - DNA, 17 bp, Homo sapiens
agggcaaggggtttcca

SEQ ID NO: 2786879 - DNA, 12 bp, Homo sapiens
agggcaataaat

SEQ ID NO: 2786880 - DNA, 14 bp, Homo sapiens
agggcacaggagct

SEQ ID NO: 2786881 - DNA, 18 bp, Homo sapiens
agggcacaggagctacct

SEQ ID NO: 2786882 - DNA, 20 bp, Homo sapiens
agggcacaggagctacctgt

SEQ ID NO: 2786883 - DNA, 14 bp, Homo sapiens
agggcagaggctgg

SEQ ID NO: 2786884 - DNA, 12 bp, Homo sapiens
agggcagcagcc

SEQ ID NO: 2786885 - DNA, 16 bp, Homo sapiens
agggcagcagccagcc

SEQ ID NO: 2786886 - DNA, 18 bp, Homo sapiens
agggcagcagccagccct

SEQ ID NO: 2786887 - DNA, 19 bp, Homo sapiens
agggcagcagccagccctg

SEQ ID NO: 2786888 - DNA, 21 bp, Homo sapiens
agggcagcagccagccctgcc

SEQ ID NO: 2786889 - DNA, 16 bp, Homo sapiens
agggcaggtgcttcag

SEQ ID NO: 2786890 - DNA, 18 bp, Homo sapiens
agggcatgcattttgcag

SEQ ID NO: 2786891 - DNA, 17 bp, Homo sapiens
agggcatgcgcacaagg

SEQ ID NO: 2786892 - DNA, 24 bp, Homo sapiens
agggccacactattaccatgagaa

SEQ ID NO: 2786893 - DNA, 16 bp, Homo sapiens
agggccacgtgccagg

SEQ ID NO: 2786894 - DNA, 18 bp, Homo sapiens
agggccacgtgccaggcc

SEQ ID NO: 2786895 - DNA, 14 bp, Homo sapiens
agggccagggccct

SEQ ID NO: 2786896 - DNA, 21 bp, Homo sapiens
agggccaggggtctccctgga

SEQ ID NO: 2786897 - DNA, 18 bp, Homo sapiens
agggccatgctgaaggga

SEQ ID NO: 2786898 - DNA, 23 bp, Homo sapiens
agggcccagagagggtggtgacc

SEQ ID NO: 2786899 - DNA, 17 bp, Homo sapiens
agggcccaggcaggcca

SEQ ID NO: 2786900 - DNA, 23 bp, Homo sapiens
agggcccctgttcccccgctggc

SEQ ID NO: 2786901 - DNA, 16 bp, Homo sapiens
agggccctgagctcgg

SEQ ID NO: 2786902 - DNA, 12 bp, Homo sapiens
agggccctgcag

SEQ ID NO: 2786903 - DNA, 21 bp, Homo sapiens
agggccggggaactggccaag

SEQ ID NO: 2786904 - DNA, 23 bp, Homo sapiens
agggccggggaactggccaagct

SEQ ID NO: 2786905 - DNA, 19 bp, Homo sapiens
agggcctgatggggtggaa

SEQ ID NO: 2786906 - DNA, 12 bp, Homo sapiens
agggcctgtggg

SEQ ID NO: 2786907 - DNA, 23 bp, Homo sapiens
agggccttgcccagagatgcctc

SEQ ID NO: 2786908 - DNA, 19 bp, Homo sapiens
agggcgggaggatgttctg

SEQ ID NO: 2786909 - DNA, 15 bp, Homo sapiens
agggcgggagtgggg

SEQ ID NO: 2786910 - DNA, 23 bp, Homo sapiens
agggcggggctatgccttgtctg

SEQ ID NO: 2786911 - DNA, 21 bp, Homo sapiens
agggcgtcgctggacaaccca

SEQ ID NO: 2786912 - DNA, 13 bp, Homo sapiens
agggctaagagct

SEQ ID NO: 2786913 - DNA, 17 bp, Homo sapiens
ccaggttggcctggtgg

SEQ ID NO: 2786914 - DNA, 18 bp, Homo sapiens
ccagtccccctgccccag

SEQ ID NO: 2786915 - DNA, 15 bp, Homo sapiens
ccagtccctggggga

SEQ ID NO: 2786916 - DNA, 19 bp, Homo sapiens
ccagtccctgggggaagcc

SEQ ID NO: 2786917 - DNA, 17 bp, Homo sapiens
ccagtcgagccctgcag

SEQ ID NO: 2786918 - DNA, 18 bp, Homo sapiens
ccagtctggaatgcagtg

SEQ ID NO: 2786919 - DNA, 20 bp, Homo sapiens
ccagtctggaatgcagtggt

SEQ ID NO: 2786920 - DNA, 16 bp, Homo sapiens
ccagtctgggctgccg

SEQ ID NO: 2786921 - DNA, 16 bp, Homo sapiens
ccagtctgttccccat

SEQ ID NO: 2786922 - DNA, 16 bp, Homo sapiens
ccagtgaaccaaagag

SEQ ID NO: 2786923 - DNA, 21 bp, Homo sapiens
ccagtgatgctaaaggttgta

SEQ ID NO: 2786924 - DNA, 20 bp, Homo sapiens
ccagtgcacttgctggaaga

SEQ ID NO: 2786925 - DNA, 13 bp, Homo sapiens
ccagtgccacaga

SEQ ID NO: 2786926 - DNA, 15 bp, Homo sapiens
ccagtgccacagaga

SEQ ID NO: 2786927 - DNA, 16 bp, Homo sapiens
ccagtgccacagagaa

SEQ ID NO: 2786928 - DNA, 15 bp, Homo sapiens
ccagtgccgcctgtg

SEQ ID NO: 2786929 - DNA, 20 bp, Homo sapiens
ccagtgccttacctcctgcc

SEQ ID NO: 2786930 - DNA, 21 bp, Homo sapiens
ccagtgccttacctcctgccc

SEQ ID NO: 2786931 - DNA, 20 bp, Homo sapiens
ccagtgggaggtgagaccac

SEQ ID NO: 2786932 - DNA, 23 bp, Homo sapiens
ccagtgggaggtgagaccacctc

SEQ ID NO: 2786933 - DNA, 14 bp, Homo sapiens
ccagtggttgctgt

SEQ ID NO: 2786934 - DNA, 14 bp, Homo sapiens
ccagtgtactgctt

SEQ ID NO: 2786935 - DNA, 15 bp, Homo sapiens
ccagtgtactgcttt

SEQ ID NO: 2786936 - DNA, 21 bp, Homo sapiens
ccagtgtactgctttcaactt

SEQ ID NO: 2786937 - DNA, 14 bp, Homo sapiens
ccagtgtagccttg

SEQ ID NO: 2786938 - DNA, 23 bp, Homo sapiens
ccagtgtttagaagagcctgact

SEQ ID NO: 2786939 - DNA, 17 bp, Homo sapiens
ccagttatgtgaatgat

SEQ ID NO: 2786940 - DNA, 14 bp, Homo sapiens
ccagttcaggagtc

SEQ ID NO: 2786941 - DNA, 18 bp, Homo sapiens
ccagttcaggagtcccaa

SEQ ID NO: 2786942 - DNA, 21 bp, Homo sapiens
ccagttcctttcaatggtttg

SEQ ID NO: 2786943 - DNA, 15 bp, Homo sapiens
ccagttctgctcctc

SEQ ID NO: 2786944 - DNA, 19 bp, Homo sapiens
ccagttgggagcactggag

SEQ ID NO: 2786945 - DNA, 17 bp, Homo sapiens
ccagttgggtggatgcc

SEQ ID NO: 2786946 - DNA, 13 bp, Homo sapiens
ccagtttcccacc

SEQ ID NO: 2786947 - DNA, 14 bp, Homo sapiens
ccagtttcccacca

SEQ ID NO: 2786948 - DNA, 23 bp, Homo sapiens
ccagtttgcagaaaagcacctgc

SEQ ID NO: 2786949 - DNA, 22 bp, Homo sapiens
ccataaacacccatgaatcaaa

SEQ ID NO: 2786950 - DNA, 15 bp, Homo sapiens
ccataaggaatgtag

SEQ ID NO: 2786951 - DNA, 20 bp, Homo sapiens
ccataattatgacagttata

SEQ ID NO: 2786952 - DNA, 21 bp, Homo sapiens
ccataattttcttcatgcaat

SEQ ID NO: 2786953 - DNA, 17 bp, Homo sapiens
ccatacacatccccagc

SEQ ID NO: 2786954 - DNA, 16 bp, Homo sapiens
ccatagatcttctgaa

SEQ ID NO: 2786955 - DNA, 20 bp, Homo sapiens
ccatagatcttctgaaatga

SEQ ID NO: 2786956 - DNA, 21 bp, Homo sapiens
ccatagcaagattgcttaaaa

SEQ ID NO: 2786957 - DNA, 15 bp, Homo sapiens
ccatatcagacctct

SEQ ID NO: 2786958 - DNA, 22 bp, Homo sapiens
ccatatcagacctctgatccct

SEQ ID NO: 2786959 - DNA, 15 bp, Homo sapiens
ccatattctgttggc

SEQ ID NO: 2786960 - DNA, 18 bp, Homo sapiens
ccatattctgttggccag

SEQ ID NO: 2786961 - DNA, 19 bp, Homo sapiens
ccatcacctactcacacag

SEQ ID NO: 2786962 - DNA, 14 bp, Homo sapiens
ccatcactggagca

SEQ ID NO: 2786963 - DNA, 15 bp, Homo sapiens
ccatcagaggctggg

SEQ ID NO: 2786964 - DNA, 12 bp, Homo sapiens
ccatcagctccc

SEQ ID NO: 2786965 - DNA, 22 bp, Homo sapiens
ccatcagggtgggccactctcc

SEQ ID NO: 2786966 - DNA, 17 bp, Homo sapiens
ccatcaggttccatccc

SEQ ID NO: 2786967 - DNA, 14 bp, Homo sapiens
ccatcagttactgg

SEQ ID NO: 2786968 - DNA, 20 bp, Homo sapiens
ccatcatatcctttgcccca

SEQ ID NO: 2786969 - DNA, 13 bp, Homo sapiens
ccatcatgtctgg

SEQ ID NO: 2786970 - DNA, 20 bp, Homo sapiens
ccatcatgtgcctggaaatt

SEQ ID NO: 2786971 - DNA, 18 bp, Homo sapiens
ccatccaggttcagcttg

SEQ ID NO: 2786972 - DNA, 20 bp, Homo sapiens
ccatcccctttcctccccac

SEQ ID NO: 2786973 - DNA, 18 bp, Homo sapiens
ccatcctgcagcctcctc

SEQ ID NO: 2786974 - DNA, 21 bp, Homo sapiens
ccatcctgcagcctcctcctg

SEQ ID NO: 2786975 - DNA, 12 bp, Homo sapiens
ccatccttccca

SEQ ID NO: 2786976 - DNA, 16 bp, Homo sapiens
ccatctaagctgcagc

SEQ ID NO: 2786977 - DNA, 21 bp, Homo sapiens
ccatctaagctgcagcttcct

SEQ ID NO: 2786978 - DNA, 14 bp, Homo sapiens
ccatctccaccctg

SEQ ID NO: 2786979 - DNA, 16 bp, Homo sapiens
ccatctcctttcaggg

SEQ ID NO: 2786980 - DNA, 19 bp, Homo sapiens
ccatctgtcttgccagcca

SEQ ID NO: 2786981 - DNA, 22 bp, Homo sapiens
ccatctgtcttgccagccagaa

SEQ ID NO: 2786982 - DNA, 21 bp, Homo sapiens
ccatctgtttgagaatatgat

SEQ ID NO: 2786983 - DNA, 19 bp, Homo sapiens
ccatgaagacaggacagtg

SEQ ID NO: 2786984 - DNA, 18 bp, Homo sapiens
ccatgaagctggaagcac

SEQ ID NO: 2786985 - DNA, 20 bp, Homo sapiens
ccatgaagctggaagcactg

SEQ ID NO: 2786986 - DNA, 23 bp, Homo sapiens
ccatgaagctggaagcactgctg

SEQ ID NO: 2786987 - DNA, 15 bp, Homo sapiens
ccatgacctccagct

SEQ ID NO: 2786988 - DNA, 21 bp, Homo sapiens
ccatgagaagagggcctgtgg

SEQ ID NO: 2786989 - DNA, 21 bp, Homo sapiens
cccaggacaagcatggtccca

SEQ ID NO: 2786990 - DNA, 13 bp, Homo sapiens
cccaggacgccac

SEQ ID NO: 2786991 - DNA, 23 bp, Homo sapiens
cccaggacgccactcatttcatc

SEQ ID NO: 2786992 - DNA, 17 bp, Homo sapiens
cccaggagacagttcaa

SEQ ID NO: 2786993 - DNA, 15 bp, Homo sapiens
cccaggagagccagc

SEQ ID NO: 2786994 - DNA, 18 bp, Homo sapiens
cccaggagagccagccct

SEQ ID NO: 2786995 - DNA, 23 bp, Homo sapiens
cccaggagagccagccctccctg

SEQ ID NO: 2786996 - DNA, 13 bp, Homo sapiens
cccaggagccccg

SEQ ID NO: 2786997 - DNA, 14 bp, Homo sapiens
cccaggagccccga

SEQ ID NO: 2786998 - DNA, 22 bp, Homo sapiens
cccaggagtttgaggctgcagc

SEQ ID NO: 2786999 - DNA, 11 bp, Homo sapiens
cccaggcaggt

SEQ ID NO: 2787000 - DNA, 23 bp, Homo sapiens
cccaggcaggtcttgaactcctg

SEQ ID NO: 2787001 - DNA, 17 bp, Homo sapiens
cccaggccaggccacca

SEQ ID NO: 2787002 - DNA, 14 bp, Homo sapiens
cccaggccccatga

SEQ ID NO: 2787003 - DNA, 20 bp, Homo sapiens
cccaggccccatgacctcca

SEQ ID NO: 2787004 - DNA, 11 bp, Homo sapiens
cccaggcccct

SEQ ID NO: 2787005 - DNA, 22 bp, Homo sapiens
cccaggcccctgccaccctggg

SEQ ID NO: 2787006 - DNA, 15 bp, Homo sapiens
cccaggcctgcctgt

SEQ ID NO: 2787007 - DNA, 16 bp, Homo sapiens
cccaggcctgcctgtt

SEQ ID NO: 2787008 - DNA, 18 bp, Homo sapiens
cccaggctggcgtgcagt

SEQ ID NO: 2787009 - DNA, 20 bp, Homo sapiens
cccaggctggcgtgcagtgg

SEQ ID NO: 2787010 - DNA, 21 bp, Homo sapiens
cccagggaagtttctgggtgc

SEQ ID NO: 2787011 - DNA, 16 bp, Homo sapiens
cccagggcatcccatg

SEQ ID NO: 2787012 - DNA, 18 bp, Homo sapiens
cccagggcatcccatggg

SEQ ID NO: 2787013 - DNA, 19 bp, Homo sapiens
cccagggcatcccatgggg

SEQ ID NO: 2787014 - DNA, 15 bp, Homo sapiens
cccagggccagggcc

SEQ ID NO: 2787015 - DNA, 17 bp, Homo sapiens
cccagggcccccacagg

SEQ ID NO: 2787016 - DNA, 18 bp, Homo sapiens
cccagggctcagcctggt

SEQ ID NO: 2787017 - DNA, 20 bp, Homo sapiens
cccagggctcagcctggtgg

SEQ ID NO: 2787018 - DNA, 15 bp, Homo sapiens
cccaggggagagggt

SEQ ID NO: 2787019 - DNA, 18 bp, Homo sapiens
cccaggggcccacaggga

SEQ ID NO: 2787020 - DNA, 22 bp, Homo sapiens
cccaggtctctccactgctctc

SEQ ID NO: 2787021 - DNA, 18 bp, Homo sapiens
cccaggtggctgacccag

SEQ ID NO: 2787022 - DNA, 17 bp, Homo sapiens
cccaggttggcctggtg

SEQ ID NO: 2787023 - DNA, 20 bp, Homo sapiens
cccaggttggcctggtggcc

SEQ ID NO: 2787024 - DNA, 23 bp, Homo sapiens
cccagtccccgtgccccgcctcc

SEQ ID NO: 2787025 - DNA, 23 bp, Homo sapiens
cccagtccctgggggaagccctg

SEQ ID NO: 2787026 - DNA, 18 bp, Homo sapiens
cccagtctggaatgcagt

SEQ ID NO: 2787027 - DNA, 19 bp, Homo sapiens
cccagtgtaaagaataaat

SEQ ID NO: 2787028 - DNA, 20 bp, Homo sapiens
cccagttctgctcctctcca

SEQ ID NO: 2787029 - DNA, 22 bp, Homo sapiens
cccagttctgctcctctccagg

SEQ ID NO: 2787030 - DNA, 22 bp, Homo sapiens
cccagtttgcagaaaagcacct

SEQ ID NO: 2787031 - DNA, 23 bp, Homo sapiens
cccatcacctactcacacaggca

SEQ ID NO: 2787032 - DNA, 14 bp, Homo sapiens
cccatcagaaggag

SEQ ID NO: 2787033 - DNA, 16 bp, Homo sapiens
cccatccatcagctcc

SEQ ID NO: 2787034 - DNA, 14 bp, Homo sapiens
cccatccccagcga

SEQ ID NO: 2787035 - DNA, 15 bp, Homo sapiens
cccatcccccactgc

SEQ ID NO: 2787036 - DNA, 19 bp, Homo sapiens
cccatcccccactgccaca

SEQ ID NO: 2787037 - DNA, 12 bp, Homo sapiens
cccatccccttt

SEQ ID NO: 2787038 - DNA, 16 bp, Homo sapiens
cccatcccctttcctc

SEQ ID NO: 2787039 - DNA, 19 bp, Homo sapiens
cccatcccctttcctcccc

SEQ ID NO: 2787040 - DNA, 23 bp, Homo sapiens
cccatcccctttcctccccacct

SEQ ID NO: 2787041 - DNA, 13 bp, Homo sapiens
cccatctccccct

SEQ ID NO: 2787042 - DNA, 14 bp, Homo sapiens
cccatctctcttcc

SEQ ID NO: 2787043 - DNA, 18 bp, Homo sapiens
cccatctcttcctaccca

SEQ ID NO: 2787044 - DNA, 19 bp, Homo sapiens
cccatctgaaccactttgc

SEQ ID NO: 2787045 - DNA, 12 bp, Homo sapiens
cccatctgctcc

SEQ ID NO: 2787046 - DNA, 14 bp, Homo sapiens
cccatctgctcctc

SEQ ID NO: 2787047 - DNA, 23 bp, Homo sapiens
cccatctgctcctcccattcccc

SEQ ID NO: 2787048 - DNA, 18 bp, Homo sapiens
cccatgaagacaggacag

SEQ ID NO: 2787049 - DNA, 14 bp, Homo sapiens
cccatgacctccag

SEQ ID NO: 2787050 - DNA, 23 bp, Homo sapiens
cccatgatgccgctcttctgtca

SEQ ID NO: 2787051 - DNA, 17 bp, Homo sapiens
cccatgctgaattattt

SEQ ID NO: 2787052 - DNA, 12 bp, Homo sapiens
cccatgctttcc

SEQ ID NO: 2787053 - DNA, 22 bp, Homo sapiens
cccatgtctttctccaaagtta

SEQ ID NO: 2787054 - DNA, 23 bp, Homo sapiens
cccatgtgcatggaaatgtcctc

SEQ ID NO: 2787055 - DNA, 13 bp, Homo sapiens
cccatgtgccaag

SEQ ID NO: 2787056 - DNA, 15 bp, Homo sapiens
cccattcacagagcc

SEQ ID NO: 2787057 - DNA, 18 bp, Homo sapiens
cccattcacagagccttt

SEQ ID NO: 2787058 - DNA, 14 bp, Homo sapiens
cccattcagacact

SEQ ID NO: 2787059 - DNA, 17 bp, Homo sapiens
cccattctctctcctgt

SEQ ID NO: 2787060 - DNA, 19 bp, Homo sapiens
cccattctctctcctgtcc

SEQ ID NO: 2787061 - DNA, 14 bp, Homo sapiens
cccattctgcctgc

SEQ ID NO: 2787062 - DNA, 20 bp, Homo sapiens
cccattctgcctgcccaggc

SEQ ID NO: 2787063 - DNA, 11 bp, Homo sapiens
cccatttcctt

SEQ ID NO: 2787064 - DNA, 17 bp, Homo sapiens
cccatttctatttattt

SEQ ID NO: 2787065 - DNA, 20 bp, Homo sapiens
cccatttctatttatttact

SEQ ID NO: 2787066 - DNA, 22 bp, Homo sapiens
cccattttggaagttttcagga

SEQ ID NO: 2787067 - DNA, 14 bp, Homo sapiens
ccccaaagagcctg

SEQ ID NO: 2787068 - DNA, 20 bp, Homo sapiens
ccccaaagagcctggagaag

SEQ ID NO: 2787069 - DNA, 15 bp, Homo sapiens
ccccaacctttccct

SEQ ID NO: 2787070 - DNA, 21 bp, Homo sapiens
ccccaacctttccctcacccc

SEQ ID NO: 2787071 - DNA, 13 bp, Homo sapiens
ccccaactcctgg

SEQ ID NO: 2787072 - DNA, 17 bp, Homo sapiens
ccccaagctgttttctt

SEQ ID NO: 2787073 - DNA, 15 bp, Homo sapiens
ccccaccagccacct

SEQ ID NO: 2787074 - DNA, 17 bp, Homo sapiens
ccccaccagccacctct

SEQ ID NO: 2787075 - DNA, 17 bp, Homo sapiens
ccccacccccttcagtg

SEQ ID NO: 2787076 - DNA, 18 bp, Homo sapiens
ccccacctcatgcctggc

SEQ ID NO: 2787077 - DNA, 13 bp, Homo sapiens
ccccacctccgcc

SEQ ID NO: 2787078 - DNA, 14 bp, Homo sapiens
ccccacctggctca

SEQ ID NO: 2787079 - DNA, 21 bp, Homo sapiens
ccctcctcacagttgccatgt

SEQ ID NO: 2787080 - DNA, 14 bp, Homo sapiens
ccctcctccccttc

SEQ ID NO: 2787081 - DNA, 17 bp, Homo sapiens
ccctcgctgtcctgctg

SEQ ID NO: 2787082 - DNA, 18 bp, Homo sapiens
ccctcgtggacacctgcc

SEQ ID NO: 2787083 - DNA, 19 bp, Homo sapiens
ccctcgtggacacctgccc

SEQ ID NO: 2787084 - DNA, 23 bp, Homo sapiens
ccctctaacccccagtgccacag

SEQ ID NO: 2787085 - DNA, 13 bp, Homo sapiens
ccctctcccaggc

SEQ ID NO: 2787086 - DNA, 13 bp, Homo sapiens
ccctctcctgcct

SEQ ID NO: 2787087 - DNA, 17 bp, Homo sapiens
ccctctcctgcctactc

SEQ ID NO: 2787088 - DNA, 14 bp, Homo sapiens
ccctctcttgcctt

SEQ ID NO: 2787089 - DNA, 22 bp, Homo sapiens
ccctctgaatggtccagggttg

SEQ ID NO: 2787090 - DNA, 12 bp, Homo sapiens
ccctcttccttc

SEQ ID NO: 2787091 - DNA, 14 bp, Homo sapiens
ccctcttccttccc

SEQ ID NO: 2787092 - DNA, 22 bp, Homo sapiens
ccctcttgacccatctccccct

SEQ ID NO: 2787093 - DNA, 15 bp, Homo sapiens
ccctgaaaacccaga

SEQ ID NO: 2787094 - DNA, 16 bp, Homo sapiens
ccctgaaaacccagag

SEQ ID NO: 2787095 - DNA, 20 bp, Homo sapiens
ccctgaaagtgacagagacc

SEQ ID NO: 2787096 - DNA, 13 bp, Homo sapiens
ccctgaaccatcc

SEQ ID NO: 2787097 - DNA, 21 bp, Homo sapiens
ccctgaagatttcagaggctg

SEQ ID NO: 2787098 - DNA, 14 bp, Homo sapiens
ccctgacctcccag

SEQ ID NO: 2787099 - DNA, 20 bp, Homo sapiens
ccctgacctcccagccctat

SEQ ID NO: 2787100 - DNA, 17 bp, Homo sapiens
ccctgactctctgtgac

SEQ ID NO: 2787101 - DNA, 18 bp, Homo sapiens
ccctgactctctgtgacc

SEQ ID NO: 2787102 - DNA, 18 bp, Homo sapiens
ccctgagaaacccaccag

SEQ ID NO: 2787103 - DNA, 22 bp, Homo sapiens
ccctgagaaacccaccagccta

SEQ ID NO: 2787104 - DNA, 19 bp, Homo sapiens
ccctgagcctgacctttct

SEQ ID NO: 2787105 - DNA, 19 bp, Homo sapiens
ccctgaggagtctgaggtc

SEQ ID NO: 2787106 - DNA, 21 bp, Homo sapiens
ccctgaggagtctgaggtcct

SEQ ID NO: 2787107 - DNA, 20 bp, Homo sapiens
ccctgagtggatctccaagg

SEQ ID NO: 2787108 - DNA, 22 bp, Homo sapiens
ccctgagtggatctccaaggac

SEQ ID NO: 2787109 - DNA, 22 bp, Homo sapiens
  misc_feature (13)..(13): n is a, c, g or t
ccctgcacctgcnttgtccctg

SEQ ID NO: 2787110 - DNA, 22 bp, Homo sapiens
ccctgcacttgcagactctaca

SEQ ID NO: 2787111 - DNA, 16 bp, Homo sapiens
ccctgcagaccctgcc

SEQ ID NO: 2787112 - DNA, 13 bp, Homo sapiens
ccctgcagcctgg

SEQ ID NO: 2787113 - DNA, 19 bp, Homo sapiens
ccctgcagcttgtagccag

SEQ ID NO: 2787114 - DNA, 21 bp, Homo sapiens
ccctgcagcttgtagccagcc

SEQ ID NO: 2787115 - DNA, 15 bp, Homo sapiens
ccctgccaccctggg

SEQ ID NO: 2787116 - DNA, 13 bp, Homo sapiens
ccctgccacctgt

SEQ ID NO: 2787117 - DNA, 16 bp, Homo sapiens
ccctgccacctgtctg

SEQ ID NO: 2787118 - DNA, 17 bp, Homo sapiens
ccctgccacctgtctgt

SEQ ID NO: 2787119 - DNA, 18 bp, Homo sapiens
ccctgccacctgtctgtc

SEQ ID NO: 2787120 - DNA, 14 bp, Homo sapiens
ccctgccagtgcct

SEQ ID NO: 2787121 - DNA, 15 bp, Homo sapiens
ccctgccagtgcctt

SEQ ID NO: 2787122 - DNA, 15 bp, Homo sapiens
ccctgcccctcttcc

SEQ ID NO: 2787123 - DNA, 17 bp, Homo sapiens
ccctgcccggctgcgga

SEQ ID NO: 2787124 - DNA, 11 bp, Homo sapiens
ccctgccctgc

SEQ ID NO: 2787125 - DNA, 15 bp, Homo sapiens
ccctgccctgccacc

SEQ ID NO: 2787126 - DNA, 17 bp, Homo sapiens
ccctgccctgccacctg

SEQ ID NO: 2787127 - DNA, 13 bp, Homo sapiens
ccctgccgcctca

SEQ ID NO: 2787128 - DNA, 12 bp, Homo sapiens
ccctgcctggag

SEQ ID NO: 2787129 - DNA, 14 bp, Homo sapiens
ccctgcctggagga

SEQ ID NO: 2787130 - DNA, 22 bp, Homo sapiens
ccctgcctggaggacctgagcc

SEQ ID NO: 2787131 - DNA, 20 bp, Homo sapiens
ccctgctgccgcctcccagc

SEQ ID NO: 2787132 - DNA, 22 bp, Homo sapiens
ccctgctgcggccagcctgact

SEQ ID NO: 2787133 - DNA, 20 bp, Homo sapiens
ccctgctggttcagggttgg

SEQ ID NO: 2787134 - DNA, 18 bp, Homo sapiens
ccctggaactgtctctca

SEQ ID NO: 2787135 - DNA, 18 bp, Homo sapiens
ccctggagcggctctcct

SEQ ID NO: 2787136 - DNA, 16 bp, Homo sapiens
ccctggatcagcgtgg

SEQ ID NO: 2787137 - DNA, 10 bp, Homo sapiens
ccctggcctc

SEQ ID NO: 2787138 - DNA, 15 bp, Homo sapiens
ccctggcctggctct

SEQ ID NO: 2787139 - DNA, 22 bp, Homo sapiens
ccctggcctttgaggcaaaggc

SEQ ID NO: 2787140 - DNA, 19 bp, Homo sapiens
ccctggctgaccccaaaga

SEQ ID NO: 2787141 - DNA, 17 bp, Homo sapiens
ccctgggattcaggaaa

SEQ ID NO: 2787142 - DNA, 14 bp, Homo sapiens
ccctgggccccacc

SEQ ID NO: 2787143 - DNA, 20 bp, Homo sapiens
ccctgggccccaccacctag

SEQ ID NO: 2787144 - DNA, 22 bp, Homo sapiens
ccctgggccccaccacctaggc

SEQ ID NO: 2787145 - DNA, 17 bp, Homo sapiens
ccctgggcctgctgctg

SEQ ID NO: 2787146 - DNA, 13 bp, Homo sapiens
ccctgggctctgc

SEQ ID NO: 2787147 - DNA, 15 bp, Homo sapiens
ccctgggctctgccc

SEQ ID NO: 2787148 - DNA, 12 bp, Homo sapiens
ccctggggcctg

SEQ ID NO: 2787149 - DNA, 15 bp, Homo sapiens
ccctggggcttctcc

SEQ ID NO: 2787150 - DNA, 23 bp, Homo sapiens
ccctggtaataagtactgtgtac

SEQ ID NO: 2787151 - DNA, 13 bp, Homo sapiens
ccctggtccttcc

SEQ ID NO: 2787152 - DNA, 16 bp, Homo sapiens
ccctggtccttccagg

SEQ ID NO: 2787153 - DNA, 16 bp, Homo sapiens
ccctggtggcagtggg

SEQ ID NO: 2787154 - DNA, 18 bp, Homo sapiens
ccctggttatattctcac

SEQ ID NO: 2787155 - DNA, 19 bp, Homo sapiens
ccctgtcaccaagctcaca

SEQ ID NO: 2787156 - DNA, 20 bp, Homo sapiens
ccctgtgggggcggctgtgg

SEQ ID NO: 2787157 - DNA, 14 bp, Homo sapiens
ccctgtttcctgag

SEQ ID NO: 2787158 - DNA, 20 bp, Homo sapiens
cccttaaggaggtagctccc

SEQ ID NO: 2787159 - DNA, 19 bp, Homo sapiens
cccttactatgatctcagg

SEQ ID NO: 2787160 - DNA, 17 bp, Homo sapiens
cccttcagtgcccacca

SEQ ID NO: 2787161 - DNA, 20 bp, Homo sapiens
cccttccatgtcgcctctgc

SEQ ID NO: 2787162 - DNA, 18 bp, Homo sapiens
cccttcccatctcttcct

SEQ ID NO: 2787163 - DNA, 20 bp, Homo sapiens
cccttcctacagatagtcaa

SEQ ID NO: 2787164 - DNA, 17 bp, Homo sapiens
cccttcctgaccctccg

SEQ ID NO: 2787165 - DNA, 13 bp, Homo sapiens
cccttcctggaca

SEQ ID NO: 2787166 - DNA, 16 bp, Homo sapiens
cccttcctggacagct

SEQ ID NO: 2787167 - DNA, 17 bp, Homo sapiens
cccttcctggacagctg

SEQ ID NO: 2787168 - DNA, 22 bp, Homo sapiens
cccttcctggacagctgtgcct

SEQ ID NO: 2787169 - DNA, 13 bp, Homo sapiens
cccttcctttcct

SEQ ID NO: 2787170 - DNA, 19 bp, Homo sapiens
cctatgtcaatttgtatat

SEQ ID NO: 2787171 - DNA, 18 bp, Homo sapiens
cctatgtcatttcatttc

SEQ ID NO: 2787172 - DNA, 21 bp, Homo sapiens
cctatgtcctaaggacacact

SEQ ID NO: 2787173 - DNA, 23 bp, Homo sapiens
cctatgtcctaaggacacactaa

SEQ ID NO: 2787174 - DNA, 24 bp, Homo sapiens
cctatgtcctaaggacacactaat

SEQ ID NO: 2787175 - DNA, 22 bp, Homo sapiens
cctattctattgcagttataga

SEQ ID NO: 2787176 - DNA, 19 bp, Homo sapiens
cctattgtgcaatgtaaat

SEQ ID NO: 2787177 - DNA, 14 bp, Homo sapiens
cctatttttcagaa

SEQ ID NO: 2787178 - DNA, 17 bp, Homo sapiens
cctcaaaaaaagccttt

SEQ ID NO: 2787179 - DNA, 12 bp, Homo sapiens
cctcaaatacat

SEQ ID NO: 2787180 - DNA, 16 bp, Homo sapiens
cctcaaatgacccaaa

SEQ ID NO: 2787181 - DNA, 19 bp, Homo sapiens
cctcaaatgacccaaagac

SEQ ID NO: 2787182 - DNA, 15 bp, Homo sapiens
cctcaagctgcatct

SEQ ID NO: 2787183 - DNA, 16 bp, Homo sapiens
cctcaatgtgaccagg

SEQ ID NO: 2787184 - DNA, 16 bp, Homo sapiens
cctcaatttctgaaca

SEQ ID NO: 2787185 - DNA, 14 bp, Homo sapiens
cctcaccaataact

SEQ ID NO: 2787186 - DNA, 17 bp, Homo sapiens
cctcaccaataacttca

SEQ ID NO: 2787187 - DNA, 24 bp, Homo sapiens
cctcaccaataacttcagagaagt

SEQ ID NO: 2787188 - DNA, 17 bp, Homo sapiens
cctcacccccagctttg

SEQ ID NO: 2787189 - DNA, 20 bp, Homo sapiens
cctcaccccctcccaccccc

SEQ ID NO: 2787190 - DNA, 17 bp, Homo sapiens
cctcaccccgtctgggg

SEQ ID NO: 2787191 - DNA, 18 bp, Homo sapiens
cctcacgcccagcctcct

SEQ ID NO: 2787192 - DNA, 17 bp, Homo sapiens
cctcactccacactggc

SEQ ID NO: 2787193 - DNA, 14 bp, Homo sapiens
cctcactgccttcc

SEQ ID NO: 2787194 - DNA, 19 bp, Homo sapiens
cctcactgccttccaggag

SEQ ID NO: 2787195 - DNA, 21 bp, Homo sapiens
cctcactgctggggagtccct

SEQ ID NO: 2787196 - DNA, 22 bp, Homo sapiens
cctcactgtcagcgtttctcca

SEQ ID NO: 2787197 - DNA, 22 bp, Homo sapiens
cctcacttttaatgaacaaatg

SEQ ID NO: 2787198 - DNA, 22 bp, Homo sapiens
cctcagaccaactctctcctgt

SEQ ID NO: 2787199 - DNA, 14 bp, Homo sapiens
cctcagcatcctgg

SEQ ID NO: 2787200 - DNA, 16 bp, Homo sapiens
cctcagcctagaccct

SEQ ID NO: 2787201 - DNA, 22 bp, Homo sapiens
cctcagcctcccaaagtgctgg

SEQ ID NO: 2787202 - DNA, 23 bp, Homo sapiens
cctcagcctcccaaagtgctggg

SEQ ID NO: 2787203 - DNA, 21 bp, Homo sapiens
cctcagggacagagacacctg

SEQ ID NO: 2787204 - DNA, 13 bp, Homo sapiens
cctcagtcctgga

SEQ ID NO: 2787205 - DNA, 14 bp, Homo sapiens
cctcagtcctggaa

SEQ ID NO: 2787206 - DNA, 15 bp, Homo sapiens
cctcagtcctggaag

SEQ ID NO: 2787207 - DNA, 12 bp, Homo sapiens
cctcagtgctcg

SEQ ID NO: 2787208 - DNA, 19 bp, Homo sapiens
cctcagttttatcattttc

SEQ ID NO: 2787209 - DNA, 15 bp, Homo sapiens
cctcatccgaggcag

SEQ ID NO: 2787210 - DNA, 16 bp, Homo sapiens
cctcatgacagccaga

SEQ ID NO: 2787211 - DNA, 18 bp, Homo sapiens
cctcatgacagccagagc

SEQ ID NO: 2787212 - DNA, 17 bp, Homo sapiens
cctcattcaggaaaact

SEQ ID NO: 2787213 - DNA, 22 bp, Homo sapiens
cctcattcaggaaaactgacag

SEQ ID NO: 2787214 - DNA, 13 bp, Homo sapiens
cctcattcctgaa

SEQ ID NO: 2787215 - DNA, 19 bp, Homo sapiens
cctccaacaataaagagct

SEQ ID NO: 2787216 - DNA, 20 bp, Homo sapiens
cctccaacaataaagagctc

SEQ ID NO: 2787217 - DNA, 21 bp, Homo sapiens
cctccaagctccatctccact

SEQ ID NO: 2787218 - DNA, 15 bp, Homo sapiens
cctccacagccgcag

SEQ ID NO: 2787219 - DNA, 17 bp, Homo sapiens
cctccacagccgcagcc

SEQ ID NO: 2787220 - DNA, 14 bp, Homo sapiens
cctccaccccagga

SEQ ID NO: 2787221 - DNA, 12 bp, Homo sapiens
cctccagctgga

SEQ ID NO: 2787222 - DNA, 22 bp, Homo sapiens
cctccagctggaattgctgctc

SEQ ID NO: 2787223 - DNA, 15 bp, Homo sapiens
cctccaggagcctac

SEQ ID NO: 2787224 - DNA, 16 bp, Homo sapiens
cctccaggcatgctgg

SEQ ID NO: 2787225 - DNA, 17 bp, Homo sapiens
cctccaggcatgctggc

SEQ ID NO: 2787226 - DNA, 14 bp, Homo sapiens
cctccagggccacg

SEQ ID NO: 2787227 - DNA, 17 bp, Homo sapiens
cctccagggccacgtgc

SEQ ID NO: 2787228 - DNA, 21 bp, Homo sapiens
cctccagggccacgtgccagg

SEQ ID NO: 2787229 - DNA, 15 bp, Homo sapiens
cctccatgctgcctc

SEQ ID NO: 2787230 - DNA, 15 bp, Homo sapiens
cctcccaaccccagg

SEQ ID NO: 2787231 - DNA, 22 bp, Homo sapiens
cctcccacaatctgggactttc

SEQ ID NO: 2787232 - DNA, 17 bp, Homo sapiens
cctcccacactccccca

SEQ ID NO: 2787233 - DNA, 16 bp, Homo sapiens
cctcccaccatgcgct

SEQ ID NO: 2787234 - DNA, 13 bp, Homo sapiens
cctcccaccccca

SEQ ID NO: 2787235 - DNA, 12 bp, Homo sapiens
cctcccagccct

SEQ ID NO: 2787236 - DNA, 20 bp, Homo sapiens
cctcccagccctatggatgt

SEQ ID NO: 2787237 - DNA, 21 bp, Homo sapiens
cctcccagggccagggccctg

SEQ ID NO: 2787238 - DNA, 14 bp, Homo sapiens
cctcccattcccct

SEQ ID NO: 2787239 - DNA, 18 bp, Homo sapiens
cctccccaccttccccag

SEQ ID NO: 2787240 - DNA, 23 bp, Homo sapiens
cctccccaccttccccagactca

SEQ ID NO: 2787241 - DNA, 12 bp, Homo sapiens
cctccccagggg

SEQ ID NO: 2787242 - DNA, 21 bp, Homo sapiens
cctccccattagagtcagcct

SEQ ID NO: 2787243 - DNA, 15 bp, Homo sapiens
cctcccccagagggg

SEQ ID NO: 2787244 - DNA, 17 bp, Homo sapiens
cctccccccactgcagg

SEQ ID NO: 2787245 - DNA, 20 bp, Homo sapiens
cctccccccactgcaggccc

SEQ ID NO: 2787246 - DNA, 19 bp, Homo sapiens
cctccccccagcccctcct

SEQ ID NO: 2787247 - DNA, 22 bp, Homo sapiens
cctccccccagcccctcctccc

SEQ ID NO: 2787248 - DNA, 12 bp, Homo sapiens
cctcccccctgt

SEQ ID NO: 2787249 - DNA, 14 bp, Homo sapiens
cctccccctgccag

SEQ ID NO: 2787250 - DNA, 17 bp, Homo sapiens
cctccccctgccagtgc

SEQ ID NO: 2787251 - DNA, 20 bp, Homo sapiens
cctccccctgccagtgcctt

SEQ ID NO: 2787252 - DNA, 13 bp, Homo sapiens
cctcccctatcca

SEQ ID NO: 2787253 - DNA, 17 bp, Homo sapiens
cctcccctatccaccca

SEQ ID NO: 2787254 - DNA, 14 bp, Homo sapiens
cctcccctcccccc

SEQ ID NO: 2787255 - DNA, 16 bp, Homo sapiens
cctccccttcctgcac

SEQ ID NO: 2787256 - DNA, 17 bp, Homo sapiens
cctcccgagtagctggg

SEQ ID NO: 2787257 - DNA, 18 bp, Homo sapiens
cctcccgagtagctggga

SEQ ID NO: 2787258 - DNA, 13 bp, Homo sapiens
cctccctccaccc

SEQ ID NO: 2787259 - DNA, 15 bp, Homo sapiens
cctccctccacccca

SEQ ID NO: 2787260 - DNA, 18 bp, Homo sapiens
cctccctcttccttcccc

SEQ ID NO: 2787261 - DNA, 14 bp, Homo sapiens
cctgggaccagggc

SEQ ID NO: 2787262 - DNA, 17 bp, Homo sapiens
cctgggagaacctcagg

SEQ ID NO: 2787263 - DNA, 19 bp, Homo sapiens
cctgggagaacctcaggct

SEQ ID NO: 2787264 - DNA, 16 bp, Homo sapiens
cctgggaggcggagag

SEQ ID NO: 2787265 - DNA, 23 bp, Homo sapiens
cctgggaggcggagagtacagtg

SEQ ID NO: 2787266 - DNA, 18 bp, Homo sapiens
cctgggagtgagctggtt

SEQ ID NO: 2787267 - DNA, 13 bp, Homo sapiens
cctgggcagaaag

SEQ ID NO: 2787268 - DNA, 18 bp, Homo sapiens
cctgggcccgctttgcct

SEQ ID NO: 2787269 - DNA, 14 bp, Homo sapiens
cctgggccctgggg

SEQ ID NO: 2787270 - DNA, 19 bp, Homo sapiens
cctgggcctatggagagcc

SEQ ID NO: 2787271 - DNA, 20 bp, Homo sapiens
cctgggcctatggagagccc

SEQ ID NO: 2787272 - DNA, 15 bp, Homo sapiens
cctgggcctgctgct

SEQ ID NO: 2787273 - DNA, 18 bp, Homo sapiens
cctgggcctgctgctgag

SEQ ID NO: 2787274 - DNA, 20 bp, Homo sapiens
cctgggcctgctgctgagaa

SEQ ID NO: 2787275 - DNA, 20 bp, Homo sapiens
cctgggctctgccccagctc

SEQ ID NO: 2787276 - DNA, 15 bp, Homo sapiens
cctggggagaaagta

SEQ ID NO: 2787277 - DNA, 19 bp, Homo sapiens
cctggggcctgtactgcct

SEQ ID NO: 2787278 - DNA, 22 bp, Homo sapiens
cctggggcctgtactgcctgct

SEQ ID NO: 2787279 - DNA, 21 bp, Homo sapiens
cctggggctcctttctccagc

SEQ ID NO: 2787280 - DNA, 20 bp, Homo sapiens
cctggggctctaacgcctga

SEQ ID NO: 2787281 - DNA, 17 bp, Homo sapiens
cctgggggcctggctgg

SEQ ID NO: 2787282 - DNA, 19 bp, Homo sapiens
cctgggggcctggctggct

SEQ ID NO: 2787283 - DNA, 15 bp, Homo sapiens
cctggggtgacccgg

SEQ ID NO: 2787284 - DNA, 18 bp, Homo sapiens
cctggggtgacccggcac

SEQ ID NO: 2787285 - DNA, 20 bp, Homo sapiens
cctgggtggctactctgtgc

SEQ ID NO: 2787286 - DNA, 19 bp, Homo sapiens
cctgggtggggctgctcct

SEQ ID NO: 2787287 - DNA, 23 bp, Homo sapiens
cctgggtggggctgctcctccag

SEQ ID NO: 2787288 - DNA, 23 bp, Homo sapiens
cctggtcacaggactctgcctcc

SEQ ID NO: 2787289 - DNA, 18 bp, Homo sapiens
cctggtccttccaggccc

SEQ ID NO: 2787290 - DNA, 14 bp, Homo sapiens
cctggtctgccctg

SEQ ID NO: 2787291 - DNA, 21 bp, Homo sapiens
cctggtgcccccgcccctggt

SEQ ID NO: 2787292 - DNA, 20 bp, Homo sapiens
cctggtggcagtgggagctg

SEQ ID NO: 2787293 - DNA, 13 bp, Homo sapiens
cctggtggggcag

SEQ ID NO: 2787294 - DNA, 15 bp, Homo sapiens
cctggtggggcagct

SEQ ID NO: 2787295 - DNA, 16 bp, Homo sapiens
cctggtggggcagctc

SEQ ID NO: 2787296 - DNA, 19 bp, Homo sapiens
cctggtggggcagctcctc

SEQ ID NO: 2787297 - DNA, 16 bp, Homo sapiens
cctgtaacaagccaga

SEQ ID NO: 2787298 - DNA, 18 bp, Homo sapiens
cctgtaacacaagccaca

SEQ ID NO: 2787299 - DNA, 22 bp, Homo sapiens
cctgtaacacaagccacagaag

SEQ ID NO: 2787300 - DNA, 16 bp, Homo sapiens
cctgtaatcccagcag

SEQ ID NO: 2787301 - DNA, 15 bp, Homo sapiens
cctgtactgcctgct

SEQ ID NO: 2787302 - DNA, 14 bp, Homo sapiens
cctgtagagtcact

SEQ ID NO: 2787303 - DNA, 17 bp, Homo sapiens
cctgtagagtcactgac

SEQ ID NO: 2787304 - DNA, 21 bp, Homo sapiens
cctgtagcatcttctggagtc

SEQ ID NO: 2787305 - DNA, 13 bp, Homo sapiens
cctgtagtcccag

SEQ ID NO: 2787306 - DNA, 19 bp, Homo sapiens
cctgtagtcccagccactc

SEQ ID NO: 2787307 - DNA, 21 bp, Homo sapiens
cctgtagttgcgtggactctg

SEQ ID NO: 2787308 - DNA, 16 bp, Homo sapiens
cctgtatttgttccca

SEQ ID NO: 2787309 - DNA, 12 bp, Homo sapiens
cctgtccaacct

SEQ ID NO: 2787310 - DNA, 23 bp, Homo sapiens
cctgtccaacctaacccctttcc

SEQ ID NO: 2787311 - DNA, 15 bp, Homo sapiens
cctgtccataaagta

SEQ ID NO: 2787312 - DNA, 16 bp, Homo sapiens
cctgtccataaagtaa

SEQ ID NO: 2787313 - DNA, 23 bp, Homo sapiens
cctgtcctttgttattatcctgc

SEQ ID NO: 2787314 - DNA, 14 bp, Homo sapiens
cctgtcgagacact

SEQ ID NO: 2787315 - DNA, 15 bp, Homo sapiens
cctgtcgagacactt

SEQ ID NO: 2787316 - DNA, 16 bp, Homo sapiens
cctgtcgattagactg

SEQ ID NO: 2787317 - DNA, 22 bp, Homo sapiens
cctgtcgattagactggacagc

SEQ ID NO: 2787318 - DNA, 14 bp, Homo sapiens
cctgtctgccagcc

SEQ ID NO: 2787319 - DNA, 19 bp, Homo sapiens
cctgtctgccagccagcag

SEQ ID NO: 2787320 - DNA, 21 bp, Homo sapiens
cctgtctgccagccagcagcc

SEQ ID NO: 2787321 - DNA, 23 bp, Homo sapiens
cctgtctgccagccagcagccag

SEQ ID NO: 2787322 - DNA, 17 bp, Homo sapiens
cctgtctttaaggaaaa

SEQ ID NO: 2787323 - DNA, 16 bp, Homo sapiens
cctgtgaacccaggac

SEQ ID NO: 2787324 - DNA, 13 bp, Homo sapiens
cctgtgaggcagg

SEQ ID NO: 2787325 - DNA, 17 bp, Homo sapiens
cctgtgcatgtatgtct

SEQ ID NO: 2787326 - DNA, 14 bp, Homo sapiens
cctgtgcccacgtg

SEQ ID NO: 2787327 - DNA, 24 bp, Homo sapiens
cctgtgcccacgtgtgcagactgt

SEQ ID NO: 2787328 - DNA, 15 bp, Homo sapiens
cctgtgcctcctcac

SEQ ID NO: 2787329 - DNA, 20 bp, Homo sapiens
cctgtgcctcctcaccccca

SEQ ID NO: 2787330 - DNA, 15 bp, Homo sapiens
cctgtgcctgaccct

SEQ ID NO: 2787331 - DNA, 20 bp, Homo sapiens
cctgtgtagctgtgacctgc

SEQ ID NO: 2787332 - DNA, 21 bp, Homo sapiens
cctgtgtgagcatctctgtgt

SEQ ID NO: 2787333 - DNA, 14 bp, Homo sapiens
cctgtgtggacagg

SEQ ID NO: 2787334 - DNA, 20 bp, Homo sapiens
cctgtgtgtgcgcctacagg

SEQ ID NO: 2787335 - DNA, 14 bp, Homo sapiens
cctgtgtttcttgc

SEQ ID NO: 2787336 - DNA, 18 bp, Homo sapiens
cctgtgtttcttgcctca

SEQ ID NO: 2787337 - DNA, 17 bp, Homo sapiens
cctgttaaaatgtacac

SEQ ID NO: 2787338 - DNA, 19 bp, Homo sapiens
cctgttaacgtcatctcag

SEQ ID NO: 2787339 - DNA, 15 bp, Homo sapiens
cctgttacccagaga

SEQ ID NO: 2787340 - DNA, 24 bp, Homo sapiens
cctgttacttaaatagcatctgct

SEQ ID NO: 2787341 - DNA, 18 bp, Homo sapiens
cctgttagctgttatttc

SEQ ID NO: 2787342 - DNA, 18 bp, Homo sapiens
cctgttaggggaaaatag

SEQ ID NO: 2787343 - DNA, 23 bp, Homo sapiens
cctgttattttttatttccacat

SEQ ID NO: 2787344 - DNA, 23 bp, Homo sapiens
cctgttcagctccagctcaccag

SEQ ID NO: 2787345 - DNA, 20 bp, Homo sapiens
cctgttggacccgctctgga

SEQ ID NO: 2787346 - DNA, 23 bp, Homo sapiens
cctgttggacccgctctggacca

SEQ ID NO: 2787347 - DNA, 18 bp, Homo sapiens
cctgtttttaagctgttt

SEQ ID NO: 2787348 - DNA, 16 bp, Homo sapiens
ccttaaaataatgatt

SEQ ID NO: 2787349 - DNA, 21 bp, Homo sapiens
ccttaaggaggtagctcccag

SEQ ID NO: 2787350 - DNA, 12 bp, Homo sapiens
ccttaagtcaga

SEQ ID NO: 2787351 - DNA, 21 bp, Homo sapiens
ccttgtatttaaatattaaat

SEQ ID NO: 2787352 - DNA, 12 bp, Homo sapiens
ccttgtgaggat

SEQ ID NO: 2787353 - DNA, 13 bp, Homo sapiens
ccttgtgctgggg

SEQ ID NO: 2787354 - DNA, 20 bp, Homo sapiens
cctttagcgcccagttgggt

SEQ ID NO: 2787355 - DNA, 22 bp, Homo sapiens
cctttagggcttatggccaggg

SEQ ID NO: 2787356 - DNA, 13 bp, Homo sapiens
cctttattgtgat

SEQ ID NO: 2787357 - DNA, 15 bp, Homo sapiens
cctttcaaatttcac

SEQ ID NO: 2787358 - DNA, 20 bp, Homo sapiens
cctttcagggaatttcagga

SEQ ID NO: 2787359 - DNA, 18 bp, Homo sapiens
cctttccacctgctttct

SEQ ID NO: 2787360 - DNA, 22 bp, Homo sapiens
cctttccacctgctttctcctg

SEQ ID NO: 2787361 - DNA, 17 bp, Homo sapiens
cctttccctcaccccct

SEQ ID NO: 2787362 - DNA, 12 bp, Homo sapiens
cctttcctcccc

SEQ ID NO: 2787363 - DNA, 14 bp, Homo sapiens
cctttcctctgcag

SEQ ID NO: 2787364 - DNA, 12 bp, Homo sapiens
cctttccttcct

SEQ ID NO: 2787365 - DNA, 22 bp, Homo sapiens
cctttctagtcctattctattg

SEQ ID NO: 2787366 - DNA, 16 bp, Homo sapiens
cctttctccagccagc

SEQ ID NO: 2787367 - DNA, 20 bp, Homo sapiens
cctttctccagccagcaatg

SEQ ID NO: 2787368 - DNA, 22 bp, Homo sapiens
cctttctccagccagcaatgat

SEQ ID NO: 2787369 - DNA, 21 bp, Homo sapiens
cctttctgagtgacatgggtg

SEQ ID NO: 2787370 - DNA, 16 bp, Homo sapiens
cctttgaatcctctct

SEQ ID NO: 2787371 - DNA, 20 bp, Homo sapiens
cctttgaatcctctctctgt

SEQ ID NO: 2787372 - DNA, 14 bp, Homo sapiens
cctttgcactgagg

SEQ ID NO: 2787373 - DNA, 17 bp, Homo sapiens
cctttgcactgagggcc

SEQ ID NO: 2787374 - DNA, 21 bp, Homo sapiens
cctttgccccaaggctgctca

SEQ ID NO: 2787375 - DNA, 16 bp, Homo sapiens
cctttggatgaccaga

SEQ ID NO: 2787376 - DNA, 15 bp, Homo sapiens
cctttgggtactact

SEQ ID NO: 2787377 - DNA, 15 bp, Homo sapiens
cctttgtgtaataaa

SEQ ID NO: 2787378 - DNA, 13 bp, Homo sapiens
ccttttctgacca

SEQ ID NO: 2787379 - DNA, 18 bp, Homo sapiens
ccttttctgaccaaagag

SEQ ID NO: 2787380 - DNA, 20 bp, Homo sapiens
ccttttctttttcccttgaa

SEQ ID NO: 2787381 - DNA, 22 bp, Homo sapiens
ccttttctttttcccttgaact

SEQ ID NO: 2787382 - DNA, 16 bp, Homo sapiens
cctttttctttataaa

SEQ ID NO: 2787383 - DNA, 20 bp, Homo sapiens
cctttttctttataaacttt

SEQ ID NO: 2787384 - DNA, 22 bp, Homo sapiens
cgaaacaggctactctcctcgg

SEQ ID NO: 2787385 - DNA, 19 bp, Homo sapiens
cgaaagggacttggaagct

SEQ ID NO: 2787386 - DNA, 21 bp, Homo sapiens
cgaacatgcctgattttaaaa

SEQ ID NO: 2787387 - DNA, 16 bp, Homo sapiens
cgaacccacctgctga

SEQ ID NO: 2787388 - DNA, 23 bp, Homo sapiens
cgaacccacctgctgagagaccc

SEQ ID NO: 2787389 - DNA, 20 bp, Homo sapiens
cgaacccctcccctcccccc

SEQ ID NO: 2787390 - DNA, 21 bp, Homo sapiens
cgaacccctcccctcccccct

SEQ ID NO: 2787391 - DNA, 13 bp, Homo sapiens
cgaagcagagagg

SEQ ID NO: 2787392 - DNA, 15 bp, Homo sapiens
cgaagcccttccagt

SEQ ID NO: 2787393 - DNA, 16 bp, Homo sapiens
cgaagcccttccagtg

SEQ ID NO: 2787394 - DNA, 12 bp, Homo sapiens
cgaatgacactg

SEQ ID NO: 2787395 - DNA, 22 bp, Homo sapiens
cgaatttggtgtggctgtattc

SEQ ID NO: 2787396 - DNA, 19 bp, Homo sapiens
cgacaaagggaaggctgct

SEQ ID NO: 2787397 - DNA, 20 bp, Homo sapiens
cgacaaagggaaggctgctg

SEQ ID NO: 2787398 - DNA, 18 bp, Homo sapiens
cgaccatgtgtagattgc

SEQ ID NO: 2787399 - DNA, 13 bp, Homo sapiens
cgacccctcagtg

SEQ ID NO: 2787400 - DNA, 12 bp, Homo sapiens
cgacctcagcct

SEQ ID NO: 2787401 - DNA, 15 bp, Homo sapiens
cgacctcagccttcc

SEQ ID NO: 2787402 - DNA, 13 bp, Homo sapiens
cgactcagggacc

SEQ ID NO: 2787403 - DNA, 10 bp, Homo sapiens
cgactccagc

SEQ ID NO: 2787404 - DNA, 13 bp, Homo sapiens
cgactccagccag

SEQ ID NO: 2787405 - DNA, 14 bp, Homo sapiens
cgactccagccagc

SEQ ID NO: 2787406 - DNA, 20 bp, Homo sapiens
cgactctatagactctagga

SEQ ID NO: 2787407 - DNA, 12 bp, Homo sapiens
cgactgaagaag

SEQ ID NO: 2787408 - DNA, 22 bp, Homo sapiens
cgacttcctctccagccttctc

SEQ ID NO: 2787409 - DNA, 18 bp, Homo sapiens
cgactttgagctggaaag

SEQ ID NO: 2787410 - DNA, 19 bp, Homo sapiens
cgagaactcgaagcccttc

SEQ ID NO: 2787411 - DNA, 14 bp, Homo sapiens
cgagacacttgcct

SEQ ID NO: 2787412 - DNA, 13 bp, Homo sapiens
cgagaccagcctg

SEQ ID NO: 2787413 - DNA, 17 bp, Homo sapiens
cgagaccagcctggcca

SEQ ID NO: 2787414 - DNA, 17 bp, Homo sapiens
cgagagaggtgggcagc

SEQ ID NO: 2787415 - DNA, 20 bp, Homo sapiens
cgagagcctgctcccccacc

SEQ ID NO: 2787416 - DNA, 21 bp, Homo sapiens
cgagagcctgctcccccaccc

SEQ ID NO: 2787417 - DNA, 14 bp, Homo sapiens
cgagaggcagagaa

SEQ ID NO: 2787418 - DNA, 14 bp, Homo sapiens
cgagagtctgtctc

SEQ ID NO: 2787419 - DNA, 15 bp, Homo sapiens
cgagagtctgtctca

SEQ ID NO: 2787420 - DNA, 17 bp, Homo sapiens
cgagatcgctggcagag

SEQ ID NO: 2787421 - DNA, 16 bp, Homo sapiens
cgagcaaccgtggccc

SEQ ID NO: 2787422 - DNA, 11 bp, Homo sapiens
cgagcagctga

SEQ ID NO: 2787423 - DNA, 14 bp, Homo sapiens
cgagcagctgagca

SEQ ID NO: 2787424 - DNA, 16 bp, Homo sapiens
cgagccctggtggcag

SEQ ID NO: 2787425 - DNA, 18 bp, Homo sapiens
cgagccctggtggcagtg

SEQ ID NO: 2787426 - DNA, 19 bp, Homo sapiens
cgagccctggtggcagtgg

SEQ ID NO: 2787427 - DNA, 14 bp, Homo sapiens
cgagccgggcctgg

SEQ ID NO: 2787428 - DNA, 19 bp, Homo sapiens
cgagcgccctgcagaccct

SEQ ID NO: 2787429 - DNA, 20 bp, Homo sapiens
cgagcgccctgcagaccctg

SEQ ID NO: 2787430 - DNA, 21 bp, Homo sapiens
cgagctccttgggtcctgcaa

SEQ ID NO: 2787431 - DNA, 13 bp, Homo sapiens
cgaggacagggag

SEQ ID NO: 2787432 - DNA, 20 bp, Homo sapiens
cgaggagcttccagtgcatg

SEQ ID NO: 2787433 - DNA, 14 bp, Homo sapiens
cgaggcagggtcag

SEQ ID NO: 2787434 - DNA, 22 bp, Homo sapiens
cgaggcagggtcaggagagggg

SEQ ID NO: 2787435 - DNA, 17 bp, Homo sapiens
cgaggcggtttccagga

SEQ ID NO: 2787436 - DNA, 20 bp, Homo sapiens
cgaggcggtttccaggaaga

SEQ ID NO: 2787437 - DNA, 22 bp, Homo sapiens
cgaggcggtttccaggaagagt

SEQ ID NO: 2787438 - DNA, 19 bp, Homo sapiens
cgagggatgggatttcatg

SEQ ID NO: 2787439 - DNA, 14 bp, Homo sapiens
cgaggtagagtttg

SEQ ID NO: 2787440 - DNA, 20 bp, Homo sapiens
cgaggtagagtttgaaggag

SEQ ID NO: 2787441 - DNA, 22 bp, Homo sapiens
cgaggtggatcacagaggcttc

SEQ ID NO: 2787442 - DNA, 11 bp, Homo sapiens
ctaaggacaca

SEQ ID NO: 2787443 - DNA, 12 bp, Homo sapiens
ctaaggacacac

SEQ ID NO: 2787444 - DNA, 14 bp, Homo sapiens
ctaaggacacacta

SEQ ID NO: 2787445 - DNA, 15 bp, Homo sapiens
ctaaggatctctcag

SEQ ID NO: 2787446 - DNA, 20 bp, Homo sapiens
ctaaggatctctcaggagca

SEQ ID NO: 2787447 - DNA, 15 bp, Homo sapiens
ctaaggtaatcctat

SEQ ID NO: 2787448 - DNA, 16 bp, Homo sapiens
ctaaggtgtgctctga

SEQ ID NO: 2787449 - DNA, 16 bp, Homo sapiens
ctaagtaaaagggtgg

SEQ ID NO: 2787450 - DNA, 20 bp, Homo sapiens
ctaagtaggggcagtgatgg

SEQ ID NO: 2787451 - DNA, 14 bp, Homo sapiens
ctaagtgaaaaggt

SEQ ID NO: 2787452 - DNA, 22 bp, Homo sapiens
ctaagtgatcctcccacctcag

SEQ ID NO: 2787453 - DNA, 17 bp, Homo sapiens
ctaagttaatttaaagt

SEQ ID NO: 2787454 - DNA, 21 bp, Homo sapiens
ctaagttaatttaaagttgtt

SEQ ID NO: 2787455 - DNA, 15 bp, Homo sapiens
ctaatacctctgtgt

SEQ ID NO: 2787456 - DNA, 19 bp, Homo sapiens
ctaatagaaccaagaattc

SEQ ID NO: 2787457 - DNA, 17 bp, Homo sapiens
ctaatatacagggtagc

SEQ ID NO: 2787458 - DNA, 12 bp, Homo sapiens
ctaatcctccaa

SEQ ID NO: 2787459 - DNA, 18 bp, Homo sapiens
ctaatctgtagggctgga

SEQ ID NO: 2787460 - DNA, 21 bp, Homo sapiens
ctaatctgtagggctggacct

SEQ ID NO: 2787461 - DNA, 23 bp, Homo sapiens
ctaatcttgttaaattgcttatt

SEQ ID NO: 2787462 - DNA, 23 bp, Homo sapiens
ctaatgaagggaaaggatatttt

SEQ ID NO: 2787463 - DNA, 22 bp, Homo sapiens
ctaattggcatgaaggtgtcat

SEQ ID NO: 2787464 - DNA, 13 bp, Homo sapiens
ctaatttaaacca

SEQ ID NO: 2787465 - DNA, 22 bp, Homo sapiens
ctaatttaaaccagcagaaaag

SEQ ID NO: 2787466 - DNA, 13 bp, Homo sapiens
ctaatttatacaa

SEQ ID NO: 2787467 - DNA, 16 bp, Homo sapiens
ctaatttatacaaaat

SEQ ID NO: 2787468 - DNA, 18 bp, Homo sapiens
ctaatttatacaaaataa

SEQ ID NO: 2787469 - DNA, 21 bp, Homo sapiens
ctaatttatcctgaaatttca

SEQ ID NO: 2787470 - DNA, 15 bp, Homo sapiens
ctaatttgatgttta

SEQ ID NO: 2787471 - DNA, 16 bp, Homo sapiens
ctaatttgatgtttac

SEQ ID NO: 2787472 - DNA, 16 bp, Homo sapiens
ctaatttttttgtatt

SEQ ID NO: 2787473 - DNA, 20 bp, Homo sapiens
ctaatttttttgtattttag

SEQ ID NO: 2787474 - DNA, 20 bp, Homo sapiens
ctacaaaacctgatgttaaa

SEQ ID NO: 2787475 - DNA, 21 bp, Homo sapiens
ctacaaaacctgatgttaaaa

SEQ ID NO: 2787476 - DNA, 14 bp, Homo sapiens
ctacaaccagagcc

SEQ ID NO: 2787477 - DNA, 15 bp, Homo sapiens
ctacaaccagagccc

SEQ ID NO: 2787478 - DNA, 12 bp, Homo sapiens
ctacacagcctg

SEQ ID NO: 2787479 - DNA, 13 bp, Homo sapiens
ctacacagcctgg

SEQ ID NO: 2787480 - DNA, 15 bp, Homo sapiens
ctacacagtaaaaac

SEQ ID NO: 2787481 - DNA, 12 bp, Homo sapiens
ctacacatatat

SEQ ID NO: 2787482 - DNA, 14 bp, Homo sapiens
ctacaccactctgg

SEQ ID NO: 2787483 - DNA, 15 bp, Homo sapiens
ctacaccactctggc

SEQ ID NO: 2787484 - DNA, 18 bp, Homo sapiens
ctacaccactctggcagc

SEQ ID NO: 2787485 - DNA, 22 bp, Homo sapiens
ctacacccctcccctgccctag

SEQ ID NO: 2787486 - DNA, 17 bp, Homo sapiens
ctacactccagcctgag

SEQ ID NO: 2787487 - DNA, 18 bp, Homo sapiens
ctacactccagcctgagc

SEQ ID NO: 2787488 - DNA, 14 bp, Homo sapiens
ctacagaacaaaga

SEQ ID NO: 2787489 - DNA, 14 bp, Homo sapiens
ctacagataattta

SEQ ID NO: 2787490 - DNA, 16 bp, Homo sapiens
ctacagccagaagccc

SEQ ID NO: 2787491 - DNA, 20 bp, Homo sapiens
ctacagccagaagcccatgg

SEQ ID NO: 2787492 - DNA, 15 bp, Homo sapiens
ctacaggcacccacc

SEQ ID NO: 2787493 - DNA, 23 bp, Homo sapiens
ctacagttagggttgagttactt

SEQ ID NO: 2787494 - DNA, 22 bp, Homo sapiens
ctacagttgttttttgaaaaca

SEQ ID NO: 2787495 - DNA, 16 bp, Homo sapiens
ctacagtttcttactg

SEQ ID NO: 2787496 - DNA, 17 bp, Homo sapiens
ctacatccccaggtctc

SEQ ID NO: 2787497 - DNA, 15 bp, Homo sapiens
ctacatgaaacagaa

SEQ ID NO: 2787498 - DNA, 22 bp, Homo sapiens
ctacattccctggcctggctct

SEQ ID NO: 2787499 - DNA, 14 bp, Homo sapiens
ctaccacagtgtct

SEQ ID NO: 2787500 - DNA, 22 bp, Homo sapiens
ctaccaccccttcctgtcccac

SEQ ID NO: 2787501 - DNA, 12 bp, Homo sapiens
ctaccatttcag

SEQ ID NO: 2787502 - DNA, 13 bp, Homo sapiens
ctacccaaccact

SEQ ID NO: 2787503 - DNA, 16 bp, Homo sapiens
ctacccaaccactcaa

SEQ ID NO: 2787504 - DNA, 13 bp, Homo sapiens
ctacccaccctcc

SEQ ID NO: 2787505 - DNA, 22 bp, Homo sapiens
ctacccacttctaaatagcaat

SEQ ID NO: 2787506 - DNA, 18 bp, Homo sapiens
ctacccagcgagccctgg

SEQ ID NO: 2787507 - DNA, 19 bp, Homo sapiens
ctacccagcgagccctggt

SEQ ID NO: 2787508 - DNA, 22 bp, Homo sapiens
ctacccttgttagttattttag

SEQ ID NO: 2787509 - DNA, 11 bp, Homo sapiens
ctacctcagcc

SEQ ID NO: 2787510 - DNA, 12 bp, Homo sapiens
ctacctcagcct

SEQ ID NO: 2787511 - DNA, 15 bp, Homo sapiens
ctacctcagcctaga

SEQ ID NO: 2787512 - DNA, 13 bp, Homo sapiens
ctacctctttgtc

SEQ ID NO: 2787513 - DNA, 17 bp, Homo sapiens
ctaccttctctacccat

SEQ ID NO: 2787514 - DNA, 22 bp, Homo sapiens
ctaccttctctacccatctccc

SEQ ID NO: 2787515 - DNA, 14 bp, Homo sapiens
ctacgctctccttt

SEQ ID NO: 2787516 - DNA, 13 bp, Homo sapiens
ctacgtataaata

SEQ ID NO: 2787517 - DNA, 19 bp, Homo sapiens
ctactaaaaatacaaaaat

SEQ ID NO: 2787518 - DNA, 18 bp, Homo sapiens
ctactatgccagatgcct

SEQ ID NO: 2787519 - DNA, 14 bp, Homo sapiens
ctactattctgtta

SEQ ID NO: 2787520 - DNA, 16 bp, Homo sapiens
ctactcaagaggctga

SEQ ID NO: 2787521 - DNA, 23 bp, Homo sapiens
ctactcacacaggcatttcctgg

SEQ ID NO: 2787522 - DNA, 17 bp, Homo sapiens
ctactcacagtctcttt

SEQ ID NO: 2787523 - DNA, 16 bp, Homo sapiens
ctactcagaagcctga

SEQ ID NO: 2787524 - DNA, 17 bp, Homo sapiens
ctactcagcagccctcc

SEQ ID NO: 2787525 - DNA, 22 bp, Homo sapiens
ctactctcaggatcaagaaagt

SEQ ID NO: 2787526 - DNA, 20 bp, Homo sapiens
ctactctgtgccagagcctg

SEQ ID NO: 2787527 - DNA, 14 bp, Homo sapiens
ctactgagaaactt

SEQ ID NO: 2787528 - DNA, 16 bp, Homo sapiens
ctactgctgcaaagtg

SEQ ID NO: 2787529 - DNA, 17 bp, Homo sapiens
ctactgctgcaaagtgc

SEQ ID NO: 2787530 - DNA, 19 bp, Homo sapiens
ctactgctgcaaagtgcaa

SEQ ID NO: 2787531 - DNA, 16 bp, Homo sapiens
ctactgggaaattact

SEQ ID NO: 2787532 - DNA, 14 bp, Homo sapiens
ctactgggaaggct

SEQ ID NO: 2787533 - DNA, 18 bp, Homo sapiens
ctcagtaatttagaaatc

SEQ ID NO: 2787534 - DNA, 16 bp, Homo sapiens
ctcagtcccccaccac

SEQ ID NO: 2787535 - DNA, 12 bp, Homo sapiens
ctcagtcctgga

SEQ ID NO: 2787536 - DNA, 15 bp, Homo sapiens
ctcagtgaagaatac

SEQ ID NO: 2787537 - DNA, 20 bp, Homo sapiens
caggcccggctccaggctcc

SEQ ID NO: 2787538 - DNA, 15 bp, Homo sapiens
caggcccggggctgg

SEQ ID NO: 2787539 - DNA, 21 bp, Homo sapiens
caggcccttattttcaagaaa

SEQ ID NO: 2787540 - DNA, 14 bp, Homo sapiens
caggccgaggcagg

SEQ ID NO: 2787541 - DNA, 21 bp, Homo sapiens
caggccgggcttgggccctgc

SEQ ID NO: 2787542 - DNA, 23 bp, Homo sapiens
caggccgggcttgggccctgcac

SEQ ID NO: 2787543 - DNA, 19 bp, Homo sapiens
caggccggtgtgggctgtg

SEQ ID NO: 2787544 - DNA, 16 bp, Homo sapiens
caggcctgtgtagctg

SEQ ID NO: 2787545 - DNA, 18 bp, Homo sapiens
caggcctgtgtagctgtg

SEQ ID NO: 2787546 - DNA, 20 bp, Homo sapiens
caggcctgtgtagctgtgac

SEQ ID NO: 2787547 - DNA, 21 bp, Homo sapiens
caggcctgtgtagctgtgacc

SEQ ID NO: 2787548 - DNA, 16 bp, Homo sapiens
caggcggggtgctgtg

SEQ ID NO: 2787549 - DNA, 13 bp, Homo sapiens
caggctaattttt

SEQ ID NO: 2787550 - DNA, 18 bp, Homo sapiens
caggctactctcctcggc

SEQ ID NO: 2787551 - DNA, 16 bp, Homo sapiens
caggctagactaggag

SEQ ID NO: 2787552 - DNA, 15 bp, Homo sapiens
caggctcacaactgt

SEQ ID NO: 2787553 - DNA, 14 bp, Homo sapiens
caggctcctttagc

SEQ ID NO: 2787554 - DNA, 19 bp, Homo sapiens
caggctcctttagcgccca

SEQ ID NO: 2787555 - DNA, 22 bp, Homo sapiens
caggctctttggggtcagccag

SEQ ID NO: 2787556 - DNA, 11 bp, Homo sapiens
caggctgaggt

SEQ ID NO: 2787557 - DNA, 15 bp, Homo sapiens
caggctgagtgagcc

SEQ ID NO: 2787558 - DNA, 16 bp, Homo sapiens
caggctgagtgagcca

SEQ ID NO: 2787559 - DNA, 14 bp, Homo sapiens
caggctgggcttca

SEQ ID NO: 2787560 - DNA, 15 bp, Homo sapiens
caggctgggcttcag

SEQ ID NO: 2787561 - DNA, 16 bp, Homo sapiens
caggctgggcttcagt

SEQ ID NO: 2787562 - DNA, 21 bp, Homo sapiens
caggctgggcttcagtggcag

SEQ ID NO: 2787563 - DNA, 20 bp, Homo sapiens
caggctgtatcccatgagcc

SEQ ID NO: 2787564 - DNA, 23 bp, Homo sapiens
caggctgtttctttttttatgac

SEQ ID NO: 2787565 - DNA, 18 bp, Homo sapiens
caggcttggaatgaattc

SEQ ID NO: 2787566 - DNA, 23 bp, Homo sapiens
caggcttgtcactagcagctgca

SEQ ID NO: 2787567 - DNA, 14 bp, Homo sapiens
cagggaaaggctct

SEQ ID NO: 2787568 - DNA, 13 bp, Homo sapiens
cagggaaggcagg

SEQ ID NO: 2787569 - DNA, 14 bp, Homo sapiens
cagggaaggcaggc

SEQ ID NO: 2787570 - DNA, 23 bp, Homo sapiens
cagggaatttcaggaactagaga

SEQ ID NO: 2787571 - DNA, 19 bp, Homo sapiens
cagggacagagacacctgc

SEQ ID NO: 2787572 - DNA, 22 bp, Homo sapiens
cagggacagagacacctgcacc

SEQ ID NO: 2787573 - DNA, 23 bp, Homo sapiens
cagggacagagacacctgcacct

SEQ ID NO: 2787574 - DNA, 22 bp, Homo sapiens
cagggacccacttcacacacag

SEQ ID NO: 2787575 - DNA, 12 bp, Homo sapiens
cagggaggagag

SEQ ID NO: 2787576 - DNA, 20 bp, Homo sapiens
cagggaggaggtggcagccc

SEQ ID NO: 2787577 - DNA, 23 bp, Homo sapiens
cagggaggaggtggcagccctgt

SEQ ID NO: 2787578 - DNA, 12 bp, Homo sapiens
cagggaggccga

SEQ ID NO: 2787579 - DNA, 23 bp, Homo sapiens
cagggaggccgaagctaacaggg

SEQ ID NO: 2787580 - DNA, 17 bp, Homo sapiens
cagggcaatcaatgttc

SEQ ID NO: 2787581 - DNA, 23 bp, Homo sapiens
cagggcacaccgggcactcagaa

SEQ ID NO: 2787582 - DNA, 12 bp, Homo sapiens
cagggcacagga

SEQ ID NO: 2787583 - DNA, 21 bp, Homo sapiens
cagggcacaggagctacctgt

SEQ ID NO: 2787584 - DNA, 22 bp, Homo sapiens
cagggcacaggagctacctgtg

SEQ ID NO: 2787585 - DNA, 18 bp, Homo sapiens
cagggcatattaaaggct

SEQ ID NO: 2787586 - DNA, 17 bp, Homo sapiens
cagggcatcccatgggg

SEQ ID NO: 2787587 - DNA, 15 bp, Homo sapiens
cagggccacgtgcca

SEQ ID NO: 2787588 - DNA, 18 bp, Homo sapiens
cagggccagggccctgca

SEQ ID NO: 2787589 - DNA, 21 bp, Homo sapiens
cagggcccaaagcccagctct

SEQ ID NO: 2787590 - DNA, 14 bp, Homo sapiens
cagggcccccacag

SEQ ID NO: 2787591 - DNA, 15 bp, Homo sapiens
cagggcccccacagg

SEQ ID NO: 2787592 - DNA, 16 bp, Homo sapiens
cagggcccccacaggc

SEQ ID NO: 2787593 - DNA, 17 bp, Homo sapiens
cagggcccccacaggcc

SEQ ID NO: 2787594 - DNA, 14 bp, Homo sapiens
cagggccctgcaga

SEQ ID NO: 2787595 - DNA, 14 bp, Homo sapiens
cagggcctagcttt

SEQ ID NO: 2787596 - DNA, 22 bp, Homo sapiens
cagggcctggggagatggagga

SEQ ID NO: 2787597 - DNA, 16 bp, Homo sapiens
cagggccttgcccaga

SEQ ID NO: 2787598 - DNA, 17 bp, Homo sapiens
cagggccttgcccagag

SEQ ID NO: 2787599 - DNA, 20 bp, Homo sapiens
cagggccttgcccagagatg

SEQ ID NO: 2787600 - DNA, 12 bp, Homo sapiens
cagggctcagcc

SEQ ID NO: 2787601 - DNA, 13 bp, Homo sapiens
cagggctcagcct

SEQ ID NO: 2787602 - DNA, 19 bp, Homo sapiens
cagggctcagcctggtggg

SEQ ID NO: 2787603 - DNA, 20 bp, Homo sapiens
cagggctcagcggggacagc

SEQ ID NO: 2787604 - DNA, 23 bp, Homo sapiens
cagggctcagcggggacagctcc

SEQ ID NO: 2787605 - DNA, 16 bp, Homo sapiens
cagggctctcctggct

SEQ ID NO: 2787606 - DNA, 19 bp, Homo sapiens
cagggctctcctggcttcc

SEQ ID NO: 2787607 - DNA, 12 bp, Homo sapiens
cagggctgcccc

SEQ ID NO: 2787608 - DNA, 11 bp, Homo sapiens
cagggctggga

SEQ ID NO: 2787609 - DNA, 22 bp, Homo sapiens
caggggccaaactggtgggagg

SEQ ID NO: 2787610 - DNA, 16 bp, Homo sapiens
caggggcctgcccagt

SEQ ID NO: 2787611 - DNA, 15 bp, Homo sapiens
caggggctccacctg

SEQ ID NO: 2787612 - DNA, 16 bp, Homo sapiens
caggggtctccctgga

SEQ ID NO: 2787613 - DNA, 17 bp, Homo sapiens
caggggtctccctggag

SEQ ID NO: 2787614 - DNA, 18 bp, Homo sapiens
cagggtccagaccctgaa

SEQ ID NO: 2787615 - DNA, 21 bp, Homo sapiens
cagggtctcactatgttgccc

SEQ ID NO: 2787616 - DNA, 23 bp, Homo sapiens
cagggtctcactatgttgcccag

SEQ ID NO: 2787617 - DNA, 17 bp, Homo sapiens
cagggtctcactctgtc

SEQ ID NO: 2787618 - DNA, 23 bp, Homo sapiens
cagggtctcactctgtcgcccag

SEQ ID NO: 2787619 - DNA, 22 bp, Homo sapiens
cagggtgagagctgctctggaa

SEQ ID NO: 2787620 - DNA, 17 bp, Homo sapiens
cagggtgggatggagga

SEQ ID NO: 2787621 - DNA, 17 bp, Homo sapiens
cagggtgggccactctc

SEQ ID NO: 2787622 - DNA, 20 bp, Homo sapiens
cagggtgggccactctcccc

SEQ ID NO: 2787623 - DNA, 21 bp, Homo sapiens
cagggttgatcacactctggg

SEQ ID NO: 2787624 - DNA, 15 bp, Homo sapiens
cagggttggcccctg

SEQ ID NO: 2787625 - DNA, 15 bp, Homo sapiens
caggtaacaggcaga

SEQ ID NO: 2787626 - DNA, 21 bp, Homo sapiens
caggtaacaggcagatacagg

SEQ ID NO: 2787627 - DNA, 17 bp, Homo sapiens
caggtaatgagggactg

SEQ ID NO: 2787628 - DNA, 22 bp, Homo sapiens
caggtaatgagggactggaacc

SEQ ID NO: 2787629 - DNA, 20 bp, Homo sapiens
caggtatgaccttctaggaa

SEQ ID NO: 2787630 - DNA, 18 bp, Homo sapiens
caggtcctggtggggcag

SEQ ID NO: 2787631 - DNA, 18 bp, Homo sapiens
caggtctagactttctca

SEQ ID NO: 2787632 - DNA, 13 bp, Homo sapiens
caggtctcctctt

SEQ ID NO: 2787633 - DNA, 23 bp, Homo sapiens
caggtctctccactgctctcagc

SEQ ID NO: 2787634 - DNA, 18 bp, Homo sapiens
caggtcttgaactcctgg

SEQ ID NO: 2787635 - DNA, 22 bp, Homo sapiens
caggtcttgaactcctggcctc

SEQ ID NO: 2787636 - DNA, 16 bp, Homo sapiens
caggtgatccacccac

SEQ ID NO: 2787637 - DNA, 17 bp, Homo sapiens
caggtgatccacccacc

SEQ ID NO: 2787638 - DNA, 15 bp, Homo sapiens
caggtgcagtggctc

SEQ ID NO: 2787639 - DNA, 12 bp, Homo sapiens
caggtggatcac

SEQ ID NO: 2787640 - DNA, 17 bp, Homo sapiens
caggtggcaggaccagg

SEQ ID NO: 2787641 - DNA, 20 bp, Homo sapiens
caggtggctgacccagtccc

SEQ ID NO: 2787642 - DNA, 15 bp, Homo sapiens
caggtggggcagctt

SEQ ID NO: 2787643 - DNA, 17 bp, Homo sapiens
caggtggggcagcttga

SEQ ID NO: 2787644 - DNA, 12 bp, Homo sapiens
caggtgtaaata

SEQ ID NO: 2787645 - DNA, 18 bp, Homo sapiens
caggtgtccctgcacttg

SEQ ID NO: 2787646 - DNA, 15 bp, Homo sapiens
caggtgtctatccac

SEQ ID NO: 2787647 - DNA, 22 bp, Homo sapiens
caggtgtctatccacctggggt

SEQ ID NO: 2787648 - DNA, 22 bp, Homo sapiens
caggtgtgagtcaccaagccca

SEQ ID NO: 2787649 - DNA, 12 bp, Homo sapiens
caggttcagctt

SEQ ID NO: 2787650 - DNA, 12 bp, Homo sapiens
caggttcctaag

SEQ ID NO: 2787651 - DNA, 20 bp, Homo sapiens
caggttgaggggctcctgga

SEQ ID NO: 2787652 - DNA, 15 bp, Homo sapiens
caggttttgtaaaga

SEQ ID NO: 2787653 - DNA, 18 bp, Homo sapiens
cagtaaaaacttgtacta

SEQ ID NO: 2787654 - DNA, 21 bp, Homo sapiens
cagtaaaaacttgtactatgt

SEQ ID NO: 2787655 - DNA, 22 bp, Homo sapiens
cagtaaaaacttgtactatgtt

SEQ ID NO: 2787656 - DNA, 10 bp, Homo sapiens
cagtaaacat

SEQ ID NO: 2787657 - DNA, 21 bp, Homo sapiens
cagtaaagtttaaaaaataca

SEQ ID NO: 2787658 - DNA, 14 bp, Homo sapiens
cagtaactcatctg

SEQ ID NO: 2787659 - DNA, 21 bp, Homo sapiens
cagtaattggtccgatctttg

SEQ ID NO: 2787660 - DNA, 23 bp, Homo sapiens
cagtagcacaagttatttaaatc

SEQ ID NO: 2787661 - DNA, 21 bp, Homo sapiens
cagtagtttgagaccagcctg

SEQ ID NO: 2787662 - DNA, 15 bp, Homo sapiens
cagtataaaagacaa

SEQ ID NO: 2787663 - DNA, 16 bp, Homo sapiens
cagtatccactttgca

SEQ ID NO: 2787664 - DNA, 21 bp, Homo sapiens
cagtatgctgttttaataatt

SEQ ID NO: 2787665 - DNA, 15 bp, Homo sapiens
cagtatggccatggg

SEQ ID NO: 2787666 - DNA, 18 bp, Homo sapiens
cagtattacttctgctac

SEQ ID NO: 2787667 - DNA, 19 bp, Homo sapiens
cagtattacttctgctaca

SEQ ID NO: 2787668 - DNA, 15 bp, Homo sapiens
cagtcaacagttcaa

SEQ ID NO: 2787669 - DNA, 20 bp, Homo sapiens
cagtcacactgttactccac

SEQ ID NO: 2787670 - DNA, 23 bp, Homo sapiens
cagtccccgtgaaggagagccct

SEQ ID NO: 2787671 - DNA, 21 bp, Homo sapiens
cagtccctgggggaagccctg

SEQ ID NO: 2787672 - DNA, 19 bp, Homo sapiens
cagtccgtcaaaacagatt

SEQ ID NO: 2787673 - DNA, 12 bp, Homo sapiens
cagtcctggaag

SEQ ID NO: 2787674 - DNA, 23 bp, Homo sapiens
cagtcctggaagccggccggctg

SEQ ID NO: 2787675 - DNA, 12 bp, Homo sapiens
cagtcctgggag

SEQ ID NO: 2787676 - DNA, 18 bp, Homo sapiens
cagtcctggtctgctcag

SEQ ID NO: 2787677 - DNA, 19 bp, Homo sapiens
cagtcctggtctgctcagg

SEQ ID NO: 2787678 - DNA, 19 bp, Homo sapiens
cagtctcaagcactaaaaa

SEQ ID NO: 2787679 - DNA, 19 bp, Homo sapiens
cagtctcagaatgtcattt

SEQ ID NO: 2787680 - DNA, 21 bp, Homo sapiens
cagtctcagaatgtcattttg

SEQ ID NO: 2787681 - DNA, 13 bp, Homo sapiens
cagtctcaggagc

SEQ ID NO: 2787682 - DNA, 16 bp, Homo sapiens
cagtctctgggagact

SEQ ID NO: 2787683 - DNA, 19 bp, Homo sapiens
cagtctctgggagactttc

SEQ ID NO: 2787684 - DNA, 20 bp, Homo sapiens
cagtctgattcccaagctct

SEQ ID NO: 2787685 - DNA, 15 bp, Homo sapiens
cagtctggaatgcag

SEQ ID NO: 2787686 - DNA, 18 bp, Homo sapiens
cagtctggaatgcagtgg

SEQ ID NO: 2787687 - DNA, 15 bp, Homo sapiens
cagtcttgaatttct

SEQ ID NO: 2787688 - DNA, 17 bp, Homo sapiens
cagtgaaaaactattaa

SEQ ID NO: 2787689 - DNA, 14 bp, Homo sapiens
cagtgaaccaaaga

SEQ ID NO: 2787690 - DNA, 20 bp, Homo sapiens
cagtgaaccaaagagactgg

SEQ ID NO: 2787691 - DNA, 23 bp, Homo sapiens
cagtgaaccaaagagactggagc

SEQ ID NO: 2787692 - DNA, 12 bp, Homo sapiens
cagtgacagcta

SEQ ID NO: 2787693 - DNA, 16 bp, Homo sapiens
cagtgacgtgcacctg

SEQ ID NO: 2787694 - DNA, 23 bp, Homo sapiens
cagtgagccaagatcgcgccact

SEQ ID NO: 2787695 - DNA, 19 bp, Homo sapiens
cagtgagccgcatcttctc

SEQ ID NO: 2787696 - DNA, 18 bp, Homo sapiens
cagtgagtcgaggacagg

SEQ ID NO: 2787697 - DNA, 15 bp, Homo sapiens
cagtgagtctcttca

SEQ ID NO: 2787698 - DNA, 22 bp, Homo sapiens
cagtgagttacagcgagaggca

SEQ ID NO: 2787699 - DNA, 15 bp, Homo sapiens
cagtgatctccatat

SEQ ID NO: 2787700 - DNA, 16 bp, Homo sapiens
cagtgatctccatatg

SEQ ID NO: 2787701 - DNA, 16 bp, Homo sapiens
cagtgattgtcttaat

SEQ ID NO: 2787702 - DNA, 17 bp, Homo sapiens
cagtgcccacaggatca

SEQ ID NO: 2787703 - DNA, 18 bp, Homo sapiens
cagtgcccacaggatcag

SEQ ID NO: 2787704 - DNA, 21 bp, Homo sapiens
cagtgcccacaggatcagtct

SEQ ID NO: 2787705 - DNA, 15 bp, Homo sapiens
cagtgcccagctaat

SEQ ID NO: 2787706 - DNA, 17 bp, Homo sapiens
cagtgccctcattttat

SEQ ID NO: 2787707 - DNA, 10 bp, Homo sapiens
cagtgcctgc

SEQ ID NO: 2787708 - DNA, 12 bp, Homo sapiens
cagtgcctgctg

SEQ ID NO: 2787709 - DNA, 13 bp, Homo sapiens
cagtgcctgctga

SEQ ID NO: 2787710 - DNA, 14 bp, Homo sapiens
cagtgcctggcaag

SEQ ID NO: 2787711 - DNA, 17 bp, Homo sapiens
cagtgccttacctcctg

SEQ ID NO: 2787712 - DNA, 20 bp, Homo sapiens
cagtgccttacctcctgccc

SEQ ID NO: 2787713 - DNA, 23 bp, Homo sapiens
cagtgccttacctcctgcccagg

SEQ ID NO: 2787714 - DNA, 23 bp, Homo sapiens
cagtgccttccataattatgaca

SEQ ID NO: 2787715 - DNA, 12 bp, Homo sapiens
cagtgccttgga

SEQ ID NO: 2787716 - DNA, 14 bp, Homo sapiens
cagtgcttcagcct

SEQ ID NO: 2787717 - DNA, 18 bp, Homo sapiens
cagtgcttcagcctgagg

SEQ ID NO: 2787718 - DNA, 19 bp, Homo sapiens
cagtgcttcagcctgaggc

SEQ ID NO: 2787719 - DNA, 17 bp, Homo sapiens
cagtgcttctctacaga

SEQ ID NO: 2787720 - DNA, 19 bp, Homo sapiens
cagtgcttgattgcgtgga

SEQ ID NO: 2787721 - DNA, 12 bp, Homo sapiens
cagtggcagctg

SEQ ID NO: 2787722 - DNA, 13 bp, Homo sapiens
cagtggcagctgc

SEQ ID NO: 2787723 - DNA, 20 bp, Homo sapiens
cagtggctcacgcctatgat

SEQ ID NO: 2787724 - DNA, 17 bp, Homo sapiens
cagtgggaactggaggg

SEQ ID NO: 2787725 - DNA, 13 bp, Homo sapiens
cagtgggagaaaa

SEQ ID NO: 2787726 - DNA, 15 bp, Homo sapiens
cagtgggagctgcct

SEQ ID NO: 2787727 - DNA, 21 bp, Homo sapiens
cagtgggaggtgagaccacct

SEQ ID NO: 2787728 - DNA, 22 bp, Homo sapiens
cagtgggaggtgagaccacctc

SEQ ID NO: 2787729 - DNA, 13 bp, Homo sapiens
cagtgggtgcccc

SEQ ID NO: 2787730 - DNA, 21 bp, Homo sapiens
cagtggtaccagctcactccc

SEQ ID NO: 2787731 - DNA, 21 bp, Homo sapiens
cagtggtgcgatctgggttca

SEQ ID NO: 2787732 - DNA, 20 bp, Homo sapiens
cagtgtaaagaataaatgaa

SEQ ID NO: 2787733 - DNA, 13 bp, Homo sapiens
cagtgtactgctt

SEQ ID NO: 2787734 - DNA, 15 bp, Homo sapiens
cagtgtactgctttc

SEQ ID NO: 2787735 - DNA, 21 bp, Homo sapiens
cagtgtactgctttcaactta

SEQ ID NO: 2787736 - DNA, 19 bp, Homo sapiens
cagtgtagccttgcccgga

SEQ ID NO: 2787737 - DNA, 19 bp, Homo sapiens
cagtgtcctcttgctcaaa

SEQ ID NO: 2787738 - DNA, 24 bp, Homo sapiens
cagtgtctgtatcggagacagtga

SEQ ID NO: 2787739 - DNA, 13 bp, Homo sapiens
cagtgtcttccat

SEQ ID NO: 2787740 - DNA, 18 bp, Homo sapiens
cagtgtcttccataatgt

SEQ ID NO: 2787741 - DNA, 14 bp, Homo sapiens
cagtgtgacaagga

SEQ ID NO: 2787742 - DNA, 19 bp, Homo sapiens
cagtgtgcacccctcccca

SEQ ID NO: 2787743 - DNA, 14 bp, Homo sapiens
cagtgttattttct

SEQ ID NO: 2787744 - DNA, 20 bp, Homo sapiens
cagtgttcctcaccaataac

SEQ ID NO: 2787745 - DNA, 23 bp, Homo sapiens
cagtgttcctcaccaataacttc

SEQ ID NO: 2787746 - DNA, 22 bp, Homo sapiens
cagtgtttagaagagcctgact

SEQ ID NO: 2787747 - DNA, 15 bp, Homo sapiens
cagtgtttcccataa

SEQ ID NO: 2787748 - DNA, 20 bp, Homo sapiens
cagtgtttcccataattttc

SEQ ID NO: 2787749 - DNA, 21 bp, Homo sapiens
cagtgtttcccataattttct

SEQ ID NO: 2787750 - DNA, 15 bp, Homo sapiens
cagttacaaaaatag

SEQ ID NO: 2787751 - DNA, 14 bp, Homo sapiens
cagttactcagccc

SEQ ID NO: 2787752 - DNA, 19 bp, Homo sapiens
cagttactcagccctgggc

SEQ ID NO: 2787753 - DNA, 15 bp, Homo sapiens
cagttactggtttca

SEQ ID NO: 2787754 - DNA, 22 bp, Homo sapiens
cagttactggtttcagttgaca

SEQ ID NO: 2787755 - DNA, 22 bp, Homo sapiens
cagttatctaagttaatttaaa

SEQ ID NO: 2787756 - DNA, 20 bp, Homo sapiens
cagttatgtgaatgatctct

SEQ ID NO: 2787757 - DNA, 14 bp, Homo sapiens
cagttcaagaaagc

SEQ ID NO: 2787758 - DNA, 23 bp, Homo sapiens
cagttcaggagtcccaaggaaag

SEQ ID NO: 2787759 - DNA, 23 bp, Homo sapiens
cagttcatatgtaccatgtacat

SEQ ID NO: 2787760 - DNA, 17 bp, Homo sapiens
cagttcatctatggcag

SEQ ID NO: 2787761 - DNA, 18 bp, Homo sapiens
cagttcctcgccctgggt

SEQ ID NO: 2787762 - DNA, 15 bp, Homo sapiens
cagttcgcagccacc

SEQ ID NO: 2787763 - DNA, 21 bp, Homo sapiens
cagttcgcagccaccctgagg

SEQ ID NO: 2787764 - DNA, 17 bp, Homo sapiens
cagttctgctcctctcc

SEQ ID NO: 2787765 - DNA, 19 bp, Homo sapiens
cagttctgctcctctccag

SEQ ID NO: 2787766 - DNA, 21 bp, Homo sapiens
cagttctgctcctctccaggc

SEQ ID NO: 2787767 - DNA, 16 bp, Homo sapiens
cagttgacagcaggtg

SEQ ID NO: 2787768 - DNA, 14 bp, Homo sapiens
cagttgggagcact

SEQ ID NO: 2787769 - DNA, 15 bp, Homo sapiens
cagttgggagcactg

SEQ ID NO: 2787770 - DNA, 16 bp, Homo sapiens
cagttgggagcactgg

SEQ ID NO: 2787771 - DNA, 17 bp, Homo sapiens
cagttgggagcactgga

SEQ ID NO: 2787772 - DNA, 20 bp, Homo sapiens
cagttgggagcactggagtg

SEQ ID NO: 2787773 - DNA, 17 bp, Homo sapiens
cagtttatatttaactc

SEQ ID NO: 2787774 - DNA, 15 bp, Homo sapiens
cagtttcaggtgttt

SEQ ID NO: 2787775 - DNA, 21 bp, Homo sapiens
cagtttgcagaaaagcacctg

SEQ ID NO: 2787776 - DNA, 23 bp, Homo sapiens
cagtttgcagaaaagcacctgcc

SEQ ID NO: 2787777 - DNA, 13 bp, Homo sapiens
cagtttgtcagac

SEQ ID NO: 2787778 - DNA, 15 bp, Homo sapiens
cagttttatcatttt

SEQ ID NO: 2787779 - DNA, 12 bp, Homo sapiens
cataaacttcat

SEQ ID NO: 2787780 - DNA, 22 bp, Homo sapiens
cataaaggtggtatgtgtgtgt

SEQ ID NO: 2787781 - DNA, 23 bp, Homo sapiens
cataaaggtggtatgtgtgtgta

SEQ ID NO: 2787782 - DNA, 16 bp, Homo sapiens
cataaagtatgccttc

SEQ ID NO: 2787783 - DNA, 21 bp, Homo sapiens
cataaagttgataaagatttt

SEQ ID NO: 2787784 - DNA, 14 bp, Homo sapiens
cataaatgaggaaa

SEQ ID NO: 2787785 - DNA, 15 bp, Homo sapiens
cataacaacttcata

SEQ ID NO: 2787786 - DNA, 19 bp, Homo sapiens
cataagaaaactaagaaat

SEQ ID NO: 2787787 - DNA, 15 bp, Homo sapiens
cataagattaaagga

SEQ ID NO: 2787788 - DNA, 17 bp, Homo sapiens
cataagattaaaggaag

SEQ ID NO: 2787789 - DNA, 20 bp, Homo sapiens
cataagattaaaggaaggaa

SEQ ID NO: 2787790 - DNA, 22 bp, Homo sapiens
cataagattaaaggaaggaaaa

SEQ ID NO: 2787791 - DNA, 21 bp, Homo sapiens
cataagcctccatttagttct

SEQ ID NO: 2787792 - DNA, 23 bp, Homo sapiens
cataagcctccatttagttcttt

SEQ ID NO: 2787793 - DNA, 22 bp, Homo sapiens
cataaggaatgtagctggtttc

SEQ ID NO: 2787794 - DNA, 18 bp, Homo sapiens
cataagttggaccagagg

SEQ ID NO: 2787795 - DNA, 17 bp, Homo sapiens
cataatatcttgaagaa

SEQ ID NO: 2787796 - DNA, 19 bp, Homo sapiens
cataatatcttgaagaata

SEQ ID NO: 2787797 - DNA, 14 bp, Homo sapiens
cataatcaaagcta

SEQ ID NO: 2787798 - DNA, 18 bp, Homo sapiens
cataatgttacattatta

SEQ ID NO: 2787799 - DNA, 15 bp, Homo sapiens
cataatttgtacata

SEQ ID NO: 2787800 - DNA, 18 bp, Homo sapiens
cataattttcaagagaag

SEQ ID NO: 2787801 - DNA, 14 bp, Homo sapiens
cataattttcttca

SEQ ID NO: 2787802 - DNA, 15 bp, Homo sapiens
catacaatttgcact

SEQ ID NO: 2787803 - DNA, 20 bp, Homo sapiens
catacacctatgtcatttca

SEQ ID NO: 2787804 - DNA, 17 bp, Homo sapiens
catacactcaaacaatc

SEQ ID NO: 2787805 - DNA, 16 bp, Homo sapiens
cataccatctgctgcc

SEQ ID NO: 2787806 - DNA, 20 bp, Homo sapiens
catacccttctttaaatcaa

SEQ ID NO: 2787807 - DNA, 21 bp, Homo sapiens
catacccttctttaaatcaaa

SEQ ID NO: 2787808 - DNA, 17 bp, Homo sapiens
catctcattccaacttc

SEQ ID NO: 2787809 - DNA, 18 bp, Homo sapiens
catctcatttaagggaaa

SEQ ID NO: 2787810 - DNA, 18 bp, Homo sapiens
catctccaccctgagcct

SEQ ID NO: 2787811 - DNA, 19 bp, Homo sapiens
catctccaccctgagcctg

SEQ ID NO: 2787812 - DNA, 14 bp, Homo sapiens
catctccactccag

SEQ ID NO: 2787813 - DNA, 23 bp, Homo sapiens
catctcttcctacccaaccactc

SEQ ID NO: 2787814 - DNA, 13 bp, Homo sapiens
catctgaaagcca

SEQ ID NO: 2787815 - DNA, 19 bp, Homo sapiens
catctgaaccactttgcct

SEQ ID NO: 2787816 - DNA, 12 bp, Homo sapiens
catctgactcac

SEQ ID NO: 2787817 - DNA, 16 bp, Homo sapiens
catctgctcctcccat

SEQ ID NO: 2787818 - DNA, 13 bp, Homo sapiens
catctgctcttct

SEQ ID NO: 2787819 - DNA, 17 bp, Homo sapiens
catctgctcttctctta

SEQ ID NO: 2787820 - DNA, 19 bp, Homo sapiens
catctgcttgtattttcca

SEQ ID NO: 2787821 - DNA, 14 bp, Homo sapiens
catctgggaggctg

SEQ ID NO: 2787822 - DNA, 16 bp, Homo sapiens
catctgggattcccac

SEQ ID NO: 2787823 - DNA, 19 bp, Homo sapiens
catctgtcttgccagccag

SEQ ID NO: 2787824 - DNA, 20 bp, Homo sapiens
catctgtgtaacctccacag

SEQ ID NO: 2787825 - DNA, 16 bp, Homo sapiens
catctgtgtctctgga

SEQ ID NO: 2787826 - DNA, 16 bp, Homo sapiens
catcttagctttccac

SEQ ID NO: 2787827 - DNA, 16 bp, Homo sapiens
catcttctccatctgg

SEQ ID NO: 2787828 - DNA, 19 bp, Homo sapiens
catcttctggagtctccag

SEQ ID NO: 2787829 - DNA, 21 bp, Homo sapiens
catcttttgtgagatgtaatt

SEQ ID NO: 2787830 - DNA, 18 bp, Homo sapiens
catgaacacagcctggga

SEQ ID NO: 2787831 - DNA, 20 bp, Homo sapiens
catgaacctcaagctgcatc

SEQ ID NO: 2787832 - DNA, 17 bp, Homo sapiens
catgaagacaggacagt

SEQ ID NO: 2787833 - DNA, 16 bp, Homo sapiens
catgaagctggaagca

SEQ ID NO: 2787834 - DNA, 16 bp, Homo sapiens
catgaaggtgtcatac

SEQ ID NO: 2787835 - DNA, 22 bp, Homo sapiens
catgaatggtatggaactctct

SEQ ID NO: 2787836 - DNA, 12 bp, Homo sapiens
catgacaaagtt

SEQ ID NO: 2787837 - DNA, 13 bp, Homo sapiens
catgaccctcctg

SEQ ID NO: 2787838 - DNA, 15 bp, Homo sapiens
catgacctccagctt

SEQ ID NO: 2787839 - DNA, 20 bp, Homo sapiens
catgacctccagctttcctg

SEQ ID NO: 2787840 - DNA, 20 bp, Homo sapiens
catgactcgtatatgtctca

SEQ ID NO: 2787841 - DNA, 14 bp, Homo sapiens
catgagaagagggc

SEQ ID NO: 2787842 - DNA, 17 bp, Homo sapiens
catgagaccactgttat

SEQ ID NO: 2787843 - DNA, 19 bp, Homo sapiens
catgagaccactgttatca

SEQ ID NO: 2787844 - DNA, 17 bp, Homo sapiens
catgagcctcagcatcc

SEQ ID NO: 2787845 - DNA, 21 bp, Homo sapiens
catgagcctcagcatcctggc

SEQ ID NO: 2787846 - DNA, 22 bp, Homo sapiens
catgagcctcagcatcctggca

SEQ ID NO: 2787847 - DNA, 20 bp, Homo sapiens
catgaggacatgatggagcg

SEQ ID NO: 2787848 - DNA, 21 bp, Homo sapiens
catgaggacatgatggagcgc

SEQ ID NO: 2787849 - DNA, 22 bp, Homo sapiens
catgaggacatgatggagcgca

SEQ ID NO: 2787850 - DNA, 23 bp, Homo sapiens
catgaggcaatgtcaggaacaga

SEQ ID NO: 2787851 - DNA, 17 bp, Homo sapiens
catgagggatcacaggg

SEQ ID NO: 2787852 - DNA, 19 bp, Homo sapiens
catgagggatcacagggcc

SEQ ID NO: 2787853 - DNA, 17 bp, Homo sapiens
catgatctccctgccgc

SEQ ID NO: 2787854 - DNA, 21 bp, Homo sapiens
catgatctccctgccgcctca

SEQ ID NO: 2787855 - DNA, 14 bp, Homo sapiens
catgattcatttta

SEQ ID NO: 2787856 - DNA, 12 bp, Homo sapiens
catgattttaca

SEQ ID NO: 2787857 - DNA, 14 bp, Homo sapiens
catgattttataca

SEQ ID NO: 2787858 - DNA, 15 bp, Homo sapiens
catgattttatacat

SEQ ID NO: 2787859 - DNA, 14 bp, Homo sapiens
catgcaccagtgcc

SEQ ID NO: 2787860 - DNA, 16 bp, Homo sapiens
catgcacgtgtgtgca

SEQ ID NO: 2787861 - DNA, 19 bp, Homo sapiens
catgcagcttcatcaattt

SEQ ID NO: 2787862 - DNA, 19 bp, Homo sapiens
catgcatagtgctaagaaa

SEQ ID NO: 2787863 - DNA, 20 bp, Homo sapiens
catgcattactgcatgcact

SEQ ID NO: 2787864 - DNA, 18 bp, Homo sapiens
catgccatctccaccctg

SEQ ID NO: 2787865 - DNA, 19 bp, Homo sapiens
catgcctacagataattta

SEQ ID NO: 2787866 - DNA, 16 bp, Homo sapiens
catgcctctgaggcca

SEQ ID NO: 2787867 - DNA, 21 bp, Homo sapiens
catgcctctgaggccagcctg

SEQ ID NO: 2787868 - DNA, 21 bp, Homo sapiens
catgcctggcccccctccagg

SEQ ID NO: 2787869 - DNA, 17 bp, Homo sapiens
catgctaagagaagtag

SEQ ID NO: 2787870 - DNA, 15 bp, Homo sapiens
catgctcaaccactg

SEQ ID NO: 2787871 - DNA, 14 bp, Homo sapiens
catgctctctgcag

SEQ ID NO: 2787872 - DNA, 23 bp, Homo sapiens
catgctctctgcagccagcccag

SEQ ID NO: 2787873 - DNA, 15 bp, Homo sapiens
catgctgaattattt

SEQ ID NO: 2787874 - DNA, 12 bp, Homo sapiens
catgctgcctcc

SEQ ID NO: 2787875 - DNA, 20 bp, Homo sapiens
catgctggcctcccaataaa

SEQ ID NO: 2787876 - DNA, 22 bp, Homo sapiens
catgctggcctcccaataaagc

SEQ ID NO: 2787877 - DNA, 23 bp, Homo sapiens
catgctggcctcccaataaagct

SEQ ID NO: 2787878 - DNA, 13 bp, Homo sapiens
catgcttcttgcc

SEQ ID NO: 2787879 - DNA, 14 bp, Homo sapiens
catgctttcccacc

SEQ ID NO: 2787880 - DNA, 15 bp, Homo sapiens
catggaaggcggcac

SEQ ID NO: 2787881 - DNA, 21 bp, Homo sapiens
catggacagaagaaggcagca

SEQ ID NO: 2787882 - DNA, 14 bp, Homo sapiens
catggaccaagaat

SEQ ID NO: 2787883 - DNA, 17 bp, Homo sapiens
catggagaaaccctgtc

SEQ ID NO: 2787884 - DNA, 20 bp, Homo sapiens
catggagactcctgccctgt

SEQ ID NO: 2787885 - DNA, 22 bp, Homo sapiens
catggaggagcttgggggatga

SEQ ID NO: 2787886 - DNA, 14 bp, Homo sapiens
catggcgtgtccct

SEQ ID NO: 2787887 - DNA, 17 bp, Homo sapiens
catggctattttatatt

SEQ ID NO: 2787888 - DNA, 12 bp, Homo sapiens
catggctggggt

SEQ ID NO: 2787889 - DNA, 23 bp, Homo sapiens
catgggaatgtgcctcggcctcc

SEQ ID NO: 2787890 - DNA, 21 bp, Homo sapiens
catgggagctggttagaaatg

SEQ ID NO: 2787891 - DNA, 15 bp, Homo sapiens
catgggcctcctgtg

SEQ ID NO: 2787892 - DNA, 15 bp, Homo sapiens
catggtcccacatcc

SEQ ID NO: 2787893 - DNA, 19 bp, Homo sapiens
catggtgcagttgacagca

SEQ ID NO: 2787894 - DNA, 18 bp, Homo sapiens
catggtggcgcaagcctg

SEQ ID NO: 2787895 - DNA, 22 bp, Homo sapiens
catggtgtgaaagtcagatgcc

SEQ ID NO: 2787896 - DNA, 12 bp, Homo sapiens
catgtaataaat

SEQ ID NO: 2787897 - DNA, 16 bp, Homo sapiens
catgtaccagtgtact

SEQ ID NO: 2787898 - DNA, 18 bp, Homo sapiens
cattgtttgtctgtcttc

SEQ ID NO: 2787899 - DNA, 14 bp, Homo sapiens
catttaagggaaaa

SEQ ID NO: 2787900 - DNA, 17 bp, Homo sapiens
catttaagggaaaaata

SEQ ID NO: 2787901 - DNA, 19 bp, Homo sapiens
catttaagggaaaaatata

SEQ ID NO: 2787902 - DNA, 23 bp, Homo sapiens
catttacaataaatattctgcat

SEQ ID NO: 2787903 - DNA, 15 bp, Homo sapiens
catttaggtttctga

SEQ ID NO: 2787904 - DNA, 20 bp, Homo sapiens
catttagtccaatgtctttt

SEQ ID NO: 2787905 - DNA, 14 bp, Homo sapiens
catttagttctttg

SEQ ID NO: 2787906 - DNA, 19 bp, Homo sapiens
catttatatatatatgtat

SEQ ID NO: 2787907 - DNA, 16 bp, Homo sapiens
catttatgaagcaagc

SEQ ID NO: 2787908 - DNA, 15 bp, Homo sapiens
catttcaactgtttg

SEQ ID NO: 2787909 - DNA, 17 bp, Homo sapiens
catttcactttaaagtc

SEQ ID NO: 2787910 - DNA, 14 bp, Homo sapiens
catttcatctattt

SEQ ID NO: 2787911 - DNA, 15 bp, Homo sapiens
catttcatctatttc

SEQ ID NO: 2787912 - DNA, 17 bp, Homo sapiens
catttccaaatgaatga

SEQ ID NO: 2787913 - DNA, 21 bp, Homo sapiens
catttccaaatgaatgacctt

SEQ ID NO: 2787914 - DNA, 14 bp, Homo sapiens
catttccctcctgg

SEQ ID NO: 2787915 - DNA, 19 bp, Homo sapiens
catttccgtgaagggcacc

SEQ ID NO: 2787916 - DNA, 20 bp, Homo sapiens
catttcctgggtggctactc

SEQ ID NO: 2787917 - DNA, 13 bp, Homo sapiens
catttcctgtgtc

SEQ ID NO: 2787918 - DNA, 17 bp, Homo sapiens
catttccttggaggcca

SEQ ID NO: 2787919 - DNA, 23 bp, Homo sapiens
catttccttggaggccaccggga

SEQ ID NO: 2787920 - DNA, 18 bp, Homo sapiens
catttctatttatttact

SEQ ID NO: 2787921 - DNA, 23 bp, Homo sapiens
catttctatttatttactgagct

SEQ ID NO: 2787922 - DNA, 16 bp, Homo sapiens
catttgagcagggctc

SEQ ID NO: 2787923 - DNA, 13 bp, Homo sapiens
catttgagtgtct

SEQ ID NO: 2787924 - DNA, 15 bp, Homo sapiens
catttgataaactaa

SEQ ID NO: 2787925 - DNA, 18 bp, Homo sapiens
catttgatgtacatgtgt

SEQ ID NO: 2787926 - DNA, 14 bp, Homo sapiens
catttgtgaaatga

SEQ ID NO: 2787927 - DNA, 16 bp, Homo sapiens
catttgtgaaatgatg

SEQ ID NO: 2787928 - DNA, 15 bp, Homo sapiens
catttgtttctactt

SEQ ID NO: 2787929 - DNA, 16 bp, Homo sapiens
cattttaactttatca

SEQ ID NO: 2787930 - DNA, 17 bp, Homo sapiens
cattttactgtctgtaa

SEQ ID NO: 2787931 - DNA, 15 bp, Homo sapiens
cattttctctagctg

SEQ ID NO: 2787932 - DNA, 12 bp, Homo sapiens
cattttgcaaaa

SEQ ID NO: 2787933 - DNA, 14 bp, Homo sapiens
cattttgcaaaatt

SEQ ID NO: 2787934 - DNA, 20 bp, Homo sapiens
cattttgcagcagtgagtct

SEQ ID NO: 2787935 - DNA, 18 bp, Homo sapiens
cattttggaagttttcag

SEQ ID NO: 2787936 - DNA, 22 bp, Homo sapiens
cattttggaagttttcaggact

SEQ ID NO: 2787937 - DNA, 20 bp, Homo sapiens
cattttggggtacccactgc

SEQ ID NO: 2787938 - DNA, 21 bp, Homo sapiens
cattttggggtacccactgct

SEQ ID NO: 2787939 - DNA, 16 bp, Homo sapiens
cattttggtactttgg

SEQ ID NO: 2787940 - DNA, 22 bp, Homo sapiens
cattttgtggtcattaagcatt

SEQ ID NO: 2787941 - DNA, 17 bp, Homo sapiens
catttttactaaagcag

SEQ ID NO: 2787942 - DNA, 18 bp, Homo sapiens
catttttactaaagcagt

SEQ ID NO: 2787943 - DNA, 21 bp, Homo sapiens
catttttactaaagcagtgtt

SEQ ID NO: 2787944 - DNA, 19 bp, Homo sapiens
catttttagtagagacagg

SEQ ID NO: 2787945 - DNA, 20 bp, Homo sapiens
catttttagtagagacaggg

SEQ ID NO: 2787946 - DNA, 23 bp, Homo sapiens
catttttggtaggcttatcaaaa

SEQ ID NO: 2787947 - DNA, 12 bp, Homo sapiens
ccaaaaatagct

SEQ ID NO: 2787948 - DNA, 17 bp, Homo sapiens
ccaaaagttacatgttt

SEQ ID NO: 2787949 - DNA, 14 bp, Homo sapiens
ccaaacaccggcag

SEQ ID NO: 2787950 - DNA, 13 bp, Homo sapiens
ccaaacagagcct

SEQ ID NO: 2787951 - DNA, 20 bp, Homo sapiens
ccaaagaaaaagggctgccg

SEQ ID NO: 2787952 - DNA, 20 bp, Homo sapiens
ccaaagagactggagcatct

SEQ ID NO: 2787953 - DNA, 15 bp, Homo sapiens
ccaaagagcctggag

SEQ ID NO: 2787954 - DNA, 23 bp, Homo sapiens
ccaaagccccttgctctcccctg

SEQ ID NO: 2787955 - DNA, 17 bp, Homo sapiens
ccaaagctaggcctggc

SEQ ID NO: 2787956 - DNA, 21 bp, Homo sapiens
ccaaagctgttggtctgtccc

SEQ ID NO: 2787957 - DNA, 18 bp, Homo sapiens
ccaaaggaagtctaggag

SEQ ID NO: 2787958 - DNA, 14 bp, Homo sapiens
ccaaagtgctggga

SEQ ID NO: 2787959 - DNA, 14 bp, Homo sapiens
ccaaataagcatct

SEQ ID NO: 2787960 - DNA, 19 bp, Homo sapiens
ccaaatggctctgtgaaat

SEQ ID NO: 2787961 - DNA, 22 bp, Homo sapiens
ccaaatgtaattgaataaagtt

SEQ ID NO: 2787962 - DNA, 16 bp, Homo sapiens
ccaaattggtgtttct

SEQ ID NO: 2787963 - DNA, 18 bp, Homo sapiens
ccaacaactccaggaaaa

SEQ ID NO: 2787964 - DNA, 14 bp, Homo sapiens
ccaacacccctccc

SEQ ID NO: 2787965 - DNA, 11 bp, Homo sapiens
ccaacagcagc

SEQ ID NO: 2787966 - DNA, 14 bp, Homo sapiens
ccaacaggtggcag

SEQ ID NO: 2787967 - DNA, 18 bp, Homo sapiens
ccaacaggtggcaggacc

SEQ ID NO: 2787968 - DNA, 19 bp, Homo sapiens
ccaacaggtggcaggacca

SEQ ID NO: 2787969 - DNA, 23 bp, Homo sapiens
ccaacaggtggcaggaccaggac

SEQ ID NO: 2787970 - DNA, 19 bp, Homo sapiens
ccaacatacccttctttaa

SEQ ID NO: 2787971 - DNA, 20 bp, Homo sapiens
ccaacatcccattgccctgg

SEQ ID NO: 2787972 - DNA, 21 bp, Homo sapiens
ccaacatcccattgccctggt

SEQ ID NO: 2787973 - DNA, 15 bp, Homo sapiens
ccaacatggtgaaac

SEQ ID NO: 2787974 - DNA, 20 bp, Homo sapiens
ccaaccaagtggctcccaca

SEQ ID NO: 2787975 - DNA, 12 bp, Homo sapiens
ccaacccatcag

SEQ ID NO: 2787976 - DNA, 14 bp, Homo sapiens
ccaacccgtggagg

SEQ ID NO: 2787977 - DNA, 16 bp, Homo sapiens
ccaaccctgtttcctg

SEQ ID NO: 2787978 - DNA, 16 bp, Homo sapiens
ccaacctttccctcac

SEQ ID NO: 2787979 - DNA, 21 bp, Homo sapiens
ccaacttcatttgatgctaaa

SEQ ID NO: 2787980 - DNA, 11 bp, Homo sapiens
ccaacttgtaa

SEQ ID NO: 2787981 - DNA, 12 bp, Homo sapiens
ccaagagatgaa

SEQ ID NO: 2787982 - DNA, 22 bp, Homo sapiens
ccaagagcatcatgcctctgag

SEQ ID NO: 2787983 - DNA, 20 bp, Homo sapiens
ccaagatgatcacatggaag

SEQ ID NO: 2787984 - DNA, 18 bp, Homo sapiens
ccaagctcacagttcctc

SEQ ID NO: 2787985 - DNA, 14 bp, Homo sapiens
ccaagctccatctc

SEQ ID NO: 2787986 - DNA, 18 bp, Homo sapiens
ccaagctctagtgggaag

SEQ ID NO: 2787987 - DNA, 17 bp, Homo sapiens
ccaagctctgctcctct

SEQ ID NO: 2787988 - DNA, 23 bp, Homo sapiens
ccaagctgaggtgcccaggagaa

SEQ ID NO: 2787989 - DNA, 20 bp, Homo sapiens
ccagagaccccttcctttcc

SEQ ID NO: 2787990 - DNA, 13 bp, Homo sapiens
ccagagagggtgg

SEQ ID NO: 2787991 - DNA, 16 bp, Homo sapiens
ccagagatgcctccac

SEQ ID NO: 2787992 - DNA, 17 bp, Homo sapiens
ccagagatgcctccacc

SEQ ID NO: 2787993 - DNA, 20 bp, Homo sapiens
ccagagcattacgtgagcca

SEQ ID NO: 2787994 - DNA, 22 bp, Homo sapiens
ccagagcattacgtgagccagg

SEQ ID NO: 2787995 - DNA, 14 bp, Homo sapiens
ccagagcccacctt

SEQ ID NO: 2787996 - DNA, 16 bp, Homo sapiens
ccagagcccaccttgg

SEQ ID NO: 2787997 - DNA, 22 bp, Homo sapiens
ccagagcccaccttggctcaag

SEQ ID NO: 2787998 - DNA, 16 bp, Homo sapiens
ccagagcccatgctca

SEQ ID NO: 2787999 - DNA, 14 bp, Homo sapiens
ccagagccccccac

SEQ ID NO: 2788000 - DNA, 19 bp, Homo sapiens
ccagagcctgtctttcagc

SEQ ID NO: 2788001 - DNA, 23 bp, Homo sapiens
ccagagcctgtctttcagcattc

SEQ ID NO: 2788002 - DNA, 23 bp, Homo sapiens
ccagagccttctcctgcctacat

SEQ ID NO: 2788003 - DNA, 12 bp, Homo sapiens
ccagaggaagcc

SEQ ID NO: 2788004 - DNA, 14 bp, Homo sapiens
ccagaggctgcaga

SEQ ID NO: 2788005 - DNA, 18 bp, Homo sapiens
ccagagggagtgacagag

SEQ ID NO: 2788006 - DNA, 20 bp, Homo sapiens
ccagagggagtgacagaggc

SEQ ID NO: 2788007 - DNA, 14 bp, Homo sapiens
ccagataagaatgc

SEQ ID NO: 2788008 - DNA, 21 bp, Homo sapiens
ccagatacttcccattttgga

SEQ ID NO: 2788009 - DNA, 18 bp, Homo sapiens
ccagatcaccagcccggc

SEQ ID NO: 2788010 - DNA, 21 bp, Homo sapiens
ccagatcaccagcccggcctg

SEQ ID NO: 2788011 - DNA, 14 bp, Homo sapiens
ccagatcctcacaa

SEQ ID NO: 2788012 - DNA, 17 bp, Homo sapiens
ccagatcctcacaacca

SEQ ID NO: 2788013 - DNA, 22 bp, Homo sapiens
ccagatgagaagttaagcagcc

SEQ ID NO: 2788014 - DNA, 23 bp, Homo sapiens
ccagatgagaagttaagcagcct

SEQ ID NO: 2788015 - DNA, 13 bp, Homo sapiens
ccagatgcaccag

SEQ ID NO: 2788016 - DNA, 14 bp, Homo sapiens
ccagatgcaccagc

SEQ ID NO: 2788017 - DNA, 15 bp, Homo sapiens
ccagatgcaccagcc

SEQ ID NO: 2788018 - DNA, 18 bp, Homo sapiens
ccagatgcaccagccctt

SEQ ID NO: 2788019 - DNA, 19 bp, Homo sapiens
ccagattgttctgtccagt

SEQ ID NO: 2788020 - DNA, 16 bp, Homo sapiens
ccagatttttacacat

SEQ ID NO: 2788021 - DNA, 21 bp, Homo sapiens
ccagcaaagagtgggctgcat

SEQ ID NO: 2788022 - DNA, 15 bp, Homo sapiens
ccagcaacacaagct

SEQ ID NO: 2788023 - DNA, 21 bp, Homo sapiens
ccagcaacacaagctggaagc

SEQ ID NO: 2788024 - DNA, 15 bp, Homo sapiens
ccagcaagtgagagc

SEQ ID NO: 2788025 - DNA, 17 bp, Homo sapiens
ccagcaagtgagagctg

SEQ ID NO: 2788026 - DNA, 19 bp, Homo sapiens
ccagcaagtgagagctggg

SEQ ID NO: 2788027 - DNA, 18 bp, Homo sapiens
ccagcactaaagcagtgg

SEQ ID NO: 2788028 - DNA, 12 bp, Homo sapiens
ccagcactgtga

SEQ ID NO: 2788029 - DNA, 20 bp, Homo sapiens
ccagcactgtgaagacccag

SEQ ID NO: 2788030 - DNA, 13 bp, Homo sapiens
ccagcagaaaagt

SEQ ID NO: 2788031 - DNA, 16 bp, Homo sapiens
ccagcagccagctctc

SEQ ID NO: 2788032 - DNA, 18 bp, Homo sapiens
ccagcagccagctctcag

SEQ ID NO: 2788033 - DNA, 21 bp, Homo sapiens
ccagcagccctaaggatctct

SEQ ID NO: 2788034 - DNA, 19 bp, Homo sapiens
ccagcatccttttctgcag

SEQ ID NO: 2788035 - DNA, 24 bp, Homo sapiens
ccagccaataaatcaactccagct

SEQ ID NO: 2788036 - DNA, 15 bp, Homo sapiens
ccagccacacagagc

SEQ ID NO: 2788037 - DNA, 17 bp, Homo sapiens
ccagccacacagagcct

SEQ ID NO: 2788038 - DNA, 19 bp, Homo sapiens
ccagccacacagagcctgc

SEQ ID NO: 2788039 - DNA, 21 bp, Homo sapiens
ccagccactcgggaggctgag

SEQ ID NO: 2788040 - DNA, 13 bp, Homo sapiens
ccagccagaagcc

SEQ ID NO: 2788041 - DNA, 16 bp, Homo sapiens
ccagccagcagccagc

SEQ ID NO: 2788042 - DNA, 23 bp, Homo sapiens
ccagccagcagccagctctcagc

SEQ ID NO: 2788043 - DNA, 19 bp, Homo sapiens
ccagccattaccatggaga

SEQ ID NO: 2788044 - DNA, 21 bp, Homo sapiens
ccagccattaccatggagaca

SEQ ID NO: 2788045 - DNA, 16 bp, Homo sapiens
ccagcccagcccagct

SEQ ID NO: 2788046 - DNA, 15 bp, Homo sapiens
ccagccccagcaaga

SEQ ID NO: 2788047 - DNA, 13 bp, Homo sapiens
ccagccccagtgc

SEQ ID NO: 2788048 - DNA, 19 bp, Homo sapiens
ccagccccgactccagcca

SEQ ID NO: 2788049 - DNA, 20 bp, Homo sapiens
ccagccccgactccagccag

SEQ ID NO: 2788050 - DNA, 22 bp, Homo sapiens
ccagccccgactccagccagcg

SEQ ID NO: 2788051 - DNA, 13 bp, Homo sapiens
ccagcccctcctc

SEQ ID NO: 2788052 - DNA, 15 bp, Homo sapiens
ccagcccctcctccc

SEQ ID NO: 2788053 - DNA, 16 bp, Homo sapiens
ccagcccctcctcccc

SEQ ID NO: 2788054 - DNA, 17 bp, Homo sapiens
ccagcccctcctcccct

SEQ ID NO: 2788055 - DNA, 23 bp, Homo sapiens
ccagcccctcctccccttcctgc

SEQ ID NO: 2788056 - DNA, 14 bp, Homo sapiens
ccagccccttgaga

SEQ ID NO: 2788057 - DNA, 14 bp, Homo sapiens
ccagcccggcctgc

SEQ ID NO: 2788058 - DNA, 17 bp, Homo sapiens
ccagcccggcctgctcc

SEQ ID NO: 2788059 - DNA, 19 bp, Homo sapiens
ccagccctccctgtcctcc

SEQ ID NO: 2788060 - DNA, 14 bp, Homo sapiens
ccagccctgcctgg

SEQ ID NO: 2788061 - DNA, 18 bp, Homo sapiens
ccagccctgcctggagga

SEQ ID NO: 2788062 - DNA, 19 bp, Homo sapiens
ccagccgaccggccctgcc

SEQ ID NO: 2788063 - DNA, 21 bp, Homo sapiens
ccagccggggcgagtggcacg

SEQ ID NO: 2788064 - DNA, 23 bp, Homo sapiens
ccagccgggtacctcagtttctc

SEQ ID NO: 2788065 - DNA, 14 bp, Homo sapiens
ccagccggtgcctg

SEQ ID NO: 2788066 - DNA, 15 bp, Homo sapiens
ccagccggtgcctgg

SEQ ID NO: 2788067 - DNA, 14 bp, Homo sapiens
ccagcctcctccca

SEQ ID NO: 2788068 - DNA, 18 bp, Homo sapiens
ccagcctcctcccaccac

SEQ ID NO: 2788069 - DNA, 12 bp, Homo sapiens
ccagcctctgtc

SEQ ID NO: 2788070 - DNA, 12 bp, Homo sapiens
ccagcctgagca

SEQ ID NO: 2788071 - DNA, 12 bp, Homo sapiens
ccagcctggcct

SEQ ID NO: 2788072 - DNA, 15 bp, Homo sapiens
ccagcctggcctcct

SEQ ID NO: 2788073 - DNA, 16 bp, Homo sapiens
ccagcctggcctcctg

SEQ ID NO: 2788074 - DNA, 20 bp, Homo sapiens
ccagcctggcctcctgcctc

SEQ ID NO: 2788075 - DNA, 19 bp, Homo sapiens
ccagcctggcttctggagc

SEQ ID NO: 2788076 - DNA, 21 bp, Homo sapiens
ccagcctggcttctggagccc

SEQ ID NO: 2788077 - DNA, 16 bp, Homo sapiens
ccagcctgggcgacag

SEQ ID NO: 2788078 - DNA, 19 bp, Homo sapiens
ccagccttctctctctggt

SEQ ID NO: 2788079 - DNA, 13 bp, Homo sapiens
ccagcgagccctg

SEQ ID NO: 2788080 - DNA, 14 bp, Homo sapiens
ataatggtttactg

SEQ ID NO: 2788081 - DNA, 17 bp, Homo sapiens
ataatggtttactgctg

SEQ ID NO: 2788082 - DNA, 19 bp, Homo sapiens
ataatggtttactgctgtc

SEQ ID NO: 2788083 - DNA, 20 bp, Homo sapiens
ataatggtttactgctgtca

SEQ ID NO: 2788084 - DNA, 19 bp, Homo sapiens
ataatgtagtatgatgtaa

SEQ ID NO: 2788085 - DNA, 18 bp, Homo sapiens
ataatgtggatttcctat

SEQ ID NO: 2788086 - DNA, 14 bp, Homo sapiens
ataatgttgttatt

SEQ ID NO: 2788087 - DNA, 15 bp, Homo sapiens
ataattaaaaaccac

SEQ ID NO: 2788088 - DNA, 21 bp, Homo sapiens
ataattagaacaatagctatt

SEQ ID NO: 2788089 - DNA, 14 bp, Homo sapiens
ataattaggatcta

SEQ ID NO: 2788090 - DNA, 17 bp, Homo sapiens
ataattatccagagttt

SEQ ID NO: 2788091 - DNA, 19 bp, Homo sapiens
ataattatcggaagcagtg

SEQ ID NO: 2788092 - DNA, 16 bp, Homo sapiens
ataattatgacagtta

SEQ ID NO: 2788093 - DNA, 19 bp, Homo sapiens
ataattatgacagttatac

SEQ ID NO: 2788094 - DNA, 19 bp, Homo sapiens
ataattccctatcttttag

SEQ ID NO: 2788095 - DNA, 19 bp, Homo sapiens
ataattcttgtatattatg

SEQ ID NO: 2788096 - DNA, 13 bp, Homo sapiens
ataattgtgtaca

SEQ ID NO: 2788097 - DNA, 15 bp, Homo sapiens
ataattgtgtacaaa

SEQ ID NO: 2788098 - DNA, 19 bp, Homo sapiens
ataattgtgtacaaagtag

SEQ ID NO: 2788099 - DNA, 17 bp, Homo sapiens
ataatttaactaattta

SEQ ID NO: 2788100 - DNA, 19 bp, Homo sapiens
ataatttaactaatttaaa

SEQ ID NO: 2788101 - DNA, 20 bp, Homo sapiens
ataatttagtttcatataaa

SEQ ID NO: 2788102 - DNA, 19 bp, Homo sapiens
ataattttatgaatgtctt

SEQ ID NO: 2788103 - DNA, 15 bp, Homo sapiens
ataattttcctccta

SEQ ID NO: 2788104 - DNA, 23 bp, Homo sapiens
ataattttcttcatgcaatgaca

SEQ ID NO: 2788105 - DNA, 15 bp, Homo sapiens
ataatttttaaagta

SEQ ID NO: 2788106 - DNA, 18 bp, Homo sapiens
ataatttttaaagtatat

SEQ ID NO: 2788107 - DNA, 21 bp, Homo sapiens
ataatttttaaagtatatatt

SEQ ID NO: 2788108 - DNA, 23 bp, Homo sapiens
ataatttttttattactgatttt

SEQ ID NO: 2788109 - DNA, 19 bp, Homo sapiens
atacaaaataatttaacta

SEQ ID NO: 2788110 - DNA, 19 bp, Homo sapiens
atacaaacatatttgttaa

SEQ ID NO: 2788111 - DNA, 16 bp, Homo sapiens
atacaaacatgtggca

SEQ ID NO: 2788112 - DNA, 23 bp, Homo sapiens
atacaaatatatttaattgtgtc

SEQ ID NO: 2788113 - DNA, 20 bp, Homo sapiens
atacaccacctcactcctgt

SEQ ID NO: 2788114 - DNA, 14 bp, Homo sapiens
atacagaaaatgct

SEQ ID NO: 2788115 - DNA, 23 bp, Homo sapiens
atacagaaagatggatgtgcttt

SEQ ID NO: 2788116 - DNA, 14 bp, Homo sapiens
atacagaatgaatc

SEQ ID NO: 2788117 - DNA, 19 bp, Homo sapiens
atacagacactaagttata

SEQ ID NO: 2788118 - DNA, 22 bp, Homo sapiens
atacagattctagccaaactat

SEQ ID NO: 2788119 - DNA, 13 bp, Homo sapiens
atacagctcagaa

SEQ ID NO: 2788120 - DNA, 23 bp, Homo sapiens
atacaggaaaagctgctgacagt

SEQ ID NO: 2788121 - DNA, 21 bp, Homo sapiens
atacagggcatgcattttgca

SEQ ID NO: 2788122 - DNA, 13 bp, Homo sapiens
atacagtaaagtt

SEQ ID NO: 2788123 - DNA, 18 bp, Homo sapiens
atacagtaaagtttaaaa

SEQ ID NO: 2788124 - DNA, 23 bp, Homo sapiens
atacagtgttattttctttgaaa

SEQ ID NO: 2788125 - DNA, 16 bp, Homo sapiens
atacatagtcacaaaa

SEQ ID NO: 2788126 - DNA, 13 bp, Homo sapiens
atacatatcagaa

SEQ ID NO: 2788127 - DNA, 21 bp, Homo sapiens
atacatatcagaaaagtagaa

SEQ ID NO: 2788128 - DNA, 16 bp, Homo sapiens
atacatattataaata

SEQ ID NO: 2788129 - DNA, 17 bp, Homo sapiens
atacatattataaataa

SEQ ID NO: 2788130 - DNA, 20 bp, Homo sapiens
atacatattataaataaatg

SEQ ID NO: 2788131 - DNA, 23 bp, Homo sapiens
atacatattataaataaatgcca

SEQ ID NO: 2788132 - DNA, 12 bp, Homo sapiens
atacatgtatag

SEQ ID NO: 2788133 - DNA, 16 bp, Homo sapiens
atacattttatatctg

SEQ ID NO: 2788134 - DNA, 19 bp, Homo sapiens
ataccagtgaaccaaagag

SEQ ID NO: 2788135 - DNA, 20 bp, Homo sapiens
ataccagtgaaccaaagaga

SEQ ID NO: 2788136 - DNA, 12 bp, Homo sapiens
ataccagtgtgg

SEQ ID NO: 2788137 - DNA, 20 bp, Homo sapiens
atacccttctttaaatcaaa

SEQ ID NO: 2788138 - DNA, 16 bp, Homo sapiens
atacctctgtgtgctc

SEQ ID NO: 2788139 - DNA, 23 bp, Homo sapiens
ataccttgaaaaagtagagaaca

SEQ ID NO: 2788140 - DNA, 17 bp, Homo sapiens
atactaagcattgaatg

SEQ ID NO: 2788141 - DNA, 23 bp, Homo sapiens
atactagaaagctctgcatgtgt

SEQ ID NO: 2788142 - DNA, 20 bp, Homo sapiens
atactccaagcttcaagtga

SEQ ID NO: 2788143 - DNA, 21 bp, Homo sapiens
atactccaagcttcaagtgat

SEQ ID NO: 2788144 - DNA, 21 bp, Homo sapiens
atactctagaacatgcacatt

SEQ ID NO: 2788145 - DNA, 12 bp, Homo sapiens
atactctgtcag

SEQ ID NO: 2788146 - DNA, 19 bp, Homo sapiens
atactcttaggaagagaaa

SEQ ID NO: 2788147 - DNA, 13 bp, Homo sapiens
atactggaagttt

SEQ ID NO: 2788148 - DNA, 14 bp, Homo sapiens
atactggaagtttt

SEQ ID NO: 2788149 - DNA, 19 bp, Homo sapiens
atacttatatggaaattct

SEQ ID NO: 2788150 - DNA, 21 bp, Homo sapiens
atagaaagctgtttatttatt

SEQ ID NO: 2788151 - DNA, 19 bp, Homo sapiens
atagaatataattatcgga

SEQ ID NO: 2788152 - DNA, 13 bp, Homo sapiens
atagaatgacagt

SEQ ID NO: 2788153 - DNA, 17 bp, Homo sapiens
atagacagaagaaacaa

SEQ ID NO: 2788154 - DNA, 14 bp, Homo sapiens
atagagaaaaactt

SEQ ID NO: 2788155 - DNA, 13 bp, Homo sapiens
atagatcttctga

SEQ ID NO: 2788156 - DNA, 14 bp, Homo sapiens
atagatcttctgaa

SEQ ID NO: 2788157 - DNA, 19 bp, Homo sapiens
atagatgcaagatatttat

SEQ ID NO: 2788158 - DNA, 13 bp, Homo sapiens
atagatgggtctg

SEQ ID NO: 2788159 - DNA, 23 bp, Homo sapiens
atagatgggtctggctgagctga

SEQ ID NO: 2788160 - DNA, 16 bp, Homo sapiens
atagcaaaagaagaag

SEQ ID NO: 2788161 - DNA, 19 bp, Homo sapiens
atagcaaaagaagaagttt

SEQ ID NO: 2788162 - DNA, 14 bp, Homo sapiens
atagcatctgctct

SEQ ID NO: 2788163 - DNA, 23 bp, Homo sapiens
atagccacttaccttcaataaag

SEQ ID NO: 2788164 - DNA, 17 bp, Homo sapiens
atagcctaggtgacaga

SEQ ID NO: 2788165 - DNA, 20 bp, Homo sapiens
atagcgtgggttatcagtta

SEQ ID NO: 2788166 - DNA, 23 bp, Homo sapiens
atagctatcatttcttttccaaa

SEQ ID NO: 2788167 - DNA, 23 bp, Homo sapiens
atagctattgcatgtaaaatgca

SEQ ID NO: 2788168 - DNA, 18 bp, Homo sapiens
atagctatttttatggaa

SEQ ID NO: 2788169 - DNA, 20 bp, Homo sapiens
atagctcaggtgtccctgca

SEQ ID NO: 2788170 - DNA, 14 bp, Homo sapiens
atccattcctcagg

SEQ ID NO: 2788171 - DNA, 20 bp, Homo sapiens
atccatttcatctatttctg

SEQ ID NO: 2788172 - DNA, 14 bp, Homo sapiens
atcccacccacatg

SEQ ID NO: 2788173 - DNA, 18 bp, Homo sapiens
atcccacccacatgtgac

SEQ ID NO: 2788174 - DNA, 23 bp, Homo sapiens
atcccacccacatgtgacacata

SEQ ID NO: 2788175 - DNA, 23 bp, Homo sapiens
atcccagagcccagggcatccca

SEQ ID NO: 2788176 - DNA, 19 bp, Homo sapiens
atcccagcactttgggagg

SEQ ID NO: 2788177 - DNA, 22 bp, Homo sapiens
atcccagcactttgggaggctg

SEQ ID NO: 2788178 - DNA, 23 bp, Homo sapiens
atcccagctactcaagaggctga

SEQ ID NO: 2788179 - DNA, 17 bp, Homo sapiens
atcccagctactcagga

SEQ ID NO: 2788180 - DNA, 20 bp, Homo sapiens
atcccaggggaccacacctc

SEQ ID NO: 2788181 - DNA, 23 bp, Homo sapiens
atcccaggggaccacacctccct

SEQ ID NO: 2788182 - DNA, 15 bp, Homo sapiens
atcccatccatcagc

SEQ ID NO: 2788183 - DNA, 16 bp, Homo sapiens
atcccatccatcagct

SEQ ID NO: 2788184 - DNA, 22 bp, Homo sapiens
atcccatgggggtgctgcagcc

SEQ ID NO: 2788185 - DNA, 16 bp, Homo sapiens
atcccattgccctggt

SEQ ID NO: 2788186 - DNA, 12 bp, Homo sapiens
atccccagccag

SEQ ID NO: 2788187 - DNA, 17 bp, Homo sapiens
atccccaggtctctcca

SEQ ID NO: 2788188 - DNA, 22 bp, Homo sapiens
atccccaggtctctccactgct

SEQ ID NO: 2788189 - DNA, 14 bp, Homo sapiens
atcccccactgcca

SEQ ID NO: 2788190 - DNA, 22 bp, Homo sapiens
atcccctttattaattcattaa

SEQ ID NO: 2788191 - DNA, 13 bp, Homo sapiens
atcccctttcctc

SEQ ID NO: 2788192 - DNA, 15 bp, Homo sapiens
atcccctttcctccc

SEQ ID NO: 2788193 - DNA, 18 bp, Homo sapiens
atcccctttcctccccac

SEQ ID NO: 2788194 - DNA, 14 bp, Homo sapiens
atcccgctcctgct

SEQ ID NO: 2788195 - DNA, 15 bp, Homo sapiens
atcccgctcctgctg

SEQ ID NO: 2788196 - DNA, 20 bp, Homo sapiens
atccctgggcctgctgctga

SEQ ID NO: 2788197 - DNA, 21 bp, Homo sapiens
atccctgggcctgctgctgag

SEQ ID NO: 2788198 - DNA, 19 bp, Homo sapiens
atccctgttacccagagaa

SEQ ID NO: 2788199 - DNA, 20 bp, Homo sapiens
atcccttaatatcctaaaca

SEQ ID NO: 2788200 - DNA, 16 bp, Homo sapiens
atccgtagttccctga

SEQ ID NO: 2788201 - DNA, 17 bp, Homo sapiens
atccgtagttccctgaa

SEQ ID NO: 2788202 - DNA, 21 bp, Homo sapiens
atcctaggcttaaatgcaata

SEQ ID NO: 2788203 - DNA, 21 bp, Homo sapiens
atcctatggtttctccatcca

SEQ ID NO: 2788204 - DNA, 19 bp, Homo sapiens
atcctccaacgttaaaaga

SEQ ID NO: 2788205 - DNA, 18 bp, Homo sapiens
atcctccaattccacagt

SEQ ID NO: 2788206 - DNA, 15 bp, Homo sapiens
atcctcccacctcag

SEQ ID NO: 2788207 - DNA, 17 bp, Homo sapiens
atcctgaaatttcagat

SEQ ID NO: 2788208 - DNA, 15 bp, Homo sapiens
atcctgcattttacg

SEQ ID NO: 2788209 - DNA, 15 bp, Homo sapiens
atcctgctagctgta

SEQ ID NO: 2788210 - DNA, 14 bp, Homo sapiens
atcctgcttcagtg

SEQ ID NO: 2788211 - DNA, 17 bp, Homo sapiens
atcctggcacccggccc

SEQ ID NO: 2788212 - DNA, 22 bp, Homo sapiens
atcctggcacccggcccctgct

SEQ ID NO: 2788213 - DNA, 23 bp, Homo sapiens
atcctgtatattatggtgtaatg

SEQ ID NO: 2788214 - DNA, 21 bp, Homo sapiens
atcctgtcgattagactggac

SEQ ID NO: 2788215 - DNA, 19 bp, Homo sapiens
atcctgtctttaaggaaaa

SEQ ID NO: 2788216 - DNA, 21 bp, Homo sapiens
atcctgtctttaaggaaaaaa

SEQ ID NO: 2788217 - DNA, 17 bp, Homo sapiens
atccttcaccagagccc

SEQ ID NO: 2788218 - DNA, 13 bp, Homo sapiens
atccttcccatga

SEQ ID NO: 2788219 - DNA, 17 bp, Homo sapiens
atcctttaaatccttcc

SEQ ID NO: 2788220 - DNA, 22 bp, Homo sapiens
atcctttgagttatagtttgct

SEQ ID NO: 2788221 - DNA, 13 bp, Homo sapiens
atcctttgcccca

SEQ ID NO: 2788222 - DNA, 13 bp, Homo sapiens
atccttttatgtt

SEQ ID NO: 2788223 - DNA, 17 bp, Homo sapiens
atccttttatgttattt

SEQ ID NO: 2788224 - DNA, 18 bp, Homo sapiens
atccttttatgttattta

SEQ ID NO: 2788225 - DNA, 19 bp, Homo sapiens
atcgagtctacctcttcag

SEQ ID NO: 2788226 - DNA, 20 bp, Homo sapiens
atcgcagaccttttttagga

SEQ ID NO: 2788227 - DNA, 17 bp, Homo sapiens
atcgctgccttgccatg

SEQ ID NO: 2788228 - DNA, 17 bp, Homo sapiens
atcggagcgaagcagag

SEQ ID NO: 2788229 - DNA, 16 bp, Homo sapiens
atcgggaacagtgttt

SEQ ID NO: 2788230 - DNA, 21 bp, Homo sapiens
atcgggaacagtgtttcccat

SEQ ID NO: 2788231 - DNA, 18 bp, Homo sapiens
atcgggagcagtgtcttc

SEQ ID NO: 2788232 - DNA, 21 bp, Homo sapiens
atcgggagcagtgtcttccat

SEQ ID NO: 2788233 - DNA, 23 bp, Homo sapiens
atcgtctcctttgacatttcctt

SEQ ID NO: 2788234 - DNA, 19 bp, Homo sapiens
atcgtgccgttactctcca

SEQ ID NO: 2788235 - DNA, 15 bp, Homo sapiens
atcgtgctaaatttt

SEQ ID NO: 2788236 - DNA, 16 bp, Homo sapiens
atcgtgctaaattttc

SEQ ID NO: 2788237 - DNA, 22 bp, Homo sapiens
atcgttagtatctaacatgtat

SEQ ID NO: 2788238 - DNA, 16 bp, Homo sapiens
atcgttatgtgtgtat

SEQ ID NO: 2788239 - DNA, 20 bp, Homo sapiens
atcgtttattgcttaatccc

SEQ ID NO: 2788240 - DNA, 17 bp, Homo sapiens
atctaaataatacagga

SEQ ID NO: 2788241 - DNA, 16 bp, Homo sapiens
atctaagcctttccat

SEQ ID NO: 2788242 - DNA, 16 bp, Homo sapiens
atctaagctgcagctt

SEQ ID NO: 2788243 - DNA, 17 bp, Homo sapiens
atctaagttaatttaaa

SEQ ID NO: 2788244 - DNA, 18 bp, Homo sapiens
atctaagttaatttaaag

SEQ ID NO: 2788245 - DNA, 19 bp, Homo sapiens
atctaatcaggttgttaat

SEQ ID NO: 2788246 - DNA, 17 bp, Homo sapiens
atctaatttatacaaaa

SEQ ID NO: 2788247 - DNA, 22 bp, Homo sapiens
atctaatttatacaaaataatt

SEQ ID NO: 2788248 - DNA, 23 bp, Homo sapiens
atctaatttatacaaaataattt

SEQ ID NO: 2788249 - DNA, 13 bp, Homo sapiens
atctacacagcct

SEQ ID NO: 2788250 - DNA, 18 bp, Homo sapiens
atctacacagcctggact

SEQ ID NO: 2788251 - DNA, 19 bp, Homo sapiens
atctacacagcctggactt

SEQ ID NO: 2788252 - DNA, 21 bp, Homo sapiens
atctaccgacctgtctccctg

SEQ ID NO: 2788253 - DNA, 22 bp, Homo sapiens
atctactaaaaatacaaaaatt

SEQ ID NO: 2788254 - DNA, 19 bp, Homo sapiens
atctagatcaattaattct

SEQ ID NO: 2788255 - DNA, 21 bp, Homo sapiens
atctagatcaattaattctta

SEQ ID NO: 2788256 - DNA, 14 bp, Homo sapiens
atctatataatgta

SEQ ID NO: 2788257 - DNA, 18 bp, Homo sapiens
atctatatctctaaactg

SEQ ID NO: 2788258 - DNA, 21 bp, Homo sapiens
atctatatctctaaactgctg

SEQ ID NO: 2788259 - DNA, 21 bp, Homo sapiens
atctatctgcctttacctaca

SEQ ID NO: 2788260 - DNA, 23 bp, Homo sapiens
atgatcacggctcactgcagcct

SEQ ID NO: 2788261 - DNA, 19 bp, Homo sapiens
atgatcagctgtttgtcat

SEQ ID NO: 2788262 - DNA, 20 bp, Homo sapiens
atgatcagctgtttgtcata

SEQ ID NO: 2788263 - DNA, 14 bp, Homo sapiens
atgatcatgtaaat

SEQ ID NO: 2788264 - DNA, 21 bp, Homo sapiens
atgatcatgtaaatgattatc

SEQ ID NO: 2788265 - DNA, 13 bp, Homo sapiens
atgatctcaggag

SEQ ID NO: 2788266 - DNA, 12 bp, Homo sapiens
atgatctccctg

SEQ ID NO: 2788267 - DNA, 14 bp, Homo sapiens
atgatctccctgcc

SEQ ID NO: 2788268 - DNA, 22 bp, Homo sapiens
atgatctgactttaattgtgtg

SEQ ID NO: 2788269 - DNA, 15 bp, Homo sapiens
atgatgaccaagaat

SEQ ID NO: 2788270 - DNA, 16 bp, Homo sapiens
atgatgaccaagaatt

SEQ ID NO: 2788271 - DNA, 16 bp, Homo sapiens
atgatgattaaacacc

SEQ ID NO: 2788272 - DNA, 22 bp, Homo sapiens
atgatgattaaacacctgacac

SEQ ID NO: 2788273 - DNA, 17 bp, Homo sapiens
atgatggagcgcacctg

SEQ ID NO: 2788274 - DNA, 16 bp, Homo sapiens
atgatgggtgttttta

SEQ ID NO: 2788275 - DNA, 16 bp, Homo sapiens
atgatgtatttttgta

SEQ ID NO: 2788276 - DNA, 14 bp, Homo sapiens
atgatgtccagaag

SEQ ID NO: 2788277 - DNA, 19 bp, Homo sapiens
atgatgtccagaagaatat

SEQ ID NO: 2788278 - DNA, 14 bp, Homo sapiens
atgatgttaaaaaa

SEQ ID NO: 2788279 - DNA, 21 bp, Homo sapiens
atgatgttaaaaaaataagaa

SEQ ID NO: 2788280 - DNA, 15 bp, Homo sapiens
atgattaaacacctg

SEQ ID NO: 2788281 - DNA, 16 bp, Homo sapiens
atgattaattcacctt

SEQ ID NO: 2788282 - DNA, 14 bp, Homo sapiens
atgattcataacaa

SEQ ID NO: 2788283 - DNA, 13 bp, Homo sapiens
atgattcatttta

SEQ ID NO: 2788284 - DNA, 14 bp, Homo sapiens
atgatttaaaaaat

SEQ ID NO: 2788285 - DNA, 17 bp, Homo sapiens
atgatttaagcatttta

SEQ ID NO: 2788286 - DNA, 16 bp, Homo sapiens
atgatttcaatgattg

SEQ ID NO: 2788287 - DNA, 14 bp, Homo sapiens
atgatttcagtagc

SEQ ID NO: 2788288 - DNA, 21 bp, Homo sapiens
atgatttcatgctatctctgt

SEQ ID NO: 2788289 - DNA, 20 bp, Homo sapiens
atgatttccaaagagaaaaa

SEQ ID NO: 2788290 - DNA, 13 bp, Homo sapiens
atgattttacaga

SEQ ID NO: 2788291 - DNA, 15 bp, Homo sapiens
atgattttatacata

SEQ ID NO: 2788292 - DNA, 17 bp, Homo sapiens
atgattttatacatagt

SEQ ID NO: 2788293 - DNA, 18 bp, Homo sapiens
atgattttatacatagtc

SEQ ID NO: 2788294 - DNA, 12 bp, Homo sapiens
atgcaaaaagaa

SEQ ID NO: 2788295 - DNA, 16 bp, Homo sapiens
atgcaaacactgtgta

SEQ ID NO: 2788296 - DNA, 14 bp, Homo sapiens
atgcaaaccatagc

SEQ ID NO: 2788297 - DNA, 16 bp, Homo sapiens
atgcaacaaatattta

SEQ ID NO: 2788298 - DNA, 16 bp, Homo sapiens
atgcaacaacatgtat

SEQ ID NO: 2788299 - DNA, 14 bp, Homo sapiens
atgcaaggaaggaa

SEQ ID NO: 2788300 - DNA, 15 bp, Homo sapiens
atgcaatttttaaac

SEQ ID NO: 2788301 - DNA, 21 bp, Homo sapiens
atgcaatttttaaactagtaa

SEQ ID NO: 2788302 - DNA, 16 bp, Homo sapiens
atgcacaatttagaaa

SEQ ID NO: 2788303 - DNA, 17 bp, Homo sapiens
atgcacaatttagaaaa

SEQ ID NO: 2788304 - DNA, 20 bp, Homo sapiens
atgcacactagcctctccag

SEQ ID NO: 2788305 - DNA, 16 bp, Homo sapiens
atgcacatttatatat

SEQ ID NO: 2788306 - DNA, 13 bp, Homo sapiens
atgcaccagccct

SEQ ID NO: 2788307 - DNA, 22 bp, Homo sapiens
atgcaccagcccttagcaggga

SEQ ID NO: 2788308 - DNA, 16 bp, Homo sapiens
atgcacctaaagaaaa

SEQ ID NO: 2788309 - DNA, 15 bp, Homo sapiens
atgcaccttgtgtct

SEQ ID NO: 2788310 - DNA, 18 bp, Homo sapiens
atgcaccttgtgtctgta

SEQ ID NO: 2788311 - DNA, 19 bp, Homo sapiens
atgcaccttgtgtctgtac

SEQ ID NO: 2788312 - DNA, 17 bp, Homo sapiens
atgcagcttcatcaatt

SEQ ID NO: 2788313 - DNA, 22 bp, Homo sapiens
atgcagcttcatcaatttttat

SEQ ID NO: 2788314 - DNA, 17 bp, Homo sapiens
atgcagtccagaataag

SEQ ID NO: 2788315 - DNA, 21 bp, Homo sapiens
atgcagtccagaataagtgct

SEQ ID NO: 2788316 - DNA, 22 bp, Homo sapiens
atgcagtccagaataagtgctg

SEQ ID NO: 2788317 - DNA, 18 bp, Homo sapiens
atgcatcagaaagggagg

SEQ ID NO: 2788318 - DNA, 20 bp, Homo sapiens
atgcatcagaaagggagggc

SEQ ID NO: 2788319 - DNA, 14 bp, Homo sapiens
atgcatccattcct

SEQ ID NO: 2788320 - DNA, 17 bp, Homo sapiens
atgcatccattcctcag

SEQ ID NO: 2788321 - DNA, 23 bp, Homo sapiens
atgcatccattcctcagggacag

SEQ ID NO: 2788322 - DNA, 14 bp, Homo sapiens
atgcatgattttat

SEQ ID NO: 2788323 - DNA, 23 bp, Homo sapiens
atgcatggtgcagttgacagcag

SEQ ID NO: 2788324 - DNA, 12 bp, Homo sapiens
atgcattttgca

SEQ ID NO: 2788325 - DNA, 17 bp, Homo sapiens
atgccaaaaaaaaatac

SEQ ID NO: 2788326 - DNA, 20 bp, Homo sapiens
atgccaaattgtagttcttg

SEQ ID NO: 2788327 - DNA, 17 bp, Homo sapiens
atgccatctccaccctg

SEQ ID NO: 2788328 - DNA, 22 bp, Homo sapiens
atgccatctccaccctgagcct

SEQ ID NO: 2788329 - DNA, 21 bp, Homo sapiens
atgcccagagggcccaggcag

SEQ ID NO: 2788330 - DNA, 23 bp, Homo sapiens
atgcccagagggcccaggcaggc

SEQ ID NO: 2788331 - DNA, 18 bp, Homo sapiens
atgcccctctgcctgggc

SEQ ID NO: 2788332 - DNA, 22 bp, Homo sapiens
atgccctaagtgttgaagaaga

SEQ ID NO: 2788333 - DNA, 19 bp, Homo sapiens
atgccgctcttctgtcatc

SEQ ID NO: 2788334 - DNA, 15 bp, Homo sapiens
atgcctacagataat

SEQ ID NO: 2788335 - DNA, 18 bp, Homo sapiens
atgcctacttgtaatttc

SEQ ID NO: 2788336 - DNA, 20 bp, Homo sapiens
atgcctctcccgcaccaggc

SEQ ID NO: 2788337 - DNA, 12 bp, Homo sapiens
atgcctctgagg

SEQ ID NO: 2788338 - DNA, 17 bp, Homo sapiens
atgcctctgaggccagc

SEQ ID NO: 2788339 - DNA, 19 bp, Homo sapiens
atgcctctgaggccagcct

SEQ ID NO: 2788340 - DNA, 20 bp, Homo sapiens
atgcctctgaggccagcctg

SEQ ID NO: 2788341 - DNA, 21 bp, Homo sapiens
atgcctctgaggccagcctgg

SEQ ID NO: 2788342 - DNA, 22 bp, Homo sapiens
atgcctctgaggccagcctggc

SEQ ID NO: 2788343 - DNA, 15 bp, Homo sapiens
atgcctgagggtgga

SEQ ID NO: 2788344 - DNA, 13 bp, Homo sapiens
atgcctggccccc

SEQ ID NO: 2788345 - DNA, 19 bp, Homo sapiens
atgcctggcccccctccag

SEQ ID NO: 2788346 - DNA, 18 bp, Homo sapiens
atgcctggtggcagctgc

SEQ ID NO: 2788347 - DNA, 21 bp, Homo sapiens
atgccttttcccaaaatgttg

SEQ ID NO: 2788348 - DNA, 21 bp, Homo sapiens
atgcgctgctcaacctctctc

SEQ ID NO: 2788349 - DNA, 21 bp, Homo sapiens
atgcgtacgtttcctgagaag

SEQ ID NO: 2788350 - DNA, 22 bp, Homo sapiens
atgtacatgtgtagggaaagtt

SEQ ID NO: 2788351 - DNA, 19 bp, Homo sapiens
atgtacatttctgaaatga

SEQ ID NO: 2788352 - DNA, 13 bp, Homo sapiens
atgtaccatcaat

SEQ ID NO: 2788353 - DNA, 21 bp, Homo sapiens
atgtacccaccgggccactcc

SEQ ID NO: 2788354 - DNA, 14 bp, Homo sapiens
atgtagctggtttc

SEQ ID NO: 2788355 - DNA, 23 bp, Homo sapiens
atgtaggcccctggtctgccctg

SEQ ID NO: 2788356 - DNA, 17 bp, Homo sapiens
atgtataaagaacaagg

SEQ ID NO: 2788357 - DNA, 23 bp, Homo sapiens
atgtataatatttttaattaaat

SEQ ID NO: 2788358 - DNA, 13 bp, Homo sapiens
atgtatatgtata

SEQ ID NO: 2788359 - DNA, 17 bp, Homo sapiens
atgtatatgtatatcta

SEQ ID NO: 2788360 - DNA, 18 bp, Homo sapiens
atgtatcttatttatata

SEQ ID NO: 2788361 - DNA, 20 bp, Homo sapiens
atgtatcttatttatatatg

SEQ ID NO: 2788362 - DNA, 18 bp, Homo sapiens
atgtatggaatacagtgt

SEQ ID NO: 2788363 - DNA, 20 bp, Homo sapiens
atgtatggaatacagtgtta

SEQ ID NO: 2788364 - DNA, 22 bp, Homo sapiens
atgtatgtgaaagtgtaaaata

SEQ ID NO: 2788365 - DNA, 17 bp, Homo sapiens
atgtattaatattcatt

SEQ ID NO: 2788366 - DNA, 18 bp, Homo sapiens
atgtattattttctatag

SEQ ID NO: 2788367 - DNA, 14 bp, Homo sapiens
atgtcaatttgtat

SEQ ID NO: 2788368 - DNA, 18 bp, Homo sapiens
atgtcaatttgtatatca

SEQ ID NO: 2788369 - DNA, 16 bp, Homo sapiens
atgtcacaggcaggtc

SEQ ID NO: 2788370 - DNA, 17 bp, Homo sapiens
atgtcacataatgaatg

SEQ ID NO: 2788371 - DNA, 23 bp, Homo sapiens
atgtcaccaccttcccagctctc

SEQ ID NO: 2788372 - DNA, 22 bp, Homo sapiens
atgtcaccgtggaccttcctgc

SEQ ID NO: 2788373 - DNA, 21 bp, Homo sapiens
atgtcagaaactcgatgaatg

SEQ ID NO: 2788374 - DNA, 19 bp, Homo sapiens
atgtcagccgagccgggcc

SEQ ID NO: 2788375 - DNA, 20 bp, Homo sapiens
atgtcaggaacagaaggatg

SEQ ID NO: 2788376 - DNA, 20 bp, Homo sapiens
atgtcattaaaataaataaa

SEQ ID NO: 2788377 - DNA, 15 bp, Homo sapiens
atgtcatttcatttc

SEQ ID NO: 2788378 - DNA, 22 bp, Homo sapiens
atgtcccatctgctcctcccat

SEQ ID NO: 2788379 - DNA, 22 bp, Homo sapiens
atgtcctaggggccgagggaaa

SEQ ID NO: 2788380 - DNA, 22 bp, Homo sapiens
atgtcctccaacaataaagagc

SEQ ID NO: 2788381 - DNA, 15 bp, Homo sapiens
atgtcgcctctgcat

SEQ ID NO: 2788382 - DNA, 21 bp, Homo sapiens
atgtcggcacgtcccatgtgc

SEQ ID NO: 2788383 - DNA, 13 bp, Homo sapiens
atgtctctcagaa

SEQ ID NO: 2788384 - DNA, 21 bp, Homo sapiens
atgtctctcagaattcttcag

SEQ ID NO: 2788385 - DNA, 16 bp, Homo sapiens
atgtctgttgatgact

SEQ ID NO: 2788386 - DNA, 20 bp, Homo sapiens
atgtcttggacactgtacaa

SEQ ID NO: 2788387 - DNA, 19 bp, Homo sapiens
atgtcttgggtaggcggga

SEQ ID NO: 2788388 - DNA, 22 bp, Homo sapiens
atgtcttgtacatgtgtagcct

SEQ ID NO: 2788389 - DNA, 20 bp, Homo sapiens
atgtctttttaagcttattt

SEQ ID NO: 2788390 - DNA, 23 bp, Homo sapiens
atgtctttttaagcttatttaat

SEQ ID NO: 2788391 - DNA, 16 bp, Homo sapiens
atgtgaatcagaccct

SEQ ID NO: 2788392 - DNA, 21 bp, Homo sapiens
atgtgaatcagaccctacccc

SEQ ID NO: 2788393 - DNA, 20 bp, Homo sapiens
atgtgacaacctttgtgtaa

SEQ ID NO: 2788394 - DNA, 23 bp, Homo sapiens
atgtgacaacctttgtgtaataa

SEQ ID NO: 2788395 - DNA, 11 bp, Homo sapiens
atgtgacacat

SEQ ID NO: 2788396 - DNA, 16 bp, Homo sapiens
atgtgacaggtaaact

SEQ ID NO: 2788397 - DNA, 20 bp, Homo sapiens
atgtgacccagatcctcaca

SEQ ID NO: 2788398 - DNA, 21 bp, Homo sapiens
atgtgatccttttatgttatt

SEQ ID NO: 2788399 - DNA, 23 bp, Homo sapiens
atgtgatccttttatgttattta

SEQ ID NO: 2788400 - DNA, 15 bp, Homo sapiens
atgtgcacggcagct

SEQ ID NO: 2788401 - DNA, 22 bp, Homo sapiens
atgtgcacggcagcttgagcct

SEQ ID NO: 2788402 - DNA, 14 bp, Homo sapiens
atgtgcccacaggg

SEQ ID NO: 2788403 - DNA, 16 bp, Homo sapiens
atgtgcccacagggac

SEQ ID NO: 2788404 - DNA, 15 bp, Homo sapiens
atgtggaatataaag

SEQ ID NO: 2788405 - DNA, 17 bp, Homo sapiens
atgtggaatataaagat

SEQ ID NO: 2788406 - DNA, 20 bp, Homo sapiens
atgtggatttcctattttaa

SEQ ID NO: 2788407 - DNA, 22 bp, Homo sapiens
atgtggatttcctattttaaaa

SEQ ID NO: 2788408 - DNA, 15 bp, Homo sapiens
atgtggccctggcct

SEQ ID NO: 2788409 - DNA, 19 bp, Homo sapiens
atgtggccctggcctgctg

SEQ ID NO: 2788410 - DNA, 16 bp, Homo sapiens
atgtgggtcaaggaat

SEQ ID NO: 2788411 - DNA, 19 bp, Homo sapiens
atgtgtaaatggagcttgt

SEQ ID NO: 2788412 - DNA, 15 bp, Homo sapiens
atgtgtagcctgtgc

SEQ ID NO: 2788413 - DNA, 21 bp, Homo sapiens
atgtgtcactactcacagtct

SEQ ID NO: 2788414 - DNA, 14 bp, Homo sapiens
atgtgtcagcatgc

SEQ ID NO: 2788415 - DNA, 17 bp, Homo sapiens
atgtgtcatgatttcaa

SEQ ID NO: 2788416 - DNA, 20 bp, Homo sapiens
atgtgtgaaggtcttgcctg

SEQ ID NO: 2788417 - DNA, 18 bp, Homo sapiens
atgtgtggatgtgtaaat

SEQ ID NO: 2788418 - DNA, 20 bp, Homo sapiens
atgtgtggtgctaactgtat

SEQ ID NO: 2788419 - DNA, 14 bp, Homo sapiens
atgtgtgtatatgt

SEQ ID NO: 2788420 - DNA, 16 bp, Homo sapiens
atgtgtgtatatgtat

SEQ ID NO: 2788421 - DNA, 13 bp, Homo sapiens
atgtgtgtgtatg

SEQ ID NO: 2788422 - DNA, 15 bp, Homo sapiens
atgtgtgtgtatgct

SEQ ID NO: 2788423 - DNA, 21 bp, Homo sapiens
atgtgtgtgtatgctactaca

SEQ ID NO: 2788424 - DNA, 19 bp, Homo sapiens
atgttaaaaaaataagaag

SEQ ID NO: 2788425 - DNA, 21 bp, Homo sapiens
atgttaaaaaaataagaagaa

SEQ ID NO: 2788426 - DNA, 22 bp, Homo sapiens
atgttaaagaggcgtcttgtat

SEQ ID NO: 2788427 - DNA, 18 bp, Homo sapiens
atgttaaatcccattcat

SEQ ID NO: 2788428 - DNA, 23 bp, Homo sapiens
atgttaaccagaataaagttctg

SEQ ID NO: 2788429 - DNA, 15 bp, Homo sapiens
atgttaagttacttc

SEQ ID NO: 2788430 - DNA, 14 bp, Homo sapiens
atgttacattatta

SEQ ID NO: 2788431 - DNA, 12 bp, Homo sapiens
atgttatttata

SEQ ID NO: 2788432 - DNA, 18 bp, Homo sapiens
atgttatttatatattgg

SEQ ID NO: 2788433 - DNA, 19 bp, Homo sapiens
atgttatttgtaatagatg

SEQ ID NO: 2788434 - DNA, 17 bp, Homo sapiens
atgttcattaaattttc

SEQ ID NO: 2788435 - DNA, 20 bp, Homo sapiens
atgttcattaaattttctat

SEQ ID NO: 2788436 - DNA, 13 bp, Homo sapiens
atgttctctgagg

SEQ ID NO: 2788437 - DNA, 16 bp, Homo sapiens
atgttctggctttaca

SEQ ID NO: 2788438 - DNA, 18 bp, Homo sapiens
atgttctgtcacgtgaaa

SEQ ID NO: 2788439 - DNA, 21 bp, Homo sapiens
atgttctgtcacgtgaaatat

SEQ ID NO: 2788440 - DNA, 16 bp, Homo sapiens
attataataatgttct

SEQ ID NO: 2788441 - DNA, 20 bp, Homo sapiens
attataataatgttctctgg

SEQ ID NO: 2788442 - DNA, 17 bp, Homo sapiens
attataggatcatttgt

SEQ ID NO: 2788443 - DNA, 18 bp, Homo sapiens
attatatatcataaagta

SEQ ID NO: 2788444 - DNA, 14 bp, Homo sapiens
attatatctaattt

SEQ ID NO: 2788445 - DNA, 20 bp, Homo sapiens
attatatctaatttatacaa

SEQ ID NO: 2788446 - DNA, 21 bp, Homo sapiens
attatatctaatttatacaaa

SEQ ID NO: 2788447 - DNA, 15 bp, Homo sapiens
attatattataataa

SEQ ID NO: 2788448 - DNA, 19 bp, Homo sapiens
attatcggaagcagtgcct

SEQ ID NO: 2788449 - DNA, 17 bp, Homo sapiens
attatcgggaacagtgt

SEQ ID NO: 2788450 - DNA, 19 bp, Homo sapiens
attatcgggaacagtgttt

SEQ ID NO: 2788451 - DNA, 21 bp, Homo sapiens
attatcgggagcagtgtcttc

SEQ ID NO: 2788452 - DNA, 22 bp, Homo sapiens
attatctgatcgggataacaaa

SEQ ID NO: 2788453 - DNA, 12 bp, Homo sapiens
attatgacagtt

SEQ ID NO: 2788454 - DNA, 14 bp, Homo sapiens
attatgacagttat

SEQ ID NO: 2788455 - DNA, 15 bp, Homo sapiens
attatgacagttata

SEQ ID NO: 2788456 - DNA, 17 bp, Homo sapiens
attatgacagttatact

SEQ ID NO: 2788457 - DNA, 16 bp, Homo sapiens
attatgggtcctgcaa

SEQ ID NO: 2788458 - DNA, 11 bp, Homo sapiens
attatggtgaa

SEQ ID NO: 2788459 - DNA, 14 bp, Homo sapiens
attatggtgaaatt

SEQ ID NO: 2788460 - DNA, 15 bp, Homo sapiens
attatggtgaaatta

SEQ ID NO: 2788461 - DNA, 20 bp, Homo sapiens
attatggtgtaatgcacaat

SEQ ID NO: 2788462 - DNA, 23 bp, Homo sapiens
attatggtgtaatgcacaattta

SEQ ID NO: 2788463 - DNA, 17 bp, Homo sapiens
attatgtctcaaaataa

SEQ ID NO: 2788464 - DNA, 17 bp, Homo sapiens
attatgtgacaaccttt

SEQ ID NO: 2788465 - DNA, 20 bp, Homo sapiens
attatgtgacaacctttgtg

SEQ ID NO: 2788466 - DNA, 21 bp, Homo sapiens
attatgtgacaacctttgtgt

SEQ ID NO: 2788467 - DNA, 23 bp, Homo sapiens
attatgtgacaacctttgtgtaa

SEQ ID NO: 2788468 - DNA, 21 bp, Homo sapiens
attattacttatttttgacag

SEQ ID NO: 2788469 - DNA, 21 bp, Homo sapiens
attattagtaagaaaacatca

SEQ ID NO: 2788470 - DNA, 17 bp, Homo sapiens
attattccctgtacaat

SEQ ID NO: 2788471 - DNA, 23 bp, Homo sapiens
attattgtgtgttatttaaatga

SEQ ID NO: 2788472 - DNA, 18 bp, Homo sapiens
attattgttgcattaaaa

SEQ ID NO: 2788473 - DNA, 14 bp, Homo sapiens
attatttacaatgc

SEQ ID NO: 2788474 - DNA, 21 bp, Homo sapiens
attatttggcatgcttaaata

SEQ ID NO: 2788475 - DNA, 19 bp, Homo sapiens
attattttctatagctctt

SEQ ID NO: 2788476 - DNA, 20 bp, Homo sapiens
attattttctatagctcttc

SEQ ID NO: 2788477 - DNA, 18 bp, Homo sapiens
attattttgttgtgattt

SEQ ID NO: 2788478 - DNA, 12 bp, Homo sapiens
attcaaaccatt

SEQ ID NO: 2788479 - DNA, 13 bp, Homo sapiens
attcaaaccattt

SEQ ID NO: 2788480 - DNA, 14 bp, Homo sapiens
attcaaaccattta

SEQ ID NO: 2788481 - DNA, 15 bp, Homo sapiens
attcaaaccatttaa

SEQ ID NO: 2788482 - DNA, 17 bp, Homo sapiens
attcaaaccatttaatt

SEQ ID NO: 2788483 - DNA, 19 bp, Homo sapiens
attcaaaccatttaattca

SEQ ID NO: 2788484 - DNA, 18 bp, Homo sapiens
attcaaactgctccaagt

SEQ ID NO: 2788485 - DNA, 13 bp, Homo sapiens
attcaacacatta

SEQ ID NO: 2788486 - DNA, 16 bp, Homo sapiens
attcaaccactgtaaa

SEQ ID NO: 2788487 - DNA, 20 bp, Homo sapiens
attcaaggagatataaaatc

SEQ ID NO: 2788488 - DNA, 16 bp, Homo sapiens
attcaattcctctggg

SEQ ID NO: 2788489 - DNA, 12 bp, Homo sapiens
attcacacaccc

SEQ ID NO: 2788490 - DNA, 13 bp, Homo sapiens
attcacactgtgc

SEQ ID NO: 2788491 - DNA, 15 bp, Homo sapiens
attcacagagccttt

SEQ ID NO: 2788492 - DNA, 21 bp, Homo sapiens
attcacatttgatgtacatgt

SEQ ID NO: 2788493 - DNA, 13 bp, Homo sapiens
attcagacaagca

SEQ ID NO: 2788494 - DNA, 18 bp, Homo sapiens
attcagatatatttttca

SEQ ID NO: 2788495 - DNA, 19 bp, Homo sapiens
attcagatcgtattaatta

SEQ ID NO: 2788496 - DNA, 22 bp, Homo sapiens
attcaggaaaactgacagagga

SEQ ID NO: 2788497 - DNA, 21 bp, Homo sapiens
attcaggacttaacggctcca

SEQ ID NO: 2788498 - DNA, 23 bp, Homo sapiens
attcagtccgcctggccggctcc

SEQ ID NO: 2788499 - DNA, 21 bp, Homo sapiens
attcagtgctgtggcctgggc

SEQ ID NO: 2788500 - DNA, 19 bp, Homo sapiens
attcagtgcttcttaaaga

SEQ ID NO: 2788501 - DNA, 18 bp, Homo sapiens
attcataacaatgtatgt

SEQ ID NO: 2788502 - DNA, 14 bp, Homo sapiens
attcataattagaa

SEQ ID NO: 2788503 - DNA, 18 bp, Homo sapiens
attcatccagttgcaata

SEQ ID NO: 2788504 - DNA, 12 bp, Homo sapiens
attcatgtaata

SEQ ID NO: 2788505 - DNA, 17 bp, Homo sapiens
attcatgtaataaatct

SEQ ID NO: 2788506 - DNA, 16 bp, Homo sapiens
attcatgtacagcatg

SEQ ID NO: 2788507 - DNA, 18 bp, Homo sapiens
attccaaacttctaaatg

SEQ ID NO: 2788508 - DNA, 20 bp, Homo sapiens
attccaaacttctaaatgtt

SEQ ID NO: 2788509 - DNA, 23 bp, Homo sapiens
attccaaagttttgaagtcatct

SEQ ID NO: 2788510 - DNA, 22 bp, Homo sapiens
attccacagtgcccagctaatt

SEQ ID NO: 2788511 - DNA, 15 bp, Homo sapiens
attccaccattcaca

SEQ ID NO: 2788512 - DNA, 18 bp, Homo sapiens
attccaccattcacattt

SEQ ID NO: 2788513 - DNA, 16 bp, Homo sapiens
attccacctgcaatca

SEQ ID NO: 2788514 - DNA, 18 bp, Homo sapiens
attccagacctgaagaat

SEQ ID NO: 2788515 - DNA, 18 bp, Homo sapiens
attccatgattttacaga

SEQ ID NO: 2788516 - DNA, 16 bp, Homo sapiens
attccatttccagttc

SEQ ID NO: 2788517 - DNA, 21 bp, Homo sapiens
attccatttttactaaagcag

SEQ ID NO: 2788518 - DNA, 22 bp, Homo sapiens
attccatttttactaaagcagt

SEQ ID NO: 2788519 - DNA, 23 bp, Homo sapiens
attcccagagacaggaaaatcct

SEQ ID NO: 2788520 - DNA, 18 bp, Homo sapiens
attcccattttgcaaaat

SEQ ID NO: 2788521 - DNA, 21 bp, Homo sapiens
attccccaggtggctgaccca

SEQ ID NO: 2788522 - DNA, 15 bp, Homo sapiens
attccccatcttcca

SEQ ID NO: 2788523 - DNA, 20 bp, Homo sapiens
attccctatcaaaacatatc

SEQ ID NO: 2788524 - DNA, 14 bp, Homo sapiens
attccctctcccag

SEQ ID NO: 2788525 - DNA, 12 bp, Homo sapiens
attccctggcct

SEQ ID NO: 2788526 - DNA, 22 bp, Homo sapiens
attccctggcctggctctcctg

SEQ ID NO: 2788527 - DNA, 23 bp, Homo sapiens
attcctaggaggaaaaagaaatg

SEQ ID NO: 2788528 - DNA, 23 bp, Homo sapiens
attcctagttccccgtgaacttc

SEQ ID NO: 2788529 - DNA, 17 bp, Homo sapiens
attcctatatagtttat

SEQ ID NO: 2788530 - DNA, 14 bp, Homo sapiens
attgcctgcagaga

SEQ ID NO: 2788531 - DNA, 15 bp, Homo sapiens
attgcctgcagagag

SEQ ID NO: 2788532 - DNA, 16 bp, Homo sapiens
attgcctgcagagaga

SEQ ID NO: 2788533 - DNA, 16 bp, Homo sapiens
attgcggacagccacg

SEQ ID NO: 2788534 - DNA, 15 bp, Homo sapiens
attggaattttctta

SEQ ID NO: 2788535 - DNA, 18 bp, Homo sapiens
attggagagtaaaaactg

SEQ ID NO: 2788536 - DNA, 13 bp, Homo sapiens
attggagggaaga

SEQ ID NO: 2788537 - DNA, 22 bp, Homo sapiens
attggagggtgggagagcccag

SEQ ID NO: 2788538 - DNA, 17 bp, Homo sapiens
attggcagtgtgtcaca

SEQ ID NO: 2788539 - DNA, 20 bp, Homo sapiens
attggcagttggaggacaca

SEQ ID NO: 2788540 - DNA, 21 bp, Homo sapiens
attggcttattttttaaaata

SEQ ID NO: 2788541 - DNA, 18 bp, Homo sapiens
attgggaagctgggggaa

SEQ ID NO: 2788542 - DNA, 21 bp, Homo sapiens
attgggagcttgggaatggat

SEQ ID NO: 2788543 - DNA, 18 bp, Homo sapiens
attgggcaagtgattgaa

SEQ ID NO: 2788544 - DNA, 19 bp, Homo sapiens
attggggaagactgtggct

SEQ ID NO: 2788545 - DNA, 15 bp, Homo sapiens
attggtaacatcctt

SEQ ID NO: 2788546 - DNA, 17 bp, Homo sapiens
attggtatcaagaaagt

SEQ ID NO: 2788547 - DNA, 18 bp, Homo sapiens
attggtatcaagaaagtc

SEQ ID NO: 2788548 - DNA, 14 bp, Homo sapiens
attggtccagcttg

SEQ ID NO: 2788549 - DNA, 15 bp, Homo sapiens
attggtccagcttgc

SEQ ID NO: 2788550 - DNA, 17 bp, Homo sapiens
attggtccagcttgctc

SEQ ID NO: 2788551 - DNA, 16 bp, Homo sapiens
attggtgataagtgga

SEQ ID NO: 2788552 - DNA, 18 bp, Homo sapiens
attggtgataagtggaaa

SEQ ID NO: 2788553 - DNA, 11 bp, Homo sapiens
attgtaaaaaa

SEQ ID NO: 2788554 - DNA, 14 bp, Homo sapiens
attgtaaatattgt

SEQ ID NO: 2788555 - DNA, 18 bp, Homo sapiens
attgtaaatttggattta

SEQ ID NO: 2788556 - DNA, 15 bp, Homo sapiens
attgtacactatcta

SEQ ID NO: 2788557 - DNA, 16 bp, Homo sapiens
attgtaccagaactat

SEQ ID NO: 2788558 - DNA, 18 bp, Homo sapiens
attgtacctctcttatag

SEQ ID NO: 2788559 - DNA, 15 bp, Homo sapiens
attgtagatggaaat

SEQ ID NO: 2788560 - DNA, 17 bp, Homo sapiens
attgtagatggaaatca

SEQ ID NO: 2788561 - DNA, 16 bp, Homo sapiens
attgtagcatttcttg

SEQ ID NO: 2788562 - DNA, 18 bp, Homo sapiens
attgtagcatttcttgat

SEQ ID NO: 2788563 - DNA, 17 bp, Homo sapiens
attgtataaaaatagaa

SEQ ID NO: 2788564 - DNA, 21 bp, Homo sapiens
attgtataaaaatagaagaat

SEQ ID NO: 2788565 - DNA, 14 bp, Homo sapiens
attgtcagatattt

SEQ ID NO: 2788566 - DNA, 16 bp, Homo sapiens
attgtcattactgcct

SEQ ID NO: 2788567 - DNA, 21 bp, Homo sapiens
attgtccatatcagacctctg

SEQ ID NO: 2788568 - DNA, 22 bp, Homo sapiens
attgtccatatcagacctctga

SEQ ID NO: 2788569 - DNA, 19 bp, Homo sapiens
attgtccatgcctacagat

SEQ ID NO: 2788570 - DNA, 23 bp, Homo sapiens
attgtccatgcctacagataatt

SEQ ID NO: 2788571 - DNA, 16 bp, Homo sapiens
attgtgaccaagttat

SEQ ID NO: 2788572 - DNA, 21 bp, Homo sapiens
attgtgatctatcaatagtca

SEQ ID NO: 2788573 - DNA, 15 bp, Homo sapiens
attgtgcaatgtaaa

SEQ ID NO: 2788574 - DNA, 17 bp, Homo sapiens
attgtgcaatgtaaata

SEQ ID NO: 2788575 - DNA, 18 bp, Homo sapiens
attgtgcaatgtaaatat

SEQ ID NO: 2788576 - DNA, 18 bp, Homo sapiens
attgtggtacaatctcaa

SEQ ID NO: 2788577 - DNA, 24 bp, Homo sapiens
attgtgtaaattcctgttgtctga

SEQ ID NO: 2788578 - DNA, 20 bp, Homo sapiens
attgtgtacaaagtagagaa

SEQ ID NO: 2788579 - DNA, 18 bp, Homo sapiens
attgtgtgttatttaaat

SEQ ID NO: 2788580 - DNA, 19 bp, Homo sapiens
attgttttatctgaatttt

SEQ ID NO: 2788581 - DNA, 22 bp, Homo sapiens
atttaaaaaactaaaaactaga

SEQ ID NO: 2788582 - DNA, 17 bp, Homo sapiens
atttaaaaaataaaaaa

SEQ ID NO: 2788583 - DNA, 20 bp, Homo sapiens
atttaaaaaataaaaaaata

SEQ ID NO: 2788584 - DNA, 17 bp, Homo sapiens
atttaaaaaataaatat

SEQ ID NO: 2788585 - DNA, 22 bp, Homo sapiens
atttaaaaaataaatataattg

SEQ ID NO: 2788586 - DNA, 16 bp, Homo sapiens
atttaaaaataagaaa

SEQ ID NO: 2788587 - DNA, 21 bp, Homo sapiens
atttaaaatagcaaaagaaga

SEQ ID NO: 2788588 - DNA, 16 bp, Homo sapiens
atttaaaccagcagaa

SEQ ID NO: 2788589 - DNA, 18 bp, Homo sapiens
atttaaaccagcagaaaa

SEQ ID NO: 2788590 - DNA, 21 bp, Homo sapiens
atttaaaccagcagaaaagtg

SEQ ID NO: 2788591 - DNA, 23 bp, Homo sapiens
atttaaaccgctaaaagaaactt

SEQ ID NO: 2788592 - DNA, 24 bp, Homo sapiens
atttaaaccgctaaaagaaacttt

SEQ ID NO: 2788593 - DNA, 12 bp, Homo sapiens
atttaaactata

SEQ ID NO: 2788594 - DNA, 19 bp, Homo sapiens
atttaaagaacaccctata

SEQ ID NO: 2788595 - DNA, 22 bp, Homo sapiens
atttaaagttgtttgtgccttt

SEQ ID NO: 2788596 - DNA, 16 bp, Homo sapiens
atttaaatattaaata

SEQ ID NO: 2788597 - DNA, 13 bp, Homo sapiens
atttaaatctgtt

SEQ ID NO: 2788598 - DNA, 12 bp, Homo sapiens
atttaactaatt

SEQ ID NO: 2788599 - DNA, 13 bp, Homo sapiens
atttaactaattt

SEQ ID NO: 2788600 - DNA, 16 bp, Homo sapiens
atttaactaatttaaa

SEQ ID NO: 2788601 - DNA, 20 bp, Homo sapiens
atttaactaatttaaaccag

SEQ ID NO: 2788602 - DNA, 20 bp, Homo sapiens
atttaacttaacattctgta

SEQ ID NO: 2788603 - DNA, 13 bp, Homo sapiens
atttaagcatttt

SEQ ID NO: 2788604 - DNA, 15 bp, Homo sapiens
atttaagggaaaaat

SEQ ID NO: 2788605 - DNA, 21 bp, Homo sapiens
atttaagtatatagtatattt

SEQ ID NO: 2788606 - DNA, 18 bp, Homo sapiens
atttaatagcaaagaatt

SEQ ID NO: 2788607 - DNA, 23 bp, Homo sapiens
atttaattcataattagaacaat

SEQ ID NO: 2788608 - DNA, 11 bp, Homo sapiens
atttaattgtg

SEQ ID NO: 2788609 - DNA, 16 bp, Homo sapiens
atttaatttttgcaat

SEQ ID NO: 2788610 - DNA, 23 bp, Homo sapiens
atttaatttttttgagacagagt

SEQ ID NO: 2788611 - DNA, 21 bp, Homo sapiens
atttacatatgaaatttaata

SEQ ID NO: 2788612 - DNA, 18 bp, Homo sapiens
atttacatgaattgcatt

SEQ ID NO: 2788613 - DNA, 20 bp, Homo sapiens
atttacatgaattgcatttt

SEQ ID NO: 2788614 - DNA, 21 bp, Homo sapiens
atttacatgaattgcatttta

SEQ ID NO: 2788615 - DNA, 15 bp, Homo sapiens
atttacgactgaaga

SEQ ID NO: 2788616 - DNA, 13 bp, Homo sapiens
atttactaaaaga

SEQ ID NO: 2788617 - DNA, 15 bp, Homo sapiens
atttactaaaagaat

SEQ ID NO: 2788618 - DNA, 20 bp, Homo sapiens
atttactgagcttctctgtg

SEQ ID NO: 2788619 - DNA, 21 bp, Homo sapiens
atttactgagcttctctgtga

SEQ ID NO: 2788620 - DNA, 20 bp, Homo sapiens
atttgatagtattgtgcata

SEQ ID NO: 2788621 - DNA, 13 bp, Homo sapiens
atttgatgtacat

SEQ ID NO: 2788622 - DNA, 18 bp, Homo sapiens
atttgatgtacatgtgta

SEQ ID NO: 2788623 - DNA, 13 bp, Homo sapiens
atttgcaataaaa

SEQ ID NO: 2788624 - DNA, 16 bp, Homo sapiens
atttgcctgtaacaag

SEQ ID NO: 2788625 - DNA, 15 bp, Homo sapiens
atttgcttatttata

SEQ ID NO: 2788626 - DNA, 18 bp, Homo sapiens
atttggcatgcttaaata

SEQ ID NO: 2788627 - DNA, 19 bp, Homo sapiens
atttggcatgcttaaatat

SEQ ID NO: 2788628 - DNA, 19 bp, Homo sapiens
atttggcctgcactaattt

SEQ ID NO: 2788629 - DNA, 18 bp, Homo sapiens
atttggtgtggctgtatt

SEQ ID NO: 2788630 - DNA, 21 bp, Homo sapiens
atttgtacatagttatttatt

SEQ ID NO: 2788631 - DNA, 11 bp, Homo sapiens
atttgtacatt

SEQ ID NO: 2788632 - DNA, 16 bp, Homo sapiens
atttgtacattcctga

SEQ ID NO: 2788633 - DNA, 22 bp, Homo sapiens
atttgtacattcctgatactgg

SEQ ID NO: 2788634 - DNA, 15 bp, Homo sapiens
atttgtatatcatga

SEQ ID NO: 2788635 - DNA, 16 bp, Homo sapiens
atttgtatttatatta

SEQ ID NO: 2788636 - DNA, 22 bp, Homo sapiens
atttgtattttgcttaaaattt

SEQ ID NO: 2788637 - DNA, 20 bp, Homo sapiens
atttgtgagccaaagagaaa

SEQ ID NO: 2788638 - DNA, 21 bp, Homo sapiens
atttgtgagccaaagagaaaa

SEQ ID NO: 2788639 - DNA, 22 bp, Homo sapiens
atttgtgagccaaagagaaaag

SEQ ID NO: 2788640 - DNA, 15 bp, Homo sapiens
atttgttaaatattt

SEQ ID NO: 2788641 - DNA, 14 bp, Homo sapiens
atttgttcccaaga

SEQ ID NO: 2788642 - DNA, 15 bp, Homo sapiens
attttaaaaacatga

SEQ ID NO: 2788643 - DNA, 17 bp, Homo sapiens
attttaaaaacatgaga

SEQ ID NO: 2788644 - DNA, 22 bp, Homo sapiens
attttaaaaacatgagaaatgt

SEQ ID NO: 2788645 - DNA, 13 bp, Homo sapiens
attttaaaaccat

SEQ ID NO: 2788646 - DNA, 14 bp, Homo sapiens
attttaaaaccatg

SEQ ID NO: 2788647 - DNA, 16 bp, Homo sapiens
attttaaaaccatgca

SEQ ID NO: 2788648 - DNA, 17 bp, Homo sapiens
attttaaaaccatgcag

SEQ ID NO: 2788649 - DNA, 19 bp, Homo sapiens
attttaaaaccatgcagct

SEQ ID NO: 2788650 - DNA, 20 bp, Homo sapiens
attttaaaaccatgcagctt

SEQ ID NO: 2788651 - DNA, 18 bp, Homo sapiens
attttaaaattttatctc

SEQ ID NO: 2788652 - DNA, 13 bp, Homo sapiens
attttaaacaaag

SEQ ID NO: 2788653 - DNA, 13 bp, Homo sapiens
attttaaagaatt

SEQ ID NO: 2788654 - DNA, 22 bp, Homo sapiens
attttaaattataacttaaaat

SEQ ID NO: 2788655 - DNA, 16 bp, Homo sapiens
attttaaattcacaat

SEQ ID NO: 2788656 - DNA, 18 bp, Homo sapiens
attttaacaaaagcaaga

SEQ ID NO: 2788657 - DNA, 19 bp, Homo sapiens
attttaactttatcacatt

SEQ ID NO: 2788658 - DNA, 18 bp, Homo sapiens
attttaagcattcttaga

SEQ ID NO: 2788659 - DNA, 23 bp, Homo sapiens
attttaattattattcttcataa

SEQ ID NO: 2788660 - DNA, 12 bp, Homo sapiens
attttacagaga

SEQ ID NO: 2788661 - DNA, 14 bp, Homo sapiens
attttacagagaat

SEQ ID NO: 2788662 - DNA, 15 bp, Homo sapiens
attttacagagaatc

SEQ ID NO: 2788663 - DNA, 18 bp, Homo sapiens
attttacagagaatctga

SEQ ID NO: 2788664 - DNA, 22 bp, Homo sapiens
attttactactgtggaaaaata

SEQ ID NO: 2788665 - DNA, 16 bp, Homo sapiens
attttactacttgtta

SEQ ID NO: 2788666 - DNA, 16 bp, Homo sapiens
attttactgacagaaa

SEQ ID NO: 2788667 - DNA, 18 bp, Homo sapiens
attttactgtctgtaaga

SEQ ID NO: 2788668 - DNA, 21 bp, Homo sapiens
attttactttaaaaggagcca

SEQ ID NO: 2788669 - DNA, 14 bp, Homo sapiens
attttatacatagt

SEQ ID NO: 2788670 - DNA, 20 bp, Homo sapiens
attttatacatagtcacaaa

SEQ ID NO: 2788671 - DNA, 18 bp, Homo sapiens
attttatagctcagttta

SEQ ID NO: 2788672 - DNA, 15 bp, Homo sapiens
attttatattacact

SEQ ID NO: 2788673 - DNA, 19 bp, Homo sapiens
attttatattagaagtgtt

SEQ ID NO: 2788674 - DNA, 16 bp, Homo sapiens
attttatgatttaaaa

SEQ ID NO: 2788675 - DNA, 20 bp, Homo sapiens
attttatgccttttatttct

SEQ ID NO: 2788676 - DNA, 20 bp, Homo sapiens
attttatttattagctgtaa

SEQ ID NO: 2788677 - DNA, 22 bp, Homo sapiens
attttcaaagctttttccagag

SEQ ID NO: 2788678 - DNA, 13 bp, Homo sapiens
attttcaagaaac

SEQ ID NO: 2788679 - DNA, 16 bp, Homo sapiens
attttcaagaaactga

SEQ ID NO: 2788680 - DNA, 22 bp, Homo sapiens
attttcaagaaactgaggaatt

SEQ ID NO: 2788681 - DNA, 15 bp, Homo sapiens
attttcaagagaaga

SEQ ID NO: 2788682 - DNA, 12 bp, Homo sapiens
attttcacttgc

SEQ ID NO: 2788683 - DNA, 12 bp, Homo sapiens
attttcagagtg

SEQ ID NO: 2788684 - DNA, 21 bp, Homo sapiens
attttcagtagggctacaaaa

SEQ ID NO: 2788685 - DNA, 22 bp, Homo sapiens
attttcagtagggctacaaaac

SEQ ID NO: 2788686 - DNA, 18 bp, Homo sapiens
attttcatgtatatgtgt

SEQ ID NO: 2788687 - DNA, 11 bp, Homo sapiens
attttcatgtt

SEQ ID NO: 2788688 - DNA, 14 bp, Homo sapiens
attttccaataaaa

SEQ ID NO: 2788689 - DNA, 21 bp, Homo sapiens
attttcctgaatattaatccc

SEQ ID NO: 2788690 - DNA, 13 bp, Homo sapiens
attttcgtgcatt

SEQ ID NO: 2788691 - DNA, 14 bp, Homo sapiens
attttcgtgcattt

SEQ ID NO: 2788692 - DNA, 15 bp, Homo sapiens
attttcgtgcatttg

SEQ ID NO: 2788693 - DNA, 12 bp, Homo sapiens
attttctgaatt

SEQ ID NO: 2788694 - DNA, 15 bp, Homo sapiens
attttctgctacttt

SEQ ID NO: 2788695 - DNA, 18 bp, Homo sapiens
attttctggaatacatga

SEQ ID NO: 2788696 - DNA, 22 bp, Homo sapiens
attttctggaatacatgaaata

SEQ ID NO: 2788697 - DNA, 15 bp, Homo sapiens
attttctttgaaatt

SEQ ID NO: 2788698 - DNA, 16 bp, Homo sapiens
attttcttttgtaaat

SEQ ID NO: 2788699 - DNA, 24 bp, Homo sapiens
attttgacataaagttgataaaga

SEQ ID NO: 2788700 - DNA, 13 bp, Homo sapiens
attttgagtgact

SEQ ID NO: 2788701 - DNA, 23 bp, Homo sapiens
attttgagtgactcgagggttgg

SEQ ID NO: 2788702 - DNA, 12 bp, Homo sapiens
attttgcagatt

SEQ ID NO: 2788703 - DNA, 18 bp, Homo sapiens
attttgcattagacagat

SEQ ID NO: 2788704 - DNA, 20 bp, Homo sapiens
attttggaagttttcaggac

SEQ ID NO: 2788705 - DNA, 13 bp, Homo sapiens
attttgtaaaaca

SEQ ID NO: 2788706 - DNA, 20 bp, Homo sapiens
attttgtaaactcaaaatat

SEQ ID NO: 2788707 - DNA, 19 bp, Homo sapiens
attttgtaacgaagacaca

SEQ ID NO: 2788708 - DNA, 12 bp, Homo sapiens
attttgtaagtt

SEQ ID NO: 2788709 - DNA, 18 bp, Homo sapiens
attttgtaataaactctc

SEQ ID NO: 2788710 - DNA, 17 bp, Homo sapiens
attttgtacaaagatat

SEQ ID NO: 2788711 - DNA, 17 bp, Homo sapiens
caaagagcctggagaag

SEQ ID NO: 2788712 - DNA, 20 bp, Homo sapiens
caaagaggttttatgaaaag

SEQ ID NO: 2788713 - DNA, 16 bp, Homo sapiens
caaagagttaatatat

SEQ ID NO: 2788714 - DNA, 16 bp, Homo sapiens
caaagagttcaagaaa

SEQ ID NO: 2788715 - DNA, 21 bp, Homo sapiens
caaagagttcaagaaataagt

SEQ ID NO: 2788716 - DNA, 14 bp, Homo sapiens
caaagcaaaagaag

SEQ ID NO: 2788717 - DNA, 17 bp, Homo sapiens
caaagcacattgaaaga

SEQ ID NO: 2788718 - DNA, 21 bp, Homo sapiens
caaagcaccagcttctccagg

SEQ ID NO: 2788719 - DNA, 20 bp, Homo sapiens
caaagcacgaaatgttattt

SEQ ID NO: 2788720 - DNA, 22 bp, Homo sapiens
caaagcacgaaatgttattttt

SEQ ID NO: 2788721 - DNA, 17 bp, Homo sapiens
caaagccaaactctgcc

SEQ ID NO: 2788722 - DNA, 22 bp, Homo sapiens
caaagccaacagtcaaaacaga

SEQ ID NO: 2788723 - DNA, 18 bp, Homo sapiens
caaagcccttccatgtcg

SEQ ID NO: 2788724 - DNA, 21 bp, Homo sapiens
caaagcctgttcatggcagat

SEQ ID NO: 2788725 - DNA, 15 bp, Homo sapiens
caaagctaggcctgg

SEQ ID NO: 2788726 - DNA, 23 bp, Homo sapiens
caaagctcaagatgacagctctt

SEQ ID NO: 2788727 - DNA, 18 bp, Homo sapiens
caaagcttctatcccagg

SEQ ID NO: 2788728 - DNA, 20 bp, Homo sapiens
caaagcttctatcccaggag

SEQ ID NO: 2788729 - DNA, 14 bp, Homo sapiens
caaagcttgaagat

SEQ ID NO: 2788730 - DNA, 16 bp, Homo sapiens
caaagctttttccaga

SEQ ID NO: 2788731 - DNA, 16 bp, Homo sapiens
caaaggaagtctagga

SEQ ID NO: 2788732 - DNA, 14 bp, Homo sapiens
caaaggagcctgtg

SEQ ID NO: 2788733 - DNA, 15 bp, Homo sapiens
caaaggagcctgtga

SEQ ID NO: 2788734 - DNA, 16 bp, Homo sapiens
caaaggccagcagcag

SEQ ID NO: 2788735 - DNA, 20 bp, Homo sapiens
caaaggccctaccagaggga

SEQ ID NO: 2788736 - DNA, 14 bp, Homo sapiens
caaaggtataattt

SEQ ID NO: 2788737 - DNA, 14 bp, Homo sapiens
caaaggtggctctc

SEQ ID NO: 2788738 - DNA, 15 bp, Homo sapiens
caaaggttgagatgt

SEQ ID NO: 2788739 - DNA, 11 bp, Homo sapiens
caaaggttttc

SEQ ID NO: 2788740 - DNA, 19 bp, Homo sapiens
caaaggttttcctcttcta

SEQ ID NO: 2788741 - DNA, 13 bp, Homo sapiens
caaagtagagaag

SEQ ID NO: 2788742 - DNA, 20 bp, Homo sapiens
caaagtcttaaaataactta

SEQ ID NO: 2788743 - DNA, 13 bp, Homo sapiens
caaagttatattt

SEQ ID NO: 2788744 - DNA, 17 bp, Homo sapiens
caaagttatatttactt

SEQ ID NO: 2788745 - DNA, 18 bp, Homo sapiens
caaagttattccccatct

SEQ ID NO: 2788746 - DNA, 18 bp, Homo sapiens
caaagttcctgttcacct

SEQ ID NO: 2788747 - DNA, 17 bp, Homo sapiens
caaagttggggcaggct

SEQ ID NO: 2788748 - DNA, 20 bp, Homo sapiens
caaagtttaataaatttatt

SEQ ID NO: 2788749 - DNA, 17 bp, Homo sapiens
caaataaatgtgtaaat

SEQ ID NO: 2788750 - DNA, 19 bp, Homo sapiens
caaataaatgtgtaaatgt

SEQ ID NO: 2788751 - DNA, 18 bp, Homo sapiens
caaataagcatctgtgta

SEQ ID NO: 2788752 - DNA, 18 bp, Homo sapiens
caaatactccaagcttca

SEQ ID NO: 2788753 - DNA, 12 bp, Homo sapiens
caaatataaact

SEQ ID NO: 2788754 - DNA, 14 bp, Homo sapiens
caaatatatttaat

SEQ ID NO: 2788755 - DNA, 15 bp, Homo sapiens
caaatatatttaatt

SEQ ID NO: 2788756 - DNA, 13 bp, Homo sapiens
caaatatctcaga

SEQ ID NO: 2788757 - DNA, 14 bp, Homo sapiens
caaatatctcagag

SEQ ID NO: 2788758 - DNA, 15 bp, Homo sapiens
caaatattaccaaaa

SEQ ID NO: 2788759 - DNA, 15 bp, Homo sapiens
caaatatttattttc

SEQ ID NO: 2788760 - DNA, 22 bp, Homo sapiens
caaatctattcagacaagcaac

SEQ ID NO: 2788761 - DNA, 22 bp, Homo sapiens
caaatgattttcatcaatttaa

SEQ ID NO: 2788762 - DNA, 18 bp, Homo sapiens
caaatgcatggtgcagtt

SEQ ID NO: 2788763 - DNA, 21 bp, Homo sapiens
caaatggtttttgcaagattt

SEQ ID NO: 2788764 - DNA, 18 bp, Homo sapiens
caaatgtaattgaataaa

SEQ ID NO: 2788765 - DNA, 22 bp, Homo sapiens
caaatgtagtatggcctgtgtc

SEQ ID NO: 2788766 - DNA, 23 bp, Homo sapiens
caaatgtagtatggcctgtgtca

SEQ ID NO: 2788767 - DNA, 14 bp, Homo sapiens
caaatgtggctcct

SEQ ID NO: 2788768 - DNA, 18 bp, Homo sapiens
caaattaggttttgtaca

SEQ ID NO: 2788769 - DNA, 19 bp, Homo sapiens
caaattcatgtacagcatg

SEQ ID NO: 2788770 - DNA, 15 bp, Homo sapiens
caaattttgcattgt

SEQ ID NO: 2788771 - DNA, 16 bp, Homo sapiens
caacaaaatatttaat

SEQ ID NO: 2788772 - DNA, 13 bp, Homo sapiens
caacaaagaaata

SEQ ID NO: 2788773 - DNA, 19 bp, Homo sapiens
caacaaattaggttttgta

SEQ ID NO: 2788774 - DNA, 17 bp, Homo sapiens
caacacaagctggaagc

SEQ ID NO: 2788775 - DNA, 20 bp, Homo sapiens
caacacaagctggaagcaca

SEQ ID NO: 2788776 - DNA, 23 bp, Homo sapiens
caacagaagtcatgaagcccaag

SEQ ID NO: 2788777 - DNA, 13 bp, Homo sapiens
caacagagcaaga

SEQ ID NO: 2788778 - DNA, 19 bp, Homo sapiens
caacagagtgagaccctgt

SEQ ID NO: 2788779 - DNA, 15 bp, Homo sapiens
caacagctcaagtct

SEQ ID NO: 2788780 - DNA, 22 bp, Homo sapiens
caacaggaatctcagagacagg

SEQ ID NO: 2788781 - DNA, 12 bp, Homo sapiens
caacaggctggg

SEQ ID NO: 2788782 - DNA, 17 bp, Homo sapiens
caacaggctgggcttca

SEQ ID NO: 2788783 - DNA, 24 bp, Homo sapiens
caacaggctgggcttcagtggcag

SEQ ID NO: 2788784 - DNA, 14 bp, Homo sapiens
caacagttccttca

SEQ ID NO: 2788785 - DNA, 18 bp, Homo sapiens
caacatacccttctttaa

SEQ ID NO: 2788786 - DNA, 23 bp, Homo sapiens
caacatacccttctttaaatcaa

SEQ ID NO: 2788787 - DNA, 15 bp, Homo sapiens
caacatatcattttt

SEQ ID NO: 2788788 - DNA, 20 bp, Homo sapiens
caacatcccattgccctggt

SEQ ID NO: 2788789 - DNA, 18 bp, Homo sapiens
caacatggtgaaaccccg

SEQ ID NO: 2788790 - DNA, 17 bp, Homo sapiens
caacatgtataatattt

SEQ ID NO: 2788791 - DNA, 23 bp, Homo sapiens
caacatgtataatatttttaatt

SEQ ID NO: 2788792 - DNA, 22 bp, Homo sapiens
caacatgttatttgtaatagat

SEQ ID NO: 2788793 - DNA, 19 bp, Homo sapiens
caacattcccccaacatta

SEQ ID NO: 2788794 - DNA, 12 bp, Homo sapiens
caacattttatt

SEQ ID NO: 2788795 - DNA, 24 bp, Homo sapiens
caaccaacctccccgcagagctcc

SEQ ID NO: 2788796 - DNA, 12 bp, Homo sapiens
caaccactgtgg

SEQ ID NO: 2788797 - DNA, 23 bp, Homo sapiens
caaccactgtggcgttctgctgc

SEQ ID NO: 2788798 - DNA, 13 bp, Homo sapiens
caaccagagcccc

SEQ ID NO: 2788799 - DNA, 19 bp, Homo sapiens
caaccagagccccccacaa

SEQ ID NO: 2788800 - DNA, 15 bp, Homo sapiens
caaccagccacacag

SEQ ID NO: 2788801 - DNA, 19 bp, Homo sapiens
caagattcccagagacagg

SEQ ID NO: 2788802 - DNA, 18 bp, Homo sapiens
caagattgcttaaaatag

SEQ ID NO: 2788803 - DNA, 21 bp, Homo sapiens
caagattgcttaaaatagcaa

SEQ ID NO: 2788804 - DNA, 17 bp, Homo sapiens
caagcaacataaaacaa

SEQ ID NO: 2788805 - DNA, 12 bp, Homo sapiens
caagcaataatt

SEQ ID NO: 2788806 - DNA, 17 bp, Homo sapiens
caagcacagttttaaga

SEQ ID NO: 2788807 - DNA, 18 bp, Homo sapiens
caagcaccctgttccctc

SEQ ID NO: 2788808 - DNA, 19 bp, Homo sapiens
caagcaccctgttccctct

SEQ ID NO: 2788809 - DNA, 13 bp, Homo sapiens
caagcacctcctg

SEQ ID NO: 2788810 - DNA, 23 bp, Homo sapiens
caagcactgctaggcgagtgcca

SEQ ID NO: 2788811 - DNA, 18 bp, Homo sapiens
caagcatggctattttat

SEQ ID NO: 2788812 - DNA, 22 bp, Homo sapiens
caagcattcagaagaaaaagaa

SEQ ID NO: 2788813 - DNA, 18 bp, Homo sapiens
caagccaacttgtaaata

SEQ ID NO: 2788814 - DNA, 21 bp, Homo sapiens
caagccaacttgtaaatacac

SEQ ID NO: 2788815 - DNA, 13 bp, Homo sapiens
caagccacagaag

SEQ ID NO: 2788816 - DNA, 22 bp, Homo sapiens
caagccacagaagccaggagca

SEQ ID NO: 2788817 - DNA, 18 bp, Homo sapiens
caagcctgtaatcccagc

SEQ ID NO: 2788818 - DNA, 16 bp, Homo sapiens
caagcctgtgaataaa

SEQ ID NO: 2788819 - DNA, 15 bp, Homo sapiens
caagcgattcttctg

SEQ ID NO: 2788820 - DNA, 18 bp, Homo sapiens
caagcgattcttctgctt

SEQ ID NO: 2788821 - DNA, 19 bp, Homo sapiens
caagcgattcttctgcttc

SEQ ID NO: 2788822 - DNA, 20 bp, Homo sapiens
caagcgattcttctgcttca

SEQ ID NO: 2788823 - DNA, 17 bp, Homo sapiens
caagcgtgagccactgc

SEQ ID NO: 2788824 - DNA, 18 bp, Homo sapiens
caagcgtgagccactgca

SEQ ID NO: 2788825 - DNA, 17 bp, Homo sapiens
caagctagaaggccaca

SEQ ID NO: 2788826 - DNA, 12 bp, Homo sapiens
caagctcacagt

SEQ ID NO: 2788827 - DNA, 21 bp, Homo sapiens
caagctccatctccactccag

SEQ ID NO: 2788828 - DNA, 17 bp, Homo sapiens
caagctctagtgggaag

SEQ ID NO: 2788829 - DNA, 15 bp, Homo sapiens
caagctgaggtgccc

SEQ ID NO: 2788830 - DNA, 19 bp, Homo sapiens
caagctgaggtgcccagga

SEQ ID NO: 2788831 - DNA, 21 bp, Homo sapiens
caagctgaggtgcccaggaga

SEQ ID NO: 2788832 - DNA, 14 bp, Homo sapiens
caagctggaagcac

SEQ ID NO: 2788833 - DNA, 17 bp, Homo sapiens
caagctggtcccactca

SEQ ID NO: 2788834 - DNA, 19 bp, Homo sapiens
caagctggtcccactcagt

SEQ ID NO: 2788835 - DNA, 20 bp, Homo sapiens
caagcttaatggctgataat

SEQ ID NO: 2788836 - DNA, 17 bp, Homo sapiens
caagcttcaaccctcag

SEQ ID NO: 2788837 - DNA, 20 bp, Homo sapiens
caagcttcaaccctcagcct

SEQ ID NO: 2788838 - DNA, 19 bp, Homo sapiens
caagcttcaagtgatatat

SEQ ID NO: 2788839 - DNA, 12 bp, Homo sapiens
caagctttcttc

SEQ ID NO: 2788840 - DNA, 19 bp, Homo sapiens
caagctttcttctacaacc

SEQ ID NO: 2788841 - DNA, 23 bp, Homo sapiens
caagctttcttctacaaccagag

SEQ ID NO: 2788842 - DNA, 12 bp, Homo sapiens
caaggaaggaaa

SEQ ID NO: 2788843 - DNA, 20 bp, Homo sapiens
caaggaggaaaaacagacaa

SEQ ID NO: 2788844 - DNA, 19 bp, Homo sapiens
caaggagttccatgaagac

SEQ ID NO: 2788845 - DNA, 23 bp, Homo sapiens
caaggagttccatgaagaccaca

SEQ ID NO: 2788846 - DNA, 22 bp, Homo sapiens
caaggcacgtttggcatttctc

SEQ ID NO: 2788847 - DNA, 19 bp, Homo sapiens
caaggcagcaaggcccgag

SEQ ID NO: 2788848 - DNA, 14 bp, Homo sapiens
caaggcccgagcag

SEQ ID NO: 2788849 - DNA, 20 bp, Homo sapiens
caaggcccgagcagctgagc

SEQ ID NO: 2788850 - DNA, 19 bp, Homo sapiens
caaggccgctgttcaccca

SEQ ID NO: 2788851 - DNA, 19 bp, Homo sapiens
caaggcgggagcatctctt

SEQ ID NO: 2788852 - DNA, 23 bp, Homo sapiens
caaggctcttctccttggaggac

SEQ ID NO: 2788853 - DNA, 19 bp, Homo sapiens
caaggctgaccaagagaga

SEQ ID NO: 2788854 - DNA, 20 bp, Homo sapiens
caaggctgaccaagagagaa

SEQ ID NO: 2788855 - DNA, 10 bp, Homo sapiens
caaggctgct

SEQ ID NO: 2788856 - DNA, 12 bp, Homo sapiens
caaggctgctca

SEQ ID NO: 2788857 - DNA, 21 bp, Homo sapiens
caagggccatgctgaagggac

SEQ ID NO: 2788858 - DNA, 14 bp, Homo sapiens
caagggcctgatgg

SEQ ID NO: 2788859 - DNA, 17 bp, Homo sapiens
caaggggtttctgtttc

SEQ ID NO: 2788860 - DNA, 19 bp, Homo sapiens
caagggttcagagactcag

SEQ ID NO: 2788861 - DNA, 20 bp, Homo sapiens
caagggttcagagactcagg

SEQ ID NO: 2788862 - DNA, 16 bp, Homo sapiens
caaggtcggtaagttg

SEQ ID NO: 2788863 - DNA, 15 bp, Homo sapiens
caaggtgcaaatcaa

SEQ ID NO: 2788864 - DNA, 12 bp, Homo sapiens
caaggtgggctg

SEQ ID NO: 2788865 - DNA, 16 bp, Homo sapiens
caaggtgggctgagcc

SEQ ID NO: 2788866 - DNA, 17 bp, Homo sapiens
caaggtgggctgagccc

SEQ ID NO: 2788867 - DNA, 20 bp, Homo sapiens
caaggtgggctgagccctgg

SEQ ID NO: 2788868 - DNA, 23 bp, Homo sapiens
caaggtgggctgagccctggcag

SEQ ID NO: 2788869 - DNA, 24 bp, Homo sapiens
caaggtgggctgagccctggcagg

SEQ ID NO: 2788870 - DNA, 18 bp, Homo sapiens
caaggttccctctgagaa

SEQ ID NO: 2788871 - DNA, 14 bp, Homo sapiens
caagtactgctgta

SEQ ID NO: 2788872 - DNA, 17 bp, Homo sapiens
caagtagtagtgtcttc

SEQ ID NO: 2788873 - DNA, 13 bp, Homo sapiens
caagtataaagtc

SEQ ID NO: 2788874 - DNA, 16 bp, Homo sapiens
caagtatttgttaatt

SEQ ID NO: 2788875 - DNA, 15 bp, Homo sapiens
caagtccaggtcctg

SEQ ID NO: 2788876 - DNA, 23 bp, Homo sapiens
caagtccctgactctctgtgacc

SEQ ID NO: 2788877 - DNA, 17 bp, Homo sapiens
caagtctccttcccctt

SEQ ID NO: 2788878 - DNA, 18 bp, Homo sapiens
caagtctggatctgggac

SEQ ID NO: 2788879 - DNA, 19 bp, Homo sapiens
caagtctggatctgggacc

SEQ ID NO: 2788880 - DNA, 14 bp, Homo sapiens
caagtgaagaaaag

SEQ ID NO: 2788881 - DNA, 17 bp, Homo sapiens
caagtgagagctgggtg

SEQ ID NO: 2788882 - DNA, 22 bp, Homo sapiens
caagtgattctcctgcctcagc

SEQ ID NO: 2788883 - DNA, 17 bp, Homo sapiens
caagtgcatgctctctg

SEQ ID NO: 2788884 - DNA, 20 bp, Homo sapiens
caagtgccagtcttgtgtct

SEQ ID NO: 2788885 - DNA, 19 bp, Homo sapiens
caagtggctcccacaccct

SEQ ID NO: 2788886 - DNA, 14 bp, Homo sapiens
caagtgggggcaga

SEQ ID NO: 2788887 - DNA, 20 bp, Homo sapiens
caagtgggggcagagggcag

SEQ ID NO: 2788888 - DNA, 22 bp, Homo sapiens
caagtggtgggaatcagatctg

SEQ ID NO: 2788889 - DNA, 23 bp, Homo sapiens
caagtgtggtagggacttaaaaa

SEQ ID NO: 2788890 - DNA, 18 bp, Homo sapiens
caagttaaagtgaataac

SEQ ID NO: 2788891 - DNA, 22 bp, Homo sapiens
cacctgggccctggggcctgta

SEQ ID NO: 2788892 - DNA, 16 bp, Homo sapiens
cacctgtactcaggag

SEQ ID NO: 2788893 - DNA, 23 bp, Homo sapiens
cacctgtactcaggaggctgagg

SEQ ID NO: 2788894 - DNA, 15 bp, Homo sapiens
cacctgtgcacccca

SEQ ID NO: 2788895 - DNA, 18 bp, Homo sapiens
cacctgtgcaccccatga

SEQ ID NO: 2788896 - DNA, 20 bp, Homo sapiens
cacctgttaaaatgtacact

SEQ ID NO: 2788897 - DNA, 18 bp, Homo sapiens
cacctgttcaggagctga

SEQ ID NO: 2788898 - DNA, 14 bp, Homo sapiens
caccttatgtatta

SEQ ID NO: 2788899 - DNA, 19 bp, Homo sapiens
caccttcaattcctgggcc

SEQ ID NO: 2788900 - DNA, 15 bp, Homo sapiens
caccttccagtgagc

SEQ ID NO: 2788901 - DNA, 13 bp, Homo sapiens
caccttcccagct

SEQ ID NO: 2788902 - DNA, 15 bp, Homo sapiens
caccttcccagctct

SEQ ID NO: 2788903 - DNA, 22 bp, Homo sapiens
caccttcccagctctccctctg

SEQ ID NO: 2788904 - DNA, 13 bp, Homo sapiens
caccttcccatgc

SEQ ID NO: 2788905 - DNA, 15 bp, Homo sapiens
caccttgacagggca

SEQ ID NO: 2788906 - DNA, 18 bp, Homo sapiens
caccttgacagggcacac

SEQ ID NO: 2788907 - DNA, 13 bp, Homo sapiens
caccttggctcaa

SEQ ID NO: 2788908 - DNA, 12 bp, Homo sapiens
cacctttctagt

SEQ ID NO: 2788909 - DNA, 16 bp, Homo sapiens
cacgaaccctgccagg

SEQ ID NO: 2788910 - DNA, 17 bp, Homo sapiens
cacgaggagcttccagt

SEQ ID NO: 2788911 - DNA, 16 bp, Homo sapiens
cacgcaggaactccca

SEQ ID NO: 2788912 - DNA, 15 bp, Homo sapiens
cacgcccagcctcct

SEQ ID NO: 2788913 - DNA, 19 bp, Homo sapiens
cacgcccagcctcctccca

SEQ ID NO: 2788914 - DNA, 21 bp, Homo sapiens
cacgcctatgatcccagcact

SEQ ID NO: 2788915 - DNA, 14 bp, Homo sapiens
cacgcctgcccagc

SEQ ID NO: 2788916 - DNA, 16 bp, Homo sapiens
cacgcctgcccagcct

SEQ ID NO: 2788917 - DNA, 20 bp, Homo sapiens
cacgcctgcccagcctcgca

SEQ ID NO: 2788918 - DNA, 22 bp, Homo sapiens
cacgcctgtaatcccagcactt

SEQ ID NO: 2788919 - DNA, 20 bp, Homo sapiens
cacgcctgtaatcccagcag

SEQ ID NO: 2788920 - DNA, 19 bp, Homo sapiens
cacgcctgtaatcccagct

SEQ ID NO: 2788921 - DNA, 16 bp, Homo sapiens
cacgcgtgcacacacc

SEQ ID NO: 2788922 - DNA, 17 bp, Homo sapiens
cacgctggaccttgaac

SEQ ID NO: 2788923 - DNA, 20 bp, Homo sapiens
cacgctggagtgcagtgagc

SEQ ID NO: 2788924 - DNA, 21 bp, Homo sapiens
cacggaggcatctgcaccctc

SEQ ID NO: 2788925 - DNA, 20 bp, Homo sapiens
cacggatccatgtagcagga

SEQ ID NO: 2788926 - DNA, 22 bp, Homo sapiens
cacggcacctgggccctggggc

SEQ ID NO: 2788927 - DNA, 19 bp, Homo sapiens
cacggcagcttgagcctgt

SEQ ID NO: 2788928 - DNA, 16 bp, Homo sapiens
cacgtacttaaatgaa

SEQ ID NO: 2788929 - DNA, 19 bp, Homo sapiens
cacgtatttatatttggaa

SEQ ID NO: 2788930 - DNA, 12 bp, Homo sapiens
cacgtcccatgt

SEQ ID NO: 2788931 - DNA, 13 bp, Homo sapiens
cacgtcccatgtg

SEQ ID NO: 2788932 - DNA, 13 bp, Homo sapiens
cacgtccccctgg

SEQ ID NO: 2788933 - DNA, 15 bp, Homo sapiens
cacgtgccaggcccg

SEQ ID NO: 2788934 - DNA, 19 bp, Homo sapiens
cacgtgctcttctgttctc

SEQ ID NO: 2788935 - DNA, 20 bp, Homo sapiens
cacgtggtcaaggcccggcc

SEQ ID NO: 2788936 - DNA, 13 bp, Homo sapiens
cactaaaaagtgg

SEQ ID NO: 2788937 - DNA, 16 bp, Homo sapiens
cactaaccacgctgga

SEQ ID NO: 2788938 - DNA, 22 bp, Homo sapiens
cactaagtagaataaagaaaaa

SEQ ID NO: 2788939 - DNA, 15 bp, Homo sapiens
cactaatacaccagg

SEQ ID NO: 2788940 - DNA, 17 bp, Homo sapiens
cactacaagtttataag

SEQ ID NO: 2788941 - DNA, 16 bp, Homo sapiens
cactacactccagcct

SEQ ID NO: 2788942 - DNA, 20 bp, Homo sapiens
cactacactccagcctgagc

SEQ ID NO: 2788943 - DNA, 14 bp, Homo sapiens
cactaccttatcag

SEQ ID NO: 2788944 - DNA, 17 bp, Homo sapiens
cactagaactctccatc

SEQ ID NO: 2788945 - DNA, 12 bp, Homo sapiens
cactagcagctg

SEQ ID NO: 2788946 - DNA, 17 bp, Homo sapiens
cactagttttgtgccag

SEQ ID NO: 2788947 - DNA, 12 bp, Homo sapiens
cactataaatgg

SEQ ID NO: 2788948 - DNA, 19 bp, Homo sapiens
cactataaatggtgttttt

SEQ ID NO: 2788949 - DNA, 22 bp, Homo sapiens
cactataaccatcagttactgg

SEQ ID NO: 2788950 - DNA, 19 bp, Homo sapiens
cactatctttctgataaca

SEQ ID NO: 2788951 - DNA, 19 bp, Homo sapiens
cactatgttgcccaggcag

SEQ ID NO: 2788952 - DNA, 19 bp, Homo sapiens
cactcaaattaatctttct

SEQ ID NO: 2788953 - DNA, 20 bp, Homo sapiens
cactcaaattaatctttctt

SEQ ID NO: 2788954 - DNA, 20 bp, Homo sapiens
cactcacatttattctgctc

SEQ ID NO: 2788955 - DNA, 16 bp, Homo sapiens
cactcacccatgtgcc

SEQ ID NO: 2788956 - DNA, 21 bp, Homo sapiens
cactcacccatgtgccaaggt

SEQ ID NO: 2788957 - DNA, 17 bp, Homo sapiens
cactcagaagcctgggg

SEQ ID NO: 2788958 - DNA, 23 bp, Homo sapiens
cactcagaagcctgggggcctgg

SEQ ID NO: 2788959 - DNA, 19 bp, Homo sapiens
cactcaggaggctgaggca

SEQ ID NO: 2788960 - DNA, 23 bp, Homo sapiens
cactcagtcccccaccacactga

SEQ ID NO: 2788961 - DNA, 16 bp, Homo sapiens
cactcatttcatctca

SEQ ID NO: 2788962 - DNA, 13 bp, Homo sapiens
cactccagcctga

SEQ ID NO: 2788963 - DNA, 23 bp, Homo sapiens
cactccagcctgggcgacagagc

SEQ ID NO: 2788964 - DNA, 21 bp, Homo sapiens
cactccggtgtgcctgcagcc

SEQ ID NO: 2788965 - DNA, 14 bp, Homo sapiens
cactcctcactgcc

SEQ ID NO: 2788966 - DNA, 17 bp, Homo sapiens
cactcctctgtctctgc

SEQ ID NO: 2788967 - DNA, 20 bp, Homo sapiens
cactcctctgtctctgctct

SEQ ID NO: 2788968 - DNA, 21 bp, Homo sapiens
cactcctctgtctctgctctt

SEQ ID NO: 2788969 - DNA, 18 bp, Homo sapiens
cactcctgttacttacct

SEQ ID NO: 2788970 - DNA, 17 bp, Homo sapiens
cactctaccctatacaa

SEQ ID NO: 2788971 - DNA, 17 bp, Homo sapiens
cactctaggggtcaggc

SEQ ID NO: 2788972 - DNA, 18 bp, Homo sapiens
cactctcccctccctctt

SEQ ID NO: 2788973 - DNA, 21 bp, Homo sapiens
cactctcccctccctcttcct

SEQ ID NO: 2788974 - DNA, 12 bp, Homo sapiens
cactctgctctg

SEQ ID NO: 2788975 - DNA, 14 bp, Homo sapiens
cactctgctctgat

SEQ ID NO: 2788976 - DNA, 15 bp, Homo sapiens
cactctgctctgatg

SEQ ID NO: 2788977 - DNA, 16 bp, Homo sapiens
cactctgtcgcccagt

SEQ ID NO: 2788978 - DNA, 20 bp, Homo sapiens
cactctgtcgcccagtctgg

SEQ ID NO: 2788979 - DNA, 15 bp, Homo sapiens
cactcttatgaaatg

SEQ ID NO: 2788980 - DNA, 17 bp, Homo sapiens
cactcttcctgcaagga

SEQ ID NO: 2788981 - DNA, 15 bp, Homo sapiens
cactctttgtaagag

SEQ ID NO: 2788982 - DNA, 21 bp, Homo sapiens
cagaaagggagggctctgagg

SEQ ID NO: 2788983 - DNA, 20 bp, Homo sapiens
cagaaataaagttggtgaca

SEQ ID NO: 2788984 - DNA, 21 bp, Homo sapiens
cagaacaaggttccctctgag

SEQ ID NO: 2788985 - DNA, 12 bp, Homo sapiens
cagaacagcaga

SEQ ID NO: 2788986 - DNA, 13 bp, Homo sapiens
cagaacatgagtt

SEQ ID NO: 2788987 - DNA, 18 bp, Homo sapiens
cagaactgaacgtcctgc

SEQ ID NO: 2788988 - DNA, 19 bp, Homo sapiens
cagaactgcttactagccc

SEQ ID NO: 2788989 - DNA, 11 bp, Homo sapiens
cagaagaaaga

SEQ ID NO: 2788990 - DNA, 12 bp, Homo sapiens
cagaagaatatt

SEQ ID NO: 2788991 - DNA, 16 bp, Homo sapiens
cagaagaatattcagg

SEQ ID NO: 2788992 - DNA, 17 bp, Homo sapiens
cagaagaatattcagga

SEQ ID NO: 2788993 - DNA, 17 bp, Homo sapiens
cagaagaattgaaccca

SEQ ID NO: 2788994 - DNA, 22 bp, Homo sapiens
cagaagaattgaacccaggagg

SEQ ID NO: 2788995 - DNA, 21 bp, Homo sapiens
cagaagagatgggcttgtttt

SEQ ID NO: 2788996 - DNA, 14 bp, Homo sapiens
cagaagcctgaggc

SEQ ID NO: 2788997 - DNA, 12 bp, Homo sapiens
cagaagcctggg

SEQ ID NO: 2788998 - DNA, 20 bp, Homo sapiens
cagaagcctgggggcctggc

SEQ ID NO: 2788999 - DNA, 21 bp, Homo sapiens
cagaagcctgggggcctggct

SEQ ID NO: 2789000 - DNA, 23 bp, Homo sapiens
cagaagcctgggggcctggctgg

SEQ ID NO: 2789001 - DNA, 18 bp, Homo sapiens
cagaaggagaaggaagga

SEQ ID NO: 2789002 - DNA, 17 bp, Homo sapiens
cagaaggatgaatgagg

SEQ ID NO: 2789003 - DNA, 18 bp, Homo sapiens
cagaagtcatgaagccca

SEQ ID NO: 2789004 - DNA, 19 bp, Homo sapiens
cagaagtcatgaagcccaa

SEQ ID NO: 2789005 - DNA, 19 bp, Homo sapiens
cagaagtttgtcaagtcaa

SEQ ID NO: 2789006 - DNA, 12 bp, Homo sapiens
cagaataagtgc

SEQ ID NO: 2789007 - DNA, 17 bp, Homo sapiens
cagaataagtgctgttt

SEQ ID NO: 2789008 - DNA, 21 bp, Homo sapiens
cagaataagtgctgtttgaga

SEQ ID NO: 2789009 - DNA, 21 bp, Homo sapiens
cagaataccttcttcgctgct

SEQ ID NO: 2789010 - DNA, 15 bp, Homo sapiens
cagaatgatgccaaa

SEQ ID NO: 2789011 - DNA, 18 bp, Homo sapiens
cagaatggggtgcatgaa

SEQ ID NO: 2789012 - DNA, 23 bp, Homo sapiens
cagaattcccagctgtctgtgtc

SEQ ID NO: 2789013 - DNA, 14 bp, Homo sapiens
cagaattctgctac

SEQ ID NO: 2789014 - DNA, 23 bp, Homo sapiens
cagaattctgctacctcactggg

SEQ ID NO: 2789015 - DNA, 23 bp, Homo sapiens
cagaattgcattctgaatgaata

SEQ ID NO: 2789016 - DNA, 22 bp, Homo sapiens
cagaatttctttgtcattcaag

SEQ ID NO: 2789017 - DNA, 18 bp, Homo sapiens
cagaattttaccaaaatt

SEQ ID NO: 2789018 - DNA, 18 bp, Homo sapiens
cagaatttttaatgactt

SEQ ID NO: 2789019 - DNA, 17 bp, Homo sapiens
cagaattttttgagtaa

SEQ ID NO: 2789020 - DNA, 19 bp, Homo sapiens
cagacaaaaacagcctcac

SEQ ID NO: 2789021 - DNA, 20 bp, Homo sapiens
cagacaaaaacagcctcaca

SEQ ID NO: 2789022 - DNA, 22 bp, Homo sapiens
cagacaaaaacagcctcacaga

SEQ ID NO: 2789023 - DNA, 13 bp, Homo sapiens
cagacaacagaag

SEQ ID NO: 2789024 - DNA, 23 bp, Homo sapiens
cagacaagcaacaggttttataa

SEQ ID NO: 2789025 - DNA, 20 bp, Homo sapiens
cagacacacaaaatgtcaca

SEQ ID NO: 2789026 - DNA, 23 bp, Homo sapiens
cagacacaggcccggctccaggc

SEQ ID NO: 2789027 - DNA, 21 bp, Homo sapiens
cagacactaagttatagtata

SEQ ID NO: 2789028 - DNA, 22 bp, Homo sapiens
cagacactggtttgaagaatgt

SEQ ID NO: 2789029 - DNA, 11 bp, Homo sapiens
cagacaggcaa

SEQ ID NO: 2789030 - DNA, 19 bp, Homo sapiens
cagacagggcctagctttc

SEQ ID NO: 2789031 - DNA, 22 bp, Homo sapiens
cagacatgtggtgggacaggga

SEQ ID NO: 2789032 - DNA, 16 bp, Homo sapiens
cagaccacctgcttct

SEQ ID NO: 2789033 - DNA, 12 bp, Homo sapiens
cagaccccagcg

SEQ ID NO: 2789034 - DNA, 14 bp, Homo sapiens
cagaccccagcggc

SEQ ID NO: 2789035 - DNA, 14 bp, Homo sapiens
cagacccccactct

SEQ ID NO: 2789036 - DNA, 16 bp, Homo sapiens
cagacccccactctca

SEQ ID NO: 2789037 - DNA, 17 bp, Homo sapiens
cagaccctaccccacca

SEQ ID NO: 2789038 - DNA, 12 bp, Homo sapiens
cagaccctgaag

SEQ ID NO: 2789039 - DNA, 18 bp, Homo sapiens
cagacctctgatccctcg

SEQ ID NO: 2789040 - DNA, 12 bp, Homo sapiens
cagacctggaca

SEQ ID NO: 2789041 - DNA, 16 bp, Homo sapiens
cagactacagccagaa

SEQ ID NO: 2789042 - DNA, 13 bp, Homo sapiens
cagactcagctcc

SEQ ID NO: 2789043 - DNA, 17 bp, Homo sapiens
cagactcagctccagaa

SEQ ID NO: 2789044 - DNA, 14 bp, Homo sapiens
cagactcagctctg

SEQ ID NO: 2789045 - DNA, 15 bp, Homo sapiens
cagactcagctctga

SEQ ID NO: 2789046 - DNA, 17 bp, Homo sapiens
cagactcagtttgtcag

SEQ ID NO: 2789047 - DNA, 18 bp, Homo sapiens
cagactcagtttgtcaga

SEQ ID NO: 2789048 - DNA, 23 bp, Homo sapiens
cagactccttcaacaattctaaa

SEQ ID NO: 2789049 - DNA, 18 bp, Homo sapiens
cagactctacagaggcca

SEQ ID NO: 2789050 - DNA, 23 bp, Homo sapiens
cagactctacagaggccatgggc

SEQ ID NO: 2789051 - DNA, 13 bp, Homo sapiens
cagactgctggga

SEQ ID NO: 2789052 - DNA, 20 bp, Homo sapiens
cagactgctgggactggcca

SEQ ID NO: 2789053 - DNA, 23 bp, Homo sapiens
cagactgctgggactggccaggt

SEQ ID NO: 2789054 - DNA, 20 bp, Homo sapiens
cagactgcttccaattttct

SEQ ID NO: 2789055 - DNA, 18 bp, Homo sapiens
cagactggaagcacagct

SEQ ID NO: 2789056 - DNA, 21 bp, Homo sapiens
cagactggaagcacagcttca

SEQ ID NO: 2789057 - DNA, 14 bp, Homo sapiens
cagacttctccaga

SEQ ID NO: 2789058 - DNA, 15 bp, Homo sapiens
cagacttctccagac

SEQ ID NO: 2789059 - DNA, 17 bp, Homo sapiens
cagacttctctttctta

SEQ ID NO: 2789060 - DNA, 15 bp, Homo sapiens
cagagaaagaagaga

SEQ ID NO: 2789061 - DNA, 20 bp, Homo sapiens
cagagaaagaagagacagga

SEQ ID NO: 2789062 - DNA, 21 bp, Homo sapiens
cagagaaagaagagacaggag

SEQ ID NO: 2789063 - DNA, 13 bp, Homo sapiens
cagagaaggcagg

SEQ ID NO: 2789064 - DNA, 20 bp, Homo sapiens
cagagaaggcaggaatgtgt

SEQ ID NO: 2789065 - DNA, 14 bp, Homo sapiens
cagagaaggcttcc

SEQ ID NO: 2789066 - DNA, 11 bp, Homo sapiens
cagagaagttc

SEQ ID NO: 2789067 - DNA, 13 bp, Homo sapiens
cagagaatttcta

SEQ ID NO: 2789068 - DNA, 16 bp, Homo sapiens
cagagaatttctacca

SEQ ID NO: 2789069 - DNA, 22 bp, Homo sapiens
cagagacaggaaaatcctctgg

SEQ ID NO: 2789070 - DNA, 23 bp, Homo sapiens
cagagacaggcccaagagatgaa

SEQ ID NO: 2789071 - DNA, 14 bp, Homo sapiens
cagagacaggtggc

SEQ ID NO: 2789072 - DNA, 20 bp, Homo sapiens
cagatttgctaatttatcct

SEQ ID NO: 2789073 - DNA, 15 bp, Homo sapiens
cagattttaattttg

SEQ ID NO: 2789074 - DNA, 23 bp, Homo sapiens
cagattttaattttgaataaata

SEQ ID NO: 2789075 - DNA, 12 bp, Homo sapiens
cagattttagac

SEQ ID NO: 2789076 - DNA, 21 bp, Homo sapiens
cagcaacacaagctggaagca

SEQ ID NO: 2789077 - DNA, 19 bp, Homo sapiens
cagcaacaggaatctcaga

SEQ ID NO: 2789078 - DNA, 20 bp, Homo sapiens
cagcaagacttctctttgcc

SEQ ID NO: 2789079 - DNA, 23 bp, Homo sapiens
cagcaagacttctctttgcctca

SEQ ID NO: 2789080 - DNA, 23 bp, Homo sapiens
cagcaaggcccgagcagctgagc

SEQ ID NO: 2789081 - DNA, 15 bp, Homo sapiens
cagcaagtgagagct

SEQ ID NO: 2789082 - DNA, 17 bp, Homo sapiens
cagcaagtgagagctgg

SEQ ID NO: 2789083 - DNA, 20 bp, Homo sapiens
cagcaatgatgtccagaaga

SEQ ID NO: 2789084 - DNA, 20 bp, Homo sapiens
cagcacatagcactgggaac

SEQ ID NO: 2789085 - DNA, 22 bp, Homo sapiens
cagcaccctgcagagcacacag

SEQ ID NO: 2789086 - DNA, 17 bp, Homo sapiens
cagcactcctctgtctc

SEQ ID NO: 2789087 - DNA, 18 bp, Homo sapiens
cagcactcctctgtctct

SEQ ID NO: 2789088 - DNA, 17 bp, Homo sapiens
cagcactttaaccctct

SEQ ID NO: 2789089 - DNA, 18 bp, Homo sapiens
cagcactttaaccctctc

SEQ ID NO: 2789090 - DNA, 20 bp, Homo sapiens
cagcactttaaccctctctt

SEQ ID NO: 2789091 - DNA, 19 bp, Homo sapiens
cagcactttgggaggctga

SEQ ID NO: 2789092 - DNA, 11 bp, Homo sapiens
cagcagaaaag

SEQ ID NO: 2789093 - DNA, 12 bp, Homo sapiens
cagcagaaaagt

SEQ ID NO: 2789094 - DNA, 13 bp, Homo sapiens
cagcagaaaagtg

SEQ ID NO: 2789095 - DNA, 16 bp, Homo sapiens
cagcagaaaagtgctt

SEQ ID NO: 2789096 - DNA, 18 bp, Homo sapiens
cagcagaaaagtgcttag

SEQ ID NO: 2789097 - DNA, 18 bp, Homo sapiens
cagcagatggaaagaaag

SEQ ID NO: 2789098 - DNA, 14 bp, Homo sapiens
cagcagccagccct

SEQ ID NO: 2789099 - DNA, 16 bp, Homo sapiens
cagcagccagccctgc

SEQ ID NO: 2789100 - DNA, 18 bp, Homo sapiens
cagcagccagccctgcct

SEQ ID NO: 2789101 - DNA, 17 bp, Homo sapiens
cagcagccagctctcag

SEQ ID NO: 2789102 - DNA, 16 bp, Homo sapiens
cagcagccctaaggat

SEQ ID NO: 2789103 - DNA, 20 bp, Homo sapiens
cagcagccctaaggatctct

SEQ ID NO: 2789104 - DNA, 11 bp, Homo sapiens
cagcagccctc

SEQ ID NO: 2789105 - DNA, 13 bp, Homo sapiens
cagcagctcagcc

SEQ ID NO: 2789106 - DNA, 21 bp, Homo sapiens
cagcagctcagcctccccccg

SEQ ID NO: 2789107 - DNA, 20 bp, Homo sapiens
cagcaggaagccaggctgag

SEQ ID NO: 2789108 - DNA, 16 bp, Homo sapiens
cagcatacctgctggt

SEQ ID NO: 2789109 - DNA, 19 bp, Homo sapiens
cagcatcctggcacccggc

SEQ ID NO: 2789110 - DNA, 12 bp, Homo sapiens
cagcatgtcact

SEQ ID NO: 2789111 - DNA, 13 bp, Homo sapiens
cagcattttacta

SEQ ID NO: 2789112 - DNA, 15 bp, Homo sapiens
cagcattttactact

SEQ ID NO: 2789113 - DNA, 19 bp, Homo sapiens
cagccaaacccatgaggca

SEQ ID NO: 2789114 - DNA, 23 bp, Homo sapiens
cagccaacaggtggcaggaccag

SEQ ID NO: 2789115 - DNA, 12 bp, Homo sapiens
cagccacacaga

SEQ ID NO: 2789116 - DNA, 13 bp, Homo sapiens
cagccacacctgt

SEQ ID NO: 2789117 - DNA, 17 bp, Homo sapiens
cagccacacctgtcagc

SEQ ID NO: 2789118 - DNA, 18 bp, Homo sapiens
cagccacacttctcagga

SEQ ID NO: 2789119 - DNA, 15 bp, Homo sapiens
cagccaccccctccc

SEQ ID NO: 2789120 - DNA, 19 bp, Homo sapiens
cagccaccctgaggagtct

SEQ ID NO: 2789121 - DNA, 20 bp, Homo sapiens
cagccaccctgaggagtctg

SEQ ID NO: 2789122 - DNA, 15 bp, Homo sapiens
cagccacggccaggc

SEQ ID NO: 2789123 - DNA, 16 bp, Homo sapiens
cagccacggccaggcc

SEQ ID NO: 2789124 - DNA, 18 bp, Homo sapiens
cagccacggccaggccag

SEQ ID NO: 2789125 - DNA, 23 bp, Homo sapiens
cagccacggccaggccagaggga

SEQ ID NO: 2789126 - DNA, 23 bp, Homo sapiens
cagccactcgggaggctgagaca

SEQ ID NO: 2789127 - DNA, 12 bp, Homo sapiens
cagccagcccag

SEQ ID NO: 2789128 - DNA, 15 bp, Homo sapiens
cagccagcccagccc

SEQ ID NO: 2789129 - DNA, 14 bp, Homo sapiens
cagccagccctgcc

SEQ ID NO: 2789130 - DNA, 17 bp, Homo sapiens
cagccagccctgcctgg

SEQ ID NO: 2789131 - DNA, 21 bp, Homo sapiens
cagccagccctgcctggagga

SEQ ID NO: 2789132 - DNA, 18 bp, Homo sapiens
cagccagccggtgcctgg

SEQ ID NO: 2789133 - DNA, 19 bp, Homo sapiens
cagccagccggtgcctggc

SEQ ID NO: 2789134 - DNA, 23 bp, Homo sapiens
cagccagcgcctccctccacccc

SEQ ID NO: 2789135 - DNA, 15 bp, Homo sapiens
cagccagctcctggg

SEQ ID NO: 2789136 - DNA, 12 bp, Homo sapiens
cagccagctctc

SEQ ID NO: 2789137 - DNA, 15 bp, Homo sapiens
cagccagctctcagc

SEQ ID NO: 2789138 - DNA, 21 bp, Homo sapiens
cagccagctctcagccaacga

SEQ ID NO: 2789139 - DNA, 14 bp, Homo sapiens
cagccaggaggaga

SEQ ID NO: 2789140 - DNA, 11 bp, Homo sapiens
cagccagggcc

SEQ ID NO: 2789141 - DNA, 12 bp, Homo sapiens
cagccagggcca

SEQ ID NO: 2789142 - DNA, 15 bp, Homo sapiens
cagccagggccaggg

SEQ ID NO: 2789143 - DNA, 22 bp, Homo sapiens
cagcccaagggcggggctatgc

SEQ ID NO: 2789144 - DNA, 18 bp, Homo sapiens
cagcccacttctgccata

SEQ ID NO: 2789145 - DNA, 13 bp, Homo sapiens
cagcccagcccag

SEQ ID NO: 2789146 - DNA, 12 bp, Homo sapiens
cagcccagcctc

SEQ ID NO: 2789147 - DNA, 18 bp, Homo sapiens
cagcccattctctctcct

SEQ ID NO: 2789148 - DNA, 18 bp, Homo sapiens
cagcccccacctccgccc

SEQ ID NO: 2789149 - DNA, 15 bp, Homo sapiens
cagccccgactccag

SEQ ID NO: 2789150 - DNA, 16 bp, Homo sapiens
cagccccgactccagc

SEQ ID NO: 2789151 - DNA, 16 bp, Homo sapiens
cagccccgcgcctcct

SEQ ID NO: 2789152 - DNA, 18 bp, Homo sapiens
cagccccgcgcctccttc

SEQ ID NO: 2789153 - DNA, 20 bp, Homo sapiens
cagccccgggcctgcctctg

SEQ ID NO: 2789154 - DNA, 22 bp, Homo sapiens
cagcccctcctccccttcctgc

SEQ ID NO: 2789155 - DNA, 16 bp, Homo sapiens
cagcccctcctctgcc

SEQ ID NO: 2789156 - DNA, 22 bp, Homo sapiens
cagcccctcctctgccacctcc

SEQ ID NO: 2789157 - DNA, 13 bp, Homo sapiens
cagcccctgcaca

SEQ ID NO: 2789158 - DNA, 17 bp, Homo sapiens
cagccccttgagaaacc

SEQ ID NO: 2789159 - DNA, 14 bp, Homo sapiens
cagccctaaacatc

SEQ ID NO: 2789160 - DNA, 16 bp, Homo sapiens
cagccctaaacatcat

SEQ ID NO: 2789161 - DNA, 20 bp, Homo sapiens
cagccctaaggatctctcag

SEQ ID NO: 2789162 - DNA, 14 bp, Homo sapiens
cagccctccctgtc

SEQ ID NO: 2789163 - DNA, 15 bp, Homo sapiens
agtcagaacagcaga

SEQ ID NO: 2789164 - DNA, 17 bp, Homo sapiens
agtcagaacagcagact

SEQ ID NO: 2789165 - DNA, 22 bp, Homo sapiens
agtcagaacagcagactcagct

SEQ ID NO: 2789166 - DNA, 14 bp, Homo sapiens
agtcagatgcccag

SEQ ID NO: 2789167 - DNA, 23 bp, Homo sapiens
agtcagatgcccagagggcccag

SEQ ID NO: 2789168 - DNA, 13 bp, Homo sapiens
agtcaggaaggga

SEQ ID NO: 2789169 - DNA, 22 bp, Homo sapiens
agtcaggccttaattttcagta

SEQ ID NO: 2789170 - DNA, 21 bp, Homo sapiens
agtcatgaagcccaagtgaaa

SEQ ID NO: 2789171 - DNA, 18 bp, Homo sapiens
agtcatgatctccctgcc

SEQ ID NO: 2789172 - DNA, 20 bp, Homo sapiens
agtccagaataagtgctgtt

SEQ ID NO: 2789173 - DNA, 15 bp, Homo sapiens
agtccagccagctcc

SEQ ID NO: 2789174 - DNA, 16 bp, Homo sapiens
agtccagccagctcct

SEQ ID NO: 2789175 - DNA, 14 bp, Homo sapiens
agtccagggcggga

SEQ ID NO: 2789176 - DNA, 15 bp, Homo sapiens
agtccaggtcctggt

SEQ ID NO: 2789177 - DNA, 16 bp, Homo sapiens
agtccaggtcctggtg

SEQ ID NO: 2789178 - DNA, 14 bp, Homo sapiens
agtcccaaggaaag

SEQ ID NO: 2789179 - DNA, 20 bp, Homo sapiens
agtcccaaggaaagccccag

SEQ ID NO: 2789180 - DNA, 16 bp, Homo sapiens
agtcccaccttggctg

SEQ ID NO: 2789181 - DNA, 18 bp, Homo sapiens
agtcccaccttggctgca

SEQ ID NO: 2789182 - DNA, 23 bp, Homo sapiens
agtcccaccttggctgcagggag

SEQ ID NO: 2789183 - DNA, 19 bp, Homo sapiens
agtcccccaccacactgaa

SEQ ID NO: 2789184 - DNA, 20 bp, Homo sapiens
agtccccgtgccccgcctcc

SEQ ID NO: 2789185 - DNA, 19 bp, Homo sapiens
agtccctgactctctgtga

SEQ ID NO: 2789186 - DNA, 20 bp, Homo sapiens
agtcctacaagctaaaatta

SEQ ID NO: 2789187 - DNA, 17 bp, Homo sapiens
agtcctagccactcagg

SEQ ID NO: 2789188 - DNA, 15 bp, Homo sapiens
agtcctcgtagccat

SEQ ID NO: 2789189 - DNA, 17 bp, Homo sapiens
agtcctcgtagccatct

SEQ ID NO: 2789190 - DNA, 14 bp, Homo sapiens
agtcctcttttctg

SEQ ID NO: 2789191 - DNA, 19 bp, Homo sapiens
agtcctcttttctgagagg

SEQ ID NO: 2789192 - DNA, 18 bp, Homo sapiens
agtcctgcagaggattta

SEQ ID NO: 2789193 - DNA, 22 bp, Homo sapiens
agtcctgggagaacctcaggct

SEQ ID NO: 2789194 - DNA, 12 bp, Homo sapiens
agtcctggtctg

SEQ ID NO: 2789195 - DNA, 17 bp, Homo sapiens
agtcctggtctgctcag

SEQ ID NO: 2789196 - DNA, 18 bp, Homo sapiens
agtcctttgattccattt

SEQ ID NO: 2789197 - DNA, 15 bp, Homo sapiens
agtcggttcccacgg

SEQ ID NO: 2789198 - DNA, 21 bp, Homo sapiens
agtcgtccttactcctgtggg

SEQ ID NO: 2789199 - DNA, 18 bp, Homo sapiens
gacaaggattgctactgt

SEQ ID NO: 2789200 - DNA, 19 bp, Homo sapiens
gacaataatttcaggtttt

SEQ ID NO: 2789201 - DNA, 12 bp, Homo sapiens
gacaattcactt

SEQ ID NO: 2789202 - DNA, 15 bp, Homo sapiens
gacacacagcactct

SEQ ID NO: 2789203 - DNA, 13 bp, Homo sapiens
gacacacagctct

SEQ ID NO: 2789204 - DNA, 15 bp, Homo sapiens
gacacaccccccagt

SEQ ID NO: 2789205 - DNA, 23 bp, Homo sapiens
gacacaccccccagtcgagccct

SEQ ID NO: 2789206 - DNA, 17 bp, Homo sapiens
gacacagctcttctcca

SEQ ID NO: 2789207 - DNA, 15 bp, Homo sapiens
gacacaggcccggct

SEQ ID NO: 2789208 - DNA, 17 bp, Homo sapiens
gacacaggcccggctcc

SEQ ID NO: 2789209 - DNA, 18 bp, Homo sapiens
gacacaggcccggctcca

SEQ ID NO: 2789210 - DNA, 19 bp, Homo sapiens
gacacaggcccggctccag

SEQ ID NO: 2789211 - DNA, 19 bp, Homo sapiens
gacacatactcatttttca

SEQ ID NO: 2789212 - DNA, 19 bp, Homo sapiens
gacaccaggagtccctggt

SEQ ID NO: 2789213 - DNA, 20 bp, Homo sapiens
gacaccaggagtccctggta

SEQ ID NO: 2789214 - DNA, 22 bp, Homo sapiens
gacacccaccccctctttgtgt

SEQ ID NO: 2789215 - DNA, 18 bp, Homo sapiens
gacaccccttatccagga

SEQ ID NO: 2789216 - DNA, 20 bp, Homo sapiens
gacaccccttatccaggact

SEQ ID NO: 2789217 - DNA, 20 bp, Homo sapiens
gacacctgcacctcccccca

SEQ ID NO: 2789218 - DNA, 10 bp, Homo sapiens
gacacctgcc

SEQ ID NO: 2789219 - DNA, 12 bp, Homo sapiens
gacacctgccct

SEQ ID NO: 2789220 - DNA, 13 bp, Homo sapiens
gacacctgtgcac

SEQ ID NO: 2789221 - DNA, 15 bp, Homo sapiens
gacacggggcagtgg

SEQ ID NO: 2789222 - DNA, 21 bp, Homo sapiens
gacacgtgtggcgggcagtgg

SEQ ID NO: 2789223 - DNA, 16 bp, Homo sapiens
gacactaaccacgctg

SEQ ID NO: 2789224 - DNA, 20 bp, Homo sapiens
gacactaaccacgctggacc

SEQ ID NO: 2789225 - DNA, 18 bp, Homo sapiens
gacactaagttatagtat

SEQ ID NO: 2789226 - DNA, 16 bp, Homo sapiens
gacactgccacacagg

SEQ ID NO: 2789227 - DNA, 16 bp, Homo sapiens
gacactggtttgaaga

SEQ ID NO: 2789228 - DNA, 20 bp, Homo sapiens
gacactgtatgactctcctc

SEQ ID NO: 2789229 - DNA, 22 bp, Homo sapiens
gacactgtatgactctcctctc

SEQ ID NO: 2789230 - DNA, 21 bp, Homo sapiens
gacacttcatggaccaagaat

SEQ ID NO: 2789231 - DNA, 22 bp, Homo sapiens
gacacttgccttcttcacccag

SEQ ID NO: 2789232 - DNA, 23 bp, Homo sapiens
gacacttgccttcttcacccagc

SEQ ID NO: 2789233 - DNA, 14 bp, Homo sapiens
gacagaaaaaaata

SEQ ID NO: 2789234 - DNA, 20 bp, Homo sapiens
gacagaaaaaaataaaaaca

SEQ ID NO: 2789235 - DNA, 18 bp, Homo sapiens
gacagaaatgcaatctcc

SEQ ID NO: 2789236 - DNA, 13 bp, Homo sapiens
gacagaacactgt

SEQ ID NO: 2789237 - DNA, 14 bp, Homo sapiens
gacagaacactgtc

SEQ ID NO: 2789238 - DNA, 20 bp, Homo sapiens
gacagaacccctacatgaaa

SEQ ID NO: 2789239 - DNA, 12 bp, Homo sapiens
gacagacacagg

SEQ ID NO: 2789240 - DNA, 20 bp, Homo sapiens
gacagacacaggcccggctc

SEQ ID NO: 2789241 - DNA, 22 bp, Homo sapiens
gacagactgcaagaggctcctg

SEQ ID NO: 2789242 - DNA, 15 bp, Homo sapiens
gacagagacacctgc

SEQ ID NO: 2789243 - DNA, 17 bp, Homo sapiens
gacagagacacctgcac

SEQ ID NO: 2789244 - DNA, 21 bp, Homo sapiens
gacagagacacctgcacctcc

SEQ ID NO: 2789245 - DNA, 18 bp, Homo sapiens
gacagagacccagatctc

SEQ ID NO: 2789246 - DNA, 18 bp, Homo sapiens
gacagaggaccattacaa

SEQ ID NO: 2789247 - DNA, 12 bp, Homo sapiens
gacagaggaggg

SEQ ID NO: 2789248 - DNA, 14 bp, Homo sapiens
gacagagtctcact

SEQ ID NO: 2789249 - DNA, 20 bp, Homo sapiens
gacagagtgagactctgtct

SEQ ID NO: 2789250 - DNA, 18 bp, Homo sapiens
gacagccacggccaggcc

SEQ ID NO: 2789251 - DNA, 20 bp, Homo sapiens
gacagccacggccaggccag

SEQ ID NO: 2789252 - DNA, 13 bp, Homo sapiens
gacagccagagcc

SEQ ID NO: 2789253 - DNA, 23 bp, Homo sapiens
gacagcctgtggcggtgcctggg

SEQ ID NO: 2789254 - DNA, 16 bp, Homo sapiens
gacagctgtccctgtc

SEQ ID NO: 2789255 - DNA, 17 bp, Homo sapiens
gacagctgtccctgtca

SEQ ID NO: 2789256 - DNA, 17 bp, Homo sapiens
gacagctgtgcctcgct

SEQ ID NO: 2789257 - DNA, 19 bp, Homo sapiens
gacagctgtgcctcgctcc

SEQ ID NO: 2789258 - DNA, 21 bp, Homo sapiens
gacagcttgtggcaagtgaat

SEQ ID NO: 2789259 - DNA, 22 bp, Homo sapiens
gacaggacagtgcttcagcctg

SEQ ID NO: 2789260 - DNA, 23 bp, Homo sapiens
gacaggactaacactcagaagcc

SEQ ID NO: 2789261 - DNA, 20 bp, Homo sapiens
gacaggagggcaagggccat

SEQ ID NO: 2789262 - DNA, 18 bp, Homo sapiens
gacaggcaagcacctcct

SEQ ID NO: 2789263 - DNA, 20 bp, Homo sapiens
gacaggcaagcacctcctgc

SEQ ID NO: 2789264 - DNA, 21 bp, Homo sapiens
gacaggcaagcacctcctgcc

SEQ ID NO: 2789265 - DNA, 14 bp, Homo sapiens
gacaggcaatgctg

SEQ ID NO: 2789266 - DNA, 17 bp, Homo sapiens
gacaggcaatgctggct

SEQ ID NO: 2789267 - DNA, 11 bp, Homo sapiens
gacaggcccaa

SEQ ID NO: 2789268 - DNA, 14 bp, Homo sapiens
gacaggcccaagag

SEQ ID NO: 2789269 - DNA, 21 bp, Homo sapiens
gacaggcccaagagatgaaga

SEQ ID NO: 2789270 - DNA, 13 bp, Homo sapiens
gacagggacccac

SEQ ID NO: 2789271 - DNA, 19 bp, Homo sapiens
gacagggacccacttcaca

SEQ ID NO: 2789272 - DNA, 24 bp, Homo sapiens
gacagggcacaccgggcactcaga

SEQ ID NO: 2789273 - DNA, 15 bp, Homo sapiens
gacagtcctgggaga

SEQ ID NO: 2789274 - DNA, 16 bp, Homo sapiens
gacagtgatctccata

SEQ ID NO: 2789275 - DNA, 17 bp, Homo sapiens
gacatatatattaaaat

SEQ ID NO: 2789276 - DNA, 15 bp, Homo sapiens
gacatattcttggag

SEQ ID NO: 2789277 - DNA, 16 bp, Homo sapiens
gacatcacttgtacaa

SEQ ID NO: 2789278 - DNA, 22 bp, Homo sapiens
gacatcacttgtacaaaataaa

SEQ ID NO: 2789279 - DNA, 21 bp, Homo sapiens
gacatgatggagcgcacctgc

SEQ ID NO: 2789280 - DNA, 19 bp, Homo sapiens
gacatggagactcctgccc

SEQ ID NO: 2789281 - DNA, 22 bp, Homo sapiens
gacatggagactcctgccctgt

SEQ ID NO: 2789282 - DNA, 23 bp, Homo sapiens
gacattctgattcgaatgacact

SEQ ID NO: 2789283 - DNA, 15 bp, Homo sapiens
gacattgcggacagc

SEQ ID NO: 2789284 - DNA, 19 bp, Homo sapiens
gacattgtagagcttctgg

SEQ ID NO: 2789285 - DNA, 19 bp, Homo sapiens
gacattgttggccaaagcc

SEQ ID NO: 2789286 - DNA, 14 bp, Homo sapiens
gaccaacctgacca

SEQ ID NO: 2789287 - DNA, 17 bp, Homo sapiens
gaccaactctctcctgt

SEQ ID NO: 2789288 - DNA, 16 bp, Homo sapiens
gaccaagagagaaaga

SEQ ID NO: 2789289 - DNA, 19 bp, Homo sapiens
gagactgcgggatggtcct

SEQ ID NO: 2789290 - DNA, 23 bp, Homo sapiens
gagactgcgggatggtcctgggg

SEQ ID NO: 2789291 - DNA, 12 bp, Homo sapiens
gagactggagca

SEQ ID NO: 2789292 - DNA, 11 bp, Homo sapiens
gagagaactta

SEQ ID NO: 2789293 - DNA, 14 bp, Homo sapiens
gagagaacttaaaa

SEQ ID NO: 2789294 - DNA, 15 bp, Homo sapiens
gagagaccctcactg

SEQ ID NO: 2789295 - DNA, 14 bp, Homo sapiens
gagagatatatctg

SEQ ID NO: 2789296 - DNA, 17 bp, Homo sapiens
gagagatatatctgaaa

SEQ ID NO: 2789297 - DNA, 18 bp, Homo sapiens
gagagatatatctgaaaa

SEQ ID NO: 2789298 - DNA, 17 bp, Homo sapiens
gagagccagctctctct

SEQ ID NO: 2789299 - DNA, 13 bp, Homo sapiens
gagagccctggga

SEQ ID NO: 2789300 - DNA, 14 bp, Homo sapiens
gagagccctgggac

SEQ ID NO: 2789301 - DNA, 22 bp, Homo sapiens
gagagcctgctcccccaccccc

SEQ ID NO: 2789302 - DNA, 23 bp, Homo sapiens
gagagcctgctcccccaccccct

SEQ ID NO: 2789303 - DNA, 14 bp, Homo sapiens
gagagctaggagca

SEQ ID NO: 2789304 - DNA, 20 bp, Homo sapiens
gagagctgggtgtcaagagg

SEQ ID NO: 2789305 - DNA, 12 bp, Homo sapiens
gagaggaagggt

SEQ ID NO: 2789306 - DNA, 14 bp, Homo sapiens
gagaggagatcagg

SEQ ID NO: 2789307 - DNA, 21 bp, Homo sapiens
gagaggccctggatcagcgtg

SEQ ID NO: 2789308 - DNA, 15 bp, Homo sapiens
gagaggccttttgga

SEQ ID NO: 2789309 - DNA, 14 bp, Homo sapiens
gagagggcagaggg

SEQ ID NO: 2789310 - DNA, 16 bp, Homo sapiens
gagaggggaagggcca

SEQ ID NO: 2789311 - DNA, 21 bp, Homo sapiens
gagaggggaataatagaagaa

SEQ ID NO: 2789312 - DNA, 16 bp, Homo sapiens
gagaggtgggcagcag

SEQ ID NO: 2789313 - DNA, 16 bp, Homo sapiens
gagagtacagtgagcc

SEQ ID NO: 2789314 - DNA, 22 bp, Homo sapiens
gagagtagccgagagcctgctc

SEQ ID NO: 2789315 - DNA, 15 bp, Homo sapiens
gagagtatattatgt

SEQ ID NO: 2789316 - DNA, 23 bp, Homo sapiens
gagagtgagaataattgtgtaca

SEQ ID NO: 2789317 - DNA, 22 bp, Homo sapiens
gagagtttatcattgggagaag

SEQ ID NO: 2789318 - DNA, 23 bp, Homo sapiens
gagagtttatcattgggagaagc

SEQ ID NO: 2789319 - DNA, 22 bp, Homo sapiens
gagataaccacaaccaggaaga

SEQ ID NO: 2789320 - DNA, 22 bp, Homo sapiens
gagatatacaaatatatttaat

SEQ ID NO: 2789321 - DNA, 11 bp, Homo sapiens
gagatatttac

SEQ ID NO: 2789322 - DNA, 22 bp, Homo sapiens
gagatatttacatgaattgcat

SEQ ID NO: 2789323 - DNA, 18 bp, Homo sapiens
gagatcacgccactgcac

SEQ ID NO: 2789324 - DNA, 19 bp, Homo sapiens
gagatcagggcgacctgca

SEQ ID NO: 2789325 - DNA, 21 bp, Homo sapiens
gagatcgtgccgttactctcc

SEQ ID NO: 2789326 - DNA, 20 bp, Homo sapiens
gagatctaagcctttccata

SEQ ID NO: 2789327 - DNA, 21 bp, Homo sapiens
gagatctaagcctttccataa

SEQ ID NO: 2789328 - DNA, 16 bp, Homo sapiens
gagatgaattaaattt

SEQ ID NO: 2789329 - DNA, 21 bp, Homo sapiens
gagatgactgagtcctcgtag

SEQ ID NO: 2789330 - DNA, 15 bp, Homo sapiens
gagatgcctccaccg

SEQ ID NO: 2789331 - DNA, 19 bp, Homo sapiens
gagatgcctccaccgctgc

SEQ ID NO: 2789332 - DNA, 22 bp, Homo sapiens
gagatgcctccaccgctgccta

SEQ ID NO: 2789333 - DNA, 22 bp, Homo sapiens
gagatggcgctattgcactcca

SEQ ID NO: 2789334 - DNA, 21 bp, Homo sapiens
gagatgtaccatgttaaagag

SEQ ID NO: 2789335 - DNA, 14 bp, Homo sapiens
gagattgggcctcc

SEQ ID NO: 2789336 - DNA, 13 bp, Homo sapiens
gagatttgtattt

SEQ ID NO: 2789337 - DNA, 17 bp, Homo sapiens
gagatttgtatttatat

SEQ ID NO: 2789338 - DNA, 14 bp, Homo sapiens
gagcaaagcctgtt

SEQ ID NO: 2789339 - DNA, 19 bp, Homo sapiens
gagcaaatgtttctgcagt

SEQ ID NO: 2789340 - DNA, 20 bp, Homo sapiens
gagcaacagagtgagaccct

SEQ ID NO: 2789341 - DNA, 20 bp, Homo sapiens
gagcaagcatttatgtttat

SEQ ID NO: 2789342 - DNA, 13 bp, Homo sapiens
gagcaatttgcac

SEQ ID NO: 2789343 - DNA, 22 bp, Homo sapiens
gagcacacaggtacagcaacag

SEQ ID NO: 2789344 - DNA, 15 bp, Homo sapiens
gagcaccaggcacga

SEQ ID NO: 2789345 - DNA, 18 bp, Homo sapiens
gagcaccccctcattccc

SEQ ID NO: 2789346 - DNA, 13 bp, Homo sapiens
gagcactgggttg

SEQ ID NO: 2789347 - DNA, 17 bp, Homo sapiens
gagcagaaagccagggt

SEQ ID NO: 2789348 - DNA, 19 bp, Homo sapiens
gagcagctgagcagggccg

SEQ ID NO: 2789349 - DNA, 19 bp, Homo sapiens
gagcaggcacatggaggag

SEQ ID NO: 2789350 - DNA, 13 bp, Homo sapiens
gagcaggggcagg

SEQ ID NO: 2789351 - DNA, 20 bp, Homo sapiens
gagcaggggtccttggtgtg

SEQ ID NO: 2789352 - DNA, 14 bp, Homo sapiens
gagcagtcacactg

SEQ ID NO: 2789353 - DNA, 12 bp, Homo sapiens
gagcagtgtctt

SEQ ID NO: 2789354 - DNA, 18 bp, Homo sapiens
gagcagtgtcttccataa

SEQ ID NO: 2789355 - DNA, 13 bp, Homo sapiens
gagcatcatgcct

SEQ ID NO: 2789356 - DNA, 16 bp, Homo sapiens
gagcatcatgcctctg

SEQ ID NO: 2789357 - DNA, 19 bp, Homo sapiens
gagcatcatgcctctgagg

SEQ ID NO: 2789358 - DNA, 22 bp, Homo sapiens
gagcatcatgcctctgaggcca

SEQ ID NO: 2789359 - DNA, 24 bp, Homo sapiens
gagcatcatgcctctgaggccagc

SEQ ID NO: 2789360 - DNA, 18 bp, Homo sapiens
gagcatctcttgaggcca

SEQ ID NO: 2789361 - DNA, 13 bp, Homo sapiens
gagcatctgactc

SEQ ID NO: 2789362 - DNA, 21 bp, Homo sapiens
gagcatggggataaaggagaa

SEQ ID NO: 2789363 - DNA, 22 bp, Homo sapiens
gagcatggggataaaggagaag

SEQ ID NO: 2789364 - DNA, 17 bp, Homo sapiens
gagcattacgtgagcca

SEQ ID NO: 2789365 - DNA, 21 bp, Homo sapiens
gagccaactcactcttatgaa

SEQ ID NO: 2789366 - DNA, 23 bp, Homo sapiens
gagccaagggttcagagactcag

SEQ ID NO: 2789367 - DNA, 19 bp, Homo sapiens
gagccaatttaaagaaaac

SEQ ID NO: 2789368 - DNA, 23 bp, Homo sapiens
gagccacagaccacctgcttctg

SEQ ID NO: 2789369 - DNA, 13 bp, Homo sapiens
gagccactgcacc

SEQ ID NO: 2789370 - DNA, 19 bp, Homo sapiens
gagccactgcaccgggcca

SEQ ID NO: 2789371 - DNA, 15 bp, Homo sapiens
gagccagccctccct

SEQ ID NO: 2789372 - DNA, 16 bp, Homo sapiens
gagccagccctccctg

SEQ ID NO: 2789373 - DNA, 17 bp, Homo sapiens
gagcccagaaaacctcc

SEQ ID NO: 2789374 - DNA, 12 bp, Homo sapiens
gagcccaggagt

SEQ ID NO: 2789375 - DNA, 14 bp, Homo sapiens
gagcccatgctcaa

SEQ ID NO: 2789376 - DNA, 22 bp, Homo sapiens
gagcccatgctcaaccactgtg

SEQ ID NO: 2789377 - DNA, 13 bp, Homo sapiens
gagccccgaggcc

SEQ ID NO: 2789378 - DNA, 17 bp, Homo sapiens
gagccccgaggccttct

SEQ ID NO: 2789379 - DNA, 17 bp, Homo sapiens
gaggcctttccccagtg

SEQ ID NO: 2789380 - DNA, 19 bp, Homo sapiens
gaggcctttccccagtgtg

SEQ ID NO: 2789381 - DNA, 20 bp, Homo sapiens
gaggcgccccaacccgtgga

SEQ ID NO: 2789382 - DNA, 19 bp, Homo sapiens
gaggcgggtggatcacctg

SEQ ID NO: 2789383 - DNA, 14 bp, Homo sapiens
gaggctagcaaagc

SEQ ID NO: 2789384 - DNA, 14 bp, Homo sapiens
gaggctgaggcaga

SEQ ID NO: 2789385 - DNA, 18 bp, Homo sapiens
gaggctgaggcagaagaa

SEQ ID NO: 2789386 - DNA, 19 bp, Homo sapiens
gaggctgaggcaggagaat

SEQ ID NO: 2789387 - DNA, 22 bp, Homo sapiens
gaggctgctcggggtgcacagg

SEQ ID NO: 2789388 - DNA, 19 bp, Homo sapiens
gaggctggaggcagggcct

SEQ ID NO: 2789389 - DNA, 20 bp, Homo sapiens
gaggctggtgctgtggccag

SEQ ID NO: 2789390 - DNA, 23 bp, Homo sapiens
gaggctgtggtggctgtctctgt

SEQ ID NO: 2789391 - DNA, 20 bp, Homo sapiens
gaggcttccagagagtcctc

SEQ ID NO: 2789392 - DNA, 23 bp, Homo sapiens
gaggcttccagagagtcctctgg

SEQ ID NO: 2789393 - DNA, 15 bp, Homo sapiens
gaggcttggaaagca

SEQ ID NO: 2789394 - DNA, 16 bp, Homo sapiens
gagggacaaaggagcc

SEQ ID NO: 2789395 - DNA, 20 bp, Homo sapiens
gagggacaaaggagcctgtg

SEQ ID NO: 2789396 - DNA, 15 bp, Homo sapiens
gagggacgaagaaag

SEQ ID NO: 2789397 - DNA, 18 bp, Homo sapiens
gagggagtgacagaggca

SEQ ID NO: 2789398 - DNA, 14 bp, Homo sapiens
gagggatcacaggg

SEQ ID NO: 2789399 - DNA, 18 bp, Homo sapiens
gagggcaagggccatgct

SEQ ID NO: 2789400 - DNA, 22 bp, Homo sapiens
gagggcaagggccatgctgaag

SEQ ID NO: 2789401 - DNA, 16 bp, Homo sapiens
gagggcagaggctgga

SEQ ID NO: 2789402 - DNA, 14 bp, Homo sapiens
gagggcagcagcca

SEQ ID NO: 2789403 - DNA, 16 bp, Homo sapiens
gagggcagcagccagc

SEQ ID NO: 2789404 - DNA, 23 bp, Homo sapiens
gagggcagcagccagccctgcct

SEQ ID NO: 2789405 - DNA, 23 bp, Homo sapiens
gagggcagttcgcagccaccctg

SEQ ID NO: 2789406 - DNA, 11 bp, Homo sapiens
gagggctctga

SEQ ID NO: 2789407 - DNA, 12 bp, Homo sapiens
gagggctctgag

SEQ ID NO: 2789408 - DNA, 12 bp, Homo sapiens
gagggcttggga

SEQ ID NO: 2789409 - DNA, 15 bp, Homo sapiens
gaggggaagggccag

SEQ ID NO: 2789410 - DNA, 18 bp, Homo sapiens
gaggggcagaacagccgc

SEQ ID NO: 2789411 - DNA, 13 bp, Homo sapiens
gaggggctcctgg

SEQ ID NO: 2789412 - DNA, 17 bp, Homo sapiens
gaggggctttctggaga

SEQ ID NO: 2789413 - DNA, 18 bp, Homo sapiens
gagggggtcgtggagagc

SEQ ID NO: 2789414 - DNA, 19 bp, Homo sapiens
gagggggtcgtggagagct

SEQ ID NO: 2789415 - DNA, 14 bp, Homo sapiens
gaggggtaggcaga

SEQ ID NO: 2789416 - DNA, 13 bp, Homo sapiens
gagggtccccggg

SEQ ID NO: 2789417 - DNA, 13 bp, Homo sapiens
gagggtggagact

SEQ ID NO: 2789418 - DNA, 14 bp, Homo sapiens
gagggtggtgacct

SEQ ID NO: 2789419 - DNA, 15 bp, Homo sapiens
gagggttagggaggg

SEQ ID NO: 2789420 - DNA, 18 bp, Homo sapiens
gaggtagagtttgaagga

SEQ ID NO: 2789421 - DNA, 21 bp, Homo sapiens
gaggtaggtggatcacctgag

SEQ ID NO: 2789422 - DNA, 19 bp, Homo sapiens
gaggtatttatctttactt

SEQ ID NO: 2789423 - DNA, 19 bp, Homo sapiens
gaggtcacattcaggaaga

SEQ ID NO: 2789424 - DNA, 22 bp, Homo sapiens
gaggtcacattcaggaagatga

SEQ ID NO: 2789425 - DNA, 13 bp, Homo sapiens
gaggtcagagcct

SEQ ID NO: 2789426 - DNA, 13 bp, Homo sapiens
gaggtcctgagca

SEQ ID NO: 2789427 - DNA, 23 bp, Homo sapiens
gaggtcctgagcactgccaggag

SEQ ID NO: 2789428 - DNA, 15 bp, Homo sapiens
gaggtgaccccaggg

SEQ ID NO: 2789429 - DNA, 17 bp, Homo sapiens
gaggtgaccccagggca

SEQ ID NO: 2789430 - DNA, 19 bp, Homo sapiens
gaggtgaccccagggcaca

SEQ ID NO: 2789431 - DNA, 15 bp, Homo sapiens
gaggtgagaccacct

SEQ ID NO: 2789432 - DNA, 13 bp, Homo sapiens
gaggtgcccagga

SEQ ID NO: 2789433 - DNA, 15 bp, Homo sapiens
gaggtggaagccctc

SEQ ID NO: 2789434 - DNA, 15 bp, Homo sapiens
gaggtggcagccctg

SEQ ID NO: 2789435 - DNA, 18 bp, Homo sapiens
gaggtggcagccctgtag

SEQ ID NO: 2789436 - DNA, 16 bp, Homo sapiens
gaggtgggcagcagct

SEQ ID NO: 2789437 - DNA, 13 bp, Homo sapiens
gaggttgcaggga

SEQ ID NO: 2789438 - DNA, 19 bp, Homo sapiens
gaggttgcagggagccgag

SEQ ID NO: 2789439 - DNA, 14 bp, Homo sapiens
gaggttgcagtgag

SEQ ID NO: 2789440 - DNA, 19 bp, Homo sapiens
gaggttgcagtgagccgag

SEQ ID NO: 2789441 - DNA, 14 bp, Homo sapiens
gagtaatttattgt

SEQ ID NO: 2789442 - DNA, 22 bp, Homo sapiens
gagtagaaagacagagctggga

SEQ ID NO: 2789443 - DNA, 14 bp, Homo sapiens
gagtagaaattgtt

SEQ ID NO: 2789444 - DNA, 17 bp, Homo sapiens
gagtagccgagagcctg

SEQ ID NO: 2789445 - DNA, 13 bp, Homo sapiens
gagtagctgagct

SEQ ID NO: 2789446 - DNA, 15 bp, Homo sapiens
gagtagctgagctca

SEQ ID NO: 2789447 - DNA, 12 bp, Homo sapiens
gagtagctggga

SEQ ID NO: 2789448 - DNA, 22 bp, Homo sapiens
gagtagctgggactacaggcac

SEQ ID NO: 2789449 - DNA, 17 bp, Homo sapiens
gagtagtttttcagcta

SEQ ID NO: 2789450 - DNA, 22 bp, Homo sapiens
gagtatgttaagctctttatga

SEQ ID NO: 2789451 - DNA, 14 bp, Homo sapiens
gagtcaagttgttc

SEQ ID NO: 2789452 - DNA, 11 bp, Homo sapiens
gagtcagcctt

SEQ ID NO: 2789453 - DNA, 19 bp, Homo sapiens
gagtcatgatctccctgcc

SEQ ID NO: 2789454 - DNA, 14 bp, Homo sapiens
gagtcattgttaca

SEQ ID NO: 2789455 - DNA, 20 bp, Homo sapiens
gagtccagggcgggagtggg

SEQ ID NO: 2789456 - DNA, 14 bp, Homo sapiens
gagtcccaaggaaa

SEQ ID NO: 2789457 - DNA, 15 bp, Homo sapiens
gagtcccaaggaaag

SEQ ID NO: 2789458 - DNA, 20 bp, Homo sapiens
gagtcccaccttggctgcag

SEQ ID NO: 2789459 - DNA, 21 bp, Homo sapiens
gagtcccaccttggctgcagg

SEQ ID NO: 2789460 - DNA, 21 bp, Homo sapiens
gagtcctacagtggctgtcac

SEQ ID NO: 2789461 - DNA, 15 bp, Homo sapiens
gagtcgaggacaggg

SEQ ID NO: 2789462 - DNA, 17 bp, Homo sapiens
gagtcgaggacagggag

SEQ ID NO: 2789463 - DNA, 20 bp, Homo sapiens
gagtctccagtggttgctgt

SEQ ID NO: 2789464 - DNA, 12 bp, Homo sapiens
gagtctcctgtg

SEQ ID NO: 2789465 - DNA, 14 bp, Homo sapiens
gagtctgaggtcct

SEQ ID NO: 2789466 - DNA, 15 bp, Homo sapiens
gagtctgaggtcctg

SEQ ID NO: 2789467 - DNA, 22 bp, Homo sapiens
gagtctgaggtcctgagcactg

SEQ ID NO: 2789468 - DNA, 24 bp, Homo sapiens
gagtgaaataattaaaaaccactg

SEQ ID NO: 2789469 - DNA, 21 bp, Homo sapiens
gagtgaacaactatttataaa

SEQ ID NO: 2789470 - DNA, 22 bp, Homo sapiens
gattcccaagctctgctcctct

SEQ ID NO: 2789471 - DNA, 13 bp, Homo sapiens
gattcccagagac

SEQ ID NO: 2789472 - DNA, 21 bp, Homo sapiens
gattcccagagacaggaaaat

SEQ ID NO: 2789473 - DNA, 19 bp, Homo sapiens
gattcccagagcaaaataa

SEQ ID NO: 2789474 - DNA, 18 bp, Homo sapiens
gattccctctcccaggcc

SEQ ID NO: 2789475 - DNA, 23 bp, Homo sapiens
gattcctaagcagtgcttgtaaa

SEQ ID NO: 2789476 - DNA, 20 bp, Homo sapiens
gattctagccaaactattct

SEQ ID NO: 2789477 - DNA, 20 bp, Homo sapiens
gattctcctgcctcagcctc

SEQ ID NO: 2789478 - DNA, 21 bp, Homo sapiens
gattctcctgcctcagcctcc

SEQ ID NO: 2789479 - DNA, 13 bp, Homo sapiens
gattcttctgctt

SEQ ID NO: 2789480 - DNA, 15 bp, Homo sapiens
gattcttctgcttca

SEQ ID NO: 2789481 - DNA, 23 bp, Homo sapiens
gattgacacacagcactctctaa

SEQ ID NO: 2789482 - DNA, 16 bp, Homo sapiens
gattgcaacaggctgg

SEQ ID NO: 2789483 - DNA, 17 bp, Homo sapiens
gattgcaacaggctggg

SEQ ID NO: 2789484 - DNA, 20 bp, Homo sapiens
gattgcaacaggctgggctt

SEQ ID NO: 2789485 - DNA, 18 bp, Homo sapiens
gattgcttaaaatagcaa

SEQ ID NO: 2789486 - DNA, 22 bp, Homo sapiens
gattggctcacccaagcaaggc

SEQ ID NO: 2789487 - DNA, 20 bp, Homo sapiens
gattgtacatatggaaatcc

SEQ ID NO: 2789488 - DNA, 15 bp, Homo sapiens
gatttaactgtgaac

SEQ ID NO: 2789489 - DNA, 15 bp, Homo sapiens
gatttacgctcattg

SEQ ID NO: 2789490 - DNA, 22 bp, Homo sapiens
gatttagtgaaagctagagata

SEQ ID NO: 2789491 - DNA, 13 bp, Homo sapiens
gatttatatctat

SEQ ID NO: 2789492 - DNA, 14 bp, Homo sapiens
gatttatatctata

SEQ ID NO: 2789493 - DNA, 22 bp, Homo sapiens
gatttattttttaatcatttaa

SEQ ID NO: 2789494 - DNA, 23 bp, Homo sapiens
gatttattttttaatcatttaaa

SEQ ID NO: 2789495 - DNA, 17 bp, Homo sapiens
gatttcaacatatcatt

SEQ ID NO: 2789496 - DNA, 15 bp, Homo sapiens
gatttcaagcctgcc

SEQ ID NO: 2789497 - DNA, 14 bp, Homo sapiens
gatttcaatgattg

SEQ ID NO: 2789498 - DNA, 20 bp, Homo sapiens
gatttcaatgattgtttaat

SEQ ID NO: 2789499 - DNA, 20 bp, Homo sapiens
gatttcaggatactctgtca

SEQ ID NO: 2789500 - DNA, 20 bp, Homo sapiens
gatttcatttcaactgtttg

SEQ ID NO: 2789501 - DNA, 14 bp, Homo sapiens
gatttcctatttta

SEQ ID NO: 2789502 - DNA, 17 bp, Homo sapiens
gatttcctattttaaaa

SEQ ID NO: 2789503 - DNA, 22 bp, Homo sapiens
gatttcctattttaaaaccatg

SEQ ID NO: 2789504 - DNA, 21 bp, Homo sapiens
gatttgctatcaaaataaatt

SEQ ID NO: 2789505 - DNA, 15 bp, Homo sapiens
gatttgtatttatat

SEQ ID NO: 2789506 - DNA, 17 bp, Homo sapiens
gatttgtatttatatta

SEQ ID NO: 2789507 - DNA, 14 bp, Homo sapiens
gatttgtcccaggt

SEQ ID NO: 2789508 - DNA, 15 bp, Homo sapiens
gattttaattttgaa

SEQ ID NO: 2789509 - DNA, 13 bp, Homo sapiens
gattttacagaga

SEQ ID NO: 2789510 - DNA, 14 bp, Homo sapiens
gattttcatgttct

SEQ ID NO: 2789511 - DNA, 12 bp, Homo sapiens
gattttgtacag

SEQ ID NO: 2789512 - DNA, 14 bp, Homo sapiens
gattttgtacagaa

SEQ ID NO: 2789513 - DNA, 17 bp, Homo sapiens
gattttgtacagaattt

SEQ ID NO: 2789514 - DNA, 14 bp, Homo sapiens
gatttttgttgatt

SEQ ID NO: 2789515 - DNA, 16 bp, Homo sapiens
gattttttaataattt

SEQ ID NO: 2789516 - DNA, 17 bp, Homo sapiens
gattttttaataattta

SEQ ID NO: 2789517 - DNA, 15 bp, Homo sapiens
gcaaaaaagaaaacc

SEQ ID NO: 2789518 - DNA, 23 bp, Homo sapiens
gcaaaaatagtttggatatgtaa

SEQ ID NO: 2789519 - DNA, 18 bp, Homo sapiens
gcaaaagaagtaaaagct

SEQ ID NO: 2789520 - DNA, 15 bp, Homo sapiens
gcaaaataattttaa

SEQ ID NO: 2789521 - DNA, 20 bp, Homo sapiens
gcaaaataattttaaacaaa

SEQ ID NO: 2789522 - DNA, 14 bp, Homo sapiens
gcaaacactgtgta

SEQ ID NO: 2789523 - DNA, 19 bp, Homo sapiens
gcaaacactgtgtatttat

SEQ ID NO: 2789524 - DNA, 11 bp, Homo sapiens
gcaaagcctgt

SEQ ID NO: 2789525 - DNA, 19 bp, Homo sapiens
gcaaagcctgttcatggca

SEQ ID NO: 2789526 - DNA, 21 bp, Homo sapiens
gcaaagcctgttcatggcaga

SEQ ID NO: 2789527 - DNA, 17 bp, Homo sapiens
gcaaaggagtagaaaga

SEQ ID NO: 2789528 - DNA, 22 bp, Homo sapiens
gcaaagttacagatgcacccca

SEQ ID NO: 2789529 - DNA, 14 bp, Homo sapiens
gcaaagttatattt

SEQ ID NO: 2789530 - DNA, 22 bp, Homo sapiens
gcaaatactccaagcttcaagt

SEQ ID NO: 2789531 - DNA, 23 bp, Homo sapiens
gcaaatgtagtatggcctgtgtc

SEQ ID NO: 2789532 - DNA, 17 bp, Homo sapiens
gcaacactctatattta

SEQ ID NO: 2789533 - DNA, 16 bp, Homo sapiens
gcaacagagcaagact

SEQ ID NO: 2789534 - DNA, 14 bp, Homo sapiens
gcaacagagtgaga

SEQ ID NO: 2789535 - DNA, 19 bp, Homo sapiens
gcaacagagtgagaccctg

SEQ ID NO: 2789536 - DNA, 16 bp, Homo sapiens
gcaacaggaatctcag

SEQ ID NO: 2789537 - DNA, 14 bp, Homo sapiens
gcaacaggctgggc

SEQ ID NO: 2789538 - DNA, 13 bp, Homo sapiens
gcaacaggtttta

SEQ ID NO: 2789539 - DNA, 16 bp, Homo sapiens
gcaacagtagcaggga

SEQ ID NO: 2789540 - DNA, 16 bp, Homo sapiens
gcaacatttccgaaga

SEQ ID NO: 2789541 - DNA, 18 bp, Homo sapiens
gcaaccccagttctgctc

SEQ ID NO: 2789542 - DNA, 19 bp, Homo sapiens
gcaaccccagttctgctcc

SEQ ID NO: 2789543 - DNA, 20 bp, Homo sapiens
gcaaccccagttctgctcct

SEQ ID NO: 2789544 - DNA, 24 bp, Homo sapiens
gcaaccccagttctgctcctctcc

SEQ ID NO: 2789545 - DNA, 14 bp, Homo sapiens
gcaacccccagcct

SEQ ID NO: 2789546 - DNA, 15 bp, Homo sapiens
gcaacccccagcctg

SEQ ID NO: 2789547 - DNA, 18 bp, Homo sapiens
gcaacccccagcctgcta

SEQ ID NO: 2789548 - DNA, 15 bp, Homo sapiens
gcaacccgtgccaag

SEQ ID NO: 2789549 - DNA, 18 bp, Homo sapiens
gcaacccgtgccaagtcc

SEQ ID NO: 2789550 - DNA, 23 bp, Homo sapiens
gcaaccgtggcccttcctggaca

SEQ ID NO: 2789551 - DNA, 19 bp, Homo sapiens
gcaacctccgcctcttggg

SEQ ID NO: 2789552 - DNA, 19 bp, Homo sapiens
gcaactgaggcagacagca

SEQ ID NO: 2789553 - DNA, 22 bp, Homo sapiens
gcaactgaggcagacagcagct

SEQ ID NO: 2789554 - DNA, 14 bp, Homo sapiens
gcaagaagaatata

SEQ ID NO: 2789555 - DNA, 18 bp, Homo sapiens
gcaagacgtcctggaatg

SEQ ID NO: 2789556 - DNA, 18 bp, Homo sapiens
gcaagactgttgctcaaa

SEQ ID NO: 2789557 - DNA, 19 bp, Homo sapiens
gcaagacttctctttgcct

SEQ ID NO: 2789558 - DNA, 23 bp, Homo sapiens
gcaagagccttggtgtccacctg

SEQ ID NO: 2789559 - DNA, 13 bp, Homo sapiens
gcaagatatttat

SEQ ID NO: 2789560 - DNA, 14 bp, Homo sapiens
gcatcccaggggac

SEQ ID NO: 2789561 - DNA, 16 bp, Homo sapiens
gcatcccctttattaa

SEQ ID NO: 2789562 - DNA, 17 bp, Homo sapiens
gcatccgtagttccctg

SEQ ID NO: 2789563 - DNA, 17 bp, Homo sapiens
gcatcctggcacccggc

SEQ ID NO: 2789564 - DNA, 21 bp, Homo sapiens
gcatcctggcacccggcccct

SEQ ID NO: 2789565 - DNA, 23 bp, Homo sapiens
gcatcctggcacccggcccctgc

SEQ ID NO: 2789566 - DNA, 17 bp, Homo sapiens
gcatctacacagcctgg

SEQ ID NO: 2789567 - DNA, 23 bp, Homo sapiens
gcatctattctttgtaccatctg

SEQ ID NO: 2789568 - DNA, 20 bp, Homo sapiens
gcatctcttgaggccaggag

SEQ ID NO: 2789569 - DNA, 20 bp, Homo sapiens
gcatctgggattcccaccaa

SEQ ID NO: 2789570 - DNA, 19 bp, Homo sapiens
gcatcttctggagtctcca

SEQ ID NO: 2789571 - DNA, 16 bp, Homo sapiens
gcatgaccatcctgtc

SEQ ID NO: 2789572 - DNA, 15 bp, Homo sapiens
gcatgattttataca

SEQ ID NO: 2789573 - DNA, 19 bp, Homo sapiens
gcatgattttatacatagt

SEQ ID NO: 2789574 - DNA, 15 bp, Homo sapiens
gcatgccagagcctg

SEQ ID NO: 2789575 - DNA, 14 bp, Homo sapiens
gcatgctctctgca

SEQ ID NO: 2789576 - DNA, 18 bp, Homo sapiens
gcatgctctctgcagcca

SEQ ID NO: 2789577 - DNA, 23 bp, Homo sapiens
gcatggacaccccttatccagga

SEQ ID NO: 2789578 - DNA, 20 bp, Homo sapiens
gcatggcaaggactgcaggg

SEQ ID NO: 2789579 - DNA, 13 bp, Homo sapiens
gcatggctggggt

SEQ ID NO: 2789580 - DNA, 23 bp, Homo sapiens
gcatggggataaaggagaaggca

SEQ ID NO: 2789581 - DNA, 21 bp, Homo sapiens
gcatggtcccacatccctggg

SEQ ID NO: 2789582 - DNA, 23 bp, Homo sapiens
gcatggtcccacatccctgggcc

SEQ ID NO: 2789583 - DNA, 13 bp, Homo sapiens
gcatggtgcagtt

SEQ ID NO: 2789584 - DNA, 14 bp, Homo sapiens
gcatgtaaaatgca

SEQ ID NO: 2789585 - DNA, 16 bp, Homo sapiens
gcatgtaaaatgcagt

SEQ ID NO: 2789586 - DNA, 22 bp, Homo sapiens
gcatgtaaaatgcagtccagaa

SEQ ID NO: 2789587 - DNA, 19 bp, Homo sapiens
gcatgtagctctatggggg

SEQ ID NO: 2789588 - DNA, 14 bp, Homo sapiens
gcatgtaggagaat

SEQ ID NO: 2789589 - DNA, 15 bp, Homo sapiens
gcatgtatgtcttgg

SEQ ID NO: 2789590 - DNA, 23 bp, Homo sapiens
gcatgtcactcccagaccacctc

SEQ ID NO: 2789591 - DNA, 23 bp, Homo sapiens
gcattaaattttagcaaagatat

SEQ ID NO: 2789592 - DNA, 16 bp, Homo sapiens
gcattacatttccaaa

SEQ ID NO: 2789593 - DNA, 16 bp, Homo sapiens
gcattagaaatagaca

SEQ ID NO: 2789594 - DNA, 14 bp, Homo sapiens
gcattccatgattt

SEQ ID NO: 2789595 - DNA, 15 bp, Homo sapiens
gcattccatgatttt

SEQ ID NO: 2789596 - DNA, 14 bp, Homo sapiens
gcattccctgagtc

SEQ ID NO: 2789597 - DNA, 22 bp, Homo sapiens
gcattccctgagtcaccaggaa

SEQ ID NO: 2789598 - DNA, 16 bp, Homo sapiens
gcatttataaatgtgt

SEQ ID NO: 2789599 - DNA, 17 bp, Homo sapiens
gcatttcccccagggaa

SEQ ID NO: 2789600 - DNA, 21 bp, Homo sapiens
gcatttcttgatgttgcttag

SEQ ID NO: 2789601 - DNA, 22 bp, Homo sapiens
gcattttactacttgttacctt

SEQ ID NO: 2789602 - DNA, 12 bp, Homo sapiens
gcattttattct

SEQ ID NO: 2789603 - DNA, 23 bp, Homo sapiens
gcatttttactactattctgtta

SEQ ID NO: 2789604 - DNA, 21 bp, Homo sapiens
gccaaaacaatgcccgtaaga

SEQ ID NO: 2789605 - DNA, 13 bp, Homo sapiens
gccaaagccaaag

SEQ ID NO: 2789606 - DNA, 14 bp, Homo sapiens
gccaaattttggcc

SEQ ID NO: 2789607 - DNA, 19 bp, Homo sapiens
gccaacagaagcttccatt

SEQ ID NO: 2789608 - DNA, 12 bp, Homo sapiens
gccaacagcagc

SEQ ID NO: 2789609 - DNA, 19 bp, Homo sapiens
gccaacaggtggcaggacc

SEQ ID NO: 2789610 - DNA, 23 bp, Homo sapiens
gccaacaggtggcaggaccagga

SEQ ID NO: 2789611 - DNA, 20 bp, Homo sapiens
gccaacagtcaaaacagaga

SEQ ID NO: 2789612 - DNA, 23 bp, Homo sapiens
gccaacgacaaagccaaactctg

SEQ ID NO: 2789613 - DNA, 20 bp, Homo sapiens
gccaactcactcttatgaaa

SEQ ID NO: 2789614 - DNA, 21 bp, Homo sapiens
gccaactcactcttatgaaat

SEQ ID NO: 2789615 - DNA, 14 bp, Homo sapiens
gccaagctgaggtg

SEQ ID NO: 2789616 - DNA, 23 bp, Homo sapiens
gccaagctgaggtgcccaggaga

SEQ ID NO: 2789617 - DNA, 21 bp, Homo sapiens
gccaagcttcaaccctcagcc

SEQ ID NO: 2789618 - DNA, 16 bp, Homo sapiens
gccaagctttcttcta

SEQ ID NO: 2789619 - DNA, 17 bp, Homo sapiens
gccaagtccaggtcctg

SEQ ID NO: 2789620 - DNA, 18 bp, Homo sapiens
gccaagtccaggtcctgg

SEQ ID NO: 2789621 - DNA, 21 bp, Homo sapiens
gccaagttcctctagtgccct

SEQ ID NO: 2789622 - DNA, 21 bp, Homo sapiens
gccaatgcacctaaagaaaaa

SEQ ID NO: 2789623 - DNA, 17 bp, Homo sapiens
gccaattaaaatatata

SEQ ID NO: 2789624 - DNA, 23 bp, Homo sapiens
gccaattaaaatatatataaata

SEQ ID NO: 2789625 - DNA, 21 bp, Homo sapiens
gccacaaccctgttttatact

SEQ ID NO: 2789626 - DNA, 20 bp, Homo sapiens
gccacacccggctccccctg

SEQ ID NO: 2789627 - DNA, 17 bp, Homo sapiens
gccacaccctccccatt

SEQ ID NO: 2789628 - DNA, 16 bp, Homo sapiens
gccacacttctcagga

SEQ ID NO: 2789629 - DNA, 19 bp, Homo sapiens
gccacacttctcaggacac

SEQ ID NO: 2789630 - DNA, 17 bp, Homo sapiens
gccacagaccacctgct

SEQ ID NO: 2789631 - DNA, 20 bp, Homo sapiens
gccacagagaaagtacttct

SEQ ID NO: 2789632 - DNA, 23 bp, Homo sapiens
gccacagagaaagtacttctcca

SEQ ID NO: 2789633 - DNA, 19 bp, Homo sapiens
gccaccaccagatgagaag

SEQ ID NO: 2789634 - DNA, 23 bp, Homo sapiens
gccaccatattcagtgctgtggc

SEQ ID NO: 2789635 - DNA, 14 bp, Homo sapiens
gccaccatcctgct

SEQ ID NO: 2789636 - DNA, 21 bp, Homo sapiens
gccacccgttctgctggcctg

SEQ ID NO: 2789637 - DNA, 23 bp, Homo sapiens
gccacccgttctgctggcctgga

SEQ ID NO: 2789638 - DNA, 13 bp, Homo sapiens
gccaccctgagga

SEQ ID NO: 2789639 - DNA, 19 bp, Homo sapiens
gccaccctgaggagtctga

SEQ ID NO: 2789640 - DNA, 10 bp, Homo sapiens
gccacctgtc

SEQ ID NO: 2789641 - DNA, 18 bp, Homo sapiens
gccacggccaggccagag

SEQ ID NO: 2789642 - DNA, 14 bp, Homo sapiens
gccacgtgccaggc

SEQ ID NO: 2789643 - DNA, 17 bp, Homo sapiens
gccacgtgccaggcccg

SEQ ID NO: 2789644 - DNA, 18 bp, Homo sapiens
gccacgtgccaggcccgg

SEQ ID NO: 2789645 - DNA, 21 bp, Homo sapiens
gccacgttccttactgcagaa

SEQ ID NO: 2789646 - DNA, 21 bp, Homo sapiens
gccactacactccagcctgag

SEQ ID NO: 2789647 - DNA, 21 bp, Homo sapiens
gccactcaggaggctgaggca

SEQ ID NO: 2789648 - DNA, 20 bp, Homo sapiens
gccactcatattctgggctc

SEQ ID NO: 2789649 - DNA, 15 bp, Homo sapiens
gccactcatttcatc

SEQ ID NO: 2789650 - DNA, 20 bp, Homo sapiens
gcccgagcagctgagcaggg

SEQ ID NO: 2789651 - DNA, 16 bp, Homo sapiens
gcccggattctgggag

SEQ ID NO: 2789652 - DNA, 17 bp, Homo sapiens
gcccggattctgggagg

SEQ ID NO: 2789653 - DNA, 20 bp, Homo sapiens
gcccggccccatcagaggct

SEQ ID NO: 2789654 - DNA, 22 bp, Homo sapiens
gcccggcctgctcccagcagcc

SEQ ID NO: 2789655 - DNA, 13 bp, Homo sapiens
gcccggctccagg

SEQ ID NO: 2789656 - DNA, 15 bp, Homo sapiens
gcccggctccaggct

SEQ ID NO: 2789657 - DNA, 18 bp, Homo sapiens
gcccgtcatgttcctcaa

SEQ ID NO: 2789658 - DNA, 15 bp, Homo sapiens
gcccgtcttcagcct

SEQ ID NO: 2789659 - DNA, 13 bp, Homo sapiens
gccctatggatgt

SEQ ID NO: 2789660 - DNA, 14 bp, Homo sapiens
gccctatggatgtg

SEQ ID NO: 2789661 - DNA, 15 bp, Homo sapiens
gccctcaatcccagc

SEQ ID NO: 2789662 - DNA, 14 bp, Homo sapiens
gccctccacagccg

SEQ ID NO: 2789663 - DNA, 23 bp, Homo sapiens
gccctccacagccgcagcctccc

SEQ ID NO: 2789664 - DNA, 14 bp, Homo sapiens
gccctccctgtcct

SEQ ID NO: 2789665 - DNA, 16 bp, Homo sapiens
gccctccctgtcctcc

SEQ ID NO: 2789666 - DNA, 18 bp, Homo sapiens
gccctccctgtcctcctc

SEQ ID NO: 2789667 - DNA, 21 bp, Homo sapiens
gccctcctcaccccgtctggg

SEQ ID NO: 2789668 - DNA, 13 bp, Homo sapiens
gccctgacctccc

SEQ ID NO: 2789669 - DNA, 15 bp, Homo sapiens
gccctgacctcccag

SEQ ID NO: 2789670 - DNA, 13 bp, Homo sapiens
gccctgagctcgg

SEQ ID NO: 2789671 - DNA, 21 bp, Homo sapiens
gccctgagtggatctccaagg

SEQ ID NO: 2789672 - DNA, 14 bp, Homo sapiens
gccctgcagaccct

SEQ ID NO: 2789673 - DNA, 18 bp, Homo sapiens
gccctgcagaccctgccc

SEQ ID NO: 2789674 - DNA, 20 bp, Homo sapiens
gccctgcagccaaacagagc

SEQ ID NO: 2789675 - DNA, 13 bp, Homo sapiens
gccctgccacctg

SEQ ID NO: 2789676 - DNA, 17 bp, Homo sapiens
gccctgccacctgtctg

SEQ ID NO: 2789677 - DNA, 12 bp, Homo sapiens
gccctgcctgga

SEQ ID NO: 2789678 - DNA, 16 bp, Homo sapiens
gccctgcctggaggac

SEQ ID NO: 2789679 - DNA, 17 bp, Homo sapiens
gccctggatcagcgtgg

SEQ ID NO: 2789680 - DNA, 18 bp, Homo sapiens
gccctggatcagcgtggc

SEQ ID NO: 2789681 - DNA, 19 bp, Homo sapiens
gccctggatcagcgtggcc

SEQ ID NO: 2789682 - DNA, 20 bp, Homo sapiens
gccctggatcagcgtggcct

SEQ ID NO: 2789683 - DNA, 23 bp, Homo sapiens
gccctggatcagcgtggccttgt

SEQ ID NO: 2789684 - DNA, 21 bp, Homo sapiens
gccctggatgtgcccacaggg

SEQ ID NO: 2789685 - DNA, 20 bp, Homo sapiens
gccctggcccagagctggaa

SEQ ID NO: 2789686 - DNA, 13 bp, Homo sapiens
gccctggcctgct

SEQ ID NO: 2789687 - DNA, 15 bp, Homo sapiens
gccctgggccccacc

SEQ ID NO: 2789688 - DNA, 19 bp, Homo sapiens
gccctgggccccaccacct

SEQ ID NO: 2789689 - DNA, 12 bp, Homo sapiens
gccctggggcct

SEQ ID NO: 2789690 - DNA, 14 bp, Homo sapiens
gccctggggcctgt

SEQ ID NO: 2789691 - DNA, 22 bp, Homo sapiens
gccctggggcctgtactgcctg

SEQ ID NO: 2789692 - DNA, 23 bp, Homo sapiens
gccctggggcctgtactgcctgc

SEQ ID NO: 2789693 - DNA, 21 bp, Homo sapiens
gccctgggtctaaggggttgg

SEQ ID NO: 2789694 - DNA, 15 bp, Homo sapiens
gccctggtccttcca

SEQ ID NO: 2789695 - DNA, 18 bp, Homo sapiens
gccctggtggcagtggga

SEQ ID NO: 2789696 - DNA, 21 bp, Homo sapiens
gccctggtggcagtgggagct

SEQ ID NO: 2789697 - DNA, 22 bp, Homo sapiens
gccctggtggcagtgggagctg

SEQ ID NO: 2789698 - DNA, 17 bp, Homo sapiens
gccctgtcgagacactt

SEQ ID NO: 2789699 - DNA, 21 bp, Homo sapiens
gccctgtcgagacacttgcct

SEQ ID NO: 2789700 - DNA, 17 bp, Homo sapiens
gccctgttgtgtataga

SEQ ID NO: 2789701 - DNA, 17 bp, Homo sapiens
gcccttaaaataatgat

SEQ ID NO: 2789702 - DNA, 17 bp, Homo sapiens
gcccttattttcaagaa

SEQ ID NO: 2789703 - DNA, 18 bp, Homo sapiens
gcccttattttcaagaaa

SEQ ID NO: 2789704 - DNA, 13 bp, Homo sapiens
gcccttccagtgg

SEQ ID NO: 2789705 - DNA, 18 bp, Homo sapiens
gcccttcctggacagctg

SEQ ID NO: 2789706 - DNA, 21 bp, Homo sapiens
gcccttcctggacagctgtgc

SEQ ID NO: 2789707 - DNA, 12 bp, Homo sapiens
gcccttctttct

SEQ ID NO: 2789708 - DNA, 16 bp, Homo sapiens
gcccttctttctaccc

SEQ ID NO: 2789709 - DNA, 17 bp, Homo sapiens
gcccttgagctccccaa

SEQ ID NO: 2789710 - DNA, 20 bp, Homo sapiens
gcccttgtttggggcaggag

SEQ ID NO: 2789711 - DNA, 22 bp, Homo sapiens
gcccttgtttggggcaggagta

SEQ ID NO: 2789712 - DNA, 21 bp, Homo sapiens
gccctttgggtactactgctg

SEQ ID NO: 2789713 - DNA, 12 bp, Homo sapiens
gccgagagcctg

SEQ ID NO: 2789714 - DNA, 17 bp, Homo sapiens
gccgagagcctgctccc

SEQ ID NO: 2789715 - DNA, 16 bp, Homo sapiens
gccgagccgggcctgg

SEQ ID NO: 2789716 - DNA, 17 bp, Homo sapiens
gccgagccgggcctggg

SEQ ID NO: 2789717 - DNA, 17 bp, Homo sapiens
gccgcatcttctccatc

SEQ ID NO: 2789718 - DNA, 18 bp, Homo sapiens
gccgcatcttctccatct

SEQ ID NO: 2789719 - DNA, 16 bp, Homo sapiens
gccgcattccctgagt

SEQ ID NO: 2789720 - DNA, 13 bp, Homo sapiens
gccgcctcaatgt

SEQ ID NO: 2789721 - DNA, 17 bp, Homo sapiens
gccgcctcccagcctgg

SEQ ID NO: 2789722 - DNA, 19 bp, Homo sapiens
gccgctgctttgcgctggt

SEQ ID NO: 2789723 - DNA, 15 bp, Homo sapiens
gccgctgttcaccca

SEQ ID NO: 2789724 - DNA, 17 bp, Homo sapiens
gccgctgttcacccaca

SEQ ID NO: 2789725 - DNA, 19 bp, Homo sapiens
gccggcaaccccagttctg

SEQ ID NO: 2789726 - DNA, 20 bp, Homo sapiens
gccggcaaccccagttctgc

SEQ ID NO: 2789727 - DNA, 23 bp, Homo sapiens
gccgggcatggtggcgcaagcct

SEQ ID NO: 2789728 - DNA, 19 bp, Homo sapiens
gccgggcgtggtggcgggc

SEQ ID NO: 2789729 - DNA, 22 bp, Homo sapiens
gccggggaactggccaagctga

SEQ ID NO: 2789730 - DNA, 23 bp, Homo sapiens
gccggggaactggccaagctgag

SEQ ID NO: 2789731 - DNA, 16 bp, Homo sapiens
gccgggtacctcagtt

SEQ ID NO: 2789732 - DNA, 13 bp, Homo sapiens
gccgggtgcggtg

SEQ ID NO: 2789733 - DNA, 18 bp, Homo sapiens
gccgggttctagtctcct

SEQ ID NO: 2789734 - DNA, 17 bp, Homo sapiens
gccgtgatgctcaggct

SEQ ID NO: 2789735 - DNA, 12 bp, Homo sapiens
gccgtgcccagg

SEQ ID NO: 2789736 - DNA, 15 bp, Homo sapiens
gccgtgcccaggggc

SEQ ID NO: 2789737 - DNA, 15 bp, Homo sapiens
gccgtggtccagctc

SEQ ID NO: 2789738 - DNA, 14 bp, Homo sapiens
gccgttactctcca

SEQ ID NO: 2789739 - DNA, 15 bp, Homo sapiens
gccgttactctccaa

SEQ ID NO: 2789740 - DNA, 18 bp, Homo sapiens
gccgttgaagaggaaggg

SEQ ID NO: 2789741 - DNA, 19 bp, Homo sapiens
gcctttcttatttgcaata

SEQ ID NO: 2789742 - DNA, 16 bp, Homo sapiens
gcctttggaagaaaca

SEQ ID NO: 2789743 - DNA, 14 bp, Homo sapiens
gccttttaaaagaa

SEQ ID NO: 2789744 - DNA, 15 bp, Homo sapiens
gccttttaaaagaaa

SEQ ID NO: 2789745 - DNA, 15 bp, Homo sapiens
gcgaaggggccctgg

SEQ ID NO: 2789746 - DNA, 17 bp, Homo sapiens
gcgacttcacaaaatgc

SEQ ID NO: 2789747 - DNA, 15 bp, Homo sapiens
gcgagaggcagagaa

SEQ ID NO: 2789748 - DNA, 16 bp, Homo sapiens
gcgagaggcagagaaa

SEQ ID NO: 2789749 - DNA, 21 bp, Homo sapiens
gcgagatcgctggcagagaag

SEQ ID NO: 2789750 - DNA, 16 bp, Homo sapiens
gcgagattgggcctcc

SEQ ID NO: 2789751 - DNA, 16 bp, Homo sapiens
gcgaggtcaacagaga

SEQ ID NO: 2789752 - DNA, 19 bp, Homo sapiens
gcgaggtcaacagagaagg

SEQ ID NO: 2789753 - DNA, 14 bp, Homo sapiens
gcgattccctctcc

SEQ ID NO: 2789754 - DNA, 17 bp, Homo sapiens
gcgattcttctgcttca

SEQ ID NO: 2789755 - DNA, 23 bp, Homo sapiens
gcgattcttctgcttcagcctcc

SEQ ID NO: 2789756 - DNA, 18 bp, Homo sapiens
gcgcacaaggctgaccaa

SEQ ID NO: 2789757 - DNA, 12 bp, Homo sapiens
gcgcacctgccc

SEQ ID NO: 2789758 - DNA, 19 bp, Homo sapiens
gcgcacctgccccctggtg

SEQ ID NO: 2789759 - DNA, 19 bp, Homo sapiens
gcgcatgtaatcccagcta

SEQ ID NO: 2789760 - DNA, 14 bp, Homo sapiens
gcgccaccatcctg

SEQ ID NO: 2789761 - DNA, 12 bp, Homo sapiens
gcgccctgcaga

SEQ ID NO: 2789762 - DNA, 16 bp, Homo sapiens
gcgccctgcagaccct

SEQ ID NO: 2789763 - DNA, 18 bp, Homo sapiens
gcgcctacaggagtgagc

SEQ ID NO: 2789764 - DNA, 21 bp, Homo sapiens
gcgcctacaggagtgagcact

SEQ ID NO: 2789765 - DNA, 21 bp, Homo sapiens
gcgcctagtggggtctccctc

SEQ ID NO: 2789766 - DNA, 21 bp, Homo sapiens
gcgcctccctccaccccagga

SEQ ID NO: 2789767 - DNA, 22 bp, Homo sapiens
gcgcctccttccttgctgtcct

SEQ ID NO: 2789768 - DNA, 22 bp, Homo sapiens
gcgcgcatgtaatcccagctac

SEQ ID NO: 2789769 - DNA, 13 bp, Homo sapiens
gcgctacccactt

SEQ ID NO: 2789770 - DNA, 16 bp, Homo sapiens
gcgctacccacttcta

SEQ ID NO: 2789771 - DNA, 20 bp, Homo sapiens
gcgctattgcactccagtct

SEQ ID NO: 2789772 - DNA, 16 bp, Homo sapiens
gcgctctagcctgggc

SEQ ID NO: 2789773 - DNA, 15 bp, Homo sapiens
gcgctctgccctccc

SEQ ID NO: 2789774 - DNA, 18 bp, Homo sapiens
gcgctgctcaacctctct

SEQ ID NO: 2789775 - DNA, 13 bp, Homo sapiens
gcgctggtggacc

SEQ ID NO: 2789776 - DNA, 19 bp, Homo sapiens
gcggacagccacggccagg

SEQ ID NO: 2789777 - DNA, 20 bp, Homo sapiens
gcggagagtacagtgagcca

SEQ ID NO: 2789778 - DNA, 17 bp, Homo sapiens
gcggaggagaccagctc

SEQ ID NO: 2789779 - DNA, 16 bp, Homo sapiens
gcggcacagaggcagc

SEQ ID NO: 2789780 - DNA, 15 bp, Homo sapiens
gcggcacattggcag

SEQ ID NO: 2789781 - DNA, 17 bp, Homo sapiens
gcggccgcattccctga

SEQ ID NO: 2789782 - DNA, 19 bp, Homo sapiens
gcggccgcattccctgagt

SEQ ID NO: 2789783 - DNA, 18 bp, Homo sapiens
gcggcctatgacttgggc

SEQ ID NO: 2789784 - DNA, 13 bp, Homo sapiens
gcggctactcagc

SEQ ID NO: 2789785 - DNA, 20 bp, Homo sapiens
gcggctactcagcagccctc

SEQ ID NO: 2789786 - DNA, 21 bp, Homo sapiens
gcggctactcagcagccctcc

SEQ ID NO: 2789787 - DNA, 23 bp, Homo sapiens
gcggctgagtcatgatctccctg

SEQ ID NO: 2789788 - DNA, 20 bp, Homo sapiens
gcgggaccggtacagaaagg

SEQ ID NO: 2789789 - DNA, 20 bp, Homo sapiens
gcgggaggatgttctgggac

SEQ ID NO: 2789790 - DNA, 22 bp, Homo sapiens
gcgggaggatgttctgggacac

SEQ ID NO: 2789791 - DNA, 17 bp, Homo sapiens
gcgggatggtcctgggg

SEQ ID NO: 2789792 - DNA, 20 bp, Homo sapiens
gcgggcacctatagtcccag

SEQ ID NO: 2789793 - DNA, 18 bp, Homo sapiens
gcggggacagctccttct

SEQ ID NO: 2789794 - DNA, 13 bp, Homo sapiens
gcggggctatgcc

SEQ ID NO: 2789795 - DNA, 13 bp, Homo sapiens
gcggtccacccag

SEQ ID NO: 2789796 - DNA, 19 bp, Homo sapiens
gcggtccacccaggagccc

SEQ ID NO: 2789797 - DNA, 15 bp, Homo sapiens
gcggtttccaggaag

SEQ ID NO: 2789798 - DNA, 22 bp, Homo sapiens
gcgtagaaaacgcacctccatc

SEQ ID NO: 2789799 - DNA, 20 bp, Homo sapiens
gcgtcgctggacaacccaga

SEQ ID NO: 2789800 - DNA, 16 bp, Homo sapiens
gcgtgagccactgcac

SEQ ID NO: 2789801 - DNA, 18 bp, Homo sapiens
gcgtgagccactgcaccg

SEQ ID NO: 2789802 - DNA, 19 bp, Homo sapiens
gcgtgcacacaccagagcc

SEQ ID NO: 2789803 - DNA, 11 bp, Homo sapiens
gcgtgcagatg

SEQ ID NO: 2789804 - DNA, 20 bp, Homo sapiens
gctaaatgcaaacactgtgt

SEQ ID NO: 2789805 - DNA, 15 bp, Homo sapiens
gctaacagggaaggc

SEQ ID NO: 2789806 - DNA, 18 bp, Homo sapiens
gctaagagctagcgctgc

SEQ ID NO: 2789807 - DNA, 20 bp, Homo sapiens
gctaagagctagcgctgccg

SEQ ID NO: 2789808 - DNA, 15 bp, Homo sapiens
gctaatgggacacta

SEQ ID NO: 2789809 - DNA, 20 bp, Homo sapiens
gctaatttatcctgaaattt

SEQ ID NO: 2789810 - DNA, 18 bp, Homo sapiens
gctacaccactctggcag

SEQ ID NO: 2789811 - DNA, 19 bp, Homo sapiens
gctacaccactctggcagc

SEQ ID NO: 2789812 - DNA, 20 bp, Homo sapiens
gctacaccactctggcagcc

SEQ ID NO: 2789813 - DNA, 21 bp, Homo sapiens
gctacaccactctggcagcca

SEQ ID NO: 2789814 - DNA, 20 bp, Homo sapiens
gctacaccttagcagctctt

SEQ ID NO: 2789815 - DNA, 13 bp, Homo sapiens
gctaccccaccca

SEQ ID NO: 2789816 - DNA, 14 bp, Homo sapiens
gctacctgtgtgga

SEQ ID NO: 2789817 - DNA, 20 bp, Homo sapiens
gctacctgtgtggacaggac

SEQ ID NO: 2789818 - DNA, 23 bp, Homo sapiens
gctaccttctctacccatctccc

SEQ ID NO: 2789819 - DNA, 14 bp, Homo sapiens
gctacgtatttaat

SEQ ID NO: 2789820 - DNA, 15 bp, Homo sapiens
gctactcagaagcct

SEQ ID NO: 2789821 - DNA, 18 bp, Homo sapiens
gctactcagaagcctgag

SEQ ID NO: 2789822 - DNA, 11 bp, Homo sapiens
gctactcagca

SEQ ID NO: 2789823 - DNA, 18 bp, Homo sapiens
gctactcagcagccctcc

SEQ ID NO: 2789824 - DNA, 15 bp, Homo sapiens
gctactcaggaggct

SEQ ID NO: 2789825 - DNA, 20 bp, Homo sapiens
gctactcataagttggacca

SEQ ID NO: 2789826 - DNA, 20 bp, Homo sapiens
gctactctagtattccagac

SEQ ID NO: 2789827 - DNA, 13 bp, Homo sapiens
gctacttgggagg

SEQ ID NO: 2789828 - DNA, 23 bp, Homo sapiens
gctactttgctgctatggttttc

SEQ ID NO: 2789829 - DNA, 13 bp, Homo sapiens
gctagaaggccac

SEQ ID NO: 2789830 - DNA, 21 bp, Homo sapiens
gctagaagtgggccaggacag

SEQ ID NO: 2789831 - DNA, 16 bp, Homo sapiens
gctgccgcctcccagc

SEQ ID NO: 2789832 - DNA, 20 bp, Homo sapiens
gctgccgcctcccagcctgg

SEQ ID NO: 2789833 - DNA, 17 bp, Homo sapiens
gctgccgggccaggcgc

SEQ ID NO: 2789834 - DNA, 14 bp, Homo sapiens
gctgcctgaaaacc

SEQ ID NO: 2789835 - DNA, 15 bp, Homo sapiens
gctgcctgaaaacca

SEQ ID NO: 2789836 - DNA, 13 bp, Homo sapiens
gctgcctgtagtt

SEQ ID NO: 2789837 - DNA, 16 bp, Homo sapiens
gctgcctgtagttagg

SEQ ID NO: 2789838 - DNA, 19 bp, Homo sapiens
gctgcctgttcagctccag

SEQ ID NO: 2789839 - DNA, 14 bp, Homo sapiens
gctgccttgccatg

SEQ ID NO: 2789840 - DNA, 21 bp, Homo sapiens
gctgcgagatcgctggcagag

SEQ ID NO: 2789841 - DNA, 14 bp, Homo sapiens
gctgcgagcatttc

SEQ ID NO: 2789842 - DNA, 18 bp, Homo sapiens
gctgcggccagcctgact

SEQ ID NO: 2789843 - DNA, 16 bp, Homo sapiens
gctgcggtccacccag

SEQ ID NO: 2789844 - DNA, 21 bp, Homo sapiens
gctgcggtccacccaggagcc

SEQ ID NO: 2789845 - DNA, 14 bp, Homo sapiens
gctgcgtctccatc

SEQ ID NO: 2789846 - DNA, 14 bp, Homo sapiens
gctgctagagaagg

SEQ ID NO: 2789847 - DNA, 20 bp, Homo sapiens
gctgctagcacttggagcca

SEQ ID NO: 2789848 - DNA, 23 bp, Homo sapiens
gctgctagcacttggagccaagg

SEQ ID NO: 2789849 - DNA, 19 bp, Homo sapiens
gctgctcaacctctctcct

SEQ ID NO: 2789850 - DNA, 19 bp, Homo sapiens
gctgctcggggtgcacagg

SEQ ID NO: 2789851 - DNA, 20 bp, Homo sapiens
gctgctcggggtgcacagga

SEQ ID NO: 2789852 - DNA, 22 bp, Homo sapiens
gctgctcggggtgcacaggagg

SEQ ID NO: 2789853 - DNA, 15 bp, Homo sapiens
gctgctctctgaggg

SEQ ID NO: 2789854 - DNA, 16 bp, Homo sapiens
gctgctgactgatgtt

SEQ ID NO: 2789855 - DNA, 17 bp, Homo sapiens
gctgctgagaacctggc

SEQ ID NO: 2789856 - DNA, 21 bp, Homo sapiens
gctgctgagaacctggccttc

SEQ ID NO: 2789857 - DNA, 17 bp, Homo sapiens
gctgctgtgtagctctg

SEQ ID NO: 2789858 - DNA, 11 bp, Homo sapiens
gctgcttccca

SEQ ID NO: 2789859 - DNA, 22 bp, Homo sapiens
gctgcttcccatgcctgcaacc

SEQ ID NO: 2789860 - DNA, 20 bp, Homo sapiens
gctgctttgcgctggtggac

SEQ ID NO: 2789861 - DNA, 19 bp, Homo sapiens
gctggaaaagtcacacaga

SEQ ID NO: 2789862 - DNA, 20 bp, Homo sapiens
gctggaaaagtcacacagac

SEQ ID NO: 2789863 - DNA, 23 bp, Homo sapiens
gctggaagacgcaagggcctgat

SEQ ID NO: 2789864 - DNA, 17 bp, Homo sapiens
gctggacaagaagctgc

SEQ ID NO: 2789865 - DNA, 16 bp, Homo sapiens
gctggaccttgaactg

SEQ ID NO: 2789866 - DNA, 21 bp, Homo sapiens
gctggaccttgaactgggtac

SEQ ID NO: 2789867 - DNA, 22 bp, Homo sapiens
gctggaccttgaactgggtact

SEQ ID NO: 2789868 - DNA, 12 bp, Homo sapiens
gctggaggcagg

SEQ ID NO: 2789869 - DNA, 15 bp, Homo sapiens
gctggagtgcagtgg

SEQ ID NO: 2789870 - DNA, 13 bp, Homo sapiens
gctggcagcactc

SEQ ID NO: 2789871 - DNA, 13 bp, Homo sapiens
gctggcagccacc

SEQ ID NO: 2789872 - DNA, 14 bp, Homo sapiens
gctggcctggatct

SEQ ID NO: 2789873 - DNA, 15 bp, Homo sapiens
gctggcctggatctc

SEQ ID NO: 2789874 - DNA, 14 bp, Homo sapiens
gctggcctggccgg

SEQ ID NO: 2789875 - DNA, 16 bp, Homo sapiens
gctggcggctactcag

SEQ ID NO: 2789876 - DNA, 14 bp, Homo sapiens
gctggcgtgcagtg

SEQ ID NO: 2789877 - DNA, 15 bp, Homo sapiens
gctggctcctccagg

SEQ ID NO: 2789878 - DNA, 17 bp, Homo sapiens
gctggctgaaaatcact

SEQ ID NO: 2789879 - DNA, 18 bp, Homo sapiens
gctggctgaaaatcacta

SEQ ID NO: 2789880 - DNA, 15 bp, Homo sapiens
gctggctgttggctg

SEQ ID NO: 2789881 - DNA, 23 bp, Homo sapiens
gctggctgttggctgggggcctc

SEQ ID NO: 2789882 - DNA, 14 bp, Homo sapiens
gctgggactggcca

SEQ ID NO: 2789883 - DNA, 23 bp, Homo sapiens
gctgggaggaacctgaacctggg

SEQ ID NO: 2789884 - DNA, 19 bp, Homo sapiens
gctgggattacaggtgtga

SEQ ID NO: 2789885 - DNA, 13 bp, Homo sapiens
gctgggctctcca

SEQ ID NO: 2789886 - DNA, 21 bp, Homo sapiens
gctgggctctccacctcagcc

SEQ ID NO: 2789887 - DNA, 20 bp, Homo sapiens
gctgggcttcagtggcagct

SEQ ID NO: 2789888 - DNA, 21 bp, Homo sapiens
gctgggcttcagtggcagctg

SEQ ID NO: 2789889 - DNA, 13 bp, Homo sapiens
gctggggagcgaa

SEQ ID NO: 2789890 - DNA, 21 bp, Homo sapiens
gctggggagcgaaagtttctt

SEQ ID NO: 2789891 - DNA, 14 bp, Homo sapiens
gctgggggcctcag

SEQ ID NO: 2789892 - DNA, 15 bp, Homo sapiens
gctgggggcctcagt

SEQ ID NO: 2789893 - DNA, 14 bp, Homo sapiens
gctgggttggaggg

SEQ ID NO: 2789894 - DNA, 14 bp, Homo sapiens
gctggtcccactca

SEQ ID NO: 2789895 - DNA, 15 bp, Homo sapiens
gctggtcccactcag

SEQ ID NO: 2789896 - DNA, 20 bp, Homo sapiens
gctggtcccactcagtccat

SEQ ID NO: 2789897 - DNA, 20 bp, Homo sapiens
gctggtctccctccagctgg

SEQ ID NO: 2789898 - DNA, 15 bp, Homo sapiens
gctggtgctgtggcc

SEQ ID NO: 2789899 - DNA, 21 bp, Homo sapiens
gctggtgggaagcgtctgtcc

SEQ ID NO: 2789900 - DNA, 15 bp, Homo sapiens
gctggtgtcacctga

SEQ ID NO: 2789901 - DNA, 18 bp, Homo sapiens
gctggtgtcacctgaaga

SEQ ID NO: 2789902 - DNA, 23 bp, Homo sapiens
gctggttcagggttggcccctgc

SEQ ID NO: 2789903 - DNA, 14 bp, Homo sapiens
gctgtaaataaatg

SEQ ID NO: 2789904 - DNA, 17 bp, Homo sapiens
gctgtaaatacatgtgt

SEQ ID NO: 2789905 - DNA, 20 bp, Homo sapiens
gctgtaaatacatgtgtgga

SEQ ID NO: 2789906 - DNA, 16 bp, Homo sapiens
gctgtacgtctggtgt

SEQ ID NO: 2789907 - DNA, 13 bp, Homo sapiens
gctgtaggtgtgc

SEQ ID NO: 2789908 - DNA, 15 bp, Homo sapiens
gctgtcattgtccat

SEQ ID NO: 2789909 - DNA, 15 bp, Homo sapiens
gctgtccctgtcacc

SEQ ID NO: 2789910 - DNA, 13 bp, Homo sapiens
gctgtcctgctgt

SEQ ID NO: 2789911 - DNA, 14 bp, Homo sapiens
gctgtcctgctgtg

SEQ ID NO: 2789912 - DNA, 23 bp, Homo sapiens
gctgtctctgtccctcactgcct

SEQ ID NO: 2789913 - DNA, 15 bp, Homo sapiens
gctgtgcctcgctcc

SEQ ID NO: 2789914 - DNA, 12 bp, Homo sapiens
gctgtgcctctg

SEQ ID NO: 2789915 - DNA, 16 bp, Homo sapiens
gctgtgcctctgcctg

SEQ ID NO: 2789916 - DNA, 13 bp, Homo sapiens
gctgtggccaggg

SEQ ID NO: 2789917 - DNA, 14 bp, Homo sapiens
gctgtggcctgggc

SEQ ID NO: 2789918 - DNA, 17 bp, Homo sapiens
gctgtggtggctgtctc

SEQ ID NO: 2789919 - DNA, 18 bp, Homo sapiens
gctgtggtggctgtctct

SEQ ID NO: 2789920 - DNA, 17 bp, Homo sapiens
gctgtgtagctctgtcc

SEQ ID NO: 2789921 - DNA, 18 bp, Homo sapiens
gctgtgtagctctgtcca

SEQ ID NO: 2789922 - DNA, 20 bp, Homo sapiens
ggacagctccttctgtccta

SEQ ID NO: 2789923 - DNA, 11 bp, Homo sapiens
ggacagctgtg

SEQ ID NO: 2789924 - DNA, 17 bp, Homo sapiens
ggacagctgtgcctcgc

SEQ ID NO: 2789925 - DNA, 22 bp, Homo sapiens
ggacaggcccggcgcggtggct

SEQ ID NO: 2789926 - DNA, 14 bp, Homo sapiens
ggacagtcctggga

SEQ ID NO: 2789927 - DNA, 15 bp, Homo sapiens
ggacatgcagctctg

SEQ ID NO: 2789928 - DNA, 20 bp, Homo sapiens
ggacattgcggacagccacg

SEQ ID NO: 2789929 - DNA, 22 bp, Homo sapiens
ggaccaaccctgtttcctgagt

SEQ ID NO: 2789930 - DNA, 13 bp, Homo sapiens
ggaccacacctcc

SEQ ID NO: 2789931 - DNA, 13 bp, Homo sapiens
ggaccaccagccc

SEQ ID NO: 2789932 - DNA, 15 bp, Homo sapiens
ggaccaccagcccca

SEQ ID NO: 2789933 - DNA, 18 bp, Homo sapiens
ggaccaccagccccagca

SEQ ID NO: 2789934 - DNA, 19 bp, Homo sapiens
ggaccagaagccaaagact

SEQ ID NO: 2789935 - DNA, 14 bp, Homo sapiens
ggaccaggacagga

SEQ ID NO: 2789936 - DNA, 21 bp, Homo sapiens
ggaccaggactatagcccagg

SEQ ID NO: 2789937 - DNA, 19 bp, Homo sapiens
ggacccatagatcttctga

SEQ ID NO: 2789938 - DNA, 20 bp, Homo sapiens
ggacccatagatcttctgaa

SEQ ID NO: 2789939 - DNA, 14 bp, Homo sapiens
ggacccgctctgga

SEQ ID NO: 2789940 - DNA, 21 bp, Homo sapiens
ggaccctttccttccttccct

SEQ ID NO: 2789941 - DNA, 21 bp, Homo sapiens
ggaccgctacaccactctggc

SEQ ID NO: 2789942 - DNA, 17 bp, Homo sapiens
ggacctatgtcctaagg

SEQ ID NO: 2789943 - DNA, 21 bp, Homo sapiens
ggacctatgtcctaaggacac

SEQ ID NO: 2789944 - DNA, 14 bp, Homo sapiens
ggacctgaaggacg

SEQ ID NO: 2789945 - DNA, 16 bp, Homo sapiens
ggacctgagcctgccg

SEQ ID NO: 2789946 - DNA, 20 bp, Homo sapiens
ggacctgagcctgccgagca

SEQ ID NO: 2789947 - DNA, 23 bp, Homo sapiens
ggacctgagcctgccgagcaacc

SEQ ID NO: 2789948 - DNA, 12 bp, Homo sapiens
ggaccttcctgc

SEQ ID NO: 2789949 - DNA, 17 bp, Homo sapiens
ggaccttgaactgggta

SEQ ID NO: 2789950 - DNA, 18 bp, Homo sapiens
ggaccttgaactgggtac

SEQ ID NO: 2789951 - DNA, 23 bp, Homo sapiens
ggactaacactcagaagcctggg

SEQ ID NO: 2789952 - DNA, 14 bp, Homo sapiens
ggactacaggtgtg

SEQ ID NO: 2789953 - DNA, 20 bp, Homo sapiens
ggactacaggtgtgagtcac

SEQ ID NO: 2789954 - DNA, 19 bp, Homo sapiens
ggactatgaaaagctagaa

SEQ ID NO: 2789955 - DNA, 15 bp, Homo sapiens
ggactcaatgcactg

SEQ ID NO: 2789956 - DNA, 15 bp, Homo sapiens
ggactcctcccacaa

SEQ ID NO: 2789957 - DNA, 15 bp, Homo sapiens
ggactgtcatagaaa

SEQ ID NO: 2789958 - DNA, 14 bp, Homo sapiens
ggactgtcgctgct

SEQ ID NO: 2789959 - DNA, 21 bp, Homo sapiens
ggactttggttctctccagga

SEQ ID NO: 2789960 - DNA, 20 bp, Homo sapiens
ggagaagaaagaggtgaccc

SEQ ID NO: 2789961 - DNA, 23 bp, Homo sapiens
ggagaagaaagaggtgaccccag

SEQ ID NO: 2789962 - DNA, 22 bp, Homo sapiens
ggagaagaattttcagacccca

SEQ ID NO: 2789963 - DNA, 22 bp, Homo sapiens
ggagaaggaaggagactcacct

SEQ ID NO: 2789964 - DNA, 14 bp, Homo sapiens
ggagaccagctcag

SEQ ID NO: 2789965 - DNA, 9 bp, Homo sapiens
ggagactca

SEQ ID NO: 2789966 - DNA, 18 bp, Homo sapiens
ggagactcacctctgcct

SEQ ID NO: 2789967 - DNA, 21 bp, Homo sapiens
ggagactcacctctgcctcaa

SEQ ID NO: 2789968 - DNA, 12 bp, Homo sapiens
ggagagagggga

SEQ ID NO: 2789969 - DNA, 14 bp, Homo sapiens
ggagagccagccct

SEQ ID NO: 2789970 - DNA, 21 bp, Homo sapiens
ggagagccagccctccctgtc

SEQ ID NO: 2789971 - DNA, 23 bp, Homo sapiens
ggagagccagccctccctgtcct

SEQ ID NO: 2789972 - DNA, 17 bp, Homo sapiens
ggagagccagctctctc

SEQ ID NO: 2789973 - DNA, 13 bp, Homo sapiens
ggagagccctggg

SEQ ID NO: 2789974 - DNA, 22 bp, Homo sapiens
ggagaggggaagggccagtctg

SEQ ID NO: 2789975 - DNA, 21 bp, Homo sapiens
ggagagggtctggagaagcag

SEQ ID NO: 2789976 - DNA, 19 bp, Homo sapiens
ggagatggaggaaagtgat

SEQ ID NO: 2789977 - DNA, 18 bp, Homo sapiens
ggagatgggccttttgga

SEQ ID NO: 2789978 - DNA, 13 bp, Homo sapiens
ggagcaaagcctg

SEQ ID NO: 2789979 - DNA, 22 bp, Homo sapiens
ggagcaaagcctgttcatggca

SEQ ID NO: 2789980 - DNA, 24 bp, Homo sapiens
ggagcaaagcctgttcatggcaga

SEQ ID NO: 2789981 - DNA, 15 bp, Homo sapiens
ggagcaaatgtttct

SEQ ID NO: 2789982 - DNA, 20 bp, Homo sapiens
ggagcaaatgtttctgcagt

SEQ ID NO: 2789983 - DNA, 13 bp, Homo sapiens
ggagcaatttgca

SEQ ID NO: 2789984 - DNA, 13 bp, Homo sapiens
ggagcacaggcag

SEQ ID NO: 2789985 - DNA, 14 bp, Homo sapiens
ggagcacaggcagc

SEQ ID NO: 2789986 - DNA, 15 bp, Homo sapiens
ggagcactggagtgc

SEQ ID NO: 2789987 - DNA, 18 bp, Homo sapiens
ggagcagtgtcttccata

SEQ ID NO: 2789988 - DNA, 23 bp, Homo sapiens
ggagccaagggttcagagactca

SEQ ID NO: 2789989 - DNA, 22 bp, Homo sapiens
ggagccccgaggccttctctga

SEQ ID NO: 2789990 - DNA, 20 bp, Homo sapiens
ggagcctcatccgaggcagg

SEQ ID NO: 2789991 - DNA, 22 bp, Homo sapiens
ggagcctcgcaacccgtgccaa

SEQ ID NO: 2789992 - DNA, 18 bp, Homo sapiens
ggagcctcggtggccatg

SEQ ID NO: 2789993 - DNA, 19 bp, Homo sapiens
ggagcctcggtggccatgc

SEQ ID NO: 2789994 - DNA, 22 bp, Homo sapiens
ggagcctgcaaactcactgctc

SEQ ID NO: 2789995 - DNA, 19 bp, Homo sapiens
ggagcctgtgaacccagga

SEQ ID NO: 2789996 - DNA, 19 bp, Homo sapiens
ggagcgaagcagagaggtg

SEQ ID NO: 2789997 - DNA, 15 bp, Homo sapiens
ggagcgcacctgccc

SEQ ID NO: 2789998 - DNA, 21 bp, Homo sapiens
ggagcgcacctgccccctggt

SEQ ID NO: 2789999 - DNA, 23 bp, Homo sapiens
ggagcgcacctgccccctggtgg

SEQ ID NO: 2790000 - DNA, 14 bp, Homo sapiens
ggagctacctgtgt

SEQ ID NO: 2790001 - DNA, 23 bp, Homo sapiens
ggagctggttagaaatgcagaat

SEQ ID NO: 2790002 - DNA, 17 bp, Homo sapiens
ggagcttccagtgcatg

SEQ ID NO: 2790003 - DNA, 23 bp, Homo sapiens
ggagcttgcaagaagcaggaagg

SEQ ID NO: 2790004 - DNA, 15 bp, Homo sapiens
ggagcttgggaatgg

SEQ ID NO: 2790005 - DNA, 10 bp, Homo sapiens
ggaggaaggg

SEQ ID NO: 2790006 - DNA, 16 bp, Homo sapiens
ggaggacctgagcctg

SEQ ID NO: 2790007 - DNA, 17 bp, Homo sapiens
ggaggacctgagcctgc

SEQ ID NO: 2790008 - DNA, 18 bp, Homo sapiens
ggaggacctgagcctgcc

SEQ ID NO: 2790009 - DNA, 22 bp, Homo sapiens
ggaggacctgagcctgccgagc

SEQ ID NO: 2790010 - DNA, 16 bp, Homo sapiens
ggaggatcactggagc

SEQ ID NO: 2790011 - DNA, 22 bp, Homo sapiens
ggaggatcactggagcccagga

SEQ ID NO: 2790012 - DNA, 22 bp, Homo sapiens
ggccacactattaccatgagaa

SEQ ID NO: 2790013 - DNA, 14 bp, Homo sapiens
ggccaccaggatgg

SEQ ID NO: 2790014 - DNA, 18 bp, Homo sapiens
ggccaccgggacagacct

SEQ ID NO: 2790015 - DNA, 17 bp, Homo sapiens
ggccacgtgccaggccc

SEQ ID NO: 2790016 - DNA, 18 bp, Homo sapiens
ggccacgtgccaggcccg

SEQ ID NO: 2790017 - DNA, 16 bp, Homo sapiens
ggccactccttcctgc

SEQ ID NO: 2790018 - DNA, 16 bp, Homo sapiens
ggccactctcccctcc

SEQ ID NO: 2790019 - DNA, 15 bp, Homo sapiens
ggccagatgcaccag

SEQ ID NO: 2790020 - DNA, 15 bp, Homo sapiens
ggctggaggcagggc

SEQ ID NO: 2790021 - DNA, 14 bp, Homo sapiens
ggctggctgagggc

SEQ ID NO: 2790022 - DNA, 14 bp, Homo sapiens
ggctggctgcagtg

SEQ ID NO: 2790023 - DNA, 15 bp, Homo sapiens
ggctggctgcagtga

SEQ ID NO: 2790024 - DNA, 13 bp, Homo sapiens
ggctggctgggca

SEQ ID NO: 2790025 - DNA, 13 bp, Homo sapiens
ggctgggcttcag

SEQ ID NO: 2790026 - DNA, 17 bp, Homo sapiens
ggctgggcttcagtggc

SEQ ID NO: 2790027 - DNA, 18 bp, Homo sapiens
ggctgggcttcagtggca

SEQ ID NO: 2790028 - DNA, 17 bp, Homo sapiens
ggctgggggcctcagtg

SEQ ID NO: 2790029 - DNA, 18 bp, Homo sapiens
ggctgggggcgggggagc

SEQ ID NO: 2790030 - DNA, 14 bp, Homo sapiens
ggctgggttggagg

SEQ ID NO: 2790031 - DNA, 18 bp, Homo sapiens
ggctgtaaacagctctgt

SEQ ID NO: 2790032 - DNA, 19 bp, Homo sapiens
ggctgtaaacagctctgtg

SEQ ID NO: 2790033 - DNA, 19 bp, Homo sapiens
ggctgtatcccatgagcct

SEQ ID NO: 2790034 - DNA, 14 bp, Homo sapiens
ggctgtctctgtcc

SEQ ID NO: 2790035 - DNA, 16 bp, Homo sapiens
ggctgtggtggctgtc

SEQ ID NO: 2790036 - DNA, 14 bp, Homo sapiens
ggctgttggctggg

SEQ ID NO: 2790037 - DNA, 20 bp, Homo sapiens
ggctgttggctgggggcctc

SEQ ID NO: 2790038 - DNA, 11 bp, Homo sapiens
ggctgtttctt

SEQ ID NO: 2790039 - DNA, 15 bp, Homo sapiens
ggcttaaaacaacac

SEQ ID NO: 2790040 - DNA, 20 bp, Homo sapiens
ggcttagttaagtcatccac

SEQ ID NO: 2790041 - DNA, 13 bp, Homo sapiens
ggcttatggccag

SEQ ID NO: 2790042 - DNA, 18 bp, Homo sapiens
ggcttattttttaaaata

SEQ ID NO: 2790043 - DNA, 17 bp, Homo sapiens
ggcttcagcatatttat

SEQ ID NO: 2790044 - DNA, 17 bp, Homo sapiens
ggcttcccatccccagc

SEQ ID NO: 2790045 - DNA, 13 bp, Homo sapiens
ggcttctcctgac

SEQ ID NO: 2790046 - DNA, 20 bp, Homo sapiens
ggcttcttcagatcagtgct

SEQ ID NO: 2790047 - DNA, 16 bp, Homo sapiens
ggcttgggccctgcac

SEQ ID NO: 2790048 - DNA, 18 bp, Homo sapiens
ggcttgggccctgcacag

SEQ ID NO: 2790049 - DNA, 15 bp, Homo sapiens
ggcttgtaactccac

SEQ ID NO: 2790050 - DNA, 16 bp, Homo sapiens
ggcttgtcactagcag

SEQ ID NO: 2790051 - DNA, 16 bp, Homo sapiens
ggctttacattttatt

SEQ ID NO: 2790052 - DNA, 13 bp, Homo sapiens
ggctttctggaga

SEQ ID NO: 2790053 - DNA, 22 bp, Homo sapiens
gggaaaggctctgaaagccagc

SEQ ID NO: 2790054 - DNA, 15 bp, Homo sapiens
gggaacagacaggag

SEQ ID NO: 2790055 - DNA, 16 bp, Homo sapiens
gggaacagacaggaga

SEQ ID NO: 2790056 - DNA, 19 bp, Homo sapiens
gggaaccatgaagctggaa

SEQ ID NO: 2790057 - DNA, 18 bp, Homo sapiens
gggaactggccaagctga

SEQ ID NO: 2790058 - DNA, 20 bp, Homo sapiens
gggaagacaggtctagactt

SEQ ID NO: 2790059 - DNA, 16 bp, Homo sapiens
gggaagctggcagcac

SEQ ID NO: 2790060 - DNA, 21 bp, Homo sapiens
gggaagctgggggaagggtgg

SEQ ID NO: 2790061 - DNA, 17 bp, Homo sapiens
gggaaggaactctggct

SEQ ID NO: 2790062 - DNA, 21 bp, Homo sapiens
gggaaggctacttcggggctg

SEQ ID NO: 2790063 - DNA, 14 bp, Homo sapiens
gggaaggctgctgt

SEQ ID NO: 2790064 - DNA, 16 bp, Homo sapiens
gggaaggctgctgtgt

SEQ ID NO: 2790065 - DNA, 16 bp, Homo sapiens
gggaagggccagtctg

SEQ ID NO: 2790066 - DNA, 16 bp, Homo sapiens
gggaagtttctgggtg

SEQ ID NO: 2790067 - DNA, 16 bp, Homo sapiens
gggacaaaggagcctg

SEQ ID NO: 2790068 - DNA, 18 bp, Homo sapiens
gggacagagacacctgca

SEQ ID NO: 2790069 - DNA, 20 bp, Homo sapiens
gggacagagacacctgcacc

SEQ ID NO: 2790070 - DNA, 17 bp, Homo sapiens
gggacaggtcctcagtg

SEQ ID NO: 2790071 - DNA, 21 bp, Homo sapiens
gggacagtattctcagtgctc

SEQ ID NO: 2790072 - DNA, 21 bp, Homo sapiens
gggaccccagctagggctgga

SEQ ID NO: 2790073 - DNA, 22 bp, Homo sapiens
gggaccgctacaccactctggc

SEQ ID NO: 2790074 - DNA, 17 bp, Homo sapiens
gggactacaggcaccca

SEQ ID NO: 2790075 - DNA, 17 bp, Homo sapiens
gggactcaatgcactga

SEQ ID NO: 2790076 - DNA, 23 bp, Homo sapiens
gggactgccagtccccctgcccc

SEQ ID NO: 2790077 - DNA, 10 bp, Homo sapiens
gggagaaaac

SEQ ID NO: 2790078 - DNA, 20 bp, Homo sapiens
gggagacggaggttgcagtg

SEQ ID NO: 2790079 - DNA, 11 bp, Homo sapiens
gggagagaact

SEQ ID NO: 2790080 - DNA, 11 bp, Homo sapiens
gggagcactgg

SEQ ID NO: 2790081 - DNA, 11 bp, Homo sapiens
gggagcagtgt

SEQ ID NO: 2790082 - DNA, 20 bp, Homo sapiens
gggagcagtgtcttccataa

SEQ ID NO: 2790083 - DNA, 16 bp, Homo sapiens
gggagccaacagcagc

SEQ ID NO: 2790084 - DNA, 12 bp, Homo sapiens
gggagctctgca

SEQ ID NO: 2790085 - DNA, 17 bp, Homo sapiens
gggaggatcactggagc

SEQ ID NO: 2790086 - DNA, 22 bp, Homo sapiens
gggaggcggcacattggcagtg

SEQ ID NO: 2790087 - DNA, 15 bp, Homo sapiens
gggaggctgagacag

SEQ ID NO: 2790088 - DNA, 14 bp, Homo sapiens
gggaggctgaggcg

SEQ ID NO: 2790089 - DNA, 18 bp, Homo sapiens
gggaggctgaggcggaag

SEQ ID NO: 2790090 - DNA, 15 bp, Homo sapiens
gggagggtaccagca

SEQ ID NO: 2790091 - DNA, 16 bp, Homo sapiens
gggagggtggatccac

SEQ ID NO: 2790092 - DNA, 18 bp, Homo sapiens
gggaggtgagaccacctc

SEQ ID NO: 2790093 - DNA, 19 bp, Homo sapiens
gggagtgagacagaagtaa

SEQ ID NO: 2790094 - DNA, 14 bp, Homo sapiens
gggagtgagctggt

SEQ ID NO: 2790095 - DNA, 23 bp, Homo sapiens
gggagttcgagaccaacctgacc

SEQ ID NO: 2790096 - DNA, 13 bp, Homo sapiens
gggatagagagag

SEQ ID NO: 2790097 - DNA, 20 bp, Homo sapiens
gggatgactaaaatatttat

SEQ ID NO: 2790098 - DNA, 13 bp, Homo sapiens
gggatgagaaagg

SEQ ID NO: 2790099 - DNA, 15 bp, Homo sapiens
gggatggaggagaag

SEQ ID NO: 2790100 - DNA, 23 bp, Homo sapiens
gggattttaaaaacatgagaaat

SEQ ID NO: 2790101 - DNA, 16 bp, Homo sapiens
gggcaacccccagcct

SEQ ID NO: 2790102 - DNA, 12 bp, Homo sapiens
gggcacaggagc

SEQ ID NO: 2790103 - DNA, 19 bp, Homo sapiens
gggcacccccagcctgggc

SEQ ID NO: 2790104 - DNA, 15 bp, Homo sapiens
gggcagaaagtggcc

SEQ ID NO: 2790105 - DNA, 19 bp, Homo sapiens
gggcagaagggagaaggat

SEQ ID NO: 2790106 - DNA, 14 bp, Homo sapiens
gggcagagccggga

SEQ ID NO: 2790107 - DNA, 23 bp, Homo sapiens
gggcagaggctggaggcagggcc

SEQ ID NO: 2790108 - DNA, 14 bp, Homo sapiens
gggcagcagccagc

SEQ ID NO: 2790109 - DNA, 17 bp, Homo sapiens
gggcagcagccagccct

SEQ ID NO: 2790110 - DNA, 19 bp, Homo sapiens
gggcagcagccagccctgc

SEQ ID NO: 2790111 - DNA, 23 bp, Homo sapiens
ggggaagggccagtctgggctgc

SEQ ID NO: 2790112 - DNA, 18 bp, Homo sapiens
ggggaatgtttgcctctg

SEQ ID NO: 2790113 - DNA, 14 bp, Homo sapiens
ggggacagctcctt

SEQ ID NO: 2790114 - DNA, 15 bp, Homo sapiens
ggggacaggtcctca

SEQ ID NO: 2790115 - DNA, 21 bp, Homo sapiens
ggggatgactagaggcaggga

SEQ ID NO: 2790116 - DNA, 17 bp, Homo sapiens
ggggcagaacagccgct

SEQ ID NO: 2790117 - DNA, 16 bp, Homo sapiens
ggggcagagggcagag

SEQ ID NO: 2790118 - DNA, 21 bp, Homo sapiens
ggggcaggagtagctgagctc

SEQ ID NO: 2790119 - DNA, 16 bp, Homo sapiens
ggggcatgctggggca

SEQ ID NO: 2790120 - DNA, 12 bp, Homo sapiens
ggggccctggtc

SEQ ID NO: 2790121 - DNA, 21 bp, Homo sapiens
ggggccctggtccttccaggc

SEQ ID NO: 2790122 - DNA, 19 bp, Homo sapiens
ggggcctggctggctgagg

SEQ ID NO: 2790123 - DNA, 22 bp, Homo sapiens
ggggcctggctggctgagggca

SEQ ID NO: 2790124 - DNA, 15 bp, Homo sapiens
ggggctagcagaagt

SEQ ID NO: 2790125 - DNA, 22 bp, Homo sapiens
ggggctcctttctccagccagc

SEQ ID NO: 2790126 - DNA, 17 bp, Homo sapiens
ggggctctaacgcctga

SEQ ID NO: 2790127 - DNA, 14 bp, Homo sapiens
ggggctgctcctcc

SEQ ID NO: 2790128 - DNA, 19 bp, Homo sapiens
ggggctggcggctactcag

SEQ ID NO: 2790129 - DNA, 15 bp, Homo sapiens
ggggctttctggaga

SEQ ID NO: 2790130 - DNA, 21 bp, Homo sapiens
gggggacttacatgattcatt

SEQ ID NO: 2790131 - DNA, 17 bp, Homo sapiens
gggggagccaacagcag

SEQ ID NO: 2790132 - DNA, 18 bp, Homo sapiens
gggggagccaacagcagc

SEQ ID NO: 2790133 - DNA, 18 bp, Homo sapiens
gggggcctcagtgccact

SEQ ID NO: 2790134 - DNA, 11 bp, Homo sapiens
gggggcctggc

SEQ ID NO: 2790135 - DNA, 14 bp, Homo sapiens
gggggcctggctgg

SEQ ID NO: 2790136 - DNA, 15 bp, Homo sapiens
gggggcctggctggc

SEQ ID NO: 2790137 - DNA, 22 bp, Homo sapiens
ggggtccttcaagttagctcag

SEQ ID NO: 2790138 - DNA, 20 bp, Homo sapiens
ggggtctccctctcctgcct

SEQ ID NO: 2790139 - DNA, 23 bp, Homo sapiens
ggggtgacccggcaccccctgca

SEQ ID NO: 2790140 - DNA, 23 bp, Homo sapiens
ggggtgatgagggcagcagccag

SEQ ID NO: 2790141 - DNA, 13 bp, Homo sapiens
ggggtgcacagga

SEQ ID NO: 2790142 - DNA, 17 bp, Homo sapiens
ggggttcagcccctcct

SEQ ID NO: 2790143 - DNA, 20 bp, Homo sapiens
ggggttctttcttcctctgc

SEQ ID NO: 2790144 - DNA, 22 bp, Homo sapiens
gggtaaaattccttagcttaga

SEQ ID NO: 2790145 - DNA, 19 bp, Homo sapiens
gggtaccatggacggcccc

SEQ ID NO: 2790146 - DNA, 19 bp, Homo sapiens
gggtacttgtggacacagc

SEQ ID NO: 2790147 - DNA, 15 bp, Homo sapiens
gggtccccagctccc

SEQ ID NO: 2790148 - DNA, 18 bp, Homo sapiens
gggtccccagctccccag

SEQ ID NO: 2790149 - DNA, 17 bp, Homo sapiens
gggtcctgagtggctga

SEQ ID NO: 2790150 - DNA, 16 bp, Homo sapiens
gggtctccctctcctg

SEQ ID NO: 2790151 - DNA, 18 bp, Homo sapiens
gggtctccctctcctgcc

SEQ ID NO: 2790152 - DNA, 21 bp, Homo sapiens
gggtgatgagggcagcagcca

SEQ ID NO: 2790153 - DNA, 23 bp, Homo sapiens
gggtgatgagggcagcagccagc

SEQ ID NO: 2790154 - DNA, 19 bp, Homo sapiens
gggtgatgatgaccaagaa

SEQ ID NO: 2790155 - DNA, 16 bp, Homo sapiens
gggtgatttcagagag

SEQ ID NO: 2790156 - DNA, 20 bp, Homo sapiens
gggtggatccactgtgcagg

SEQ ID NO: 2790157 - DNA, 17 bp, Homo sapiens
gggtggatgcctggtgg

SEQ ID NO: 2790158 - DNA, 23 bp, Homo sapiens
gggtggctactctgtgccagagc

SEQ ID NO: 2790159 - DNA, 18 bp, Homo sapiens
gggtggctagtcagagag

SEQ ID NO: 2790160 - DNA, 16 bp, Homo sapiens
gggtgggcagggctgg

SEQ ID NO: 2790161 - DNA, 16 bp, Homo sapiens
gggtggtctgagcacc

SEQ ID NO: 2790162 - DNA, 12 bp, Homo sapiens
gggtggtgacct

SEQ ID NO: 2790163 - DNA, 19 bp, Homo sapiens
gggtgtaacaggtctcctc

SEQ ID NO: 2790164 - DNA, 13 bp, Homo sapiens
gggtgtgccaggc

SEQ ID NO: 2790165 - DNA, 22 bp, Homo sapiens
gggtgtgtgtttgtgtgagaga

SEQ ID NO: 2790166 - DNA, 19 bp, Homo sapiens
gggttcagcccctcctctg

SEQ ID NO: 2790167 - DNA, 20 bp, Homo sapiens
gggttcagcccctcctctgc

SEQ ID NO: 2790168 - DNA, 22 bp, Homo sapiens
gggttcagcccctcctctgcca

SEQ ID NO: 2790169 - DNA, 18 bp, Homo sapiens
gggttctgggagttccct

SEQ ID NO: 2790170 - DNA, 19 bp, Homo sapiens
gggttctttggaaggagtg

SEQ ID NO: 2790171 - DNA, 19 bp, Homo sapiens
gggttggcccctgcccggc

SEQ ID NO: 2790172 - DNA, 21 bp, Homo sapiens
gggttgtcaagagagagtcaa

SEQ ID NO: 2790173 - DNA, 14 bp, Homo sapiens
gggttgtgaggcct

SEQ ID NO: 2790174 - DNA, 23 bp, Homo sapiens
gggttgtgaggcctggccaggca

SEQ ID NO: 2790175 - DNA, 20 bp, Homo sapiens
gggttttgccatgttggcca

SEQ ID NO: 2790176 - DNA, 23 bp, Homo sapiens
gggttttgccatgttggccaggc

SEQ ID NO: 2790177 - DNA, 18 bp, Homo sapiens
ggtaacagggagactgca

SEQ ID NO: 2790178 - DNA, 21 bp, Homo sapiens
ggtaccagcagaaaggttagt

SEQ ID NO: 2790179 - DNA, 17 bp, Homo sapiens
ggtaccagctcactccc

SEQ ID NO: 2790180 - DNA, 17 bp, Homo sapiens
ggtacccactgctctgg

SEQ ID NO: 2790181 - DNA, 16 bp, Homo sapiens
ggtacctcagtttctc

SEQ ID NO: 2790182 - DNA, 22 bp, Homo sapiens
ggtactactgctgcaaagtgca

SEQ ID NO: 2790183 - DNA, 16 bp, Homo sapiens
ggtactgcacattttg

SEQ ID NO: 2790184 - DNA, 17 bp, Homo sapiens
ggtacttgtggacacag

SEQ ID NO: 2790185 - DNA, 18 bp, Homo sapiens
ggtagaattgggaagctg

SEQ ID NO: 2790186 - DNA, 23 bp, Homo sapiens
ggtagaattgggaagctggggga

SEQ ID NO: 2790187 - DNA, 23 bp, Homo sapiens
ggtagagtttgaaggaggtgagg

SEQ ID NO: 2790188 - DNA, 18 bp, Homo sapiens
ggtagcccagcactgtga

SEQ ID NO: 2790189 - DNA, 14 bp, Homo sapiens
ggtagcttttccct

SEQ ID NO: 2790190 - DNA, 19 bp, Homo sapiens
ggtaggaggtttggatggg

SEQ ID NO: 2790191 - DNA, 20 bp, Homo sapiens
ggtataatggttgactgggt

SEQ ID NO: 2790192 - DNA, 20 bp, Homo sapiens
ggtatgaacttgaggacaca

SEQ ID NO: 2790193 - DNA, 21 bp, Homo sapiens
ggtatgaacttgaggacacat

SEQ ID NO: 2790194 - DNA, 15 bp, Homo sapiens
ggtatgagctgaggg

SEQ ID NO: 2790195 - DNA, 16 bp, Homo sapiens
ggtatgagctgagggg

SEQ ID NO: 2790196 - DNA, 15 bp, Homo sapiens
ggtatggaactctct

SEQ ID NO: 2790197 - DNA, 14 bp, Homo sapiens
ggtatgtgtgtgta

SEQ ID NO: 2790198 - DNA, 18 bp, Homo sapiens
ggtcaaaatagtgccact

SEQ ID NO: 2790199 - DNA, 22 bp, Homo sapiens
ggtcaaaccgcactcacccatg

SEQ ID NO: 2790200 - DNA, 20 bp, Homo sapiens
ggtcaacagagaaggcagga

SEQ ID NO: 2790201 - DNA, 13 bp, Homo sapiens
ggtgggcagggct

SEQ ID NO: 2790202 - DNA, 15 bp, Homo sapiens
ggtgggccactctcc

SEQ ID NO: 2790203 - DNA, 15 bp, Homo sapiens
ggtgggctgagccct

SEQ ID NO: 2790204 - DNA, 17 bp, Homo sapiens
ggtggggctgctcctcc

SEQ ID NO: 2790205 - DNA, 20 bp, Homo sapiens
ggtggggggatcacaaggtc

SEQ ID NO: 2790206 - DNA, 19 bp, Homo sapiens
ggtgggttctttggaagga

SEQ ID NO: 2790207 - DNA, 14 bp, Homo sapiens
ggtggtgacctctg

SEQ ID NO: 2790208 - DNA, 19 bp, Homo sapiens
ggtgtcacctgaagactca

SEQ ID NO: 2790209 - DNA, 16 bp, Homo sapiens
ggtgtctgcacccagg

SEQ ID NO: 2790210 - DNA, 18 bp, Homo sapiens
ggtgtgagtcaccaagcc

SEQ ID NO: 2790211 - DNA, 14 bp, Homo sapiens
ggtgttaatttttg

SEQ ID NO: 2790212 - DNA, 17 bp, Homo sapiens
ggtgttgacatgtgctt

SEQ ID NO: 2790213 - DNA, 15 bp, Homo sapiens
ggttagggaggggta

SEQ ID NO: 2790214 - DNA, 23 bp, Homo sapiens
ggttcaagcgattcttctgcttc

SEQ ID NO: 2790215 - DNA, 14 bp, Homo sapiens
ggttcagcccctcc

SEQ ID NO: 2790216 - DNA, 19 bp, Homo sapiens
ggttcagcccctcctctgc

SEQ ID NO: 2790217 - DNA, 22 bp, Homo sapiens
ggttcagggttggcccctgccc

SEQ ID NO: 2790218 - DNA, 15 bp, Homo sapiens
ggttcatctgagcaa

SEQ ID NO: 2790219 - DNA, 18 bp, Homo sapiens
ggttccatgcctgagggt

SEQ ID NO: 2790220 - DNA, 23 bp, Homo sapiens
ggttctagtctcctttgcactga

SEQ ID NO: 2790221 - DNA, 14 bp, Homo sapiens
ggttctttcttcct

SEQ ID NO: 2790222 - DNA, 17 bp, Homo sapiens
ggttctttcttcctctg

SEQ ID NO: 2790223 - DNA, 14 bp, Homo sapiens
ggttgaagcaccaa

SEQ ID NO: 2790224 - DNA, 14 bp, Homo sapiens
ggttgatcacactc

SEQ ID NO: 2790225 - DNA, 21 bp, Homo sapiens
ggttggcccctgcccggctgc

SEQ ID NO: 2790226 - DNA, 21 bp, Homo sapiens
ggttggccgtggtccagctct

SEQ ID NO: 2790227 - DNA, 23 bp, Homo sapiens
ggttggccgtggtccagctcttg

SEQ ID NO: 2790228 - DNA, 10 bp, Homo sapiens
ggttgtcaat

SEQ ID NO: 2790229 - DNA, 21 bp, Homo sapiens
ggttgtctgtttttgtaactt

SEQ ID NO: 2790230 - DNA, 22 bp, Homo sapiens
ggtttccactgtcttgcctgcc

SEQ ID NO: 2790231 - DNA, 23 bp, Homo sapiens
ggtttccactgtcttgcctgcca

SEQ ID NO: 2790232 - DNA, 14 bp, Homo sapiens
ggtttccaggaaga

SEQ ID NO: 2790233 - DNA, 11 bp, Homo sapiens
ggtttccaggc

SEQ ID NO: 2790234 - DNA, 11 bp, Homo sapiens
ggtttctcaga

SEQ ID NO: 2790235 - DNA, 13 bp, Homo sapiens
ggtttgtatattg

SEQ ID NO: 2790236 - DNA, 15 bp, Homo sapiens
ggttttatattttta

SEQ ID NO: 2790237 - DNA, 14 bp, Homo sapiens
ggttttcttcccat

SEQ ID NO: 2790238 - DNA, 23 bp, Homo sapiens
ggtttttgtttgtttcctttgtt

SEQ ID NO: 2790239 - DNA, 18 bp, Homo sapiens
gtaaaacatttattttga

SEQ ID NO: 2790240 - DNA, 20 bp, Homo sapiens
gtaaaacatttattttgaca

SEQ ID NO: 2790241 - DNA, 18 bp, Homo sapiens
gtaaaagaacagtaaaca

SEQ ID NO: 2790242 - DNA, 19 bp, Homo sapiens
gtaaaagcaaaaaagaaaa

SEQ ID NO: 2790243 - DNA, 13 bp, Homo sapiens
gtaaaagctaatt

SEQ ID NO: 2790244 - DNA, 15 bp, Homo sapiens
gtaaaagtgtgagca

SEQ ID NO: 2790245 - DNA, 14 bp, Homo sapiens
gtaaaataaaatta

SEQ ID NO: 2790246 - DNA, 18 bp, Homo sapiens
gtaaaatgcagtccagaa

SEQ ID NO: 2790247 - DNA, 18 bp, Homo sapiens
gtaaacagtgcctgctga

SEQ ID NO: 2790248 - DNA, 23 bp, Homo sapiens
gtaaacataattcttgtatatta

SEQ ID NO: 2790249 - DNA, 23 bp, Homo sapiens
gtaaactcaaaatatttgtacat

SEQ ID NO: 2790250 - DNA, 16 bp, Homo sapiens
gtaaagaataaatgaa

SEQ ID NO: 2790251 - DNA, 18 bp, Homo sapiens
gtaaagtgataatttctg

SEQ ID NO: 2790252 - DNA, 13 bp, Homo sapiens
gtaaatacaaaat

SEQ ID NO: 2790253 - DNA, 20 bp, Homo sapiens
gtaaatacaaaataaaatta

SEQ ID NO: 2790254 - DNA, 22 bp, Homo sapiens
gtaaatacaaaataaaattatg

SEQ ID NO: 2790255 - DNA, 12 bp, Homo sapiens
gtaaatacacca

SEQ ID NO: 2790256 - DNA, 22 bp, Homo sapiens
gtaaatacatgtgtggatgtgt

SEQ ID NO: 2790257 - DNA, 22 bp, Homo sapiens
gtaaatcctttttctttataaa

SEQ ID NO: 2790258 - DNA, 22 bp, Homo sapiens
gtaaatggagcttgtacatatt

SEQ ID NO: 2790259 - DNA, 15 bp, Homo sapiens
gtaaatgtggacaca

SEQ ID NO: 2790260 - DNA, 14 bp, Homo sapiens
gtaaattcctgttg

SEQ ID NO: 2790261 - DNA, 16 bp, Homo sapiens
gtaacaagccagattt

SEQ ID NO: 2790262 - DNA, 17 bp, Homo sapiens
gtaacacaagccacaga

SEQ ID NO: 2790263 - DNA, 20 bp, Homo sapiens
gtaacacaagccacagaagc

SEQ ID NO: 2790264 - DNA, 14 bp, Homo sapiens
gtaacaggtctcct

SEQ ID NO: 2790265 - DNA, 16 bp, Homo sapiens
gtaacaggtctcctct

SEQ ID NO: 2790266 - DNA, 14 bp, Homo sapiens
gtaacatagattta

SEQ ID NO: 2790267 - DNA, 12 bp, Homo sapiens
gtaacatgttta

SEQ ID NO: 2790268 - DNA, 13 bp, Homo sapiens
gtaactcatctgt

SEQ ID NO: 2790269 - DNA, 15 bp, Homo sapiens
gtaactcatctgtca

SEQ ID NO: 2790270 - DNA, 12 bp, Homo sapiens
gtaactccacca

SEQ ID NO: 2790271 - DNA, 15 bp, Homo sapiens
gtaacttttgtaaga

SEQ ID NO: 2790272 - DNA, 11 bp, Homo sapiens
gtaagaagccg

SEQ ID NO: 2790273 - DNA, 15 bp, Homo sapiens
gtaagacaaaggttt

SEQ ID NO: 2790274 - DNA, 16 bp, Homo sapiens
gtaagaccttggtagg

SEQ ID NO: 2790275 - DNA, 13 bp, Homo sapiens
gtaagctctggct

SEQ ID NO: 2790276 - DNA, 20 bp, Homo sapiens
gtaaggtaatttctgtgtat

SEQ ID NO: 2790277 - DNA, 13 bp, Homo sapiens
gtaagtaattatc

SEQ ID NO: 2790278 - DNA, 23 bp, Homo sapiens
gtaagtaattatcgggaacagtg

SEQ ID NO: 2790279 - DNA, 18 bp, Homo sapiens
gtaagtaccactcaggcc

SEQ ID NO: 2790280 - DNA, 22 bp, Homo sapiens
gtaagtggggttgcaaccactg

SEQ ID NO: 2790281 - DNA, 11 bp, Homo sapiens
gtaataaactc

SEQ ID NO: 2790282 - DNA, 13 bp, Homo sapiens
gtaataaactctc

SEQ ID NO: 2790283 - DNA, 14 bp, Homo sapiens
gtaatcaatgtttc

SEQ ID NO: 2790284 - DNA, 15 bp, Homo sapiens
gtaatcccagctact

SEQ ID NO: 2790285 - DNA, 21 bp, Homo sapiens
gtaatcccagctactcaggag

SEQ ID NO: 2790286 - DNA, 16 bp, Homo sapiens
gtaatcccagctactt

SEQ ID NO: 2790287 - DNA, 16 bp, Homo sapiens
gtaatcgttatgtgtg

SEQ ID NO: 2790288 - DNA, 12 bp, Homo sapiens
gtaatgaatatc

SEQ ID NO: 2790289 - DNA, 12 bp, Homo sapiens
gtaatgcacaat

SEQ ID NO: 2790290 - DNA, 14 bp, Homo sapiens
gtaatgcacaattt

SEQ ID NO: 2790291 - DNA, 17 bp, Homo sapiens
gtaatgcacaatttaga

SEQ ID NO: 2790292 - DNA, 12 bp, Homo sapiens
gtataaaaacaa

SEQ ID NO: 2790293 - DNA, 14 bp, Homo sapiens
gtataaagaaaagt

SEQ ID NO: 2790294 - DNA, 17 bp, Homo sapiens
gtataaatatgaaatga

SEQ ID NO: 2790295 - DNA, 13 bp, Homo sapiens
gtataaattgtcg

SEQ ID NO: 2790296 - DNA, 14 bp, Homo sapiens
gtatagatgcaaga

SEQ ID NO: 2790297 - DNA, 18 bp, Homo sapiens
gtatagatgcaagatatt

SEQ ID NO: 2790298 - DNA, 19 bp, Homo sapiens
gtatagtactggcatggta

SEQ ID NO: 2790299 - DNA, 20 bp, Homo sapiens
gtatatagtatatttatact

SEQ ID NO: 2790300 - DNA, 22 bp, Homo sapiens
gtatatagtatatttatactct

SEQ ID NO: 2790301 - DNA, 10 bp, Homo sapiens
gtatatatat

SEQ ID NO: 2790302 - DNA, 21 bp, Homo sapiens
gtatatattctacacatatat

SEQ ID NO: 2790303 - DNA, 17 bp, Homo sapiens
gtatatctggacaagcc

SEQ ID NO: 2790304 - DNA, 16 bp, Homo sapiens
gtatatgtatgtgtgt

SEQ ID NO: 2790305 - DNA, 15 bp, Homo sapiens
gtatatgtctcaggt

SEQ ID NO: 2790306 - DNA, 15 bp, Homo sapiens
gtatattatggtgta

SEQ ID NO: 2790307 - DNA, 13 bp, Homo sapiens
gtatatttatact

SEQ ID NO: 2790308 - DNA, 22 bp, Homo sapiens
gtatcaggtgctgccatccagg

SEQ ID NO: 2790309 - DNA, 12 bp, Homo sapiens
gtatcatagaaa

SEQ ID NO: 2790310 - DNA, 21 bp, Homo sapiens
gtatcattttgcacgtgctct

SEQ ID NO: 2790311 - DNA, 17 bp, Homo sapiens
gtatccaattatgtgac

SEQ ID NO: 2790312 - DNA, 14 bp, Homo sapiens
gtatccactttgca

SEQ ID NO: 2790313 - DNA, 19 bp, Homo sapiens
gtatccactttgcacagct

SEQ ID NO: 2790314 - DNA, 20 bp, Homo sapiens
gtatcctgataaacattaaa

SEQ ID NO: 2790315 - DNA, 18 bp, Homo sapiens
gtatcgctgccttgccat

SEQ ID NO: 2790316 - DNA, 19 bp, Homo sapiens
gtatcgctgccttgccatg

SEQ ID NO: 2790317 - DNA, 15 bp, Homo sapiens
gtatcggagacagtg

SEQ ID NO: 2790318 - DNA, 14 bp, Homo sapiens
gtatctccaggatt

SEQ ID NO: 2790319 - DNA, 22 bp, Homo sapiens
gtatgaacttgaggacacatgt

SEQ ID NO: 2790320 - DNA, 23 bp, Homo sapiens
gtatgaacttgaggacacatgtc

SEQ ID NO: 2790321 - DNA, 19 bp, Homo sapiens
gtatgactctcctctcctg

SEQ ID NO: 2790322 - DNA, 14 bp, Homo sapiens
gtatgagctgaggg

SEQ ID NO: 2790323 - DNA, 22 bp, Homo sapiens
gtatgatcacggctcactgcag

SEQ ID NO: 2790324 - DNA, 16 bp, Homo sapiens
gtatgcttattttaaa

SEQ ID NO: 2790325 - DNA, 17 bp, Homo sapiens
gtatggaatacagtgtt

SEQ ID NO: 2790326 - DNA, 18 bp, Homo sapiens
gtatggaatacagtgtta

SEQ ID NO: 2790327 - DNA, 15 bp, Homo sapiens
gtatgggtgtgtgtt

SEQ ID NO: 2790328 - DNA, 16 bp, Homo sapiens
gtatggtggctgggtt

SEQ ID NO: 2790329 - DNA, 23 bp, Homo sapiens
gtatgtgaaagtgtaaaatagaa

SEQ ID NO: 2790330 - DNA, 17 bp, Homo sapiens
gtatgtgatatctgaac

SEQ ID NO: 2790331 - DNA, 19 bp, Homo sapiens
gtattcagatcgtattaat

SEQ ID NO: 2790332 - DNA, 21 bp, Homo sapiens
gtattgagccattttttaaat

SEQ ID NO: 2790333 - DNA, 13 bp, Homo sapiens
gtatttataaata

SEQ ID NO: 2790334 - DNA, 12 bp, Homo sapiens
gtatttatatat

SEQ ID NO: 2790335 - DNA, 13 bp, Homo sapiens
gtatttatatatt

SEQ ID NO: 2790336 - DNA, 16 bp, Homo sapiens
gtatttatatatttat

SEQ ID NO: 2790337 - DNA, 17 bp, Homo sapiens
gtatttatatatttata

SEQ ID NO: 2790338 - DNA, 13 bp, Homo sapiens
gtatttatattag

SEQ ID NO: 2790339 - DNA, 16 bp, Homo sapiens
gtatttatattagagt

SEQ ID NO: 2790340 - DNA, 15 bp, Homo sapiens
gtatttatatttgga

SEQ ID NO: 2790341 - DNA, 16 bp, Homo sapiens
gtatttatatttggaa

SEQ ID NO: 2790342 - DNA, 19 bp, Homo sapiens
gtatttatatttggaaaga

SEQ ID NO: 2790343 - DNA, 21 bp, Homo sapiens
gtatttatatttggaaagaga

SEQ ID NO: 2790344 - DNA, 23 bp, Homo sapiens
gtatttatatttggaaagagacc

SEQ ID NO: 2790345 - DNA, 13 bp, Homo sapiens
gtatttatcttta

SEQ ID NO: 2790346 - DNA, 17 bp, Homo sapiens
gtatttgttaatttaga

SEQ ID NO: 2790347 - DNA, 15 bp, Homo sapiens
gtattttcgtgcatt

SEQ ID NO: 2790348 - DNA, 21 bp, Homo sapiens
gtattttcttcccatttgtaa

SEQ ID NO: 2790349 - DNA, 22 bp, Homo sapiens
gtattttcttcccatttgtaat

SEQ ID NO: 2790350 - DNA, 15 bp, Homo sapiens
gtcaaacatgaagtg

SEQ ID NO: 2790351 - DNA, 22 bp, Homo sapiens
gtcaaaccgcactcacccatgt

SEQ ID NO: 2790352 - DNA, 18 bp, Homo sapiens
gtcaacagagaaggcagg

SEQ ID NO: 2790353 - DNA, 15 bp, Homo sapiens
gtcaacggccctgtt

SEQ ID NO: 2790354 - DNA, 18 bp, Homo sapiens
gtcaacggccctgtttat

SEQ ID NO: 2790355 - DNA, 18 bp, Homo sapiens
gtcaagagggtctgagga

SEQ ID NO: 2790356 - DNA, 16 bp, Homo sapiens
gtcaagtataaagtca

SEQ ID NO: 2790357 - DNA, 15 bp, Homo sapiens
gtcaatattaaatac

SEQ ID NO: 2790358 - DNA, 18 bp, Homo sapiens
gtcaatattaaatacaga

SEQ ID NO: 2790359 - DNA, 22 bp, Homo sapiens
gtcaatcccctcattcaggaaa

SEQ ID NO: 2790360 - DNA, 21 bp, Homo sapiens
gtcaatgaaatatttgcttat

SEQ ID NO: 2790361 - DNA, 22 bp, Homo sapiens
gtcaatttccctgactcctcta

SEQ ID NO: 2790362 - DNA, 16 bp, Homo sapiens
gtcacacagacacaca

SEQ ID NO: 2790363 - DNA, 21 bp, Homo sapiens
gtcacacagtattacttctgc

SEQ ID NO: 2790364 - DNA, 22 bp, Homo sapiens
gtcacacagtattacttctgct

SEQ ID NO: 2790365 - DNA, 17 bp, Homo sapiens
gtcacaggactctgcct

SEQ ID NO: 2790366 - DNA, 12 bp, Homo sapiens
gtcacaggcagg

SEQ ID NO: 2790367 - DNA, 13 bp, Homo sapiens
gtcacaggcaggt

SEQ ID NO: 2790368 - DNA, 19 bp, Homo sapiens
gtcaccaatgtacccaccg

SEQ ID NO: 2790369 - DNA, 13 bp, Homo sapiens
gtcaccacctctc

SEQ ID NO: 2790370 - DNA, 21 bp, Homo sapiens
gtcacctcagagacatacacc

SEQ ID NO: 2790371 - DNA, 13 bp, Homo sapiens
gtcacgtcttgaa

SEQ ID NO: 2790372 - DNA, 17 bp, Homo sapiens
gtcactactcacagtct

SEQ ID NO: 2790373 - DNA, 22 bp, Homo sapiens
gtcactactcacagtctcttta

SEQ ID NO: 2790374 - DNA, 23 bp, Homo sapiens
gtcactagcagctgcagtcaaca

SEQ ID NO: 2790375 - DNA, 19 bp, Homo sapiens
gtcactcttcctgcaagga

SEQ ID NO: 2790376 - DNA, 16 bp, Homo sapiens
gtcagaacagcagact

SEQ ID NO: 2790377 - DNA, 14 bp, Homo sapiens
gtcagactgctggg

SEQ ID NO: 2790378 - DNA, 16 bp, Homo sapiens
gtcagactgctgggac

SEQ ID NO: 2790379 - DNA, 18 bp, Homo sapiens
gtcagactggctggctgc

SEQ ID NO: 2790380 - DNA, 16 bp, Homo sapiens
gtcagagatgggctga

SEQ ID NO: 2790381 - DNA, 14 bp, Homo sapiens
gtcagagcctgcag

SEQ ID NO: 2790382 - DNA, 14 bp, Homo sapiens
gtcagccagggcca

SEQ ID NO: 2790383 - DNA, 21 bp, Homo sapiens
gtgaaaataggtatacagtgg

SEQ ID NO: 2790384 - DNA, 20 bp, Homo sapiens
gtgaaagtgtaaaatagaat

SEQ ID NO: 2790385 - DNA, 21 bp, Homo sapiens
gtgaaataattaaaaaccact

SEQ ID NO: 2790386 - DNA, 11 bp, Homo sapiens
gtgaaattatg

SEQ ID NO: 2790387 - DNA, 23 bp, Homo sapiens
gtgaaccaaagagactggagcat

SEQ ID NO: 2790388 - DNA, 23 bp, Homo sapiens
gtgaaccaccacacccagcccac

SEQ ID NO: 2790389 - DNA, 15 bp, Homo sapiens
gtgaacccaggacaa

SEQ ID NO: 2790390 - DNA, 17 bp, Homo sapiens
gtgaacccaggacaagc

SEQ ID NO: 2790391 - DNA, 23 bp, Homo sapiens
gtgaagaaaagtgaatgctcaag

SEQ ID NO: 2790392 - DNA, 13 bp, Homo sapiens
gtgaagaaatgga

SEQ ID NO: 2790393 - DNA, 14 bp, Homo sapiens
gtgaagaatacttc

SEQ ID NO: 2790394 - DNA, 17 bp, Homo sapiens
gtgaaggaccctggctc

SEQ ID NO: 2790395 - DNA, 19 bp, Homo sapiens
gtgaaggaccctggctctt

SEQ ID NO: 2790396 - DNA, 16 bp, Homo sapiens
gtgaaggtcttgcctg

SEQ ID NO: 2790397 - DNA, 13 bp, Homo sapiens
gtgaataaaaacc

SEQ ID NO: 2790398 - DNA, 18 bp, Homo sapiens
gtgaataaacttcagcac

SEQ ID NO: 2790399 - DNA, 20 bp, Homo sapiens
gtgaataaagttagtgtgtt

SEQ ID NO: 2790400 - DNA, 14 bp, Homo sapiens
gtgaatcagagcac

SEQ ID NO: 2790401 - DNA, 19 bp, Homo sapiens
gtgaatgtgtgaaggtctt

SEQ ID NO: 2790402 - DNA, 20 bp, Homo sapiens
gtgaattgcctgcagagaga

SEQ ID NO: 2790403 - DNA, 22 bp, Homo sapiens
gtgaattgcctgcagagagaag

SEQ ID NO: 2790404 - DNA, 23 bp, Homo sapiens
gtgaattgcctgcagagagaagc

SEQ ID NO: 2790405 - DNA, 17 bp, Homo sapiens
gtgaatttttttttcct

SEQ ID NO: 2790406 - DNA, 16 bp, Homo sapiens
gtgacaacctttgtgt

SEQ ID NO: 2790407 - DNA, 13 bp, Homo sapiens
gtgacagaggcag

SEQ ID NO: 2790408 - DNA, 14 bp, Homo sapiens
gtgacagaggcagc

SEQ ID NO: 2790409 - DNA, 22 bp, Homo sapiens
gtgacatgggtgtgccaggcta

SEQ ID NO: 2790410 - DNA, 17 bp, Homo sapiens
gtgaccaggcatcctcc

SEQ ID NO: 2790411 - DNA, 20 bp, Homo sapiens
gtgaccaggctcacaactgt

SEQ ID NO: 2790412 - DNA, 13 bp, Homo sapiens
gtgaccccagggc

SEQ ID NO: 2790413 - DNA, 14 bp, Homo sapiens
gtgaccccagggca

SEQ ID NO: 2790414 - DNA, 15 bp, Homo sapiens
gtgaccccagggcac

SEQ ID NO: 2790415 - DNA, 19 bp, Homo sapiens
gtgaccccagggcacagga

SEQ ID NO: 2790416 - DNA, 22 bp, Homo sapiens
gtgaccccagggcacaggagct

SEQ ID NO: 2790417 - DNA, 23 bp, Homo sapiens
gtgaccccagggcacaggagcta

SEQ ID NO: 2790418 - DNA, 14 bp, Homo sapiens
gtgacctctgcctg

SEQ ID NO: 2790419 - DNA, 15 bp, Homo sapiens
gtgacctctgcctga

SEQ ID NO: 2790420 - DNA, 13 bp, Homo sapiens
gtgacctgctgag

SEQ ID NO: 2790421 - DNA, 18 bp, Homo sapiens
gtgacctgctgagctctg

SEQ ID NO: 2790422 - DNA, 20 bp, Homo sapiens
gtgacctgctgagctctgag

SEQ ID NO: 2790423 - DNA, 17 bp, Homo sapiens
gtgactgcgatcttcag

SEQ ID NO: 2790424 - DNA, 19 bp, Homo sapiens
gtgactgtcgtgtttacaa

SEQ ID NO: 2790425 - DNA, 20 bp, Homo sapiens
gtgactgtcgtgtttacaaa

SEQ ID NO: 2790426 - DNA, 23 bp, Homo sapiens
gtgactgtcgtgtttacaaaagg

SEQ ID NO: 2790427 - DNA, 16 bp, Homo sapiens
gtgacttcagctctgt

SEQ ID NO: 2790428 - DNA, 21 bp, Homo sapiens
gtgagaagaaatgacattttg

SEQ ID NO: 2790429 - DNA, 18 bp, Homo sapiens
gtgagaataattgtgtac

SEQ ID NO: 2790430 - DNA, 14 bp, Homo sapiens
gtgagaccacctct

SEQ ID NO: 2790431 - DNA, 16 bp, Homo sapiens
gtgagactctgtctca

SEQ ID NO: 2790432 - DNA, 18 bp, Homo sapiens
gtgagactctgtctcaaa

SEQ ID NO: 2790433 - DNA, 14 bp, Homo sapiens
gtgagactgacacc

SEQ ID NO: 2790434 - DNA, 23 bp, Homo sapiens
gtgagagacattaactcattaga

SEQ ID NO: 2790435 - DNA, 18 bp, Homo sapiens
gtgagcacatctgggagg

SEQ ID NO: 2790436 - DNA, 21 bp, Homo sapiens
gtgagcactaaggtgtgctct

SEQ ID NO: 2790437 - DNA, 17 bp, Homo sapiens
gtgagcagaggagtcca

SEQ ID NO: 2790438 - DNA, 15 bp, Homo sapiens
gtgagccaaagagaa

SEQ ID NO: 2790439 - DNA, 16 bp, Homo sapiens
gtgagccacagaccac

SEQ ID NO: 2790440 - DNA, 20 bp, Homo sapiens
gtgagccacagaccacctgc

SEQ ID NO: 2790441 - DNA, 14 bp, Homo sapiens
gtgagccactgcac

SEQ ID NO: 2790442 - DNA, 18 bp, Homo sapiens
gtgagccgcatcttctcc

SEQ ID NO: 2790443 - DNA, 12 bp, Homo sapiens
gtgaggcagggg

SEQ ID NO: 2790444 - DNA, 14 bp, Homo sapiens
gtgaggcctggcca

SEQ ID NO: 2790445 - DNA, 16 bp, Homo sapiens
gtgaggcctggccagg

SEQ ID NO: 2790446 - DNA, 20 bp, Homo sapiens
gtgaggtgggttttcttccc

SEQ ID NO: 2790447 - DNA, 15 bp, Homo sapiens
gtgagtcgaggacag

SEQ ID NO: 2790448 - DNA, 11 bp, Homo sapiens
gtgataagtgg

SEQ ID NO: 2790449 - DNA, 15 bp, Homo sapiens
gtgataagtggaaaa

SEQ ID NO: 2790450 - DNA, 17 bp, Homo sapiens
gtgatatatgtatttat

SEQ ID NO: 2790451 - DNA, 18 bp, Homo sapiens
gtgatccacccacctcag

SEQ ID NO: 2790452 - DNA, 21 bp, Homo sapiens
gtgatccctagctgtgacctc

SEQ ID NO: 2790453 - DNA, 22 bp, Homo sapiens
gtgatccctagctgtgacctct

SEQ ID NO: 2790454 - DNA, 20 bp, Homo sapiens
gtgatcctcccacctcagcc

SEQ ID NO: 2790455 - DNA, 23 bp, Homo sapiens
gtgatcctcccacctcagcctcc

SEQ ID NO: 2790456 - DNA, 13 bp, Homo sapiens
gtgatctccatat

SEQ ID NO: 2790457 - DNA, 14 bp, Homo sapiens
gtgatgagggcagc

SEQ ID NO: 2790458 - DNA, 18 bp, Homo sapiens
gtgatgagggcagcagcc

SEQ ID NO: 2790459 - DNA, 20 bp, Homo sapiens
gtgatgagggcagcagccag

SEQ ID NO: 2790460 - DNA, 22 bp, Homo sapiens
gtgatgctaaaggttgtattgc

SEQ ID NO: 2790461 - DNA, 21 bp, Homo sapiens
gtgatggggtgggcagggctg

SEQ ID NO: 2790462 - DNA, 20 bp, Homo sapiens
gtgatggtctcacagagcca

SEQ ID NO: 2790463 - DNA, 17 bp, Homo sapiens
gtgattctcctgcctca

SEQ ID NO: 2790464 - DNA, 19 bp, Homo sapiens
gtgattctcctgcctcagc

SEQ ID NO: 2790465 - DNA, 19 bp, Homo sapiens
gtgatttcagagagggcag

SEQ ID NO: 2790466 - DNA, 16 bp, Homo sapiens
gtgattttgtacagaa

SEQ ID NO: 2790467 - DNA, 21 bp, Homo sapiens
gtgattttgtacagaattttt

SEQ ID NO: 2790468 - DNA, 17 bp, Homo sapiens
gtgcaatgagccagatg

SEQ ID NO: 2790469 - DNA, 13 bp, Homo sapiens
gtgcacacttgta

SEQ ID NO: 2790470 - DNA, 18 bp, Homo sapiens
gtgcacctgtactcagga

SEQ ID NO: 2790471 - DNA, 21 bp, Homo sapiens
gtgcacctgtactcaggaggc

SEQ ID NO: 2790472 - DNA, 16 bp, Homo sapiens
gtgcactggccccacc

SEQ ID NO: 2790473 - DNA, 12 bp, Homo sapiens
gttaatttaaag

SEQ ID NO: 2790474 - DNA, 21 bp, Homo sapiens
gttacagcgagaggcagagaa

SEQ ID NO: 2790475 - DNA, 20 bp, Homo sapiens
gttacccagtaactcatctg

SEQ ID NO: 2790476 - DNA, 23 bp, Homo sapiens
gttacgcacacgtacttaaatga

SEQ ID NO: 2790477 - DNA, 17 bp, Homo sapiens
gttactcagccctgggc

SEQ ID NO: 2790478 - DNA, 17 bp, Homo sapiens
gttacttacctaaacag

SEQ ID NO: 2790479 - DNA, 13 bp, Homo sapiens
gttacttcctatc

SEQ ID NO: 2790480 - DNA, 19 bp, Homo sapiens
gttacttgaaataccagtg

SEQ ID NO: 2790481 - DNA, 19 bp, Homo sapiens
gttagaaatgcagaatcct

SEQ ID NO: 2790482 - DNA, 21 bp, Homo sapiens
gttaggaaataaaacctttca

SEQ ID NO: 2790483 - DNA, 15 bp, Homo sapiens
gttaggagttcgaga

SEQ ID NO: 2790484 - DNA, 17 bp, Homo sapiens
gttaggggaaaatagta

SEQ ID NO: 2790485 - DNA, 23 bp, Homo sapiens
gttagggtgctctggaagagagg

SEQ ID NO: 2790486 - DNA, 17 bp, Homo sapiens
gttataaatcaatgtca

SEQ ID NO: 2790487 - DNA, 18 bp, Homo sapiens
gttataaatcaatgtcac

SEQ ID NO: 2790488 - DNA, 19 bp, Homo sapiens
gttatactgtcggtttttt

SEQ ID NO: 2790489 - DNA, 16 bp, Homo sapiens
gttatcagttaacatt

SEQ ID NO: 2790490 - DNA, 15 bp, Homo sapiens
gttatctaagttaat

SEQ ID NO: 2790491 - DNA, 17 bp, Homo sapiens
gttatgaaaacagatgc

SEQ ID NO: 2790492 - DNA, 22 bp, Homo sapiens
gttatgtgaatgatctctctga

SEQ ID NO: 2790493 - DNA, 10 bp, Homo sapiens
gttatttaaa

SEQ ID NO: 2790494 - DNA, 13 bp, Homo sapiens
gttatttaaagaa

SEQ ID NO: 2790495 - DNA, 11 bp, Homo sapiens
gttatttaaat

SEQ ID NO: 2790496 - DNA, 13 bp, Homo sapiens
gttatttaaatga

SEQ ID NO: 2790497 - DNA, 15 bp, Homo sapiens
gttatttaaatgagt

SEQ ID NO: 2790498 - DNA, 14 bp, Homo sapiens
gttatttatatatt

SEQ ID NO: 2790499 - DNA, 19 bp, Homo sapiens
gttattttaggagacagtc

SEQ ID NO: 2790500 - DNA, 23 bp, Homo sapiens
gttatttttatatcagcctgagt

SEQ ID NO: 2790501 - DNA, 21 bp, Homo sapiens
gttattttttaattattattt

SEQ ID NO: 2790502 - DNA, 19 bp, Homo sapiens
gttcaagcgattcttctgc

SEQ ID NO: 2790503 - DNA, 16 bp, Homo sapiens
gttcaattctcatttg

SEQ ID NO: 2790504 - DNA, 15 bp, Homo sapiens
gttcacgcaacttga

SEQ ID NO: 2790505 - DNA, 17 bp, Homo sapiens
gttcagagactcagggc

SEQ ID NO: 2790506 - DNA, 22 bp, Homo sapiens
gttcagagactcagggccccag

SEQ ID NO: 2790507 - DNA, 14 bp, Homo sapiens
gttcagcccctcct

SEQ ID NO: 2790508 - DNA, 15 bp, Homo sapiens
gttcagcccctcctc

SEQ ID NO: 2790509 - DNA, 18 bp, Homo sapiens
gttcagcccctcctctgc

SEQ ID NO: 2790510 - DNA, 15 bp, Homo sapiens
gttcagctccagctc

SEQ ID NO: 2790511 - DNA, 13 bp, Homo sapiens
gttcaggagctga

SEQ ID NO: 2790512 - DNA, 15 bp, Homo sapiens
gttcaggagtcccaa

SEQ ID NO: 2790513 - DNA, 21 bp, Homo sapiens
gttcaggagtcccaaggaaag

SEQ ID NO: 2790514 - DNA, 18 bp, Homo sapiens
gttcagggttggcccctg

SEQ ID NO: 2790515 - DNA, 22 bp, Homo sapiens
gttcatagggtctcttcaggtt

SEQ ID NO: 2790516 - DNA, 22 bp, Homo sapiens
gttcatatgtaccatgtacatg

SEQ ID NO: 2790517 - DNA, 20 bp, Homo sapiens
gttcatctatggcagtccag

SEQ ID NO: 2790518 - DNA, 22 bp, Homo sapiens
gttcatggcagatgtaggaggg

SEQ ID NO: 2790519 - DNA, 18 bp, Homo sapiens
gttcattaaattttctat

SEQ ID NO: 2790520 - DNA, 19 bp, Homo sapiens
gttcattaaattttctatg

SEQ ID NO: 2790521 - DNA, 14 bp, Homo sapiens
gttccaacagacag

SEQ ID NO: 2790522 - DNA, 14 bp, Homo sapiens
gttccatgcctgag

SEQ ID NO: 2790523 - DNA, 15 bp, Homo sapiens
gttccatgcctgagg

SEQ ID NO: 2790524 - DNA, 18 bp, Homo sapiens
gttcccaataaaagtgac

SEQ ID NO: 2790525 - DNA, 18 bp, Homo sapiens
gttccctgaacatctgtg

SEQ ID NO: 2790526 - DNA, 21 bp, Homo sapiens
gttcctcaccaataacttcag

SEQ ID NO: 2790527 - DNA, 15 bp, Homo sapiens
gttcctcgccctggg

SEQ ID NO: 2790528 - DNA, 16 bp, Homo sapiens
gttcctcgccctgggt

SEQ ID NO: 2790529 - DNA, 13 bp, Homo sapiens
gttcctggctttg

SEQ ID NO: 2790530 - DNA, 17 bp, Homo sapiens
gttcgagaccagcctgg

SEQ ID NO: 2790531 - DNA, 13 bp, Homo sapiens
gttcgcagccacc

SEQ ID NO: 2790532 - DNA, 15 bp, Homo sapiens
gttcgcagccaccct

SEQ ID NO: 2790533 - DNA, 17 bp, Homo sapiens
gttcgcagccaccctga

SEQ ID NO: 2790534 - DNA, 18 bp, Homo sapiens
gttctaatatttttagct

SEQ ID NO: 2790535 - DNA, 15 bp, Homo sapiens
gttctagagaagagg

SEQ ID NO: 2790536 - DNA, 23 bp, Homo sapiens
gttctagagaagaggctggtgct

SEQ ID NO: 2790537 - DNA, 23 bp, Homo sapiens
gttctagtctcctttgcactgag

SEQ ID NO: 2790538 - DNA, 14 bp, Homo sapiens
gttctcaaatgcta

SEQ ID NO: 2790539 - DNA, 13 bp, Homo sapiens
gttctctccagga

SEQ ID NO: 2790540 - DNA, 16 bp, Homo sapiens
gttctctgaggacact

SEQ ID NO: 2790541 - DNA, 15 bp, Homo sapiens
gttctgaataatttc

SEQ ID NO: 2790542 - DNA, 13 bp, Homo sapiens
gttctgctcctct

SEQ ID NO: 2790543 - DNA, 15 bp, Homo sapiens
gttctgctcctctcc

SEQ ID NO: 2790544 - DNA, 16 bp, Homo sapiens
gttctgctcctctcca

SEQ ID NO: 2790545 - DNA, 13 bp, Homo sapiens
gttctggagctgc

SEQ ID NO: 2790546 - DNA, 12 bp, Homo sapiens
gttctgggacac

SEQ ID NO: 2790547 - DNA, 12 bp, Homo sapiens
gttctgtatttt

SEQ ID NO: 2790548 - DNA, 14 bp, Homo sapiens
gttcttcgaggtgg

SEQ ID NO: 2790549 - DNA, 19 bp, Homo sapiens
gttctttaggtgcctcctg

SEQ ID NO: 2790550 - DNA, 14 bp, Homo sapiens
gttctttcttcctc

SEQ ID NO: 2790551 - DNA, 17 bp, Homo sapiens
gttctttcttcctctgc

SEQ ID NO: 2790552 - DNA, 19 bp, Homo sapiens
gttctttcttcctctgctg

SEQ ID NO: 2790553 - DNA, 18 bp, Homo sapiens
gttctttggaaggagtga

SEQ ID NO: 2790554 - DNA, 13 bp, Homo sapiens
gttcttttaaagg

SEQ ID NO: 2790555 - DNA, 14 bp, Homo sapiens
gttcttttactgta

SEQ ID NO: 2790556 - DNA, 22 bp, Homo sapiens
gttctttttaaaaagttgcaca

SEQ ID NO: 2790557 - DNA, 22 bp, Homo sapiens
gttgaaaatgagcctgtaatcc

SEQ ID NO: 2790558 - DNA, 15 bp, Homo sapiens
gttgaaagagtccta

SEQ ID NO: 2790559 - DNA, 19 bp, Homo sapiens
gttgaacatctcactttgc

SEQ ID NO: 2790560 - DNA, 18 bp, Homo sapiens
gttgaagcaaatcgaatg

SEQ ID NO: 2790561 - DNA, 23 bp, Homo sapiens
gttgaagcaaatcgaatgaaatt

SEQ ID NO: 2790562 - DNA, 16 bp, Homo sapiens
gttgaatggcctgcct

SEQ ID NO: 2790563 - DNA, 19 bp, Homo sapiens
gttgagggaacagacagga

SEQ ID NO: 2790564 - DNA, 16 bp, Homo sapiens
taaaccagcagaaaag

SEQ ID NO: 2790565 - DNA, 20 bp, Homo sapiens
taaaccagcagaaaagtgct

SEQ ID NO: 2790566 - DNA, 13 bp, Homo sapiens
taaaccttttttg

SEQ ID NO: 2790567 - DNA, 22 bp, Homo sapiens
taaacgtgatgatcagctgttt

SEQ ID NO: 2790568 - DNA, 20 bp, Homo sapiens
taaactatcttggtgaattt

SEQ ID NO: 2790569 - DNA, 21 bp, Homo sapiens
taaactatcttggtgaatttt

SEQ ID NO: 2790570 - DNA, 22 bp, Homo sapiens
taaactatcttggtgaattttt

SEQ ID NO: 2790571 - DNA, 22 bp, Homo sapiens
taaactggggagttataaaaat

SEQ ID NO: 2790572 - DNA, 13 bp, Homo sapiens
taaactgtgtgca

SEQ ID NO: 2790573 - DNA, 16 bp, Homo sapiens
taaacttcagcaccat

SEQ ID NO: 2790574 - DNA, 20 bp, Homo sapiens
taaacttcatggtcatgggt

SEQ ID NO: 2790575 - DNA, 15 bp, Homo sapiens
taaagaaaaacaaac

SEQ ID NO: 2790576 - DNA, 19 bp, Homo sapiens
taaagaacaccctatattt

SEQ ID NO: 2790577 - DNA, 18 bp, Homo sapiens
taaagaggcgtcttgtat

SEQ ID NO: 2790578 - DNA, 14 bp, Homo sapiens
taaagatggctatt

SEQ ID NO: 2790579 - DNA, 20 bp, Homo sapiens
taaagattttttaataattt

SEQ ID NO: 2790580 - DNA, 21 bp, Homo sapiens
taaagattttttaataattta

SEQ ID NO: 2790581 - DNA, 13 bp, Homo sapiens
taaagcagtggac

SEQ ID NO: 2790582 - DNA, 13 bp, Homo sapiens
taaagcagtgttt

SEQ ID NO: 2790583 - DNA, 15 bp, Homo sapiens
taaagcgtttgcaca

SEQ ID NO: 2790584 - DNA, 18 bp, Homo sapiens
taaagctggacaagaagc

SEQ ID NO: 2790585 - DNA, 22 bp, Homo sapiens
taaagctggacaagaagctgct

SEQ ID NO: 2790586 - DNA, 14 bp, Homo sapiens
taaaggaaggaaaa

SEQ ID NO: 2790587 - DNA, 17 bp, Homo sapiens
taaaggagaaggcatga

SEQ ID NO: 2790588 - DNA, 20 bp, Homo sapiens
taaaggagttaagagtagca

SEQ ID NO: 2790589 - DNA, 22 bp, Homo sapiens
taaaggcttttggcagcaaagt

SEQ ID NO: 2790590 - DNA, 22 bp, Homo sapiens
taaaggtatttagaatatatta

SEQ ID NO: 2790591 - DNA, 22 bp, Homo sapiens
taaaggtggtatgtgtgtgtat

SEQ ID NO: 2790592 - DNA, 20 bp, Homo sapiens
taaaggttgacaataaatgt

SEQ ID NO: 2790593 - DNA, 14 bp, Homo sapiens
taaagtacctgtag

SEQ ID NO: 2790594 - DNA, 16 bp, Homo sapiens
taaagtgataatttct

SEQ ID NO: 2790595 - DNA, 18 bp, Homo sapiens
taaagttcaacatgttat

SEQ ID NO: 2790596 - DNA, 14 bp, Homo sapiens
taaagtttaaaaaa

SEQ ID NO: 2790597 - DNA, 13 bp, Homo sapiens
taaataaaccctt

SEQ ID NO: 2790598 - DNA, 11 bp, Homo sapiens
taaataaatgc

SEQ ID NO: 2790599 - DNA, 16 bp, Homo sapiens
taaataaatgtcatta

SEQ ID NO: 2790600 - DNA, 14 bp, Homo sapiens
taaataaattcaaa

SEQ ID NO: 2790601 - DNA, 18 bp, Homo sapiens
taaatacaaaataaaatt

SEQ ID NO: 2790602 - DNA, 23 bp, Homo sapiens
taaatacaaaataaaattatggt

SEQ ID NO: 2790603 - DNA, 23 bp, Homo sapiens
taaatacaccacctcactcctgt

SEQ ID NO: 2790604 - DNA, 14 bp, Homo sapiens
taaatacagacact

SEQ ID NO: 2790605 - DNA, 16 bp, Homo sapiens
taaatacagacactaa

SEQ ID NO: 2790606 - DNA, 18 bp, Homo sapiens
taaatacagacactaagt

SEQ ID NO: 2790607 - DNA, 19 bp, Homo sapiens
taaatacagacactaagtt

SEQ ID NO: 2790608 - DNA, 22 bp, Homo sapiens
taaatacagacactaagttata

SEQ ID NO: 2790609 - DNA, 18 bp, Homo sapiens
taaatagttcagtataaa

SEQ ID NO: 2790610 - DNA, 21 bp, Homo sapiens
taaatataattgggattttaa

SEQ ID NO: 2790611 - DNA, 22 bp, Homo sapiens
taaatatatttaagataattat

SEQ ID NO: 2790612 - DNA, 15 bp, Homo sapiens
taaatatgaacaaag

SEQ ID NO: 2790613 - DNA, 11 bp, Homo sapiens
taaatatttac

SEQ ID NO: 2790614 - DNA, 18 bp, Homo sapiens
taaatatttacatatgaa

SEQ ID NO: 2790615 - DNA, 21 bp, Homo sapiens
taaatatttacatatgaaatt

SEQ ID NO: 2790616 - DNA, 17 bp, Homo sapiens
taaatattttaaagaat

SEQ ID NO: 2790617 - DNA, 18 bp, Homo sapiens
taaatattttaaagaatt

SEQ ID NO: 2790618 - DNA, 19 bp, Homo sapiens
taaatcaaaagctgcttga

SEQ ID NO: 2790619 - DNA, 21 bp, Homo sapiens
taaatcacgctttttgaaaaa

SEQ ID NO: 2790620 - DNA, 11 bp, Homo sapiens
taaatcactga

SEQ ID NO: 2790621 - DNA, 17 bp, Homo sapiens
taaatcactgaggcatt

SEQ ID NO: 2790622 - DNA, 17 bp, Homo sapiens
taaatcctttttcttta

SEQ ID NO: 2790623 - DNA, 13 bp, Homo sapiens
taaatcttttata

SEQ ID NO: 2790624 - DNA, 17 bp, Homo sapiens
taaatgaatcttactcc

SEQ ID NO: 2790625 - DNA, 12 bp, Homo sapiens
taaatgaatgtt

SEQ ID NO: 2790626 - DNA, 16 bp, Homo sapiens
taaatgcaaacactgt

SEQ ID NO: 2790627 - DNA, 17 bp, Homo sapiens
taaatgcaaacactgtg

SEQ ID NO: 2790628 - DNA, 11 bp, Homo sapiens
taaatgcaata

SEQ ID NO: 2790629 - DNA, 14 bp, Homo sapiens
taaatgcaatatgt

SEQ ID NO: 2790630 - DNA, 22 bp, Homo sapiens
taaatgcagcgaaccaatattt

SEQ ID NO: 2790631 - DNA, 16 bp, Homo sapiens
taaatgcataaatgca

SEQ ID NO: 2790632 - DNA, 14 bp, Homo sapiens
taaatgcatgattt

SEQ ID NO: 2790633 - DNA, 22 bp, Homo sapiens
taaatgcatgattttatacata

SEQ ID NO: 2790634 - DNA, 17 bp, Homo sapiens
taaatgctttatgcaaa

SEQ ID NO: 2790635 - DNA, 21 bp, Homo sapiens
taaatgctttgtgtgattgaa

SEQ ID NO: 2790636 - DNA, 16 bp, Homo sapiens
taaatggagcttgtac

SEQ ID NO: 2790637 - DNA, 19 bp, Homo sapiens
taaatgtatcttattcaca

SEQ ID NO: 2790638 - DNA, 12 bp, Homo sapiens
taaatgtctgtt

SEQ ID NO: 2790639 - DNA, 17 bp, Homo sapiens
taaatgtgtaaatgtgg

SEQ ID NO: 2790640 - DNA, 21 bp, Homo sapiens
taaattatgtttgtactagtt

SEQ ID NO: 2790641 - DNA, 20 bp, Homo sapiens
taaattcaaccactgtaaaa

SEQ ID NO: 2790642 - DNA, 23 bp, Homo sapiens
taaattcaaccactgtaaaatga

SEQ ID NO: 2790643 - DNA, 23 bp, Homo sapiens
taaattcagatatatttttcaca

SEQ ID NO: 2790644 - DNA, 14 bp, Homo sapiens
taaattccactgga

SEQ ID NO: 2790645 - DNA, 16 bp, Homo sapiens
taaattgcttattcta

SEQ ID NO: 2790646 - DNA, 16 bp, Homo sapiens
taaattggtgataagt

SEQ ID NO: 2790647 - DNA, 20 bp, Homo sapiens
taaattggtgataagtggaa

SEQ ID NO: 2790648 - DNA, 23 bp, Homo sapiens
taaattggtgataagtggaaaaa

SEQ ID NO: 2790649 - DNA, 15 bp, Homo sapiens
taaatttatttcaaa

SEQ ID NO: 2790650 - DNA, 15 bp, Homo sapiens
taacaaaacaagaaa

SEQ ID NO: 2790651 - DNA, 22 bp, Homo sapiens
taacaatgtatgtgaaagtgta

SEQ ID NO: 2790652 - DNA, 17 bp, Homo sapiens
taacacaagccacagaa

SEQ ID NO: 2790653 - DNA, 22 bp, Homo sapiens
taacacattatcgggagcagtg

SEQ ID NO: 2790654 - DNA, 14 bp, Homo sapiens
taacactacttaaa

SEQ ID NO: 2790655 - DNA, 16 bp, Homo sapiens
taacactataaaggtt

SEQ ID NO: 2790656 - DNA, 21 bp, Homo sapiens
taacactcagaagcctggggg

SEQ ID NO: 2790657 - DNA, 17 bp, Homo sapiens
taacagatacagctcgg

SEQ ID NO: 2790658 - DNA, 22 bp, Homo sapiens
taacaggctcaatattcctgaa

SEQ ID NO: 2790659 - DNA, 16 bp, Homo sapiens
taacagggaaggcagg

SEQ ID NO: 2790660 - DNA, 19 bp, Homo sapiens
taacagggaaggcaggcag

SEQ ID NO: 2790661 - DNA, 20 bp, Homo sapiens
taacagggaaggcaggcagg

SEQ ID NO: 2790662 - DNA, 22 bp, Homo sapiens
taacagggagactgcatctcaa

SEQ ID NO: 2790663 - DNA, 16 bp, Homo sapiens
taacaggtctcctctt

SEQ ID NO: 2790664 - DNA, 19 bp, Homo sapiens
taacaggtctcctcttaaa

SEQ ID NO: 2790665 - DNA, 23 bp, Homo sapiens
taacatcctttctattgaaaaat

SEQ ID NO: 2790666 - DNA, 21 bp, Homo sapiens
taacatctattataaaaccat

SEQ ID NO: 2790667 - DNA, 13 bp, Homo sapiens
taacatctgagaa

SEQ ID NO: 2790668 - DNA, 15 bp, Homo sapiens
taacatgtatcccaa

SEQ ID NO: 2790669 - DNA, 15 bp, Homo sapiens
taacattaacatcta

SEQ ID NO: 2790670 - DNA, 16 bp, Homo sapiens
taacattaattctact

SEQ ID NO: 2790671 - DNA, 14 bp, Homo sapiens
taacattgatttat

SEQ ID NO: 2790672 - DNA, 17 bp, Homo sapiens
taacatttatctaaaag

SEQ ID NO: 2790673 - DNA, 13 bp, Homo sapiens
taaccacggaaaa

SEQ ID NO: 2790674 - DNA, 22 bp, Homo sapiens
taaccatcagttactggtttca

SEQ ID NO: 2790675 - DNA, 13 bp, Homo sapiens
taaccccagctcc

SEQ ID NO: 2790676 - DNA, 19 bp, Homo sapiens
taaccccagctccctagga

SEQ ID NO: 2790677 - DNA, 21 bp, Homo sapiens
taacccccagtgccacagaga

SEQ ID NO: 2790678 - DNA, 14 bp, Homo sapiens
taaccgtttttcaa

SEQ ID NO: 2790679 - DNA, 15 bp, Homo sapiens
taaccgtttttcaag

SEQ ID NO: 2790680 - DNA, 18 bp, Homo sapiens
taaccgtttttcaagaaa

SEQ ID NO: 2790681 - DNA, 14 bp, Homo sapiens
taacgcctgagccc

SEQ ID NO: 2790682 - DNA, 13 bp, Homo sapiens
taacggctccagg

SEQ ID NO: 2790683 - DNA, 14 bp, Homo sapiens
taactaaattaaca

SEQ ID NO: 2790684 - DNA, 15 bp, Homo sapiens
taactaatttaaacc

SEQ ID NO: 2790685 - DNA, 20 bp, Homo sapiens
taactaatttaaaccagcag

SEQ ID NO: 2790686 - DNA, 23 bp, Homo sapiens
taactaatttaaaccagcagaaa

SEQ ID NO: 2790687 - DNA, 15 bp, Homo sapiens
taactagaatttatt

SEQ ID NO: 2790688 - DNA, 17 bp, Homo sapiens
taactagaatttattca

SEQ ID NO: 2790689 - DNA, 17 bp, Homo sapiens
taactagtgttgcttgg

SEQ ID NO: 2790690 - DNA, 14 bp, Homo sapiens
taactcaatatttt

SEQ ID NO: 2790691 - DNA, 22 bp, Homo sapiens
taactcaatattttccatgaaa

SEQ ID NO: 2790692 - DNA, 14 bp, Homo sapiens
taactcatcataaa

SEQ ID NO: 2790693 - DNA, 15 bp, Homo sapiens
taactcatcataaaa

SEQ ID NO: 2790694 - DNA, 17 bp, Homo sapiens
taactcatcataaaata

SEQ ID NO: 2790695 - DNA, 15 bp, Homo sapiens
taactcatctgtcac

SEQ ID NO: 2790696 - DNA, 16 bp, Homo sapiens
taactcattagactgg

SEQ ID NO: 2790697 - DNA, 11 bp, Homo sapiens
taactccacca

SEQ ID NO: 2790698 - DNA, 22 bp, Homo sapiens
taactctaattcccattttgca

SEQ ID NO: 2790699 - DNA, 20 bp, Homo sapiens
taactgaaaattatttaaac

SEQ ID NO: 2790700 - DNA, 15 bp, Homo sapiens
taactgaaggagaag

SEQ ID NO: 2790701 - DNA, 17 bp, Homo sapiens
taactgggggaaaagat

SEQ ID NO: 2790702 - DNA, 17 bp, Homo sapiens
taactgggtaatgaaac

SEQ ID NO: 2790703 - DNA, 19 bp, Homo sapiens
taactgggtaatgaaacaa

SEQ ID NO: 2790704 - DNA, 20 bp, Homo sapiens
taactgggtaatgaaacaaa

SEQ ID NO: 2790705 - DNA, 17 bp, Homo sapiens
taactgtgtgaagaaat

SEQ ID NO: 2790706 - DNA, 18 bp, Homo sapiens
taactgtgtgaagaaatg

SEQ ID NO: 2790707 - DNA, 19 bp, Homo sapiens
taactgtgtgaagaaatgg

SEQ ID NO: 2790708 - DNA, 16 bp, Homo sapiens
taacttaaaatatttt

SEQ ID NO: 2790709 - DNA, 23 bp, Homo sapiens
taacttatatcatcagcatacct

SEQ ID NO: 2790710 - DNA, 19 bp, Homo sapiens
taacttcagagaagtcagt

SEQ ID NO: 2790711 - DNA, 21 bp, Homo sapiens
taacttgtatattccaccatt

SEQ ID NO: 2790712 - DNA, 23 bp, Homo sapiens
taactttcattaaagcatttact

SEQ ID NO: 2790713 - DNA, 21 bp, Homo sapiens
taagaaacttttttatttaaa

SEQ ID NO: 2790714 - DNA, 14 bp, Homo sapiens
taagaagcaaataa

SEQ ID NO: 2790715 - DNA, 19 bp, Homo sapiens
taagaccataacagccaac

SEQ ID NO: 2790716 - DNA, 20 bp, Homo sapiens
taagacttcagtcctggtct

SEQ ID NO: 2790717 - DNA, 21 bp, Homo sapiens
taagacttcagtcctggtctg

SEQ ID NO: 2790718 - DNA, 17 bp, Homo sapiens
taagacttgacagtgga

SEQ ID NO: 2790719 - DNA, 12 bp, Homo sapiens
taagagaagtag

SEQ ID NO: 2790720 - DNA, 21 bp, Homo sapiens
taagagttagtttctttggga

SEQ ID NO: 2790721 - DNA, 14 bp, Homo sapiens
taagataatgatga

SEQ ID NO: 2790722 - DNA, 17 bp, Homo sapiens
taagatctatagcctct

SEQ ID NO: 2790723 - DNA, 13 bp, Homo sapiens
taagattagaatg

SEQ ID NO: 2790724 - DNA, 18 bp, Homo sapiens
taagattagaatgaaaat

SEQ ID NO: 2790725 - DNA, 14 bp, Homo sapiens
taagattgtacata

SEQ ID NO: 2790726 - DNA, 18 bp, Homo sapiens
taagattgtacatatgga

SEQ ID NO: 2790727 - DNA, 23 bp, Homo sapiens
taagcaaagggagcactgggttg

SEQ ID NO: 2790728 - DNA, 14 bp, Homo sapiens
taagcaagaaggca

SEQ ID NO: 2790729 - DNA, 21 bp, Homo sapiens
taagcagatttaacaattcca

SEQ ID NO: 2790730 - DNA, 16 bp, Homo sapiens
taagccctgtcgagac

SEQ ID NO: 2790731 - DNA, 17 bp, Homo sapiens
taagcctccatttagtt

SEQ ID NO: 2790732 - DNA, 20 bp, Homo sapiens
taagcctccatttagttctt

SEQ ID NO: 2790733 - DNA, 15 bp, Homo sapiens
taagcctttccataa

SEQ ID NO: 2790734 - DNA, 16 bp, Homo sapiens
taagcctttccataag

SEQ ID NO: 2790735 - DNA, 13 bp, Homo sapiens
taagctctggctt

SEQ ID NO: 2790736 - DNA, 17 bp, Homo sapiens
taaggaaaaaaagacaa

SEQ ID NO: 2790737 - DNA, 13 bp, Homo sapiens
taaggaactggaa

SEQ ID NO: 2790738 - DNA, 14 bp, Homo sapiens
taaggaactggaac

SEQ ID NO: 2790739 - DNA, 19 bp, Homo sapiens
taaggaatgtagctggttt

SEQ ID NO: 2790740 - DNA, 14 bp, Homo sapiens
taaggacacactaa

SEQ ID NO: 2790741 - DNA, 16 bp, Homo sapiens
taaggagggacaagaa

SEQ ID NO: 2790742 - DNA, 16 bp, Homo sapiens
taaggatctctcagga

SEQ ID NO: 2790743 - DNA, 19 bp, Homo sapiens
taaggatggagccagctct

SEQ ID NO: 2790744 - DNA, 17 bp, Homo sapiens
taaggctccttcatgtg

SEQ ID NO: 2790745 - DNA, 16 bp, Homo sapiens
tacctttcccatgctg

SEQ ID NO: 2790746 - DNA, 13 bp, Homo sapiens
tacgctctccttt

SEQ ID NO: 2790747 - DNA, 19 bp, Homo sapiens
tacgctctcctttctttct

SEQ ID NO: 2790748 - DNA, 13 bp, Homo sapiens
tacgtatgagacg

SEQ ID NO: 2790749 - DNA, 14 bp, Homo sapiens
tacgtctgacaggc

SEQ ID NO: 2790750 - DNA, 15 bp, Homo sapiens
tacgtctgacaggca

SEQ ID NO: 2790751 - DNA, 12 bp, Homo sapiens
tactaaaagaat

SEQ ID NO: 2790752 - DNA, 13 bp, Homo sapiens
tactaaagcagtg

SEQ ID NO: 2790753 - DNA, 13 bp, Homo sapiens
tactacaaaattt

SEQ ID NO: 2790754 - DNA, 18 bp, Homo sapiens
tactacaaaatttgaaat

SEQ ID NO: 2790755 - DNA, 18 bp, Homo sapiens
tactactagatgtcttta

SEQ ID NO: 2790756 - DNA, 15 bp, Homo sapiens
tactactattctgtt

SEQ ID NO: 2790757 - DNA, 22 bp, Homo sapiens
tactactattctgttaaaatca

SEQ ID NO: 2790758 - DNA, 17 bp, Homo sapiens
tactagaatttgtattt

SEQ ID NO: 2790759 - DNA, 18 bp, Homo sapiens
tactagaatttgtatttt

SEQ ID NO: 2790760 - DNA, 14 bp, Homo sapiens
tactattttacttc

SEQ ID NO: 2790761 - DNA, 18 bp, Homo sapiens
tactattttacttctaga

SEQ ID NO: 2790762 - DNA, 19 bp, Homo sapiens
tactcaagaggctgaggca

SEQ ID NO: 2790763 - DNA, 14 bp, Homo sapiens
tactcacacaggca

SEQ ID NO: 2790764 - DNA, 17 bp, Homo sapiens
tactcagaagcctgagg

SEQ ID NO: 2790765 - DNA, 23 bp, Homo sapiens
tactcagcagccctcctcacccc

SEQ ID NO: 2790766 - DNA, 13 bp, Homo sapiens
tactcagccctgg

SEQ ID NO: 2790767 - DNA, 15 bp, Homo sapiens
tactcaggaggctga

SEQ ID NO: 2790768 - DNA, 16 bp, Homo sapiens
tactcatttttcatga

SEQ ID NO: 2790769 - DNA, 19 bp, Homo sapiens
tactccagtggtgaagaaa

SEQ ID NO: 2790770 - DNA, 18 bp, Homo sapiens
tactccatacataacttg

SEQ ID NO: 2790771 - DNA, 14 bp, Homo sapiens
tactcctacctcag

SEQ ID NO: 2790772 - DNA, 16 bp, Homo sapiens
tactcctacctcagcc

SEQ ID NO: 2790773 - DNA, 17 bp, Homo sapiens
tactcctacctcagcct

SEQ ID NO: 2790774 - DNA, 18 bp, Homo sapiens
tactcctgtgggagcctc

SEQ ID NO: 2790775 - DNA, 22 bp, Homo sapiens
tactctagaacatgcacattta

SEQ ID NO: 2790776 - DNA, 18 bp, Homo sapiens
tactctccaacctggaca

SEQ ID NO: 2790777 - DNA, 15 bp, Homo sapiens
tactctgtgccagag

SEQ ID NO: 2790778 - DNA, 17 bp, Homo sapiens
tactctgtgccagagcc

SEQ ID NO: 2790779 - DNA, 18 bp, Homo sapiens
tactctgtgccagagcct

SEQ ID NO: 2790780 - DNA, 20 bp, Homo sapiens
tactctgtgccagagcctgg

SEQ ID NO: 2790781 - DNA, 22 bp, Homo sapiens
tactctgtgccagagcctgggg

SEQ ID NO: 2790782 - DNA, 21 bp, Homo sapiens
tactcttcagaatatggacaa

SEQ ID NO: 2790783 - DNA, 23 bp, Homo sapiens
tactgacactttgccagaaagca

SEQ ID NO: 2790784 - DNA, 14 bp, Homo sapiens
tactgacagaaatg

SEQ ID NO: 2790785 - DNA, 18 bp, Homo sapiens
tactgagccttgtaattc

SEQ ID NO: 2790786 - DNA, 23 bp, Homo sapiens
tactgagccttgtaattctaaat

SEQ ID NO: 2790787 - DNA, 19 bp, Homo sapiens
tactgagcggacagaatga

SEQ ID NO: 2790788 - DNA, 16 bp, Homo sapiens
tactgataaagaaaga

SEQ ID NO: 2790789 - DNA, 21 bp, Homo sapiens
tactgcccaggcctgcctgtt

SEQ ID NO: 2790790 - DNA, 14 bp, Homo sapiens
tactgctgcaaagt

SEQ ID NO: 2790791 - DNA, 15 bp, Homo sapiens
tactgctgtcattgt

SEQ ID NO: 2790792 - DNA, 23 bp, Homo sapiens
tactgctgtcattgtccatgcct

SEQ ID NO: 2790793 - DNA, 17 bp, Homo sapiens
tactgctttcaacttaa

SEQ ID NO: 2790794 - DNA, 21 bp, Homo sapiens
tactgctttcaacttaaatca

SEQ ID NO: 2790795 - DNA, 23 bp, Homo sapiens
tactggaagttttgcatttatgg

SEQ ID NO: 2790796 - DNA, 18 bp, Homo sapiens
tactggtcttgtggaatt

SEQ ID NO: 2790797 - DNA, 22 bp, Homo sapiens
tactgtgtacagaattctgcta

SEQ ID NO: 2790798 - DNA, 16 bp, Homo sapiens
tactgttttgtatcaa

SEQ ID NO: 2790799 - DNA, 12 bp, Homo sapiens
tacttaactgtg

SEQ ID NO: 2790800 - DNA, 19 bp, Homo sapiens
tacttaataaattcagata

SEQ ID NO: 2790801 - DNA, 16 bp, Homo sapiens
tacttacctaaacaga

SEQ ID NO: 2790802 - DNA, 22 bp, Homo sapiens
tacttacctaaacagatataaa

SEQ ID NO: 2790803 - DNA, 15 bp, Homo sapiens
tacttattttccaat

SEQ ID NO: 2790804 - DNA, 17 bp, Homo sapiens
tacttatttttgacagt

SEQ ID NO: 2790805 - DNA, 19 bp, Homo sapiens
tacttatttttgacagtgt

SEQ ID NO: 2790806 - DNA, 20 bp, Homo sapiens
tacttatttttgacagtgtt

SEQ ID NO: 2790807 - DNA, 23 bp, Homo sapiens
tacttcaagttaaagtgaataac

SEQ ID NO: 2790808 - DNA, 22 bp, Homo sapiens
tacttcactttaattctcatgt

SEQ ID NO: 2790809 - DNA, 16 bp, Homo sapiens
tacttcattttcagag

SEQ ID NO: 2790810 - DNA, 20 bp, Homo sapiens
tacttcggggctgggaagtc

SEQ ID NO: 2790811 - DNA, 20 bp, Homo sapiens
tacttctccaccctgctctc

SEQ ID NO: 2790812 - DNA, 14 bp, Homo sapiens
tacttgcacaagct

SEQ ID NO: 2790813 - DNA, 19 bp, Homo sapiens
tacttggtgtaattaataa

SEQ ID NO: 2790814 - DNA, 19 bp, Homo sapiens
tacttgtggacacagctct

SEQ ID NO: 2790815 - DNA, 16 bp, Homo sapiens
tactttttatactcca

SEQ ID NO: 2790816 - DNA, 20 bp, Homo sapiens
tactttttatactccataca

SEQ ID NO: 2790817 - DNA, 16 bp, Homo sapiens
tagaaaacattcatcc

SEQ ID NO: 2790818 - DNA, 21 bp, Homo sapiens
tagaaaaggctaggtacacag

SEQ ID NO: 2790819 - DNA, 19 bp, Homo sapiens
tagaaaatgcaaaatgaaa

SEQ ID NO: 2790820 - DNA, 23 bp, Homo sapiens
tagaaacatggttttgaaatgct

SEQ ID NO: 2790821 - DNA, 21 bp, Homo sapiens
tagaaagaagcccaatattat

SEQ ID NO: 2790822 - DNA, 23 bp, Homo sapiens
tagaaagaagcccaatattataa

SEQ ID NO: 2790823 - DNA, 21 bp, Homo sapiens
tagaaagctctgcatgtgtgt

SEQ ID NO: 2790824 - DNA, 11 bp, Homo sapiens
tagaaatcata

SEQ ID NO: 2790825 - DNA, 23 bp, Homo sapiens
tagaacctaattcaattcaaagc

SEQ ID NO: 2790826 - DNA, 22 bp, Homo sapiens
tagaagaacatccaaggagaaa

SEQ ID NO: 2790827 - DNA, 17 bp, Homo sapiens
tagaagagcctgactgt

SEQ ID NO: 2790828 - DNA, 22 bp, Homo sapiens
tagaagcggtttccaggccacc

SEQ ID NO: 2790829 - DNA, 20 bp, Homo sapiens
tagaagtaggaagtgaaaat

SEQ ID NO: 2790830 - DNA, 15 bp, Homo sapiens
tagaagtcacacagt

SEQ ID NO: 2790831 - DNA, 21 bp, Homo sapiens
tagaagtccaggcagagacaa

SEQ ID NO: 2790832 - DNA, 18 bp, Homo sapiens
tagaagtggaccaggaca

SEQ ID NO: 2790833 - DNA, 19 bp, Homo sapiens
tagaagtgggccaggacag

SEQ ID NO: 2790834 - DNA, 20 bp, Homo sapiens
tagaagtgggccaggacagg

SEQ ID NO: 2790835 - DNA, 13 bp, Homo sapiens
tagttttaaatat

SEQ ID NO: 2790836 - DNA, 16 bp, Homo sapiens
tagttttaaatatgaa

SEQ ID NO: 2790837 - DNA, 11 bp, Homo sapiens
tataaaaacaa

SEQ ID NO: 2790838 - DNA, 19 bp, Homo sapiens
tataaaatctagatcaatt

SEQ ID NO: 2790839 - DNA, 23 bp, Homo sapiens
tataaacattaaaagaagactgg

SEQ ID NO: 2790840 - DNA, 15 bp, Homo sapiens
tataaactagatctc

SEQ ID NO: 2790841 - DNA, 14 bp, Homo sapiens
tataaacttgtgta

SEQ ID NO: 2790842 - DNA, 17 bp, Homo sapiens
tataaagatggctgact

SEQ ID NO: 2790843 - DNA, 20 bp, Homo sapiens
tataaatatatatttttcaa

SEQ ID NO: 2790844 - DNA, 16 bp, Homo sapiens
tataaatatgaaatga

SEQ ID NO: 2790845 - DNA, 16 bp, Homo sapiens
tataaatcaatgtcac

SEQ ID NO: 2790846 - DNA, 14 bp, Homo sapiens
tataaatgcatgat

SEQ ID NO: 2790847 - DNA, 15 bp, Homo sapiens
tataaatgcatgatt

SEQ ID NO: 2790848 - DNA, 19 bp, Homo sapiens
tataaatgcatgattttat

SEQ ID NO: 2790849 - DNA, 14 bp, Homo sapiens
tataaatgtgtggt

SEQ ID NO: 2790850 - DNA, 19 bp, Homo sapiens
tataacaaggttcttctaa

SEQ ID NO: 2790851 - DNA, 22 bp, Homo sapiens
tataacaaggttcttctaaaat

SEQ ID NO: 2790852 - DNA, 16 bp, Homo sapiens
tataaccagacacata

SEQ ID NO: 2790853 - DNA, 22 bp, Homo sapiens
tataaccatcagttactggttt

SEQ ID NO: 2790854 - DNA, 17 bp, Homo sapiens
tataactcatcataaaa

SEQ ID NO: 2790855 - DNA, 21 bp, Homo sapiens
tataactcatcataaaataaa

SEQ ID NO: 2790856 - DNA, 17 bp, Homo sapiens
tataactgcatagtaat

SEQ ID NO: 2790857 - DNA, 19 bp, Homo sapiens
tataacttaaaaaaatgac

SEQ ID NO: 2790858 - DNA, 20 bp, Homo sapiens
tataatatactatatttatg

SEQ ID NO: 2790859 - DNA, 22 bp, Homo sapiens
tataatatttttaattaaataa

SEQ ID NO: 2790860 - DNA, 22 bp, Homo sapiens
tataatggaaacatttacaata

SEQ ID NO: 2790861 - DNA, 15 bp, Homo sapiens
tataatggttgactg

SEQ ID NO: 2790862 - DNA, 16 bp, Homo sapiens
tataatggtttactgc

SEQ ID NO: 2790863 - DNA, 20 bp, Homo sapiens
tataatggtttactgctgtc

SEQ ID NO: 2790864 - DNA, 21 bp, Homo sapiens
tataatggtttactgctgtca

SEQ ID NO: 2790865 - DNA, 19 bp, Homo sapiens
tataatgtggatttcctat

SEQ ID NO: 2790866 - DNA, 19 bp, Homo sapiens
tataattatcggaagcagt

SEQ ID NO: 2790867 - DNA, 18 bp, Homo sapiens
tataattgttttatctga

SEQ ID NO: 2790868 - DNA, 11 bp, Homo sapiens
tataatttaat

SEQ ID NO: 2790869 - DNA, 16 bp, Homo sapiens
tataatttaatgcatg

SEQ ID NO: 2790870 - DNA, 20 bp, Homo sapiens
tataatttttttattactga

SEQ ID NO: 2790871 - DNA, 17 bp, Homo sapiens
tatacaaaataatttaa

SEQ ID NO: 2790872 - DNA, 20 bp, Homo sapiens
tatacaaaataatttaacta

SEQ ID NO: 2790873 - DNA, 15 bp, Homo sapiens
tatacaataacataa

SEQ ID NO: 2790874 - DNA, 16 bp, Homo sapiens
tatacatagtcacaaa

SEQ ID NO: 2790875 - DNA, 19 bp, Homo sapiens
tatacatatcagaaaagta

SEQ ID NO: 2790876 - DNA, 23 bp, Homo sapiens
tatacatatcagaaaagtagaat

SEQ ID NO: 2790877 - DNA, 11 bp, Homo sapiens
tatacatatta

SEQ ID NO: 2790878 - DNA, 22 bp, Homo sapiens
tatacatattataaataaatgc

SEQ ID NO: 2790879 - DNA, 23 bp, Homo sapiens
tatacatattataaataaatgcc

SEQ ID NO: 2790880 - DNA, 16 bp, Homo sapiens
tatacatgtatagtga

SEQ ID NO: 2790881 - DNA, 16 bp, Homo sapiens
tatacattctttatct

SEQ ID NO: 2790882 - DNA, 13 bp, Homo sapiens
tatacatttctgt

SEQ ID NO: 2790883 - DNA, 12 bp, Homo sapiens
tatacctgtgtt

SEQ ID NO: 2790884 - DNA, 22 bp, Homo sapiens
tatacctgtgtttcttgcctca

SEQ ID NO: 2790885 - DNA, 23 bp, Homo sapiens
tatacctgtgtttcttgcctcat

SEQ ID NO: 2790886 - DNA, 23 bp, Homo sapiens
tatagagaaaaactttcattttt

SEQ ID NO: 2790887 - DNA, 22 bp, Homo sapiens
tatagatgcaagatatttatat

SEQ ID NO: 2790888 - DNA, 18 bp, Homo sapiens
tatagccaaaaatagcta

SEQ ID NO: 2790889 - DNA, 22 bp, Homo sapiens
tatagccaaaaatagctaaata

SEQ ID NO: 2790890 - DNA, 18 bp, Homo sapiens
tatagcctaggtgacaga

SEQ ID NO: 2790891 - DNA, 20 bp, Homo sapiens
tatagcctaggtgacagagt

SEQ ID NO: 2790892 - DNA, 17 bp, Homo sapiens
tatagctatcatttctt

SEQ ID NO: 2790893 - DNA, 20 bp, Homo sapiens
tatagctcttctatttaaaa

SEQ ID NO: 2790894 - DNA, 22 bp, Homo sapiens
tatagctcttctatttaaaaaa

SEQ ID NO: 2790895 - DNA, 15 bp, Homo sapiens
tataggatcatttgt

SEQ ID NO: 2790896 - DNA, 22 bp, Homo sapiens
tatagtaactactttttatact

SEQ ID NO: 2790897 - DNA, 20 bp, Homo sapiens
tatagtagtcaattagtaca

SEQ ID NO: 2790898 - DNA, 15 bp, Homo sapiens
tatagtatatttata

SEQ ID NO: 2790899 - DNA, 20 bp, Homo sapiens
tatagtcccagctactcaga

SEQ ID NO: 2790900 - DNA, 11 bp, Homo sapiens
tatataaatat

SEQ ID NO: 2790901 - DNA, 18 bp, Homo sapiens
tatataatggtttactgc

SEQ ID NO: 2790902 - DNA, 12 bp, Homo sapiens
tatatacatatt

SEQ ID NO: 2790903 - DNA, 18 bp, Homo sapiens
tatatacatattataaat

SEQ ID NO: 2790904 - DNA, 19 bp, Homo sapiens
tatatacatattataaata

SEQ ID NO: 2790905 - DNA, 16 bp, Homo sapiens
tatatacatgtatagt

SEQ ID NO: 2790906 - DNA, 14 bp, Homo sapiens
tatatagtatattt

SEQ ID NO: 2790907 - DNA, 18 bp, Homo sapiens
tatatagtatatttatac

SEQ ID NO: 2790908 - DNA, 17 bp, Homo sapiens
tatatagtttactattt

SEQ ID NO: 2790909 - DNA, 14 bp, Homo sapiens
tatatatacatgta

SEQ ID NO: 2790910 - DNA, 12 bp, Homo sapiens
tatatatagaat

SEQ ID NO: 2790911 - DNA, 14 bp, Homo sapiens
tatatatatatgta

SEQ ID NO: 2790912 - DNA, 16 bp, Homo sapiens
tatatatatatgtata

SEQ ID NO: 2790913 - DNA, 14 bp, Homo sapiens
tatatatatgtata

SEQ ID NO: 2790914 - DNA, 16 bp, Homo sapiens
tatatatgaagtaagt

SEQ ID NO: 2790915 - DNA, 13 bp, Homo sapiens
tatatatgtacag

SEQ ID NO: 2790916 - DNA, 15 bp, Homo sapiens
tatatatgtatatgt

SEQ ID NO: 2790917 - DNA, 20 bp, Homo sapiens
tatatatttttcaaccagca

SEQ ID NO: 2790918 - DNA, 15 bp, Homo sapiens
tatatcagcctgagt

SEQ ID NO: 2790919 - DNA, 13 bp, Homo sapiens
tatatcataaagt

SEQ ID NO: 2790920 - DNA, 13 bp, Homo sapiens
tatatctaattta

SEQ ID NO: 2790921 - DNA, 15 bp, Homo sapiens
tatatctaatttata

SEQ ID NO: 2790922 - DNA, 17 bp, Homo sapiens
tatatctaatttataca

SEQ ID NO: 2790923 - DNA, 14 bp, Homo sapiens
tatatctatagtag

SEQ ID NO: 2790924 - DNA, 19 bp, Homo sapiens
tatatctatagtagtcaat

SEQ ID NO: 2790925 - DNA, 17 bp, Homo sapiens
tatatctatatctctaa

SEQ ID NO: 2790926 - DNA, 13 bp, Homo sapiens
tatttttatttgt

SEQ ID NO: 2790927 - DNA, 18 bp, Homo sapiens
tatttttcaaccagcatt

SEQ ID NO: 2790928 - DNA, 17 bp, Homo sapiens
tatttttgtagagccag

SEQ ID NO: 2790929 - DNA, 15 bp, Homo sapiens
tattttttaattatt

SEQ ID NO: 2790930 - DNA, 15 bp, Homo sapiens
tattttttatttcca

SEQ ID NO: 2790931 - DNA, 14 bp, Homo sapiens
tattttttctacac

SEQ ID NO: 2790932 - DNA, 20 bp, Homo sapiens
tcaaaaaaagggcaataaat

SEQ ID NO: 2790933 - DNA, 23 bp, Homo sapiens
tcaaaaagtctacgctctccttt

SEQ ID NO: 2790934 - DNA, 19 bp, Homo sapiens
tcaaaaattacactacaag

SEQ ID NO: 2790935 - DNA, 15 bp, Homo sapiens
tcaaaacagagatgt

SEQ ID NO: 2790936 - DNA, 14 bp, Homo sapiens
tcaaaacagattgt

SEQ ID NO: 2790937 - DNA, 18 bp, Homo sapiens
tcaaaacatatcaattca

SEQ ID NO: 2790938 - DNA, 12 bp, Homo sapiens
tcaaaagctgct

SEQ ID NO: 2790939 - DNA, 21 bp, Homo sapiens
tcaaacaccaacataaaaatg

SEQ ID NO: 2790940 - DNA, 22 bp, Homo sapiens
tcaaacatgaagtgtgtttcct

SEQ ID NO: 2790941 - DNA, 15 bp, Homo sapiens
tcaaaccataaactt

SEQ ID NO: 2790942 - DNA, 20 bp, Homo sapiens
tcaaaccatttaattcataa

SEQ ID NO: 2790943 - DNA, 21 bp, Homo sapiens
tcaaaccatttaattcataat

SEQ ID NO: 2790944 - DNA, 16 bp, Homo sapiens
tcaaactgaagccaga

SEQ ID NO: 2790945 - DNA, 15 bp, Homo sapiens
tcaaactgctccaag

SEQ ID NO: 2790946 - DNA, 22 bp, Homo sapiens
tcaaactttactctaagtctcc

SEQ ID NO: 2790947 - DNA, 21 bp, Homo sapiens
tcaaagaagtcatggcccaaa

SEQ ID NO: 2790948 - DNA, 19 bp, Homo sapiens
tcaaagcaagcattcagaa

SEQ ID NO: 2790949 - DNA, 22 bp, Homo sapiens
tcaaagcaagcattcagaagaa

SEQ ID NO: 2790950 - DNA, 14 bp, Homo sapiens
tcaaagtttaataa

SEQ ID NO: 2790951 - DNA, 16 bp, Homo sapiens
tcaaatgacccaaaga

SEQ ID NO: 2790952 - DNA, 21 bp, Homo sapiens
tcaaatgacccaaagaccaat

SEQ ID NO: 2790953 - DNA, 16 bp, Homo sapiens
tcaaattctcaaccta

SEQ ID NO: 2790954 - DNA, 20 bp, Homo sapiens
tcaaattttgcattgtgtga

SEQ ID NO: 2790955 - DNA, 16 bp, Homo sapiens
tcaacaaagaaatatt

SEQ ID NO: 2790956 - DNA, 21 bp, Homo sapiens
tcaacacattacttgcacaag

SEQ ID NO: 2790957 - DNA, 19 bp, Homo sapiens
tcaacagagaaggcaggaa

SEQ ID NO: 2790958 - DNA, 13 bp, Homo sapiens
tcaacatatcatt

SEQ ID NO: 2790959 - DNA, 15 bp, Homo sapiens
tcaaccaatgtagaa

SEQ ID NO: 2790960 - DNA, 13 bp, Homo sapiens
tcaaccactgtgg

SEQ ID NO: 2790961 - DNA, 21 bp, Homo sapiens
tcaaccagcattttactactt

SEQ ID NO: 2790962 - DNA, 20 bp, Homo sapiens
tcaaccccaccacttctttt

SEQ ID NO: 2790963 - DNA, 12 bp, Homo sapiens
tcaaccctcagc

SEQ ID NO: 2790964 - DNA, 19 bp, Homo sapiens
tcaacctaagcaacagaaa

SEQ ID NO: 2790965 - DNA, 20 bp, Homo sapiens
tcaacctaccaccccttcct

SEQ ID NO: 2790966 - DNA, 15 bp, Homo sapiens
tcaacctgtgtctta

SEQ ID NO: 2790967 - DNA, 14 bp, Homo sapiens
tcaacggccctgtt

SEQ ID NO: 2790968 - DNA, 18 bp, Homo sapiens
tcaactgaccagcctcca

SEQ ID NO: 2790969 - DNA, 15 bp, Homo sapiens
tcaacttaaatcact

SEQ ID NO: 2790970 - DNA, 17 bp, Homo sapiens
tcaagaaactgaggaat

SEQ ID NO: 2790971 - DNA, 22 bp, Homo sapiens
tcaagaaactgaggaattttct

SEQ ID NO: 2790972 - DNA, 21 bp, Homo sapiens
tcaagaaagcttcaaactgca

SEQ ID NO: 2790973 - DNA, 18 bp, Homo sapiens
tcaagagaagaaaaaatt

SEQ ID NO: 2790974 - DNA, 14 bp, Homo sapiens
tcaagagagagtca

SEQ ID NO: 2790975 - DNA, 17 bp, Homo sapiens
tcaagagggtctgagga

SEQ ID NO: 2790976 - DNA, 20 bp, Homo sapiens
tcaagatgtcctccttgttc

SEQ ID NO: 2790977 - DNA, 22 bp, Homo sapiens
tcaagattatattataataatg

SEQ ID NO: 2790978 - DNA, 17 bp, Homo sapiens
tcaagcaccctgttccc

SEQ ID NO: 2790979 - DNA, 19 bp, Homo sapiens
tcaagcaccctgttccctc

SEQ ID NO: 2790980 - DNA, 14 bp, Homo sapiens
tcaagcctgcctag

SEQ ID NO: 2790981 - DNA, 15 bp, Homo sapiens
tcaagcctgtgaata

SEQ ID NO: 2790982 - DNA, 18 bp, Homo sapiens
tcaagctagaaggccaca

SEQ ID NO: 2790983 - DNA, 20 bp, Homo sapiens
tcaagctagaaggccacatg

SEQ ID NO: 2790984 - DNA, 18 bp, Homo sapiens
tcaaggagatataaaatc

SEQ ID NO: 2790985 - DNA, 16 bp, Homo sapiens
tcaaggcccggcccca

SEQ ID NO: 2790986 - DNA, 21 bp, Homo sapiens
tcaagtataaagtcaggacct

SEQ ID NO: 2790987 - DNA, 23 bp, Homo sapiens
tcaagtataaagtcaggacctgg

SEQ ID NO: 2790988 - DNA, 17 bp, Homo sapiens
tcaagtgatatatgtat

SEQ ID NO: 2790989 - DNA, 17 bp, Homo sapiens
tcaagtgattctcctgc

SEQ ID NO: 2790990 - DNA, 21 bp, Homo sapiens
tcaagtgattctcctgcctca

SEQ ID NO: 2790991 - DNA, 16 bp, Homo sapiens
tcaagtttttacaaaa

SEQ ID NO: 2790992 - DNA, 16 bp, Homo sapiens
tcaataaaatcatgta

SEQ ID NO: 2790993 - DNA, 21 bp, Homo sapiens
tcaataaaatcatgtacattt

SEQ ID NO: 2790994 - DNA, 13 bp, Homo sapiens
tcaataaagtatc

SEQ ID NO: 2790995 - DNA, 15 bp, Homo sapiens
tcaataaatgtctgt

SEQ ID NO: 2790996 - DNA, 19 bp, Homo sapiens
tcaatagtaaaagataaca

SEQ ID NO: 2790997 - DNA, 14 bp, Homo sapiens
tcaatattaaatac

SEQ ID NO: 2790998 - DNA, 15 bp, Homo sapiens
tcaatattaaataca

SEQ ID NO: 2790999 - DNA, 16 bp, Homo sapiens
tcaatattcaataaag

SEQ ID NO: 2791000 - DNA, 13 bp, Homo sapiens
tcaatatttatta

SEQ ID NO: 2791001 - DNA, 16 bp, Homo sapiens
tcaatattttccatga

SEQ ID NO: 2791002 - DNA, 18 bp, Homo sapiens
tcaatattttccatgaaa

SEQ ID NO: 2791003 - DNA, 22 bp, Homo sapiens
tcaatcagtctcagaatgtcat

SEQ ID NO: 2791004 - DNA, 16 bp, Homo sapiens
tcaatgaaatatttgc

SEQ ID NO: 2791005 - DNA, 17 bp, Homo sapiens
tcaatgaaatatttgct

SEQ ID NO: 2791006 - DNA, 18 bp, Homo sapiens
tcaatgaaatatttgctt

SEQ ID NO: 2791007 - DNA, 23 bp, Homo sapiens
tcaatgaaatatttgcttattta

SEQ ID NO: 2791008 - DNA, 19 bp, Homo sapiens
tcaatgcttttctagcaac

SEQ ID NO: 2791009 - DNA, 17 bp, Homo sapiens
tcaatggtttgcaagga

SEQ ID NO: 2791010 - DNA, 15 bp, Homo sapiens
tcaatgtgaatcaga

SEQ ID NO: 2791011 - DNA, 20 bp, Homo sapiens
tcaatgttcacgcaacttga

SEQ ID NO: 2791012 - DNA, 14 bp, Homo sapiens
tcaattaaatgtag

SEQ ID NO: 2791013 - DNA, 15 bp, Homo sapiens
tcaattagtacagta

SEQ ID NO: 2791014 - DNA, 17 bp, Homo sapiens
tcaattcaaagctgtgt

SEQ ID NO: 2791015 - DNA, 23 bp, Homo sapiens
tcaattcaacacattacttgcac

SEQ ID NO: 2791016 - DNA, 14 bp, Homo sapiens
tcagcggggacagc

SEQ ID NO: 2791017 - DNA, 19 bp, Homo sapiens
tcagcggggacagctcctt

SEQ ID NO: 2791018 - DNA, 22 bp, Homo sapiens
tcagctccagctcaccagcccc

SEQ ID NO: 2791019 - DNA, 16 bp, Homo sapiens
tcagctgtttgtcata

SEQ ID NO: 2791020 - DNA, 17 bp, Homo sapiens
tcagcttcagactttta

SEQ ID NO: 2791021 - DNA, 14 bp, Homo sapiens
tcaggaaaaggcct

SEQ ID NO: 2791022 - DNA, 17 bp, Homo sapiens
tcaggaaaaggcctggg

SEQ ID NO: 2791023 - DNA, 18 bp, Homo sapiens
tcaggaaaattgaatgca

SEQ ID NO: 2791024 - DNA, 20 bp, Homo sapiens
tcaggaagatgaaagaggag

SEQ ID NO: 2791025 - DNA, 19 bp, Homo sapiens
tcaggaatcggaatcctgt

SEQ ID NO: 2791026 - DNA, 18 bp, Homo sapiens
tcaggacacaggcctgtg

SEQ ID NO: 2791027 - DNA, 12 bp, Homo sapiens
tcaggacactaa

SEQ ID NO: 2791028 - DNA, 15 bp, Homo sapiens
tcaggagaggggcag

SEQ ID NO: 2791029 - DNA, 17 bp, Homo sapiens
tcaggagaggggcagaa

SEQ ID NO: 2791030 - DNA, 18 bp, Homo sapiens
tcaggagaggggcagaac

SEQ ID NO: 2791031 - DNA, 13 bp, Homo sapiens
tcaggaggctgag

SEQ ID NO: 2791032 - DNA, 18 bp, Homo sapiens
tcaggaggctgaggcaga

SEQ ID NO: 2791033 - DNA, 22 bp, Homo sapiens
tcaggaggctgaggcagaagaa

SEQ ID NO: 2791034 - DNA, 19 bp, Homo sapiens
tcaggagtcccaaggaaag

SEQ ID NO: 2791035 - DNA, 20 bp, Homo sapiens
tcaggagtcccaaggaaagc

SEQ ID NO: 2791036 - DNA, 14 bp, Homo sapiens
tcaggagttcgaga

SEQ ID NO: 2791037 - DNA, 23 bp, Homo sapiens
tcaggagttcgagaccagcccag

SEQ ID NO: 2791038 - DNA, 18 bp, Homo sapiens
tcaggatactctgtcaga

SEQ ID NO: 2791039 - DNA, 16 bp, Homo sapiens
tcaggccaggtgcagt

SEQ ID NO: 2791040 - DNA, 18 bp, Homo sapiens
tcaggcggggtgctgtgg

SEQ ID NO: 2791041 - DNA, 11 bp, Homo sapiens
tcaggctccat

SEQ ID NO: 2791042 - DNA, 20 bp, Homo sapiens
tcaggctccattaggatttg

SEQ ID NO: 2791043 - DNA, 14 bp, Homo sapiens
tcaggcttccttgg

SEQ ID NO: 2791044 - DNA, 23 bp, Homo sapiens
tcaggcttccttggcatcacagg

SEQ ID NO: 2791045 - DNA, 23 bp, Homo sapiens
tcagggacagagacacctgcacc

SEQ ID NO: 2791046 - DNA, 22 bp, Homo sapiens
tcagggcgacctgcacgcactg

SEQ ID NO: 2791047 - DNA, 13 bp, Homo sapiens
tcagggtgggcca

SEQ ID NO: 2791048 - DNA, 17 bp, Homo sapiens
tcagggttggcccctgc

SEQ ID NO: 2791049 - DNA, 23 bp, Homo sapiens
tcagggttggcccctgcccggct

SEQ ID NO: 2791050 - DNA, 16 bp, Homo sapiens
tcaggtaacaggcaga

SEQ ID NO: 2791051 - DNA, 22 bp, Homo sapiens
tcaggtaacaggcagatacagg

SEQ ID NO: 2791052 - DNA, 14 bp, Homo sapiens
tcaggtggggcagc

SEQ ID NO: 2791053 - DNA, 18 bp, Homo sapiens
tcaggtggggcagcttga

SEQ ID NO: 2791054 - DNA, 18 bp, Homo sapiens
tcaggttcttagtgtcac

SEQ ID NO: 2791055 - DNA, 14 bp, Homo sapiens
tcagtaatttgagg

SEQ ID NO: 2791056 - DNA, 15 bp, Homo sapiens
tcagtccatagcaga

SEQ ID NO: 2791057 - DNA, 19 bp, Homo sapiens
tcagtctcagaatgtcatt

SEQ ID NO: 2791058 - DNA, 21 bp, Homo sapiens
tcagtctgattcccaagctct

SEQ ID NO: 2791059 - DNA, 14 bp, Homo sapiens
tcagtctgggtgtc

SEQ ID NO: 2791060 - DNA, 15 bp, Homo sapiens
tcagtgacagagttc

SEQ ID NO: 2791061 - DNA, 13 bp, Homo sapiens
tcagtgcccacca

SEQ ID NO: 2791062 - DNA, 15 bp, Homo sapiens
tcagtgctcggcagt

SEQ ID NO: 2791063 - DNA, 15 bp, Homo sapiens
tcagtgctgtggcct

SEQ ID NO: 2791064 - DNA, 11 bp, Homo sapiens
tcagtggcagc

SEQ ID NO: 2791065 - DNA, 12 bp, Homo sapiens
tcagtggcagct

SEQ ID NO: 2791066 - DNA, 21 bp, Homo sapiens
tcagtgtatggaaataaatgt

SEQ ID NO: 2791067 - DNA, 20 bp, Homo sapiens
tcagtgttccctttcctact

SEQ ID NO: 2791068 - DNA, 14 bp, Homo sapiens
tcagttactcagcc

SEQ ID NO: 2791069 - DNA, 15 bp, Homo sapiens
tcagttactcagccc

SEQ ID NO: 2791070 - DNA, 12 bp, Homo sapiens
tcagttggagaa

SEQ ID NO: 2791071 - DNA, 22 bp, Homo sapiens
tcagttggagaaaatgaagaaa

SEQ ID NO: 2791072 - DNA, 14 bp, Homo sapiens
tcagttggctgact

SEQ ID NO: 2791073 - DNA, 10 bp, Homo sapiens
tcagtttctc

SEQ ID NO: 2791074 - DNA, 19 bp, Homo sapiens
tcagttttatcattttcaa

SEQ ID NO: 2791075 - DNA, 13 bp, Homo sapiens
tcataattagaac

SEQ ID NO: 2791076 - DNA, 14 bp, Homo sapiens
tcataattagaaca

SEQ ID NO: 2791077 - DNA, 15 bp, Homo sapiens
tcataattagaacaa

SEQ ID NO: 2791078 - DNA, 16 bp, Homo sapiens
tcataattagaacaat

SEQ ID NO: 2791079 - DNA, 22 bp, Homo sapiens
tcatactggggtgcgagagagg

SEQ ID NO: 2791080 - DNA, 13 bp, Homo sapiens
tcatagaaatgta

SEQ ID NO: 2791081 - DNA, 17 bp, Homo sapiens
tcatagggtctcttcag

SEQ ID NO: 2791082 - DNA, 15 bp, Homo sapiens
tcatagtatggtggc

SEQ ID NO: 2791083 - DNA, 13 bp, Homo sapiens
tcatataaagtat

SEQ ID NO: 2791084 - DNA, 18 bp, Homo sapiens
tcatataaagtatcatca

SEQ ID NO: 2791085 - DNA, 14 bp, Homo sapiens
tcatatatatctat

SEQ ID NO: 2791086 - DNA, 21 bp, Homo sapiens
tcatatgtaccatgtacatga

SEQ ID NO: 2791087 - DNA, 14 bp, Homo sapiens
tcatattgtatgta

SEQ ID NO: 2791088 - DNA, 16 bp, Homo sapiens
tcatcaacaaagaaat

SEQ ID NO: 2791089 - DNA, 13 bp, Homo sapiens
tcatcaattaaag

SEQ ID NO: 2791090 - DNA, 16 bp, Homo sapiens
tcatcaatttttatac

SEQ ID NO: 2791091 - DNA, 17 bp, Homo sapiens
tcatcaatttttataca

SEQ ID NO: 2791092 - DNA, 20 bp, Homo sapiens
tcatcaatttttatacatat

SEQ ID NO: 2791093 - DNA, 13 bp, Homo sapiens
tcatcataaaata

SEQ ID NO: 2791094 - DNA, 14 bp, Homo sapiens
tcatcataaaataa

SEQ ID NO: 2791095 - DNA, 19 bp, Homo sapiens
tcatcataaaataaagtat

SEQ ID NO: 2791096 - DNA, 15 bp, Homo sapiens
tcatcatacatgact

SEQ ID NO: 2791097 - DNA, 14 bp, Homo sapiens
tcatcattccttga

SEQ ID NO: 2791098 - DNA, 19 bp, Homo sapiens
tcatccactgtgccatgtg

SEQ ID NO: 2791099 - DNA, 12 bp, Homo sapiens
tcatcccgctcc

SEQ ID NO: 2791100 - DNA, 15 bp, Homo sapiens
tcatccgaggcaggg

SEQ ID NO: 2791101 - DNA, 11 bp, Homo sapiens
tcatctatttc

SEQ ID NO: 2791102 - DNA, 15 bp, Homo sapiens
tcatctatttctgag

SEQ ID NO: 2791103 - DNA, 14 bp, Homo sapiens
tcatctcatttaag

SEQ ID NO: 2791104 - DNA, 22 bp, Homo sapiens
tcatctcatttaagggaaaaat

SEQ ID NO: 2791105 - DNA, 23 bp, Homo sapiens
tcatctcatttaagggaaaaata

SEQ ID NO: 2791106 - DNA, 16 bp, Homo sapiens
tcatctctctttaata

SEQ ID NO: 2791107 - DNA, 20 bp, Homo sapiens
tccatgaagaccacatccac

SEQ ID NO: 2791108 - DNA, 23 bp, Homo sapiens
tccatgaagaccacatccacaca

SEQ ID NO: 2791109 - DNA, 20 bp, Homo sapiens
tccatgattttacagagaat

SEQ ID NO: 2791110 - DNA, 18 bp, Homo sapiens
tccatgcctacagataat

SEQ ID NO: 2791111 - DNA, 14 bp, Homo sapiens
tccatgcctgaggg

SEQ ID NO: 2791112 - DNA, 15 bp, Homo sapiens
tccatgtagcaggac

SEQ ID NO: 2791113 - DNA, 18 bp, Homo sapiens
tccatgtcgcctctgcat

SEQ ID NO: 2791114 - DNA, 19 bp, Homo sapiens
tccatgtcgcctctgcatt

SEQ ID NO: 2791115 - DNA, 22 bp, Homo sapiens
tccattaacttagcatgtgttg

SEQ ID NO: 2791116 - DNA, 14 bp, Homo sapiens
tccatttagttctt

SEQ ID NO: 2791117 - DNA, 15 bp, Homo sapiens
tccatttccagttca

SEQ ID NO: 2791118 - DNA, 20 bp, Homo sapiens
tccatttcgcccctcattta

SEQ ID NO: 2791119 - DNA, 22 bp, Homo sapiens
tccatttctggcttctagtctg

SEQ ID NO: 2791120 - DNA, 20 bp, Homo sapiens
tccatttttactaaagcagt

SEQ ID NO: 2791121 - DNA, 21 bp, Homo sapiens
tccatttttactaaagcagtg

SEQ ID NO: 2791122 - DNA, 13 bp, Homo sapiens
tcccaaagtgctg

SEQ ID NO: 2791123 - DNA, 21 bp, Homo sapiens
tcccaaagtgctgggattaca

SEQ ID NO: 2791124 - DNA, 14 bp, Homo sapiens
tcccaacttgtaaa

SEQ ID NO: 2791125 - DNA, 13 bp, Homo sapiens
tcccaagctctgc

SEQ ID NO: 2791126 - DNA, 12 bp, Homo sapiens
tcccaaggaaag

SEQ ID NO: 2791127 - DNA, 22 bp, Homo sapiens
tcccaaggctctgagcaaatgt

SEQ ID NO: 2791128 - DNA, 16 bp, Homo sapiens
tcccaataaaagtgac

SEQ ID NO: 2791129 - DNA, 15 bp, Homo sapiens
tcccaataaagctgg

SEQ ID NO: 2791130 - DNA, 17 bp, Homo sapiens
tcccaataaagctggac

SEQ ID NO: 2791131 - DNA, 17 bp, Homo sapiens
tcccacatccctgggcc

SEQ ID NO: 2791132 - DNA, 18 bp, Homo sapiens
tcccaccaccctcccacc

SEQ ID NO: 2791133 - DNA, 21 bp, Homo sapiens
tcccaccaccctcccaccatg

SEQ ID NO: 2791134 - DNA, 22 bp, Homo sapiens
tcccaccaccctcccaccatgc

SEQ ID NO: 2791135 - DNA, 14 bp, Homo sapiens
tcccaccagcatgt

SEQ ID NO: 2791136 - DNA, 19 bp, Homo sapiens
tcccaccatgcgctgctca

SEQ ID NO: 2791137 - DNA, 19 bp, Homo sapiens
tcccacccaattcaaaaca

SEQ ID NO: 2791138 - DNA, 18 bp, Homo sapiens
tcccaccccacccccttc

SEQ ID NO: 2791139 - DNA, 20 bp, Homo sapiens
tcccaccccacccccttcag

SEQ ID NO: 2791140 - DNA, 17 bp, Homo sapiens
tcccacccccagccccg

SEQ ID NO: 2791141 - DNA, 14 bp, Homo sapiens
tcccacctcagcct

SEQ ID NO: 2791142 - DNA, 18 bp, Homo sapiens
tcccacctcagcctcccg

SEQ ID NO: 2791143 - DNA, 22 bp, Homo sapiens
tcccacctcttctcttcctgta

SEQ ID NO: 2791144 - DNA, 17 bp, Homo sapiens
tcccaccttggctgcag

SEQ ID NO: 2791145 - DNA, 18 bp, Homo sapiens
tcccaccttggctgcagg

SEQ ID NO: 2791146 - DNA, 21 bp, Homo sapiens
tcccaccttggctgcagggag

SEQ ID NO: 2791147 - DNA, 12 bp, Homo sapiens
tcccacttgtca

SEQ ID NO: 2791148 - DNA, 17 bp, Homo sapiens
tcccagagacaggaaaa

SEQ ID NO: 2791149 - DNA, 18 bp, Homo sapiens
tcccagcactttgggagg

SEQ ID NO: 2791150 - DNA, 16 bp, Homo sapiens
tcccagccactcggga

SEQ ID NO: 2791151 - DNA, 22 bp, Homo sapiens
tcccagccactcgggaggctga

SEQ ID NO: 2791152 - DNA, 18 bp, Homo sapiens
tcccagctacacctgagg

SEQ ID NO: 2791153 - DNA, 19 bp, Homo sapiens
tcccagctactcagaagcc

SEQ ID NO: 2791154 - DNA, 23 bp, Homo sapiens
tcccagctactcagaagcctgag

SEQ ID NO: 2791155 - DNA, 15 bp, Homo sapiens
tcccagctactcagg

SEQ ID NO: 2791156 - DNA, 16 bp, Homo sapiens
tcccagctactcagga

SEQ ID NO: 2791157 - DNA, 16 bp, Homo sapiens
tcccagctactcggga

SEQ ID NO: 2791158 - DNA, 16 bp, Homo sapiens
tcccagctacttggga

SEQ ID NO: 2791159 - DNA, 21 bp, Homo sapiens
tcccagctgtgctctggacag

SEQ ID NO: 2791160 - DNA, 22 bp, Homo sapiens
tcccagctgtgctctggacagg

SEQ ID NO: 2791161 - DNA, 11 bp, Homo sapiens
tcccaggaact

SEQ ID NO: 2791162 - DNA, 16 bp, Homo sapiens
tcccaggagacagttc

SEQ ID NO: 2791163 - DNA, 17 bp, Homo sapiens
tcccaggggaccacacc

SEQ ID NO: 2791164 - DNA, 18 bp, Homo sapiens
tcccaggggaccacacct

SEQ ID NO: 2791165 - DNA, 19 bp, Homo sapiens
tcccaggttggcctggtgg

SEQ ID NO: 2791166 - DNA, 22 bp, Homo sapiens
tcccataattttcttcatgcaa

SEQ ID NO: 2791167 - DNA, 17 bp, Homo sapiens
tcccatctgctcctccc

SEQ ID NO: 2791168 - DNA, 18 bp, Homo sapiens
tcccatgagcctcagcat

SEQ ID NO: 2791169 - DNA, 22 bp, Homo sapiens
tcccatgagcctcagcatcctg

SEQ ID NO: 2791170 - DNA, 18 bp, Homo sapiens
tcccatgatgccgctctt

SEQ ID NO: 2791171 - DNA, 12 bp, Homo sapiens
tcccatgccctg

SEQ ID NO: 2791172 - DNA, 16 bp, Homo sapiens
tcccatgcctgcaacc

SEQ ID NO: 2791173 - DNA, 12 bp, Homo sapiens
tcccatgctgaa

SEQ ID NO: 2791174 - DNA, 15 bp, Homo sapiens
tcccattccccttaa

SEQ ID NO: 2791175 - DNA, 13 bp, Homo sapiens
tcccattgccctg

SEQ ID NO: 2791176 - DNA, 14 bp, Homo sapiens
tcccattgccctgg

SEQ ID NO: 2791177 - DNA, 16 bp, Homo sapiens
tcccatttatcgcaga

SEQ ID NO: 2791178 - DNA, 21 bp, Homo sapiens
tcccatttccttggaggccac

SEQ ID NO: 2791179 - DNA, 19 bp, Homo sapiens
tcccatttgtaatgtatct

SEQ ID NO: 2791180 - DNA, 10 bp, Homo sapiens
tccccacaga

SEQ ID NO: 2791181 - DNA, 20 bp, Homo sapiens
tccccaccttcaattcctgg

SEQ ID NO: 2791182 - DNA, 22 bp, Homo sapiens
tccccaccttcaattcctgggc

SEQ ID NO: 2791183 - DNA, 13 bp, Homo sapiens
tccccaccttccc

SEQ ID NO: 2791184 - DNA, 22 bp, Homo sapiens
tccccactccctggctctcaga

SEQ ID NO: 2791185 - DNA, 16 bp, Homo sapiens
tccccactctgctctg

SEQ ID NO: 2791186 - DNA, 20 bp, Homo sapiens
tccccactctgctctgatgc

SEQ ID NO: 2791187 - DNA, 17 bp, Homo sapiens
tccccagactcagctcc

SEQ ID NO: 2791188 - DNA, 13 bp, Homo sapiens
tccccagattgca

SEQ ID NO: 2791189 - DNA, 20 bp, Homo sapiens
tccccagattgcaacaggct

SEQ ID NO: 2791190 - DNA, 14 bp, Homo sapiens
tccccagccagaag

SEQ ID NO: 2791191 - DNA, 14 bp, Homo sapiens
tccccagctcccca

SEQ ID NO: 2791192 - DNA, 18 bp, Homo sapiens
tccccagctccccaggac

SEQ ID NO: 2791193 - DNA, 19 bp, Homo sapiens
tccccaggactcaccctca

SEQ ID NO: 2791194 - DNA, 19 bp, Homo sapiens
tccccaggccaggccacca

SEQ ID NO: 2791195 - DNA, 10 bp, Homo sapiens
tccccagggg

SEQ ID NO: 2791196 - DNA, 14 bp, Homo sapiens
tccccaggggagag

SEQ ID NO: 2791197 - DNA, 21 bp, Homo sapiens
tccccaggtctctccactgct

SEQ ID NO: 2791198 - DNA, 13 bp, Homo sapiens
tcctgcctcagcc

SEQ ID NO: 2791199 - DNA, 15 bp, Homo sapiens
tcctgcctcagcctc

SEQ ID NO: 2791200 - DNA, 16 bp, Homo sapiens
tcctgcctcagcctcc

SEQ ID NO: 2791201 - DNA, 21 bp, Homo sapiens
tcctgcctcgaactggctgca

SEQ ID NO: 2791202 - DNA, 16 bp, Homo sapiens
tcctgcctctactggg

SEQ ID NO: 2791203 - DNA, 19 bp, Homo sapiens
tcctgcgggagtagttgga

SEQ ID NO: 2791204 - DNA, 16 bp, Homo sapiens
tcctgctagctgtaga

SEQ ID NO: 2791205 - DNA, 22 bp, Homo sapiens
tcctgctagctgtagaaatgta

SEQ ID NO: 2791206 - DNA, 16 bp, Homo sapiens
tcctgctggatgcgtg

SEQ ID NO: 2791207 - DNA, 23 bp, Homo sapiens
tcctgctgtgtgaattcccaggt

SEQ ID NO: 2791208 - DNA, 14 bp, Homo sapiens
tcctggaagctgtg

SEQ ID NO: 2791209 - DNA, 16 bp, Homo sapiens
tcctggaatgaagcat

SEQ ID NO: 2791210 - DNA, 16 bp, Homo sapiens
tcctggacagctgtgc

SEQ ID NO: 2791211 - DNA, 19 bp, Homo sapiens
tcctggacagctgtgcctc

SEQ ID NO: 2791212 - DNA, 20 bp, Homo sapiens
tcctggcacccggcccctgc

SEQ ID NO: 2791213 - DNA, 19 bp, Homo sapiens
tcctggccccagcccccac

SEQ ID NO: 2791214 - DNA, 21 bp, Homo sapiens
tcctgggagagaaggagatca

SEQ ID NO: 2791215 - DNA, 15 bp, Homo sapiens
tcctgggcagcttga

SEQ ID NO: 2791216 - DNA, 22 bp, Homo sapiens
tcctgggcccgctttgcctgct

SEQ ID NO: 2791217 - DNA, 22 bp, Homo sapiens
tcctggggcctcggagcctcat

SEQ ID NO: 2791218 - DNA, 17 bp, Homo sapiens
tcctgggggatgtgcac

SEQ ID NO: 2791219 - DNA, 24 bp, Homo sapiens
tcctgggtggctactctgtgccag

SEQ ID NO: 2791220 - DNA, 16 bp, Homo sapiens
tcctggtctgctcagg

SEQ ID NO: 2791221 - DNA, 17 bp, Homo sapiens
tcctggtcttgagatgt

SEQ ID NO: 2791222 - DNA, 13 bp, Homo sapiens
tcctggtggggca

SEQ ID NO: 2791223 - DNA, 17 bp, Homo sapiens
tcctgtagcatcttctg

SEQ ID NO: 2791224 - DNA, 19 bp, Homo sapiens
tcctgtagcatcttctgga

SEQ ID NO: 2791225 - DNA, 21 bp, Homo sapiens
tcctgtagttgcgtggactct

SEQ ID NO: 2791226 - DNA, 15 bp, Homo sapiens
tcctgtccagcaggt

SEQ ID NO: 2791227 - DNA, 13 bp, Homo sapiens
tcctgtccctcac

SEQ ID NO: 2791228 - DNA, 14 bp, Homo sapiens
tcctgtctgccagc

SEQ ID NO: 2791229 - DNA, 17 bp, Homo sapiens
tcctgtctgccagccag

SEQ ID NO: 2791230 - DNA, 22 bp, Homo sapiens
tcctgtctgccagccagcagcc

SEQ ID NO: 2791231 - DNA, 18 bp, Homo sapiens
tcctgtctttaaggaaaa

SEQ ID NO: 2791232 - DNA, 19 bp, Homo sapiens
tcctgtctttaaggaaaaa

SEQ ID NO: 2791233 - DNA, 24 bp, Homo sapiens
tcctgtgtcttgcaatggcagcct

SEQ ID NO: 2791234 - DNA, 18 bp, Homo sapiens
tcctgttacttacctaaa

SEQ ID NO: 2791235 - DNA, 19 bp, Homo sapiens
tcctgttcaccttatgtat

SEQ ID NO: 2791236 - DNA, 21 bp, Homo sapiens
tcctgttgttgttaatgaaaa

SEQ ID NO: 2791237 - DNA, 17 bp, Homo sapiens
tccttaagtcagaacag

SEQ ID NO: 2791238 - DNA, 14 bp, Homo sapiens
tccttaatgatccg

SEQ ID NO: 2791239 - DNA, 22 bp, Homo sapiens
tccttagcttagacctcagcct

SEQ ID NO: 2791240 - DNA, 23 bp, Homo sapiens
tccttagcttagacctcagcctg

SEQ ID NO: 2791241 - DNA, 23 bp, Homo sapiens
tccttcaagttagctcaggaggc

SEQ ID NO: 2791242 - DNA, 22 bp, Homo sapiens
tccttccagctagtgacccaca

SEQ ID NO: 2791243 - DNA, 16 bp, Homo sapiens
tccttccaggccccca

SEQ ID NO: 2791244 - DNA, 13 bp, Homo sapiens
tccttccatgaaa

SEQ ID NO: 2791245 - DNA, 9 bp, Homo sapiens
tccttcccc

SEQ ID NO: 2791246 - DNA, 14 bp, Homo sapiens
tccttccctggctt

SEQ ID NO: 2791247 - DNA, 15 bp, Homo sapiens
tccttccctggcttg

SEQ ID NO: 2791248 - DNA, 19 bp, Homo sapiens
tccttccgatgacagtgct

SEQ ID NO: 2791249 - DNA, 18 bp, Homo sapiens
tccttcctcagtcctgga

SEQ ID NO: 2791250 - DNA, 14 bp, Homo sapiens
tccttccttccctg

SEQ ID NO: 2791251 - DNA, 16 bp, Homo sapiens
tccttccttccctggc

SEQ ID NO: 2791252 - DNA, 19 bp, Homo sapiens
tccttccttgctgtcctag

SEQ ID NO: 2791253 - DNA, 16 bp, Homo sapiens
tccttgatctgtatat

SEQ ID NO: 2791254 - DNA, 22 bp, Homo sapiens
tccttgattttagccttctctg

SEQ ID NO: 2791255 - DNA, 17 bp, Homo sapiens
tccttgcacctgcatcc

SEQ ID NO: 2791256 - DNA, 21 bp, Homo sapiens
tccttggcaggctgatttcta

SEQ ID NO: 2791257 - DNA, 21 bp, Homo sapiens
tccttggtgtgaccctctgaa

SEQ ID NO: 2791258 - DNA, 15 bp, Homo sapiens
tccttgtatttaaat

SEQ ID NO: 2791259 - DNA, 19 bp, Homo sapiens
tcctttcaatggtttgcaa

SEQ ID NO: 2791260 - DNA, 21 bp, Homo sapiens
tcctttcagggaatttcagga

SEQ ID NO: 2791261 - DNA, 15 bp, Homo sapiens
tcctttctattgaaa

SEQ ID NO: 2791262 - DNA, 12 bp, Homo sapiens
tcctttgagaaa

SEQ ID NO: 2791263 - DNA, 15 bp, Homo sapiens
tcctttgagaaagaa

SEQ ID NO: 2791264 - DNA, 17 bp, Homo sapiens
tcctttgcactgagggc

SEQ ID NO: 2791265 - DNA, 22 bp, Homo sapiens
tcctttgcattccatgatttta

SEQ ID NO: 2791266 - DNA, 20 bp, Homo sapiens
tcctttgccccctgtgccct

SEQ ID NO: 2791267 - DNA, 19 bp, Homo sapiens
tcctttgttattatcctgc

SEQ ID NO: 2791268 - DNA, 10 bp, Homo sapiens
tcctttgttc

SEQ ID NO: 2791269 - DNA, 19 bp, Homo sapiens
tccttttaaaacacttcca

SEQ ID NO: 2791270 - DNA, 12 bp, Homo sapiens
tccttttatgtt

SEQ ID NO: 2791271 - DNA, 15 bp, Homo sapiens
tccttttatgttatt

SEQ ID NO: 2791272 - DNA, 13 bp, Homo sapiens
tccttttgcttga

SEQ ID NO: 2791273 - DNA, 21 bp, Homo sapiens
tcgaaacctgtccataaagta

SEQ ID NO: 2791274 - DNA, 23 bp, Homo sapiens
tcgaagaacaatgtcagaaactc

SEQ ID NO: 2791275 - DNA, 16 bp, Homo sapiens
tcgaagcccttccagt

SEQ ID NO: 2791276 - DNA, 14 bp, Homo sapiens
tcgaatgacactgt

SEQ ID NO: 2791277 - DNA, 15 bp, Homo sapiens
tcgaccctttctctg

SEQ ID NO: 2791278 - DNA, 16 bp, Homo sapiens
tcgaccctttctctga

SEQ ID NO: 2791279 - DNA, 14 bp, Homo sapiens
tcgactcaggatcc

SEQ ID NO: 2791280 - DNA, 17 bp, Homo sapiens
tcgagaccagcctggcc

SEQ ID NO: 2791281 - DNA, 19 bp, Homo sapiens
tcgagaccagcctggccaa

SEQ ID NO: 2791282 - DNA, 19 bp, Homo sapiens
tcgagcgccctgcagaccc

SEQ ID NO: 2791283 - DNA, 16 bp, Homo sapiens
tcgaggctgcagtcag

SEQ ID NO: 2791284 - DNA, 20 bp, Homo sapiens
tcgaggctgcagtcagtcat

SEQ ID NO: 2791285 - DNA, 23 bp, Homo sapiens
tcgaggtaggtggatcacctgag

SEQ ID NO: 2791286 - DNA, 12 bp, Homo sapiens
tcgattagactg

SEQ ID NO: 2791287 - DNA, 13 bp, Homo sapiens
tcgattagactgg

SEQ ID NO: 2791288 - DNA, 19 bp, Homo sapiens
tctctgcagccagcccagc

SEQ ID NO: 2791289 - DNA, 20 bp, Homo sapiens
tctctgcagccagcccagcc

SEQ ID NO: 2791290 - DNA, 22 bp, Homo sapiens
tctctgtccctcactgccttcc

SEQ ID NO: 2791291 - DNA, 18 bp, Homo sapiens
tctctgtgcccctgtaaa

SEQ ID NO: 2791292 - DNA, 18 bp, Homo sapiens
tctctgttcatttcctca

SEQ ID NO: 2791293 - DNA, 19 bp, Homo sapiens
tctcttacgctctctgtct

SEQ ID NO: 2791294 - DNA, 17 bp, Homo sapiens
tctcttatagaatattt

SEQ ID NO: 2791295 - DNA, 16 bp, Homo sapiens
tctcttcaggttctta

SEQ ID NO: 2791296 - DNA, 18 bp, Homo sapiens
tctcttgaggccaggagt

SEQ ID NO: 2791297 - DNA, 14 bp, Homo sapiens
tctctttcttattt

SEQ ID NO: 2791298 - DNA, 14 bp, Homo sapiens
tctgaaaactggaa

SEQ ID NO: 2791299 - DNA, 13 bp, Homo sapiens
tctgaaaactgtt

SEQ ID NO: 2791300 - DNA, 14 bp, Homo sapiens
tctgaaaactgttt

SEQ ID NO: 2791301 - DNA, 19 bp, Homo sapiens
tctgaaaattaacactgct

SEQ ID NO: 2791302 - DNA, 15 bp, Homo sapiens
tctgaacaaaagctt

SEQ ID NO: 2791303 - DNA, 16 bp, Homo sapiens
tctgaaccactttgcc

SEQ ID NO: 2791304 - DNA, 15 bp, Homo sapiens
tctgaactcaagctg

SEQ ID NO: 2791305 - DNA, 17 bp, Homo sapiens
tctgaagtcacatcaca

SEQ ID NO: 2791306 - DNA, 20 bp, Homo sapiens
tctgaagtcacatcacagga

SEQ ID NO: 2791307 - DNA, 22 bp, Homo sapiens
tctgaagtcacatcacaggaca

SEQ ID NO: 2791308 - DNA, 13 bp, Homo sapiens
tctgaatggtcca

SEQ ID NO: 2791309 - DNA, 12 bp, Homo sapiens
tctgacacacag

SEQ ID NO: 2791310 - DNA, 13 bp, Homo sapiens
tctgacacacagc

SEQ ID NO: 2791311 - DNA, 15 bp, Homo sapiens
tctgacacacagctc

SEQ ID NO: 2791312 - DNA, 18 bp, Homo sapiens
tctgacacacagctctgt

SEQ ID NO: 2791313 - DNA, 18 bp, Homo sapiens
tctgacagttactcttca

SEQ ID NO: 2791314 - DNA, 23 bp, Homo sapiens
tctgacagttactcttcagtttt

SEQ ID NO: 2791315 - DNA, 18 bp, Homo sapiens
tctgaccatttcaggggt

SEQ ID NO: 2791316 - DNA, 13 bp, Homo sapiens
tctgacccactgc

SEQ ID NO: 2791317 - DNA, 12 bp, Homo sapiens
tctgacctgcag

SEQ ID NO: 2791318 - DNA, 19 bp, Homo sapiens
tctgacctgcaggccaaga

SEQ ID NO: 2791319 - DNA, 21 bp, Homo sapiens
tctgacctgcaggccaagagc

SEQ ID NO: 2791320 - DNA, 15 bp, Homo sapiens
tctgactcttgcctt

SEQ ID NO: 2791321 - DNA, 22 bp, Homo sapiens
tctgactcttgcctttccacct

SEQ ID NO: 2791322 - DNA, 18 bp, Homo sapiens
tctgactttaattgtgtg

SEQ ID NO: 2791323 - DNA, 20 bp, Homo sapiens
tctgagaattccaaggagtt

SEQ ID NO: 2791324 - DNA, 15 bp, Homo sapiens
tctgagagagatgat

SEQ ID NO: 2791325 - DNA, 16 bp, Homo sapiens
tctgagaggccctgga

SEQ ID NO: 2791326 - DNA, 15 bp, Homo sapiens
tctgagcaagagctg

SEQ ID NO: 2791327 - DNA, 14 bp, Homo sapiens
tctgagcaccccct

SEQ ID NO: 2791328 - DNA, 16 bp, Homo sapiens
tctgagcaccccctca

SEQ ID NO: 2791329 - DNA, 19 bp, Homo sapiens
tctgagcaccccctcattc

SEQ ID NO: 2791330 - DNA, 15 bp, Homo sapiens
tctgagcctaaatct

SEQ ID NO: 2791331 - DNA, 15 bp, Homo sapiens
tctgagcttcagtat

SEQ ID NO: 2791332 - DNA, 18 bp, Homo sapiens
tctgaggaatccagaccc

SEQ ID NO: 2791333 - DNA, 22 bp, Homo sapiens
tctgaggaatccagacccggct

SEQ ID NO: 2791334 - DNA, 23 bp, Homo sapiens
tctgaggaatccagacccggctg

SEQ ID NO: 2791335 - DNA, 22 bp, Homo sapiens
tctgaggagaaacaaataagac

SEQ ID NO: 2791336 - DNA, 12 bp, Homo sapiens
tctgaggccagc

SEQ ID NO: 2791337 - DNA, 15 bp, Homo sapiens
tctgaggccagcctg

SEQ ID NO: 2791338 - DNA, 16 bp, Homo sapiens
tctgaggccagcctgg

SEQ ID NO: 2791339 - DNA, 19 bp, Homo sapiens
tctgaggccagcctggcct

SEQ ID NO: 2791340 - DNA, 15 bp, Homo sapiens
tctgaggcttccaga

SEQ ID NO: 2791341 - DNA, 18 bp, Homo sapiens
tctgaggtcctgagcact

SEQ ID NO: 2791342 - DNA, 20 bp, Homo sapiens
tctgaggtcctgagcactgc

SEQ ID NO: 2791343 - DNA, 12 bp, Homo sapiens
tctgataaacac

SEQ ID NO: 2791344 - DNA, 15 bp, Homo sapiens
tctgataaacacaga

SEQ ID NO: 2791345 - DNA, 21 bp, Homo sapiens
tctgatcatccactgtgccat

SEQ ID NO: 2791346 - DNA, 21 bp, Homo sapiens
tctgatcgggataacaaaatc

SEQ ID NO: 2791347 - DNA, 23 bp, Homo sapiens
tctgatcgggataacaaaatcac

SEQ ID NO: 2791348 - DNA, 23 bp, Homo sapiens
tctgattcccaagctctgctcct

SEQ ID NO: 2791349 - DNA, 22 bp, Homo sapiens
tctgattcgaatgacactgttc

SEQ ID NO: 2791350 - DNA, 15 bp, Homo sapiens
tctgattggacattt

SEQ ID NO: 2791351 - DNA, 16 bp, Homo sapiens
tctgattgtgatgtga

SEQ ID NO: 2791352 - DNA, 17 bp, Homo sapiens
tctgcaaggtctttggt

SEQ ID NO: 2791353 - DNA, 23 bp, Homo sapiens
tctgcacatgaatcccacccaca

SEQ ID NO: 2791354 - DNA, 17 bp, Homo sapiens
tctgcacatgtcttgta

SEQ ID NO: 2791355 - DNA, 19 bp, Homo sapiens
tctgcacatgtcttgtaca

SEQ ID NO: 2791356 - DNA, 23 bp, Homo sapiens
tctgcagcactttaaccctctct

SEQ ID NO: 2791357 - DNA, 19 bp, Homo sapiens
tctgcagccagcccagccc

SEQ ID NO: 2791358 - DNA, 23 bp, Homo sapiens
tctgcagcccggcgccaccatcc

SEQ ID NO: 2791359 - DNA, 18 bp, Homo sapiens
tctgcagtagtctctgtg

SEQ ID NO: 2791360 - DNA, 21 bp, Homo sapiens
tctgcagtagtctctgtgctt

SEQ ID NO: 2791361 - DNA, 17 bp, Homo sapiens
tctgcattcaggatcaa

SEQ ID NO: 2791362 - DNA, 16 bp, Homo sapiens
tctgcattctagtact

SEQ ID NO: 2791363 - DNA, 19 bp, Homo sapiens
tctgcatttataaatgtgt

SEQ ID NO: 2791364 - DNA, 20 bp, Homo sapiens
tctgcatttataaatgtgtg

SEQ ID NO: 2791365 - DNA, 10 bp, Homo sapiens
tctgccacca

SEQ ID NO: 2791366 - DNA, 23 bp, Homo sapiens
tctgccacctcccctatccaccc

SEQ ID NO: 2791367 - DNA, 19 bp, Homo sapiens
tctgccagccagcagccag

SEQ ID NO: 2791368 - DNA, 18 bp, Homo sapiens
tctgcccacattggaccc

SEQ ID NO: 2791369 - DNA, 17 bp, Homo sapiens
tctgccccagctctggc

SEQ ID NO: 2791370 - DNA, 19 bp, Homo sapiens
tctgcccccagcctctgtc

SEQ ID NO: 2791371 - DNA, 18 bp, Homo sapiens
tctgccctccctggcctc

SEQ ID NO: 2791372 - DNA, 19 bp, Homo sapiens
tctgccctccctggcctca

SEQ ID NO: 2791373 - DNA, 16 bp, Homo sapiens
tctgcctcaatgtgaa

SEQ ID NO: 2791374 - DNA, 18 bp, Homo sapiens
tctgcctctgacacacag

SEQ ID NO: 2791375 - DNA, 22 bp, Homo sapiens
tctgcctctgacacacagctct

SEQ ID NO: 2791376 - DNA, 20 bp, Homo sapiens
tctgcctgaagtcacacagt

SEQ ID NO: 2791377 - DNA, 16 bp, Homo sapiens
tctgcctgcccaggcc

SEQ ID NO: 2791378 - DNA, 17 bp, Homo sapiens
tcttggacactgtacaa

SEQ ID NO: 2791379 - DNA, 18 bp, Homo sapiens
tcttggacctctgctctg

SEQ ID NO: 2791380 - DNA, 16 bp, Homo sapiens
tcttggcccctgtgtg

SEQ ID NO: 2791381 - DNA, 22 bp, Homo sapiens
tcttggccgactcagggaccta

SEQ ID NO: 2791382 - DNA, 14 bp, Homo sapiens
tcttggtaagaagc

SEQ ID NO: 2791383 - DNA, 14 bp, Homo sapiens
tcttgtattttctt

SEQ ID NO: 2791384 - DNA, 14 bp, Homo sapiens
tcttgtctccacta

SEQ ID NO: 2791385 - DNA, 13 bp, Homo sapiens
tcttgttaatgca

SEQ ID NO: 2791386 - DNA, 19 bp, Homo sapiens
tctttaaaaagcagtcctc

SEQ ID NO: 2791387 - DNA, 19 bp, Homo sapiens
tctttaaaagaaagttagg

SEQ ID NO: 2791388 - DNA, 15 bp, Homo sapiens
tctttaaatcaaaag

SEQ ID NO: 2791389 - DNA, 21 bp, Homo sapiens
tctttaaatcaaaagctgctt

SEQ ID NO: 2791390 - DNA, 18 bp, Homo sapiens
tctttaagtattgtttta

SEQ ID NO: 2791391 - DNA, 14 bp, Homo sapiens
tctttaatcttcag

SEQ ID NO: 2791392 - DNA, 15 bp, Homo sapiens
tctttaatgtcacag

SEQ ID NO: 2791393 - DNA, 13 bp, Homo sapiens
tctttacctgaga

SEQ ID NO: 2791394 - DNA, 12 bp, Homo sapiens
tctttactttta

SEQ ID NO: 2791395 - DNA, 21 bp, Homo sapiens
tctttaggtgcctcctgtctt

SEQ ID NO: 2791396 - DNA, 19 bp, Homo sapiens
tctttcaagtgaatctaaa

SEQ ID NO: 2791397 - DNA, 12 bp, Homo sapiens
tctttcagcatt

SEQ ID NO: 2791398 - DNA, 17 bp, Homo sapiens
tctttccctagaggcaa

SEQ ID NO: 2791399 - DNA, 17 bp, Homo sapiens
tctttccgtctccctaa

SEQ ID NO: 2791400 - DNA, 11 bp, Homo sapiens
tctttcctctt

SEQ ID NO: 2791401 - DNA, 23 bp, Homo sapiens
tctttcctcttccccttgccctt

SEQ ID NO: 2791402 - DNA, 21 bp, Homo sapiens
tctttctaactccagtgaagt

SEQ ID NO: 2791403 - DNA, 19 bp, Homo sapiens
tctttctaatgtgtgaatc

SEQ ID NO: 2791404 - DNA, 17 bp, Homo sapiens
tctttctcactaaatct

SEQ ID NO: 2791405 - DNA, 15 bp, Homo sapiens
tctttcttcctctgc

SEQ ID NO: 2791406 - DNA, 17 bp, Homo sapiens
tctttcttcctctgctg

SEQ ID NO: 2791407 - DNA, 17 bp, Homo sapiens
tctttctttacctgaga

SEQ ID NO: 2791408 - DNA, 13 bp, Homo sapiens
tctttgaataaag

SEQ ID NO: 2791409 - DNA, 16 bp, Homo sapiens
tctttgaataaagtct

SEQ ID NO: 2791410 - DNA, 17 bp, Homo sapiens
tctttgaataaagtctg

SEQ ID NO: 2791411 - DNA, 20 bp, Homo sapiens
tctttgaataaagtctgagt

SEQ ID NO: 2791412 - DNA, 21 bp, Homo sapiens
tctttgagagagtttatcatt

SEQ ID NO: 2791413 - DNA, 14 bp, Homo sapiens
tctttgcagacagg

SEQ ID NO: 2791414 - DNA, 17 bp, Homo sapiens
tctttgcagacaggcaa

SEQ ID NO: 2791415 - DNA, 12 bp, Homo sapiens
tctttgcctcaa

SEQ ID NO: 2791416 - DNA, 18 bp, Homo sapiens
tctttgcctgtgtgagca

SEQ ID NO: 2791417 - DNA, 21 bp, Homo sapiens
tctttgcctgtgtgagcatct

SEQ ID NO: 2791418 - DNA, 17 bp, Homo sapiens
tctttggaaggagtgag

SEQ ID NO: 2791419 - DNA, 21 bp, Homo sapiens
tctttggggtcagccagggcc

SEQ ID NO: 2791420 - DNA, 14 bp, Homo sapiens
tctttgtggcttcc

SEQ ID NO: 2791421 - DNA, 12 bp, Homo sapiens
tctttgttcagt

SEQ ID NO: 2791422 - DNA, 18 bp, Homo sapiens
tctttgttggaaaagaat

SEQ ID NO: 2791423 - DNA, 13 bp, Homo sapiens
tcttttactcctt

SEQ ID NO: 2791424 - DNA, 16 bp, Homo sapiens
tcttttagttttagtt

SEQ ID NO: 2791425 - DNA, 18 bp, Homo sapiens
tcttttagttttagttgc

SEQ ID NO: 2791426 - DNA, 13 bp, Homo sapiens
tcttttataaaaa

SEQ ID NO: 2791427 - DNA, 19 bp, Homo sapiens
tcttttataactagtcctt

SEQ ID NO: 2791428 - DNA, 17 bp, Homo sapiens
tcttttctctgtgcttc

SEQ ID NO: 2791429 - DNA, 19 bp, Homo sapiens
tcttttctggaatgtaatc

SEQ ID NO: 2791430 - DNA, 20 bp, Homo sapiens
tcttttgaatccatgcttgg

SEQ ID NO: 2791431 - DNA, 14 bp, Homo sapiens
tctttttttgtgat

SEQ ID NO: 2791432 - DNA, 16 bp, Homo sapiens
tgaaaaaaaagtttca

SEQ ID NO: 2791433 - DNA, 18 bp, Homo sapiens
tgaaaaactcttctactt

SEQ ID NO: 2791434 - DNA, 12 bp, Homo sapiens
tgaaaaacttcc

SEQ ID NO: 2791435 - DNA, 23 bp, Homo sapiens
tgaaaacatggtagaattggaga

SEQ ID NO: 2791436 - DNA, 14 bp, Homo sapiens
tgaaaactggaata

SEQ ID NO: 2791437 - DNA, 23 bp, Homo sapiens
tgaaaactggaataagaagcaaa

SEQ ID NO: 2791438 - DNA, 20 bp, Homo sapiens
tgaaaactgtaaatacaaaa

SEQ ID NO: 2791439 - DNA, 23 bp, Homo sapiens
tgaaaagaggggaccagaagcca

SEQ ID NO: 2791440 - DNA, 17 bp, Homo sapiens
tgaaaagctagaattga

SEQ ID NO: 2791441 - DNA, 21 bp, Homo sapiens
tgaaaaggtttatgaaaaaga

SEQ ID NO: 2791442 - DNA, 16 bp, Homo sapiens
tgaaaatcgtgacaac

SEQ ID NO: 2791443 - DNA, 19 bp, Homo sapiens
tgaaaatcgtgacaacact

SEQ ID NO: 2791444 - DNA, 18 bp, Homo sapiens
tgaaaatgagcctgtaat

SEQ ID NO: 2791445 - DNA, 18 bp, Homo sapiens
tgaaaatgcaacaacatg

SEQ ID NO: 2791446 - DNA, 20 bp, Homo sapiens
tgaaaatgcaacaacatgta

SEQ ID NO: 2791447 - DNA, 18 bp, Homo sapiens
tgaaaatgtcagaaacca

SEQ ID NO: 2791448 - DNA, 21 bp, Homo sapiens
tgaaaatgtcagaaaccagtt

SEQ ID NO: 2791449 - DNA, 15 bp, Homo sapiens
tgaaaattaacactg

SEQ ID NO: 2791450 - DNA, 17 bp, Homo sapiens
tgaaaattgtatgttaa

SEQ ID NO: 2791451 - DNA, 18 bp, Homo sapiens
tgaaacaaataatcacat

SEQ ID NO: 2791452 - DNA, 22 bp, Homo sapiens
tgaaacaaataatcacattgac

SEQ ID NO: 2791453 - DNA, 21 bp, Homo sapiens
tgaaacaagataactgagaat

SEQ ID NO: 2791454 - DNA, 15 bp, Homo sapiens
tgaaacacctcccag

SEQ ID NO: 2791455 - DNA, 15 bp, Homo sapiens
tgaaacttcataaat

SEQ ID NO: 2791456 - DNA, 16 bp, Homo sapiens
tgaaagaattattttt

SEQ ID NO: 2791457 - DNA, 12 bp, Homo sapiens
tgaaagaccttc

SEQ ID NO: 2791458 - DNA, 17 bp, Homo sapiens
tgaaagaccttctccaa

SEQ ID NO: 2791459 - DNA, 14 bp, Homo sapiens
tgaaagccatttgt

SEQ ID NO: 2791460 - DNA, 12 bp, Homo sapiens
tgaaagctgaat

SEQ ID NO: 2791461 - DNA, 11 bp, Homo sapiens
tgaaagctgtg

SEQ ID NO: 2791462 - DNA, 16 bp, Homo sapiens
tgaaagggcccagaga

SEQ ID NO: 2791463 - DNA, 17 bp, Homo sapiens
tgaaagggcccagagag

SEQ ID NO: 2791464 - DNA, 19 bp, Homo sapiens
tgaaaggttaccctgtaac

SEQ ID NO: 2791465 - DNA, 18 bp, Homo sapiens
tgaaagtcagatgcccag

SEQ ID NO: 2791466 - DNA, 16 bp, Homo sapiens
tgaaagtgacagagac

SEQ ID NO: 2791467 - DNA, 17 bp, Homo sapiens
tgaaagtgtaaaataga

SEQ ID NO: 2791468 - DNA, 17 bp, Homo sapiens
tgaaagtttgcactgta

SEQ ID NO: 2791469 - DNA, 14 bp, Homo sapiens
tgactccttgtggt

SEQ ID NO: 2791470 - DNA, 21 bp, Homo sapiens
tgactcgcttagctgaaacct

SEQ ID NO: 2791471 - DNA, 13 bp, Homo sapiens
tgactcttgcctt

SEQ ID NO: 2791472 - DNA, 16 bp, Homo sapiens
tgactgccccaactcc

SEQ ID NO: 2791473 - DNA, 17 bp, Homo sapiens
tgactgccccaactcct

SEQ ID NO: 2791474 - DNA, 19 bp, Homo sapiens
tgactgccccaactcctgg

SEQ ID NO: 2791475 - DNA, 20 bp, Homo sapiens
tgactgccccaactcctgga

SEQ ID NO: 2791476 - DNA, 13 bp, Homo sapiens
tgactgtcactgt

SEQ ID NO: 2791477 - DNA, 16 bp, Homo sapiens
tgactgtcactgttcc

SEQ ID NO: 2791478 - DNA, 19 bp, Homo sapiens
tgactgtcgtgtttacaaa

SEQ ID NO: 2791479 - DNA, 21 bp, Homo sapiens
tgactgtcgtgtttacaaaag

SEQ ID NO: 2791480 - DNA, 22 bp, Homo sapiens
tgactgtcgtgtttacaaaagg

SEQ ID NO: 2791481 - DNA, 14 bp, Homo sapiens
tgacttccacacct

SEQ ID NO: 2791482 - DNA, 19 bp, Homo sapiens
tgacttcctcgcctctccc

SEQ ID NO: 2791483 - DNA, 13 bp, Homo sapiens
tgactttaattgt

SEQ ID NO: 2791484 - DNA, 13 bp, Homo sapiens
tgactttttataa

SEQ ID NO: 2791485 - DNA, 19 bp, Homo sapiens
tgagaaaagctttgaaccc

SEQ ID NO: 2791486 - DNA, 15 bp, Homo sapiens
tgagaaacccaccag

SEQ ID NO: 2791487 - DNA, 17 bp, Homo sapiens
tgagaaacccaccagcc

SEQ ID NO: 2791488 - DNA, 15 bp, Homo sapiens
tgagaaatttaaact

SEQ ID NO: 2791489 - DNA, 16 bp, Homo sapiens
tgagaacctggccttc

SEQ ID NO: 2791490 - DNA, 17 bp, Homo sapiens
tgagaagactcctgggc

SEQ ID NO: 2791491 - DNA, 17 bp, Homo sapiens
tgagaagagggcctgtg

SEQ ID NO: 2791492 - DNA, 21 bp, Homo sapiens
tgagaagagggcctgtgggag

SEQ ID NO: 2791493 - DNA, 18 bp, Homo sapiens
tgagaagttaagcagcct

SEQ ID NO: 2791494 - DNA, 15 bp, Homo sapiens
tgagaataattgtgt

SEQ ID NO: 2791495 - DNA, 16 bp, Homo sapiens
tgagaataattgtgta

SEQ ID NO: 2791496 - DNA, 17 bp, Homo sapiens
tgagaataattgtgtac

SEQ ID NO: 2791497 - DNA, 19 bp, Homo sapiens
tgagaataattgtgtacaa

SEQ ID NO: 2791498 - DNA, 16 bp, Homo sapiens
tgagaatcaaaactct

SEQ ID NO: 2791499 - DNA, 19 bp, Homo sapiens
tgagaatttaaaaataaga

SEQ ID NO: 2791500 - DNA, 23 bp, Homo sapiens
tgagaattttaaattataactta

SEQ ID NO: 2791501 - DNA, 11 bp, Homo sapiens
tgagacagagt

SEQ ID NO: 2791502 - DNA, 21 bp, Homo sapiens
tgagaccacagagagagggga

SEQ ID NO: 2791503 - DNA, 15 bp, Homo sapiens
tgagaccagcctggc

SEQ ID NO: 2791504 - DNA, 17 bp, Homo sapiens
tgagaccagcctggcca

SEQ ID NO: 2791505 - DNA, 21 bp, Homo sapiens
tgagaccagttgggagcactg

SEQ ID NO: 2791506 - DNA, 23 bp, Homo sapiens
tgagaccagttgggagcactgga

SEQ ID NO: 2791507 - DNA, 13 bp, Homo sapiens
tgagacctcagcc

SEQ ID NO: 2791508 - DNA, 14 bp, Homo sapiens
tgagactgacacct

SEQ ID NO: 2791509 - DNA, 19 bp, Homo sapiens
tgagagaattgtatcattt

SEQ ID NO: 2791510 - DNA, 19 bp, Homo sapiens
tgagagctgctctggaaaa

SEQ ID NO: 2791511 - DNA, 14 bp, Homo sapiens
tgagagctgggtgt

SEQ ID NO: 2791512 - DNA, 14 bp, Homo sapiens
tgagaggccctgga

SEQ ID NO: 2791513 - DNA, 16 bp, Homo sapiens
tgagaggccctggatc

SEQ ID NO: 2791514 - DNA, 17 bp, Homo sapiens
tgagagggcatgcgcac

SEQ ID NO: 2791515 - DNA, 15 bp, Homo sapiens
tgagaggtgctgcag

SEQ ID NO: 2791516 - DNA, 22 bp, Homo sapiens
tgagataaccacaaccaggaag

SEQ ID NO: 2791517 - DNA, 23 bp, Homo sapiens
tgagataaccacaaccaggaaga

SEQ ID NO: 2791518 - DNA, 19 bp, Homo sapiens
tgagatagtagcatacatt

SEQ ID NO: 2791519 - DNA, 20 bp, Homo sapiens
tgagatctaagcctttccat

SEQ ID NO: 2791520 - DNA, 21 bp, Homo sapiens
tgagatctaagcctttccata

SEQ ID NO: 2791521 - DNA, 17 bp, Homo sapiens
tgagattccctctcctc

SEQ ID NO: 2791522 - DNA, 12 bp, Homo sapiens
tgagatttgtat

SEQ ID NO: 2791523 - DNA, 14 bp, Homo sapiens
tgagatttgtattt

SEQ ID NO: 2791524 - DNA, 16 bp, Homo sapiens
tgagcaaatgtggctc

SEQ ID NO: 2791525 - DNA, 19 bp, Homo sapiens
tgagcaaatgtggctcctg

SEQ ID NO: 2791526 - DNA, 13 bp, Homo sapiens
tgagcaccccctc

SEQ ID NO: 2791527 - DNA, 21 bp, Homo sapiens
tgagcactaaggtgtgctctg

SEQ ID NO: 2791528 - DNA, 13 bp, Homo sapiens
tgagcactgccag

SEQ ID NO: 2791529 - DNA, 12 bp, Homo sapiens
tgagcagggctc

SEQ ID NO: 2791530 - DNA, 14 bp, Homo sapiens
tgagcagggctcag

SEQ ID NO: 2791531 - DNA, 19 bp, Homo sapiens
tgagcagggctcagcgggg

SEQ ID NO: 2791532 - DNA, 20 bp, Homo sapiens
tgagcagggctcagcgggga

SEQ ID NO: 2791533 - DNA, 16 bp, Homo sapiens
tgagcagtagaagcct

SEQ ID NO: 2791534 - DNA, 16 bp, Homo sapiens
tgagcagtcacactgt

SEQ ID NO: 2791535 - DNA, 23 bp, Homo sapiens
tgagcatctctgtgtacccactc

SEQ ID NO: 2791536 - DNA, 19 bp, Homo sapiens
tgagccaagcttcaaccct

SEQ ID NO: 2791537 - DNA, 17 bp, Homo sapiens
tgagccacagaccacct

SEQ ID NO: 2791538 - DNA, 24 bp, Homo sapiens
tgagccacagaccacctgcttctg

SEQ ID NO: 2791539 - DNA, 18 bp, Homo sapiens
tgagccactgcaccgggc

SEQ ID NO: 2791540 - DNA, 20 bp, Homo sapiens
tgagccaggtaatgagggac

SEQ ID NO: 2791541 - DNA, 12 bp, Homo sapiens
tgagcccaggag

SEQ ID NO: 2791542 - DNA, 13 bp, Homo sapiens
tgagcccagggag

SEQ ID NO: 2791543 - DNA, 14 bp, Homo sapiens
tgagcccagggagg

SEQ ID NO: 2791544 - DNA, 15 bp, Homo sapiens
tgagcccagggaggc

SEQ ID NO: 2791545 - DNA, 19 bp, Homo sapiens
tgagccgagatcacgccac

SEQ ID NO: 2791546 - DNA, 22 bp, Homo sapiens
tgagccgagatcacgccactgc

SEQ ID NO: 2791547 - DNA, 20 bp, Homo sapiens
tgagccgcatcttctccatc

SEQ ID NO: 2791548 - DNA, 23 bp, Homo sapiens
tgagccgcatcttctccatctgg

SEQ ID NO: 2791549 - DNA, 20 bp, Homo sapiens
tgagcctaaatctaatcagg

SEQ ID NO: 2791550 - DNA, 16 bp, Homo sapiens
tgagcctgacctttct

SEQ ID NO: 2791551 - DNA, 22 bp, Homo sapiens
tgagcctgacctttctgagtga

SEQ ID NO: 2791552 - DNA, 22 bp, Homo sapiens
tgagcctgtcacgtggtcaagg

SEQ ID NO: 2791553 - DNA, 13 bp, Homo sapiens
tgagccttgtaat

SEQ ID NO: 2791554 - DNA, 19 bp, Homo sapiens
tgagctcagacccccactc

SEQ ID NO: 2791555 - DNA, 20 bp, Homo sapiens
tgagctcagacccccactct

SEQ ID NO: 2791556 - DNA, 21 bp, Homo sapiens
tgagctccccaaaaacctcac

SEQ ID NO: 2791557 - DNA, 12 bp, Homo sapiens
tgagctcctgcg

SEQ ID NO: 2791558 - DNA, 14 bp, Homo sapiens
tgagctcggtggac

SEQ ID NO: 2791559 - DNA, 20 bp, Homo sapiens
tgagctcggtggacccaggg

SEQ ID NO: 2791560 - DNA, 19 bp, Homo sapiens
cagcctagccgacctcagc

SEQ ID NO: 2791561 - DNA, 13 bp, Homo sapiens
cagcctcagaggc

SEQ ID NO: 2791562 - DNA, 14 bp, Homo sapiens
cagcctccaagctc

SEQ ID NO: 2791563 - DNA, 14 bp, Homo sapiens
cagcctcccaaccc

SEQ ID NO: 2791564 - DNA, 20 bp, Homo sapiens
cagcctcccgagtagctggg

SEQ ID NO: 2791565 - DNA, 13 bp, Homo sapiens
cagcctccctctg

SEQ ID NO: 2791566 - DNA, 15 bp, Homo sapiens
cagcctccctctgac

SEQ ID NO: 2791567 - DNA, 20 bp, Homo sapiens
cagcctcctcccaccaccct

SEQ ID NO: 2791568 - DNA, 21 bp, Homo sapiens
cagcctcgcatgccagagcct

SEQ ID NO: 2791569 - DNA, 21 bp, Homo sapiens
cagcctcttaaagctgcctgt

SEQ ID NO: 2791570 - DNA, 22 bp, Homo sapiens
cagcctgactagaccccaccct

SEQ ID NO: 2791571 - DNA, 10 bp, Homo sapiens
cagcctgagt

SEQ ID NO: 2791572 - DNA, 17 bp, Homo sapiens
cagcctgagtctcctgt

SEQ ID NO: 2791573 - DNA, 20 bp, Homo sapiens
cagcctgagtctcctgtgcc

SEQ ID NO: 2791574 - DNA, 22 bp, Homo sapiens
cagcctgagtctcctgtgccca

SEQ ID NO: 2791575 - DNA, 19 bp, Homo sapiens
cagcctgctaattccccag

SEQ ID NO: 2791576 - DNA, 14 bp, Homo sapiens
cagcctggcctcct

SEQ ID NO: 2791577 - DNA, 16 bp, Homo sapiens
cagcctggcttctgga

SEQ ID NO: 2791578 - DNA, 17 bp, Homo sapiens
cagcctggcttctggag

SEQ ID NO: 2791579 - DNA, 19 bp, Homo sapiens
cagcctggcttctggagcc

SEQ ID NO: 2791580 - DNA, 17 bp, Homo sapiens
cagcctgggaccagggc

SEQ ID NO: 2791581 - DNA, 20 bp, Homo sapiens
cagcctgggaccagggcata

SEQ ID NO: 2791582 - DNA, 23 bp, Homo sapiens
cagcctgggcctatggagagccc

SEQ ID NO: 2791583 - DNA, 11 bp, Homo sapiens
cagcctgggcg

SEQ ID NO: 2791584 - DNA, 17 bp, Homo sapiens
cagcctggtgggcctcc

SEQ ID NO: 2791585 - DNA, 23 bp, Homo sapiens
cagcctggtgggcctcctctgtc

SEQ ID NO: 2791586 - DNA, 21 bp, Homo sapiens
cagcctgtggcggtgcctggg

SEQ ID NO: 2791587 - DNA, 21 bp, Homo sapiens
cagccttggataatgctgttg

SEQ ID NO: 2791588 - DNA, 18 bp, Homo sapiens
cagcgagaggcagagaaa

SEQ ID NO: 2791589 - DNA, 17 bp, Homo sapiens
cagcgagccctggtggc

SEQ ID NO: 2791590 - DNA, 21 bp, Homo sapiens
cagcgagccctggtggcagtg

SEQ ID NO: 2791591 - DNA, 22 bp, Homo sapiens
cagcgagttgtggaaagcctct

SEQ ID NO: 2791592 - DNA, 23 bp, Homo sapiens
cagcgcctagtggggtctccctc

SEQ ID NO: 2791593 - DNA, 14 bp, Homo sapiens
cagcgcctccctcc

SEQ ID NO: 2791594 - DNA, 18 bp, Homo sapiens
cagcgcctccctccaccc

SEQ ID NO: 2791595 - DNA, 21 bp, Homo sapiens
cagcgcctccctccaccccag

SEQ ID NO: 2791596 - DNA, 12 bp, Homo sapiens
cagcgtggcctt

SEQ ID NO: 2791597 - DNA, 15 bp, Homo sapiens
cagcgtggccttgtt

SEQ ID NO: 2791598 - DNA, 18 bp, Homo sapiens
cagctaagctaggaatga

SEQ ID NO: 2791599 - DNA, 14 bp, Homo sapiens
cagctaatctgtag

SEQ ID NO: 2791600 - DNA, 17 bp, Homo sapiens
cagctaatctgtagggc

SEQ ID NO: 2791601 - DNA, 14 bp, Homo sapiens
cagctactcagaag

SEQ ID NO: 2791602 - DNA, 16 bp, Homo sapiens
cagctacttgggaggc

SEQ ID NO: 2791603 - DNA, 15 bp, Homo sapiens
cagctagggctggac

SEQ ID NO: 2791604 - DNA, 19 bp, Homo sapiens
cagctaggtggggcctaga

SEQ ID NO: 2791605 - DNA, 21 bp, Homo sapiens
cagctagtgacccacatgcca

SEQ ID NO: 2791606 - DNA, 13 bp, Homo sapiens
cagctcaccagcc

SEQ ID NO: 2791607 - DNA, 14 bp, Homo sapiens
cagctcaccagccc

SEQ ID NO: 2791608 - DNA, 22 bp, Homo sapiens
cagctcaccagccccagtgccc

SEQ ID NO: 2791609 - DNA, 14 bp, Homo sapiens
cagctcactccctg

SEQ ID NO: 2791610 - DNA, 15 bp, Homo sapiens
cagctcactccctgg

SEQ ID NO: 2791611 - DNA, 21 bp, Homo sapiens
cagctcagaagtttcttcttt

SEQ ID NO: 2791612 - DNA, 22 bp, Homo sapiens
cagctcagaagtttcttcttta

SEQ ID NO: 2791613 - DNA, 18 bp, Homo sapiens
cagctcagaggcccagga

SEQ ID NO: 2791614 - DNA, 21 bp, Homo sapiens
cagctcaggcacacttcttct

SEQ ID NO: 2791615 - DNA, 18 bp, Homo sapiens
cagctcagtcccatcaga

SEQ ID NO: 2791616 - DNA, 16 bp, Homo sapiens
cagctccagaatacct

SEQ ID NO: 2791617 - DNA, 19 bp, Homo sapiens
cagctccagaataccttct

SEQ ID NO: 2791618 - DNA, 13 bp, Homo sapiens
cagctccagctca

SEQ ID NO: 2791619 - DNA, 14 bp, Homo sapiens
cagctccagctcac

SEQ ID NO: 2791620 - DNA, 15 bp, Homo sapiens
cagctccagctcacc

SEQ ID NO: 2791621 - DNA, 18 bp, Homo sapiens
cagctccagctcaccagc

SEQ ID NO: 2791622 - DNA, 22 bp, Homo sapiens
cagctccagctcaccagcccca

SEQ ID NO: 2791623 - DNA, 12 bp, Homo sapiens
cagctcccaccc

SEQ ID NO: 2791624 - DNA, 14 bp, Homo sapiens
cagctcccacccca

SEQ ID NO: 2791625 - DNA, 15 bp, Homo sapiens
cagctcccaccccac

SEQ ID NO: 2791626 - DNA, 20 bp, Homo sapiens
cagctcccaccccaccccct

SEQ ID NO: 2791627 - DNA, 23 bp, Homo sapiens
cagctcccaccccacccccttca

SEQ ID NO: 2791628 - DNA, 12 bp, Homo sapiens
cagctccccagg

SEQ ID NO: 2791629 - DNA, 22 bp, Homo sapiens
cagctccccaggactcaccctc

SEQ ID NO: 2791630 - DNA, 21 bp, Homo sapiens
caggagagccagccctccctg

SEQ ID NO: 2791631 - DNA, 17 bp, Homo sapiens
caggagaggggcagaac

SEQ ID NO: 2791632 - DNA, 20 bp, Homo sapiens
caggagatggaagttgcagt

SEQ ID NO: 2791633 - DNA, 19 bp, Homo sapiens
caggagcaaatgtttctgc

SEQ ID NO: 2791634 - DNA, 18 bp, Homo sapiens
caggagcacaggcagctg

SEQ ID NO: 2791635 - DNA, 15 bp, Homo sapiens
caggagccccgaggc

SEQ ID NO: 2791636 - DNA, 23 bp, Homo sapiens
caggagccccgaggccttctctg

SEQ ID NO: 2791637 - DNA, 16 bp, Homo sapiens
caggagcctaccccct

SEQ ID NO: 2791638 - DNA, 11 bp, Homo sapiens
caggagcctgg

SEQ ID NO: 2791639 - DNA, 17 bp, Homo sapiens
caggagcttgcaagaag

SEQ ID NO: 2791640 - DNA, 19 bp, Homo sapiens
caggagcttgcaagaagca

SEQ ID NO: 2791641 - DNA, 22 bp, Homo sapiens
caggaggattgcttgagcccag

SEQ ID NO: 2791642 - DNA, 13 bp, Homo sapiens
caggaggctgagg

SEQ ID NO: 2791643 - DNA, 17 bp, Homo sapiens
caggaggctgaggcaga

SEQ ID NO: 2791644 - DNA, 19 bp, Homo sapiens
caggaggctgaggcaggag

SEQ ID NO: 2791645 - DNA, 19 bp, Homo sapiens
caggagggacaaaggagcc

SEQ ID NO: 2791646 - DNA, 21 bp, Homo sapiens
caggagggacaaaggagcctg

SEQ ID NO: 2791647 - DNA, 22 bp, Homo sapiens
caggagggacaaaggagcctgt

SEQ ID NO: 2791648 - DNA, 23 bp, Homo sapiens
caggagggacaaaggagcctgtg

SEQ ID NO: 2791649 - DNA, 18 bp, Homo sapiens
caggagggggtcgtggag

SEQ ID NO: 2791650 - DNA, 12 bp, Homo sapiens
aaaaaaaataca

SEQ ID NO: 2791651 - DNA, 13 bp, Homo sapiens
aaaaaaaattgca

SEQ ID NO: 2791652 - DNA, 13 bp, Homo sapiens
aaaaaaacacaaa

SEQ ID NO: 2791653 - DNA, 10 bp, Homo sapiens
aaaaaaagaa

SEQ ID NO: 2791654 - DNA, 13 bp, Homo sapiens
aaaaaaagacaag

SEQ ID NO: 2791655 - DNA, 12 bp, Homo sapiens
aaaaaaatacag

SEQ ID NO: 2791656 - DNA, 12 bp, Homo sapiens
aaaaaaatgact

SEQ ID NO: 2791657 - DNA, 12 bp, Homo sapiens
aaaaaagaaacc

SEQ ID NO: 2791658 - DNA, 24 bp, Homo sapiens
aaacattcatccagttgcaataaa

SEQ ID NO: 2791659 - DNA, 19 bp, Homo sapiens
aaacatttacaataaatat

SEQ ID NO: 2791660 - DNA, 17 bp, Homo sapiens
aaacatttattttgaca

SEQ ID NO: 2791661 - DNA, 20 bp, Homo sapiens
aaacatttattttgacataa

SEQ ID NO: 2791662 - DNA, 14 bp, Homo sapiens
aaacatttgtacat

SEQ ID NO: 2791663 - DNA, 21 bp, Homo sapiens
aaacatttgtacattcctgat

SEQ ID NO: 2791664 - DNA, 18 bp, Homo sapiens
aaaccagcagaaaagtgc

SEQ ID NO: 2791665 - DNA, 20 bp, Homo sapiens
aaaccagcagaaaagtgctt

SEQ ID NO: 2791666 - DNA, 19 bp, Homo sapiens
aaaccatccatctgtggaa

SEQ ID NO: 2791667 - DNA, 18 bp, Homo sapiens
aaaccatttaattcataa

SEQ ID NO: 2791668 - DNA, 21 bp, Homo sapiens
aaaccatttaattcataatta

SEQ ID NO: 2791669 - DNA, 23 bp, Homo sapiens
aaacccaaataaatgtgtaaatg

SEQ ID NO: 2791670 - DNA, 11 bp, Homo sapiens
aaacccagaga

SEQ ID NO: 2791671 - DNA, 20 bp, Homo sapiens
aaacctaaggcaacatttcc

SEQ ID NO: 2791672 - DNA, 22 bp, Homo sapiens
aaacctcatgacagccagagcc

SEQ ID NO: 2791673 - DNA, 15 bp, Homo sapiens
aaacctctatatgtt

SEQ ID NO: 2791674 - DNA, 18 bp, Homo sapiens
aaacctgtccataaagta

SEQ ID NO: 2791675 - DNA, 17 bp, Homo sapiens
aaacctttcaaatttca

SEQ ID NO: 2791676 - DNA, 20 bp, Homo sapiens
aaacgaacccactgtgctta

SEQ ID NO: 2791677 - DNA, 19 bp, Homo sapiens
aaacgagtcaatcccctca

SEQ ID NO: 2791678 - DNA, 16 bp, Homo sapiens
aaacgcacctccatcc

SEQ ID NO: 2791679 - DNA, 19 bp, Homo sapiens
aaacgtacttaactgtgtg

SEQ ID NO: 2791680 - DNA, 23 bp, Homo sapiens
aaacgtacttaactgtgtgaaga

SEQ ID NO: 2791681 - DNA, 23 bp, Homo sapiens
aaactacttttgtaccagtgtga

SEQ ID NO: 2791682 - DNA, 22 bp, Homo sapiens
aaactagtaatgggccaattaa

SEQ ID NO: 2791683 - DNA, 17 bp, Homo sapiens
aaactatggttcccaat

SEQ ID NO: 2791684 - DNA, 18 bp, Homo sapiens
aaactatggttcccaata

SEQ ID NO: 2791685 - DNA, 13 bp, Homo sapiens
aaactcaaaatat

SEQ ID NO: 2791686 - DNA, 18 bp, Homo sapiens
aaactgaggaattttctt

SEQ ID NO: 2791687 - DNA, 22 bp, Homo sapiens
aaactggggagttataaaaata

SEQ ID NO: 2791688 - DNA, 16 bp, Homo sapiens
aaactggggcctccct

SEQ ID NO: 2791689 - DNA, 22 bp, Homo sapiens
aaactggtttgttgcagccaaa

SEQ ID NO: 2791690 - DNA, 18 bp, Homo sapiens
aaactgtaaatacaaaat

SEQ ID NO: 2791691 - DNA, 20 bp, Homo sapiens
aaactgtttatggtattttc

SEQ ID NO: 2791692 - DNA, 19 bp, Homo sapiens
aaacttgtgtatgatccaa

SEQ ID NO: 2791693 - DNA, 21 bp, Homo sapiens
aaactttagagtagcatgaga

SEQ ID NO: 2791694 - DNA, 16 bp, Homo sapiens
aaactttgaagttagc

SEQ ID NO: 2791695 - DNA, 20 bp, Homo sapiens
aaactttgttatatatatca

SEQ ID NO: 2791696 - DNA, 16 bp, Homo sapiens
aaacttttaaacatga

SEQ ID NO: 2791697 - DNA, 15 bp, Homo sapiens
aaacttttaatgcct

SEQ ID NO: 2791698 - DNA, 17 bp, Homo sapiens
aaacttttttatttaaa

SEQ ID NO: 2791699 - DNA, 18 bp, Homo sapiens
aaagaaaaaataattgat

SEQ ID NO: 2791700 - DNA, 16 bp, Homo sapiens
aaagaaaaccatttta

SEQ ID NO: 2791701 - DNA, 19 bp, Homo sapiens
aaagaaaaccattttagtt

SEQ ID NO: 2791702 - DNA, 23 bp, Homo sapiens
aaagaaagttaggttataagaaa

SEQ ID NO: 2791703 - DNA, 14 bp, Homo sapiens
aaagaacaagaaat

SEQ ID NO: 2791704 - DNA, 15 bp, Homo sapiens
aaagaacagtaaaca

SEQ ID NO: 2791705 - DNA, 13 bp, Homo sapiens
aaagaagtaaaag

SEQ ID NO: 2791706 - DNA, 15 bp, Homo sapiens
aaagaagtttgatat

SEQ ID NO: 2791707 - DNA, 18 bp, Homo sapiens
aaagaataaatgaatctt

SEQ ID NO: 2791708 - DNA, 15 bp, Homo sapiens
aaagaatacagaaag

SEQ ID NO: 2791709 - DNA, 23 bp, Homo sapiens
aaagaattatttttgtgtttcta

SEQ ID NO: 2791710 - DNA, 20 bp, Homo sapiens
aaagacagtggatcatgaaa

SEQ ID NO: 2791711 - DNA, 22 bp, Homo sapiens
aaagacagtggatcatgaaaag

SEQ ID NO: 2791712 - DNA, 10 bp, Homo sapiens
aaagagacca

SEQ ID NO: 2791713 - DNA, 14 bp, Homo sapiens
aaagagaccagcac

SEQ ID NO: 2791714 - DNA, 15 bp, Homo sapiens
aaagagactggagca

SEQ ID NO: 2791715 - DNA, 15 bp, Homo sapiens
aaagagcaagtctgg

SEQ ID NO: 2791716 - DNA, 20 bp, Homo sapiens
aaagagttcaagaaataagt

SEQ ID NO: 2791717 - DNA, 16 bp, Homo sapiens
aaagatggatgtgctt

SEQ ID NO: 2791718 - DNA, 12 bp, Homo sapiens
aaagattatata

SEQ ID NO: 2791719 - DNA, 15 bp, Homo sapiens
aaagattatatatca

SEQ ID NO: 2791720 - DNA, 17 bp, Homo sapiens
aaagattatatatcata

SEQ ID NO: 2791721 - DNA, 21 bp, Homo sapiens
aaagattatatatcataaagt

SEQ ID NO: 2791722 - DNA, 13 bp, Homo sapiens
aaagattttttaa

SEQ ID NO: 2791723 - DNA, 14 bp, Homo sapiens
aaagattttttaat

SEQ ID NO: 2791724 - DNA, 22 bp, Homo sapiens
aaagattttttaataatttaga

SEQ ID NO: 2791725 - DNA, 16 bp, Homo sapiens
aaagcaaaaaagaaaa

SEQ ID NO: 2791726 - DNA, 13 bp, Homo sapiens
aaagcaaatgaga

SEQ ID NO: 2791727 - DNA, 14 bp, Homo sapiens
aaagcaagactgtt

SEQ ID NO: 2791728 - DNA, 22 bp, Homo sapiens
aaagcaccagcttctccaggct

SEQ ID NO: 2791729 - DNA, 19 bp, Homo sapiens
aaagcaccgcagcatgtgg

SEQ ID NO: 2791730 - DNA, 13 bp, Homo sapiens
aaagcacctgccg

SEQ ID NO: 2791731 - DNA, 11 bp, Homo sapiens
aaagcagtgtt

SEQ ID NO: 2791732 - DNA, 14 bp, Homo sapiens
aaagcatgaatggt

SEQ ID NO: 2791733 - DNA, 17 bp, Homo sapiens
aaagcatttactttgaa

SEQ ID NO: 2791734 - DNA, 13 bp, Homo sapiens
aaagccacatttt

SEQ ID NO: 2791735 - DNA, 15 bp, Homo sapiens
aaagccacattttgc

SEQ ID NO: 2791736 - DNA, 21 bp, Homo sapiens
aaagcccagctctttgttcag

SEQ ID NO: 2791737 - DNA, 20 bp, Homo sapiens
aaagctacctgtggtgatgt

SEQ ID NO: 2791738 - DNA, 14 bp, Homo sapiens
aaagctagaattga

SEQ ID NO: 2791739 - DNA, 13 bp, Homo sapiens
aaagctcaagatg

SEQ ID NO: 2791740 - DNA, 21 bp, Homo sapiens
aaagctcaagatgacagctct

SEQ ID NO: 2791741 - DNA, 18 bp, Homo sapiens
aaagctctgaacaaaagc

SEQ ID NO: 2791742 - DNA, 19 bp, Homo sapiens
aaagctggacaagaagctg

SEQ ID NO: 2791743 - DNA, 20 bp, Homo sapiens
aaagctggacaagaagctgc

SEQ ID NO: 2791744 - DNA, 18 bp, Homo sapiens
aaagctggtttaatgttt

SEQ ID NO: 2791745 - DNA, 15 bp, Homo sapiens
aaagcttaaatgcct

SEQ ID NO: 2791746 - DNA, 17 bp, Homo sapiens
aaaggaacacccggaaa

SEQ ID NO: 2791747 - DNA, 19 bp, Homo sapiens
aaaggagagaagagagaaa

SEQ ID NO: 2791748 - DNA, 20 bp, Homo sapiens
ctgctcctctccccagcaag

SEQ ID NO: 2791749 - DNA, 16 bp, Homo sapiens
ctgctcgaagaacaat

SEQ ID NO: 2791750 - DNA, 17 bp, Homo sapiens
ctgctcgaagaacaatg

SEQ ID NO: 2791751 - DNA, 20 bp, Homo sapiens
ctgctcggggtgcacaggag

SEQ ID NO: 2791752 - DNA, 22 bp, Homo sapiens
ctgctcggggtgcacaggaggg

SEQ ID NO: 2791753 - DNA, 23 bp, Homo sapiens
ctgctcggggtgcacaggagggg

SEQ ID NO: 2791754 - DNA, 15 bp, Homo sapiens
ctgctctattgtagc

SEQ ID NO: 2791755 - DNA, 16 bp, Homo sapiens
ctgctctcagcctccc

SEQ ID NO: 2791756 - DNA, 17 bp, Homo sapiens
ctgctctcagcctccca

SEQ ID NO: 2791757 - DNA, 19 bp, Homo sapiens
ctgctctccgaccagacac

SEQ ID NO: 2791758 - DNA, 15 bp, Homo sapiens
ctgctctctgaggga

SEQ ID NO: 2791759 - DNA, 22 bp, Homo sapiens
ctgctctgaggcttccagagag

SEQ ID NO: 2791760 - DNA, 13 bp, Homo sapiens
ctgctctggaaaa

SEQ ID NO: 2791761 - DNA, 12 bp, Homo sapiens
ctgctctggtta

SEQ ID NO: 2791762 - DNA, 14 bp, Homo sapiens
ctgctcttgcctgc

SEQ ID NO: 2791763 - DNA, 18 bp, Homo sapiens
ctgctcttgcctgcaccc

SEQ ID NO: 2791764 - DNA, 16 bp, Homo sapiens
ctgctgaaacacctcc

SEQ ID NO: 2791765 - DNA, 17 bp, Homo sapiens
ctgctgaaggaataaat

SEQ ID NO: 2791766 - DNA, 15 bp, Homo sapiens
ctgctgacagacaca

SEQ ID NO: 2791767 - DNA, 20 bp, Homo sapiens
ctgctgacagacacaggccc

SEQ ID NO: 2791768 - DNA, 21 bp, Homo sapiens
ctgctgacagacacaggcccg

SEQ ID NO: 2791769 - DNA, 21 bp, Homo sapiens
ctgctgagagacccaaggagg

SEQ ID NO: 2791770 - DNA, 20 bp, Homo sapiens
ctgctgcatttgtgtcatct

SEQ ID NO: 2791771 - DNA, 19 bp, Homo sapiens
ctgctgccccgcttcccca

SEQ ID NO: 2791772 - DNA, 13 bp, Homo sapiens
ctgctgcccctgc

SEQ ID NO: 2791773 - DNA, 17 bp, Homo sapiens
ctgctgcccctgcagtt

SEQ ID NO: 2791774 - DNA, 17 bp, Homo sapiens
ctgctgctgagaacctg

SEQ ID NO: 2791775 - DNA, 22 bp, Homo sapiens
ctgctgctgagaacctggcctt

SEQ ID NO: 2791776 - DNA, 12 bp, Homo sapiens
ctgctggcctgg

SEQ ID NO: 2791777 - DNA, 15 bp, Homo sapiens
ctgctggcctggatc

SEQ ID NO: 2791778 - DNA, 23 bp, Homo sapiens
ctgctgggaccccagctagggct

SEQ ID NO: 2791779 - DNA, 17 bp, Homo sapiens
ctgctgggactggccag

SEQ ID NO: 2791780 - DNA, 16 bp, Homo sapiens
ctgctgggctctccac

SEQ ID NO: 2791781 - DNA, 21 bp, Homo sapiens
ctgctgggctctccacctcag

SEQ ID NO: 2791782 - DNA, 22 bp, Homo sapiens
ctgctgggctctccacctcagc

SEQ ID NO: 2791783 - DNA, 18 bp, Homo sapiens
ctgctggtgcagagctga

SEQ ID NO: 2791784 - DNA, 21 bp, Homo sapiens
ctgctgtcattgtccatgcct

SEQ ID NO: 2791785 - DNA, 19 bp, Homo sapiens
ctgctgtgtagctctgtcc

SEQ ID NO: 2791786 - DNA, 20 bp, Homo sapiens
ctgctgtgtagctctgtcca

SEQ ID NO: 2791787 - DNA, 22 bp, Homo sapiens
ctgcttctcagccccgggcctg

SEQ ID NO: 2791788 - DNA, 14 bp, Homo sapiens
ctgcttctgaactc

SEQ ID NO: 2791789 - DNA, 15 bp, Homo sapiens
ctgcttctgaactca

SEQ ID NO: 2791790 - DNA, 20 bp, Homo sapiens
ctgcttctgaactcaagctg

SEQ ID NO: 2791791 - DNA, 16 bp, Homo sapiens
ctgcttgactatcaca

SEQ ID NO: 2791792 - DNA, 22 bp, Homo sapiens
ctgcttgactatcacatacaat

SEQ ID NO: 2791793 - DNA, 15 bp, Homo sapiens
ctgcttgttgtcaag

SEQ ID NO: 2791794 - DNA, 17 bp, Homo sapiens
ctgctttaaatctatct

SEQ ID NO: 2791795 - DNA, 13 bp, Homo sapiens
ctgctttcaactt

SEQ ID NO: 2791796 - DNA, 19 bp, Homo sapiens
ctgcttttgtctatgggac

SEQ ID NO: 2791797 - DNA, 14 bp, Homo sapiens
ctggaaaggctcag

SEQ ID NO: 2791798 - DNA, 17 bp, Homo sapiens
ctggaaaggctcagtct

SEQ ID NO: 2791799 - DNA, 22 bp, Homo sapiens
ctggaaaggctcagtctcagga

SEQ ID NO: 2791800 - DNA, 16 bp, Homo sapiens
ctggaacttgaactga

SEQ ID NO: 2791801 - DNA, 20 bp, Homo sapiens
ctggaacttgaactgattca

SEQ ID NO: 2791802 - DNA, 21 bp, Homo sapiens
ctggaagacgcaagggcctga

SEQ ID NO: 2791803 - DNA, 15 bp, Homo sapiens
ctggaagcacagctt

SEQ ID NO: 2791804 - DNA, 21 bp, Homo sapiens
ctggaagccggccggctggga

SEQ ID NO: 2791805 - DNA, 22 bp, Homo sapiens
ctggaagctgtgtccttgcacc

SEQ ID NO: 2791806 - DNA, 20 bp, Homo sapiens
ctggaagttttgcatttatg

SEQ ID NO: 2791807 - DNA, 21 bp, Homo sapiens
ctggaataagaagcaaataaa

SEQ ID NO: 2791808 - DNA, 18 bp, Homo sapiens
ctggaatacatgaaatat

SEQ ID NO: 2791809 - DNA, 23 bp, Homo sapiens
ctggaatcaagatgtcagactgg

SEQ ID NO: 2791810 - DNA, 22 bp, Homo sapiens
ctggaatcgatctgtactgtaa

SEQ ID NO: 2791811 - DNA, 16 bp, Homo sapiens
ctggaatgaagcatgt

SEQ ID NO: 2791812 - DNA, 12 bp, Homo sapiens
ctggacaaccca

SEQ ID NO: 2791813 - DNA, 15 bp, Homo sapiens
ctggacaagaagctg

SEQ ID NO: 2791814 - DNA, 16 bp, Homo sapiens
ctggacaagaagctgc

SEQ ID NO: 2791815 - DNA, 17 bp, Homo sapiens
ctggacaagaagctgct

SEQ ID NO: 2791816 - DNA, 23 bp, Homo sapiens
ctggacaagccaacttgtaaata

SEQ ID NO: 2791817 - DNA, 13 bp, Homo sapiens
ctggacagctgtg

SEQ ID NO: 2791818 - DNA, 16 bp, Homo sapiens
ctggacagctgtgcct

SEQ ID NO: 2791819 - DNA, 14 bp, Homo sapiens
ctggacagcttgtg

SEQ ID NO: 2791820 - DNA, 22 bp, Homo sapiens
ctggaccaaccctgtttcctga

SEQ ID NO: 2791821 - DNA, 20 bp, Homo sapiens
ctggaccaccagccccagca

SEQ ID NO: 2791822 - DNA, 14 bp, Homo sapiens
ctggaccactgggc

SEQ ID NO: 2791823 - DNA, 19 bp, Homo sapiens
ctggacctatgtcctaagg

SEQ ID NO: 2791824 - DNA, 17 bp, Homo sapiens
ctggaccttgaactggg

SEQ ID NO: 2791825 - DNA, 17 bp, Homo sapiens
ctggacgcccagctgag

SEQ ID NO: 2791826 - DNA, 19 bp, Homo sapiens
ctggacgcccagctgaggc

SEQ ID NO: 2791827 - DNA, 22 bp, Homo sapiens
ctggacgcccagctgaggctgg

SEQ ID NO: 2791828 - DNA, 19 bp, Homo sapiens
ctggactcctctgtccagg

SEQ ID NO: 2791829 - DNA, 15 bp, Homo sapiens
ctggactctggcacc

SEQ ID NO: 2791830 - DNA, 18 bp, Homo sapiens
ctggactctggcacccag

SEQ ID NO: 2791831 - DNA, 18 bp, Homo sapiens
ctggacttgagcttggca

SEQ ID NO: 2791832 - DNA, 20 bp, Homo sapiens
ctggacttgagcttggcagc

SEQ ID NO: 2791833 - DNA, 19 bp, Homo sapiens
ctggagaagaccctccccg

SEQ ID NO: 2791834 - DNA, 14 bp, Homo sapiens
ctggagaagcagtg

SEQ ID NO: 2791835 - DNA, 21 bp, Homo sapiens
ctggagaagcagtgagccgca

SEQ ID NO: 2791836 - DNA, 13 bp, Homo sapiens
ctggagaagctga

SEQ ID NO: 2791837 - DNA, 12 bp, Homo sapiens
ctggagagaagt

SEQ ID NO: 2791838 - DNA, 22 bp, Homo sapiens
ctggagcatctgactcacaaga

SEQ ID NO: 2791839 - DNA, 19 bp, Homo sapiens
ctggagcctcggtggccat

SEQ ID NO: 2791840 - DNA, 23 bp, Homo sapiens
ctggagcctcggtggccatgctt

SEQ ID NO: 2791841 - DNA, 22 bp, Homo sapiens
ctggagcggctctcctgagagg

SEQ ID NO: 2791842 - DNA, 22 bp, Homo sapiens
ctggaggacctgagcctgccga

SEQ ID NO: 2791843 - DNA, 17 bp, Homo sapiens
ctggaggattttccagt

SEQ ID NO: 2791844 - DNA, 12 bp, Homo sapiens
ctggaggcaggg

SEQ ID NO: 2791845 - DNA, 14 bp, Homo sapiens
ctggaggcagggcc

SEQ ID NO: 2791846 - DNA, 23 bp, Homo sapiens
ctggaggcagggccttgcccaga

SEQ ID NO: 2791847 - DNA, 20 bp, Homo sapiens
ctggagggtgagaggaaggg

SEQ ID NO: 2791848 - DNA, 14 bp, Homo sapiens
ctggagtctccagt

SEQ ID NO: 2791849 - DNA, 15 bp, Homo sapiens
ctggagtgcagtgag

SEQ ID NO: 2791850 - DNA, 17 bp, Homo sapiens
ctggagtgcagtgagcc

SEQ ID NO: 2791851 - DNA, 20 bp, Homo sapiens
ctggagtgcagtgagccgag

SEQ ID NO: 2791852 - DNA, 14 bp, Homo sapiens
ctggagtgcagtgg

SEQ ID NO: 2791853 - DNA, 20 bp, Homo sapiens
ctggatatgttgttaaacac

SEQ ID NO: 2791854 - DNA, 13 bp, Homo sapiens
ctggatcagcgtg

SEQ ID NO: 2791855 - DNA, 20 bp, Homo sapiens
ctggatctgggaccctttcc

SEQ ID NO: 2791856 - DNA, 16 bp, Homo sapiens
ctggatggcaccagag

SEQ ID NO: 2791857 - DNA, 23 bp, Homo sapiens
ctggatggcaccagaggctgcag

SEQ ID NO: 2791858 - DNA, 14 bp, Homo sapiens
ctggatgtgcccac

SEQ ID NO: 2791859 - DNA, 19 bp, Homo sapiens
ctggatgtgcccacaggga

SEQ ID NO: 2791860 - DNA, 20 bp, Homo sapiens
ctggattttcagcgaacatg

SEQ ID NO: 2791861 - DNA, 18 bp, Homo sapiens
ctggcaaaggtggctctc

SEQ ID NO: 2791862 - DNA, 22 bp, Homo sapiens
ctggcaaaggtggctctccagt

SEQ ID NO: 2791863 - DNA, 14 bp, Homo sapiens
ctggcaacagagca

SEQ ID NO: 2791864 - DNA, 12 bp, Homo sapiens
ctggcacacatc

SEQ ID NO: 2791865 - DNA, 17 bp, Homo sapiens
ctggcacccggcccctg

SEQ ID NO: 2791866 - DNA, 18 bp, Homo sapiens
ctggcacccggcccctgc

SEQ ID NO: 2791867 - DNA, 15 bp, Homo sapiens
ctggcactcccctga

SEQ ID NO: 2791868 - DNA, 16 bp, Homo sapiens
ctggcagagaaggctt

SEQ ID NO: 2791869 - DNA, 14 bp, Homo sapiens
ctggcagctgtcat

SEQ ID NO: 2791870 - DNA, 18 bp, Homo sapiens
ctggcaggatgaccctgc

SEQ ID NO: 2791871 - DNA, 18 bp, Homo sapiens
ctggcagggtgggatgga

SEQ ID NO: 2791872 - DNA, 21 bp, Homo sapiens
ctggcatgaccatcctgtcct

SEQ ID NO: 2791873 - DNA, 15 bp, Homo sapiens
ctggcattacagctg

SEQ ID NO: 2791874 - DNA, 19 bp, Homo sapiens
ctggccaagctgaggtgcc

SEQ ID NO: 2791875 - DNA, 23 bp, Homo sapiens
ctggccaagctgaggtgcccagg

SEQ ID NO: 2791876 - DNA, 16 bp, Homo sapiens
ctggccagatgcacca

SEQ ID NO: 2791877 - DNA, 19 bp, Homo sapiens
ctggccagatgcaccagcc

SEQ ID NO: 2791878 - DNA, 17 bp, Homo sapiens
ctggcccagagctggaa

SEQ ID NO: 2791879 - DNA, 16 bp, Homo sapiens
ctggcccccctccagg

SEQ ID NO: 2791880 - DNA, 18 bp, Homo sapiens
ctggcccccctccaggca

SEQ ID NO: 2791881 - DNA, 12 bp, Homo sapiens
ctggccctgcct

SEQ ID NO: 2791882 - DNA, 15 bp, Homo sapiens
ctggccgcctccagg

SEQ ID NO: 2791883 - DNA, 18 bp, Homo sapiens
ctggccggcaaccccagt

SEQ ID NO: 2791884 - DNA, 23 bp, Homo sapiens
ctggccggctccagtttccccat

SEQ ID NO: 2791885 - DNA, 16 bp, Homo sapiens
ctggcctcaaagcaag

SEQ ID NO: 2791886 - DNA, 14 bp, Homo sapiens
ctggcctggatctc

SEQ ID NO: 2791887 - DNA, 15 bp, Homo sapiens
ctggcctggatctcc

SEQ ID NO: 2791888 - DNA, 22 bp, Homo sapiens
ctggcctggatctccccactct

SEQ ID NO: 2791889 - DNA, 13 bp, Homo sapiens
ctggcctggcaca

SEQ ID NO: 2791890 - DNA, 15 bp, Homo sapiens
ctggcctggccggca

SEQ ID NO: 2791891 - DNA, 17 bp, Homo sapiens
ctggcctggctctcctg

SEQ ID NO: 2791892 - DNA, 16 bp, Homo sapiens
ctggcggctactcagc

SEQ ID NO: 2791893 - DNA, 17 bp, Homo sapiens
ctggcggctactcagca

SEQ ID NO: 2791894 - DNA, 18 bp, Homo sapiens
ctggcggctactcagcag

SEQ ID NO: 2791895 - DNA, 23 bp, Homo sapiens
ctggcggctactcagcagccctc

SEQ ID NO: 2791896 - DNA, 13 bp, Homo sapiens
ctggctcttctct

SEQ ID NO: 2791897 - DNA, 18 bp, Homo sapiens
ctggctgaaaatcactat

SEQ ID NO: 2791898 - DNA, 13 bp, Homo sapiens
ctggctgagggca

SEQ ID NO: 2791899 - DNA, 15 bp, Homo sapiens
ctggctggctgaggg

SEQ ID NO: 2791900 - DNA, 15 bp, Homo sapiens
ctggctgggcatgga

SEQ ID NO: 2791901 - DNA, 16 bp, Homo sapiens
ctggctgttggctggg

SEQ ID NO: 2791902 - DNA, 18 bp, Homo sapiens
ctggctgttggctggggg

SEQ ID NO: 2791903 - DNA, 20 bp, Homo sapiens
ctggctgttggctgggggcc

SEQ ID NO: 2791904 - DNA, 16 bp, Homo sapiens
ctggcttccaggtatc

SEQ ID NO: 2791905 - DNA, 16 bp, Homo sapiens
ctggcttcccatcccc

SEQ ID NO: 2791906 - DNA, 16 bp, Homo sapiens
ctggcttctggagccc

SEQ ID NO: 2791907 - DNA, 17 bp, Homo sapiens
ctggcttgtaactccac

SEQ ID NO: 2791908 - DNA, 14 bp, Homo sapiens
ctggctttgacatg

SEQ ID NO: 2791909 - DNA, 23 bp, Homo sapiens
ctggctttgacatgaaaagatag

SEQ ID NO: 2791910 - DNA, 17 bp, Homo sapiens
ctgggaaataagagaga

SEQ ID NO: 2791911 - DNA, 18 bp, Homo sapiens
ctgggaacccgactgtga

SEQ ID NO: 2791912 - DNA, 23 bp, Homo sapiens
ctgggaaggctacttcggggctg

SEQ ID NO: 2791913 - DNA, 16 bp, Homo sapiens
ctgggaccccagctag

SEQ ID NO: 2791914 - DNA, 22 bp, Homo sapiens
ctgggaccccagctagggctgg

SEQ ID NO: 2791915 - DNA, 14 bp, Homo sapiens
ctgggaccctttcc

SEQ ID NO: 2791916 - DNA, 19 bp, Homo sapiens
ctgggaccctttccttcct

SEQ ID NO: 2791917 - DNA, 17 bp, Homo sapiens
ctgggactacaggcacc

SEQ ID NO: 2791918 - DNA, 17 bp, Homo sapiens
ctgggagaacctcaggc

SEQ ID NO: 2791919 - DNA, 18 bp, Homo sapiens
ctgggaggaacctgaacc

SEQ ID NO: 2791920 - DNA, 13 bp, Homo sapiens
ctgggaggaagca

SEQ ID NO: 2791921 - DNA, 12 bp, Homo sapiens
ctgggagtgagc

SEQ ID NO: 2791922 - DNA, 13 bp, Homo sapiens
ctgggagtgagct

SEQ ID NO: 2791923 - DNA, 21 bp, Homo sapiens
tcaatgaaatatttgcttatt

SEQ ID NO: 2791924 - DNA, 14 bp, Homo sapiens
tcaatgacctgtat

SEQ ID NO: 2791925 - DNA, 15 bp, Homo sapiens
tcaatgacctgtatt

SEQ ID NO: 2791926 - DNA, 13 bp, Homo sapiens
tcaatgcttttct

SEQ ID NO: 2791927 - DNA, 21 bp, Homo sapiens
tcaatgttcacgcaacttgaa

SEQ ID NO: 2791928 - DNA, 22 bp, Homo sapiens
tcaatgtttatgcaaggaagga

SEQ ID NO: 2791929 - DNA, 13 bp, Homo sapiens
tcaattaaatgta

SEQ ID NO: 2791930 - DNA, 14 bp, Homo sapiens
tcaattagtacagt

SEQ ID NO: 2791931 - DNA, 15 bp, Homo sapiens
tcaattcaacacatt

SEQ ID NO: 2791932 - DNA, 18 bp, Homo sapiens
tcaattcaacacattact

SEQ ID NO: 2791933 - DNA, 24 bp, Homo sapiens
tcaattcaacacattacttgcaca

SEQ ID NO: 2791934 - DNA, 14 bp, Homo sapiens
tcaattccacctgc

SEQ ID NO: 2791935 - DNA, 13 bp, Homo sapiens
tcaattcctgggc

SEQ ID NO: 2791936 - DNA, 17 bp, Homo sapiens
tcaattcctgggcccca

SEQ ID NO: 2791937 - DNA, 13 bp, Homo sapiens
tcaatttccaaga

SEQ ID NO: 2791938 - DNA, 22 bp, Homo sapiens
aaaacctcacccgaggctgccc

SEQ ID NO: 2791939 - DNA, 17 bp, Homo sapiens
aaaactatggttcccaa

SEQ ID NO: 2791940 - DNA, 20 bp, Homo sapiens
aaaactggaaatctggattt

SEQ ID NO: 2791941 - DNA, 17 bp, Homo sapiens
aaaactggaataagaag

SEQ ID NO: 2791942 - DNA, 21 bp, Homo sapiens
aaaactggaataagaagcaaa

SEQ ID NO: 2791943 - DNA, 13 bp, Homo sapiens
aaaactttaaagc

SEQ ID NO: 2791944 - DNA, 12 bp, Homo sapiens
aaaactttcatt

SEQ ID NO: 2791945 - DNA, 17 bp, Homo sapiens
aaaagaaaaccatttta

SEQ ID NO: 2791946 - DNA, 20 bp, Homo sapiens
aaaagaaaaccattttagtt

SEQ ID NO: 2791947 - DNA, 20 bp, Homo sapiens
aaacaccaccaaatgacaag

SEQ ID NO: 2791948 - DNA, 14 bp, Homo sapiens
aaacacctcccagg

SEQ ID NO: 2791949 - DNA, 12 bp, Homo sapiens
aaacacctgaca

SEQ ID NO: 2791950 - DNA, 12 bp, Homo sapiens
aaacactgtaat

SEQ ID NO: 2791951 - DNA, 21 bp, Homo sapiens
aaacacttctcatcatattgt

SEQ ID NO: 2791952 - DNA, 21 bp, Homo sapiens
aaacagaaacaaaaacactaa

SEQ ID NO: 2791953 - DNA, 22 bp, Homo sapiens
aaacagacaaaaacagcctcac

SEQ ID NO: 2791954 - DNA, 17 bp, Homo sapiens
aatcagactcatctaca

SEQ ID NO: 2791955 - DNA, 14 bp, Homo sapiens
aatcagatagatat

SEQ ID NO: 2791956 - DNA, 21 bp, Homo sapiens
aatcagatagatattcctatt

SEQ ID NO: 2791957 - DNA, 12 bp, Homo sapiens
aatcagcctctt

SEQ ID NO: 2791958 - DNA, 20 bp, Homo sapiens
aatcagcttttaataaaatt

SEQ ID NO: 2791959 - DNA, 18 bp, Homo sapiens
aatcataaactgtgtgca

SEQ ID NO: 2791960 - DNA, 20 bp, Homo sapiens
aatcataattttcaagagaa

SEQ ID NO: 2791961 - DNA, 22 bp, Homo sapiens
aatcatgaatatttcaaaataa

SEQ ID NO: 2791962 - DNA, 18 bp, Homo sapiens
aatcatgagtcagacatt

SEQ ID NO: 2791963 - DNA, 19 bp, Homo sapiens
aatcatgtacatttctgaa

SEQ ID NO: 2791964 - DNA, 20 bp, Homo sapiens
aatcattttaattattattc

SEQ ID NO: 2791965 - DNA, 10 bp, Homo sapiens
aatccaaaga

SEQ ID NO: 2791966 - DNA, 11 bp, Homo sapiens
aatccaaagaa

SEQ ID NO: 2791967 - DNA, 17 bp, Homo sapiens
aatccaacccatgatga

SEQ ID NO: 2791968 - DNA, 17 bp, Homo sapiens
aatccagtgtgcacccc

SEQ ID NO: 2791969 - DNA, 15 bp, Homo sapiens
aatccatgcttgggt

SEQ ID NO: 2791970 - DNA, 18 bp, Homo sapiens
aatcccattcataacttt

SEQ ID NO: 2791971 - DNA, 14 bp, Homo sapiens
aatcccctcattca

SEQ ID NO: 2791972 - DNA, 18 bp, Homo sapiens
aatcctattaaaacacag

SEQ ID NO: 2791973 - DNA, 21 bp, Homo sapiens
aatcctattaaaacacagctt

SEQ ID NO: 2791974 - DNA, 19 bp, Homo sapiens
aatcctgtcgattagactg

SEQ ID NO: 2791975 - DNA, 14 bp, Homo sapiens
aatcgaaatgaatt

SEQ ID NO: 2791976 - DNA, 16 bp, Homo sapiens
aatcgacctcactgtc

SEQ ID NO: 2791977 - DNA, 13 bp, Homo sapiens
aatcgattggctt

SEQ ID NO: 2791978 - DNA, 22 bp, Homo sapiens
aatcggatctggggctctggga

SEQ ID NO: 2791979 - DNA, 23 bp, Homo sapiens
aatcggatctggggctctgggat

SEQ ID NO: 2791980 - DNA, 20 bp, Homo sapiens
aatctagatcaattaattct

SEQ ID NO: 2791981 - DNA, 21 bp, Homo sapiens
aatctagatcaattaattctt

SEQ ID NO: 2791982 - DNA, 12 bp, Homo sapiens
aatctattcaga

SEQ ID NO: 2791983 - DNA, 13 bp, Homo sapiens
aatctattcagac

SEQ ID NO: 2791984 - DNA, 15 bp, Homo sapiens
aatctcagagacagg

SEQ ID NO: 2791985 - DNA, 21 bp, Homo sapiens
aatctccagggctgcccctgt

SEQ ID NO: 2791986 - DNA, 22 bp, Homo sapiens
aatctccagggctgcccctgta

SEQ ID NO: 2791987 - DNA, 18 bp, Homo sapiens
aatctcctcttttatctt

SEQ ID NO: 2791988 - DNA, 20 bp, Homo sapiens
aatctctcggttccacgtcc

SEQ ID NO: 2791989 - DNA, 11 bp, Homo sapiens
aatctctgtga

SEQ ID NO: 2791990 - DNA, 19 bp, Homo sapiens
aatctgagcctaaatctaa

SEQ ID NO: 2791991 - DNA, 20 bp, Homo sapiens
aatctgagcctaaatctaat

SEQ ID NO: 2791992 - DNA, 19 bp, Homo sapiens
aatctgattggacattttc

SEQ ID NO: 2791993 - DNA, 15 bp, Homo sapiens
aatctggactcctct

SEQ ID NO: 2791994 - DNA, 17 bp, Homo sapiens
aatctggactcctctgt

SEQ ID NO: 2791995 - DNA, 19 bp, Homo sapiens
aatctggcaaagttatatt

SEQ ID NO: 2791996 - DNA, 15 bp, Homo sapiens
aatctgggactttca

SEQ ID NO: 2791997 - DNA, 19 bp, Homo sapiens
aatctgtagggctggacct

SEQ ID NO: 2791998 - DNA, 21 bp, Homo sapiens
aatacagacactaagttatag

SEQ ID NO: 2791999 - DNA, 16 bp, Homo sapiens
aatacagggcatgcat

SEQ ID NO: 2792000 - DNA, 13 bp, Homo sapiens
aatacagtaaagt

SEQ ID NO: 2792001 - DNA, 18 bp, Homo sapiens
aatacagtaaagtttaaa

SEQ ID NO: 2792002 - DNA, 19 bp, Homo sapiens
aatacagtaaagtttaaaa

SEQ ID NO: 2792003 - DNA, 21 bp, Homo sapiens
aatacatgctaagagaagtag

SEQ ID NO: 2792004 - DNA, 19 bp, Homo sapiens
aatacatgtgtggatgtgt

SEQ ID NO: 2792005 - DNA, 16 bp, Homo sapiens
aatacctctgtgtgct

SEQ ID NO: 2792006 - DNA, 19 bp, Homo sapiens
aatactccaagcttcaagt

SEQ ID NO: 2792007 - DNA, 22 bp, Homo sapiens
aatacttctcattttttaaaaa

SEQ ID NO: 2792008 - DNA, 13 bp, Homo sapiens
aatagctgggact

SEQ ID NO: 2792009 - DNA, 21 bp, Homo sapiens
aataggatgataggaaataaa

SEQ ID NO: 2792010 - DNA, 18 bp, Homo sapiens
aatagtatttatgaaatg

SEQ ID NO: 2792011 - DNA, 13 bp, Homo sapiens
aatagtcaagaaa

SEQ ID NO: 2792012 - DNA, 17 bp, Homo sapiens
aatataaacttgtgtat

SEQ ID NO: 2792013 - DNA, 23 bp, Homo sapiens
aatataaataaataaaaatattc

SEQ ID NO: 2792014 - DNA, 20 bp, Homo sapiens
aatataagaacttgatatat

SEQ ID NO: 2792015 - DNA, 20 bp, Homo sapiens
aatatacaaacatgtggcaa

SEQ ID NO: 2792016 - DNA, 17 bp, Homo sapiens
aatatactatatttatg

SEQ ID NO: 2792017 - DNA, 14 bp, Homo sapiens
aatatagttctgat

SEQ ID NO: 2792018 - DNA, 19 bp, Homo sapiens
aatatataatggtttactg

SEQ ID NO: 2792019 - DNA, 20 bp, Homo sapiens
aatatataatggtttactgc

SEQ ID NO: 2792020 - DNA, 16 bp, Homo sapiens
aatatatataaatata

SEQ ID NO: 2792021 - DNA, 12 bp, Homo sapiens
aatatatatttt

SEQ ID NO: 2792022 - DNA, 14 bp, Homo sapiens
aagctagagatatg

SEQ ID NO: 2792023 - DNA, 17 bp, Homo sapiens
aagctaggcctggccag

SEQ ID NO: 2792024 - DNA, 18 bp, Homo sapiens
aagctaggcctggccaga

SEQ ID NO: 2792025 - DNA, 17 bp, Homo sapiens
aagctatccaaataact

SEQ ID NO: 2792026 - DNA, 15 bp, Homo sapiens
aagctattgatgttt

SEQ ID NO: 2792027 - DNA, 18 bp, Homo sapiens
aagctattgatgtttcca

SEQ ID NO: 2792028 - DNA, 11 bp, Homo sapiens
aagctcacagt

SEQ ID NO: 2792029 - DNA, 20 bp, Homo sapiens
aagctcacagttcctcgccc

SEQ ID NO: 2792030 - DNA, 14 bp, Homo sapiens
aagctccatctcca

SEQ ID NO: 2792031 - DNA, 19 bp, Homo sapiens
aagctctgaacaaaagctt

SEQ ID NO: 2792032 - DNA, 13 bp, Homo sapiens
aagctctgctcct

SEQ ID NO: 2792033 - DNA, 18 bp, Homo sapiens
aagctctggccccaggct

SEQ ID NO: 2792034 - DNA, 18 bp, Homo sapiens
aagctgaggtgcccagga

SEQ ID NO: 2792035 - DNA, 11 bp, Homo sapiens
aagctgcagct

SEQ ID NO: 2792036 - DNA, 16 bp, Homo sapiens
aagctgcagcttcctg

SEQ ID NO: 2792037 - DNA, 15 bp, Homo sapiens
aagctgccctgccca

SEQ ID NO: 2792038 - DNA, 19 bp, Homo sapiens
aagctgcctgtagttagga

SEQ ID NO: 2792039 - DNA, 22 bp, Homo sapiens
aagctgcctgtagttaggaaat

SEQ ID NO: 2792040 - DNA, 19 bp, Homo sapiens
aagctgcttgactatcaca

SEQ ID NO: 2792041 - DNA, 20 bp, Homo sapiens
aagctgcttgactatcacat

SEQ ID NO: 2792042 - DNA, 23 bp, Homo sapiens
aagctgcttgactatcacataca

SEQ ID NO: 2792043 - DNA, 11 bp, Homo sapiens
aagctggaagc

SEQ ID NO: 2792044 - DNA, 17 bp, Homo sapiens
aagctggacaagaagct

SEQ ID NO: 2792045 - DNA, 19 bp, Homo sapiens
aagctggcagctgtcattc

SEQ ID NO: 2792046 - DNA, 18 bp, Homo sapiens
aagctggtcccactcagt

SEQ ID NO: 2792047 - DNA, 21 bp, Homo sapiens
aagctggtcccactcagtcca

SEQ ID NO: 2792048 - DNA, 16 bp, Homo sapiens
aagctggtttaatgtt

SEQ ID NO: 2792049 - DNA, 13 bp, Homo sapiens
aagctgtggccag

SEQ ID NO: 2792050 - DNA, 12 bp, Homo sapiens
aagctgtgtcct

SEQ ID NO: 2792051 - DNA, 13 bp, Homo sapiens
aagcttaaaactt

SEQ ID NO: 2792052 - DNA, 17 bp, Homo sapiens
aagcttaaaactttgaa

SEQ ID NO: 2792053 - DNA, 19 bp, Homo sapiens
aagcttaatggctgataat

SEQ ID NO: 2792054 - DNA, 21 bp, Homo sapiens
aagcttaatggctgataattt

SEQ ID NO: 2792055 - DNA, 18 bp, Homo sapiens
aagcttcaaccctcagcc

SEQ ID NO: 2792056 - DNA, 18 bp, Homo sapiens
aagcttcaagtgatatat

SEQ ID NO: 2792057 - DNA, 20 bp, Homo sapiens
aagcttcaagtgatatatgt

SEQ ID NO: 2792058 - DNA, 15 bp, Homo sapiens
aagcttgtatataca

SEQ ID NO: 2792059 - DNA, 17 bp, Homo sapiens
aagcttgtatatacata

SEQ ID NO: 2792060 - DNA, 22 bp, Homo sapiens
aagcttgtatatacatattata

SEQ ID NO: 2792061 - DNA, 23 bp, Homo sapiens
aagctttcttctacaaccagagc

SEQ ID NO: 2792062 - DNA, 21 bp, Homo sapiens
aaggaaacttgaatcaaagca

SEQ ID NO: 2792063 - DNA, 19 bp, Homo sapiens
aaggaacagtgctgttctg

SEQ ID NO: 2792064 - DNA, 14 bp, Homo sapiens
aaggaactggaaca

SEQ ID NO: 2792065 - DNA, 22 bp, Homo sapiens
aaggaagccacagctggtggta

SEQ ID NO: 2792066 - DNA, 12 bp, Homo sapiens
aaggaaggaaaa

SEQ ID NO: 2792067 - DNA, 22 bp, Homo sapiens
aaggaaggagactcacctctgc

SEQ ID NO: 2792068 - DNA, 15 bp, Homo sapiens
aaggaatctgtgcag

SEQ ID NO: 2792069 - DNA, 21 bp, Homo sapiens
aaggaatctgtgcagatgagc

SEQ ID NO: 2792070 - DNA, 21 bp, Homo sapiens
aaggaatgtagctggtttcct

SEQ ID NO: 2792071 - DNA, 20 bp, Homo sapiens
aaggaattctaggcatccca

SEQ ID NO: 2792072 - DNA, 17 bp, Homo sapiens
aaggaccgtttttacta

SEQ ID NO: 2792073 - DNA, 17 bp, Homo sapiens
aaggagactcacctctg

SEQ ID NO: 2792074 - DNA, 20 bp, Homo sapiens
aaggagactcacctctgcct

SEQ ID NO: 2792075 - DNA, 12 bp, Homo sapiens
aaggagcctgtg

SEQ ID NO: 2792076 - DNA, 21 bp, Homo sapiens
aaggagcctgtgaacccagga

SEQ ID NO: 2792077 - DNA, 16 bp, Homo sapiens
aaggagggacaagaat

SEQ ID NO: 2792078 - DNA, 20 bp, Homo sapiens
aaggaggggatagagagaga

SEQ ID NO: 2792079 - DNA, 20 bp, Homo sapiens
aaggatctctcaggagcaca

SEQ ID NO: 2792080 - DNA, 19 bp, Homo sapiens
aaggatgttttgtcccatt

SEQ ID NO: 2792081 - DNA, 17 bp, Homo sapiens
aaggcacaggtgtaaat

SEQ ID NO: 2792082 - DNA, 16 bp, Homo sapiens
aaggcagcaaggcccg

SEQ ID NO: 2792083 - DNA, 16 bp, Homo sapiens
aaggcaggaatgtgtg

SEQ ID NO: 2792084 - DNA, 16 bp, Homo sapiens
aaggcagtgttcctca

SEQ ID NO: 2792085 - DNA, 16 bp, Homo sapiens
aaggcccgagcagctg

SEQ ID NO: 2792086 - DNA, 23 bp, Homo sapiens
aaggcccggccccatcagaggct

SEQ ID NO: 2792087 - DNA, 14 bp, Homo sapiens
aaggccgctgcccc

SEQ ID NO: 2792088 - DNA, 19 bp, Homo sapiens
aaggccgctgccccagccc

SEQ ID NO: 2792089 - DNA, 15 bp, Homo sapiens
aaggcctggggtgac

SEQ ID NO: 2792090 - DNA, 22 bp, Homo sapiens
aaggcctggggtgacccggcac

SEQ ID NO: 2792091 - DNA, 15 bp, Homo sapiens
aaggctgaccaagag

SEQ ID NO: 2792092 - DNA, 16 bp, Homo sapiens
aaggctgaccaagaga

SEQ ID NO: 2792093 - DNA, 17 bp, Homo sapiens
aaggctgaccaagagag

SEQ ID NO: 2792094 - DNA, 12 bp, Homo sapiens
aagggaaaaata

SEQ ID NO: 2792095 - DNA, 19 bp, Homo sapiens
aagggaaggctgctgtgta

SEQ ID NO: 2792096 - DNA, 19 bp, Homo sapiens
aagggacagtattctcagt

SEQ ID NO: 2792097 - DNA, 13 bp, Homo sapiens
aagggagggctct

SEQ ID NO: 2792098 - DNA, 18 bp, Homo sapiens
aagggccagtctgggctg

SEQ ID NO: 2792099 - DNA, 13 bp, Homo sapiens
aagggcccagaga

SEQ ID NO: 2792100 - DNA, 13 bp, Homo sapiens
aaggggccctggt

SEQ ID NO: 2792101 - DNA, 13 bp, Homo sapiens
aagggtaaagaag

SEQ ID NO: 2792102 - DNA, 16 bp, Homo sapiens
aagggtatcaggtgct

SEQ ID NO: 2792103 - DNA, 20 bp, Homo sapiens
aagggtctagggagagaccc

SEQ ID NO: 2792104 - DNA, 22 bp, Homo sapiens
aagggtctagggagagaccctt

SEQ ID NO: 2792105 - DNA, 15 bp, Homo sapiens
aagggtctgataaac

SEQ ID NO: 2792106 - DNA, 18 bp, Homo sapiens
aagggtggtctgagcacc

SEQ ID NO: 2792107 - DNA, 12 bp, Homo sapiens
aaggtaatccta

SEQ ID NO: 2792108 - DNA, 17 bp, Homo sapiens
aaggtagaacctcacct

SEQ ID NO: 2792109 - DNA, 18 bp, Homo sapiens
aaggtattaaattgatgt

SEQ ID NO: 2792110 - DNA, 22 bp, Homo sapiens
aaggtattccttttgtgtacag

SEQ ID NO: 2792111 - DNA, 19 bp, Homo sapiens
aaggtattgagccattttt

SEQ ID NO: 2792112 - DNA, 13 bp, Homo sapiens
aactgctccaagt

SEQ ID NO: 2792113 - DNA, 21 bp, Homo sapiens
aactggaataagaagcaaata

SEQ ID NO: 2792114 - DNA, 17 bp, Homo sapiens
aactggacgcccagctg

SEQ ID NO: 2792115 - DNA, 19 bp, Homo sapiens
aactggggagttataaaaa

SEQ ID NO: 2792116 - DNA, 18 bp, Homo sapiens
aactgggtaatgaaacaa

SEQ ID NO: 2792117 - DNA, 14 bp, Homo sapiens
aactgtaaatacaa

SEQ ID NO: 2792118 - DNA, 20 bp, Homo sapiens
aactgtagataaagtggttt

SEQ ID NO: 2792119 - DNA, 14 bp, Homo sapiens
aactgtgacaggaa

SEQ ID NO: 2792120 - DNA, 19 bp, Homo sapiens
aactgtgatggggtgggca

SEQ ID NO: 2792121 - DNA, 21 bp, Homo sapiens
aactgtgatggggtgggcagg

SEQ ID NO: 2792122 - DNA, 14 bp, Homo sapiens
aactgtgtgaagaa

SEQ ID NO: 2792123 - DNA, 18 bp, Homo sapiens
aactgtgtgaagaaatgg

SEQ ID NO: 2792124 - DNA, 14 bp, Homo sapiens
aactgtttttgaag

SEQ ID NO: 2792125 - DNA, 15 bp, Homo sapiens
aacttaaataaatgt

SEQ ID NO: 2792126 - DNA, 13 bp, Homo sapiens
aacttaaatcact

SEQ ID NO: 2792127 - DNA, 14 bp, Homo sapiens
aacttaaatcactg

SEQ ID NO: 2792128 - DNA, 23 bp, Homo sapiens
aacttacattgtgaaacttctgt

SEQ ID NO: 2792129 - DNA, 19 bp, Homo sapiens
aacttacctgggcattctt

SEQ ID NO: 2792130 - DNA, 23 bp, Homo sapiens
aacttagtgcggacaagttttaa

SEQ ID NO: 2792131 - DNA, 14 bp, Homo sapiens
aacttcagagaagt

SEQ ID NO: 2792132 - DNA, 13 bp, Homo sapiens
aacttcagcacca

SEQ ID NO: 2792133 - DNA, 15 bp, Homo sapiens
aacttcataaatgtt

SEQ ID NO: 2792134 - DNA, 12 bp, Homo sapiens
aacttcatttga

SEQ ID NO: 2792135 - DNA, 20 bp, Homo sapiens
aacttcgaccctttctctga

SEQ ID NO: 2792136 - DNA, 14 bp, Homo sapiens
aacttgaactgatt

SEQ ID NO: 2792137 - DNA, 21 bp, Homo sapiens
aacttgaactgattcacatct

SEQ ID NO: 2792138 - DNA, 12 bp, Homo sapiens
aacttgaggaca

SEQ ID NO: 2792139 - DNA, 18 bp, Homo sapiens
aacttgaggacacatgtc

SEQ ID NO: 2792140 - DNA, 15 bp, Homo sapiens
aacttgtatattcca

SEQ ID NO: 2792141 - DNA, 23 bp, Homo sapiens
aactttgtacagtggagaaatat

SEQ ID NO: 2792142 - DNA, 18 bp, Homo sapiens
aacttttaatgccttcca

SEQ ID NO: 2792143 - DNA, 13 bp, Homo sapiens
aagaaaaaaatat

SEQ ID NO: 2792144 - DNA, 14 bp, Homo sapiens
aagaaaaaaatata

SEQ ID NO: 2792145 - DNA, 14 bp, Homo sapiens
aagaaaaaatacat

SEQ ID NO: 2792146 - DNA, 16 bp, Homo sapiens
aagaaaaaatacattt

SEQ ID NO: 2792147 - DNA, 15 bp, Homo sapiens
aagaaaaagaagcaa

SEQ ID NO: 2792148 - DNA, 16 bp, Homo sapiens
aagaaaaaggctggct

SEQ ID NO: 2792149 - DNA, 12 bp, Homo sapiens
aagaaaaccatt

SEQ ID NO: 2792150 - DNA, 19 bp, Homo sapiens
aagaaaagcactttttaaa

SEQ ID NO: 2792151 - DNA, 19 bp, Homo sapiens
aagaaaagtgaatgctcaa

SEQ ID NO: 2792152 - DNA, 19 bp, Homo sapiens
aagaaacaggggatcaaag

SEQ ID NO: 2792153 - DNA, 11 bp, Homo sapiens
aagaaacccaa

SEQ ID NO: 2792154 - DNA, 17 bp, Homo sapiens
aagaaactatacatcat

SEQ ID NO: 2792155 - DNA, 20 bp, Homo sapiens
aagaaactgaggaattttct

SEQ ID NO: 2792156 - DNA, 13 bp, Homo sapiens
aagaaagaaggaa

SEQ ID NO: 2792157 - DNA, 23 bp, Homo sapiens
aagaaagaggtgaccccagggca

SEQ ID NO: 2792158 - DNA, 15 bp, Homo sapiens
aagaaataagttttt

SEQ ID NO: 2792159 - DNA, 21 bp, Homo sapiens
aagaacaaagagaaaaaatac

SEQ ID NO: 2792160 - DNA, 18 bp, Homo sapiens
aagaacatccaaggagaa

SEQ ID NO: 2792161 - DNA, 23 bp, Homo sapiens
aagaacttgatatatttcattct

SEQ ID NO: 2792162 - DNA, 10 bp, Homo sapiens
aagaagagac

SEQ ID NO: 2792163 - DNA, 19 bp, Homo sapiens
aagaagccacagacctagg

SEQ ID NO: 2792164 - DNA, 19 bp, Homo sapiens
aagaaggcaaaaatagttt

SEQ ID NO: 2792165 - DNA, 19 bp, Homo sapiens
aagaagggaaattcacact

SEQ ID NO: 2792166 - DNA, 14 bp, Homo sapiens
aagaagtaaaagca

SEQ ID NO: 2792167 - DNA, 22 bp, Homo sapiens
aagaagtaaaagcaaaaaagaa

SEQ ID NO: 2792168 - DNA, 15 bp, Homo sapiens
aagaagtaggcatga

SEQ ID NO: 2792169 - DNA, 20 bp, Homo sapiens
aagaataaaaattgacttct

SEQ ID NO: 2792170 - DNA, 18 bp, Homo sapiens
aagaatacaaacatattt

SEQ ID NO: 2792171 - DNA, 16 bp, Homo sapiens
aagaatacagaaaatg

SEQ ID NO: 2792172 - DNA, 17 bp, Homo sapiens
aagaatacagaaaatgc

SEQ ID NO: 2792173 - DNA, 22 bp, Homo sapiens
aagaatacttctcattttttaa

SEQ ID NO: 2792174 - DNA, 13 bp, Homo sapiens
aagaatattcagg

SEQ ID NO: 2792175 - DNA, 20 bp, Homo sapiens
aagaatctcatctcagtgaa

SEQ ID NO: 2792176 - DNA, 15 bp, Homo sapiens
aagaatgctggtttt

SEQ ID NO: 2792177 - DNA, 18 bp, Homo sapiens
aagaatgttaagacttga

SEQ ID NO: 2792178 - DNA, 16 bp, Homo sapiens
aagaattgaacccagg

SEQ ID NO: 2792179 - DNA, 18 bp, Homo sapiens
aagaattgaacccaggag

SEQ ID NO: 2792180 - DNA, 17 bp, Homo sapiens
aagacccagcaggaagc

SEQ ID NO: 2792181 - DNA, 20 bp, Homo sapiens
aagaccttctgaagatctca

SEQ ID NO: 2792182 - DNA, 22 bp, Homo sapiens
aagacgtcctggaatgaagcat

SEQ ID NO: 2792183 - DNA, 14 bp, Homo sapiens
aagactcagtgttc

SEQ ID NO: 2792184 - DNA, 19 bp, Homo sapiens
aagactgagcacctgcttc

SEQ ID NO: 2792185 - DNA, 18 bp, Homo sapiens
aagactgtggctgctagc

SEQ ID NO: 2792186 - DNA, 17 bp, Homo sapiens
aagactgttgctcaaat

SEQ ID NO: 2792187 - DNA, 24 bp, Homo sapiens
aagactgttgctcaaatctattca

SEQ ID NO: 2792188 - DNA, 17 bp, Homo sapiens
aagacttaaatagttca

SEQ ID NO: 2792189 - DNA, 20 bp, Homo sapiens
aagacttcagtcctggtctg

SEQ ID NO: 2792190 - DNA, 19 bp, Homo sapiens
aagacttctctttgcctca

SEQ ID NO: 2792191 - DNA, 20 bp, Homo sapiens
aagacttctctttgcctcaa

SEQ ID NO: 2792192 - DNA, 17 bp, Homo sapiens
aagagaaaaaccaatga

SEQ ID NO: 2792193 - DNA, 12 bp, Homo sapiens
aagagaaatttt

SEQ ID NO: 2792194 - DNA, 15 bp, Homo sapiens
aagagaagaaaaaat

SEQ ID NO: 2792195 - DNA, 11 bp, Homo sapiens
aagagaattca

SEQ ID NO: 2792196 - DNA, 16 bp, Homo sapiens
aaggtgggctgagccc

SEQ ID NO: 2792197 - DNA, 20 bp, Homo sapiens
aaggtgggctgagccctggc

SEQ ID NO: 2792198 - DNA, 21 bp, Homo sapiens
aaggtgggctgagccctggca

SEQ ID NO: 2792199 - DNA, 17 bp, Homo sapiens
aaggtggtatgtgtgtg

SEQ ID NO: 2792200 - DNA, 17 bp, Homo sapiens
aaggtgtaactctaatt

SEQ ID NO: 2792201 - DNA, 13 bp, Homo sapiens
aaggttgtattgc

SEQ ID NO: 2792202 - DNA, 17 bp, Homo sapiens
aaggttgtattgcatat

SEQ ID NO: 2792203 - DNA, 16 bp, Homo sapiens
aaggtttctgaaaatt

SEQ ID NO: 2792204 - DNA, 15 bp, Homo sapiens
aagtaaaagctaatt

SEQ ID NO: 2792205 - DNA, 15 bp, Homo sapiens
aagtaagttctgaaa

SEQ ID NO: 2792206 - DNA, 17 bp, Homo sapiens
aagtaccactcaggcca

SEQ ID NO: 2792207 - DNA, 12 bp, Homo sapiens
aagtacctgtag

SEQ ID NO: 2792208 - DNA, 20 bp, Homo sapiens
aagtacttctccaccctgct

SEQ ID NO: 2792209 - DNA, 19 bp, Homo sapiens
aagtagaatggcagctgga

SEQ ID NO: 2792210 - DNA, 15 bp, Homo sapiens
aagtagaattatatc

SEQ ID NO: 2792211 - DNA, 17 bp, Homo sapiens
aagtagaattatatcta

SEQ ID NO: 2792212 - DNA, 19 bp, Homo sapiens
aagtagaattatatctaat

SEQ ID NO: 2792213 - DNA, 15 bp, Homo sapiens
aagtaggaaaaataa

SEQ ID NO: 2792214 - DNA, 22 bp, Homo sapiens
aagtaggactttcctaaatgtt

SEQ ID NO: 2792215 - DNA, 16 bp, Homo sapiens
aagtagtagtgtcttc

SEQ ID NO: 2792216 - DNA, 13 bp, Homo sapiens
aagtataaagtca

SEQ ID NO: 2792217 - DNA, 22 bp, Homo sapiens
aagtatagaaaagatttaagta

SEQ ID NO: 2792218 - DNA, 18 bp, Homo sapiens
aagtatatagtatattta

SEQ ID NO: 2792219 - DNA, 20 bp, Homo sapiens
aagtatccaattatgtgaca

SEQ ID NO: 2792220 - DNA, 17 bp, Homo sapiens
aagtatctacatgcggt

SEQ ID NO: 2792221 - DNA, 18 bp, Homo sapiens
aagtatgtgatatctgaa

SEQ ID NO: 2792222 - DNA, 16 bp, Homo sapiens
aagtatttaggttttt

SEQ ID NO: 2792223 - DNA, 13 bp, Homo sapiens
aagtatttatata

SEQ ID NO: 2792224 - DNA, 21 bp, Homo sapiens
aagtatttgttaatttagaaa

SEQ ID NO: 2792225 - DNA, 18 bp, Homo sapiens
aagtatttttttaagtta

SEQ ID NO: 2792226 - DNA, 23 bp, Homo sapiens
aagtatttttttaagttagagaa

SEQ ID NO: 2792227 - DNA, 19 bp, Homo sapiens
aagtcaaaaggtgcctgtg

SEQ ID NO: 2792228 - DNA, 14 bp, Homo sapiens
aagtcaaagtaaaa

SEQ ID NO: 2792229 - DNA, 22 bp, Homo sapiens
aagtcaaccaatgtagaaagct

SEQ ID NO: 2792230 - DNA, 17 bp, Homo sapiens
aagtcacatcacaggac

SEQ ID NO: 2792231 - DNA, 19 bp, Homo sapiens
aagtcacatcacaggacac

SEQ ID NO: 2792232 - DNA, 20 bp, Homo sapiens
aagtcagactgctgggactg

SEQ ID NO: 2792233 - DNA, 17 bp, Homo sapiens
aagtcatgaagcccaag

SEQ ID NO: 2792234 - DNA, 18 bp, Homo sapiens
aagtcattttaactttat

SEQ ID NO: 2792235 - DNA, 20 bp, Homo sapiens
aagtccaggcagagacaata

SEQ ID NO: 2792236 - DNA, 19 bp, Homo sapiens
aagtccaggtcctggtggg

SEQ ID NO: 2792237 - DNA, 21 bp, Homo sapiens
aagtccaggtcctggtggggc

SEQ ID NO: 2792238 - DNA, 19 bp, Homo sapiens
aagtccctgactctctgtg

SEQ ID NO: 2792239 - DNA, 19 bp, Homo sapiens
aagtcgtccttactcctgt

SEQ ID NO: 2792240 - DNA, 21 bp, Homo sapiens
aagtcgtccttactcctgtgg

SEQ ID NO: 2792241 - DNA, 24 bp, Homo sapiens
aagtcgtccttactcctgtgggag

SEQ ID NO: 2792242 - DNA, 19 bp, Homo sapiens
aagtctaggagctgggagg

SEQ ID NO: 2792243 - DNA, 22 bp, Homo sapiens
aagtcttccctgatcaagtcac

SEQ ID NO: 2792244 - DNA, 16 bp, Homo sapiens
aagtgaagaaaagtga

SEQ ID NO: 2792245 - DNA, 17 bp, Homo sapiens
aagtgaatttgcctgta

SEQ ID NO: 2792246 - DNA, 20 bp, Homo sapiens
aagtgacctatacctgtgtt

SEQ ID NO: 2792247 - DNA, 14 bp, Homo sapiens
aagtgagagctggg

SEQ ID NO: 2792248 - DNA, 15 bp, Homo sapiens
aagtgatatatgtat

SEQ ID NO: 2792249 - DNA, 18 bp, Homo sapiens
aagtgatatatgtattta

SEQ ID NO: 2792250 - DNA, 16 bp, Homo sapiens
aagtgattctcctgcc

SEQ ID NO: 2792251 - DNA, 18 bp, Homo sapiens
aagtgattctcctgcctc

SEQ ID NO: 2792252 - DNA, 20 bp, Homo sapiens
aagtgattctcctgcctcag

SEQ ID NO: 2792253 - DNA, 19 bp, Homo sapiens
aagtgcaaaggtgtgcaaa

SEQ ID NO: 2792254 - DNA, 14 bp, Homo sapiens
aagtgcaaatactc

SEQ ID NO: 2792255 - DNA, 16 bp, Homo sapiens
aagtgcatgctctctg

SEQ ID NO: 2792256 - DNA, 21 bp, Homo sapiens
aagtgccagtcttgtgtctgc

SEQ ID NO: 2792257 - DNA, 22 bp, Homo sapiens
aagtgctgggattacaggtgtg

SEQ ID NO: 2792258 - DNA, 13 bp, Homo sapiens
aagtgctgtttga

SEQ ID NO: 2792259 - DNA, 18 bp, Homo sapiens
aagtgctgtttgagatgt

SEQ ID NO: 2792260 - DNA, 13 bp, Homo sapiens
aagtggaaaaaag

SEQ ID NO: 2792261 - DNA, 20 bp, Homo sapiens
aagtggaccaggacaggacc

SEQ ID NO: 2792262 - DNA, 19 bp, Homo sapiens
aagtgggggcagagggcag

SEQ ID NO: 2792263 - DNA, 15 bp, Homo sapiens
aagtgtaaaatagaa

SEQ ID NO: 2792264 - DNA, 15 bp, Homo sapiens
aagtgtgagcagtga

SEQ ID NO: 2792265 - DNA, 16 bp, Homo sapiens
aagtgttgaagaagag

SEQ ID NO: 2792266 - DNA, 18 bp, Homo sapiens
aagtgttgtaaatattta

SEQ ID NO: 2792267 - DNA, 13 bp, Homo sapiens
aagttaacagaga

SEQ ID NO: 2792268 - DNA, 20 bp, Homo sapiens
aaagattttttaataattta

SEQ ID NO: 2792269 - DNA, 21 bp, Homo sapiens
aaagattttttaataatttag

SEQ ID NO: 2792270 - DNA, 15 bp, Homo sapiens
aaagcaaaaaagaaa

SEQ ID NO: 2792271 - DNA, 21 bp, Homo sapiens
aaagcaaaaaagaaaaccttt

SEQ ID NO: 2792272 - DNA, 14 bp, Homo sapiens
aaagcaccaaattc

SEQ ID NO: 2792273 - DNA, 18 bp, Homo sapiens
aaagcaccgcagcatgtg

SEQ ID NO: 2792274 - DNA, 17 bp, Homo sapiens
aaagcaggtggcatctc

SEQ ID NO: 2792275 - DNA, 10 bp, Homo sapiens
aaagcagtgt

SEQ ID NO: 2792276 - DNA, 12 bp, Homo sapiens
aaagcagtgttt

SEQ ID NO: 2792277 - DNA, 15 bp, Homo sapiens
aaagcataaatgcaa

SEQ ID NO: 2792278 - DNA, 13 bp, Homo sapiens
aaagcatgtctca

SEQ ID NO: 2792279 - DNA, 16 bp, Homo sapiens
aaagcatttactttga

SEQ ID NO: 2792280 - DNA, 15 bp, Homo sapiens
aaagccaaatttata

SEQ ID NO: 2792281 - DNA, 17 bp, Homo sapiens
aaagccaaatttatatg

SEQ ID NO: 2792282 - DNA, 23 bp, Homo sapiens
aaagccaacagtcaaaacagaga

SEQ ID NO: 2792283 - DNA, 19 bp, Homo sapiens
aaagccagctgccgaccag

SEQ ID NO: 2792284 - DNA, 19 bp, Homo sapiens
aaagcccccacttctctcc

SEQ ID NO: 2792285 - DNA, 17 bp, Homo sapiens
aaagcctgttcatggca

SEQ ID NO: 2792286 - DNA, 18 bp, Homo sapiens
aaagcctgttcatggcag

SEQ ID NO: 2792287 - DNA, 16 bp, Homo sapiens
aaagcgaaaaaatcag

SEQ ID NO: 2792288 - DNA, 20 bp, Homo sapiens
aaagctagaattgagtgttt

SEQ ID NO: 2792289 - DNA, 17 bp, Homo sapiens
aaagctaggcctggcca

SEQ ID NO: 2792290 - DNA, 20 bp, Homo sapiens
aaagctcaagatgacagctc

SEQ ID NO: 2792291 - DNA, 15 bp, Homo sapiens
aaagctgcctgtagt

SEQ ID NO: 2792292 - DNA, 16 bp, Homo sapiens
aaagctgcctgtagtt

SEQ ID NO: 2792293 - DNA, 23 bp, Homo sapiens
aaagctgctgagaatctagcctc

SEQ ID NO: 2792294 - DNA, 24 bp, Homo sapiens
aaagctgcttgactatcacataca

SEQ ID NO: 2792295 - DNA, 18 bp, Homo sapiens
aaagctggacaagaagct

SEQ ID NO: 2792296 - DNA, 21 bp, Homo sapiens
aaagctggacaagaagctgct

SEQ ID NO: 2792297 - DNA, 11 bp, Homo sapiens
aaaggagcctg

SEQ ID NO: 2792298 - DNA, 12 bp, Homo sapiens
aaaggagcctgt

SEQ ID NO: 2792299 - DNA, 23 bp, Homo sapiens
aaaggagcctgtgaacccaggac

SEQ ID NO: 2792300 - DNA, 18 bp, Homo sapiens
aaaggatgttttgtccca

SEQ ID NO: 2792301 - DNA, 12 bp, Homo sapiens
aaaggcaaaggc

SEQ ID NO: 2792302 - DNA, 21 bp, Homo sapiens
aaaggcataagaccctaagcc

SEQ ID NO: 2792303 - DNA, 10 bp, Homo sapiens
aaaggcctgg

SEQ ID NO: 2792304 - DNA, 13 bp, Homo sapiens
aaaggctgtggta

SEQ ID NO: 2792305 - DNA, 22 bp, Homo sapiens
aaagggacttggaagctccgct

SEQ ID NO: 2792306 - DNA, 23 bp, Homo sapiens
aaagggagcactgggttgacttt

SEQ ID NO: 2792307 - DNA, 20 bp, Homo sapiens
aaagggcccagagagggtgg

SEQ ID NO: 2792308 - DNA, 16 bp, Homo sapiens
aaaggtataattttat

SEQ ID NO: 2792309 - DNA, 17 bp, Homo sapiens
aaaggtcattgtggcta

SEQ ID NO: 2792310 - DNA, 17 bp, Homo sapiens
aaaggtggtatgtgtgt

SEQ ID NO: 2792311 - DNA, 16 bp, Homo sapiens
aaaggtttatgaaaaa

SEQ ID NO: 2792312 - DNA, 16 bp, Homo sapiens
aaagtaattttgtgaa

SEQ ID NO: 2792313 - DNA, 20 bp, Homo sapiens
aaagtagaattatatctaat

SEQ ID NO: 2792314 - DNA, 23 bp, Homo sapiens
aaagtagaattatatctaattta

SEQ ID NO: 2792315 - DNA, 19 bp, Homo sapiens
aaagtagagaagtatccaa

SEQ ID NO: 2792316 - DNA, 14 bp, Homo sapiens
aaagtatatattct

SEQ ID NO: 2792317 - DNA, 14 bp, Homo sapiens
aaagtatgtgatat

SEQ ID NO: 2792318 - DNA, 18 bp, Homo sapiens
aaagtcaaaaggtgcctg

SEQ ID NO: 2792319 - DNA, 13 bp, Homo sapiens
aaagtcacacaga

SEQ ID NO: 2792320 - DNA, 17 bp, Homo sapiens
aaagtcacacagacaca

SEQ ID NO: 2792321 - DNA, 20 bp, Homo sapiens
aaagtcacatataaaagtta

SEQ ID NO: 2792322 - DNA, 18 bp, Homo sapiens
aaagtgacagagacccag

SEQ ID NO: 2792323 - DNA, 15 bp, Homo sapiens
aaagtgataatttct

SEQ ID NO: 2792324 - DNA, 21 bp, Homo sapiens
aaagtgataatttctggaatt

SEQ ID NO: 2792325 - DNA, 23 bp, Homo sapiens
aaagtgatcagtatgctgtttta

SEQ ID NO: 2792326 - DNA, 20 bp, Homo sapiens
aaagtgcttagaaagttatt

SEQ ID NO: 2792327 - DNA, 15 bp, Homo sapiens
aaagtggattttcct

SEQ ID NO: 2792328 - DNA, 17 bp, Homo sapiens
aaagtggccatgccacc

SEQ ID NO: 2792329 - DNA, 16 bp, Homo sapiens
aaagtggctaattcaa

SEQ ID NO: 2792330 - DNA, 19 bp, Homo sapiens
aaagtggctaattcaattt

SEQ ID NO: 2792331 - DNA, 20 bp, Homo sapiens
aaagtgtaaatcctttttct

SEQ ID NO: 2792332 - DNA, 14 bp, Homo sapiens
aaagtgtgagcagt

SEQ ID NO: 2792333 - DNA, 20 bp, Homo sapiens
aaagtgttattatttggcat

SEQ ID NO: 2792334 - DNA, 21 bp, Homo sapiens
aaagtgttattatttggcatg

SEQ ID NO: 2792335 - DNA, 20 bp, Homo sapiens
aaagttaaactacttgtaaa

SEQ ID NO: 2792336 - DNA, 22 bp, Homo sapiens
aaagttcatagggtctcttcag

SEQ ID NO: 2792337 - DNA, 17 bp, Homo sapiens
aaagttgataaagattt

SEQ ID NO: 2792338 - DNA, 18 bp, Homo sapiens
aaagttgataaagatttt

SEQ ID NO: 2792339 - DNA, 16 bp, Homo sapiens
aaagtttaaaaaatac

SEQ ID NO: 2792340 - DNA, 12 bp, Homo sapiens
aaagtttaataa

SEQ ID NO: 2792341 - DNA, 18 bp, Homo sapiens
aaagtttcttggtctcag

SEQ ID NO: 2792342 - DNA, 13 bp, Homo sapiens
aaagtttgccaga

SEQ ID NO: 2792343 - DNA, 22 bp, Homo sapiens
aaagtttgccctggatgtcata

SEQ ID NO: 2792344 - DNA, 17 bp, Homo sapiens
aaataaaaaaatacagt

SEQ ID NO: 2792345 - DNA, 15 bp, Homo sapiens
aaataaaaaccagaa

SEQ ID NO: 2792346 - DNA, 11 bp, Homo sapiens
aaataaaacct

SEQ ID NO: 2792347 - DNA, 12 bp, Homo sapiens
aaataaaacctt

SEQ ID NO: 2792348 - DNA, 14 bp, Homo sapiens
aaataaaacctttc

SEQ ID NO: 2792349 - DNA, 13 bp, Homo sapiens
aaataaaagcagc

SEQ ID NO: 2792350 - DNA, 19 bp, Homo sapiens
aaataaaagcagcatctgc

SEQ ID NO: 2792351 - DNA, 12 bp, Homo sapiens
aaataaaataat

SEQ ID NO: 2792352 - DNA, 13 bp, Homo sapiens
aaataaaatgatg

SEQ ID NO: 2792353 - DNA, 16 bp, Homo sapiens
aaataaatagcctctt

SEQ ID NO: 2792354 - DNA, 11 bp, Homo sapiens
aaataaatata

SEQ ID NO: 2792355 - DNA, 14 bp, Homo sapiens
aaataaatataatt

SEQ ID NO: 2792356 - DNA, 13 bp, Homo sapiens
aaataaatgcaat

SEQ ID NO: 2792357 - DNA, 15 bp, Homo sapiens
aaataaatgtatcat

SEQ ID NO: 2792358 - DNA, 12 bp, Homo sapiens
aaataaattcaa

SEQ ID NO: 2792359 - DNA, 15 bp, Homo sapiens
agcctctgtccctct

SEQ ID NO: 2792360 - DNA, 20 bp, Homo sapiens
agcctgaattttgttgctgt

SEQ ID NO: 2792361 - DNA, 22 bp, Homo sapiens
agcctgactgtgttcagtgcct

SEQ ID NO: 2792362 - DNA, 11 bp, Homo sapiens
agcctgaggct

SEQ ID NO: 2792363 - DNA, 17 bp, Homo sapiens
agcctgcaaactcactg

SEQ ID NO: 2792364 - DNA, 23 bp, Homo sapiens
agcctgcagttattaacactaac

SEQ ID NO: 2792365 - DNA, 17 bp, Homo sapiens
agcctgccgagcaaccg

SEQ ID NO: 2792366 - DNA, 15 bp, Homo sapiens
agcctgctcccccac

SEQ ID NO: 2792367 - DNA, 19 bp, Homo sapiens
agcctgctcccccaccccc

SEQ ID NO: 2792368 - DNA, 21 bp, Homo sapiens
agcctgctcccccaccccctc

SEQ ID NO: 2792369 - DNA, 14 bp, Homo sapiens
agcctgctttttaa

SEQ ID NO: 2792370 - DNA, 20 bp, Homo sapiens
agcctggaagggaagtgaga

SEQ ID NO: 2792371 - DNA, 21 bp, Homo sapiens
agcctggactttggttctctc

SEQ ID NO: 2792372 - DNA, 17 bp, Homo sapiens
agcctggcaacagagca

SEQ ID NO: 2792373 - DNA, 14 bp, Homo sapiens
agcctggccaacat

SEQ ID NO: 2792374 - DNA, 15 bp, Homo sapiens
agcctggcctcctgc

SEQ ID NO: 2792375 - DNA, 16 bp, Homo sapiens
agcctggcctcctgcc

SEQ ID NO: 2792376 - DNA, 17 bp, Homo sapiens
agcctggcctcctgcct

SEQ ID NO: 2792377 - DNA, 20 bp, Homo sapiens
agcctggcctcctgcctcta

SEQ ID NO: 2792378 - DNA, 23 bp, Homo sapiens
agcctggcttctggagcccttgg

SEQ ID NO: 2792379 - DNA, 17 bp, Homo sapiens
agcctgggaccagggca

SEQ ID NO: 2792380 - DNA, 15 bp, Homo sapiens
agcctgggcaacaga

SEQ ID NO: 2792381 - DNA, 15 bp, Homo sapiens
agcctggggctctaa

SEQ ID NO: 2792382 - DNA, 21 bp, Homo sapiens
agcctggggctctaacgcctg

SEQ ID NO: 2792383 - DNA, 16 bp, Homo sapiens
agcctgggggcctggc

SEQ ID NO: 2792384 - DNA, 19 bp, Homo sapiens
agcctgggggcctggctgg

SEQ ID NO: 2792385 - DNA, 20 bp, Homo sapiens
agcctgggggcctggctggc

SEQ ID NO: 2792386 - DNA, 22 bp, Homo sapiens
agcctgggggcctggctggctg

SEQ ID NO: 2792387 - DNA, 23 bp, Homo sapiens
agcctgggggcctggctggctga

SEQ ID NO: 2792388 - DNA, 14 bp, Homo sapiens
agcctgtcacgtgg

SEQ ID NO: 2792389 - DNA, 17 bp, Homo sapiens
agcctgtcacgtggtca

SEQ ID NO: 2792390 - DNA, 23 bp, Homo sapiens
agcctgtccactaacttgtcttt

SEQ ID NO: 2792391 - DNA, 22 bp, Homo sapiens
agcctgtgaataaaaaccctgt

SEQ ID NO: 2792392 - DNA, 20 bp, Homo sapiens
agcctgttgagacttagata

SEQ ID NO: 2792393 - DNA, 14 bp, Homo sapiens
agcctgttggaccc

SEQ ID NO: 2792394 - DNA, 19 bp, Homo sapiens
agccttcacaaccagccac

SEQ ID NO: 2792395 - DNA, 19 bp, Homo sapiens
agccttccccctcccaggg

SEQ ID NO: 2792396 - DNA, 13 bp, Homo sapiens
agccttctcctgc

SEQ ID NO: 2792397 - DNA, 12 bp, Homo sapiens
agccttctctct

SEQ ID NO: 2792398 - DNA, 14 bp, Homo sapiens
agccttctctctct

SEQ ID NO: 2792399 - DNA, 12 bp, Homo sapiens
agccttctctgt

SEQ ID NO: 2792400 - DNA, 20 bp, Homo sapiens
agccttctctgttcatttcc

SEQ ID NO: 2792401 - DNA, 21 bp, Homo sapiens
agccttctctgttcatttcct

SEQ ID NO: 2792402 - DNA, 23 bp, Homo sapiens
agccttctctgttcatttcctca

SEQ ID NO: 2792403 - DNA, 17 bp, Homo sapiens
agccttggtgtccacct

SEQ ID NO: 2792404 - DNA, 20 bp, Homo sapiens
agcctttggatgaccagaac

SEQ ID NO: 2792405 - DNA, 18 bp, Homo sapiens
agcgaacatgcctgattt

SEQ ID NO: 2792406 - DNA, 22 bp, Homo sapiens
agcgaacatgcctgattttaaa

SEQ ID NO: 2792407 - DNA, 15 bp, Homo sapiens
agcgaagcagagagg

SEQ ID NO: 2792408 - DNA, 12 bp, Homo sapiens
agcgagaccctt

SEQ ID NO: 2792409 - DNA, 22 bp, Homo sapiens
agcgagacccttgcattagaaa

SEQ ID NO: 2792410 - DNA, 13 bp, Homo sapiens
agcgagccctggt

SEQ ID NO: 2792411 - DNA, 19 bp, Homo sapiens
agcgagccctggtggcagt

SEQ ID NO: 2792412 - DNA, 19 bp, Homo sapiens
agcgaggtcaacagagaag

SEQ ID NO: 2792413 - DNA, 18 bp, Homo sapiens
agcgatgaatttggagac

SEQ ID NO: 2792414 - DNA, 22 bp, Homo sapiens
agcgattccctctcccaggccc

SEQ ID NO: 2792415 - DNA, 22 bp, Homo sapiens
agcgattcttctgcttcagcct

SEQ ID NO: 2792416 - DNA, 12 bp, Homo sapiens
agcgcacctgcc

SEQ ID NO: 2792417 - DNA, 22 bp, Homo sapiens
agctgcttgactatcacataca

SEQ ID NO: 2792418 - DNA, 22 bp, Homo sapiens
agctgcttgttgtcaagtataa

SEQ ID NO: 2792419 - DNA, 23 bp, Homo sapiens
agctgcttgttgtcaagtataaa

SEQ ID NO: 2792420 - DNA, 14 bp, Homo sapiens
agctgctttaaatc

SEQ ID NO: 2792421 - DNA, 24 bp, Homo sapiens
agctgcttttgtctatgggactca

SEQ ID NO: 2792422 - DNA, 13 bp, Homo sapiens
agctggaagcact

SEQ ID NO: 2792423 - DNA, 21 bp, Homo sapiens
agctggaattgctgctctctg

SEQ ID NO: 2792424 - DNA, 19 bp, Homo sapiens
agctggacaagaagctgct

SEQ ID NO: 2792425 - DNA, 15 bp, Homo sapiens
agctggagaagaccc

SEQ ID NO: 2792426 - DNA, 21 bp, Homo sapiens
agctggcagcactcagtgagg

SEQ ID NO: 2792427 - DNA, 15 bp, Homo sapiens
agctggccctttcca

SEQ ID NO: 2792428 - DNA, 21 bp, Homo sapiens
agctgggaacccgactgtgaa

SEQ ID NO: 2792429 - DNA, 22 bp, Homo sapiens
agctgggaacccgactgtgaaa

SEQ ID NO: 2792430 - DNA, 14 bp, Homo sapiens
agctggggtacagg

SEQ ID NO: 2792431 - DNA, 22 bp, Homo sapiens
agctgggtgtcaagagggtctg

SEQ ID NO: 2792432 - DNA, 15 bp, Homo sapiens
agctggtcccactca

SEQ ID NO: 2792433 - DNA, 18 bp, Homo sapiens
agctggtcccactcagtc

SEQ ID NO: 2792434 - DNA, 15 bp, Homo sapiens
agctggtgggaagcg

SEQ ID NO: 2792435 - DNA, 22 bp, Homo sapiens
agctggtttttagcggagacgg

SEQ ID NO: 2792436 - DNA, 19 bp, Homo sapiens
agctgtaaatacatgtgtg

SEQ ID NO: 2792437 - DNA, 15 bp, Homo sapiens
agctgtagaaatgta

SEQ ID NO: 2792438 - DNA, 19 bp, Homo sapiens
agctgtagaaatgtatcct

SEQ ID NO: 2792439 - DNA, 19 bp, Homo sapiens
agctgtcatcaattaaagg

SEQ ID NO: 2792440 - DNA, 14 bp, Homo sapiens
agctgtcattcagg

SEQ ID NO: 2792441 - DNA, 15 bp, Homo sapiens
agctgtccctgtcac

SEQ ID NO: 2792442 - DNA, 11 bp, Homo sapiens
agctgtctgct

SEQ ID NO: 2792443 - DNA, 16 bp, Homo sapiens
agctgtctgtggcttc

SEQ ID NO: 2792444 - DNA, 17 bp, Homo sapiens
agctgtgacctctcccc

SEQ ID NO: 2792445 - DNA, 18 bp, Homo sapiens
agctgtgacctgctgagc

SEQ ID NO: 2792446 - DNA, 20 bp, Homo sapiens
agctgtgacctgctgagctc

SEQ ID NO: 2792447 - DNA, 22 bp, Homo sapiens
agctgtgacctgctgagctctg

SEQ ID NO: 2792448 - DNA, 18 bp, Homo sapiens
agctgtgtccttgcacct

SEQ ID NO: 2792449 - DNA, 17 bp, Homo sapiens
agctgtttatttattca

SEQ ID NO: 2792450 - DNA, 18 bp, Homo sapiens
agctgtttatttattcac

SEQ ID NO: 2792451 - DNA, 13 bp, Homo sapiens
agcttaaaacttt

SEQ ID NO: 2792452 - DNA, 14 bp, Homo sapiens
agcttaaaactttg

SEQ ID NO: 2792453 - DNA, 22 bp, Homo sapiens
agcttaaaactttgaagttagc

SEQ ID NO: 2792454 - DNA, 14 bp, Homo sapiens
agcttaaataaatt

SEQ ID NO: 2792455 - DNA, 16 bp, Homo sapiens
agcttaaataaattca

SEQ ID NO: 2792456 - DNA, 21 bp, Homo sapiens
agcttaaataaattcaaacca

SEQ ID NO: 2792457 - DNA, 19 bp, Homo sapiens
agcttaatggctgataatt

SEQ ID NO: 2792458 - DNA, 15 bp, Homo sapiens
agcttagacctcagc

SEQ ID NO: 2792459 - DNA, 20 bp, Homo sapiens
agcttagacctcagcctgtg

SEQ ID NO: 2792460 - DNA, 12 bp, Homo sapiens
agcttatttaat

SEQ ID NO: 2792461 - DNA, 17 bp, Homo sapiens
agcttcaagtgatatat

SEQ ID NO: 2792462 - DNA, 19 bp, Homo sapiens
agcttcaagtgatatatgt

SEQ ID NO: 2792463 - DNA, 20 bp, Homo sapiens
agcttcaagtgatatatgta

SEQ ID NO: 2792464 - DNA, 17 bp, Homo sapiens
agcttcatcaattttta

SEQ ID NO: 2792465 - DNA, 20 bp, Homo sapiens
agcttcatcaatttttatac

SEQ ID NO: 2792466 - DNA, 21 bp, Homo sapiens
agcttcatcaatttttataca

SEQ ID NO: 2792467 - DNA, 20 bp, Homo sapiens
agcttcatttccgtgaaggg

SEQ ID NO: 2792468 - DNA, 19 bp, Homo sapiens
agcttccagtgcatgttgc

SEQ ID NO: 2792469 - DNA, 21 bp, Homo sapiens
agcttcccctcgctgtcctgc

SEQ ID NO: 2792470 - DNA, 17 bp, Homo sapiens
agcttctatcccaggag

SEQ ID NO: 2792471 - DNA, 12 bp, Homo sapiens
agcttctccagg

SEQ ID NO: 2792472 - DNA, 13 bp, Homo sapiens
agcttctctgtga

SEQ ID NO: 2792473 - DNA, 18 bp, Homo sapiens
aggagcctgtgaacccag

SEQ ID NO: 2792474 - DNA, 20 bp, Homo sapiens
aggagcctgtgaacccagga

SEQ ID NO: 2792475 - DNA, 15 bp, Homo sapiens
aggagctacctgtgt

SEQ ID NO: 2792476 - DNA, 18 bp, Homo sapiens
aggagctacctgtgtgga

SEQ ID NO: 2792477 - DNA, 23 bp, Homo sapiens
aggagcttccagtgcatgttgcc

SEQ ID NO: 2792478 - DNA, 16 bp, Homo sapiens
aggagcttgcaagaag

SEQ ID NO: 2792479 - DNA, 18 bp, Homo sapiens
aggaggatggacgaacag

SEQ ID NO: 2792480 - DNA, 22 bp, Homo sapiens
aggagggacaaaggagcctgtg

SEQ ID NO: 2792481 - DNA, 21 bp, Homo sapiens
aggagggggtcgtggagagct

SEQ ID NO: 2792482 - DNA, 18 bp, Homo sapiens
aggagggttagggagggg

SEQ ID NO: 2792483 - DNA, 20 bp, Homo sapiens
aggaggtggaggttgcagtg

SEQ ID NO: 2792484 - DNA, 23 bp, Homo sapiens
aggaggtttggggtctgccacca

SEQ ID NO: 2792485 - DNA, 13 bp, Homo sapiens
aggagtctgaggt

SEQ ID NO: 2792486 - DNA, 15 bp, Homo sapiens
aggagtctgaggtcc

SEQ ID NO: 2792487 - DNA, 16 bp, Homo sapiens
aggagtctgaggtcct

SEQ ID NO: 2792488 - DNA, 19 bp, Homo sapiens
aggagtctgaggtcctgag

SEQ ID NO: 2792489 - DNA, 14 bp, Homo sapiens
aggagtgagatcat

SEQ ID NO: 2792490 - DNA, 14 bp, Homo sapiens
aggagtgagcacta

SEQ ID NO: 2792491 - DNA, 17 bp, Homo sapiens
aggagttaagagtagca

SEQ ID NO: 2792492 - DNA, 19 bp, Homo sapiens
aggagttcctaaccagcct

SEQ ID NO: 2792493 - DNA, 16 bp, Homo sapiens
aggagttcgagaccag

SEQ ID NO: 2792494 - DNA, 21 bp, Homo sapiens
aggagttcgagaccagcctgg

SEQ ID NO: 2792495 - DNA, 14 bp, Homo sapiens
aggagttgctgttt

SEQ ID NO: 2792496 - DNA, 19 bp, Homo sapiens
aggagtttcgaggtagagt

SEQ ID NO: 2792497 - DNA, 24 bp, Homo sapiens
aggagtttgaggctgcagcgagct

SEQ ID NO: 2792498 - DNA, 13 bp, Homo sapiens
aggatactctgtc

SEQ ID NO: 2792499 - DNA, 14 bp, Homo sapiens
aggatcactggagc

SEQ ID NO: 2792500 - DNA, 12 bp, Homo sapiens
aggatcagtctg

SEQ ID NO: 2792501 - DNA, 20 bp, Homo sapiens
aggatcatttgttggaatga

SEQ ID NO: 2792502 - DNA, 20 bp, Homo sapiens
aggatcctattctcaccagg

SEQ ID NO: 2792503 - DNA, 21 bp, Homo sapiens
aggatcctattctcaccagga

SEQ ID NO: 2792504 - DNA, 22 bp, Homo sapiens
aggatctagaatgtgttttctg

SEQ ID NO: 2792505 - DNA, 20 bp, Homo sapiens
aggatctatgcaatttttaa

SEQ ID NO: 2792506 - DNA, 23 bp, Homo sapiens
aggcaggggtgggagagccagct

SEQ ID NO: 2792507 - DNA, 22 bp, Homo sapiens
aggcagtgttcctcaccaataa

SEQ ID NO: 2792508 - DNA, 14 bp, Homo sapiens
aggcatctgcaccc

SEQ ID NO: 2792509 - DNA, 15 bp, Homo sapiens
aggcatgagggatca

SEQ ID NO: 2792510 - DNA, 20 bp, Homo sapiens
aggcatgagggatcacaggg

SEQ ID NO: 2792511 - DNA, 22 bp, Homo sapiens
aggcatgcaccagtgccgcctg

SEQ ID NO: 2792512 - DNA, 15 bp, Homo sapiens
aggcatggagacagc

SEQ ID NO: 2792513 - DNA, 12 bp, Homo sapiens
aggcatggctgg

SEQ ID NO: 2792514 - DNA, 13 bp, Homo sapiens
aggcatggctggg

SEQ ID NO: 2792515 - DNA, 20 bp, Homo sapiens
aggcatggtggcacacgcct

SEQ ID NO: 2792516 - DNA, 17 bp, Homo sapiens
aggcatgttctctgagg

SEQ ID NO: 2792517 - DNA, 14 bp, Homo sapiens
aggcatttcctggg

SEQ ID NO: 2792518 - DNA, 15 bp, Homo sapiens
aggcatttcctgggt

SEQ ID NO: 2792519 - DNA, 14 bp, Homo sapiens
aggccaagaatcaa

SEQ ID NO: 2792520 - DNA, 17 bp, Homo sapiens
aggccaagagcagaggc

SEQ ID NO: 2792521 - DNA, 21 bp, Homo sapiens
aggccacaccatctcctttca

SEQ ID NO: 2792522 - DNA, 21 bp, Homo sapiens
aggccaccgggacagacctgg

SEQ ID NO: 2792523 - DNA, 22 bp, Homo sapiens
aggccaccgggacagacctgga

SEQ ID NO: 2792524 - DNA, 12 bp, Homo sapiens
aggccagcctgg

SEQ ID NO: 2792525 - DNA, 15 bp, Homo sapiens
aggccagcctggcct

SEQ ID NO: 2792526 - DNA, 22 bp, Homo sapiens
aggccagcctggcctcctgcct

SEQ ID NO: 2792527 - DNA, 23 bp, Homo sapiens
aggccagcctggcctcctgcctc

SEQ ID NO: 2792528 - DNA, 21 bp, Homo sapiens
aggccaggagtttgagaccag

SEQ ID NO: 2792529 - DNA, 16 bp, Homo sapiens
aggccaggccaccagg

SEQ ID NO: 2792530 - DNA, 17 bp, Homo sapiens
aggccaggccaccagga

SEQ ID NO: 2792531 - DNA, 18 bp, Homo sapiens
aggccaggccaccaggat

SEQ ID NO: 2792532 - DNA, 17 bp, Homo sapiens
aggccatgggcctcctg

SEQ ID NO: 2792533 - DNA, 24 bp, Homo sapiens
aggcccaggtcaacatctaagcct

SEQ ID NO: 2792534 - DNA, 21 bp, Homo sapiens
aggccccaaggggtttctgtt

SEQ ID NO: 2792535 - DNA, 14 bp, Homo sapiens
aggccccccgcagc

SEQ ID NO: 2792536 - DNA, 17 bp, Homo sapiens
aggccccccgcagcacc

SEQ ID NO: 2792537 - DNA, 22 bp, Homo sapiens
aggccccgcttgtccagcgcct

SEQ ID NO: 2792538 - DNA, 21 bp, Homo sapiens
aggcccctgccaccctgggga

SEQ ID NO: 2792539 - DNA, 22 bp, Homo sapiens
aggcccgagcagctgagcaggg

SEQ ID NO: 2792540 - DNA, 14 bp, Homo sapiens
aggcccggccccat

SEQ ID NO: 2792541 - DNA, 14 bp, Homo sapiens
aggcccggctccag

SEQ ID NO: 2792542 - DNA, 18 bp, Homo sapiens
aggcccggctccaggctc

SEQ ID NO: 2792543 - DNA, 14 bp, Homo sapiens
aggcccggggctgg

SEQ ID NO: 2792544 - DNA, 16 bp, Homo sapiens
aggccctgccttcagc

SEQ ID NO: 2792545 - DNA, 18 bp, Homo sapiens
aggccctggatcagcgtg

SEQ ID NO: 2792546 - DNA, 23 bp, Homo sapiens
aggccctggatcagcgtggcctt

SEQ ID NO: 2792547 - DNA, 16 bp, Homo sapiens
aggcccttattttcaa

SEQ ID NO: 2792548 - DNA, 18 bp, Homo sapiens
aggccgctgccccagccc

SEQ ID NO: 2792549 - DNA, 20 bp, Homo sapiens
aggccgctgccccagccccg

SEQ ID NO: 2792550 - DNA, 17 bp, Homo sapiens
aggccgctgttcaccca

SEQ ID NO: 2792551 - DNA, 11 bp, Homo sapiens
aggcctatcaa

SEQ ID NO: 2792552 - DNA, 13 bp, Homo sapiens
aggcctccctcaa

SEQ ID NO: 2792553 - DNA, 18 bp, Homo sapiens
aggcctcttggacctctg

SEQ ID NO: 2792554 - DNA, 24 bp, Homo sapiens
aggcctcttggacctctgctctga

SEQ ID NO: 2792555 - DNA, 17 bp, Homo sapiens
aggcctgccctcaggga

SEQ ID NO: 2792556 - DNA, 15 bp, Homo sapiens
aggcctggccagatg

SEQ ID NO: 2792557 - DNA, 17 bp, Homo sapiens
aggcctggccagatgca

SEQ ID NO: 2792558 - DNA, 11 bp, Homo sapiens
aggcctggggt

SEQ ID NO: 2792559 - DNA, 21 bp, Homo sapiens
aggcctggggtgacccggcac

SEQ ID NO: 2792560 - DNA, 23 bp, Homo sapiens
aggcctgtgtagctgtgacctgc

SEQ ID NO: 2792561 - DNA, 24 bp, Homo sapiens
aggcctgtgtagctgtgacctgct

SEQ ID NO: 2792562 - DNA, 18 bp, Homo sapiens
aggcgacttcctctccag

SEQ ID NO: 2792563 - DNA, 19 bp, Homo sapiens
aggcgacttcctctccagc

SEQ ID NO: 2792564 - DNA, 23 bp, Homo sapiens
aggcgacttcctctccagccttc

SEQ ID NO: 2792565 - DNA, 14 bp, Homo sapiens
aggcgagtgccagg

SEQ ID NO: 2792566 - DNA, 15 bp, Homo sapiens
aggcgagtgccagga

SEQ ID NO: 2792567 - DNA, 24 bp, Homo sapiens
aggcgagtgccaggactccccagg

SEQ ID NO: 2792568 - DNA, 22 bp, Homo sapiens
aggcgccccaacccgtggaggc

SEQ ID NO: 2792569 - DNA, 16 bp, Homo sapiens
aggcgccctcccttcc

SEQ ID NO: 2792570 - DNA, 15 bp, Homo sapiens
aggcggagagtacag

SEQ ID NO: 2792571 - DNA, 16 bp, Homo sapiens
aggcggtttccaggaa

SEQ ID NO: 2792572 - DNA, 16 bp, Homo sapiens
aggctcacaactgttt

SEQ ID NO: 2792573 - DNA, 23 bp, Homo sapiens
aggctcacaactgtttttgaaga

SEQ ID NO: 2792574 - DNA, 17 bp, Homo sapiens
aggctcagtctcaggag

SEQ ID NO: 2792575 - DNA, 18 bp, Homo sapiens
aggctcagtctcaggagc

SEQ ID NO: 2792576 - DNA, 14 bp, Homo sapiens
aggctccattagga

SEQ ID NO: 2792577 - DNA, 12 bp, Homo sapiens
aggctcctgtcc

SEQ ID NO: 2792578 - DNA, 23 bp, Homo sapiens
aggctcttctccttggaggacag

SEQ ID NO: 2792579 - DNA, 21 bp, Homo sapiens
aggctctttggggtcagccag

SEQ ID NO: 2792580 - DNA, 22 bp, Homo sapiens
aggctctttggggtcagccagg

SEQ ID NO: 2792581 - DNA, 13 bp, Homo sapiens
aggctgagacagg

SEQ ID NO: 2792582 - DNA, 14 bp, Homo sapiens
aggctgagacagga

SEQ ID NO: 2792583 - DNA, 15 bp, Homo sapiens
aggctgagacaggag

SEQ ID NO: 2792584 - DNA, 11 bp, Homo sapiens
aggctgaggca

SEQ ID NO: 2792585 - DNA, 15 bp, Homo sapiens
aggctgaggcagaag

SEQ ID NO: 2792586 - DNA, 17 bp, Homo sapiens
aggctgaggcagaagaa

SEQ ID NO: 2792587 - DNA, 14 bp, Homo sapiens
aggctgaggcagga

SEQ ID NO: 2792588 - DNA, 21 bp, Homo sapiens
aggctgaggcgggtggatcac

SEQ ID NO: 2792589 - DNA, 22 bp, Homo sapiens
aggctgaggggaggatcactgg

SEQ ID NO: 2792590 - DNA, 14 bp, Homo sapiens
aggctgaggtgtct

SEQ ID NO: 2792591 - DNA, 15 bp, Homo sapiens
aggctgatttctagg

SEQ ID NO: 2792592 - DNA, 23 bp, Homo sapiens
aggctgccccgggtccccagctc

SEQ ID NO: 2792593 - DNA, 21 bp, Homo sapiens
aggctgctcagaggggccccg

SEQ ID NO: 2792594 - DNA, 20 bp, Homo sapiens
aggctgctgtgtagctctgt

SEQ ID NO: 2792595 - DNA, 13 bp, Homo sapiens
aggctggagaagc

SEQ ID NO: 2792596 - DNA, 14 bp, Homo sapiens
aggctggagaagct

SEQ ID NO: 2792597 - DNA, 13 bp, Homo sapiens
aggctggcactcc

SEQ ID NO: 2792598 - DNA, 15 bp, Homo sapiens
aggctggctgaaaat

SEQ ID NO: 2792599 - DNA, 14 bp, Homo sapiens
aggctgggcttcag

SEQ ID NO: 2792600 - DNA, 19 bp, Homo sapiens
aggctgggcttcagtggca

SEQ ID NO: 2792601 - DNA, 21 bp, Homo sapiens
aggctgggcttcagtggcagc

SEQ ID NO: 2792602 - DNA, 22 bp, Homo sapiens
aggctggtgctgtggccagggt

SEQ ID NO: 2792603 - DNA, 18 bp, Homo sapiens
aggctgtatcccatgagc

SEQ ID NO: 2792604 - DNA, 21 bp, Homo sapiens
aggctgtatcccatgagcctc

SEQ ID NO: 2792605 - DNA, 12 bp, Homo sapiens
aggcttcaccct

SEQ ID NO: 2792606 - DNA, 14 bp, Homo sapiens
aggcttccagagag

SEQ ID NO: 2792607 - DNA, 22 bp, Homo sapiens
aggcttcttcagatcagtgctt

SEQ ID NO: 2792608 - DNA, 17 bp, Homo sapiens
aggcttggaatgaattc

SEQ ID NO: 2792609 - DNA, 13 bp, Homo sapiens
agggaaatgctgt

SEQ ID NO: 2792610 - DNA, 19 bp, Homo sapiens
agggaaatgctgttggtga

SEQ ID NO: 2792611 - DNA, 17 bp, Homo sapiens
agggaaattcacactgt

SEQ ID NO: 2792612 - DNA, 19 bp, Homo sapiens
agggaacacggcctactga

SEQ ID NO: 2792613 - DNA, 15 bp, Homo sapiens
agggaacagacagga

SEQ ID NO: 2792614 - DNA, 19 bp, Homo sapiens
agggaaccgtctgttttta

SEQ ID NO: 2792615 - DNA, 20 bp, Homo sapiens
agggaaccgtctgtttttaa

SEQ ID NO: 2792616 - DNA, 13 bp, Homo sapiens
agggaaggctgct

SEQ ID NO: 2792617 - DNA, 16 bp, Homo sapiens
agggaaggctgctgtg

SEQ ID NO: 2792618 - DNA, 16 bp, Homo sapiens
agggacaaaggagcct

SEQ ID NO: 2792619 - DNA, 19 bp, Homo sapiens
agggacaaaggagcctgtg

SEQ ID NO: 2792620 - DNA, 21 bp, Homo sapiens
agggacaaaggagcctgtgaa

SEQ ID NO: 2792621 - DNA, 19 bp, Homo sapiens
agggacagagacacctgca

SEQ ID NO: 2792622 - DNA, 15 bp, Homo sapiens
agggacgaagaaagg

SEQ ID NO: 2792623 - DNA, 15 bp, Homo sapiens
agggactggaaccag

SEQ ID NO: 2792624 - DNA, 18 bp, Homo sapiens
agggactggaaccaggga

SEQ ID NO: 2792625 - DNA, 15 bp, Homo sapiens
agggacttggaagct

SEQ ID NO: 2792626 - DNA, 22 bp, Homo sapiens
agggagaaggatctagaatgtg

SEQ ID NO: 2792627 - DNA, 14 bp, Homo sapiens
agggagagcggggc

SEQ ID NO: 2792628 - DNA, 17 bp, Homo sapiens
agggagcccctttgatg

SEQ ID NO: 2792629 - DNA, 16 bp, Homo sapiens
agggaggccgaagcta

SEQ ID NO: 2792630 - DNA, 23 bp, Homo sapiens
agggaggccgaagctaacaggga

SEQ ID NO: 2792631 - DNA, 13 bp, Homo sapiens
agggagggctctg

SEQ ID NO: 2792632 - DNA, 16 bp, Homo sapiens
agggagggctctgagg

SEQ ID NO: 2792633 - DNA, 23 bp, Homo sapiens
agggagtccgaaagggacttgga

SEQ ID NO: 2792634 - DNA, 19 bp, Homo sapiens
agggagtgacagaggcagc

SEQ ID NO: 2792635 - DNA, 17 bp, Homo sapiens
agggatgggatttcatg

SEQ ID NO: 2792636 - DNA, 24 bp, Homo sapiens
agggatgggatttcatgtaaccaa

SEQ ID NO: 2792637 - DNA, 17 bp, Homo sapiens
atgcctgattttaaaag

SEQ ID NO: 2792638 - DNA, 18 bp, Homo sapiens
atgcctggcccccctcca

SEQ ID NO: 2792639 - DNA, 11 bp, Homo sapiens
atgcctggtgg

SEQ ID NO: 2792640 - DNA, 13 bp, Homo sapiens
atgcctggtggca

SEQ ID NO: 2792641 - DNA, 16 bp, Homo sapiens
atgcctggtggcagct

SEQ ID NO: 2792642 - DNA, 19 bp, Homo sapiens
atgcctggtggcagctgcg

SEQ ID NO: 2792643 - DNA, 21 bp, Homo sapiens
atgcctggtggcagctgcggt

SEQ ID NO: 2792644 - DNA, 11 bp, Homo sapiens
atgccttccac

SEQ ID NO: 2792645 - DNA, 13 bp, Homo sapiens
atgcctttctagt

SEQ ID NO: 2792646 - DNA, 23 bp, Homo sapiens
atgccttttcccaaaatgttgaa

SEQ ID NO: 2792647 - DNA, 23 bp, Homo sapiens
atgctaaaggttgtattgcatat

SEQ ID NO: 2792648 - DNA, 19 bp, Homo sapiens
atgctaccatgcctctcca

SEQ ID NO: 2792649 - DNA, 16 bp, Homo sapiens
atgctcaagtttttca

SEQ ID NO: 2792650 - DNA, 20 bp, Homo sapiens
atgctcaagtttttcagaaa

SEQ ID NO: 2792651 - DNA, 14 bp, Homo sapiens
atgctctcctttcc

SEQ ID NO: 2792652 - DNA, 21 bp, Homo sapiens
atgctctctgcagccagccca

SEQ ID NO: 2792653 - DNA, 23 bp, Homo sapiens
atgctctgtgcgagggttactat

SEQ ID NO: 2792654 - DNA, 17 bp, Homo sapiens
atgctgaattattttgt

SEQ ID NO: 2792655 - DNA, 22 bp, Homo sapiens
atgctgaattattttgttgtga

SEQ ID NO: 2792656 - DNA, 22 bp, Homo sapiens
atgctggctgttggctgggggc

SEQ ID NO: 2792657 - DNA, 16 bp, Homo sapiens
atgctgttgcctcatc

SEQ ID NO: 2792658 - DNA, 17 bp, Homo sapiens
atgctgttggtgagaat

SEQ ID NO: 2792659 - DNA, 14 bp, Homo sapiens
atgcttattttaaa

SEQ ID NO: 2792660 - DNA, 16 bp, Homo sapiens
atgcttattttaaaat

SEQ ID NO: 2792661 - DNA, 18 bp, Homo sapiens
atgcttcagttgtacttc

SEQ ID NO: 2792662 - DNA, 12 bp, Homo sapiens
atgcttcttgcc

SEQ ID NO: 2792663 - DNA, 19 bp, Homo sapiens
atgcttcttgccccttggg

SEQ ID NO: 2792664 - DNA, 19 bp, Homo sapiens
atgctttcctccctggcat

SEQ ID NO: 2792665 - DNA, 22 bp, Homo sapiens
atgctttgtgtgattgaatctg

SEQ ID NO: 2792666 - DNA, 20 bp, Homo sapiens
atggaaactggccaggggtc

SEQ ID NO: 2792667 - DNA, 17 bp, Homo sapiens
atggaaagaatctaata

SEQ ID NO: 2792668 - DNA, 22 bp, Homo sapiens
atggaactcagctgtctgtggc

SEQ ID NO: 2792669 - DNA, 22 bp, Homo sapiens
atggaaggtttgtatattgtca

SEQ ID NO: 2792670 - DNA, 19 bp, Homo sapiens
atggacagaagaaggcagc

SEQ ID NO: 2792671 - DNA, 20 bp, Homo sapiens
atggacagaagaaggcagca

SEQ ID NO: 2792672 - DNA, 21 bp, Homo sapiens
atggacggccccgtcagccac

SEQ ID NO: 2792673 - DNA, 15 bp, Homo sapiens
atggactctgcacat

SEQ ID NO: 2792674 - DNA, 13 bp, Homo sapiens
atggagagagggg

SEQ ID NO: 2792675 - DNA, 14 bp, Homo sapiens
atggagagagggga

SEQ ID NO: 2792676 - DNA, 15 bp, Homo sapiens
atggagagaggggaa

SEQ ID NO: 2792677 - DNA, 18 bp, Homo sapiens
atggagagccctgggacc

SEQ ID NO: 2792678 - DNA, 17 bp, Homo sapiens
atggagcgcacctgccc

SEQ ID NO: 2792679 - DNA, 11 bp, Homo sapiens
atggaggagaa

SEQ ID NO: 2792680 - DNA, 17 bp, Homo sapiens
atggaggagaagaattt

SEQ ID NO: 2792681 - DNA, 18 bp, Homo sapiens
atggaggatggagagagg

SEQ ID NO: 2792682 - DNA, 12 bp, Homo sapiens
atggattctaaa

SEQ ID NO: 2792683 - DNA, 13 bp, Homo sapiens
atggattctaaaa

SEQ ID NO: 2792684 - DNA, 18 bp, Homo sapiens
atggattctaaaatgcct

SEQ ID NO: 2792685 - DNA, 16 bp, Homo sapiens
atggcatttttttaaa

SEQ ID NO: 2792686 - DNA, 18 bp, Homo sapiens
atggcccttcccactgga

SEQ ID NO: 2792687 - DNA, 18 bp, Homo sapiens
atggcctatgcacatatg

SEQ ID NO: 2792688 - DNA, 16 bp, Homo sapiens
atggctaattcccaga

SEQ ID NO: 2792689 - DNA, 19 bp, Homo sapiens
atggctatgtttttaatgt

SEQ ID NO: 2792690 - DNA, 15 bp, Homo sapiens
atggctattataatg

SEQ ID NO: 2792691 - DNA, 15 bp, Homo sapiens
atggctctgtgaaat

SEQ ID NO: 2792692 - DNA, 18 bp, Homo sapiens
atggctgactttgctctt

SEQ ID NO: 2792693 - DNA, 20 bp, Homo sapiens
atggctgataattttaaatt

SEQ ID NO: 2792694 - DNA, 11 bp, Homo sapiens
atggctgcctg

SEQ ID NO: 2792695 - DNA, 12 bp, Homo sapiens
atggctgtattt

SEQ ID NO: 2792696 - DNA, 19 bp, Homo sapiens
atggctgtatttttagaga

SEQ ID NO: 2792697 - DNA, 24 bp, Homo sapiens
atggcttagttaagtcatccacag

SEQ ID NO: 2792698 - DNA, 22 bp, Homo sapiens
atgggagctggttagaaatgca

SEQ ID NO: 2792699 - DNA, 19 bp, Homo sapiens
atgggcaacccccagcctg

SEQ ID NO: 2792700 - DNA, 21 bp, Homo sapiens
atgggcaacccccagcctgct

SEQ ID NO: 2792701 - DNA, 20 bp, Homo sapiens
atgggccaattaaaatatat

SEQ ID NO: 2792702 - DNA, 23 bp, Homo sapiens
atgggcttgttttcttgccaatg

SEQ ID NO: 2792703 - DNA, 12 bp, Homo sapiens
atggggatgcag

SEQ ID NO: 2792704 - DNA, 17 bp, Homo sapiens
atggggtgggcagggct

SEQ ID NO: 2792705 - DNA, 21 bp, Homo sapiens
atggggtgggcagggctggga

SEQ ID NO: 2792706 - DNA, 12 bp, Homo sapiens
atgggtgtgtgt

SEQ ID NO: 2792707 - DNA, 19 bp, Homo sapiens
atgggtgtgtgtttgtgtg

SEQ ID NO: 2792708 - DNA, 19 bp, Homo sapiens
atggtataatggttgactg

SEQ ID NO: 2792709 - DNA, 14 bp, Homo sapiens
atggtatgagctga

SEQ ID NO: 2792710 - DNA, 20 bp, Homo sapiens
atggtatgagctgagggggg

SEQ ID NO: 2792711 - DNA, 18 bp, Homo sapiens
atggtattgtaatgaata

SEQ ID NO: 2792712 - DNA, 22 bp, Homo sapiens
atggtcatctttttctctaaaa

SEQ ID NO: 2792713 - DNA, 23 bp, Homo sapiens
atggtcccacatccctgggcctg

SEQ ID NO: 2792714 - DNA, 15 bp, Homo sapiens
atggtccggtgtcct

SEQ ID NO: 2792715 - DNA, 20 bp, Homo sapiens
atggtcctggggctctgtgc

SEQ ID NO: 2792716 - DNA, 14 bp, Homo sapiens
atggtcgcccagga

SEQ ID NO: 2792717 - DNA, 16 bp, Homo sapiens
atggtcgcccaggaga

SEQ ID NO: 2792718 - DNA, 22 bp, Homo sapiens
atggtgcagaaaaaaaaaaaga

SEQ ID NO: 2792719 - DNA, 15 bp, Homo sapiens
atggtggctgggttg

SEQ ID NO: 2792720 - DNA, 22 bp, Homo sapiens
atggtggtttgtcatatattca

SEQ ID NO: 2792721 - DNA, 12 bp, Homo sapiens
atggtgtaatgc

SEQ ID NO: 2792722 - DNA, 17 bp, Homo sapiens
atggtgtaatgcacaat

SEQ ID NO: 2792723 - DNA, 21 bp, Homo sapiens
atctgtcttgccagccagaag

SEQ ID NO: 2792724 - DNA, 22 bp, Homo sapiens
atctgtcttgccagccagaagc

SEQ ID NO: 2792725 - DNA, 19 bp, Homo sapiens
atctgtgtaacctccacag

SEQ ID NO: 2792726 - DNA, 20 bp, Homo sapiens
atctgtgtaacctccacagt

SEQ ID NO: 2792727 - DNA, 14 bp, Homo sapiens
atctgtgtctctgg

SEQ ID NO: 2792728 - DNA, 22 bp, Homo sapiens
atctgttttaaatttatttcaa

SEQ ID NO: 2792729 - DNA, 19 bp, Homo sapiens
atctgtttttaaaaatcat

SEQ ID NO: 2792730 - DNA, 20 bp, Homo sapiens
atcttaggggagagctttct

SEQ ID NO: 2792731 - DNA, 16 bp, Homo sapiens
atcttattttcatgta

SEQ ID NO: 2792732 - DNA, 18 bp, Homo sapiens
atcttcagagcaggggtc

SEQ ID NO: 2792733 - DNA, 18 bp, Homo sapiens
atcttctggagtctccag

SEQ ID NO: 2792734 - DNA, 17 bp, Homo sapiens
atcttcttatgcaattt

SEQ ID NO: 2792735 - DNA, 12 bp, Homo sapiens
atcttgaagaat

SEQ ID NO: 2792736 - DNA, 19 bp, Homo sapiens
atcttggactgacatttag

SEQ ID NO: 2792737 - DNA, 21 bp, Homo sapiens
atcttggactgacatttagcg

SEQ ID NO: 2792738 - DNA, 17 bp, Homo sapiens
atcttgttaaattgctt

SEQ ID NO: 2792739 - DNA, 20 bp, Homo sapiens
atctttaaaaagcagtcctc

SEQ ID NO: 2792740 - DNA, 14 bp, Homo sapiens
atctttaagtattg

SEQ ID NO: 2792741 - DNA, 16 bp, Homo sapiens
atctttaagtattgtt

SEQ ID NO: 2792742 - DNA, 16 bp, Homo sapiens
atctttgaaagctgaa

SEQ ID NO: 2792743 - DNA, 13 bp, Homo sapiens
atgaaaaatatga

SEQ ID NO: 2792744 - DNA, 13 bp, Homo sapiens
atgaaaaattctc

SEQ ID NO: 2792745 - DNA, 13 bp, Homo sapiens
atgaaacagaaac

SEQ ID NO: 2792746 - DNA, 18 bp, Homo sapiens
atgaaacagaaacaaaaa

SEQ ID NO: 2792747 - DNA, 13 bp, Homo sapiens
atgaaagaggagg

SEQ ID NO: 2792748 - DNA, 19 bp, Homo sapiens
atgaaagatggctgtgcct

SEQ ID NO: 2792749 - DNA, 22 bp, Homo sapiens
atgaaataaattggtgataagt

SEQ ID NO: 2792750 - DNA, 22 bp, Homo sapiens
atgaaatatttgcttatttata

SEQ ID NO: 2792751 - DNA, 16 bp, Homo sapiens
atgaaatggttaagaa

SEQ ID NO: 2792752 - DNA, 21 bp, Homo sapiens
atgaaatttaatatagctatt

SEQ ID NO: 2792753 - DNA, 14 bp, Homo sapiens
atgaactcaacttt

SEQ ID NO: 2792754 - DNA, 16 bp, Homo sapiens
atgaactcttaatcaa

SEQ ID NO: 2792755 - DNA, 14 bp, Homo sapiens
atgaactgtgacag

SEQ ID NO: 2792756 - DNA, 15 bp, Homo sapiens
atgaacttgaggaca

SEQ ID NO: 2792757 - DNA, 20 bp, Homo sapiens
atgaacttgaggacacatgt

SEQ ID NO: 2792758 - DNA, 21 bp, Homo sapiens
atgaacttgaggacacatgtc

SEQ ID NO: 2792759 - DNA, 22 bp, Homo sapiens
atgaacttgaggacacatgtcc

SEQ ID NO: 2792760 - DNA, 15 bp, Homo sapiens
atgaagaaaaaatac

SEQ ID NO: 2792761 - DNA, 22 bp, Homo sapiens
atgaagaaaaaatacattttat

SEQ ID NO: 2792762 - DNA, 20 bp, Homo sapiens
atgaagaaaaaggctggctg

SEQ ID NO: 2792763 - DNA, 21 bp, Homo sapiens
atgaagaaaaaggctggctga

SEQ ID NO: 2792764 - DNA, 22 bp, Homo sapiens
atgaagacccagtgtaaagaat

SEQ ID NO: 2792765 - DNA, 12 bp, Homo sapiens
atgaagcatgta

SEQ ID NO: 2792766 - DNA, 19 bp, Homo sapiens
atgaagctggaagcactgc

SEQ ID NO: 2792767 - DNA, 19 bp, Homo sapiens
atgaaggagttttttttaa

SEQ ID NO: 2792768 - DNA, 16 bp, Homo sapiens
atgaaggcaaaaaaat

SEQ ID NO: 2792769 - DNA, 19 bp, Homo sapiens
atgaaggtttctgaaaatt

SEQ ID NO: 2792770 - DNA, 13 bp, Homo sapiens
atgaatatctgct

SEQ ID NO: 2792771 - DNA, 14 bp, Homo sapiens
atgaatcaaagaca

SEQ ID NO: 2792772 - DNA, 19 bp, Homo sapiens
atgaatgaggtcccaggca

SEQ ID NO: 2792773 - DNA, 15 bp, Homo sapiens
atgaatgcacactag

SEQ ID NO: 2792774 - DNA, 13 bp, Homo sapiens
atgaatgctgacc

SEQ ID NO: 2792775 - DNA, 21 bp, Homo sapiens
atgaatggtatggaactctct

SEQ ID NO: 2792776 - DNA, 22 bp, Homo sapiens
atgaatgtttacactctttgta

SEQ ID NO: 2792777 - DNA, 15 bp, Homo sapiens
atgaatttggagact

SEQ ID NO: 2792778 - DNA, 13 bp, Homo sapiens
atgacaaacccag

SEQ ID NO: 2792779 - DNA, 12 bp, Homo sapiens
atgacagagcga

SEQ ID NO: 2792780 - DNA, 12 bp, Homo sapiens
atgacagccaga

SEQ ID NO: 2792781 - DNA, 19 bp, Homo sapiens
atgacagctcttctaagga

SEQ ID NO: 2792782 - DNA, 15 bp, Homo sapiens
atgacagctgtccct

SEQ ID NO: 2792783 - DNA, 16 bp, Homo sapiens
atgacagctgtccctg

SEQ ID NO: 2792784 - DNA, 22 bp, Homo sapiens
atgacagttatactgtcggttt

SEQ ID NO: 2792785 - DNA, 18 bp, Homo sapiens
atgacatcacttgtacaa

SEQ ID NO: 2792786 - DNA, 24 bp, Homo sapiens
atgacatcttcaaagcttgaagat

SEQ ID NO: 2792787 - DNA, 14 bp, Homo sapiens
atgacatttttgat

SEQ ID NO: 2792788 - DNA, 12 bp, Homo sapiens
atgaccaagaat

SEQ ID NO: 2792789 - DNA, 17 bp, Homo sapiens
atgaccaatctctgtga

SEQ ID NO: 2792790 - DNA, 15 bp, Homo sapiens
atgaccctcctgtcc

SEQ ID NO: 2792791 - DNA, 23 bp, Homo sapiens
atgaccctgcgaaggggccctgg

SEQ ID NO: 2792792 - DNA, 12 bp, Homo sapiens
atgacctccagc

SEQ ID NO: 2792793 - DNA, 13 bp, Homo sapiens
atgacctccagct

SEQ ID NO: 2792794 - DNA, 19 bp, Homo sapiens
atgacctccagctttcctg

SEQ ID NO: 2792795 - DNA, 22 bp, Homo sapiens
atgactggatacagaatgaatc

SEQ ID NO: 2792796 - DNA, 19 bp, Homo sapiens
atgactgtttttcggacag

SEQ ID NO: 2792797 - DNA, 21 bp, Homo sapiens
atgactgtttttcggacagtt

SEQ ID NO: 2792798 - DNA, 18 bp, Homo sapiens
atgactgtttttgtagtg

SEQ ID NO: 2792799 - DNA, 18 bp, Homo sapiens
atgacttgggcaccccca

SEQ ID NO: 2792800 - DNA, 20 bp, Homo sapiens
atgacttgggcacccccagc

SEQ ID NO: 2792801 - DNA, 12 bp, Homo sapiens
atgagaaaaaac

SEQ ID NO: 2792802 - DNA, 22 bp, Homo sapiens
atgagaaaggttgaagcaccaa

SEQ ID NO: 2792803 - DNA, 15 bp, Homo sapiens
atgagaagagggcct

SEQ ID NO: 2792804 - DNA, 17 bp, Homo sapiens
atgagaagttaagcagc

SEQ ID NO: 2792805 - DNA, 18 bp, Homo sapiens
atgagaccactgttatca

SEQ ID NO: 2792806 - DNA, 18 bp, Homo sapiens
atgagagttccagattgt

SEQ ID NO: 2792807 - DNA, 19 bp, Homo sapiens
atgagatcccgcctcttct

SEQ ID NO: 2792808 - DNA, 17 bp, Homo sapiens
atgagcagtcacactgt

SEQ ID NO: 2792809 - DNA, 12 bp, Homo sapiens
atgagcctcagc

SEQ ID NO: 2792810 - DNA, 15 bp, Homo sapiens
atgagcctcagcatc

SEQ ID NO: 2792811 - DNA, 19 bp, Homo sapiens
atgagcctcagcatcctgg

SEQ ID NO: 2792812 - DNA, 14 bp, Homo sapiens
atgagctcctcttc

SEQ ID NO: 2792813 - DNA, 11 bp, Homo sapiens
atgagctcctg

SEQ ID NO: 2792814 - DNA, 21 bp, Homo sapiens
agttctgctcctctccaggca

SEQ ID NO: 2792815 - DNA, 12 bp, Homo sapiens
agttcttgtgcc

SEQ ID NO: 2792816 - DNA, 13 bp, Homo sapiens
agttcttgtgcca

SEQ ID NO: 2792817 - DNA, 19 bp, Homo sapiens
agttctttaggtgcctcct

SEQ ID NO: 2792818 - DNA, 23 bp, Homo sapiens
agttctttaggtgcctcctgtct

SEQ ID NO: 2792819 - DNA, 16 bp, Homo sapiens
agttgaaatcagaagc

SEQ ID NO: 2792820 - DNA, 13 bp, Homo sapiens
agttgaacatctc

SEQ ID NO: 2792821 - DNA, 14 bp, Homo sapiens
agttgaagcaaatc

SEQ ID NO: 2792822 - DNA, 20 bp, Homo sapiens
agttgaatggcctgccttga

SEQ ID NO: 2792823 - DNA, 13 bp, Homo sapiens
agttgacagcagg

SEQ ID NO: 2792824 - DNA, 22 bp, Homo sapiens
agttgacttactgtttcttacc

SEQ ID NO: 2792825 - DNA, 20 bp, Homo sapiens
agttgatgaccaatctctgt

SEQ ID NO: 2792826 - DNA, 17 bp, Homo sapiens
agttgcaataaaatagt

SEQ ID NO: 2792827 - DNA, 17 bp, Homo sapiens
agttgcagactcagttt

SEQ ID NO: 2792828 - DNA, 18 bp, Homo sapiens
agttgcagactcagtttg

SEQ ID NO: 2792829 - DNA, 22 bp, Homo sapiens
agttgcagactcagtttgtcag

SEQ ID NO: 2792830 - DNA, 16 bp, Homo sapiens
agttgcagattcattt

SEQ ID NO: 2792831 - DNA, 22 bp, Homo sapiens
agttgctttaaagtacctgtag

SEQ ID NO: 2792832 - DNA, 14 bp, Homo sapiens
agttggcagaaagg

SEQ ID NO: 2792833 - DNA, 16 bp, Homo sapiens
agttggctaggacccc

SEQ ID NO: 2792834 - DNA, 16 bp, Homo sapiens
agttgggagcactgga

SEQ ID NO: 2792835 - DNA, 21 bp, Homo sapiens
agttgggtggatgcctggtgg

SEQ ID NO: 2792836 - DNA, 19 bp, Homo sapiens
agttgtggaaagcctctgc

SEQ ID NO: 2792837 - DNA, 20 bp, Homo sapiens
agttgtggaaagcctctgct

SEQ ID NO: 2792838 - DNA, 21 bp, Homo sapiens
agttgtggaaagcctctgctg

SEQ ID NO: 2792839 - DNA, 21 bp, Homo sapiens
agttgtgtctggcagtttata

SEQ ID NO: 2792840 - DNA, 19 bp, Homo sapiens
agttgttcacatatatgta

SEQ ID NO: 2792841 - DNA, 15 bp, Homo sapiens
agttgtttcattgac

SEQ ID NO: 2792842 - DNA, 19 bp, Homo sapiens
agttgtttcattgactatc

SEQ ID NO: 2792843 - DNA, 15 bp, Homo sapiens
agtttaaaaaataca

SEQ ID NO: 2792844 - DNA, 16 bp, Homo sapiens
agtttactattttact

SEQ ID NO: 2792845 - DNA, 13 bp, Homo sapiens
agtttacttcatg

SEQ ID NO: 2792846 - DNA, 14 bp, Homo sapiens
agtttagaggaaaa

SEQ ID NO: 2792847 - DNA, 19 bp, Homo sapiens
agtttagaggaaaaaaatg

SEQ ID NO: 2792848 - DNA, 15 bp, Homo sapiens
agtttataagcccaa

SEQ ID NO: 2792849 - DNA, 13 bp, Homo sapiens
agtttatttgttg

SEQ ID NO: 2792850 - DNA, 17 bp, Homo sapiens
agtttattttgttacac

SEQ ID NO: 2792851 - DNA, 16 bp, Homo sapiens
agtttattttttctac

SEQ ID NO: 2792852 - DNA, 19 bp, Homo sapiens
agtttattttttctacaca

SEQ ID NO: 2792853 - DNA, 16 bp, Homo sapiens
agtttcaattcagtgc

SEQ ID NO: 2792854 - DNA, 12 bp, Homo sapiens
agtttcagagaa

SEQ ID NO: 2792855 - DNA, 22 bp, Homo sapiens
agtttccaaagggcagtaaagt

SEQ ID NO: 2792856 - DNA, 13 bp, Homo sapiens
agtttctcagctc

SEQ ID NO: 2792857 - DNA, 20 bp, Homo sapiens
agtttctcctttattgctcc

SEQ ID NO: 2792858 - DNA, 14 bp, Homo sapiens
agtttctcttttca

SEQ ID NO: 2792859 - DNA, 20 bp, Homo sapiens
agtttcttggtctcagcttc

SEQ ID NO: 2792860 - DNA, 19 bp, Homo sapiens
agtttgagaccagcctggc

SEQ ID NO: 2792861 - DNA, 14 bp, Homo sapiens
agtttgaggctgca

SEQ ID NO: 2792862 - DNA, 17 bp, Homo sapiens
agtttgatattaaagga

SEQ ID NO: 2792863 - DNA, 17 bp, Homo sapiens
agtttgatcaaatctaa

SEQ ID NO: 2792864 - DNA, 19 bp, Homo sapiens
agtttgatttaatatctga

SEQ ID NO: 2792865 - DNA, 22 bp, Homo sapiens
agtttgcagaaaagcacctgcc

SEQ ID NO: 2792866 - DNA, 23 bp, Homo sapiens
agtttgcagaaaagcacctgccg

SEQ ID NO: 2792867 - DNA, 15 bp, Homo sapiens
agtttgctttgccct

SEQ ID NO: 2792868 - DNA, 22 bp, Homo sapiens
agtttggatatgtaaaacattt

SEQ ID NO: 2792869 - DNA, 19 bp, Homo sapiens
agtttgggccactgcactc

SEQ ID NO: 2792870 - DNA, 19 bp, Homo sapiens
agtttgtggtaaaaagatt

SEQ ID NO: 2792871 - DNA, 14 bp, Homo sapiens
agttttaaatatga

SEQ ID NO: 2792872 - DNA, 16 bp, Homo sapiens
agttttaaatatgaac

SEQ ID NO: 2792873 - DNA, 19 bp, Homo sapiens
agttttaaatatgaacaaa

SEQ ID NO: 2792874 - DNA, 21 bp, Homo sapiens
agttttaaatatgaacaaaga

SEQ ID NO: 2792875 - DNA, 16 bp, Homo sapiens
agttttaatccagaat

SEQ ID NO: 2792876 - DNA, 14 bp, Homo sapiens
agttttatcatttt

SEQ ID NO: 2792877 - DNA, 19 bp, Homo sapiens
agttttgccagaacagttt

SEQ ID NO: 2792878 - DNA, 21 bp, Homo sapiens
agtttttacctaccacagtgt

SEQ ID NO: 2792879 - DNA, 16 bp, Homo sapiens
agtttttgatagcttt

SEQ ID NO: 2792880 - DNA, 14 bp, Homo sapiens
ataatatttttaat

SEQ ID NO: 2792881 - DNA, 16 bp, Homo sapiens
ataatcagcctcttaa

SEQ ID NO: 2792882 - DNA, 17 bp, Homo sapiens
ataatcagcctcttaaa

SEQ ID NO: 2792883 - DNA, 22 bp, Homo sapiens
ataatcggcccacagctcccac

SEQ ID NO: 2792884 - DNA, 18 bp, Homo sapiens
ataatctggactcctctg

SEQ ID NO: 2792885 - DNA, 20 bp, Homo sapiens
ataatctggactcctctgtc

SEQ ID NO: 2792886 - DNA, 13 bp, Homo sapiens
ataatgaacagaa

SEQ ID NO: 2792887 - DNA, 18 bp, Homo sapiens
ataatgctgttgcctcat

SEQ ID NO: 2792888 - DNA, 14 bp, Homo sapiens
ataatggttgactg

SEQ ID NO: 2792889 - DNA, 18 bp, Homo sapiens
ataatggtttactgctgt

SEQ ID NO: 2792890 - DNA, 22 bp, Homo sapiens
ataatggtttactgctgtcatt

SEQ ID NO: 2792891 - DNA, 17 bp, Homo sapiens
ataatgtggatttccta

SEQ ID NO: 2792892 - DNA, 23 bp, Homo sapiens
ataatgtggatttcctattttaa

SEQ ID NO: 2792893 - DNA, 19 bp, Homo sapiens
ataatgttgttatttaaag

SEQ ID NO: 2792894 - DNA, 15 bp, Homo sapiens
ataattagaacaata

SEQ ID NO: 2792895 - DNA, 17 bp, Homo sapiens
ataattagaacaatagc

SEQ ID NO: 2792896 - DNA, 18 bp, Homo sapiens
ataattagaacaatagct

SEQ ID NO: 2792897 - DNA, 16 bp, Homo sapiens
ataattataatatact

SEQ ID NO: 2792898 - DNA, 20 bp, Homo sapiens
ataattatcggaagcagtgc

SEQ ID NO: 2792899 - DNA, 18 bp, Homo sapiens
ataattatgacagttata

SEQ ID NO: 2792900 - DNA, 23 bp, Homo sapiens
ataggatcatttgttggaatgaa

SEQ ID NO: 2792901 - DNA, 22 bp, Homo sapiens
ataggatttatttaaaatagca

SEQ ID NO: 2792902 - DNA, 19 bp, Homo sapiens
atagggcccttagctctcc

SEQ ID NO: 2792903 - DNA, 16 bp, Homo sapiens
atagggtctcttcagg

SEQ ID NO: 2792904 - DNA, 13 bp, Homo sapiens
atagtaaatcacg

SEQ ID NO: 2792905 - DNA, 23 bp, Homo sapiens
atagtagcagagtcattgttaca

SEQ ID NO: 2792906 - DNA, 14 bp, Homo sapiens
atagtagtcaatta

SEQ ID NO: 2792907 - DNA, 18 bp, Homo sapiens
atagtagtcaattagtac

SEQ ID NO: 2792908 - DNA, 22 bp, Homo sapiens
atagtagtcaattagtacagta

SEQ ID NO: 2792909 - DNA, 16 bp, Homo sapiens
atagtatatctggaca

SEQ ID NO: 2792910 - DNA, 17 bp, Homo sapiens
atagtatatctggacaa

SEQ ID NO: 2792911 - DNA, 15 bp, Homo sapiens
atagtatatttatac

SEQ ID NO: 2792912 - DNA, 22 bp, Homo sapiens
atagtcaaaccataaacttcat

SEQ ID NO: 2792913 - DNA, 22 bp, Homo sapiens
atagtcaagaaaaattattgta

SEQ ID NO: 2792914 - DNA, 21 bp, Homo sapiens
atagtcacaaaaatggtggtt

SEQ ID NO: 2792915 - DNA, 16 bp, Homo sapiens
atagtgcacacttgta

SEQ ID NO: 2792916 - DNA, 20 bp, Homo sapiens
atagtgctttattttgttaa

SEQ ID NO: 2792917 - DNA, 13 bp, Homo sapiens
atagtttattgac

SEQ ID NO: 2792918 - DNA, 14 bp, Homo sapiens
atagtttattgaca

SEQ ID NO: 2792919 - DNA, 19 bp, Homo sapiens
atagtttggatatgtaaaa

SEQ ID NO: 2792920 - DNA, 23 bp, Homo sapiens
atagtttggatatgtaaaacatt

SEQ ID NO: 2792921 - DNA, 17 bp, Homo sapiens
atagttttaaatatgaa

SEQ ID NO: 2792922 - DNA, 17 bp, Homo sapiens
atagttttataaaactc

SEQ ID NO: 2792923 - DNA, 20 bp, Homo sapiens
atataaaagttaaactactt

SEQ ID NO: 2792924 - DNA, 13 bp, Homo sapiens
atataaacactat

SEQ ID NO: 2792925 - DNA, 23 bp, Homo sapiens
atataaacttgtgtatgatccaa

SEQ ID NO: 2792926 - DNA, 24 bp, Homo sapiens
atataaagtatcatcagtgtagaa

SEQ ID NO: 2792927 - DNA, 15 bp, Homo sapiens
atataaatgcatgat

SEQ ID NO: 2792928 - DNA, 23 bp, Homo sapiens
atataaatgcatgattttataca

SEQ ID NO: 2792929 - DNA, 20 bp, Homo sapiens
atataatggtttactgctgt

SEQ ID NO: 2792930 - DNA, 18 bp, Homo sapiens
atatacaataacataatt

SEQ ID NO: 2792931 - DNA, 22 bp, Homo sapiens
atatacttttttcttatttaac

SEQ ID NO: 2792932 - DNA, 18 bp, Homo sapiens
atatagaaagctgtttat

SEQ ID NO: 2792933 - DNA, 23 bp, Homo sapiens
atatagcgtgggttatcagttaa

SEQ ID NO: 2792934 - DNA, 23 bp, Homo sapiens
atatagtaactactttttatact

SEQ ID NO: 2792935 - DNA, 16 bp, Homo sapiens
atatagtatatttata

SEQ ID NO: 2792936 - DNA, 18 bp, Homo sapiens
atatagtatatttatact

SEQ ID NO: 2792937 - DNA, 13 bp, Homo sapiens
atatataaatata

SEQ ID NO: 2792938 - DNA, 17 bp, Homo sapiens
atatataatggtttact

SEQ ID NO: 2792939 - DNA, 12 bp, Homo sapiens
atatatacatgt

SEQ ID NO: 2792940 - DNA, 19 bp, Homo sapiens
atatatacatgtatagtga

SEQ ID NO: 2792941 - DNA, 13 bp, Homo sapiens
atatatagagaaa

SEQ ID NO: 2792942 - DNA, 14 bp, Homo sapiens
atatatataaatat

SEQ ID NO: 2792943 - DNA, 16 bp, Homo sapiens
atatatatgtacagtt

SEQ ID NO: 2792944 - DNA, 22 bp, Homo sapiens
atatatatgtatatgtatatat

SEQ ID NO: 2792945 - DNA, 19 bp, Homo sapiens
atatatctatctatttgag

SEQ ID NO: 2792946 - DNA, 14 bp, Homo sapiens
atatatctatctta

SEQ ID NO: 2792947 - DNA, 12 bp, Homo sapiens
atatatctgaaa

SEQ ID NO: 2792948 - DNA, 12 bp, Homo sapiens
atatatgtacag

SEQ ID NO: 2792949 - DNA, 14 bp, Homo sapiens
atatatgtacagtt

SEQ ID NO: 2792950 - DNA, 12 bp, Homo sapiens
atatatgtatat

SEQ ID NO: 2792951 - DNA, 15 bp, Homo sapiens
atatatgtatatgta

SEQ ID NO: 2792952 - DNA, 20 bp, Homo sapiens
atatatgtatatgtatatct

SEQ ID NO: 2792953 - DNA, 22 bp, Homo sapiens
atatattaaaatgtaggaagaa

SEQ ID NO: 2792954 - DNA, 13 bp, Homo sapiens
atatattcatgta

SEQ ID NO: 2792955 - DNA, 15 bp, Homo sapiens
atatattcatgtaat

SEQ ID NO: 2792956 - DNA, 16 bp, Homo sapiens
atatatttaattgtgt

SEQ ID NO: 2792957 - DNA, 14 bp, Homo sapiens
atatatttataact

SEQ ID NO: 2792958 - DNA, 16 bp, Homo sapiens
atatatttataactca

SEQ ID NO: 2792959 - DNA, 21 bp, Homo sapiens
atatatttataactcatcata

SEQ ID NO: 2792960 - DNA, 23 bp, Homo sapiens
atatatttataactcatcataaa

SEQ ID NO: 2792961 - DNA, 13 bp, Homo sapiens
atatattttatga

SEQ ID NO: 2792962 - DNA, 14 bp, Homo sapiens
atatattttatgat

SEQ ID NO: 2792963 - DNA, 18 bp, Homo sapiens
atatattttatgatttaa

SEQ ID NO: 2792964 - DNA, 14 bp, Homo sapiens
atatatttttcaca

SEQ ID NO: 2792965 - DNA, 15 bp, Homo sapiens
atatcaaggatgttc

SEQ ID NO: 2792966 - DNA, 17 bp, Homo sapiens
atatcaattcaacacat

SEQ ID NO: 2792967 - DNA, 22 bp, Homo sapiens
atatcagaaaagtagaattata

SEQ ID NO: 2792968 - DNA, 14 bp, Homo sapiens
atatcagacctctg

SEQ ID NO: 2792969 - DNA, 15 bp, Homo sapiens
atatcagacctctga

SEQ ID NO: 2792970 - DNA, 20 bp, Homo sapiens
atatcagacctctgatccct

SEQ ID NO: 2792971 - DNA, 19 bp, Homo sapiens
atatcagttactcagccct

SEQ ID NO: 2792972 - DNA, 22 bp, Homo sapiens
atatcagttactcagccctggg

SEQ ID NO: 2792973 - DNA, 18 bp, Homo sapiens
atatcatgaaacacttct

SEQ ID NO: 2792974 - DNA, 16 bp, Homo sapiens
atatccacatctttaa

SEQ ID NO: 2792975 - DNA, 15 bp, Homo sapiens
atatcctaaacatca

SEQ ID NO: 2792976 - DNA, 16 bp, Homo sapiens
cagatcgtattaatta

SEQ ID NO: 2792977 - DNA, 13 bp, Homo sapiens
cagatctttttgt

SEQ ID NO: 2792978 - DNA, 15 bp, Homo sapiens
cagatctttttgtga

SEQ ID NO: 2792979 - DNA, 21 bp, Homo sapiens
cagatgagaagttaagcagcc

SEQ ID NO: 2792980 - DNA, 20 bp, Homo sapiens
cagatgagattccctctcct

SEQ ID NO: 2792981 - DNA, 22 bp, Homo sapiens
cagatgagattccctctcctcc

SEQ ID NO: 2792982 - DNA, 15 bp, Homo sapiens
cagatgcccagaggg

SEQ ID NO: 2792983 - DNA, 15 bp, Homo sapiens
cagatgcccccgtga

SEQ ID NO: 2792984 - DNA, 17 bp, Homo sapiens
cagatgtaggagggact

SEQ ID NO: 2792985 - DNA, 16 bp, Homo sapiens
cagattacttcagggc

SEQ ID NO: 2792986 - DNA, 17 bp, Homo sapiens
cagattacttcagggct

SEQ ID NO: 2792987 - DNA, 22 bp, Homo sapiens
cagattattttagtctgtcatc

SEQ ID NO: 2792988 - DNA, 15 bp, Homo sapiens
cagattcatttttct

SEQ ID NO: 2792989 - DNA, 18 bp, Homo sapiens
cagattgcaacaggctgg

SEQ ID NO: 2792990 - DNA, 19 bp, Homo sapiens
cagattgcaacaggctggg

SEQ ID NO: 2792991 - DNA, 13 bp, Homo sapiens
cagattgtttgca

SEQ ID NO: 2792992 - DNA, 22 bp, Homo sapiens
cagatttagtgaaagctagaga

SEQ ID NO: 2792993 - DNA, 19 bp, Homo sapiens
cagcaaagtgtcagtgttg

SEQ ID NO: 2792994 - DNA, 16 bp, Homo sapiens
cagcaacacaagctgg

SEQ ID NO: 2792995 - DNA, 22 bp, Homo sapiens
cagcaacaggaatctcagagac

SEQ ID NO: 2792996 - DNA, 23 bp, Homo sapiens
cagcaacaggaatctcagagaca

SEQ ID NO: 2792997 - DNA, 14 bp, Homo sapiens
cagcaaggcccgag

SEQ ID NO: 2792998 - DNA, 16 bp, Homo sapiens
cagcaaggcccgagca

SEQ ID NO: 2792999 - DNA, 19 bp, Homo sapiens
cagcaaggcccgagcagct

SEQ ID NO: 2793000 - DNA, 19 bp, Homo sapiens
cagcaagtgagagctgggt

SEQ ID NO: 2793001 - DNA, 21 bp, Homo sapiens
cagcaagtgagagctgggtgt

SEQ ID NO: 2793002 - DNA, 15 bp, Homo sapiens
cagcaccctgcagag

SEQ ID NO: 2793003 - DNA, 17 bp, Homo sapiens
cagcactaaagcagtgg

SEQ ID NO: 2793004 - DNA, 19 bp, Homo sapiens
cagcactaaagcagtggac

SEQ ID NO: 2793005 - DNA, 20 bp, Homo sapiens
cagcactaaagcagtggaca

SEQ ID NO: 2793006 - DNA, 22 bp, Homo sapiens
cagcactcaaccaacctccccg

SEQ ID NO: 2793007 - DNA, 23 bp, Homo sapiens
cagcactcagaaaagaaaaccat

SEQ ID NO: 2793008 - DNA, 13 bp, Homo sapiens
cagcactcagtga

SEQ ID NO: 2793009 - DNA, 12 bp, Homo sapiens
cagcactgtgaa

SEQ ID NO: 2793010 - DNA, 19 bp, Homo sapiens
cagcactttaaccctctct

SEQ ID NO: 2793011 - DNA, 21 bp, Homo sapiens
cagcactttaaccctctcttc

SEQ ID NO: 2793012 - DNA, 23 bp, Homo sapiens
cagcactttaaccctctcttccc

SEQ ID NO: 2793013 - DNA, 15 bp, Homo sapiens
cagcagaaaagtgct

SEQ ID NO: 2793014 - DNA, 23 bp, Homo sapiens
cagcagactcagctctgacattc

SEQ ID NO: 2793015 - DNA, 10 bp, Homo sapiens
cagcagccag

SEQ ID NO: 2793016 - DNA, 12 bp, Homo sapiens
cagcagccagcc

SEQ ID NO: 2793017 - DNA, 15 bp, Homo sapiens
cagcagccagccctg

SEQ ID NO: 2793018 - DNA, 20 bp, Homo sapiens
cagcagccagctctcagcca

SEQ ID NO: 2793019 - DNA, 21 bp, Homo sapiens
cagcagccagctctcagccaa

SEQ ID NO: 2793020 - DNA, 13 bp, Homo sapiens
cagcagcccctgc

SEQ ID NO: 2793021 - DNA, 23 bp, Homo sapiens
cagcagcccctgcacaaagccct

SEQ ID NO: 2793022 - DNA, 24 bp, Homo sapiens
cagcagccctaaggatctctcagg

SEQ ID NO: 2793023 - DNA, 13 bp, Homo sapiens
cagcagccctcct

SEQ ID NO: 2793024 - DNA, 15 bp, Homo sapiens
cagcagccctcctca

SEQ ID NO: 2793025 - DNA, 13 bp, Homo sapiens
cagcagctcaggc

SEQ ID NO: 2793026 - DNA, 16 bp, Homo sapiens
cagcagctcaggcaca

SEQ ID NO: 2793027 - DNA, 14 bp, Homo sapiens
cagcaggaagccag

SEQ ID NO: 2793028 - DNA, 15 bp, Homo sapiens
cagcaggaagccagg

SEQ ID NO: 2793029 - DNA, 18 bp, Homo sapiens
cagcaggaagccaggctg

SEQ ID NO: 2793030 - DNA, 20 bp, Homo sapiens
cagcaggaggctagcaaagc

SEQ ID NO: 2793031 - DNA, 15 bp, Homo sapiens
cagcagggcctcaaa

SEQ ID NO: 2793032 - DNA, 17 bp, Homo sapiens
cagcagggcctcaaagt

SEQ ID NO: 2793033 - DNA, 22 bp, Homo sapiens
cagcaggtgcctggtgggccac

SEQ ID NO: 2793034 - DNA, 23 bp, Homo sapiens
cagcaggtgcctggtgggccacg

SEQ ID NO: 2793035 - DNA, 16 bp, Homo sapiens
cagcagtatgaatgat

SEQ ID NO: 2793036 - DNA, 19 bp, Homo sapiens
cagcagtgagtctcttcag

SEQ ID NO: 2793037 - DNA, 15 bp, Homo sapiens
cagcatcctggcacc

SEQ ID NO: 2793038 - DNA, 16 bp, Homo sapiens
cagcatcctggcaccc

SEQ ID NO: 2793039 - DNA, 17 bp, Homo sapiens
cagcatgtcactcccag

SEQ ID NO: 2793040 - DNA, 16 bp, Homo sapiens
cagcatgtggggaagc

SEQ ID NO: 2793041 - DNA, 18 bp, Homo sapiens
cagcatgtggggaagcaa

SEQ ID NO: 2793042 - DNA, 13 bp, Homo sapiens
cagcattcctcca

SEQ ID NO: 2793043 - DNA, 14 bp, Homo sapiens
cagccaaacagagc

SEQ ID NO: 2793044 - DNA, 15 bp, Homo sapiens
cagccaaacagagcc

SEQ ID NO: 2793045 - DNA, 17 bp, Homo sapiens
cagccaaacccatgagg

SEQ ID NO: 2793046 - DNA, 19 bp, Homo sapiens
cagccaacaggtggcagga

SEQ ID NO: 2793047 - DNA, 13 bp, Homo sapiens
cagccacacagag

SEQ ID NO: 2793048 - DNA, 15 bp, Homo sapiens
cagccacacagagcc

SEQ ID NO: 2793049 - DNA, 20 bp, Homo sapiens
cagccacacttctcaggaca

SEQ ID NO: 2793050 - DNA, 15 bp, Homo sapiens
cagccaccctgagga

SEQ ID NO: 2793051 - DNA, 18 bp, Homo sapiens
cagccaccctgaggagtc

SEQ ID NO: 2793052 - DNA, 22 bp, Homo sapiens
cagccaccctgaggagtctgag

SEQ ID NO: 2793053 - DNA, 15 bp, Homo sapiens
cagccacctctcttt

SEQ ID NO: 2793054 - DNA, 16 bp, Homo sapiens
cagccacctctctttt

SEQ ID NO: 2793055 - DNA, 13 bp, Homo sapiens
cagccagcaatga

SEQ ID NO: 2793056 - DNA, 22 bp, Homo sapiens
cagccagcaatgatgtccagaa

SEQ ID NO: 2793057 - DNA, 11 bp, Homo sapiens
cagccagcagc

SEQ ID NO: 2793058 - DNA, 13 bp, Homo sapiens
cagccagcccagc

SEQ ID NO: 2793059 - DNA, 16 bp, Homo sapiens
cagccagcccagccca

SEQ ID NO: 2793060 - DNA, 17 bp, Homo sapiens
cagccagcccagcccag

SEQ ID NO: 2793061 - DNA, 18 bp, Homo sapiens
cagccagccctgcctgga

SEQ ID NO: 2793062 - DNA, 19 bp, Homo sapiens
cagccagccctgcctggag

SEQ ID NO: 2793063 - DNA, 20 bp, Homo sapiens
cagccagccggtgcctggcg

SEQ ID NO: 2793064 - DNA, 17 bp, Homo sapiens
cagccagcgcctccctc

SEQ ID NO: 2793065 - DNA, 18 bp, Homo sapiens
cagccagcgcctccctcc

SEQ ID NO: 2793066 - DNA, 14 bp, Homo sapiens
caaacactgtgtat

SEQ ID NO: 2793067 - DNA, 15 bp, Homo sapiens
caaacactgtgtatt

SEQ ID NO: 2793068 - DNA, 21 bp, Homo sapiens
caaacagaaaagtgcaaagtt

SEQ ID NO: 2793069 - DNA, 11 bp, Homo sapiens
caaacagagcc

SEQ ID NO: 2793070 - DNA, 17 bp, Homo sapiens
caaacagagccttcaca

SEQ ID NO: 2793071 - DNA, 22 bp, Homo sapiens
caaacatgaagtgtgtttcctt

SEQ ID NO: 2793072 - DNA, 20 bp, Homo sapiens
caaacatgtggttaatgcca

SEQ ID NO: 2793073 - DNA, 12 bp, Homo sapiens
caaaccaggatt

SEQ ID NO: 2793074 - DNA, 14 bp, Homo sapiens
caaaccatttaatt

SEQ ID NO: 2793075 - DNA, 21 bp, Homo sapiens
caaacccaaaacctcatgaca

SEQ ID NO: 2793076 - DNA, 19 bp, Homo sapiens
caaacccaggagtttgtgt

SEQ ID NO: 2793077 - DNA, 18 bp, Homo sapiens
caaaccccgaccacctgc

SEQ ID NO: 2793078 - DNA, 19 bp, Homo sapiens
caaactcactgctcaagaa

SEQ ID NO: 2793079 - DNA, 16 bp, Homo sapiens
caaactctgccagcca

SEQ ID NO: 2793080 - DNA, 20 bp, Homo sapiens
caaactcttgacctcaggtg

SEQ ID NO: 2793081 - DNA, 21 bp, Homo sapiens
caaactcttgacctcaggtga

SEQ ID NO: 2793082 - DNA, 17 bp, Homo sapiens
caaactggggcctccct

SEQ ID NO: 2793083 - DNA, 16 bp, Homo sapiens
caaacttctaaatgtt

SEQ ID NO: 2793084 - DNA, 19 bp, Homo sapiens
caaacttgtatctgaagac

SEQ ID NO: 2793085 - DNA, 17 bp, Homo sapiens
caaagaaaaaaatatat

SEQ ID NO: 2793086 - DNA, 13 bp, Homo sapiens
caaagaaacccaa

SEQ ID NO: 2793087 - DNA, 19 bp, Homo sapiens
caaagaacggcatgtgaat

SEQ ID NO: 2793088 - DNA, 20 bp, Homo sapiens
caaagacttagtatattttc

SEQ ID NO: 2793089 - DNA, 15 bp, Homo sapiens
caaagagaataaaga

SEQ ID NO: 2793090 - DNA, 17 bp, Homo sapiens
caaagagactggagcat

SEQ ID NO: 2793091 - DNA, 18 bp, Homo sapiens
caaagagactggagcatc

SEQ ID NO: 2793092 - DNA, 16 bp, Homo sapiens
caaagatgtttgtcag

SEQ ID NO: 2793093 - DNA, 17 bp, Homo sapiens
caaagcaaaagaagtaa

SEQ ID NO: 2793094 - DNA, 23 bp, Homo sapiens
caaagcaagcattcagaagaaaa

SEQ ID NO: 2793095 - DNA, 20 bp, Homo sapiens
caaagccaaagctaggcctg

SEQ ID NO: 2793096 - DNA, 19 bp, Homo sapiens
caaagcccccacttctctc

SEQ ID NO: 2793097 - DNA, 22 bp, Homo sapiens
caaagcccccacttctctccag

SEQ ID NO: 2793098 - DNA, 15 bp, Homo sapiens
caaagcccttttata

SEQ ID NO: 2793099 - DNA, 18 bp, Homo sapiens
caaagctaggcctggcca

SEQ ID NO: 2793100 - DNA, 21 bp, Homo sapiens
caaagctcaagatgacagctc

SEQ ID NO: 2793101 - DNA, 14 bp, Homo sapiens
caaagcttaaatgc

SEQ ID NO: 2793102 - DNA, 21 bp, Homo sapiens
caaagcttctatcccaggagg

SEQ ID NO: 2793103 - DNA, 19 bp, Homo sapiens
caaagcttgaagatcgtta

SEQ ID NO: 2793104 - DNA, 19 bp, Homo sapiens
caaaggaatctccagtttt

SEQ ID NO: 2793105 - DNA, 22 bp, Homo sapiens
caaaggaatctccagttttcag

SEQ ID NO: 2793106 - DNA, 13 bp, Homo sapiens
caaaggagcctgt

SEQ ID NO: 2793107 - DNA, 23 bp, Homo sapiens
caaaggcgcagtgcttctctaca

SEQ ID NO: 2793108 - DNA, 18 bp, Homo sapiens
caaagggcagtaaagttt

SEQ ID NO: 2793109 - DNA, 20 bp, Homo sapiens
caaagggcagtaaagttttc

SEQ ID NO: 2793110 - DNA, 17 bp, Homo sapiens
caaagggctgaaagcca

SEQ ID NO: 2793111 - DNA, 22 bp, Homo sapiens
caaaggggaggcatcagtgtcc

SEQ ID NO: 2793112 - DNA, 18 bp, Homo sapiens
caaagggtatcaggtgct

SEQ ID NO: 2793113 - DNA, 20 bp, Homo sapiens
caaagggtatcaggtgctgc

SEQ ID NO: 2793114 - DNA, 21 bp, Homo sapiens
caaagggtatcaggtgctgcc

SEQ ID NO: 2793115 - DNA, 16 bp, Homo sapiens
caaaggtgtgcaaact

SEQ ID NO: 2793116 - DNA, 13 bp, Homo sapiens
caaagtgctggga

SEQ ID NO: 2793117 - DNA, 19 bp, Homo sapiens
caaagtgctgggattacaa

SEQ ID NO: 2793118 - DNA, 23 bp, Homo sapiens
caaagtgctgggattacaagcgt

SEQ ID NO: 2793119 - DNA, 15 bp, Homo sapiens
caaagtgtcagtgtt

SEQ ID NO: 2793120 - DNA, 13 bp, Homo sapiens
caaagttatccag

SEQ ID NO: 2793121 - DNA, 22 bp, Homo sapiens
caaagttattccccatcttcca

SEQ ID NO: 2793122 - DNA, 22 bp, Homo sapiens
caaagttccctacttcctgtga

SEQ ID NO: 2793123 - DNA, 20 bp, Homo sapiens
caaagttcctgttcacctta

SEQ ID NO: 2793124 - DNA, 13 bp, Homo sapiens
caaagtttaataa

SEQ ID NO: 2793125 - DNA, 18 bp, Homo sapiens
caaataaaaagtgctttt

SEQ ID NO: 2793126 - DNA, 12 bp, Homo sapiens
caaataaatgtg

SEQ ID NO: 2793127 - DNA, 13 bp, Homo sapiens
caaataatcacat

SEQ ID NO: 2793128 - DNA, 18 bp, Homo sapiens
cactcagaagacactgat

SEQ ID NO: 2793129 - DNA, 19 bp, Homo sapiens
cactcagaagacactgatg

SEQ ID NO: 2793130 - DNA, 22 bp, Homo sapiens
cactcagaagacactgatgggc

SEQ ID NO: 2793131 - DNA, 13 bp, Homo sapiens
cactcagaagcct

SEQ ID NO: 2793132 - DNA, 16 bp, Homo sapiens
cactcagaagcctggg

SEQ ID NO: 2793133 - DNA, 20 bp, Homo sapiens
cactcaggaggctgaggcag

SEQ ID NO: 2793134 - DNA, 16 bp, Homo sapiens
cactcagtccatagca

SEQ ID NO: 2793135 - DNA, 12 bp, Homo sapiens
cactcatttcat

SEQ ID NO: 2793136 - DNA, 19 bp, Homo sapiens
cactcatttcatctcattt

SEQ ID NO: 2793137 - DNA, 10 bp, Homo sapiens
cactccacca

SEQ ID NO: 2793138 - DNA, 14 bp, Homo sapiens
cactccaccaccca

SEQ ID NO: 2793139 - DNA, 15 bp, Homo sapiens
cactccaccacccaa

SEQ ID NO: 2793140 - DNA, 14 bp, Homo sapiens
cactccagcctgag

SEQ ID NO: 2793141 - DNA, 15 bp, Homo sapiens
cactccagcctgagc

SEQ ID NO: 2793142 - DNA, 15 bp, Homo sapiens
cactccagcctgggc

SEQ ID NO: 2793143 - DNA, 16 bp, Homo sapiens
cactccagcctgggcg

SEQ ID NO: 2793144 - DNA, 21 bp, Homo sapiens
cactccagcctgggcgacaga

SEQ ID NO: 2793145 - DNA, 11 bp, Homo sapiens
cactccctccc

SEQ ID NO: 2793146 - DNA, 15 bp, Homo sapiens
cactcctcactgccc

SEQ ID NO: 2793147 - DNA, 18 bp, Homo sapiens
cacagaaacacaatattt

SEQ ID NO: 2793148 - DNA, 16 bp, Homo sapiens
cacagaagccaggagc

SEQ ID NO: 2793149 - DNA, 20 bp, Homo sapiens
cacagaaggaatctgtgcag

SEQ ID NO: 2793150 - DNA, 17 bp, Homo sapiens
cacagacagatcccatc

SEQ ID NO: 2793151 - DNA, 15 bp, Homo sapiens
cacagactacagcca

SEQ ID NO: 2793152 - DNA, 12 bp, Homo sapiens
cacagagaaagt

SEQ ID NO: 2793153 - DNA, 21 bp, Homo sapiens
cacagagaaagtacttctcca

SEQ ID NO: 2793154 - DNA, 20 bp, Homo sapiens
cacagagaagacgggatttg

SEQ ID NO: 2793155 - DNA, 12 bp, Homo sapiens
cacagagcctgc

SEQ ID NO: 2793156 - DNA, 14 bp, Homo sapiens
cacagagcctgcct

SEQ ID NO: 2793157 - DNA, 20 bp, Homo sapiens
cacagagcctgcctcagctg

SEQ ID NO: 2793158 - DNA, 20 bp, Homo sapiens
cacagaggcagctgtgtggg

SEQ ID NO: 2793159 - DNA, 18 bp, Homo sapiens
cacagaggcttcttcaga

SEQ ID NO: 2793160 - DNA, 14 bp, Homo sapiens
cacagatatttcca

SEQ ID NO: 2793161 - DNA, 20 bp, Homo sapiens
cacagatatttccatttctt

SEQ ID NO: 2793162 - DNA, 19 bp, Homo sapiens
cacagatgggtattaaact

SEQ ID NO: 2793163 - DNA, 20 bp, Homo sapiens
cacagatgggtattaaactt

SEQ ID NO: 2793164 - DNA, 19 bp, Homo sapiens
cacagcagctgaacagcca

SEQ ID NO: 2793165 - DNA, 16 bp, Homo sapiens
cacagcccacacatga

SEQ ID NO: 2793166 - DNA, 22 bp, Homo sapiens
cacagccgcagcctccctctga

SEQ ID NO: 2793167 - DNA, 18 bp, Homo sapiens
cacagcctgggaccaggg

SEQ ID NO: 2793168 - DNA, 21 bp, Homo sapiens
cacagcggaggagaccagctc

SEQ ID NO: 2793169 - DNA, 20 bp, Homo sapiens
cacagcggggccccagggct

SEQ ID NO: 2793170 - DNA, 22 bp, Homo sapiens
cacagctatgaaggctgtacac

SEQ ID NO: 2793171 - DNA, 14 bp, Homo sapiens
cacagctcccaccc

SEQ ID NO: 2793172 - DNA, 19 bp, Homo sapiens
cacagctcccaccccaccc

SEQ ID NO: 2793173 - DNA, 20 bp, Homo sapiens
cacagctcctcgctgcgtct

SEQ ID NO: 2793174 - DNA, 14 bp, Homo sapiens
cacagctctgtcct

SEQ ID NO: 2793175 - DNA, 21 bp, Homo sapiens
cacagctcttctccaggctgt

SEQ ID NO: 2793176 - DNA, 21 bp, Homo sapiens
cacaggacacctggccgcctc

SEQ ID NO: 2793177 - DNA, 14 bp, Homo sapiens
cacaggagctacct

SEQ ID NO: 2793178 - DNA, 23 bp, Homo sapiens
cacaggagggggtcgtggagagc

SEQ ID NO: 2793179 - DNA, 12 bp, Homo sapiens
cacaggatcagt

SEQ ID NO: 2793180 - DNA, 17 bp, Homo sapiens
cacaggatcagtctgat

SEQ ID NO: 2793181 - DNA, 20 bp, Homo sapiens
cacaggcaactgaggcagac

SEQ ID NO: 2793182 - DNA, 15 bp, Homo sapiens
cacaggcaggtccag

SEQ ID NO: 2793183 - DNA, 20 bp, Homo sapiens
cacaggcatctacacagcct

SEQ ID NO: 2793184 - DNA, 17 bp, Homo sapiens
cacaggccccccgcagc

SEQ ID NO: 2793185 - DNA, 21 bp, Homo sapiens
cacaggccccccgcagcaccc

SEQ ID NO: 2793186 - DNA, 17 bp, Homo sapiens
cacaggcccggctccag

SEQ ID NO: 2793187 - DNA, 18 bp, Homo sapiens
cacaggcccggctccagg

SEQ ID NO: 2793188 - DNA, 21 bp, Homo sapiens
cacaggcctgtgtagctgtga

SEQ ID NO: 2793189 - DNA, 23 bp, Homo sapiens
cacaggcctgtgtagctgtgacc

SEQ ID NO: 2793190 - DNA, 17 bp, Homo sapiens
cacagggcagagccggg

SEQ ID NO: 2793191 - DNA, 13 bp, Homo sapiens
cacagggctaaga

SEQ ID NO: 2793192 - DNA, 22 bp, Homo sapiens
caacaacatgtataatattttt

SEQ ID NO: 2793193 - DNA, 19 bp, Homo sapiens
caacaactccaggaaaact

SEQ ID NO: 2793194 - DNA, 21 bp, Homo sapiens
caacacattacttgcacaagc

SEQ ID NO: 2793195 - DNA, 23 bp, Homo sapiens
caacacattacttgcacaagctt

SEQ ID NO: 2793196 - DNA, 10 bp, Homo sapiens
caacagcagc

SEQ ID NO: 2793197 - DNA, 20 bp, Homo sapiens
caacaggaatctcagagaca

SEQ ID NO: 2793198 - DNA, 13 bp, Homo sapiens
caacaggctgggc

SEQ ID NO: 2793199 - DNA, 21 bp, Homo sapiens
caacaggtggcaggaccagga

SEQ ID NO: 2793200 - DNA, 22 bp, Homo sapiens
caacaggtggcaggaccaggac

SEQ ID NO: 2793201 - DNA, 21 bp, Homo sapiens
caacaggttttcaccatagcc

SEQ ID NO: 2793202 - DNA, 18 bp, Homo sapiens
caacagtcaaaacagaga

SEQ ID NO: 2793203 - DNA, 16 bp, Homo sapiens
caacagttcaaagaag

SEQ ID NO: 2793204 - DNA, 22 bp, Homo sapiens
caacagttttttatgctaatca

SEQ ID NO: 2793205 - DNA, 23 bp, Homo sapiens
caacatctaagcctgttgagact

SEQ ID NO: 2793206 - DNA, 22 bp, Homo sapiens
caacatggagaaaccctgtctc

SEQ ID NO: 2793207 - DNA, 23 bp, Homo sapiens
caacatggagaaaccctgtctct

SEQ ID NO: 2793208 - DNA, 19 bp, Homo sapiens
caacatgtataatattttt

SEQ ID NO: 2793209 - DNA, 14 bp, Homo sapiens
caaccactgtaaaa

SEQ ID NO: 2793210 - DNA, 22 bp, Homo sapiens
caaccactgtggcgttctgctg

SEQ ID NO: 2793211 - DNA, 16 bp, Homo sapiens
caaccagcattttact

SEQ ID NO: 2793212 - DNA, 16 bp, Homo sapiens
caaccagccacacaga

SEQ ID NO: 2793213 - DNA, 13 bp, Homo sapiens
caaccaggaagaa

SEQ ID NO: 2793214 - DNA, 22 bp, Homo sapiens
caacccatgatgagctcctctt

SEQ ID NO: 2793215 - DNA, 16 bp, Homo sapiens
caaccccagacactgg

SEQ ID NO: 2793216 - DNA, 23 bp, Homo sapiens
caaccccagggcccccacaggcc

SEQ ID NO: 2793217 - DNA, 15 bp, Homo sapiens
caacccccagcctgc

SEQ ID NO: 2793218 - DNA, 16 bp, Homo sapiens
caacccccagcctgct

SEQ ID NO: 2793219 - DNA, 17 bp, Homo sapiens
caaccccccacctgcca

SEQ ID NO: 2793220 - DNA, 14 bp, Homo sapiens
caaccccttcgctc

SEQ ID NO: 2793221 - DNA, 18 bp, Homo sapiens
caaccccttcgctcctgt

SEQ ID NO: 2793222 - DNA, 16 bp, Homo sapiens
caacccgtgccaagtc

SEQ ID NO: 2793223 - DNA, 13 bp, Homo sapiens
caaccctcagcct

SEQ ID NO: 2793224 - DNA, 14 bp, Homo sapiens
caaccctcagcctt

SEQ ID NO: 2793225 - DNA, 19 bp, Homo sapiens
caaccctgttttatactgt

SEQ ID NO: 2793226 - DNA, 18 bp, Homo sapiens
caacctaacccctttcct

SEQ ID NO: 2793227 - DNA, 21 bp, Homo sapiens
caacctaccaccccttcctgt

SEQ ID NO: 2793228 - DNA, 22 bp, Homo sapiens
caacctaccaccccttcctgtc

SEQ ID NO: 2793229 - DNA, 21 bp, Homo sapiens
caacctccccgcagagctccc

SEQ ID NO: 2793230 - DNA, 20 bp, Homo sapiens
caacctgaccaacatggaga

SEQ ID NO: 2793231 - DNA, 18 bp, Homo sapiens
caacctgctctcctcttg

SEQ ID NO: 2793232 - DNA, 16 bp, Homo sapiens
caacctggtcacagga

SEQ ID NO: 2793233 - DNA, 14 bp, Homo sapiens
caacctttgtgtaa

SEQ ID NO: 2793234 - DNA, 15 bp, Homo sapiens
caactacagtctaaa

SEQ ID NO: 2793235 - DNA, 19 bp, Homo sapiens
caactacagtctaaagctg

SEQ ID NO: 2793236 - DNA, 17 bp, Homo sapiens
caactaggcttcagcat

SEQ ID NO: 2793237 - DNA, 13 bp, Homo sapiens
caactatttataa

SEQ ID NO: 2793238 - DNA, 14 bp, Homo sapiens
caactccagctccc

SEQ ID NO: 2793239 - DNA, 14 bp, Homo sapiens
caactcctggaagc

SEQ ID NO: 2793240 - DNA, 15 bp, Homo sapiens
caactctctcctgta

SEQ ID NO: 2793241 - DNA, 14 bp, Homo sapiens
caactgaaaagact

SEQ ID NO: 2793242 - DNA, 21 bp, Homo sapiens
caactgaggcagacagcagct

SEQ ID NO: 2793243 - DNA, 19 bp, Homo sapiens
caactggacattgtctgcg

SEQ ID NO: 2793244 - DNA, 19 bp, Homo sapiens
caactgttgattgcaggaa

SEQ ID NO: 2793245 - DNA, 17 bp, Homo sapiens
caactgtttttgaagaa

SEQ ID NO: 2793246 - DNA, 16 bp, Homo sapiens
caacttcaagtgcatg

SEQ ID NO: 2793247 - DNA, 18 bp, Homo sapiens
caagaaaactggaaatct

SEQ ID NO: 2793248 - DNA, 12 bp, Homo sapiens
caagaaagaaac

SEQ ID NO: 2793249 - DNA, 22 bp, Homo sapiens
caagaaatccagtttcccacca

SEQ ID NO: 2793250 - DNA, 14 bp, Homo sapiens
caagaactctgggc

SEQ ID NO: 2793251 - DNA, 17 bp, Homo sapiens
caagtccaggtcctggt

SEQ ID NO: 2793252 - DNA, 24 bp, Homo sapiens
caagtccaggtcctggtggggcag

SEQ ID NO: 2793253 - DNA, 18 bp, Homo sapiens
caagtccctgactctctg

SEQ ID NO: 2793254 - DNA, 21 bp, Homo sapiens
caagtcctcttttctgagagg

SEQ ID NO: 2793255 - DNA, 15 bp, Homo sapiens
caagtcttccctgat

SEQ ID NO: 2793256 - DNA, 18 bp, Homo sapiens
caagtgagagctgggtgt

SEQ ID NO: 2793257 - DNA, 14 bp, Homo sapiens
caagtgatatatgt

SEQ ID NO: 2793258 - DNA, 17 bp, Homo sapiens
caagtgatatatgtatt

SEQ ID NO: 2793259 - DNA, 18 bp, Homo sapiens
caagtgatatatgtattt

SEQ ID NO: 2793260 - DNA, 21 bp, Homo sapiens
caagtgattctcctgcctcag

SEQ ID NO: 2793261 - DNA, 21 bp, Homo sapiens
caagttcctctagtgccctcc

SEQ ID NO: 2793262 - DNA, 13 bp, Homo sapiens
caagttctagaga

SEQ ID NO: 2793263 - DNA, 16 bp, Homo sapiens
caagttctagagaaga

SEQ ID NO: 2793264 - DNA, 18 bp, Homo sapiens
caagttctagagaagagg

SEQ ID NO: 2793265 - DNA, 15 bp, Homo sapiens
caagttgagaacaaa

SEQ ID NO: 2793266 - DNA, 18 bp, Homo sapiens
caagtttataagcccaaa

SEQ ID NO: 2793267 - DNA, 23 bp, Homo sapiens
caagtttataagcccaaatggct

SEQ ID NO: 2793268 - DNA, 22 bp, Homo sapiens
caataaaaatctttgattcaga

SEQ ID NO: 2793269 - DNA, 17 bp, Homo sapiens
caataaaatagtattga

SEQ ID NO: 2793270 - DNA, 21 bp, Homo sapiens
caataaaatagtattgaaagt

SEQ ID NO: 2793271 - DNA, 14 bp, Homo sapiens
caataaaatcatgt

SEQ ID NO: 2793272 - DNA, 12 bp, Homo sapiens
caataaagagct

SEQ ID NO: 2793273 - DNA, 17 bp, Homo sapiens
caataaagctgctgaga

SEQ ID NO: 2793274 - DNA, 23 bp, Homo sapiens
caataaagctgctgagaatctag

SEQ ID NO: 2793275 - DNA, 17 bp, Homo sapiens
caataaagctggacaag

SEQ ID NO: 2793276 - DNA, 19 bp, Homo sapiens
caataaagctggacaagaa

SEQ ID NO: 2793277 - DNA, 23 bp, Homo sapiens
caataaagctggacaagaagctg

SEQ ID NO: 2793278 - DNA, 11 bp, Homo sapiens
caataaagtat

SEQ ID NO: 2793279 - DNA, 16 bp, Homo sapiens
caataaatgtctgttg

SEQ ID NO: 2793280 - DNA, 23 bp, Homo sapiens
caataacgtttaagccaaaacaa

SEQ ID NO: 2793281 - DNA, 12 bp, Homo sapiens
caataacttcag

SEQ ID NO: 2793282 - DNA, 17 bp, Homo sapiens
caataacttcagagaag

SEQ ID NO: 2793283 - DNA, 18 bp, Homo sapiens
caataacttcagagaagt

SEQ ID NO: 2793284 - DNA, 14 bp, Homo sapiens
agctacttgggagg

SEQ ID NO: 2793285 - DNA, 15 bp, Homo sapiens
agctagaaggccaca

SEQ ID NO: 2793286 - DNA, 19 bp, Homo sapiens
agctagaagtgggccagga

SEQ ID NO: 2793287 - DNA, 22 bp, Homo sapiens
agctagaagtgggccaggacag

SEQ ID NO: 2793288 - DNA, 24 bp, Homo sapiens
agctagaagtgggccaggacaggc

SEQ ID NO: 2793289 - DNA, 13 bp, Homo sapiens
agctaggaatgaa

SEQ ID NO: 2793290 - DNA, 15 bp, Homo sapiens
agctaggagcaaagc

SEQ ID NO: 2793291 - DNA, 17 bp, Homo sapiens
agctaggagcaaagcct

SEQ ID NO: 2793292 - DNA, 21 bp, Homo sapiens
agctaggagcaaagcctgttc

SEQ ID NO: 2793293 - DNA, 12 bp, Homo sapiens
agctaggcatgg

SEQ ID NO: 2793294 - DNA, 12 bp, Homo sapiens
agctaggcctgg

SEQ ID NO: 2793295 - DNA, 15 bp, Homo sapiens
agctattagcaactg

SEQ ID NO: 2793296 - DNA, 18 bp, Homo sapiens
agctattagcaactgtgc

SEQ ID NO: 2793297 - DNA, 13 bp, Homo sapiens
agctattgcatgt

SEQ ID NO: 2793298 - DNA, 22 bp, Homo sapiens
agctattgcatgtaaaatgcag

SEQ ID NO: 2793299 - DNA, 18 bp, Homo sapiens
agctcaagtcttccctga

SEQ ID NO: 2793300 - DNA, 15 bp, Homo sapiens
agctcacaaggcagc

SEQ ID NO: 2793301 - DNA, 19 bp, Homo sapiens
agctcaccagccccagtgc

SEQ ID NO: 2793302 - DNA, 20 bp, Homo sapiens
agctcaccagccccagtgcc

SEQ ID NO: 2793303 - DNA, 21 bp, Homo sapiens
agctcaccagccccagtgccc

SEQ ID NO: 2793304 - DNA, 23 bp, Homo sapiens
agctcaccagccccagtgcccac

SEQ ID NO: 2793305 - DNA, 17 bp, Homo sapiens
agctcacccaataaaca

SEQ ID NO: 2793306 - DNA, 16 bp, Homo sapiens
agctcagacccccact

SEQ ID NO: 2793307 - DNA, 15 bp, Homo sapiens
agctcagaggcccag

SEQ ID NO: 2793308 - DNA, 17 bp, Homo sapiens
agctcagaggcccagga

SEQ ID NO: 2793309 - DNA, 20 bp, Homo sapiens
agctcagctttttgtctttt

SEQ ID NO: 2793310 - DNA, 21 bp, Homo sapiens
agctcagtcccatcagagagc

SEQ ID NO: 2793311 - DNA, 19 bp, Homo sapiens
agctcagtttatccaaggt

SEQ ID NO: 2793312 - DNA, 17 bp, Homo sapiens
agctccagctcaccagc

SEQ ID NO: 2793313 - DNA, 19 bp, Homo sapiens
agctccagctcaccagccc

SEQ ID NO: 2793314 - DNA, 13 bp, Homo sapiens
agctccagttcga

SEQ ID NO: 2793315 - DNA, 13 bp, Homo sapiens
agctcccacccca

SEQ ID NO: 2793316 - DNA, 15 bp, Homo sapiens
agctcccaccccacc

SEQ ID NO: 2793317 - DNA, 17 bp, Homo sapiens
agctcccagcactcaac

SEQ ID NO: 2793318 - DNA, 13 bp, Homo sapiens
agctccccaggac

SEQ ID NO: 2793319 - DNA, 20 bp, Homo sapiens
agctccccaggactcaccct

SEQ ID NO: 2793320 - DNA, 23 bp, Homo sapiens
agctccccaggactcaccctcat

SEQ ID NO: 2793321 - DNA, 17 bp, Homo sapiens
agctccctaggagacca

SEQ ID NO: 2793322 - DNA, 23 bp, Homo sapiens
agctccgctttctacccagcgag

SEQ ID NO: 2793323 - DNA, 18 bp, Homo sapiens
agctcctctgtctcgagc

SEQ ID NO: 2793324 - DNA, 14 bp, Homo sapiens
agctcctgggcagc

SEQ ID NO: 2793325 - DNA, 20 bp, Homo sapiens
agctcctggtcttgagatgt

SEQ ID NO: 2793326 - DNA, 15 bp, Homo sapiens
agctccttctgtcct

SEQ ID NO: 2793327 - DNA, 16 bp, Homo sapiens
agctcggtggacccag

SEQ ID NO: 2793328 - DNA, 20 bp, Homo sapiens
agctcggtggacccagggat

SEQ ID NO: 2793329 - DNA, 11 bp, Homo sapiens
agctctccctc

SEQ ID NO: 2793330 - DNA, 15 bp, Homo sapiens
agctctccctctggc

SEQ ID NO: 2793331 - DNA, 19 bp, Homo sapiens
agctctccctctggccctg

SEQ ID NO: 2793332 - DNA, 18 bp, Homo sapiens
agctctccggtctctctc

SEQ ID NO: 2793333 - DNA, 21 bp, Homo sapiens
agctctgaagtcacatcacag

SEQ ID NO: 2793334 - DNA, 15 bp, Homo sapiens
agctctgagaggccc

SEQ ID NO: 2793335 - DNA, 23 bp, Homo sapiens
agctctgagaggccctggatcag

SEQ ID NO: 2793336 - DNA, 12 bp, Homo sapiens
agctctgcatta

SEQ ID NO: 2793337 - DNA, 12 bp, Homo sapiens
agctctgctcct

SEQ ID NO: 2793338 - DNA, 22 bp, Homo sapiens
agctctggccccaggcttgtca

SEQ ID NO: 2793339 - DNA, 20 bp, Homo sapiens
agctctggcttccagaaaac

SEQ ID NO: 2793340 - DNA, 13 bp, Homo sapiens
agctctgtccact

SEQ ID NO: 2793341 - DNA, 21 bp, Homo sapiens
agctctgtcctgggagtgagc

SEQ ID NO: 2793342 - DNA, 23 bp, Homo sapiens
agctcttcccctttcctggggga

SEQ ID NO: 2793343 - DNA, 12 bp, Homo sapiens
agctcttctatt

SEQ ID NO: 2793344 - DNA, 16 bp, Homo sapiens
agctcttctatttaaa

SEQ ID NO: 2793345 - DNA, 18 bp, Homo sapiens
agctcttctatttaaaaa

SEQ ID NO: 2793346 - DNA, 21 bp, Homo sapiens
agctcttctatttaaaaaata

SEQ ID NO: 2793347 - DNA, 23 bp, Homo sapiens
agctcttctatttaaaaaataaa

SEQ ID NO: 2793348 - DNA, 16 bp, Homo sapiens
agctcttctccaggct

SEQ ID NO: 2793349 - DNA, 23 bp, Homo sapiens
agctgaagcccatgctttcccac

SEQ ID NO: 2793350 - DNA, 20 bp, Homo sapiens
agctgacacataatttgaat

SEQ ID NO: 2793351 - DNA, 16 bp, Homo sapiens
agctgacccagcccct

SEQ ID NO: 2793352 - DNA, 20 bp, Homo sapiens
agctgagctcacaaggcagc

SEQ ID NO: 2793353 - DNA, 21 bp, Homo sapiens
agctgagctcacaaggcagca

SEQ ID NO: 2793354 - DNA, 22 bp, Homo sapiens
agctgagctcacaaggcagcaa

SEQ ID NO: 2793355 - DNA, 13 bp, Homo sapiens
agctgaggggggc

SEQ ID NO: 2793356 - DNA, 23 bp, Homo sapiens
agctgaggggggccgtgcccagg

SEQ ID NO: 2793357 - DNA, 15 bp, Homo sapiens
agctgaggtgcccag

SEQ ID NO: 2793358 - DNA, 15 bp, Homo sapiens
agctgcaagtgacat

SEQ ID NO: 2793359 - DNA, 18 bp, Homo sapiens
agctgcaagtgacatctc

SEQ ID NO: 2793360 - DNA, 18 bp, Homo sapiens
agctgcacctgccagcct

SEQ ID NO: 2793361 - DNA, 22 bp, Homo sapiens
agctgcacctgccagcctggct

SEQ ID NO: 2793362 - DNA, 13 bp, Homo sapiens
agctgcagcttcc

SEQ ID NO: 2793363 - DNA, 15 bp, Homo sapiens
agctgcagcttcctg

SEQ ID NO: 2793364 - DNA, 16 bp, Homo sapiens
agctgcagcttcctgt

SEQ ID NO: 2793365 - DNA, 22 bp, Homo sapiens
agctgcaggaatcaaaaattga

SEQ ID NO: 2793366 - DNA, 17 bp, Homo sapiens
agctgccgaccagagcc

SEQ ID NO: 2793367 - DNA, 20 bp, Homo sapiens
agctgcctgtagttaggaaa

SEQ ID NO: 2793368 - DNA, 13 bp, Homo sapiens
agctgcctgttca

SEQ ID NO: 2793369 - DNA, 19 bp, Homo sapiens
agctgcctgttcagctcca

SEQ ID NO: 2793370 - DNA, 13 bp, Homo sapiens
agctgcggtccac

SEQ ID NO: 2793371 - DNA, 23 bp, Homo sapiens
agctgcggtccacccaggagccc

SEQ ID NO: 2793372 - DNA, 14 bp, Homo sapiens
agctgctctattgt

SEQ ID NO: 2793373 - DNA, 12 bp, Homo sapiens
agctgctgacag

SEQ ID NO: 2793374 - DNA, 17 bp, Homo sapiens
agcccagcctctgtccc

SEQ ID NO: 2793375 - DNA, 19 bp, Homo sapiens
agcccagctctttgttcag

SEQ ID NO: 2793376 - DNA, 21 bp, Homo sapiens
agcccagggcatcccatgggg

SEQ ID NO: 2793377 - DNA, 17 bp, Homo sapiens
agcccatggagcaggga

SEQ ID NO: 2793378 - DNA, 15 bp, Homo sapiens
agccccacacggagg

SEQ ID NO: 2793379 - DNA, 12 bp, Homo sapiens
agccccagcaag

SEQ ID NO: 2793380 - DNA, 12 bp, Homo sapiens
agccccagcact

SEQ ID NO: 2793381 - DNA, 13 bp, Homo sapiens
agccccagtgccc

SEQ ID NO: 2793382 - DNA, 14 bp, Homo sapiens
agccccagtgccca

SEQ ID NO: 2793383 - DNA, 16 bp, Homo sapiens
agccccagtgcccaca

SEQ ID NO: 2793384 - DNA, 23 bp, Homo sapiens
agccccataattttttttttcct

SEQ ID NO: 2793385 - DNA, 18 bp, Homo sapiens
agccccattctgcctgcc

SEQ ID NO: 2793386 - DNA, 13 bp, Homo sapiens
agcccccacccca

SEQ ID NO: 2793387 - DNA, 17 bp, Homo sapiens
agcccccacttctctcc

SEQ ID NO: 2793388 - DNA, 16 bp, Homo sapiens
agccccccacaatgat

SEQ ID NO: 2793389 - DNA, 17 bp, Homo sapiens
agccccgactccagcca

SEQ ID NO: 2793390 - DNA, 19 bp, Homo sapiens
agccccgactccagccagc

SEQ ID NO: 2793391 - DNA, 23 bp, Homo sapiens
agccccgactccagccagcgcct

SEQ ID NO: 2793392 - DNA, 22 bp, Homo sapiens
agccccgaggccttctctgaag

SEQ ID NO: 2793393 - DNA, 16 bp, Homo sapiens
agccccgggcctgcct

SEQ ID NO: 2793394 - DNA, 11 bp, Homo sapiens
agcccctcctc

SEQ ID NO: 2793395 - DNA, 19 bp, Homo sapiens
agcccctcctccccttcct

SEQ ID NO: 2793396 - DNA, 21 bp, Homo sapiens
agcccctcctccccttcctgc

SEQ ID NO: 2793397 - DNA, 17 bp, Homo sapiens
agcccctcctctgccac

SEQ ID NO: 2793398 - DNA, 19 bp, Homo sapiens
agcccctcctctgccacct

SEQ ID NO: 2793399 - DNA, 22 bp, Homo sapiens
agccccttactatgatctcagg

SEQ ID NO: 2793400 - DNA, 17 bp, Homo sapiens
agccccttgagaaacct

SEQ ID NO: 2793401 - DNA, 21 bp, Homo sapiens
agcccggcctgctcccagcag

SEQ ID NO: 2793402 - DNA, 21 bp, Homo sapiens
agccctaaggatctctcagga

SEQ ID NO: 2793403 - DNA, 14 bp, Homo sapiens
agccctatggatgt

SEQ ID NO: 2793404 - DNA, 15 bp, Homo sapiens
agccctccctgtcct

SEQ ID NO: 2793405 - DNA, 16 bp, Homo sapiens
agccctccctgtcctc

SEQ ID NO: 2793406 - DNA, 17 bp, Homo sapiens
agccctccctgtcctcc

SEQ ID NO: 2793407 - DNA, 19 bp, Homo sapiens
agccctccctgtcctcctc

SEQ ID NO: 2793408 - DNA, 12 bp, Homo sapiens
agccctcctcac

SEQ ID NO: 2793409 - DNA, 14 bp, Homo sapiens
agccctcctcaccc

SEQ ID NO: 2793410 - DNA, 17 bp, Homo sapiens
agccctgactggtgcta

SEQ ID NO: 2793411 - DNA, 16 bp, Homo sapiens
agccctgcctggagga

SEQ ID NO: 2793412 - DNA, 17 bp, Homo sapiens
agccctggcaggatgac

SEQ ID NO: 2793413 - DNA, 21 bp, Homo sapiens
agccctggcaggatgaccctg

SEQ ID NO: 2793414 - DNA, 13 bp, Homo sapiens
agccctgggaccg

SEQ ID NO: 2793415 - DNA, 20 bp, Homo sapiens
agccctgggaccgctacacc

SEQ ID NO: 2793416 - DNA, 14 bp, Homo sapiens
agccctggtggcag

SEQ ID NO: 2793417 - DNA, 17 bp, Homo sapiens
agccctgtcgagacact

SEQ ID NO: 2793418 - DNA, 18 bp, Homo sapiens
agccctgtcgagacactt

SEQ ID NO: 2793419 - DNA, 21 bp, Homo sapiens
agcccttagcagggaaacagc

SEQ ID NO: 2793420 - DNA, 19 bp, Homo sapiens
agcccttccatgtcgcctc

SEQ ID NO: 2793421 - DNA, 22 bp, Homo sapiens
agcccttccatgtcgcctctgc

SEQ ID NO: 2793422 - DNA, 15 bp, Homo sapiens
agcccttccctgctt

SEQ ID NO: 2793423 - DNA, 16 bp, Homo sapiens
agcccttccctgcttt

SEQ ID NO: 2793424 - DNA, 21 bp, Homo sapiens
agccctttacttgacctccta

SEQ ID NO: 2793425 - DNA, 13 bp, Homo sapiens
agccgacctcagc

SEQ ID NO: 2793426 - DNA, 18 bp, Homo sapiens
agccgagagcctgctccc

SEQ ID NO: 2793427 - DNA, 20 bp, Homo sapiens
agccgagatcacgccactgc

SEQ ID NO: 2793428 - DNA, 18 bp, Homo sapiens
agccgagccgggcctggg

SEQ ID NO: 2793429 - DNA, 21 bp, Homo sapiens
agccgagccgggcctggggct

SEQ ID NO: 2793430 - DNA, 18 bp, Homo sapiens
agccgcagcctccctctg

SEQ ID NO: 2793431 - DNA, 19 bp, Homo sapiens
agccgctcctgtctgccag

SEQ ID NO: 2793432 - DNA, 23 bp, Homo sapiens
agccgggaacagacaacagaagt

SEQ ID NO: 2793433 - DNA, 13 bp, Homo sapiens
agccgggcctggg

SEQ ID NO: 2793434 - DNA, 16 bp, Homo sapiens
aattagctgtgtgaaa

SEQ ID NO: 2793435 - DNA, 19 bp, Homo sapiens
aattaggatctatgcaatt

SEQ ID NO: 2793436 - DNA, 20 bp, Homo sapiens
aattaggggttgctaagaag

SEQ ID NO: 2793437 - DNA, 22 bp, Homo sapiens
aattagtacagtagcttaaata

SEQ ID NO: 2793438 - DNA, 14 bp, Homo sapiens
aattagtgagattt

SEQ ID NO: 2793439 - DNA, 17 bp, Homo sapiens
aattagtgagatttgta

SEQ ID NO: 2793440 - DNA, 18 bp, Homo sapiens
aattagtgagatttgtat

SEQ ID NO: 2793441 - DNA, 23 bp, Homo sapiens
aattataacttaaaatattttat

SEQ ID NO: 2793442 - DNA, 20 bp, Homo sapiens
aattatatctaatttataca

SEQ ID NO: 2793443 - DNA, 15 bp, Homo sapiens
aattatcggaagcag

SEQ ID NO: 2793444 - DNA, 21 bp, Homo sapiens
aattatcggaagcagtgcctt

SEQ ID NO: 2793445 - DNA, 20 bp, Homo sapiens
aattatcgggaacagtgttt

SEQ ID NO: 2793446 - DNA, 14 bp, Homo sapiens
aattatcttattta

SEQ ID NO: 2793447 - DNA, 13 bp, Homo sapiens
aattatgacagtt

SEQ ID NO: 2793448 - DNA, 12 bp, Homo sapiens
aattatggtgaa

SEQ ID NO: 2793449 - DNA, 15 bp, Homo sapiens
aattatggtgaaatt

SEQ ID NO: 2793450 - DNA, 13 bp, Homo sapiens
aattatgtgacaa

SEQ ID NO: 2793451 - DNA, 19 bp, Homo sapiens
aattatgtgacaacctttg

SEQ ID NO: 2793452 - DNA, 21 bp, Homo sapiens
aattattattcttcataacaa

SEQ ID NO: 2793453 - DNA, 11 bp, Homo sapiens
aattattattt

SEQ ID NO: 2793454 - DNA, 12 bp, Homo sapiens
aattattgtata

SEQ ID NO: 2793455 - DNA, 14 bp, Homo sapiens
aattatttttgtgt

SEQ ID NO: 2793456 - DNA, 19 bp, Homo sapiens
aattatttttgtgtttcta

SEQ ID NO: 2793457 - DNA, 13 bp, Homo sapiens
aattcaaaccatt

SEQ ID NO: 2793458 - DNA, 17 bp, Homo sapiens
aattcaacctgtgtctt

SEQ ID NO: 2793459 - DNA, 13 bp, Homo sapiens
aattcaattcaaa

SEQ ID NO: 2793460 - DNA, 15 bp, Homo sapiens
aattcaattcaaagc

SEQ ID NO: 2793461 - DNA, 20 bp, Homo sapiens
aattcagatatatttttcac

SEQ ID NO: 2793462 - DNA, 16 bp, Homo sapiens
aattcataattagaac

SEQ ID NO: 2793463 - DNA, 14 bp, Homo sapiens
aattcattaaattt

SEQ ID NO: 2793464 - DNA, 23 bp, Homo sapiens
aattcattaaatttctggatttg

SEQ ID NO: 2793465 - DNA, 19 bp, Homo sapiens
aattccttttctaactctc

SEQ ID NO: 2793466 - DNA, 12 bp, Homo sapiens
aattctaaaatg

SEQ ID NO: 2793467 - DNA, 14 bp, Homo sapiens
aattctaacttttt

SEQ ID NO: 2793468 - DNA, 13 bp, Homo sapiens
aattctagaaaat

SEQ ID NO: 2793469 - DNA, 23 bp, Homo sapiens
aattctaggcatcccaggggacc

SEQ ID NO: 2793470 - DNA, 20 bp, Homo sapiens
aattctcatgtgatcctttt

SEQ ID NO: 2793471 - DNA, 21 bp, Homo sapiens
aattctcatgtgatcctttta

SEQ ID NO: 2793472 - DNA, 15 bp, Homo sapiens
aattctgctacctca

SEQ ID NO: 2793473 - DNA, 20 bp, Homo sapiens
aattctgtgaagaatgaagt

SEQ ID NO: 2793474 - DNA, 15 bp, Homo sapiens
aattcttggaatact

SEQ ID NO: 2793475 - DNA, 12 bp, Homo sapiens
aattgaaatata

SEQ ID NO: 2793476 - DNA, 17 bp, Homo sapiens
aattgaagagagatata

SEQ ID NO: 2793477 - DNA, 23 bp, Homo sapiens
aattgaagagagatatatctgaa

SEQ ID NO: 2793478 - DNA, 21 bp, Homo sapiens
aattgaagagatttcaacata

SEQ ID NO: 2793479 - DNA, 23 bp, Homo sapiens
aattgaagatgtaaggaattgaa

SEQ ID NO: 2793480 - DNA, 17 bp, Homo sapiens
aattgaaggagaaaatg

SEQ ID NO: 2793481 - DNA, 22 bp, Homo sapiens
aattgacttcttgcttgtacat

SEQ ID NO: 2793482 - DNA, 17 bp, Homo sapiens
agcaacagtagcaggga

SEQ ID NO: 2793483 - DNA, 19 bp, Homo sapiens
agcaaccgtggcccttcct

SEQ ID NO: 2793484 - DNA, 15 bp, Homo sapiens
agcaacctcagtaat

SEQ ID NO: 2793485 - DNA, 12 bp, Homo sapiens
agcaactgttgg

SEQ ID NO: 2793486 - DNA, 19 bp, Homo sapiens
agcaagaaggcaaaaatag

SEQ ID NO: 2793487 - DNA, 19 bp, Homo sapiens
agcaagacgtcctggaatg

SEQ ID NO: 2793488 - DNA, 23 bp, Homo sapiens
agcaagacttctctttgcctcaa

SEQ ID NO: 2793489 - DNA, 13 bp, Homo sapiens
agcaagagcacaa

SEQ ID NO: 2793490 - DNA, 21 bp, Homo sapiens
agcaagcattcagaagaaaaa

SEQ ID NO: 2793491 - DNA, 22 bp, Homo sapiens
agcaagcattcagaagaaaaag

SEQ ID NO: 2793492 - DNA, 17 bp, Homo sapiens
agcaaggcccgagcagc

SEQ ID NO: 2793493 - DNA, 19 bp, Homo sapiens
agcaaggcccgagcagctg

SEQ ID NO: 2793494 - DNA, 21 bp, Homo sapiens
agcaaggcccgagcagctgag

SEQ ID NO: 2793495 - DNA, 15 bp, Homo sapiens
agcaagtgagagctg

SEQ ID NO: 2793496 - DNA, 20 bp, Homo sapiens
agcaagttctagagaagagg

SEQ ID NO: 2793497 - DNA, 23 bp, Homo sapiens
agcaagttctagagaagaggctg

SEQ ID NO: 2793498 - DNA, 11 bp, Homo sapiens
agcaataatta

SEQ ID NO: 2793499 - DNA, 19 bp, Homo sapiens
agcaataattaggatctat

SEQ ID NO: 2793500 - DNA, 21 bp, Homo sapiens
agcaataattaggatctatgc

SEQ ID NO: 2793501 - DNA, 19 bp, Homo sapiens
agcaattcatttcacttta

SEQ ID NO: 2793502 - DNA, 22 bp, Homo sapiens
agcaatttcgccgttgaagagg

SEQ ID NO: 2793503 - DNA, 16 bp, Homo sapiens
agcacaaagctcaaga

SEQ ID NO: 2793504 - DNA, 14 bp, Homo sapiens
agcacacaggtaca

SEQ ID NO: 2793505 - DNA, 20 bp, Homo sapiens
agcacacgaaccctgccagg

SEQ ID NO: 2793506 - DNA, 19 bp, Homo sapiens
agcacactgtagcattaca

SEQ ID NO: 2793507 - DNA, 21 bp, Homo sapiens
agcacagcagcccctgcacaa

SEQ ID NO: 2793508 - DNA, 13 bp, Homo sapiens
agcacaggcagct

SEQ ID NO: 2793509 - DNA, 14 bp, Homo sapiens
agcacatttctcct

SEQ ID NO: 2793510 - DNA, 21 bp, Homo sapiens
agcacatttctcctgtttaca

SEQ ID NO: 2793511 - DNA, 14 bp, Homo sapiens
agcaccagaatgta

SEQ ID NO: 2793512 - DNA, 23 bp, Homo sapiens
agcaccaggcacgaacccacctg

SEQ ID NO: 2793513 - DNA, 18 bp, Homo sapiens
agcaccccctcattcccc

SEQ ID NO: 2793514 - DNA, 21 bp, Homo sapiens
agcaccccctcattcccctcg

SEQ ID NO: 2793515 - DNA, 21 bp, Homo sapiens
agcaccctgttccctctttct

SEQ ID NO: 2793516 - DNA, 14 bp, Homo sapiens
agcaccgcagcatg

SEQ ID NO: 2793517 - DNA, 13 bp, Homo sapiens
agcacctcctgcc

SEQ ID NO: 2793518 - DNA, 11 bp, Homo sapiens
agcacctgccg

SEQ ID NO: 2793519 - DNA, 20 bp, Homo sapiens
agcacctgcttcatgctcag

SEQ ID NO: 2793520 - DNA, 13 bp, Homo sapiens
agcacctgttttt

SEQ ID NO: 2793521 - DNA, 17 bp, Homo sapiens
agcactaaagcagtgga

SEQ ID NO: 2793522 - DNA, 19 bp, Homo sapiens
agcactcctctgtctctgc

SEQ ID NO: 2793523 - DNA, 15 bp, Homo sapiens
agcactgccaggagg

SEQ ID NO: 2793524 - DNA, 23 bp, Homo sapiens
agcactgctaggcgagtgccagg

SEQ ID NO: 2793525 - DNA, 17 bp, Homo sapiens
agcactgggttgacttt

SEQ ID NO: 2793526 - DNA, 22 bp, Homo sapiens
agcacttctttcctctccaatt

SEQ ID NO: 2793527 - DNA, 22 bp, Homo sapiens
agcactttacagatgagattcc

SEQ ID NO: 2793528 - DNA, 19 bp, Homo sapiens
agcactttgggaggccaag

SEQ ID NO: 2793529 - DNA, 21 bp, Homo sapiens
agcactttgggaggctgaagt

SEQ ID NO: 2793530 - DNA, 20 bp, Homo sapiens
agcagaaaagtgcttagaaa

SEQ ID NO: 2793531 - DNA, 21 bp, Homo sapiens
agcagaaaagtgcttagaaag

SEQ ID NO: 2793532 - DNA, 13 bp, Homo sapiens
agcagaagccaaa

SEQ ID NO: 2793533 - DNA, 21 bp, Homo sapiens
agcagagaatgaaagggccca

SEQ ID NO: 2793534 - DNA, 23 bp, Homo sapiens
agcagagaatgaaagggcccaga

SEQ ID NO: 2793535 - DNA, 22 bp, Homo sapiens
agcagaggagtccagggcggga

SEQ ID NO: 2793536 - DNA, 18 bp, Homo sapiens
agcagagggactttgtat

SEQ ID NO: 2793537 - DNA, 15 bp, Homo sapiens
agcagatggaaagaa

SEQ ID NO: 2793538 - DNA, 18 bp, Homo sapiens
agcagatttaacaattcc

SEQ ID NO: 2793539 - DNA, 22 bp, Homo sapiens
agcagccagccctgcctggagg

SEQ ID NO: 2793540 - DNA, 23 bp, Homo sapiens
agcagccagccctgcctggagga

SEQ ID NO: 2793541 - DNA, 18 bp, Homo sapiens
agcagccagctctcagcc

SEQ ID NO: 2793542 - DNA, 12 bp, Homo sapiens
agcagccctcct

SEQ ID NO: 2793543 - DNA, 16 bp, Homo sapiens
agcagccctcctcacc

SEQ ID NO: 2793544 - DNA, 18 bp, Homo sapiens
agcagccctcctcacccc

SEQ ID NO: 2793545 - DNA, 18 bp, Homo sapiens
agcagccgtttctccttg

SEQ ID NO: 2793546 - DNA, 21 bp, Homo sapiens
agcagctcaggcacacttctt

SEQ ID NO: 2793547 - DNA, 12 bp, Homo sapiens
agcagctgagca

SEQ ID NO: 2793548 - DNA, 12 bp, Homo sapiens
agacccccactc

SEQ ID NO: 2793549 - DNA, 13 bp, Homo sapiens
agacccccactct

SEQ ID NO: 2793550 - DNA, 16 bp, Homo sapiens
agaccctaccccacca

SEQ ID NO: 2793551 - DNA, 16 bp, Homo sapiens
agacccttgcattaga

SEQ ID NO: 2793552 - DNA, 14 bp, Homo sapiens
agaccgaattttat

SEQ ID NO: 2793553 - DNA, 16 bp, Homo sapiens
agacctatttgacata

SEQ ID NO: 2793554 - DNA, 12 bp, Homo sapiens
agacctctgatc

SEQ ID NO: 2793555 - DNA, 19 bp, Homo sapiens
agacctgacaagcactgct

SEQ ID NO: 2793556 - DNA, 16 bp, Homo sapiens
agaccttctccaaatg

SEQ ID NO: 2793557 - DNA, 18 bp, Homo sapiens
agaccttctgaagatctc

SEQ ID NO: 2793558 - DNA, 14 bp, Homo sapiens
agaccttttttagg

SEQ ID NO: 2793559 - DNA, 16 bp, Homo sapiens
agaccttttttaggaa

SEQ ID NO: 2793560 - DNA, 17 bp, Homo sapiens
agacgttaccaattatg

SEQ ID NO: 2793561 - DNA, 13 bp, Homo sapiens
agactaagccctg

SEQ ID NO: 2793562 - DNA, 12 bp, Homo sapiens
agactatgtgtc

SEQ ID NO: 2793563 - DNA, 15 bp, Homo sapiens
agactcacctctgcc

SEQ ID NO: 2793564 - DNA, 17 bp, Homo sapiens
agactcacctctgcctc

SEQ ID NO: 2793565 - DNA, 11 bp, Homo sapiens
agactcagctc

SEQ ID NO: 2793566 - DNA, 17 bp, Homo sapiens
agactcagctccagaat

SEQ ID NO: 2793567 - DNA, 13 bp, Homo sapiens
agactcagctctg

SEQ ID NO: 2793568 - DNA, 18 bp, Homo sapiens
agactcagctctgacatt

SEQ ID NO: 2793569 - DNA, 20 bp, Homo sapiens
agactcagctctgacattct

SEQ ID NO: 2793570 - DNA, 17 bp, Homo sapiens
agactcagggccccagc

SEQ ID NO: 2793571 - DNA, 13 bp, Homo sapiens
agactcagtgttc

SEQ ID NO: 2793572 - DNA, 12 bp, Homo sapiens
agactcagtttg

SEQ ID NO: 2793573 - DNA, 15 bp, Homo sapiens
agactcatctacaca

SEQ ID NO: 2793574 - DNA, 17 bp, Homo sapiens
agactctacagaggcca

SEQ ID NO: 2793575 - DNA, 19 bp, Homo sapiens
agactctacccatattaca

SEQ ID NO: 2793576 - DNA, 19 bp, Homo sapiens
agactgcaagaggctcctg

SEQ ID NO: 2793577 - DNA, 14 bp, Homo sapiens
agactgcatctcaa

SEQ ID NO: 2793578 - DNA, 23 bp, Homo sapiens
agactgcgggatggtcctggggc

SEQ ID NO: 2793579 - DNA, 20 bp, Homo sapiens
agactgctgggactggccag

SEQ ID NO: 2793580 - DNA, 19 bp, Homo sapiens
agactgcttccaattttct

SEQ ID NO: 2793581 - DNA, 18 bp, Homo sapiens
agactggaacttgaactg

SEQ ID NO: 2793582 - DNA, 19 bp, Homo sapiens
agactggaagcacagcttc

SEQ ID NO: 2793583 - DNA, 13 bp, Homo sapiens
agactggacagct

SEQ ID NO: 2793584 - DNA, 17 bp, Homo sapiens
agactggacagcttgtg

SEQ ID NO: 2793585 - DNA, 15 bp, Homo sapiens
agactggagcatctg

SEQ ID NO: 2793586 - DNA, 16 bp, Homo sapiens
agactggagcatctga

SEQ ID NO: 2793587 - DNA, 17 bp, Homo sapiens
agactgtaattaagtaa

SEQ ID NO: 2793588 - DNA, 17 bp, Homo sapiens
agactgtacttattttc

SEQ ID NO: 2793589 - DNA, 21 bp, Homo sapiens
agactgtacttattttccaat

SEQ ID NO: 2793590 - DNA, 15 bp, Homo sapiens
agactgttgctcaaa

SEQ ID NO: 2793591 - DNA, 21 bp, Homo sapiens
agacttccaaacctgacagat

SEQ ID NO: 2793592 - DNA, 18 bp, Homo sapiens
agacttctctttgcctca

SEQ ID NO: 2793593 - DNA, 19 bp, Homo sapiens
agacttctctttgcctcaa

SEQ ID NO: 2793594 - DNA, 13 bp, Homo sapiens
agacttgacagtg

SEQ ID NO: 2793595 - DNA, 15 bp, Homo sapiens
agacttgacagtgga

SEQ ID NO: 2793596 - DNA, 18 bp, Homo sapiens
agacttgtatgaaagatg

SEQ ID NO: 2793597 - DNA, 14 bp, Homo sapiens
agactttaaagaat

SEQ ID NO: 2793598 - DNA, 22 bp, Homo sapiens
agagaaaagattaaaattagtg

SEQ ID NO: 2793599 - DNA, 16 bp, Homo sapiens
agagaaagaagagaca

SEQ ID NO: 2793600 - DNA, 17 bp, Homo sapiens
agagaaagtgacctatt

SEQ ID NO: 2793601 - DNA, 20 bp, Homo sapiens
agagaaatttttatttttga

SEQ ID NO: 2793602 - DNA, 22 bp, Homo sapiens
agagaaatttttatttttgaac

SEQ ID NO: 2793603 - DNA, 14 bp, Homo sapiens
agagaaggagatca

SEQ ID NO: 2793604 - DNA, 15 bp, Homo sapiens
agagaaggagatcag

SEQ ID NO: 2793605 - DNA, 15 bp, Homo sapiens
agagaaggcttcctc

SEQ ID NO: 2793606 - DNA, 22 bp, Homo sapiens
agagaagggggattggagggaa

SEQ ID NO: 2793607 - DNA, 18 bp, Homo sapiens
agagaatatatttttgat

SEQ ID NO: 2793608 - DNA, 19 bp, Homo sapiens
agagaatctgaagctattg

SEQ ID NO: 2793609 - DNA, 22 bp, Homo sapiens
agagaatctgaagctattgatg

SEQ ID NO: 2793610 - DNA, 14 bp, Homo sapiens
agagaattctaaga

SEQ ID NO: 2793611 - DNA, 20 bp, Homo sapiens
agagaattctaagattgtac

SEQ ID NO: 2793612 - DNA, 21 bp, Homo sapiens
agagaattctaagattgtaca

SEQ ID NO: 2793613 - DNA, 22 bp, Homo sapiens
agagaattctaagattgtacat

SEQ ID NO: 2793614 - DNA, 18 bp, Homo sapiens
agagacaataaaacattc

SEQ ID NO: 2793615 - DNA, 13 bp, Homo sapiens
agagacacctgca

SEQ ID NO: 2793616 - DNA, 16 bp, Homo sapiens
agagacacctgcacct

SEQ ID NO: 2793617 - DNA, 19 bp, Homo sapiens
agagacacctgcacctccc

SEQ ID NO: 2793618 - DNA, 22 bp, Homo sapiens
agagacacctgcacctcccccc

SEQ ID NO: 2793619 - DNA, 21 bp, Homo sapiens
agagacaggaaaatcctctgg

SEQ ID NO: 2793620 - DNA, 18 bp, Homo sapiens
agagacaggcccaagaga

SEQ ID NO: 2793621 - DNA, 12 bp, Homo sapiens
agagacccaagg

SEQ ID NO: 2793622 - DNA, 14 bp, Homo sapiens
agagacccaaggag

SEQ ID NO: 2793623 - DNA, 14 bp, Homo sapiens
agagaccccttcct

SEQ ID NO: 2793624 - DNA, 21 bp, Homo sapiens
agagaccccttcctttcctct

SEQ ID NO: 2793625 - DNA, 22 bp, Homo sapiens
agagaccctcactgctggggag

SEQ ID NO: 2793626 - DNA, 17 bp, Homo sapiens
agagacccttgtttgat

SEQ ID NO: 2793627 - DNA, 20 bp, Homo sapiens
agagactcagggccccagca

SEQ ID NO: 2793628 - DNA, 17 bp, Homo sapiens
agagagaaacatttatg

SEQ ID NO: 2793629 - DNA, 22 bp, Homo sapiens
agagagatatatctgaaaactg

SEQ ID NO: 2793630 - DNA, 18 bp, Homo sapiens
agagagcgagcgctaccc

SEQ ID NO: 2793631 - DNA, 21 bp, Homo sapiens
agagagggtggtgacctctgc

SEQ ID NO: 2793632 - DNA, 21 bp, Homo sapiens
agagaggtgggcagcagctca

SEQ ID NO: 2793633 - DNA, 22 bp, Homo sapiens
agagagtcctctggatggcacc

SEQ ID NO: 2793634 - DNA, 17 bp, Homo sapiens
agagagtttatcattgg

SEQ ID NO: 2793635 - DNA, 17 bp, Homo sapiens
agagatatggcagcgaa

SEQ ID NO: 2793636 - DNA, 23 bp, Homo sapiens
agagatgcctccaccgctgccta

SEQ ID NO: 2793637 - DNA, 17 bp, Homo sapiens
agagattaatttgtgta

SEQ ID NO: 2793638 - DNA, 21 bp, Homo sapiens
agagatttcaacatatcattt

SEQ ID NO: 2793639 - DNA, 18 bp, Homo sapiens
agagcaagactccgtctc

SEQ ID NO: 2793640 - DNA, 13 bp, Homo sapiens
agagcagagagca

SEQ ID NO: 2793641 - DNA, 13 bp, Homo sapiens
agagcaggcacat

SEQ ID NO: 2793642 - DNA, 19 bp, Homo sapiens
agagcaggcacatggagga

SEQ ID NO: 2793643 - DNA, 15 bp, Homo sapiens
agagcatcatgcctc

SEQ ID NO: 2793644 - DNA, 16 bp, Homo sapiens
agagcatcatgcctct

SEQ ID NO: 2793645 - DNA, 21 bp, Homo sapiens
agagcatcatgcctctgaggc

SEQ ID NO: 2793646 - DNA, 21 bp, Homo sapiens
agagcattacgtgagccaggt

SEQ ID NO: 2793647 - DNA, 22 bp, Homo sapiens
agagcattacgtgagccaggta

SEQ ID NO: 2793648 - DNA, 14 bp, Homo sapiens
agagccagctctct

SEQ ID NO: 2793649 - DNA, 18 bp, Homo sapiens
agagccagctctctctac

SEQ ID NO: 2793650 - DNA, 13 bp, Homo sapiens
agagcccaccttg

SEQ ID NO: 2793651 - DNA, 12 bp, Homo sapiens
agagccctggga

SEQ ID NO: 2793652 - DNA, 13 bp, Homo sapiens
agagccgggaagc

SEQ ID NO: 2793653 - DNA, 14 bp, Homo sapiens
agagcctgactgtg

SEQ ID NO: 2793654 - DNA, 14 bp, Homo sapiens
agagcctgcctcag

SEQ ID NO: 2793655 - DNA, 18 bp, Homo sapiens
agagcctgctcccccacc

SEQ ID NO: 2793656 - DNA, 19 bp, Homo sapiens
agagcctgctcccccaccc

SEQ ID NO: 2793657 - DNA, 13 bp, Homo sapiens
agagcctggagaa

SEQ ID NO: 2793658 - DNA, 14 bp, Homo sapiens
agagcctggagaag

SEQ ID NO: 2793659 - DNA, 16 bp, Homo sapiens
agagcctggagaagct

SEQ ID NO: 2793660 - DNA, 10 bp, Homo sapiens
agagcctggg

SEQ ID NO: 2793661 - DNA, 21 bp, Homo sapiens
agagccttctcctgcctacat

SEQ ID NO: 2793662 - DNA, 19 bp, Homo sapiens
agagccttggtgtccacct

SEQ ID NO: 2793663 - DNA, 20 bp, Homo sapiens
agagccttggtgtccacctg

SEQ ID NO: 2793664 - DNA, 21 bp, Homo sapiens
agagcctttggatgaccagaa

SEQ ID NO: 2793665 - DNA, 17 bp, Homo sapiens
agagctacgtatttaat

SEQ ID NO: 2793666 - DNA, 14 bp, Homo sapiens
agagctagcgctgc

SEQ ID NO: 2793667 - DNA, 16 bp, Homo sapiens
agagctagcgctgccg

SEQ ID NO: 2793668 - DNA, 23 bp, Homo sapiens
agagctgatgtgagtgtgtgtga

SEQ ID NO: 2793669 - DNA, 23 bp, Homo sapiens
agagctgctctggaaaatgtgac

SEQ ID NO: 2793670 - DNA, 17 bp, Homo sapiens
agaggaaaaaaatgact

SEQ ID NO: 2793671 - DNA, 14 bp, Homo sapiens
agaggacttttctt

SEQ ID NO: 2793672 - DNA, 22 bp, Homo sapiens
agaggacttttctttgtggctt

SEQ ID NO: 2793673 - DNA, 13 bp, Homo sapiens
agaggcagagaaa

SEQ ID NO: 2793674 - DNA, 18 bp, Homo sapiens
agaggcagagaaagaaga

SEQ ID NO: 2793675 - DNA, 20 bp, Homo sapiens
agaggcagagaaagaagaga

SEQ ID NO: 2793676 - DNA, 21 bp, Homo sapiens
agaggcagagaaagaagagac

SEQ ID NO: 2793677 - DNA, 17 bp, Homo sapiens
agaggcagggaggggac

SEQ ID NO: 2793678 - DNA, 21 bp, Homo sapiens
agaggcagggtctcactctgt

SEQ ID NO: 2793679 - DNA, 13 bp, Homo sapiens
agaggcatggctg

SEQ ID NO: 2793680 - DNA, 19 bp, Homo sapiens
agaggccatgggcctcctg

SEQ ID NO: 2793681 - DNA, 12 bp, Homo sapiens
agaggccctgga

SEQ ID NO: 2793682 - DNA, 15 bp, Homo sapiens
agaggccctggatca

SEQ ID NO: 2793683 - DNA, 17 bp, Homo sapiens
agaggccctggatcagc

SEQ ID NO: 2793684 - DNA, 20 bp, Homo sapiens
agaggccctggatcagcgtg

SEQ ID NO: 2793685 - DNA, 22 bp, Homo sapiens
agaggccctggatcagcgtggc

SEQ ID NO: 2793686 - DNA, 23 bp, Homo sapiens
agaggccctggatcagcgtggcc

SEQ ID NO: 2793687 - DNA, 24 bp, Homo sapiens
agaggccctggatcagcgtggcct

SEQ ID NO: 2793688 - DNA, 12 bp, Homo sapiens
agaggctgcagg

SEQ ID NO: 2793689 - DNA, 16 bp, Homo sapiens
agaggctggaggcagg

SEQ ID NO: 2793690 - DNA, 17 bp, Homo sapiens
agaggctggaggcaggg

SEQ ID NO: 2793691 - DNA, 22 bp, Homo sapiens
agaggctggaggcagggccttg

SEQ ID NO: 2793692 - DNA, 21 bp, Homo sapiens
agagggcaaacccaaaacctc

SEQ ID NO: 2793693 - DNA, 17 bp, Homo sapiens
agagggcccaggcaggc

SEQ ID NO: 2793694 - DNA, 21 bp, Homo sapiens
agagggcccaggcaggccacc

SEQ ID NO: 2793695 - DNA, 20 bp, Homo sapiens
agagggctgcgagcatttcc

SEQ ID NO: 2793696 - DNA, 16 bp, Homo sapiens
agaggggcagaacagc

SEQ ID NO: 2793697 - DNA, 20 bp, Homo sapiens
agagggtctgaggaatccag

SEQ ID NO: 2793698 - DNA, 19 bp, Homo sapiens
agagggtggtgacctctgc

SEQ ID NO: 2793699 - DNA, 20 bp, Homo sapiens
agagggtggtgacctctgcc

SEQ ID NO: 2793700 - DNA, 18 bp, Homo sapiens
agaggtaaaagtgtgagc

SEQ ID NO: 2793701 - DNA, 16 bp, Homo sapiens
agaggtgagaaattta

SEQ ID NO: 2793702 - DNA, 13 bp, Homo sapiens
agaggtgagcaga

SEQ ID NO: 2793703 - DNA, 21 bp, Homo sapiens
agaggttcctggggtggattc

SEQ ID NO: 2793704 - DNA, 15 bp, Homo sapiens
agagtaaaaactgaa

SEQ ID NO: 2793705 - DNA, 13 bp, Homo sapiens
agagtagccgaga

SEQ ID NO: 2793706 - DNA, 19 bp, Homo sapiens
agagtagccgagagcctgc

SEQ ID NO: 2793707 - DNA, 23 bp, Homo sapiens
agagtagccgagagcctgctccc

SEQ ID NO: 2793708 - DNA, 15 bp, Homo sapiens
agagtatatatgtac

SEQ ID NO: 2793709 - DNA, 16 bp, Homo sapiens
agagtatatatgtaca

SEQ ID NO: 2793710 - DNA, 20 bp, Homo sapiens
agagtatatatgtacagtta

SEQ ID NO: 2793711 - DNA, 18 bp, Homo sapiens
agagtatgcaagaagaat

SEQ ID NO: 2793712 - DNA, 20 bp, Homo sapiens
agagtatgcaagaagaatat

SEQ ID NO: 2793713 - DNA, 21 bp, Homo sapiens
agagtcactgaccctggagcg

SEQ ID NO: 2793714 - DNA, 15 bp, Homo sapiens
agagtcattgttaca

SEQ ID NO: 2793715 - DNA, 22 bp, Homo sapiens
agagtctcactgttgcccaggc

SEQ ID NO: 2793716 - DNA, 22 bp, Homo sapiens
agagtgaaataattaaaaacca

SEQ ID NO: 2793717 - DNA, 20 bp, Homo sapiens
agagtgagaataattgtgta

SEQ ID NO: 2793718 - DNA, 13 bp, Homo sapiens
agagtgagagaca

SEQ ID NO: 2793719 - DNA, 22 bp, Homo sapiens
agagtgagagacattaactcat

SEQ ID NO: 2793720 - DNA, 21 bp, Homo sapiens
agagtgagagggcatgcgcac

SEQ ID NO: 2793721 - DNA, 21 bp, Homo sapiens
agagtgcccttaaaataatga

SEQ ID NO: 2793722 - DNA, 22 bp, Homo sapiens
agagtgctgagaaggacacctc

SEQ ID NO: 2793723 - DNA, 19 bp, Homo sapiens
agagtgtgaaatagacatt

SEQ ID NO: 2793724 - DNA, 21 bp, Homo sapiens
agagtgtgaccaaaagttaca

SEQ ID NO: 2793725 - DNA, 19 bp, Homo sapiens
agagtgtgggaagggagag

SEQ ID NO: 2793726 - DNA, 20 bp, Homo sapiens
agagtgtgggaagggagagc

SEQ ID NO: 2793727 - DNA, 21 bp, Homo sapiens
agagttcaagaaataagtttt

SEQ ID NO: 2793728 - DNA, 13 bp, Homo sapiens
agaccacctccct

SEQ ID NO: 2793729 - DNA, 21 bp, Homo sapiens
agaccacctccctgccctgtc

SEQ ID NO: 2793730 - DNA, 22 bp, Homo sapiens
agaccacctccctgccctgtcc

SEQ ID NO: 2793731 - DNA, 16 bp, Homo sapiens
agaccacctgcttctg

SEQ ID NO: 2793732 - DNA, 14 bp, Homo sapiens
agaccagactgtgg

SEQ ID NO: 2793733 - DNA, 17 bp, Homo sapiens
agaccagactgtggaga

SEQ ID NO: 2793734 - DNA, 11 bp, Homo sapiens
agaccagctca

SEQ ID NO: 2793735 - DNA, 14 bp, Homo sapiens
agaccagctcagag

SEQ ID NO: 2793736 - DNA, 22 bp, Homo sapiens
agaccagttgggagcactggag

SEQ ID NO: 2793737 - DNA, 23 bp, Homo sapiens
agaccagttgggagcactggagt

SEQ ID NO: 2793738 - DNA, 16 bp, Homo sapiens
agacccaaggaggaaa

SEQ ID NO: 2793739 - DNA, 13 bp, Homo sapiens
agacccagcagga

SEQ ID NO: 2793740 - DNA, 22 bp, Homo sapiens
agacccagtgtaaagaataaat

SEQ ID NO: 2793741 - DNA, 23 bp, Homo sapiens
agacccagtgtaaagaataaatg

SEQ ID NO: 2793742 - DNA, 16 bp, Homo sapiens
tggccgtggtccagct

SEQ ID NO: 2793743 - DNA, 16 bp, Homo sapiens
tggcctaaaaatgcaa

SEQ ID NO: 2793744 - DNA, 14 bp, Homo sapiens
tggcctatgcacat

SEQ ID NO: 2793745 - DNA, 17 bp, Homo sapiens
tggcctatgcacatatg

SEQ ID NO: 2793746 - DNA, 20 bp, Homo sapiens
tggcctatgcacatatggac

SEQ ID NO: 2793747 - DNA, 15 bp, Homo sapiens
tggcctcaaagcaag

SEQ ID NO: 2793748 - DNA, 13 bp, Homo sapiens
tgcctcagcctcc

SEQ ID NO: 2793749 - DNA, 22 bp, Homo sapiens
tgcctcagctgctcgcacagat

SEQ ID NO: 2793750 - DNA, 20 bp, Homo sapiens
tgcctcatctataacatgca

SEQ ID NO: 2793751 - DNA, 13 bp, Homo sapiens
tgcctccaccgct

SEQ ID NO: 2793752 - DNA, 17 bp, Homo sapiens
tgcctccaccgctgcct

SEQ ID NO: 2793753 - DNA, 24 bp, Homo sapiens
tgcctcctcacccccagctttgct

SEQ ID NO: 2793754 - DNA, 14 bp, Homo sapiens
tgcctcctcttcaa

SEQ ID NO: 2793755 - DNA, 12 bp, Homo sapiens
tgcctcctgtct

SEQ ID NO: 2793756 - DNA, 17 bp, Homo sapiens
tgcctcctgtcttatgg

SEQ ID NO: 2793757 - DNA, 19 bp, Homo sapiens
tgcctcgaactggctgcaa

SEQ ID NO: 2793758 - DNA, 19 bp, Homo sapiens
tgcctctactgggaaggct

SEQ ID NO: 2793759 - DNA, 23 bp, Homo sapiens
tgcctctactgggaaggctactt

SEQ ID NO: 2793760 - DNA, 14 bp, Homo sapiens
tgcctctgacacac

SEQ ID NO: 2793761 - DNA, 16 bp, Homo sapiens
tgcctctgacacacag

SEQ ID NO: 2793762 - DNA, 12 bp, Homo sapiens
tgcctctgcctc

SEQ ID NO: 2793763 - DNA, 13 bp, Homo sapiens
tgcctcttcctcc

SEQ ID NO: 2793764 - DNA, 21 bp, Homo sapiens
tgcctgaatccatcaggactt

SEQ ID NO: 2793765 - DNA, 20 bp, Homo sapiens
tgcctgcaaccttgcatcca

SEQ ID NO: 2793766 - DNA, 11 bp, Homo sapiens
tgcctgcagcc

SEQ ID NO: 2793767 - DNA, 17 bp, Homo sapiens
tgcctgcccaggcccct

SEQ ID NO: 2793768 - DNA, 19 bp, Homo sapiens
tgcctgcccaggcccctgc

SEQ ID NO: 2793769 - DNA, 23 bp, Homo sapiens
tgcctgctgaatgatttccaaag

SEQ ID NO: 2793770 - DNA, 22 bp, Homo sapiens
tgcctgcttggggggtgatgag

SEQ ID NO: 2793771 - DNA, 16 bp, Homo sapiens
tgcctggaggacctga

SEQ ID NO: 2793772 - DNA, 21 bp, Homo sapiens
tgcctggaggacctgagcctg

SEQ ID NO: 2793773 - DNA, 22 bp, Homo sapiens
tgcctggaggacctgagcctgc

SEQ ID NO: 2793774 - DNA, 16 bp, Homo sapiens
tgcctggcccccctcc

SEQ ID NO: 2793775 - DNA, 16 bp, Homo sapiens
tgcctggcctggcaca

SEQ ID NO: 2793776 - DNA, 20 bp, Homo sapiens
tgcctggcctggcacacatc

SEQ ID NO: 2793777 - DNA, 16 bp, Homo sapiens
tgcctgggcttatgcc

SEQ ID NO: 2793778 - DNA, 16 bp, Homo sapiens
tgcctggtggcagctg

SEQ ID NO: 2793779 - DNA, 20 bp, Homo sapiens
tgcctgtagccccagtgaca

SEQ ID NO: 2793780 - DNA, 18 bp, Homo sapiens
tgcctgtagttaggaaat

SEQ ID NO: 2793781 - DNA, 20 bp, Homo sapiens
tgcctgtagttaggaaataa

SEQ ID NO: 2793782 - DNA, 20 bp, Homo sapiens
tgcctgtgcacggccagctg

SEQ ID NO: 2793783 - DNA, 21 bp, Homo sapiens
tgcctgtgcacggccagctgc

SEQ ID NO: 2793784 - DNA, 13 bp, Homo sapiens
tgcctgtgtgagc

SEQ ID NO: 2793785 - DNA, 17 bp, Homo sapiens
tgcctgttcagctccag

SEQ ID NO: 2793786 - DNA, 18 bp, Homo sapiens
tgcctgttcagctccagc

SEQ ID NO: 2793787 - DNA, 19 bp, Homo sapiens
tgccttacctcctgcccag

SEQ ID NO: 2793788 - DNA, 21 bp, Homo sapiens
tgccttacctcctgcccagga

SEQ ID NO: 2793789 - DNA, 12 bp, Homo sapiens
tgccttcatttg

SEQ ID NO: 2793790 - DNA, 16 bp, Homo sapiens
tgccttctacttttaa

SEQ ID NO: 2793791 - DNA, 21 bp, Homo sapiens
tgccttcttattctcactcca

SEQ ID NO: 2793792 - DNA, 13 bp, Homo sapiens
tgccttcttcacc

SEQ ID NO: 2793793 - DNA, 17 bp, Homo sapiens
tgccttcttcacccagc

SEQ ID NO: 2793794 - DNA, 22 bp, Homo sapiens
tgccttcttcggggaactcctg

SEQ ID NO: 2793795 - DNA, 23 bp, Homo sapiens
tgccttcttcggggaactcctgg

SEQ ID NO: 2793796 - DNA, 19 bp, Homo sapiens
tgccttgtgtacagttatt

SEQ ID NO: 2793797 - DNA, 13 bp, Homo sapiens
tgcctttctagtc

SEQ ID NO: 2793798 - DNA, 19 bp, Homo sapiens
tgcctttcttatttgcaat

SEQ ID NO: 2793799 - DNA, 21 bp, Homo sapiens
tgcctttttgtttttgtaaaa

SEQ ID NO: 2793800 - DNA, 22 bp, Homo sapiens
tgcgagatcgctggcagagaag

SEQ ID NO: 2793801 - DNA, 19 bp, Homo sapiens
tgcgatctgggttcactgc

SEQ ID NO: 2793802 - DNA, 22 bp, Homo sapiens
tgcgcacaaggctgaccaagag

SEQ ID NO: 2793803 - DNA, 13 bp, Homo sapiens
tgcgcctacagga

SEQ ID NO: 2793804 - DNA, 14 bp, Homo sapiens
tgcgcctacaggag

SEQ ID NO: 2793805 - DNA, 20 bp, Homo sapiens
tgcgcgcatgtaatcccagc

SEQ ID NO: 2793806 - DNA, 15 bp, Homo sapiens
tgcgctgctcaacct

SEQ ID NO: 2793807 - DNA, 15 bp, Homo sapiens
tgcggacaagtttta

SEQ ID NO: 2793808 - DNA, 19 bp, Homo sapiens
tgcggccgcattccctgag

SEQ ID NO: 2793809 - DNA, 17 bp, Homo sapiens
tgcgggatggtcctggg

SEQ ID NO: 2793810 - DNA, 18 bp, Homo sapiens
tgcgggatggtcctgggg

SEQ ID NO: 2793811 - DNA, 23 bp, Homo sapiens
tgcggttcaggaaaattgaatgc

SEQ ID NO: 2793812 - DNA, 20 bp, Homo sapiens
tgcgtacgtttcctgagaag

SEQ ID NO: 2793813 - DNA, 23 bp, Homo sapiens
tgcgtccccccccaacctttccc

SEQ ID NO: 2793814 - DNA, 13 bp, Homo sapiens
tgcgtggaccccg

SEQ ID NO: 2793815 - DNA, 13 bp, Homo sapiens
tgcgttttagagt

SEQ ID NO: 2793816 - DNA, 20 bp, Homo sapiens
tgcgttttagagtatgcaag

SEQ ID NO: 2793817 - DNA, 22 bp, Homo sapiens
tgctaaatggtcgcccaggaga

SEQ ID NO: 2793818 - DNA, 21 bp, Homo sapiens
tgctaaattttcagtagggct

SEQ ID NO: 2793819 - DNA, 16 bp, Homo sapiens
tgctaactgtatgtgt

SEQ ID NO: 2793820 - DNA, 12 bp, Homo sapiens
tgctaataaaac

SEQ ID NO: 2793821 - DNA, 13 bp, Homo sapiens
tgctaatcttctt

SEQ ID NO: 2793822 - DNA, 14 bp, Homo sapiens
tgctacctcactgg

SEQ ID NO: 2793823 - DNA, 22 bp, Homo sapiens
tgctacctcactggggtcctgg

SEQ ID NO: 2793824 - DNA, 14 bp, Homo sapiens
tgctactacaaaaa

SEQ ID NO: 2793825 - DNA, 15 bp, Homo sapiens
tgctagctgtagaaa

SEQ ID NO: 2793826 - DNA, 19 bp, Homo sapiens
tgctaggcgagtgccagga

SEQ ID NO: 2793827 - DNA, 17 bp, Homo sapiens
tgctatggttttctcca

SEQ ID NO: 2793828 - DNA, 15 bp, Homo sapiens
tgctatgttagaagt

SEQ ID NO: 2793829 - DNA, 13 bp, Homo sapiens
tgctatttgaagt

SEQ ID NO: 2793830 - DNA, 22 bp, Homo sapiens
tgctatttgttgtttttaacaa

SEQ ID NO: 2793831 - DNA, 19 bp, Homo sapiens
tgctcaaatctattcagac

SEQ ID NO: 2793832 - DNA, 16 bp, Homo sapiens
tgctcaacctctctcc

SEQ ID NO: 2793833 - DNA, 14 bp, Homo sapiens
tgctcaagaagaca

SEQ ID NO: 2793834 - DNA, 16 bp, Homo sapiens
tgctcacatatctgtc

SEQ ID NO: 2793835 - DNA, 17 bp, Homo sapiens
tgctcacatatctgtca

SEQ ID NO: 2793836 - DNA, 22 bp, Homo sapiens
tgctcagccctgactggtgcta

SEQ ID NO: 2793837 - DNA, 17 bp, Homo sapiens
tgctcaggaattgaaga

SEQ ID NO: 2793838 - DNA, 22 bp, Homo sapiens
tgcttgaaggaacagtgctgtt

SEQ ID NO: 2793839 - DNA, 15 bp, Homo sapiens
tgcttgactatcaca

SEQ ID NO: 2793840 - DNA, 16 bp, Homo sapiens
tgcttgactatcacat

SEQ ID NO: 2793841 - DNA, 20 bp, Homo sapiens
tgcttgactatcacatacaa

SEQ ID NO: 2793842 - DNA, 21 bp, Homo sapiens
tgcttgactatcacatacaat

SEQ ID NO: 2793843 - DNA, 22 bp, Homo sapiens
tgcttgcactttgtaacatgtt

SEQ ID NO: 2793844 - DNA, 19 bp, Homo sapiens
tgcttgcctgcgttttgga

SEQ ID NO: 2793845 - DNA, 17 bp, Homo sapiens
tgcttgttgtcaagtat

SEQ ID NO: 2793846 - DNA, 20 bp, Homo sapiens
tgcttgttgtcaagtataaa

SEQ ID NO: 2793847 - DNA, 21 bp, Homo sapiens
tgctttaaagtacctgtagtg

SEQ ID NO: 2793848 - DNA, 22 bp, Homo sapiens
tgctttcaacttaaatcactga

SEQ ID NO: 2793849 - DNA, 17 bp, Homo sapiens
tgctttgatatttcaat

SEQ ID NO: 2793850 - DNA, 17 bp, Homo sapiens
tgcttttggtctgtgtg

SEQ ID NO: 2793851 - DNA, 17 bp, Homo sapiens
tgctttttaagtgttaa

SEQ ID NO: 2793852 - DNA, 15 bp, Homo sapiens
tggaaaaaagagaaa

SEQ ID NO: 2793853 - DNA, 12 bp, Homo sapiens
tggaaaaatatt

SEQ ID NO: 2793854 - DNA, 19 bp, Homo sapiens
tggaaaagaatacagaaag

SEQ ID NO: 2793855 - DNA, 17 bp, Homo sapiens
tggaaaagtcacacaga

SEQ ID NO: 2793856 - DNA, 18 bp, Homo sapiens
tggaaaagtcacacagac

SEQ ID NO: 2793857 - DNA, 14 bp, Homo sapiens
tggaaacaggacca

SEQ ID NO: 2793858 - DNA, 10 bp, Homo sapiens
tggaaagaga

SEQ ID NO: 2793859 - DNA, 15 bp, Homo sapiens
tggaaagcctctgct

SEQ ID NO: 2793860 - DNA, 17 bp, Homo sapiens
tggaaaggctcagtctc

SEQ ID NO: 2793861 - DNA, 20 bp, Homo sapiens
tggaaaggctcagtctcagg

SEQ ID NO: 2793862 - DNA, 21 bp, Homo sapiens
tggaaaggctcagtctcagga

SEQ ID NO: 2793863 - DNA, 23 bp, Homo sapiens
tggaaataaatgtatcatagaaa

SEQ ID NO: 2793864 - DNA, 22 bp, Homo sapiens
tggaaatatcagttactcagcc

SEQ ID NO: 2793865 - DNA, 20 bp, Homo sapiens
tggaaatctggattttcagc

SEQ ID NO: 2793866 - DNA, 20 bp, Homo sapiens
tggaaatgtcctccaacaat

SEQ ID NO: 2793867 - DNA, 11 bp, Homo sapiens
tggaaccaatc

SEQ ID NO: 2793868 - DNA, 16 bp, Homo sapiens
tggaactctaccctgg

SEQ ID NO: 2793869 - DNA, 20 bp, Homo sapiens
tggaagaaattcctgtagca

SEQ ID NO: 2793870 - DNA, 16 bp, Homo sapiens
tggaagcactgctgtg

SEQ ID NO: 2793871 - DNA, 22 bp, Homo sapiens
tggaagcatgtaggagaatcca

SEQ ID NO: 2793872 - DNA, 12 bp, Homo sapiens
tggaagccctcc

SEQ ID NO: 2793873 - DNA, 15 bp, Homo sapiens
tggaagccctccttc

SEQ ID NO: 2793874 - DNA, 16 bp, Homo sapiens
tggaagccctccttcc

SEQ ID NO: 2793875 - DNA, 22 bp, Homo sapiens
tggaagccggccggctgggatc

SEQ ID NO: 2793876 - DNA, 14 bp, Homo sapiens
tggaaggcatggcg

SEQ ID NO: 2793877 - DNA, 20 bp, Homo sapiens
tggaaggtttggtgtgtgga

SEQ ID NO: 2793878 - DNA, 15 bp, Homo sapiens
tggaagttttcagga

SEQ ID NO: 2793879 - DNA, 14 bp, Homo sapiens
tggaagttttgcat

SEQ ID NO: 2793880 - DNA, 23 bp, Homo sapiens
tggaataataattttcctcctaa

SEQ ID NO: 2793881 - DNA, 15 bp, Homo sapiens
tggaatacagtgtta

SEQ ID NO: 2793882 - DNA, 13 bp, Homo sapiens
tggaatataaaga

SEQ ID NO: 2793883 - DNA, 14 bp, Homo sapiens
tggaatataattgt

SEQ ID NO: 2793884 - DNA, 13 bp, Homo sapiens
tggaatcctttca

SEQ ID NO: 2793885 - DNA, 18 bp, Homo sapiens
tggaatcgatctgtactg

SEQ ID NO: 2793886 - DNA, 19 bp, Homo sapiens
tggaatcgatctgtactgt

SEQ ID NO: 2793887 - DNA, 15 bp, Homo sapiens
tggaatgaagcatgt

SEQ ID NO: 2793888 - DNA, 17 bp, Homo sapiens
tggaatgaattaaataa

SEQ ID NO: 2793889 - DNA, 18 bp, Homo sapiens
tggaattgctgctctctg

SEQ ID NO: 2793890 - DNA, 19 bp, Homo sapiens
tggaattgctgctctctga

SEQ ID NO: 2793891 - DNA, 14 bp, Homo sapiens
tggacaacccagaa

SEQ ID NO: 2793892 - DNA, 20 bp, Homo sapiens
tggacaccaggagtccctgg

SEQ ID NO: 2793893 - DNA, 22 bp, Homo sapiens
tggacaccccttatccaggact

SEQ ID NO: 2793894 - DNA, 14 bp, Homo sapiens
tggacacctgccct

SEQ ID NO: 2793895 - DNA, 16 bp, Homo sapiens
tggacacctgccctgc

SEQ ID NO: 2793896 - DNA, 23 bp, Homo sapiens
tggacacctgccctgccctgcca

SEQ ID NO: 2793897 - DNA, 12 bp, Homo sapiens
tggacagaagat

SEQ ID NO: 2793898 - DNA, 13 bp, Homo sapiens
tggacagctgtgc

SEQ ID NO: 2793899 - DNA, 15 bp, Homo sapiens
tggacagctgtgcct

SEQ ID NO: 2793900 - DNA, 19 bp, Homo sapiens
tggacagctgtgcctcgct

SEQ ID NO: 2793901 - DNA, 12 bp, Homo sapiens
tggacagcttgt

SEQ ID NO: 2793902 - DNA, 23 bp, Homo sapiens
tggacaggcatgttctctgagga

SEQ ID NO: 2793903 - DNA, 17 bp, Homo sapiens
tggacagtcctgggaga

SEQ ID NO: 2793904 - DNA, 15 bp, Homo sapiens
tggaccacaggcatc

SEQ ID NO: 2793905 - DNA, 14 bp, Homo sapiens
tggacccgctctgg

SEQ ID NO: 2793906 - DNA, 19 bp, Homo sapiens
tggacccgctctggaccaa

SEQ ID NO: 2793907 - DNA, 19 bp, Homo sapiens
tggacctatgtcctaagga

SEQ ID NO: 2793908 - DNA, 12 bp, Homo sapiens
tggaccttcctg

SEQ ID NO: 2793909 - DNA, 18 bp, Homo sapiens
tggactattataatttaa

SEQ ID NO: 2793910 - DNA, 16 bp, Homo sapiens
tggactcctcccacaa

SEQ ID NO: 2793911 - DNA, 17 bp, Homo sapiens
tggactctgcacatgtc

SEQ ID NO: 2793912 - DNA, 22 bp, Homo sapiens
tggactctgcacatgtcttgta

SEQ ID NO: 2793913 - DNA, 21 bp, Homo sapiens
tggactgtcatagaaattaca

SEQ ID NO: 2793914 - DNA, 23 bp, Homo sapiens
tggagaaataaaaatacctcttt

SEQ ID NO: 2793915 - DNA, 17 bp, Homo sapiens
tggagaactttccatct

SEQ ID NO: 2793916 - DNA, 19 bp, Homo sapiens
tggagaactttccatctgc

SEQ ID NO: 2793917 - DNA, 19 bp, Homo sapiens
tggagactctgtggggcct

SEQ ID NO: 2793918 - DNA, 13 bp, Homo sapiens
tggagagagggga

SEQ ID NO: 2793919 - DNA, 13 bp, Homo sapiens
tggagagccctgg

SEQ ID NO: 2793920 - DNA, 14 bp, Homo sapiens
tggagagccctggg

SEQ ID NO: 2793921 - DNA, 18 bp, Homo sapiens
tggagagccctgggaccg

SEQ ID NO: 2793922 - DNA, 21 bp, Homo sapiens
tggagaggagggatgctgcct

SEQ ID NO: 2793923 - DNA, 17 bp, Homo sapiens
tggagagggacgaagaa

SEQ ID NO: 2793924 - DNA, 11 bp, Homo sapiens
tggagcatctg

SEQ ID NO: 2793925 - DNA, 19 bp, Homo sapiens
tggagcctcggtggccatg

SEQ ID NO: 2793926 - DNA, 14 bp, Homo sapiens
tggagcgcacctgc

SEQ ID NO: 2793927 - DNA, 13 bp, Homo sapiens
tgaggtcacctgg

SEQ ID NO: 2793928 - DNA, 16 bp, Homo sapiens
tgaggtcagagcctgc

SEQ ID NO: 2793929 - DNA, 18 bp, Homo sapiens
tgaggtcatagcagtgct

SEQ ID NO: 2793930 - DNA, 16 bp, Homo sapiens
tgaggtcctgagcact

SEQ ID NO: 2793931 - DNA, 19 bp, Homo sapiens
tgaggtcctgagcactgcc

SEQ ID NO: 2793932 - DNA, 20 bp, Homo sapiens
tgaggtcctgagcactgcca

SEQ ID NO: 2793933 - DNA, 22 bp, Homo sapiens
tgaggtcctgcatttctcagtc

SEQ ID NO: 2793934 - DNA, 16 bp, Homo sapiens
tgaggtgcccaggaga

SEQ ID NO: 2793935 - DNA, 21 bp, Homo sapiens
tgaggtgggttttcttcccat

SEQ ID NO: 2793936 - DNA, 19 bp, Homo sapiens
tgagtactagaatttgtat

SEQ ID NO: 2793937 - DNA, 16 bp, Homo sapiens
tgagtcaccaagccca

SEQ ID NO: 2793938 - DNA, 21 bp, Homo sapiens
tgagtcatgatctccctgccg

SEQ ID NO: 2793939 - DNA, 15 bp, Homo sapiens
tgagtcgaggacagg

SEQ ID NO: 2793940 - DNA, 16 bp, Homo sapiens
tgagtcgaggacaggg

SEQ ID NO: 2793941 - DNA, 15 bp, Homo sapiens
tgccatgaggccttt

SEQ ID NO: 2793942 - DNA, 22 bp, Homo sapiens
tgccatgaggcctttccccagt

SEQ ID NO: 2793943 - DNA, 16 bp, Homo sapiens
tgccatgtagacccct

SEQ ID NO: 2793944 - DNA, 14 bp, Homo sapiens
tgccatgtgccagg

SEQ ID NO: 2793945 - DNA, 17 bp, Homo sapiens
tgccatgttggccaggc

SEQ ID NO: 2793946 - DNA, 18 bp, Homo sapiens
tgcccaacctgctctcct

SEQ ID NO: 2793947 - DNA, 22 bp, Homo sapiens
tgcccaacctgctctcctcttg

SEQ ID NO: 2793948 - DNA, 14 bp, Homo sapiens
tgcccacagggacc

SEQ ID NO: 2793949 - DNA, 23 bp, Homo sapiens
tgcccaccaacatcccattgccc

SEQ ID NO: 2793950 - DNA, 12 bp, Homo sapiens
tgcccagagatg

SEQ ID NO: 2793951 - DNA, 21 bp, Homo sapiens
tgcccagagatgcctccaccg

SEQ ID NO: 2793952 - DNA, 19 bp, Homo sapiens
tgcccagagggcccaggca

SEQ ID NO: 2793953 - DNA, 22 bp, Homo sapiens
tgcccaggagagccagccctcc

SEQ ID NO: 2793954 - DNA, 13 bp, Homo sapiens
tgcccaggcaggt

SEQ ID NO: 2793955 - DNA, 17 bp, Homo sapiens
tgcccaggcaggtcttg

SEQ ID NO: 2793956 - DNA, 14 bp, Homo sapiens
tgcccaggcccctg

SEQ ID NO: 2793957 - DNA, 18 bp, Homo sapiens
tgcccaggcccctgccac

SEQ ID NO: 2793958 - DNA, 20 bp, Homo sapiens
tgcccaggctggcgtgcagt

SEQ ID NO: 2793959 - DNA, 11 bp, Homo sapiens
tgcccagggct

SEQ ID NO: 2793960 - DNA, 14 bp, Homo sapiens
tgcccagggctcag

SEQ ID NO: 2793961 - DNA, 17 bp, Homo sapiens
tgcccagggctcagcct

SEQ ID NO: 2793962 - DNA, 20 bp, Homo sapiens
tgcccagggctcagcctggt

SEQ ID NO: 2793963 - DNA, 21 bp, Homo sapiens
tgcccagggctcagcctggtg

SEQ ID NO: 2793964 - DNA, 19 bp, Homo sapiens
tgccccaactccttccagc

SEQ ID NO: 2793965 - DNA, 12 bp, Homo sapiens
tgccccaccagc

SEQ ID NO: 2793966 - DNA, 16 bp, Homo sapiens
tgccccagctctggct

SEQ ID NO: 2793967 - DNA, 18 bp, Homo sapiens
tgccccagctctggcttc

SEQ ID NO: 2793968 - DNA, 19 bp, Homo sapiens
tgccccagctctggcttcc

SEQ ID NO: 2793969 - DNA, 23 bp, Homo sapiens
tgcccccagcactcctctgtctc

SEQ ID NO: 2793970 - DNA, 16 bp, Homo sapiens
tgcccccagcctctgt

SEQ ID NO: 2793971 - DNA, 21 bp, Homo sapiens
tgccccctggtggacagtcct

SEQ ID NO: 2793972 - DNA, 13 bp, Homo sapiens
tgccccgcccagc

SEQ ID NO: 2793973 - DNA, 23 bp, Homo sapiens
tgccccgcttccccacagaactg

SEQ ID NO: 2793974 - DNA, 20 bp, Homo sapiens
tgccccgggtccccagctcc

SEQ ID NO: 2793975 - DNA, 21 bp, Homo sapiens
tgccccgggtccccagctccc

SEQ ID NO: 2793976 - DNA, 22 bp, Homo sapiens
tgccccgggtccccagctcccc

SEQ ID NO: 2793977 - DNA, 23 bp, Homo sapiens
tgccccgggtccccagctcccca

SEQ ID NO: 2793978 - DNA, 22 bp, Homo sapiens
tgcccctcacctgcctgccctc

SEQ ID NO: 2793979 - DNA, 13 bp, Homo sapiens
tgcccctgcagtt

SEQ ID NO: 2793980 - DNA, 12 bp, Homo sapiens
tgcccctgtaaa

SEQ ID NO: 2793981 - DNA, 13 bp, Homo sapiens
tgcccctgtaaat

SEQ ID NO: 2793982 - DNA, 21 bp, Homo sapiens
tgccccttcccatctcttcct

SEQ ID NO: 2793983 - DNA, 15 bp, Homo sapiens
tgccccttgggcctc

SEQ ID NO: 2793984 - DNA, 17 bp, Homo sapiens
tgccccttgggcctccc

SEQ ID NO: 2793985 - DNA, 12 bp, Homo sapiens
tgcccggctgcg

SEQ ID NO: 2793986 - DNA, 16 bp, Homo sapiens
tgcccgtcttcagcct

SEQ ID NO: 2793987 - DNA, 17 bp, Homo sapiens
tgcccgtcttcagccta

SEQ ID NO: 2793988 - DNA, 18 bp, Homo sapiens
tgcccgtcttcagcctag

SEQ ID NO: 2793989 - DNA, 18 bp, Homo sapiens
tgccctcagatggagaca

SEQ ID NO: 2793990 - DNA, 18 bp, Homo sapiens
tgccctccacagccgcag

SEQ ID NO: 2793991 - DNA, 21 bp, Homo sapiens
tgccctccacagccgcagcct

SEQ ID NO: 2793992 - DNA, 19 bp, Homo sapiens
tgccctcccacctccgctg

SEQ ID NO: 2793993 - DNA, 23 bp, Homo sapiens
tgccctccctggcctcacgccca

SEQ ID NO: 2793994 - DNA, 17 bp, Homo sapiens
tgccctctggattctct

SEQ ID NO: 2793995 - DNA, 16 bp, Homo sapiens
tgccctgacccctgca

SEQ ID NO: 2793996 - DNA, 12 bp, Homo sapiens
tgccctgacctc

SEQ ID NO: 2793997 - DNA, 15 bp, Homo sapiens
tgccctgacctccca

SEQ ID NO: 2793998 - DNA, 18 bp, Homo sapiens
tgccctgacctcccagcc

SEQ ID NO: 2793999 - DNA, 22 bp, Homo sapiens
tgccctgacctcccagccctat

SEQ ID NO: 2794000 - DNA, 23 bp, Homo sapiens
tgccctgagtggatctccaagga

SEQ ID NO: 2794001 - DNA, 17 bp, Homo sapiens
tgccctgccacctgtct

SEQ ID NO: 2794002 - DNA, 20 bp, Homo sapiens
tgccctgccacctgtctgtc

SEQ ID NO: 2794003 - DNA, 21 bp, Homo sapiens
tgccctgccacctgtctgtct

SEQ ID NO: 2794004 - DNA, 15 bp, Homo sapiens
tgccctgccctgcca

SEQ ID NO: 2794005 - DNA, 18 bp, Homo sapiens
tgccctgccctgccacct

SEQ ID NO: 2794006 - DNA, 18 bp, Homo sapiens
tgccctggatccatcagg

SEQ ID NO: 2794007 - DNA, 15 bp, Homo sapiens
tgccctgtcctccag

SEQ ID NO: 2794008 - DNA, 21 bp, Homo sapiens
tgccctgtcctccagcttccc

SEQ ID NO: 2794009 - DNA, 21 bp, Homo sapiens
tgcccttaaaataatgattta

SEQ ID NO: 2794010 - DNA, 15 bp, Homo sapiens
tgcccttgccctgac

SEQ ID NO: 2794011 - DNA, 20 bp, Homo sapiens
tgcccttgtttggggcagga

SEQ ID NO: 2794012 - DNA, 15 bp, Homo sapiens
tgccgaccagagccc

SEQ ID NO: 2794013 - DNA, 17 bp, Homo sapiens
tgccgacctcgtcctcc

SEQ ID NO: 2794014 - DNA, 15 bp, Homo sapiens
tgccgagcaaccgtg

SEQ ID NO: 2794015 - DNA, 15 bp, Homo sapiens
tgccgcaccccagag

SEQ ID NO: 2794016 - DNA, 18 bp, Homo sapiens
tgccgcaccccagagtgt

SEQ ID NO: 2794017 - DNA, 14 bp, Homo sapiens
tgccgctcttctgt

SEQ ID NO: 2794018 - DNA, 17 bp, Homo sapiens
tgccgctcttctgtcat

SEQ ID NO: 2794019 - DNA, 20 bp, Homo sapiens
tgccgctcttctgtcatccc

SEQ ID NO: 2794020 - DNA, 19 bp, Homo sapiens
tgccgggttctagtctcct

SEQ ID NO: 2794021 - DNA, 19 bp, Homo sapiens
tgccgttactctccaacct

SEQ ID NO: 2794022 - DNA, 22 bp, Homo sapiens
tgccgttactctccaacctgga

SEQ ID NO: 2794023 - DNA, 15 bp, Homo sapiens
tgcctaagtggctgc

SEQ ID NO: 2794024 - DNA, 23 bp, Homo sapiens
tgcctacagataatttattttgt

SEQ ID NO: 2794025 - DNA, 17 bp, Homo sapiens
tgcctacattccctggc

SEQ ID NO: 2794026 - DNA, 19 bp, Homo sapiens
tgcctacattccctggcct

SEQ ID NO: 2794027 - DNA, 21 bp, Homo sapiens
tgcctaggaggccttctcgca

SEQ ID NO: 2794028 - DNA, 14 bp, Homo sapiens
tgcctatccatcct

SEQ ID NO: 2794029 - DNA, 17 bp, Homo sapiens
tgcctatccatcctgcg

SEQ ID NO: 2794030 - DNA, 12 bp, Homo sapiens
tgcctcagcctc

SEQ ID NO: 2794031 - DNA, 20 bp, Homo sapiens
tgcagactcagtttgtcaga

SEQ ID NO: 2794032 - DNA, 16 bp, Homo sapiens
tgcagactctacagag

SEQ ID NO: 2794033 - DNA, 13 bp, Homo sapiens
tgcagagaccttg

SEQ ID NO: 2794034 - DNA, 14 bp, Homo sapiens
tgcagagagaagcc

SEQ ID NO: 2794035 - DNA, 21 bp, Homo sapiens
tgcagagcaggaaacatgact

SEQ ID NO: 2794036 - DNA, 19 bp, Homo sapiens
tgcagaggattgaggctta

SEQ ID NO: 2794037 - DNA, 18 bp, Homo sapiens
tgcagaggatttaactgt

SEQ ID NO: 2794038 - DNA, 18 bp, Homo sapiens
tgcagatgagcagtcaca

SEQ ID NO: 2794039 - DNA, 20 bp, Homo sapiens
tgcagatgagcagtcacact

SEQ ID NO: 2794040 - DNA, 23 bp, Homo sapiens
tgcagattattttagtctgtcat

SEQ ID NO: 2794041 - DNA, 13 bp, Homo sapiens
tgcagccaaacag

SEQ ID NO: 2794042 - DNA, 13 bp, Homo sapiens
tgcagccagccca

SEQ ID NO: 2794043 - DNA, 15 bp, Homo sapiens
tgcagccagcccagc

SEQ ID NO: 2794044 - DNA, 23 bp, Homo sapiens
tgcagccaggaggagaggaaagg

SEQ ID NO: 2794045 - DNA, 21 bp, Homo sapiens
tgcagcctcaacctcctgggc

SEQ ID NO: 2794046 - DNA, 17 bp, Homo sapiens
tgcagcctcctcctgac

SEQ ID NO: 2794047 - DNA, 20 bp, Homo sapiens
tgcagcttcatcaattttta

SEQ ID NO: 2794048 - DNA, 11 bp, Homo sapiens
tgcagcttcct

SEQ ID NO: 2794049 - DNA, 18 bp, Homo sapiens
tgcagcttcctgtcaaca

SEQ ID NO: 2794050 - DNA, 14 bp, Homo sapiens
tgcagcttgtagcc

SEQ ID NO: 2794051 - DNA, 21 bp, Homo sapiens
tgcaggaatcaaaaattgaag

SEQ ID NO: 2794052 - DNA, 21 bp, Homo sapiens
tgcaggccaagagcagaggca

SEQ ID NO: 2794053 - DNA, 14 bp, Homo sapiens
tgcagggagccgag

SEQ ID NO: 2794054 - DNA, 22 bp, Homo sapiens
tgcagggggtgtgtctgctcag

SEQ ID NO: 2794055 - DNA, 21 bp, Homo sapiens
tgcagtagtctctgtgctttg

SEQ ID NO: 2794056 - DNA, 20 bp, Homo sapiens
tgcagtccagaataagtgct

SEQ ID NO: 2794057 - DNA, 22 bp, Homo sapiens
tgcagtgacgtgcacctgtact

SEQ ID NO: 2794058 - DNA, 21 bp, Homo sapiens
tgcagtggtgcgatctgggtt

SEQ ID NO: 2794059 - DNA, 23 bp, Homo sapiens
tgcagttaatacttaacattgat

SEQ ID NO: 2794060 - DNA, 16 bp, Homo sapiens
tgcagttgacagcagg

SEQ ID NO: 2794061 - DNA, 17 bp, Homo sapiens
tgcagttgacagcaggt

SEQ ID NO: 2794062 - DNA, 22 bp, Homo sapiens
tgcataagattaaaggaaggaa

SEQ ID NO: 2794063 - DNA, 20 bp, Homo sapiens
tgcatagtaccaatcatttt

SEQ ID NO: 2794064 - DNA, 17 bp, Homo sapiens
tgcatatatacatatat

SEQ ID NO: 2794065 - DNA, 18 bp, Homo sapiens
tgcatgaaggtttctgaa

SEQ ID NO: 2794066 - DNA, 21 bp, Homo sapiens
tgcatgaaggtttctgaaaat

SEQ ID NO: 2794067 - DNA, 14 bp, Homo sapiens
tgcatgatgtattt

SEQ ID NO: 2794068 - DNA, 16 bp, Homo sapiens
tgcatgattttataca

SEQ ID NO: 2794069 - DNA, 18 bp, Homo sapiens
tgcatgattttatacata

SEQ ID NO: 2794070 - DNA, 20 bp, Homo sapiens
tgcatgattttatacatagt

SEQ ID NO: 2794071 - DNA, 22 bp, Homo sapiens
tgcatgccaaattgtagttctt

SEQ ID NO: 2794072 - DNA, 21 bp, Homo sapiens
tgcatgccatctccaccctga

SEQ ID NO: 2794073 - DNA, 17 bp, Homo sapiens
tgcatgctctctgcagc

SEQ ID NO: 2794074 - DNA, 14 bp, Homo sapiens
tgcatgtatgtctt

SEQ ID NO: 2794075 - DNA, 16 bp, Homo sapiens
tgcatgtatgtcttgg

SEQ ID NO: 2794076 - DNA, 14 bp, Homo sapiens
tgcattaacttaaa

SEQ ID NO: 2794077 - DNA, 14 bp, Homo sapiens
tgcattagaaatta

SEQ ID NO: 2794078 - DNA, 23 bp, Homo sapiens
tgcattagaaattagctgtgtga

SEQ ID NO: 2794079 - DNA, 15 bp, Homo sapiens
tgcattccatgattt

SEQ ID NO: 2794080 - DNA, 13 bp, Homo sapiens
tgcattgaatata

SEQ ID NO: 2794081 - DNA, 16 bp, Homo sapiens
tgccaaagcaaaagaa

SEQ ID NO: 2794082 - DNA, 17 bp, Homo sapiens
tgccaaagcaaaagaag

SEQ ID NO: 2794083 - DNA, 23 bp, Homo sapiens
tgccaacatacccttctttaaat

SEQ ID NO: 2794084 - DNA, 16 bp, Homo sapiens
tgccaagctttcttct

SEQ ID NO: 2794085 - DNA, 20 bp, Homo sapiens
tgccaagtccaggtcctggt

SEQ ID NO: 2794086 - DNA, 21 bp, Homo sapiens
tgccaagtccaggtcctggtg

SEQ ID NO: 2794087 - DNA, 20 bp, Homo sapiens
tgccaatgaggtctgaaatg

SEQ ID NO: 2794088 - DNA, 15 bp, Homo sapiens
tgccaattagcaatt

SEQ ID NO: 2794089 - DNA, 14 bp, Homo sapiens
tgccacacactgtt

SEQ ID NO: 2794090 - DNA, 13 bp, Homo sapiens
tgccacaccctcc

SEQ ID NO: 2794091 - DNA, 22 bp, Homo sapiens
tgccacactcagtcccccacca

SEQ ID NO: 2794092 - DNA, 13 bp, Homo sapiens
tgccacagagaag

SEQ ID NO: 2794093 - DNA, 14 bp, Homo sapiens
tgccacagagaaga

SEQ ID NO: 2794094 - DNA, 16 bp, Homo sapiens
tgccaccaccagatga

SEQ ID NO: 2794095 - DNA, 20 bp, Homo sapiens
tgccaccaccagatgagaag

SEQ ID NO: 2794096 - DNA, 16 bp, Homo sapiens
tgccaccagtcactgt

SEQ ID NO: 2794097 - DNA, 13 bp, Homo sapiens
tgccacctcccct

SEQ ID NO: 2794098 - DNA, 10 bp, Homo sapiens
tgccacctgt

SEQ ID NO: 2794099 - DNA, 12 bp, Homo sapiens
tgccacctgtct

SEQ ID NO: 2794100 - DNA, 16 bp, Homo sapiens
tgccacctgtctgtct

SEQ ID NO: 2794101 - DNA, 21 bp, Homo sapiens
tgccacctgttaaaatgtaca

SEQ ID NO: 2794102 - DNA, 17 bp, Homo sapiens
tgccactttcgggaggg

SEQ ID NO: 2794103 - DNA, 16 bp, Homo sapiens
tgccagagcctggggc

SEQ ID NO: 2794104 - DNA, 23 bp, Homo sapiens
tgccagagcctggggcatcccag

SEQ ID NO: 2794105 - DNA, 18 bp, Homo sapiens
tgccagagcctggggctc

SEQ ID NO: 2794106 - DNA, 12 bp, Homo sapiens
tgccagccagaa

SEQ ID NO: 2794107 - DNA, 17 bp, Homo sapiens
tgccagccagcagccag

SEQ ID NO: 2794108 - DNA, 21 bp, Homo sapiens
tgccagccgtgatgctcaggc

SEQ ID NO: 2794109 - DNA, 16 bp, Homo sapiens
tgccagcctggcttct

SEQ ID NO: 2794110 - DNA, 12 bp, Homo sapiens
tgccaggactcc

SEQ ID NO: 2794111 - DNA, 21 bp, Homo sapiens
tgccaggagggacaaaggagc

SEQ ID NO: 2794112 - DNA, 11 bp, Homo sapiens
tgccaggcccg

SEQ ID NO: 2794113 - DNA, 20 bp, Homo sapiens
tgccagtccccctgccccag

SEQ ID NO: 2794114 - DNA, 22 bp, Homo sapiens
tgccagtgccttacctcctgcc

SEQ ID NO: 2794115 - DNA, 23 bp, Homo sapiens
tgccagtgccttacctcctgccc

SEQ ID NO: 2794116 - DNA, 16 bp, Homo sapiens
tgccatagtcacatgg

SEQ ID NO: 2794117 - DNA, 19 bp, Homo sapiens
tgccatagtcacatggcct

SEQ ID NO: 2794118 - DNA, 12 bp, Homo sapiens
tgccatccaggt

SEQ ID NO: 2794119 - DNA, 21 bp, Homo sapiens
tgccatccaggttcagcttgt

SEQ ID NO: 2794120 - DNA, 21 bp, Homo sapiens
tgccatctccaccctgagcct

SEQ ID NO: 2794121 - DNA, 21 bp, Homo sapiens
tgacagggcacaccgggcact

SEQ ID NO: 2794122 - DNA, 22 bp, Homo sapiens
tgacagggcacaccgggcactc

SEQ ID NO: 2794123 - DNA, 20 bp, Homo sapiens
tgacagtagtcccctccgta

SEQ ID NO: 2794124 - DNA, 18 bp, Homo sapiens
tgacagtccgtcaaaaca

SEQ ID NO: 2794125 - DNA, 16 bp, Homo sapiens
tgacagtgctctaggc

SEQ ID NO: 2794126 - DNA, 22 bp, Homo sapiens
tgacagtgctctaggctgcccc

SEQ ID NO: 2794127 - DNA, 17 bp, Homo sapiens
tgacatcacttgtacaa

SEQ ID NO: 2794128 - DNA, 18 bp, Homo sapiens
tgacatcacttgtacaaa

SEQ ID NO: 2794129 - DNA, 22 bp, Homo sapiens
tgacatcacttgtacaaaataa

SEQ ID NO: 2794130 - DNA, 21 bp, Homo sapiens
tgacattgttggccaaagcca

SEQ ID NO: 2794131 - DNA, 23 bp, Homo sapiens
tgaccaaaagttacatgtttgca

SEQ ID NO: 2794132 - DNA, 20 bp, Homo sapiens
tgaccaacatggagaaaccc

SEQ ID NO: 2794133 - DNA, 23 bp, Homo sapiens
tgaccaacatggagaaaccctgt

SEQ ID NO: 2794134 - DNA, 18 bp, Homo sapiens
tgaccaagatgatcacat

SEQ ID NO: 2794135 - DNA, 16 bp, Homo sapiens
tgaccaagttataaat

SEQ ID NO: 2794136 - DNA, 13 bp, Homo sapiens
tgaccaatctctg

SEQ ID NO: 2794137 - DNA, 14 bp, Homo sapiens
tgaccaatctctgt

SEQ ID NO: 2794138 - DNA, 21 bp, Homo sapiens
tgaccacggacgtttccatca

SEQ ID NO: 2794139 - DNA, 21 bp, Homo sapiens
tgaccaggctcacaactgttt

SEQ ID NO: 2794140 - DNA, 16 bp, Homo sapiens
tgaccatcctgtcctt

SEQ ID NO: 2794141 - DNA, 14 bp, Homo sapiens
tgacccacatgcca

SEQ ID NO: 2794142 - DNA, 19 bp, Homo sapiens
tgaccccaaagagcctgga

SEQ ID NO: 2794143 - DNA, 12 bp, Homo sapiens
tgaccccagggc

SEQ ID NO: 2794144 - DNA, 20 bp, Homo sapiens
tgaccccagggcacaggagc

SEQ ID NO: 2794145 - DNA, 21 bp, Homo sapiens
tgacccggcaccccctgcagc

SEQ ID NO: 2794146 - DNA, 22 bp, Homo sapiens
tgacccggcaccccctgcagct

SEQ ID NO: 2794147 - DNA, 16 bp, Homo sapiens
tgaccctcctgtccag

SEQ ID NO: 2794148 - DNA, 23 bp, Homo sapiens
tgaccctgcgaaggggccctggt

SEQ ID NO: 2794149 - DNA, 22 bp, Homo sapiens
tgaccctggagcggctctcctg

SEQ ID NO: 2794150 - DNA, 19 bp, Homo sapiens
tgaataaacttcagcacca

SEQ ID NO: 2794151 - DNA, 12 bp, Homo sapiens
tgaataaagtct

SEQ ID NO: 2794152 - DNA, 13 bp, Homo sapiens
tgaataaagtctg

SEQ ID NO: 2794153 - DNA, 15 bp, Homo sapiens
tgaataaccacttaa

SEQ ID NO: 2794154 - DNA, 14 bp, Homo sapiens
tgaataagtattct

SEQ ID NO: 2794155 - DNA, 16 bp, Homo sapiens
tgaatacccttttctg

SEQ ID NO: 2794156 - DNA, 15 bp, Homo sapiens
tgaatatcattaaat

SEQ ID NO: 2794157 - DNA, 21 bp, Homo sapiens
tgaatatggactcagttttct

SEQ ID NO: 2794158 - DNA, 18 bp, Homo sapiens
tgaatatttcaaaataaa

SEQ ID NO: 2794159 - DNA, 16 bp, Homo sapiens
tgaatcagaccctacc

SEQ ID NO: 2794160 - DNA, 21 bp, Homo sapiens
tgaatcctctctctgtgttac

SEQ ID NO: 2794161 - DNA, 15 bp, Homo sapiens
tgaatcttactcctt

SEQ ID NO: 2794162 - DNA, 17 bp, Homo sapiens
tgaatgaggtcccaggc

SEQ ID NO: 2794163 - DNA, 22 bp, Homo sapiens
tgaatgaggtcccaggcagaga

SEQ ID NO: 2794164 - DNA, 19 bp, Homo sapiens
tgaatgcaaaccatagcac

SEQ ID NO: 2794165 - DNA, 19 bp, Homo sapiens
tgaatgcacactagcctct

SEQ ID NO: 2794166 - DNA, 23 bp, Homo sapiens
tgaatgcccacaggcaaatgcat

SEQ ID NO: 2794167 - DNA, 15 bp, Homo sapiens
tgaatggcctgcctt

SEQ ID NO: 2794168 - DNA, 21 bp, Homo sapiens
tgaatggcctgccttgaagcc

SEQ ID NO: 2794169 - DNA, 20 bp, Homo sapiens
tgaatggctatgtttttaat

SEQ ID NO: 2794170 - DNA, 16 bp, Homo sapiens
tgaatgtattgaactt

SEQ ID NO: 2794171 - DNA, 21 bp, Homo sapiens
tgaatgtttgaactgccaaga

SEQ ID NO: 2794172 - DNA, 15 bp, Homo sapiens
tgaattaaatttaat

SEQ ID NO: 2794173 - DNA, 21 bp, Homo sapiens
tgaattattttgttgtgattt

SEQ ID NO: 2794174 - DNA, 22 bp, Homo sapiens
tgaattattttgttgtgatttt

SEQ ID NO: 2794175 - DNA, 14 bp, Homo sapiens
tgaattctgtgaag

SEQ ID NO: 2794176 - DNA, 15 bp, Homo sapiens
tgaatttggagactc

SEQ ID NO: 2794177 - DNA, 14 bp, Homo sapiens
tgaattttgttgct

SEQ ID NO: 2794178 - DNA, 21 bp, Homo sapiens
tgaatttttaaacaagtattt

SEQ ID NO: 2794179 - DNA, 17 bp, Homo sapiens
tgacaaaattggccaga

SEQ ID NO: 2794180 - DNA, 16 bp, Homo sapiens
tgacaaagttacaaat

SEQ ID NO: 2794181 - DNA, 18 bp, Homo sapiens
tgacaacctttgtgtaat

SEQ ID NO: 2794182 - DNA, 20 bp, Homo sapiens
tgacaacctttgtgtaataa

SEQ ID NO: 2794183 - DNA, 22 bp, Homo sapiens
tgacaacctttgtgtaataaaa

SEQ ID NO: 2794184 - DNA, 15 bp, Homo sapiens
tgacaagtcacaccc

SEQ ID NO: 2794185 - DNA, 14 bp, Homo sapiens
tgacaataaatgtg

SEQ ID NO: 2794186 - DNA, 14 bp, Homo sapiens
tgacaataatttca

SEQ ID NO: 2794187 - DNA, 17 bp, Homo sapiens
tgacaataatttcaggt

SEQ ID NO: 2794188 - DNA, 20 bp, Homo sapiens
tgacacacagactacagcca

SEQ ID NO: 2794189 - DNA, 20 bp, Homo sapiens
tgacacacgtatttatattt

SEQ ID NO: 2794190 - DNA, 19 bp, Homo sapiens
tgacacccaagagggctgc

SEQ ID NO: 2794191 - DNA, 19 bp, Homo sapiens
tgacactaccttatcaggc

SEQ ID NO: 2794192 - DNA, 14 bp, Homo sapiens
tgacagaaatgcaa

SEQ ID NO: 2794193 - DNA, 15 bp, Homo sapiens
tgacagaacactgtc

SEQ ID NO: 2794194 - DNA, 13 bp, Homo sapiens
tgacagacacagg

SEQ ID NO: 2794195 - DNA, 14 bp, Homo sapiens
tgacagacacaggc

SEQ ID NO: 2794196 - DNA, 19 bp, Homo sapiens
tgacagagacccagatctc

SEQ ID NO: 2794197 - DNA, 13 bp, Homo sapiens
tgacagaggcagc

SEQ ID NO: 2794198 - DNA, 14 bp, Homo sapiens
tgacagaggcagcc

SEQ ID NO: 2794199 - DNA, 23 bp, Homo sapiens
tgacagaggcagccccattctgc

SEQ ID NO: 2794200 - DNA, 14 bp, Homo sapiens
tgacagagtgagac

SEQ ID NO: 2794201 - DNA, 15 bp, Homo sapiens
tgacagagttcacta

SEQ ID NO: 2794202 - DNA, 22 bp, Homo sapiens
tgacagatgtcagccgagccgg

SEQ ID NO: 2794203 - DNA, 14 bp, Homo sapiens
tgacagccagagcc

SEQ ID NO: 2794204 - DNA, 15 bp, Homo sapiens
tgacagccagagcct

SEQ ID NO: 2794205 - DNA, 18 bp, Homo sapiens
tgacagctcttctaagga

SEQ ID NO: 2794206 - DNA, 12 bp, Homo sapiens
tgacagctgtcc

SEQ ID NO: 2794207 - DNA, 17 bp, Homo sapiens
tgacagctgtccctgtc

SEQ ID NO: 2794208 - DNA, 20 bp, Homo sapiens
tgacaggcaatgctggctgt

SEQ ID NO: 2794209 - DNA, 23 bp, Homo sapiens
tcttgcaatggcagccttggcaa

SEQ ID NO: 2794210 - DNA, 23 bp, Homo sapiens
tcttgcaggaaggactatgaaaa

SEQ ID NO: 2794211 - DNA, 17 bp, Homo sapiens
tcttgccactgcctctt

SEQ ID NO: 2794212 - DNA, 13 bp, Homo sapiens
tcttgccagccag

SEQ ID NO: 2794213 - DNA, 14 bp, Homo sapiens
tcttgccagccaga

SEQ ID NO: 2794214 - DNA, 15 bp, Homo sapiens
tcttgccagccagaa

SEQ ID NO: 2794215 - DNA, 19 bp, Homo sapiens
tcttgccagccagaagcct

SEQ ID NO: 2794216 - DNA, 20 bp, Homo sapiens
tcttgccagccagaagcctc

SEQ ID NO: 2794217 - DNA, 16 bp, Homo sapiens
tcttgccccttgggcc

SEQ ID NO: 2794218 - DNA, 14 bp, Homo sapiens
tcttgcctgcaccc

SEQ ID NO: 2794219 - DNA, 15 bp, Homo sapiens
tcttgcctgcaccct

SEQ ID NO: 2794220 - DNA, 13 bp, Homo sapiens
tcttgcctgccag

SEQ ID NO: 2794221 - DNA, 16 bp, Homo sapiens
tcttggacctctgctc

SEQ ID NO: 2794222 - DNA, 14 bp, Homo sapiens
tcttggagaacttt

SEQ ID NO: 2794223 - DNA, 17 bp, Homo sapiens
tcttggagaactttcca

SEQ ID NO: 2794224 - DNA, 22 bp, Homo sapiens
tcttggcccctgtgtgagttga

SEQ ID NO: 2794225 - DNA, 18 bp, Homo sapiens
tcttggccgactcaggga

SEQ ID NO: 2794226 - DNA, 14 bp, Homo sapiens
tcttggtctcagct

SEQ ID NO: 2794227 - DNA, 19 bp, Homo sapiens
tcttgtacatgtgtagcct

SEQ ID NO: 2794228 - DNA, 23 bp, Homo sapiens
tcttgtcccctcttgacccatct

SEQ ID NO: 2794229 - DNA, 13 bp, Homo sapiens
tcttgtctccact

SEQ ID NO: 2794230 - DNA, 15 bp, Homo sapiens
tcttgtctctgggct

SEQ ID NO: 2794231 - DNA, 14 bp, Homo sapiens
tcttgttttcagtt

SEQ ID NO: 2794232 - DNA, 20 bp, Homo sapiens
tctttaaatcaaaagctgct

SEQ ID NO: 2794233 - DNA, 15 bp, Homo sapiens
tctttaagtattgtt

SEQ ID NO: 2794234 - DNA, 22 bp, Homo sapiens
tctttaatgtcacaggcaggtc

SEQ ID NO: 2794235 - DNA, 16 bp, Homo sapiens
tctttaggtgcctcct

SEQ ID NO: 2794236 - DNA, 18 bp, Homo sapiens
tctttaggtgcctcctgt

SEQ ID NO: 2794237 - DNA, 19 bp, Homo sapiens
tctttaggtgcctcctgtc

SEQ ID NO: 2794238 - DNA, 15 bp, Homo sapiens
tctttatgactgttt

SEQ ID NO: 2794239 - DNA, 21 bp, Homo sapiens
tctttcctctccaattgtaaa

SEQ ID NO: 2794240 - DNA, 23 bp, Homo sapiens
tctttcggactgaggccttctca

SEQ ID NO: 2794241 - DNA, 18 bp, Homo sapiens
tctttcttattttgtaat

SEQ ID NO: 2794242 - DNA, 19 bp, Homo sapiens
tctttcttattttgtaata

SEQ ID NO: 2794243 - DNA, 22 bp, Homo sapiens
tctttcttattttgtaataaac

SEQ ID NO: 2794244 - DNA, 23 bp, Homo sapiens
tctttcttattttgtaataaact

SEQ ID NO: 2794245 - DNA, 12 bp, Homo sapiens
tctttgaataaa

SEQ ID NO: 2794246 - DNA, 18 bp, Homo sapiens
tctttgaataaagtctga

SEQ ID NO: 2794247 - DNA, 19 bp, Homo sapiens
tctttgaataaagtctgag

SEQ ID NO: 2794248 - DNA, 17 bp, Homo sapiens
tctttgattcagacagc

SEQ ID NO: 2794249 - DNA, 16 bp, Homo sapiens
tctttgcctgtgtgag

SEQ ID NO: 2794250 - DNA, 18 bp, Homo sapiens
tctttggaaggagtgaga

SEQ ID NO: 2794251 - DNA, 13 bp, Homo sapiens
tctttgtgtagct

SEQ ID NO: 2794252 - DNA, 19 bp, Homo sapiens
tctttgttcagttgactta

SEQ ID NO: 2794253 - DNA, 13 bp, Homo sapiens
tctctcctgtcca

SEQ ID NO: 2794254 - DNA, 14 bp, Homo sapiens
tctctcctgtccaa

SEQ ID NO: 2794255 - DNA, 20 bp, Homo sapiens
tctctcgtaactggtttcat

SEQ ID NO: 2794256 - DNA, 20 bp, Homo sapiens
tctctctactcctacctcag

SEQ ID NO: 2794257 - DNA, 19 bp, Homo sapiens
tctctctatatatacatgt

SEQ ID NO: 2794258 - DNA, 14 bp, Homo sapiens
tctctctctacaaa

SEQ ID NO: 2794259 - DNA, 11 bp, Homo sapiens
tctctctctgg

SEQ ID NO: 2794260 - DNA, 14 bp, Homo sapiens
tctctctctggtca

SEQ ID NO: 2794261 - DNA, 10 bp, Homo sapiens
tctctcttcc

SEQ ID NO: 2794262 - DNA, 17 bp, Homo sapiens
tctctgactcttgcctt

SEQ ID NO: 2794263 - DNA, 21 bp, Homo sapiens
tctctgactcttgcctttcca

SEQ ID NO: 2794264 - DNA, 14 bp, Homo sapiens
tctctgagaacaga

SEQ ID NO: 2794265 - DNA, 16 bp, Homo sapiens
tctctgagagagatga

SEQ ID NO: 2794266 - DNA, 17 bp, Homo sapiens
tctctgagatgcccctc

SEQ ID NO: 2794267 - DNA, 17 bp, Homo sapiens
tctctgaggacactaac

SEQ ID NO: 2794268 - DNA, 17 bp, Homo sapiens
tctctgctcttgcctgc

SEQ ID NO: 2794269 - DNA, 18 bp, Homo sapiens
tctctgctcttgcctgca

SEQ ID NO: 2794270 - DNA, 21 bp, Homo sapiens
tctctgctcttgcctgcaccc

SEQ ID NO: 2794271 - DNA, 19 bp, Homo sapiens
tctctggcccttcttgcct

SEQ ID NO: 2794272 - DNA, 23 bp, Homo sapiens
tctctgtgaacgatttagaaaga

SEQ ID NO: 2794273 - DNA, 20 bp, Homo sapiens
tctctgtgactcgcttagct

SEQ ID NO: 2794274 - DNA, 19 bp, Homo sapiens
tctctgtgcttcaattaat

SEQ ID NO: 2794275 - DNA, 16 bp, Homo sapiens
tctctgttcatttcct

SEQ ID NO: 2794276 - DNA, 15 bp, Homo sapiens
tctcttatagaatat

SEQ ID NO: 2794277 - DNA, 14 bp, Homo sapiens
tctcttcaggttct

SEQ ID NO: 2794278 - DNA, 23 bp, Homo sapiens
tctcttcaggttcttagtgtcac

SEQ ID NO: 2794279 - DNA, 16 bp, Homo sapiens
tctcttgcctttctta

SEQ ID NO: 2794280 - DNA, 16 bp, Homo sapiens
tctctttaatcttcag

SEQ ID NO: 2794281 - DNA, 20 bp, Homo sapiens
tctctttaatcttcagtttt

SEQ ID NO: 2794282 - DNA, 20 bp, Homo sapiens
tctctttaatgtcacaggca

SEQ ID NO: 2794283 - DNA, 21 bp, Homo sapiens
tctctttaatgtcacaggcag

SEQ ID NO: 2794284 - DNA, 13 bp, Homo sapiens
tctctttgcctca

SEQ ID NO: 2794285 - DNA, 20 bp, Homo sapiens
tctcttttgaatccatgctt

SEQ ID NO: 2794286 - DNA, 23 bp, Homo sapiens
tctcttttgaatccatgcttggg

SEQ ID NO: 2794287 - DNA, 12 bp, Homo sapiens
tctgaaaactgg

SEQ ID NO: 2794288 - DNA, 15 bp, Homo sapiens
tctgaaaactgttta

SEQ ID NO: 2794289 - DNA, 18 bp, Homo sapiens
tctgaaaattaacactgc

SEQ ID NO: 2794290 - DNA, 12 bp, Homo sapiens
tctgaaagccac

SEQ ID NO: 2794291 - DNA, 14 bp, Homo sapiens
tctgaaagccacgt

SEQ ID NO: 2794292 - DNA, 14 bp, Homo sapiens
tctgaaatgaaaca

SEQ ID NO: 2794293 - DNA, 13 bp, Homo sapiens
tctgaagatctca

SEQ ID NO: 2794294 - DNA, 15 bp, Homo sapiens
tctgaagatctcaga

SEQ ID NO: 2794295 - DNA, 20 bp, Homo sapiens
tctgaagctattgatgtttc

SEQ ID NO: 2794296 - DNA, 22 bp, Homo sapiens
tctgaaggacattgcggacagc

SEQ ID NO: 2794297 - DNA, 19 bp, Homo sapiens
tctgaatataggaagcata

SEQ ID NO: 2794298 - DNA, 15 bp, Homo sapiens
tctgaatgaataaag

SEQ ID NO: 2794299 - DNA, 19 bp, Homo sapiens
tctgaatttttaaacaagt

SEQ ID NO: 2794300 - DNA, 21 bp, Homo sapiens
tctgacaggcaatgctggctg

SEQ ID NO: 2794301 - DNA, 17 bp, Homo sapiens
tctgacattctgattcg

SEQ ID NO: 2794302 - DNA, 14 bp, Homo sapiens
tctgaccatttcag

SEQ ID NO: 2794303 - DNA, 16 bp, Homo sapiens
tctgacctgcaggcca

SEQ ID NO: 2794304 - DNA, 21 bp, Homo sapiens
tctgagaacagacgttaccaa

SEQ ID NO: 2794305 - DNA, 18 bp, Homo sapiens
tccttggaggacagtggg

SEQ ID NO: 2794306 - DNA, 17 bp, Homo sapiens
tccttgtggtttatgtc

SEQ ID NO: 2794307 - DNA, 22 bp, Homo sapiens
tccttgtggtttatgtcatcat

SEQ ID NO: 2794308 - DNA, 17 bp, Homo sapiens
tcctttaaatccttcca

SEQ ID NO: 2794309 - DNA, 19 bp, Homo sapiens
tcctttagcgcccagttgg

SEQ ID NO: 2794310 - DNA, 22 bp, Homo sapiens
tcctttagcgcccagttgggtg

SEQ ID NO: 2794311 - DNA, 23 bp, Homo sapiens
tcctttagcgcccagttgggtgg

SEQ ID NO: 2794312 - DNA, 15 bp, Homo sapiens
tcctttatccctgag

SEQ ID NO: 2794313 - DNA, 23 bp, Homo sapiens
tcctttcagggaatttcaggaac

SEQ ID NO: 2794314 - DNA, 11 bp, Homo sapiens
tcctttcctct

SEQ ID NO: 2794315 - DNA, 16 bp, Homo sapiens
tcctttctccagccag

SEQ ID NO: 2794316 - DNA, 13 bp, Homo sapiens
tcctttgacattt

SEQ ID NO: 2794317 - DNA, 16 bp, Homo sapiens
tcctttgagaaagaaa

SEQ ID NO: 2794318 - DNA, 17 bp, Homo sapiens
tcctttgccccaaggct

SEQ ID NO: 2794319 - DNA, 16 bp, Homo sapiens
tcctttgttcttacct

SEQ ID NO: 2794320 - DNA, 19 bp, Homo sapiens
tccttttgcaacaagacaa

SEQ ID NO: 2794321 - DNA, 18 bp, Homo sapiens
tccttttgtgtacagtgt

SEQ ID NO: 2794322 - DNA, 14 bp, Homo sapiens
tcctttttctttat

SEQ ID NO: 2794323 - DNA, 19 bp, Homo sapiens
tcctttttctttataaact

SEQ ID NO: 2794324 - DNA, 20 bp, Homo sapiens
tcgaaatgaatttatctgaa

SEQ ID NO: 2794325 - DNA, 14 bp, Homo sapiens
tcgaactggctgca

SEQ ID NO: 2794326 - DNA, 15 bp, Homo sapiens
tcgaagcccttccag

SEQ ID NO: 2794327 - DNA, 12 bp, Homo sapiens
tcgaatgaaatt

SEQ ID NO: 2794328 - DNA, 19 bp, Homo sapiens
tcgaccccaaagccccttg

SEQ ID NO: 2794329 - DNA, 15 bp, Homo sapiens
tcgacctcactgtca

SEQ ID NO: 2794330 - DNA, 14 bp, Homo sapiens
tcgagacacttgcc

SEQ ID NO: 2794331 - DNA, 18 bp, Homo sapiens
tcgagaccaacctgacca

SEQ ID NO: 2794332 - DNA, 16 bp, Homo sapiens
tcgagaccagcctggc

SEQ ID NO: 2794333 - DNA, 12 bp, Homo sapiens
tcgagccctgca

SEQ ID NO: 2794334 - DNA, 14 bp, Homo sapiens
tcgagcgccctgca

SEQ ID NO: 2794335 - DNA, 18 bp, Homo sapiens
tcgagcgccctgcagacc

SEQ ID NO: 2794336 - DNA, 13 bp, Homo sapiens
tcgaggacaggga

SEQ ID NO: 2794337 - DNA, 17 bp, Homo sapiens
tcgaggacagggaggtg

SEQ ID NO: 2794338 - DNA, 22 bp, Homo sapiens
tcgaggcggtttccaggaagag

SEQ ID NO: 2794339 - DNA, 16 bp, Homo sapiens
tcgatctgtactgtaa

SEQ ID NO: 2794340 - DNA, 19 bp, Homo sapiens
tcgatctgtactgtaattt

SEQ ID NO: 2794341 - DNA, 23 bp, Homo sapiens
tcgatgaagcccaataaacctct

SEQ ID NO: 2794342 - DNA, 20 bp, Homo sapiens
tcgatgaatgtgttgatttg

SEQ ID NO: 2794343 - DNA, 23 bp, Homo sapiens
tcgatgaatgtgttgatttgaga

SEQ ID NO: 2794344 - DNA, 18 bp, Homo sapiens
tcgattagactggacagc

SEQ ID NO: 2794345 - DNA, 16 bp, Homo sapiens
tcgattcaaactgctc

SEQ ID NO: 2794346 - DNA, 16 bp, Homo sapiens
tcgcagccaccctgag

SEQ ID NO: 2794347 - DNA, 19 bp, Homo sapiens
tcgcagccaccctgaggag

SEQ ID NO: 2794348 - DNA, 16 bp, Homo sapiens
tcgccacacccggctc

SEQ ID NO: 2794349 - DNA, 12 bp, Homo sapiens
tcgcccaggaga

SEQ ID NO: 2794350 - DNA, 22 bp, Homo sapiens
tcgccccagatcaccagcccgg

SEQ ID NO: 2794351 - DNA, 15 bp, Homo sapiens
tcgctccccactctg

SEQ ID NO: 2794352 - DNA, 13 bp, Homo sapiens
tcgctcctgtgtc

SEQ ID NO: 2794353 - DNA, 23 bp, Homo sapiens
tcgctctgctggcctggccggca

SEQ ID NO: 2794354 - DNA, 15 bp, Homo sapiens
tcgctggacaaccca

SEQ ID NO: 2794355 - DNA, 16 bp, Homo sapiens
tcgctggcagagaagg

SEQ ID NO: 2794356 - DNA, 12 bp, Homo sapiens
tcgctgtcctgc

SEQ ID NO: 2794357 - DNA, 16 bp, Homo sapiens
tcgctgtcctgctgtg

SEQ ID NO: 2794358 - DNA, 17 bp, Homo sapiens
tcgcttagctgaaacct

SEQ ID NO: 2794359 - DNA, 16 bp, Homo sapiens
tcggagtagaaattgt

SEQ ID NO: 2794360 - DNA, 19 bp, Homo sapiens
tcggctgtaaacagctctg

SEQ ID NO: 2794361 - DNA, 14 bp, Homo sapiens
tcgggaacagtgtt

SEQ ID NO: 2794362 - DNA, 14 bp, Homo sapiens
tcgggagcagtgtc

SEQ ID NO: 2794363 - DNA, 19 bp, Homo sapiens
tcgggataacaaaatcaca

SEQ ID NO: 2794364 - DNA, 15 bp, Homo sapiens
tcggggaactcctgg

SEQ ID NO: 2794365 - DNA, 18 bp, Homo sapiens
tcggggcatgctggggca

SEQ ID NO: 2794366 - DNA, 17 bp, Homo sapiens
tcggggtgcacaggagg

SEQ ID NO: 2794367 - DNA, 19 bp, Homo sapiens
tcggggtgcacaggagggg

SEQ ID NO: 2794368 - DNA, 14 bp, Homo sapiens
tcggtggccatgct

SEQ ID NO: 2794369 - DNA, 19 bp, Homo sapiens
tcggtggccatgcttcttg

SEQ ID NO: 2794370 - DNA, 16 bp, Homo sapiens
tcgtcctccccctgcc

SEQ ID NO: 2794371 - DNA, 23 bp, Homo sapiens
tcgtcctccccctgccagtgcct

SEQ ID NO: 2794372 - DNA, 19 bp, Homo sapiens
tcgtccttactcctgtggg

SEQ ID NO: 2794373 - DNA, 17 bp, Homo sapiens
tcgtgcatttgtgagcc

SEQ ID NO: 2794374 - DNA, 20 bp, Homo sapiens
tcgtgccgttactctccaac

SEQ ID NO: 2794375 - DNA, 23 bp, Homo sapiens
tcgtgccgttactctccaacctg

SEQ ID NO: 2794376 - DNA, 13 bp, Homo sapiens
tcgtggacacctg

SEQ ID NO: 2794377 - DNA, 17 bp, Homo sapiens
tcgtggacacctgccct

SEQ ID NO: 2794378 - DNA, 18 bp, Homo sapiens
tcgtggagagctaggagc

SEQ ID NO: 2794379 - DNA, 20 bp, Homo sapiens
tcgtggcagataatcagcct

SEQ ID NO: 2794380 - DNA, 22 bp, Homo sapiens
tcgtggtgatcaattaaatgta

SEQ ID NO: 2794381 - DNA, 14 bp, Homo sapiens
tcgtgtttacaaaa

SEQ ID NO: 2794382 - DNA, 19 bp, Homo sapiens
tctaaaaataaaatgatgt

SEQ ID NO: 2794383 - DNA, 13 bp, Homo sapiens
tctaaaactatgg

SEQ ID NO: 2794384 - DNA, 21 bp, Homo sapiens
tctaaaactatggttcccaat

SEQ ID NO: 2794385 - DNA, 17 bp, Homo sapiens
tctaaaagaatttaaat

SEQ ID NO: 2794386 - DNA, 17 bp, Homo sapiens
tctaaatcttccttgtg

SEQ ID NO: 2794387 - DNA, 13 bp, Homo sapiens
tctaaatgaagtg

SEQ ID NO: 2794388 - DNA, 14 bp, Homo sapiens
tctaaatgttggaa

SEQ ID NO: 2794389 - DNA, 13 bp, Homo sapiens
tctaacgcctgag

SEQ ID NO: 2794390 - DNA, 16 bp, Homo sapiens
tctaacgcctgagccc

SEQ ID NO: 2794391 - DNA, 21 bp, Homo sapiens
tctaacgcctgagcccaggga

SEQ ID NO: 2794392 - DNA, 16 bp, Homo sapiens
tctaagattgtacata

SEQ ID NO: 2794393 - DNA, 18 bp, Homo sapiens
tctaagctgcagcttcct

SEQ ID NO: 2794394 - DNA, 14 bp, Homo sapiens
tctaagttaattta

SEQ ID NO: 2794395 - DNA, 16 bp, Homo sapiens
tctaagttaatttaaa

SEQ ID NO: 2794396 - DNA, 20 bp, Homo sapiens
tctaagttaatttaaagttg

SEQ ID NO: 2794397 - DNA, 13 bp, Homo sapiens
tctaagttctatt

SEQ ID NO: 2794398 - DNA, 16 bp, Homo sapiens
tctaatacctctgtgt

SEQ ID NO: 2794399 - DNA, 20 bp, Homo sapiens
tctaatacctctgtgtgctc

SEQ ID NO: 2794400 - DNA, 17 bp, Homo sapiens
tctaatcttgttaaatt

SEQ ID NO: 2794401 - DNA, 19 bp, Homo sapiens
tctaattcccattttgcaa

SEQ ID NO: 2794402 - DNA, 22 bp, Homo sapiens
tctaattcccattttgcaaaat

SEQ ID NO: 2794403 - DNA, 14 bp, Homo sapiens
tctaatttatacaa

SEQ ID NO: 2794404 - DNA, 14 bp, Homo sapiens
tctacacacccata

SEQ ID NO: 2794405 - DNA, 21 bp, Homo sapiens
tctacacagcagtatgaatga

SEQ ID NO: 2794406 - DNA, 22 bp, Homo sapiens
tctacacagcagtatgaatgat

SEQ ID NO: 2794407 - DNA, 13 bp, Homo sapiens
tctacacagcctg

SEQ ID NO: 2794408 - DNA, 17 bp, Homo sapiens
tctacagaacaaagaac

SEQ ID NO: 2794409 - DNA, 19 bp, Homo sapiens
tctacccagcgagccctgg

SEQ ID NO: 2794410 - DNA, 19 bp, Homo sapiens
tctacccatctcccccatc

SEQ ID NO: 2794411 - DNA, 19 bp, Homo sapiens
tctacccggcccagagacc

SEQ ID NO: 2794412 - DNA, 22 bp, Homo sapiens
tctacccggcccagagacccct

SEQ ID NO: 2794413 - DNA, 20 bp, Homo sapiens
tctaccctggtaggaaagca

SEQ ID NO: 2794414 - DNA, 22 bp, Homo sapiens
tctaccgacctgtctccctggg

SEQ ID NO: 2794415 - DNA, 16 bp, Homo sapiens
tctacgtataaatatg

SEQ ID NO: 2794416 - DNA, 19 bp, Homo sapiens
tctactcctacctcagcct

SEQ ID NO: 2794417 - DNA, 20 bp, Homo sapiens
tctactgggaaggctacttc

SEQ ID NO: 2794418 - DNA, 13 bp, Homo sapiens
tctagaacacagg

SEQ ID NO: 2794419 - DNA, 15 bp, Homo sapiens
tctagaacacaggca

SEQ ID NO: 2794420 - DNA, 19 bp, Homo sapiens
tctagaacatgcacattta

SEQ ID NO: 2794421 - DNA, 17 bp, Homo sapiens
tctagactttctcagtg

SEQ ID NO: 2794422 - DNA, 21 bp, Homo sapiens
tctagaggcttccttcatttc

SEQ ID NO: 2794423 - DNA, 18 bp, Homo sapiens
tctagctgatcagaattt

SEQ ID NO: 2794424 - DNA, 17 bp, Homo sapiens
tctaggagctgggagga

SEQ ID NO: 2794425 - DNA, 18 bp, Homo sapiens
tctaggagctgggaggaa

SEQ ID NO: 2794426 - DNA, 21 bp, Homo sapiens
tctaggagctgggaggaaaag

SEQ ID NO: 2794427 - DNA, 18 bp, Homo sapiens
tctaggcatcccagggga

SEQ ID NO: 2794428 - DNA, 19 bp, Homo sapiens
tctaggtctgtaatttatt

SEQ ID NO: 2794429 - DNA, 22 bp, Homo sapiens
tctagtacttgggagacctgta

SEQ ID NO: 2794430 - DNA, 19 bp, Homo sapiens
tctagtcctattctattgc

SEQ ID NO: 2794431 - DNA, 22 bp, Homo sapiens
tctagtctcctttgcactgagg

SEQ ID NO: 2794432 - DNA, 12 bp, Homo sapiens
tctagtgggaag

SEQ ID NO: 2794433 - DNA, 17 bp, Homo sapiens
tctagttagcaggaaat

SEQ ID NO: 2794434 - DNA, 13 bp, Homo sapiens
tctataaataacc

SEQ ID NO: 2794435 - DNA, 15 bp, Homo sapiens
tctataacatgcatt

SEQ ID NO: 2794436 - DNA, 15 bp, Homo sapiens
tctataatggaaaca

SEQ ID NO: 2794437 - DNA, 13 bp, Homo sapiens
tctatagactcta

SEQ ID NO: 2794438 - DNA, 16 bp, Homo sapiens
tctatagagaaaaact

SEQ ID NO: 2794439 - DNA, 20 bp, Homo sapiens
tctatagccaaaaatagcta

SEQ ID NO: 2794440 - DNA, 12 bp, Homo sapiens
tctatagctctt

SEQ ID NO: 2794441 - DNA, 15 bp, Homo sapiens
tctatagctcttcta

SEQ ID NO: 2794442 - DNA, 19 bp, Homo sapiens
tctatagtagtcaattagt

SEQ ID NO: 2794443 - DNA, 15 bp, Homo sapiens
tctatataatgtagt

SEQ ID NO: 2794444 - DNA, 18 bp, Homo sapiens
tctatatgttgctgaaac

SEQ ID NO: 2794445 - DNA, 19 bp, Homo sapiens
tctatcaaccccagacact

SEQ ID NO: 2794446 - DNA, 20 bp, Homo sapiens
tctatcaaccccagacactg

SEQ ID NO: 2794447 - DNA, 18 bp, Homo sapiens
tctatctgtattttcatt

SEQ ID NO: 2794448 - DNA, 15 bp, Homo sapiens
tctatgcaattttta

SEQ ID NO: 2794449 - DNA, 16 bp, Homo sapiens
tctatgcaatttttaa

SEQ ID NO: 2794450 - DNA, 22 bp, Homo sapiens
tctatgcaatttttaaactagt

SEQ ID NO: 2794451 - DNA, 23 bp, Homo sapiens
tctatgcaatttttaaactagta

SEQ ID NO: 2794452 - DNA, 15 bp, Homo sapiens
tctatgcattttctg

SEQ ID NO: 2794453 - DNA, 18 bp, Homo sapiens
tctatggcagtccagcca

SEQ ID NO: 2794454 - DNA, 21 bp, Homo sapiens
tctatggcagtccagccagct

SEQ ID NO: 2794455 - DNA, 20 bp, Homo sapiens
tctattattataaaaataat

SEQ ID NO: 2794456 - DNA, 16 bp, Homo sapiens
tctattcagacaagca

SEQ ID NO: 2794457 - DNA, 23 bp, Homo sapiens
tctattgcagttatagaaaatct

SEQ ID NO: 2794458 - DNA, 19 bp, Homo sapiens
tctattgtagcatttcttg

SEQ ID NO: 2794459 - DNA, 20 bp, Homo sapiens
tctattgtagcatttcttga

SEQ ID NO: 2794460 - DNA, 13 bp, Homo sapiens
tctatttaaaaaa

SEQ ID NO: 2794461 - DNA, 12 bp, Homo sapiens
tctatttctgag

SEQ ID NO: 2794462 - DNA, 15 bp, Homo sapiens
tctatttctgagaag

SEQ ID NO: 2794463 - DNA, 22 bp, Homo sapiens
tctcaaaaaaagggcaataaat

SEQ ID NO: 2794464 - DNA, 18 bp, Homo sapiens
tctcaaaataagttgaaa

SEQ ID NO: 2794465 - DNA, 13 bp, Homo sapiens
tctcaaactcttg

SEQ ID NO: 2794466 - DNA, 22 bp, Homo sapiens
tctcaaactcttgacctcaggt

SEQ ID NO: 2794467 - DNA, 21 bp, Homo sapiens
tctcaagcactaaaaagtggc

SEQ ID NO: 2794468 - DNA, 15 bp, Homo sapiens
tctcaatgcttttct

SEQ ID NO: 2794469 - DNA, 20 bp, Homo sapiens
tctcacgggcagtagctgtg

SEQ ID NO: 2794470 - DNA, 14 bp, Homo sapiens
tctcactaaatctt

SEQ ID NO: 2794471 - DNA, 17 bp, Homo sapiens
tctcactatgttgccca

SEQ ID NO: 2794472 - DNA, 13 bp, Homo sapiens
tctcactccacca

SEQ ID NO: 2794473 - DNA, 15 bp, Homo sapiens
tctcactccaccacc

SEQ ID NO: 2794474 - DNA, 17 bp, Homo sapiens
tctcactctgtcgccca

SEQ ID NO: 2794475 - DNA, 14 bp, Homo sapiens
tctcactgttgccc

SEQ ID NO: 2794476 - DNA, 15 bp, Homo sapiens
tctcactgttgccca

SEQ ID NO: 2794477 - DNA, 20 bp, Homo sapiens
tctcactgttgcccaggctg

SEQ ID NO: 2794478 - DNA, 17 bp, Homo sapiens
tctcagaatccaaagat

SEQ ID NO: 2794479 - DNA, 14 bp, Homo sapiens
tctcagagacaggt

SEQ ID NO: 2794480 - DNA, 20 bp, Homo sapiens
tctcagagacaggtggccta

SEQ ID NO: 2794481 - DNA, 20 bp, Homo sapiens
tctcagaggctatagctggg

SEQ ID NO: 2794482 - DNA, 22 bp, Homo sapiens
tctcagccccgggcctgcctct

SEQ ID NO: 2794483 - DNA, 23 bp, Homo sapiens
tctcagccccgggcctgcctctg

SEQ ID NO: 2794484 - DNA, 18 bp, Homo sapiens
tctcagcttcatttccgt

SEQ ID NO: 2794485 - DNA, 20 bp, Homo sapiens
tctcagcttcatttccgtga

SEQ ID NO: 2794486 - DNA, 15 bp, Homo sapiens
tctcaggacacaggc

SEQ ID NO: 2794487 - DNA, 16 bp, Homo sapiens
tctcaggacacaggcc

SEQ ID NO: 2794488 - DNA, 17 bp, Homo sapiens
tctcaggacacaggcct

SEQ ID NO: 2794489 - DNA, 18 bp, Homo sapiens
tctcaggacacaggcctg

SEQ ID NO: 2794490 - DNA, 20 bp, Homo sapiens
tctcaggacacaggcctgtg

SEQ ID NO: 2794491 - DNA, 18 bp, Homo sapiens
tctcaggagcacaggcag

SEQ ID NO: 2794492 - DNA, 23 bp, Homo sapiens
tctcaggagcacaggcagctgga

SEQ ID NO: 2794493 - DNA, 15 bp, Homo sapiens
tctcaggagcatggg

SEQ ID NO: 2794494 - DNA, 16 bp, Homo sapiens
tctcagggtccagacc

SEQ ID NO: 2794495 - DNA, 18 bp, Homo sapiens
tctcagggtccagaccct

SEQ ID NO: 2794496 - DNA, 15 bp, Homo sapiens
tctcaggtccctgca

SEQ ID NO: 2794497 - DNA, 14 bp, Homo sapiens
tctcagtgctctcc

SEQ ID NO: 2794498 - DNA, 14 bp, Homo sapiens
tctcatcatattgt

SEQ ID NO: 2794499 - DNA, 14 bp, Homo sapiens
tctcatgaacctca

SEQ ID NO: 2794500 - DNA, 23 bp, Homo sapiens
tctcatggaaactggccaggggt

SEQ ID NO: 2794501 - DNA, 14 bp, Homo sapiens
tctcatgtgatcct

SEQ ID NO: 2794502 - DNA, 16 bp, Homo sapiens
tctcattccccaggtg

SEQ ID NO: 2794503 - DNA, 18 bp, Homo sapiens
tctcatttaagggaaaaa

SEQ ID NO: 2794504 - DNA, 12 bp, Homo sapiens
tctccaaatgag

SEQ ID NO: 2794505 - DNA, 17 bp, Homo sapiens
tctccaattgtaaaaaa

SEQ ID NO: 2794506 - DNA, 14 bp, Homo sapiens
tctccaccctgagc

SEQ ID NO: 2794507 - DNA, 16 bp, Homo sapiens
tctccaccctgctctc

SEQ ID NO: 2794508 - DNA, 17 bp, Homo sapiens
tctccacctcagccttg

SEQ ID NO: 2794509 - DNA, 18 bp, Homo sapiens
tctccacctcagccttgg

SEQ ID NO: 2794510 - DNA, 13 bp, Homo sapiens
tctccactccaga

SEQ ID NO: 2794511 - DNA, 18 bp, Homo sapiens
tctccactgctctcagcc

SEQ ID NO: 2794512 - DNA, 19 bp, Homo sapiens
tctccactgctctcagcct

SEQ ID NO: 2794513 - DNA, 22 bp, Homo sapiens
tctccactgctctcagcctccc

SEQ ID NO: 2794514 - DNA, 15 bp, Homo sapiens
tctccagccagcaat

SEQ ID NO: 2794515 - DNA, 20 bp, Homo sapiens
tctccagccttctctctctg

SEQ ID NO: 2794516 - DNA, 21 bp, Homo sapiens
tctccagccttctctctctgg

SEQ ID NO: 2794517 - DNA, 17 bp, Homo sapiens
tctccaggcacccttct

SEQ ID NO: 2794518 - DNA, 17 bp, Homo sapiens
tctccagtggttgctgt

SEQ ID NO: 2794519 - DNA, 20 bp, Homo sapiens
tctccagtggttgctgttga

SEQ ID NO: 2794520 - DNA, 14 bp, Homo sapiens
tctccatatgttac

SEQ ID NO: 2794521 - DNA, 17 bp, Homo sapiens
tctccatctggcagggt

SEQ ID NO: 2794522 - DNA, 14 bp, Homo sapiens
tctcccaggcccca

SEQ ID NO: 2794523 - DNA, 21 bp, Homo sapiens
tctcccaggccccatgacctc

SEQ ID NO: 2794524 - DNA, 23 bp, Homo sapiens
tctccccagcaagtgagagctgg

SEQ ID NO: 2794525 - DNA, 20 bp, Homo sapiens
tctcccccatcccccactgc

SEQ ID NO: 2794526 - DNA, 14 bp, Homo sapiens
tctccctaaaataa

SEQ ID NO: 2794527 - DNA, 16 bp, Homo sapiens
tctccctaaaataaaa

SEQ ID NO: 2794528 - DNA, 18 bp, Homo sapiens
tctccctaaaataaaaac

SEQ ID NO: 2794529 - DNA, 12 bp, Homo sapiens
tctccctccagc

SEQ ID NO: 2794530 - DNA, 14 bp, Homo sapiens
tctccctccagctg

SEQ ID NO: 2794531 - DNA, 14 bp, Homo sapiens
tctccctctcctgc

SEQ ID NO: 2794532 - DNA, 21 bp, Homo sapiens
tctccctctcctgcctactca

SEQ ID NO: 2794533 - DNA, 17 bp, Homo sapiens
tctccctctggccctgc

SEQ ID NO: 2794534 - DNA, 18 bp, Homo sapiens
tctccctctggccctgcc

SEQ ID NO: 2794535 - DNA, 14 bp, Homo sapiens
tctccctgccgcct

SEQ ID NO: 2794536 - DNA, 19 bp, Homo sapiens
tctcctaccccacctcatg

SEQ ID NO: 2794537 - DNA, 18 bp, Homo sapiens
tctcctatttttcagaat

SEQ ID NO: 2794538 - DNA, 14 bp, Homo sapiens
tctcctcagactgc

SEQ ID NO: 2794539 - DNA, 14 bp, Homo sapiens
tccctatcaaaaca

SEQ ID NO: 2794540 - DNA, 13 bp, Homo sapiens
tccctcaaatgac

SEQ ID NO: 2794541 - DNA, 19 bp, Homo sapiens
tccctcaaatgacccaaag

SEQ ID NO: 2794542 - DNA, 20 bp, Homo sapiens
tccctcaaatgacccaaaga

SEQ ID NO: 2794543 - DNA, 16 bp, Homo sapiens
tccctcaaccccacca

SEQ ID NO: 2794544 - DNA, 20 bp, Homo sapiens
tccctcaccccctcccaccc

SEQ ID NO: 2794545 - DNA, 18 bp, Homo sapiens
tccctcactgccttccag

SEQ ID NO: 2794546 - DNA, 12 bp, Homo sapiens
tccctcctggga

SEQ ID NO: 2794547 - DNA, 14 bp, Homo sapiens
tccctctaatttat

SEQ ID NO: 2794548 - DNA, 16 bp, Homo sapiens
tccctctaatttatct

SEQ ID NO: 2794549 - DNA, 12 bp, Homo sapiens
tccctctcccag

SEQ ID NO: 2794550 - DNA, 17 bp, Homo sapiens
tccctctcccaggcccc

SEQ ID NO: 2794551 - DNA, 14 bp, Homo sapiens
tccctctcttgcct

SEQ ID NO: 2794552 - DNA, 18 bp, Homo sapiens
tccctctgacctgcaggc

SEQ ID NO: 2794553 - DNA, 22 bp, Homo sapiens
tccctctgagaattccaaggag

SEQ ID NO: 2794554 - DNA, 17 bp, Homo sapiens
tccctctggccctgcct

SEQ ID NO: 2794555 - DNA, 15 bp, Homo sapiens
tccctcttccttccc

SEQ ID NO: 2794556 - DNA, 18 bp, Homo sapiens
tccctcttccttccccca

SEQ ID NO: 2794557 - DNA, 17 bp, Homo sapiens
tccctgaaaacccagag

SEQ ID NO: 2794558 - DNA, 19 bp, Homo sapiens
tccctgaaaacccagagag

SEQ ID NO: 2794559 - DNA, 20 bp, Homo sapiens
tccctgaaaacccagagagg

SEQ ID NO: 2794560 - DNA, 16 bp, Homo sapiens
tccctgaacatctgtg

SEQ ID NO: 2794561 - DNA, 15 bp, Homo sapiens
tccctgaaccatccc

SEQ ID NO: 2794562 - DNA, 17 bp, Homo sapiens
tccctgacctccctcta

SEQ ID NO: 2794563 - DNA, 17 bp, Homo sapiens
tccctgactctctgtga

SEQ ID NO: 2794564 - DNA, 16 bp, Homo sapiens
tccctgaggtcacctg

SEQ ID NO: 2794565 - DNA, 15 bp, Homo sapiens
tccctgagtcaccag

SEQ ID NO: 2794566 - DNA, 14 bp, Homo sapiens
tccctgcacttgca

SEQ ID NO: 2794567 - DNA, 23 bp, Homo sapiens
tccctgccacactcagtccccca

SEQ ID NO: 2794568 - DNA, 14 bp, Homo sapiens
tccctgccagtgtt

SEQ ID NO: 2794569 - DNA, 15 bp, Homo sapiens
tccctgccctgtcct

SEQ ID NO: 2794570 - DNA, 22 bp, Homo sapiens
tccctgccctgtcctccagctt

SEQ ID NO: 2794571 - DNA, 14 bp, Homo sapiens
tccctgccgcctca

SEQ ID NO: 2794572 - DNA, 19 bp, Homo sapiens
tccctggcctggctctcct

SEQ ID NO: 2794573 - DNA, 15 bp, Homo sapiens
tccctggctctcaga

SEQ ID NO: 2794574 - DNA, 16 bp, Homo sapiens
tccctggctctcagaa

SEQ ID NO: 2794575 - DNA, 19 bp, Homo sapiens
tccctggctctcagaaggt

SEQ ID NO: 2794576 - DNA, 21 bp, Homo sapiens
tccctggcttgtaactccacc

SEQ ID NO: 2794577 - DNA, 22 bp, Homo sapiens
tccctggcttgtaactccacca

SEQ ID NO: 2794578 - DNA, 18 bp, Homo sapiens
tccctgggggaagccctg

SEQ ID NO: 2794579 - DNA, 22 bp, Homo sapiens
tccctggggtcacatgctttgt

SEQ ID NO: 2794580 - DNA, 14 bp, Homo sapiens
tccctggtgcagag

SEQ ID NO: 2794581 - DNA, 22 bp, Homo sapiens
tccctgtcaccaagctcacagt

SEQ ID NO: 2794582 - DNA, 12 bp, Homo sapiens
tccctgtcctcc

SEQ ID NO: 2794583 - DNA, 17 bp, Homo sapiens
tcccttctttttcttct

SEQ ID NO: 2794584 - DNA, 23 bp, Homo sapiens
tcccttgaactgttctggcctca

SEQ ID NO: 2794585 - DNA, 13 bp, Homo sapiens
tcccttgagacct

SEQ ID NO: 2794586 - DNA, 13 bp, Homo sapiens
tccgaccagacac

SEQ ID NO: 2794587 - DNA, 19 bp, Homo sapiens
tccgccacgaggagcttcc

SEQ ID NO: 2794588 - DNA, 14 bp, Homo sapiens
tccgccccagacac

SEQ ID NO: 2794589 - DNA, 15 bp, Homo sapiens
tccgccccagacaca

SEQ ID NO: 2794590 - DNA, 16 bp, Homo sapiens
tccgctttctacccag

SEQ ID NO: 2794591 - DNA, 21 bp, Homo sapiens
tccggcctgatgacagagcga

SEQ ID NO: 2794592 - DNA, 16 bp, Homo sapiens
tccggtgtgagatata

SEQ ID NO: 2794593 - DNA, 18 bp, Homo sapiens
tccggtgtgcctgcagcc

SEQ ID NO: 2794594 - DNA, 19 bp, Homo sapiens
tccggtgtgcctgcagccc

SEQ ID NO: 2794595 - DNA, 13 bp, Homo sapiens
tccgtaaaaatga

SEQ ID NO: 2794596 - DNA, 17 bp, Homo sapiens
tccgtctccctaaaata

SEQ ID NO: 2794597 - DNA, 20 bp, Homo sapiens
tccgtctgcaatgtcccttg

SEQ ID NO: 2794598 - DNA, 23 bp, Homo sapiens
tccgtgaagggcaccgagaactc

SEQ ID NO: 2794599 - DNA, 21 bp, Homo sapiens
tcctaaacatcattcattttt

SEQ ID NO: 2794600 - DNA, 15 bp, Homo sapiens
tcctaagacttcagt

SEQ ID NO: 2794601 - DNA, 12 bp, Homo sapiens
tcctaaggacac

SEQ ID NO: 2794602 - DNA, 16 bp, Homo sapiens
tcctaaggacacacta

SEQ ID NO: 2794603 - DNA, 17 bp, Homo sapiens
tcctaaggacacactaa

SEQ ID NO: 2794604 - DNA, 14 bp, Homo sapiens
tcctacaaagatgt

SEQ ID NO: 2794605 - DNA, 15 bp, Homo sapiens
tcctacaaagatgtt

SEQ ID NO: 2794606 - DNA, 16 bp, Homo sapiens
tcctaccaaatataaa

SEQ ID NO: 2794607 - DNA, 16 bp, Homo sapiens
tcctacccaaccactc

SEQ ID NO: 2794608 - DNA, 21 bp, Homo sapiens
tcctaccccacctcatgcctg

SEQ ID NO: 2794609 - DNA, 23 bp, Homo sapiens
tcctaccccacctcatgcctggc

SEQ ID NO: 2794610 - DNA, 20 bp, Homo sapiens
tcctacgtcaaacatgaagt

SEQ ID NO: 2794611 - DNA, 14 bp, Homo sapiens
tcctactctgtgtc

SEQ ID NO: 2794612 - DNA, 15 bp, Homo sapiens
tcctactctgtgtca

SEQ ID NO: 2794613 - DNA, 13 bp, Homo sapiens
tcctaggccacac

SEQ ID NO: 2794614 - DNA, 17 bp, Homo sapiens
tcctaggcttaaatgca

SEQ ID NO: 2794615 - DNA, 20 bp, Homo sapiens
tcctagggaaaagttcatag

SEQ ID NO: 2794616 - DNA, 22 bp, Homo sapiens
tcctaggggccgagggaaatgc

SEQ ID NO: 2794617 - DNA, 13 bp, Homo sapiens
tcctagttttctc

SEQ ID NO: 2794618 - DNA, 16 bp, Homo sapiens
tcctatacatttctgt

SEQ ID NO: 2794619 - DNA, 17 bp, Homo sapiens
tcctatacatttctgtt

SEQ ID NO: 2794620 - DNA, 18 bp, Homo sapiens
tcctatatagtttattga

SEQ ID NO: 2794621 - DNA, 20 bp, Homo sapiens
tcctatcaagccagtacgtg

SEQ ID NO: 2794622 - DNA, 17 bp, Homo sapiens
tcctatcagaagtttct

SEQ ID NO: 2794623 - DNA, 22 bp, Homo sapiens
tcctatgtcaatttgtatatca

SEQ ID NO: 2794624 - DNA, 16 bp, Homo sapiens
tcctattaaaacacag

SEQ ID NO: 2794625 - DNA, 14 bp, Homo sapiens
tcctattctattgc

SEQ ID NO: 2794626 - DNA, 15 bp, Homo sapiens
tcctattctcaccag

SEQ ID NO: 2794627 - DNA, 15 bp, Homo sapiens
tcctatttcttatag

SEQ ID NO: 2794628 - DNA, 20 bp, Homo sapiens
tcctattttaaaaccatgca

SEQ ID NO: 2794629 - DNA, 22 bp, Homo sapiens
tcctattttaaaaccatgcagc

SEQ ID NO: 2794630 - DNA, 15 bp, Homo sapiens
tcctcaccaataact

SEQ ID NO: 2794631 - DNA, 17 bp, Homo sapiens
tcctcaccaataacttc

SEQ ID NO: 2794632 - DNA, 18 bp, Homo sapiens
tcctcaccaataacttca

SEQ ID NO: 2794633 - DNA, 20 bp, Homo sapiens
tcctcaccaataacttcaga

SEQ ID NO: 2794634 - DNA, 21 bp, Homo sapiens
tcctcactatgacactgagca

SEQ ID NO: 2794635 - DNA, 16 bp, Homo sapiens
tcctcactgccccacc

SEQ ID NO: 2794636 - DNA, 22 bp, Homo sapiens
tcctcactgccccaccagccac

SEQ ID NO: 2794637 - DNA, 15 bp, Homo sapiens
tcctcagactgctca

SEQ ID NO: 2794638 - DNA, 16 bp, Homo sapiens
tcctcagggacagaga

SEQ ID NO: 2794639 - DNA, 14 bp, Homo sapiens
tcctcagtcctgga

SEQ ID NO: 2794640 - DNA, 23 bp, Homo sapiens
tcctccaacgttaaaagacagtg

SEQ ID NO: 2794641 - DNA, 21 bp, Homo sapiens
tcctccaattccacagtctct

SEQ ID NO: 2794642 - DNA, 22 bp, Homo sapiens
tcctcccaccaccctcccacca

SEQ ID NO: 2794643 - DNA, 20 bp, Homo sapiens
tcctcccacctcagcctccc

SEQ ID NO: 2794644 - DNA, 21 bp, Homo sapiens
tcctcccacctcagcctcccg

SEQ ID NO: 2794645 - DNA, 17 bp, Homo sapiens
tcctccccaccttcccc

SEQ ID NO: 2794646 - DNA, 19 bp, Homo sapiens
tcctccccaccttccccag

SEQ ID NO: 2794647 - DNA, 20 bp, Homo sapiens
tcctcccccaccttcaagca

SEQ ID NO: 2794648 - DNA, 13 bp, Homo sapiens
tcctccccctgcc

SEQ ID NO: 2794649 - DNA, 23 bp, Homo sapiens
tcctccccctgccagtgccttac

SEQ ID NO: 2794650 - DNA, 13 bp, Homo sapiens
tcctccccttcct

SEQ ID NO: 2794651 - DNA, 19 bp, Homo sapiens
tcctccccttcctgcaccc

SEQ ID NO: 2794652 - DNA, 15 bp, Homo sapiens
tcctccctcagtgcc

SEQ ID NO: 2794653 - DNA, 19 bp, Homo sapiens
tcctccctgggcagaaagt

SEQ ID NO: 2794654 - DNA, 17 bp, Homo sapiens
tcctccgtcacctcaga

SEQ ID NO: 2794655 - DNA, 18 bp, Homo sapiens
tcctcctttgcctaggag

SEQ ID NO: 2794656 - DNA, 18 bp, Homo sapiens
tcctctccaattgtaaaa

SEQ ID NO: 2794657 - DNA, 23 bp, Homo sapiens
tcctctccagccttctctctctg

SEQ ID NO: 2794658 - DNA, 17 bp, Homo sapiens
tcctctctgagactgct

SEQ ID NO: 2794659 - DNA, 15 bp, Homo sapiens
tcctctgatacccag

SEQ ID NO: 2794660 - DNA, 17 bp, Homo sapiens
tcctctggatggcacca

SEQ ID NO: 2794661 - DNA, 19 bp, Homo sapiens
tcctctggatggcaccaga

SEQ ID NO: 2794662 - DNA, 17 bp, Homo sapiens
tcctctgtccaggcact

SEQ ID NO: 2794663 - DNA, 23 bp, Homo sapiens
tcctctgtccagggccctgagct

SEQ ID NO: 2794664 - DNA, 14 bp, Homo sapiens
tcctctgtctctgc

SEQ ID NO: 2794665 - DNA, 17 bp, Homo sapiens
tcctctgtctctgctct

SEQ ID NO: 2794666 - DNA, 20 bp, Homo sapiens
tcctcttaaaaaataaaaac

SEQ ID NO: 2794667 - DNA, 15 bp, Homo sapiens
tcctcttccccttgc

SEQ ID NO: 2794668 - DNA, 16 bp, Homo sapiens
tcctcttccccttgcc

SEQ ID NO: 2794669 - DNA, 19 bp, Homo sapiens
tcctcttccccttgccctt

SEQ ID NO: 2794670 - DNA, 13 bp, Homo sapiens
tcctcttgctcaa

SEQ ID NO: 2794671 - DNA, 14 bp, Homo sapiens
tcctcttgctcaaa

SEQ ID NO: 2794672 - DNA, 12 bp, Homo sapiens
tcctgaccctcc

SEQ ID NO: 2794673 - DNA, 15 bp, Homo sapiens
tcctgagaggtgctg

SEQ ID NO: 2794674 - DNA, 12 bp, Homo sapiens
tcctgagcactg

SEQ ID NO: 2794675 - DNA, 17 bp, Homo sapiens
tcctgagcactgccagg

SEQ ID NO: 2794676 - DNA, 23 bp, Homo sapiens
tcctgagcactgccaggagggac

SEQ ID NO: 2794677 - DNA, 17 bp, Homo sapiens
tcctgatactgggtaca

SEQ ID NO: 2794678 - DNA, 18 bp, Homo sapiens
tcctgcagcctcctcctg

SEQ ID NO: 2794679 - DNA, 16 bp, Homo sapiens
tcctgcatttgtgaaa

SEQ ID NO: 2794680 - DNA, 12 bp, Homo sapiens
tcctgcatttta

SEQ ID NO: 2794681 - DNA, 17 bp, Homo sapiens
tcctgccaccagtcact

SEQ ID NO: 2794682 - DNA, 16 bp, Homo sapiens
tcctgcccaggagagc

SEQ ID NO: 2794683 - DNA, 21 bp, Homo sapiens
tcctgccccaactccttccag

SEQ ID NO: 2794684 - DNA, 21 bp, Homo sapiens
tcctgcctacattccctggcc

SEQ ID NO: 2794685 - DNA, 23 bp, Homo sapiens
tcctgcctacattccctggcctg

SEQ ID NO: 2794686 - DNA, 11 bp, Homo sapiens
tcctgcctact

SEQ ID NO: 2794687 - DNA, 17 bp, Homo sapiens
tcctgcctcagcctccc

SEQ ID NO: 2794688 - DNA, 20 bp, Homo sapiens
tcctgcctcgaactggctgc

SEQ ID NO: 2794689 - DNA, 15 bp, Homo sapiens
tcctgcctctactgg

SEQ ID NO: 2794690 - DNA, 21 bp, Homo sapiens
tcctgctgaaacacctcccag

SEQ ID NO: 2794691 - DNA, 14 bp, Homo sapiens
tcctgctgctgtgt

SEQ ID NO: 2794692 - DNA, 15 bp, Homo sapiens
tcctgctgctgtgtt

SEQ ID NO: 2794693 - DNA, 21 bp, Homo sapiens
tcctgctgtgtgaattcccag

SEQ ID NO: 2794694 - DNA, 23 bp, Homo sapiens
tcctggaaagactgattgtttta

SEQ ID NO: 2794695 - DNA, 15 bp, Homo sapiens
tcctggaaccaatcc

SEQ ID NO: 2794696 - DNA, 19 bp, Homo sapiens
tcctggaatgaagcatgta

SEQ ID NO: 2794697 - DNA, 11 bp, Homo sapiens
tcctggacagc

SEQ ID NO: 2794698 - DNA, 19 bp, Homo sapiens
tcctggcacccggcccctg

SEQ ID NO: 2794699 - DNA, 23 bp, Homo sapiens
tcctggcacccggcccctgctgg

SEQ ID NO: 2794700 - DNA, 17 bp, Homo sapiens
tcctggccccagccccc

SEQ ID NO: 2794701 - DNA, 12 bp, Homo sapiens
tcctggcctcaa

SEQ ID NO: 2794702 - DNA, 18 bp, Homo sapiens
tcctgggagaacctcagg

SEQ ID NO: 2794703 - DNA, 19 bp, Homo sapiens
tcctgggagaacctcaggc

SEQ ID NO: 2794704 - DNA, 20 bp, Homo sapiens
tcctgggagaacctcaggct

SEQ ID NO: 2794705 - DNA, 14 bp, Homo sapiens
tcctgggagtgagc

SEQ ID NO: 2794706 - DNA, 14 bp, Homo sapiens
tcctgggcagcttg

SEQ ID NO: 2794707 - DNA, 21 bp, Homo sapiens
tcctgggcccgctttgcctgc

SEQ ID NO: 2794708 - DNA, 13 bp, Homo sapiens
tcctggggcctcg

SEQ ID NO: 2794709 - DNA, 21 bp, Homo sapiens
tcctggggcctcggagcctca

SEQ ID NO: 2794710 - DNA, 18 bp, Homo sapiens
tcctggggctctgtgcag

SEQ ID NO: 2794711 - DNA, 19 bp, Homo sapiens
tcctgggggatgtgcacgg

SEQ ID NO: 2794712 - DNA, 13 bp, Homo sapiens
tcctgggtggcta

SEQ ID NO: 2794713 - DNA, 22 bp, Homo sapiens
tcctgggtggctactctgtgcc

SEQ ID NO: 2794714 - DNA, 23 bp, Homo sapiens
tcctgggtggctactctgtgcca

SEQ ID NO: 2794715 - DNA, 22 bp, Homo sapiens
tcctggtattatttacaatgca

SEQ ID NO: 2794716 - DNA, 20 bp, Homo sapiens
tcctggtcttgagatgtctt

SEQ ID NO: 2794717 - DNA, 19 bp, Homo sapiens
tcctggtggggcagctcct

SEQ ID NO: 2794718 - DNA, 20 bp, Homo sapiens
tcctgtaacacaagccacag

SEQ ID NO: 2794719 - DNA, 15 bp, Homo sapiens
tcctgtaattttgta

SEQ ID NO: 2794720 - DNA, 19 bp, Homo sapiens
tcctgtaattttgtagtag

SEQ ID NO: 2794721 - DNA, 17 bp, Homo sapiens
tcctgtacgaacccctc

SEQ ID NO: 2794722 - DNA, 14 bp, Homo sapiens
tcctgtagcatctt

SEQ ID NO: 2794723 - DNA, 21 bp, Homo sapiens
tcctgtagcatcttctggagt

SEQ ID NO: 2794724 - DNA, 22 bp, Homo sapiens
tcctgtagcatcttctggagtc

SEQ ID NO: 2794725 - DNA, 22 bp, Homo sapiens
tcctgtagctctcctggggttc

SEQ ID NO: 2794726 - DNA, 19 bp, Homo sapiens
tcctgtatttgttcccaag

SEQ ID NO: 2794727 - DNA, 22 bp, Homo sapiens
tcctgtatttgttcccaagagc

SEQ ID NO: 2794728 - DNA, 18 bp, Homo sapiens
tcctgtcctttgttatta

SEQ ID NO: 2794729 - DNA, 17 bp, Homo sapiens
tcctgtcgattagactg

SEQ ID NO: 2794730 - DNA, 21 bp, Homo sapiens
tcctgtcgattagactggaca

SEQ ID NO: 2794731 - DNA, 12 bp, Homo sapiens
tcctgtctgcca

SEQ ID NO: 2794732 - DNA, 18 bp, Homo sapiens
tcctgtgggagcctcgca

SEQ ID NO: 2794733 - DNA, 13 bp, Homo sapiens
tcctgtgggtgtg

SEQ ID NO: 2794734 - DNA, 14 bp, Homo sapiens
tcctgtgtgtgcgc

SEQ ID NO: 2794735 - DNA, 18 bp, Homo sapiens
tcctgtgtgtgcgcctac

SEQ ID NO: 2794736 - DNA, 20 bp, Homo sapiens
tcctgttaacgtcatctcag

SEQ ID NO: 2794737 - DNA, 22 bp, Homo sapiens
tcctgttaacgtcatctcaggg

SEQ ID NO: 2794738 - DNA, 16 bp, Homo sapiens
tcctgttcaccttatg

SEQ ID NO: 2794739 - DNA, 20 bp, Homo sapiens
tccttactcctgtgggagcc

SEQ ID NO: 2794740 - DNA, 19 bp, Homo sapiens
tccttagagacatcaaaat

SEQ ID NO: 2794741 - DNA, 20 bp, Homo sapiens
tccttcaacaattctaaaat

SEQ ID NO: 2794742 - DNA, 19 bp, Homo sapiens
tccttcaagttagctcagg

SEQ ID NO: 2794743 - DNA, 19 bp, Homo sapiens
tccttcaccagagcccatg

SEQ ID NO: 2794744 - DNA, 20 bp, Homo sapiens
tccttcaccagagcccatgc

SEQ ID NO: 2794745 - DNA, 12 bp, Homo sapiens
tccttcagtgca

SEQ ID NO: 2794746 - DNA, 11 bp, Homo sapiens
tccttcatttc

SEQ ID NO: 2794747 - DNA, 18 bp, Homo sapiens
tccttcccccatcccctt

SEQ ID NO: 2794748 - DNA, 23 bp, Homo sapiens
tccttcccccatcccctttcctc

SEQ ID NO: 2794749 - DNA, 17 bp, Homo sapiens
tccttcccctttcccca

SEQ ID NO: 2794750 - DNA, 12 bp, Homo sapiens
tccttccctggc

SEQ ID NO: 2794751 - DNA, 16 bp, Homo sapiens
tccttctctgccccca

SEQ ID NO: 2794752 - DNA, 15 bp, Homo sapiens
tccttctttgtctta

SEQ ID NO: 2794753 - DNA, 13 bp, Homo sapiens
tccttgagcattt

SEQ ID NO: 2794754 - DNA, 22 bp, Homo sapiens
tccttgatctgtatatacaata

SEQ ID NO: 2794755 - DNA, 22 bp, Homo sapiens
tccttgcttatgacatcacttg

SEQ ID NO: 2794756 - DNA, 16 bp, Homo sapiens
tccttggaggacagtg

SEQ ID NO: 2794757 - DNA, 20 bp, Homo sapiens
tatattcatgtaataaatct

SEQ ID NO: 2794758 - DNA, 22 bp, Homo sapiens
tatattcatgtaataaatctga

SEQ ID NO: 2794759 - DNA, 19 bp, Homo sapiens
tatattccaccattcacat

SEQ ID NO: 2794760 - DNA, 14 bp, Homo sapiens
tatattgaaaagat

SEQ ID NO: 2794761 - DNA, 17 bp, Homo sapiens
tatattggtaacatcct

SEQ ID NO: 2794762 - DNA, 19 bp, Homo sapiens
tatattgtcagatattttt

SEQ ID NO: 2794763 - DNA, 14 bp, Homo sapiens
tatatttaattgtg

SEQ ID NO: 2794764 - DNA, 21 bp, Homo sapiens
tatatttaattgtgtcatatt

SEQ ID NO: 2794765 - DNA, 17 bp, Homo sapiens
tatatttactaaaagaa

SEQ ID NO: 2794766 - DNA, 21 bp, Homo sapiens
tatatttagattgttaaaata

SEQ ID NO: 2794767 - DNA, 16 bp, Homo sapiens
tatatttataactcat

SEQ ID NO: 2794768 - DNA, 14 bp, Homo sapiens
tatattttaatttg

SEQ ID NO: 2794769 - DNA, 11 bp, Homo sapiens
tatattttatg

SEQ ID NO: 2794770 - DNA, 12 bp, Homo sapiens
tatattttatga

SEQ ID NO: 2794771 - DNA, 22 bp, Homo sapiens
tatattttccctctcttgcctt

SEQ ID NO: 2794772 - DNA, 18 bp, Homo sapiens
tatatttttcaaccagca

SEQ ID NO: 2794773 - DNA, 19 bp, Homo sapiens
tatatttttggttgtcaat

SEQ ID NO: 2794774 - DNA, 14 bp, Homo sapiens
tatcaaaacatatc

SEQ ID NO: 2794775 - DNA, 16 bp, Homo sapiens
tatcaaaacatatcaa

SEQ ID NO: 2794776 - DNA, 18 bp, Homo sapiens
tatcaaaacatatcaatt

SEQ ID NO: 2794777 - DNA, 19 bp, Homo sapiens
tatcaaaacatatcaattc

SEQ ID NO: 2794778 - DNA, 20 bp, Homo sapiens
tatcaaaacatatcaattca

SEQ ID NO: 2794779 - DNA, 14 bp, Homo sapiens
tatcaaaatcacta

SEQ ID NO: 2794780 - DNA, 17 bp, Homo sapiens
tatcaaccccagacact

SEQ ID NO: 2794781 - DNA, 11 bp, Homo sapiens
tatcaattcaa

SEQ ID NO: 2794782 - DNA, 16 bp, Homo sapiens
tatcaattcaacacat

SEQ ID NO: 2794783 - DNA, 15 bp, Homo sapiens
tatcagaaaagtaga

SEQ ID NO: 2794784 - DNA, 16 bp, Homo sapiens
tatcagaaaagtagaa

SEQ ID NO: 2794785 - DNA, 17 bp, Homo sapiens
tatcagaaaagtagaat

SEQ ID NO: 2794786 - DNA, 22 bp, Homo sapiens
tatcagaaaagtagaattatat

SEQ ID NO: 2794787 - DNA, 23 bp, Homo sapiens
tatcagaaaagtagaattatatc

SEQ ID NO: 2794788 - DNA, 13 bp, Homo sapiens
tatcagacctctg

SEQ ID NO: 2794789 - DNA, 13 bp, Homo sapiens
tatcagcctgagt

SEQ ID NO: 2794790 - DNA, 15 bp, Homo sapiens
tatcagtgacagagt

SEQ ID NO: 2794791 - DNA, 23 bp, Homo sapiens
tatcagtgatggtctcacagagc

SEQ ID NO: 2794792 - DNA, 15 bp, Homo sapiens
tatcagttaacatta

SEQ ID NO: 2794793 - DNA, 15 bp, Homo sapiens
tatcagttactcagc

SEQ ID NO: 2794794 - DNA, 14 bp, Homo sapiens
tatcataaagtatg

SEQ ID NO: 2794795 - DNA, 14 bp, Homo sapiens
tatcatagaaatgt

SEQ ID NO: 2794796 - DNA, 18 bp, Homo sapiens
tatcatcagatagcatct

SEQ ID NO: 2794797 - DNA, 17 bp, Homo sapiens
tatcatgaaacacttct

SEQ ID NO: 2794798 - DNA, 18 bp, Homo sapiens
tatccaattatgtgacaa

SEQ ID NO: 2794799 - DNA, 15 bp, Homo sapiens
tatccacccagccca

SEQ ID NO: 2794800 - DNA, 15 bp, Homo sapiens
tatcctgcattttac

SEQ ID NO: 2794801 - DNA, 20 bp, Homo sapiens
tatcctgctagctgtagaaa

SEQ ID NO: 2794802 - DNA, 23 bp, Homo sapiens
tatcctgttaggggaaaatagta

SEQ ID NO: 2794803 - DNA, 20 bp, Homo sapiens
tatcgcaccactgtgtattt

SEQ ID NO: 2794804 - DNA, 16 bp, Homo sapiens
tatcgggaacagtgtt

SEQ ID NO: 2794805 - DNA, 19 bp, Homo sapiens
tatctaagttaatttaaag

SEQ ID NO: 2794806 - DNA, 21 bp, Homo sapiens
tatctaatatgtaacaagcca

SEQ ID NO: 2794807 - DNA, 18 bp, Homo sapiens
tatctaatttatacaaaa

SEQ ID NO: 2794808 - DNA, 19 bp, Homo sapiens
tatctaatttatacaaaat

SEQ ID NO: 2794809 - DNA, 20 bp, Homo sapiens
tatctaatttatacaaaata

SEQ ID NO: 2794810 - DNA, 21 bp, Homo sapiens
tatctaatttatacaaaataa

SEQ ID NO: 2794811 - DNA, 22 bp, Homo sapiens
tatctatagtagtcaattagta

SEQ ID NO: 2794812 - DNA, 17 bp, Homo sapiens
tatctatatctctaaac

SEQ ID NO: 2794813 - DNA, 14 bp, Homo sapiens
tatctcatcaacaa

SEQ ID NO: 2794814 - DNA, 23 bp, Homo sapiens
tatctcatcaacaaagaaatatt

SEQ ID NO: 2794815 - DNA, 11 bp, Homo sapiens
tatctcatctc

SEQ ID NO: 2794816 - DNA, 21 bp, Homo sapiens
tatctctaaactgctgttaat

SEQ ID NO: 2794817 - DNA, 13 bp, Homo sapiens
tatctgaaaactg

SEQ ID NO: 2794818 - DNA, 15 bp, Homo sapiens
tatctgaaaactgga

SEQ ID NO: 2794819 - DNA, 20 bp, Homo sapiens
tatctgaatttttaaacaag

SEQ ID NO: 2794820 - DNA, 16 bp, Homo sapiens
tatctgagaagtgtat

SEQ ID NO: 2794821 - DNA, 18 bp, Homo sapiens
tatctgagaagtgtatat

SEQ ID NO: 2794822 - DNA, 18 bp, Homo sapiens
tatctgcatttataaatg

SEQ ID NO: 2794823 - DNA, 22 bp, Homo sapiens
tatctgcatttataaatgtgtg

SEQ ID NO: 2794824 - DNA, 20 bp, Homo sapiens
tatctgtcatttgagcaggg

SEQ ID NO: 2794825 - DNA, 18 bp, Homo sapiens
tatctgtgaggtgctgat

SEQ ID NO: 2794826 - DNA, 18 bp, Homo sapiens
tatcttactatttcacaa

SEQ ID NO: 2794827 - DNA, 21 bp, Homo sapiens
tatcttatttaatttttgcaa

SEQ ID NO: 2794828 - DNA, 17 bp, Homo sapiens
tatcttatttatatatg

SEQ ID NO: 2794829 - DNA, 12 bp, Homo sapiens
tatcttgaagaa

SEQ ID NO: 2794830 - DNA, 17 bp, Homo sapiens
tatcttggactgacatt

SEQ ID NO: 2794831 - DNA, 21 bp, Homo sapiens
tattagttaggtgtgccaaac

SEQ ID NO: 2794832 - DNA, 15 bp, Homo sapiens
tattataaaaccatg

SEQ ID NO: 2794833 - DNA, 12 bp, Homo sapiens
tattataaataa

SEQ ID NO: 2794834 - DNA, 13 bp, Homo sapiens
tattataactgca

SEQ ID NO: 2794835 - DNA, 16 bp, Homo sapiens
tattataacttaaaaa

SEQ ID NO: 2794836 - DNA, 21 bp, Homo sapiens
tattataataatgttctctgg

SEQ ID NO: 2794837 - DNA, 15 bp, Homo sapiens
tattataatttaatg

SEQ ID NO: 2794838 - DNA, 16 bp, Homo sapiens
tattatccccatttct

SEQ ID NO: 2794839 - DNA, 16 bp, Homo sapiens
tattatggtgtaatgc

SEQ ID NO: 2794840 - DNA, 17 bp, Homo sapiens
tattatggtgtaatgca

SEQ ID NO: 2794841 - DNA, 23 bp, Homo sapiens
tattatggtgtaatgcacaattt

SEQ ID NO: 2794842 - DNA, 16 bp, Homo sapiens
tattatttacaatgca

SEQ ID NO: 2794843 - DNA, 15 bp, Homo sapiens
tattattttcacctg

SEQ ID NO: 2794844 - DNA, 16 bp, Homo sapiens
tattattttctatagc

SEQ ID NO: 2794845 - DNA, 20 bp, Homo sapiens
tattattttctatagctctt

SEQ ID NO: 2794846 - DNA, 11 bp, Homo sapiens
tattcaataaa

SEQ ID NO: 2794847 - DNA, 13 bp, Homo sapiens
tattcaataaagc

SEQ ID NO: 2794848 - DNA, 15 bp, Homo sapiens
tattcaattcctctg

SEQ ID NO: 2794849 - DNA, 16 bp, Homo sapiens
tactaaagcagtgttt

SEQ ID NO: 2794850 - DNA, 19 bp, Homo sapiens
tactaaagcagtgttttca

SEQ ID NO: 2794851 - DNA, 16 bp, Homo sapiens
tactacaaaaaagttg

SEQ ID NO: 2794852 - DNA, 15 bp, Homo sapiens
tactactgctgcaaa

SEQ ID NO: 2794853 - DNA, 20 bp, Homo sapiens
tactactgctgcaaagtgca

SEQ ID NO: 2794854 - DNA, 21 bp, Homo sapiens
tactactgctgcaaagtgcaa

SEQ ID NO: 2794855 - DNA, 22 bp, Homo sapiens
tactactgctgcaaagtgcaaa

SEQ ID NO: 2794856 - DNA, 22 bp, Homo sapiens
tactacttgttacctttcccat

SEQ ID NO: 2794857 - DNA, 21 bp, Homo sapiens
tactagaaagctctgcatgtg

SEQ ID NO: 2794858 - DNA, 14 bp, Homo sapiens
tactagatgtcttt

SEQ ID NO: 2794859 - DNA, 18 bp, Homo sapiens
tactagttgatgaaggag

SEQ ID NO: 2794860 - DNA, 16 bp, Homo sapiens
tactatggctgtattt

SEQ ID NO: 2794861 - DNA, 19 bp, Homo sapiens
tactattttacttctagag

SEQ ID NO: 2794862 - DNA, 13 bp, Homo sapiens
tactcacacaggc

SEQ ID NO: 2794863 - DNA, 21 bp, Homo sapiens
tactcacacaggcatttcctg

SEQ ID NO: 2794864 - DNA, 19 bp, Homo sapiens
tactcagaagcctgaggct

SEQ ID NO: 2794865 - DNA, 14 bp, Homo sapiens
tactcagccctggg

SEQ ID NO: 2794866 - DNA, 15 bp, Homo sapiens
tactcagccctgggc

SEQ ID NO: 2794867 - DNA, 22 bp, Homo sapiens
tactcagccctgggccccacca

SEQ ID NO: 2794868 - DNA, 23 bp, Homo sapiens
tactcagccctgggccccaccac

SEQ ID NO: 2794869 - DNA, 22 bp, Homo sapiens
tactcataagttggaccagagg

SEQ ID NO: 2794870 - DNA, 21 bp, Homo sapiens
tactcatatatatctatctta

SEQ ID NO: 2794871 - DNA, 14 bp, Homo sapiens
tactcatttttcat

SEQ ID NO: 2794872 - DNA, 19 bp, Homo sapiens
tactccaagcttcaagtga

SEQ ID NO: 2794873 - DNA, 12 bp, Homo sapiens
tactccacagcg

SEQ ID NO: 2794874 - DNA, 14 bp, Homo sapiens
tactccagtggtga

SEQ ID NO: 2794875 - DNA, 16 bp, Homo sapiens
tactcctgcaaaattt

SEQ ID NO: 2794876 - DNA, 22 bp, Homo sapiens
tactcctgcaaaattttatagc

SEQ ID NO: 2794877 - DNA, 23 bp, Homo sapiens
tactctccaaaggccctaccaga

SEQ ID NO: 2794878 - DNA, 16 bp, Homo sapiens
tactctccaacctgga

SEQ ID NO: 2794879 - DNA, 15 bp, Homo sapiens
tactctgtcagatgg

SEQ ID NO: 2794880 - DNA, 18 bp, Homo sapiens
tactcttaggaagagaaa

SEQ ID NO: 2794881 - DNA, 20 bp, Homo sapiens
tactgaaaggttaccctgta

SEQ ID NO: 2794882 - DNA, 14 bp, Homo sapiens
tactgagcttctct

SEQ ID NO: 2794883 - DNA, 18 bp, Homo sapiens
tactgagcttctctgtga

SEQ ID NO: 2794884 - DNA, 22 bp, Homo sapiens
tactgaggcctaaaagtaaaca

SEQ ID NO: 2794885 - DNA, 13 bp, Homo sapiens
tactgcacatttt

SEQ ID NO: 2794886 - DNA, 17 bp, Homo sapiens
tactgcagaatacagta

SEQ ID NO: 2794887 - DNA, 13 bp, Homo sapiens
tactgcatgcact

SEQ ID NO: 2794888 - DNA, 10 bp, Homo sapiens
tactgcctgc

SEQ ID NO: 2794889 - DNA, 16 bp, Homo sapiens
tactgctgcaaagtgc

SEQ ID NO: 2794890 - DNA, 18 bp, Homo sapiens
tactgggtacaagagcca

SEQ ID NO: 2794891 - DNA, 22 bp, Homo sapiens
tactgtaattggtgacaatgtc

SEQ ID NO: 2794892 - DNA, 19 bp, Homo sapiens
tactgtaattttgtttgta

SEQ ID NO: 2794893 - DNA, 14 bp, Homo sapiens
tactgtacttaata

SEQ ID NO: 2794894 - DNA, 16 bp, Homo sapiens
tactgtcctacccacc

SEQ ID NO: 2794895 - DNA, 17 bp, Homo sapiens
tactgtctgtaagagaa

SEQ ID NO: 2794896 - DNA, 15 bp, Homo sapiens
tactgttttgtatca

SEQ ID NO: 2794897 - DNA, 14 bp, Homo sapiens
tacttaactgtgtg

SEQ ID NO: 2794898 - DNA, 16 bp, Homo sapiens
tacttatatggaaatt

SEQ ID NO: 2794899 - DNA, 15 bp, Homo sapiens
tacttcactttaatt

SEQ ID NO: 2794900 - DNA, 11 bp, Homo sapiens
tacttcatgag

SEQ ID NO: 2794901 - DNA, 18 bp, Homo sapiens
tacttcattttcagagtg

SEQ ID NO: 2794902 - DNA, 21 bp, Homo sapiens
tacttctagagatagtacata

SEQ ID NO: 2794903 - DNA, 20 bp, Homo sapiens
tacttctcattttttaaaaa

SEQ ID NO: 2794904 - DNA, 16 bp, Homo sapiens
tacttctctctatctg

SEQ ID NO: 2794905 - DNA, 18 bp, Homo sapiens
tacttcttcattcaatac

SEQ ID NO: 2794906 - DNA, 12 bp, Homo sapiens
tacttgcacaag

SEQ ID NO: 2794907 - DNA, 12 bp, Homo sapiens
tacttgggaggc

SEQ ID NO: 2794908 - DNA, 13 bp, Homo sapiens
tacttgtggacac

SEQ ID NO: 2794909 - DNA, 14 bp, Homo sapiens
tacttgtggacaca

SEQ ID NO: 2794910 - DNA, 19 bp, Homo sapiens
tacttgttacctttcccat

SEQ ID NO: 2794911 - DNA, 19 bp, Homo sapiens
tactttgaaaccagaaaat

SEQ ID NO: 2794912 - DNA, 24 bp, Homo sapiens
tactttggaatgactataaacatt

SEQ ID NO: 2794913 - DNA, 19 bp, Homo sapiens
tacttttgttctgtatttt

SEQ ID NO: 2794914 - DNA, 17 bp, Homo sapiens
tagaaaacgcacctcca

SEQ ID NO: 2794915 - DNA, 15 bp, Homo sapiens
tagaaaactttaaag

SEQ ID NO: 2794916 - DNA, 16 bp, Homo sapiens
tagaaaactttaaagc

SEQ ID NO: 2794917 - DNA, 20 bp, Homo sapiens
tagaaagctgtttatttatt

SEQ ID NO: 2794918 - DNA, 15 bp, Homo sapiens
tagaaagttattgtg

SEQ ID NO: 2794919 - DNA, 13 bp, Homo sapiens
tagaaatcatttt

SEQ ID NO: 2794920 - DNA, 13 bp, Homo sapiens
tagaacaatagct

SEQ ID NO: 2794921 - DNA, 17 bp, Homo sapiens
tagaacaatagctattg

SEQ ID NO: 2794922 - DNA, 22 bp, Homo sapiens
tagaacaatagctattgcatgt

SEQ ID NO: 2794923 - DNA, 23 bp, Homo sapiens
tagaagaaagggcaagaaggaaa

SEQ ID NO: 2794924 - DNA, 18 bp, Homo sapiens
tagaagaacatccaagga

SEQ ID NO: 2794925 - DNA, 15 bp, Homo sapiens
tagaatataattatc

SEQ ID NO: 2794926 - DNA, 12 bp, Homo sapiens
tagaatatttat

SEQ ID NO: 2794927 - DNA, 16 bp, Homo sapiens
tagaatgatttcatgc

SEQ ID NO: 2794928 - DNA, 15 bp, Homo sapiens
tataaactttagagt

SEQ ID NO: 2794929 - DNA, 21 bp, Homo sapiens
tataaactttagagtagcatg

SEQ ID NO: 2794930 - DNA, 15 bp, Homo sapiens
tataaataaatgcca

SEQ ID NO: 2794931 - DNA, 12 bp, Homo sapiens
tataaatatata

SEQ ID NO: 2794932 - DNA, 14 bp, Homo sapiens
tataaatatatatt

SEQ ID NO: 2794933 - DNA, 15 bp, Homo sapiens
tataaatatatttaa

SEQ ID NO: 2794934 - DNA, 15 bp, Homo sapiens
tataaatcaatgtca

SEQ ID NO: 2794935 - DNA, 20 bp, Homo sapiens
tataaatcaatgtcacttaa

SEQ ID NO: 2794936 - DNA, 16 bp, Homo sapiens
tataaatgcatgattt

SEQ ID NO: 2794937 - DNA, 23 bp, Homo sapiens
tataaatgcatgattttatacat

SEQ ID NO: 2794938 - DNA, 16 bp, Homo sapiens
tataaatggtgttttt

SEQ ID NO: 2794939 - DNA, 12 bp, Homo sapiens
tataaccccacc

SEQ ID NO: 2794940 - DNA, 14 bp, Homo sapiens
tataactagtcctt

SEQ ID NO: 2794941 - DNA, 23 bp, Homo sapiens
taatgaaacaaagagttcaagaa

SEQ ID NO: 2794942 - DNA, 15 bp, Homo sapiens
taatgaactgtgaca

SEQ ID NO: 2794943 - DNA, 17 bp, Homo sapiens
taatgaactgtgacagg

SEQ ID NO: 2794944 - DNA, 17 bp, Homo sapiens
taatgaagacccagtgt

SEQ ID NO: 2794945 - DNA, 21 bp, Homo sapiens
taatgcacaatttagaaaaca

SEQ ID NO: 2794946 - DNA, 16 bp, Homo sapiens
taatgcatgttaggaa

SEQ ID NO: 2794947 - DNA, 17 bp, Homo sapiens
taatgcctctcccgcac

SEQ ID NO: 2794948 - DNA, 21 bp, Homo sapiens
taatggctgataattttaaat

SEQ ID NO: 2794949 - DNA, 22 bp, Homo sapiens
taatggctgataattttaaatt

SEQ ID NO: 2794950 - DNA, 17 bp, Homo sapiens
taatgggccaattaaaa

SEQ ID NO: 2794951 - DNA, 13 bp, Homo sapiens
taatggtttactg

SEQ ID NO: 2794952 - DNA, 18 bp, Homo sapiens
taatgtagtatgatgtaa

SEQ ID NO: 2794953 - DNA, 19 bp, Homo sapiens
taatgtagtatgatgtaat

SEQ ID NO: 2794954 - DNA, 16 bp, Homo sapiens
taatgtatcttattta

SEQ ID NO: 2794955 - DNA, 15 bp, Homo sapiens
taatgtcacaggcag

SEQ ID NO: 2794956 - DNA, 17 bp, Homo sapiens
taatgtggatttcctat

SEQ ID NO: 2794957 - DNA, 22 bp, Homo sapiens
taatgttctgaataatttctta

SEQ ID NO: 2794958 - DNA, 20 bp, Homo sapiens
taatgttgggatttatatct

SEQ ID NO: 2794959 - DNA, 13 bp, Homo sapiens
taatgtttgctat

SEQ ID NO: 2794960 - DNA, 15 bp, Homo sapiens
taattaaaaagttaa

SEQ ID NO: 2794961 - DNA, 21 bp, Homo sapiens
taattaaataaaaatctgtgg

SEQ ID NO: 2794962 - DNA, 22 bp, Homo sapiens
taattaaataaatcattaatac

SEQ ID NO: 2794963 - DNA, 12 bp, Homo sapiens
taattaagtaaa

SEQ ID NO: 2794964 - DNA, 19 bp, Homo sapiens
taattagattttcttgcag

SEQ ID NO: 2794965 - DNA, 16 bp, Homo sapiens
taattaggatctatgc

SEQ ID NO: 2794966 - DNA, 21 bp, Homo sapiens
taattaggatctatgcaattt

SEQ ID NO: 2794967 - DNA, 17 bp, Homo sapiens
taattatcggaagcagt

SEQ ID NO: 2794968 - DNA, 18 bp, Homo sapiens
taattatcggaagcagtg

SEQ ID NO: 2794969 - DNA, 20 bp, Homo sapiens
taattatcgggaacagtgtt

SEQ ID NO: 2794970 - DNA, 13 bp, Homo sapiens
taattatgacagt

SEQ ID NO: 2794971 - DNA, 12 bp, Homo sapiens
taattattattc

SEQ ID NO: 2794972 - DNA, 14 bp, Homo sapiens
taattattattctt

SEQ ID NO: 2794973 - DNA, 15 bp, Homo sapiens
taattcataattaga

SEQ ID NO: 2794974 - DNA, 19 bp, Homo sapiens
taattcataattagaacaa

SEQ ID NO: 2794975 - DNA, 16 bp, Homo sapiens
taattcattaaatttc

SEQ ID NO: 2794976 - DNA, 17 bp, Homo sapiens
taattcccattttgcaa

SEQ ID NO: 2794977 - DNA, 15 bp, Homo sapiens
taattccctatcttt

SEQ ID NO: 2794978 - DNA, 20 bp, Homo sapiens
taattccctatcttttagtt

SEQ ID NO: 2794979 - DNA, 21 bp, Homo sapiens
taattcggaagggaaaacagt

SEQ ID NO: 2794980 - DNA, 18 bp, Homo sapiens
taattcttaataggcttt

SEQ ID NO: 2794981 - DNA, 15 bp, Homo sapiens
taattcttgtatatt

SEQ ID NO: 2794982 - DNA, 20 bp, Homo sapiens
taattggaagaaattcctgt

SEQ ID NO: 2794983 - DNA, 21 bp, Homo sapiens
taattggaagaaattcctgta

SEQ ID NO: 2794984 - DNA, 12 bp, Homo sapiens
taattgggattt

SEQ ID NO: 2794985 - DNA, 14 bp, Homo sapiens
taattggtgacaat

SEQ ID NO: 2794986 - DNA, 13 bp, Homo sapiens
taattgtgtacaa

SEQ ID NO: 2794987 - DNA, 13 bp, Homo sapiens
taatttaaaccag

SEQ ID NO: 2794988 - DNA, 21 bp, Homo sapiens
taatttaaaccagcagaaaag

SEQ ID NO: 2794989 - DNA, 14 bp, Homo sapiens
taatttaatgcatg

SEQ ID NO: 2794990 - DNA, 17 bp, Homo sapiens
taatttatacaaaataa

SEQ ID NO: 2794991 - DNA, 23 bp, Homo sapiens
taatttatcttgtctctgggctt

SEQ ID NO: 2794992 - DNA, 20 bp, Homo sapiens
taatttatgagtttttgata

SEQ ID NO: 2794993 - DNA, 21 bp, Homo sapiens
taatttctaactccttatgtt

SEQ ID NO: 2794994 - DNA, 17 bp, Homo sapiens
taatttctgtgtatttt

SEQ ID NO: 2794995 - DNA, 18 bp, Homo sapiens
taatttgaggacaaccat

SEQ ID NO: 2794996 - DNA, 16 bp, Homo sapiens
taattttattattaga

SEQ ID NO: 2794997 - DNA, 20 bp, Homo sapiens
taattttattattagattct

SEQ ID NO: 2794998 - DNA, 22 bp, Homo sapiens
taattttcaagagaagaaaaaa

SEQ ID NO: 2794999 - DNA, 20 bp, Homo sapiens
taatttttgatactaagcat

SEQ ID NO: 2795000 - DNA, 16 bp, Homo sapiens
taatttttttcaatat

SEQ ID NO: 2795001 - DNA, 13 bp, Homo sapiens
tacaaaaatagta

SEQ ID NO: 2795002 - DNA, 23 bp, Homo sapiens
tacaaaataaaattatggtgaaa

SEQ ID NO: 2795003 - DNA, 20 bp, Homo sapiens
tacaaaataaacaaataaca

SEQ ID NO: 2795004 - DNA, 14 bp, Homo sapiens
tacaaaataattta

SEQ ID NO: 2795005 - DNA, 12 bp, Homo sapiens
tacaaacatatt

SEQ ID NO: 2795006 - DNA, 17 bp, Homo sapiens
tacaaacatgtggttaa

SEQ ID NO: 2795007 - DNA, 14 bp, Homo sapiens
tacaaagtagagaa

SEQ ID NO: 2795008 - DNA, 19 bp, Homo sapiens
tacaaatactcttaggaag

SEQ ID NO: 2795009 - DNA, 23 bp, Homo sapiens
tacaaatactcttaggaagagaa

SEQ ID NO: 2795010 - DNA, 19 bp, Homo sapiens
tacaaatatatttaattgt

SEQ ID NO: 2795011 - DNA, 13 bp, Homo sapiens
tacaaattatcat

SEQ ID NO: 2795012 - DNA, 22 bp, Homo sapiens
tacaaccagagccccccacaat

SEQ ID NO: 2795013 - DNA, 19 bp, Homo sapiens
tacaactagatcaaggagc

SEQ ID NO: 2795014 - DNA, 16 bp, Homo sapiens
tacaagcgtgagccac

SEQ ID NO: 2795015 - DNA, 18 bp, Homo sapiens
tacaagcgtgagccactg

SEQ ID NO: 2795016 - DNA, 21 bp, Homo sapiens
tacaagtagaatggcagctgg

SEQ ID NO: 2795017 - DNA, 18 bp, Homo sapiens
tacaataaatattctgca

SEQ ID NO: 2795018 - DNA, 13 bp, Homo sapiens
tacaataacataa

SEQ ID NO: 2795019 - DNA, 16 bp, Homo sapiens
tacaataattctatga

SEQ ID NO: 2795020 - DNA, 14 bp, Homo sapiens
tacaatatttaaaa

SEQ ID NO: 2795021 - DNA, 14 bp, Homo sapiens
tacaattgaactta

SEQ ID NO: 2795022 - DNA, 16 bp, Homo sapiens
tacacaagtaaacatt

SEQ ID NO: 2795023 - DNA, 22 bp, Homo sapiens
taactccaccaacccatcagaa

SEQ ID NO: 2795024 - DNA, 14 bp, Homo sapiens
taactctctttatg

SEQ ID NO: 2795025 - DNA, 14 bp, Homo sapiens
taactgaaggagaa

SEQ ID NO: 2795026 - DNA, 16 bp, Homo sapiens
taactgaaggagaagg

SEQ ID NO: 2795027 - DNA, 23 bp, Homo sapiens
taactgccatcaagatgagagaa

SEQ ID NO: 2795028 - DNA, 16 bp, Homo sapiens
taactgtatgtgtctt

SEQ ID NO: 2795029 - DNA, 16 bp, Homo sapiens
taactgtgtgaagaaa

SEQ ID NO: 2795030 - DNA, 16 bp, Homo sapiens
taacttaatagtattt

SEQ ID NO: 2795031 - DNA, 19 bp, Homo sapiens
taacttgtcctatgtcaat

SEQ ID NO: 2795032 - DNA, 21 bp, Homo sapiens
taactttatcacattatttgc

SEQ ID NO: 2795033 - DNA, 19 bp, Homo sapiens
taactttcattaaagcatt

SEQ ID NO: 2795034 - DNA, 16 bp, Homo sapiens
taagaaaacatcactg

SEQ ID NO: 2795035 - DNA, 14 bp, Homo sapiens
taagacttgacagt

SEQ ID NO: 2795036 - DNA, 13 bp, Homo sapiens
taagagaaagaaa

SEQ ID NO: 2795037 - DNA, 14 bp, Homo sapiens
taagagaagtagaa

SEQ ID NO: 2795038 - DNA, 20 bp, Homo sapiens
taagagaagtagaaatcata

SEQ ID NO: 2795039 - DNA, 16 bp, Homo sapiens
taagagctagcgctgc

SEQ ID NO: 2795040 - DNA, 15 bp, Homo sapiens
taagaggcagggtct

SEQ ID NO: 2795041 - DNA, 22 bp, Homo sapiens
taagaggcagggtctcactctg

SEQ ID NO: 2795042 - DNA, 18 bp, Homo sapiens
taagaggcgacttcctct

SEQ ID NO: 2795043 - DNA, 15 bp, Homo sapiens
taagagttgtatgaa

SEQ ID NO: 2795044 - DNA, 17 bp, Homo sapiens
taagattaaaggaagga

SEQ ID NO: 2795045 - DNA, 18 bp, Homo sapiens
taagattaaaggaaggaa

SEQ ID NO: 2795046 - DNA, 14 bp, Homo sapiens
taagcagcctttct

SEQ ID NO: 2795047 - DNA, 20 bp, Homo sapiens
taagcatgatcttgttaatg

SEQ ID NO: 2795048 - DNA, 23 bp, Homo sapiens
taagcattcttagactagttgaa

SEQ ID NO: 2795049 - DNA, 14 bp, Homo sapiens
taagcctccattta

SEQ ID NO: 2795050 - DNA, 19 bp, Homo sapiens
taagcctccatttagttct

SEQ ID NO: 2795051 - DNA, 15 bp, Homo sapiens
taagcctgttgagac

SEQ ID NO: 2795052 - DNA, 16 bp, Homo sapiens
taagcctgttgagact

SEQ ID NO: 2795053 - DNA, 18 bp, Homo sapiens
taagctgcagcttcctgt

SEQ ID NO: 2795054 - DNA, 16 bp, Homo sapiens
taagctgctctattgt

SEQ ID NO: 2795055 - DNA, 16 bp, Homo sapiens
taagctgtttccatag

SEQ ID NO: 2795056 - DNA, 16 bp, Homo sapiens
taagcttatgtcagac

SEQ ID NO: 2795057 - DNA, 18 bp, Homo sapiens
taagcttatttaattaaa

SEQ ID NO: 2795058 - DNA, 20 bp, Homo sapiens
taaggaactggaacacacat

SEQ ID NO: 2795059 - DNA, 23 bp, Homo sapiens
taaggaactggaacacacatgtc

SEQ ID NO: 2795060 - DNA, 15 bp, Homo sapiens
taaggaattgaagat

SEQ ID NO: 2795061 - DNA, 17 bp, Homo sapiens
taaggaattgaagatag

SEQ ID NO: 2795062 - DNA, 20 bp, Homo sapiens
taaggatggagccagctctg

SEQ ID NO: 2795063 - DNA, 15 bp, Homo sapiens
taaggattgtgatat

SEQ ID NO: 2795064 - DNA, 22 bp, Homo sapiens
taagggctggtctctgctgaag

SEQ ID NO: 2795065 - DNA, 19 bp, Homo sapiens
taaggtaatttctgtgtat

SEQ ID NO: 2795066 - DNA, 23 bp, Homo sapiens
taaggtaatttctgtgtattttg

SEQ ID NO: 2795067 - DNA, 19 bp, Homo sapiens
taaggtacaagaagcattt

SEQ ID NO: 2795068 - DNA, 18 bp, Homo sapiens
taaggtagaacctcacct

SEQ ID NO: 2795069 - DNA, 23 bp, Homo sapiens
taagtaattatcgggaacagtgt

SEQ ID NO: 2795070 - DNA, 21 bp, Homo sapiens
taagtaattgcatttctgctc

SEQ ID NO: 2795071 - DNA, 14 bp, Homo sapiens
taagtactgtgtac

SEQ ID NO: 2795072 - DNA, 20 bp, Homo sapiens
taagtagaataaagaaaaac

SEQ ID NO: 2795073 - DNA, 13 bp, Homo sapiens
taagtatatagta

SEQ ID NO: 2795074 - DNA, 20 bp, Homo sapiens
taagtatttaggtttttgtt

SEQ ID NO: 2795075 - DNA, 19 bp, Homo sapiens
taagtatttatatatttat

SEQ ID NO: 2795076 - DNA, 15 bp, Homo sapiens
taagtctctgactct

SEQ ID NO: 2795077 - DNA, 15 bp, Homo sapiens
taagtgctttgtaat

SEQ ID NO: 2795078 - DNA, 16 bp, Homo sapiens
taagtggaaaaaagag

SEQ ID NO: 2795079 - DNA, 20 bp, Homo sapiens
taagtggggttgcaaccact

SEQ ID NO: 2795080 - DNA, 21 bp, Homo sapiens
taagtggggttgcaaccactg

SEQ ID NO: 2795081 - DNA, 14 bp, Homo sapiens
taagttacttcact

SEQ ID NO: 2795082 - DNA, 13 bp, Homo sapiens
taagtttgatcaa

SEQ ID NO: 2795083 - DNA, 15 bp, Homo sapiens
taataaaaaatggaa

SEQ ID NO: 2795084 - DNA, 20 bp, Homo sapiens
taataaaaaatggaaagaat

SEQ ID NO: 2795085 - DNA, 21 bp, Homo sapiens
taataaaaaatggaaagaatc

SEQ ID NO: 2795086 - DNA, 12 bp, Homo sapiens
taataaaattga

SEQ ID NO: 2795087 - DNA, 22 bp, Homo sapiens
taataaacatccttcaagaact

SEQ ID NO: 2795088 - DNA, 14 bp, Homo sapiens
taataaactctcta

SEQ ID NO: 2795089 - DNA, 21 bp, Homo sapiens
taataactagatctcctgtaa

SEQ ID NO: 2795090 - DNA, 15 bp, Homo sapiens
taatacctctgtgtg

SEQ ID NO: 2795091 - DNA, 15 bp, Homo sapiens
taatagcaaagaatt

SEQ ID NO: 2795092 - DNA, 14 bp, Homo sapiens
taatataaagttgg

SEQ ID NO: 2795093 - DNA, 19 bp, Homo sapiens
taatataaagttggatgcg

SEQ ID NO: 2795094 - DNA, 16 bp, Homo sapiens
taatatactatattta

SEQ ID NO: 2795095 - DNA, 12 bp, Homo sapiens
taatatcctaaa

SEQ ID NO: 2795096 - DNA, 14 bp, Homo sapiens
taatatcctaaaca

SEQ ID NO: 2795097 - DNA, 21 bp, Homo sapiens
taatatctgagaagtgtatat

SEQ ID NO: 2795098 - DNA, 18 bp, Homo sapiens
taatatcttgaagaatat

SEQ ID NO: 2795099 - DNA, 19 bp, Homo sapiens
taatatgttcattaaattt

SEQ ID NO: 2795100 - DNA, 14 bp, Homo sapiens
taatcagcctctta

SEQ ID NO: 2795101 - DNA, 20 bp, Homo sapiens
taatcaggttgttaatgttg

SEQ ID NO: 2795102 - DNA, 18 bp, Homo sapiens
taatcccagctacacctg

SEQ ID NO: 2795103 - DNA, 14 bp, Homo sapiens
taatcccagctact

SEQ ID NO: 2795104 - DNA, 18 bp, Homo sapiens
taatcgagtctacctctt

SEQ ID NO: 2795105 - DNA, 16 bp, Homo sapiens
taatcggcccacagct

SEQ ID NO: 2795106 - DNA, 16 bp, Homo sapiens
taatcgttatgtgtgt

SEQ ID NO: 2795107 - DNA, 19 bp, Homo sapiens
taatctggactcctctgtc

SEQ ID NO: 2795108 - DNA, 20 bp, Homo sapiens
taatctggactcctctgtcc

SEQ ID NO: 2795109 - DNA, 17 bp, Homo sapiens
taatctgtagggctgga

SEQ ID NO: 2795110 - DNA, 13 bp, Homo sapiens
taatcttcagttt

SEQ ID NO: 2795111 - DNA, 22 bp, Homo sapiens
taatctttgggtaacttcaaaa

SEQ ID NO: 2795112 - DNA, 15 bp, Homo sapiens
taatgaaaatgtcag

SEQ ID NO: 2795113 - DNA, 16 bp, Homo sapiens
tacactccagcctgag

SEQ ID NO: 2795114 - DNA, 18 bp, Homo sapiens
tacagaattctgctacct

SEQ ID NO: 2795115 - DNA, 21 bp, Homo sapiens
tacagaatttttaatgacttt

SEQ ID NO: 2795116 - DNA, 13 bp, Homo sapiens
tacagacactaag

SEQ ID NO: 2795117 - DNA, 18 bp, Homo sapiens
tacagacactaagttata

SEQ ID NO: 2795118 - DNA, 13 bp, Homo sapiens
tacagacgtatgc

SEQ ID NO: 2795119 - DNA, 16 bp, Homo sapiens
tacagacgtatgctta

SEQ ID NO: 2795120 - DNA, 13 bp, Homo sapiens
tacagataattta

SEQ ID NO: 2795121 - DNA, 18 bp, Homo sapiens
tacagcaacaggaatctc

SEQ ID NO: 2795122 - DNA, 13 bp, Homo sapiens
tacagccagaagc

SEQ ID NO: 2795123 - DNA, 21 bp, Homo sapiens
tacagcctcagaggcagcagg

SEQ ID NO: 2795124 - DNA, 14 bp, Homo sapiens
tacagcgagaggca

SEQ ID NO: 2795125 - DNA, 13 bp, Homo sapiens
tacagctgcctgc

SEQ ID NO: 2795126 - DNA, 18 bp, Homo sapiens
tacaggaaaagctgctga

SEQ ID NO: 2795127 - DNA, 19 bp, Homo sapiens
tacagggtagataacctgt

SEQ ID NO: 2795128 - DNA, 22 bp, Homo sapiens
tacagggtagcaggtaccactg

SEQ ID NO: 2795129 - DNA, 20 bp, Homo sapiens
tacagtaaagtttaaaaaat

SEQ ID NO: 2795130 - DNA, 21 bp, Homo sapiens
tacagtaagctgctctattgt

SEQ ID NO: 2795131 - DNA, 20 bp, Homo sapiens
tacagtagcttaaataaatt

SEQ ID NO: 2795132 - DNA, 21 bp, Homo sapiens
tacagtagcttaaataaattc

SEQ ID NO: 2795133 - DNA, 19 bp, Homo sapiens
tacagtcttcttacttgga

SEQ ID NO: 2795134 - DNA, 20 bp, Homo sapiens
tacagttgttttttgaaaac

SEQ ID NO: 2795135 - DNA, 21 bp, Homo sapiens
tacataaaggtggtatgtgtg

SEQ ID NO: 2795136 - DNA, 22 bp, Homo sapiens
tacataacttgatatagaaagc

SEQ ID NO: 2795137 - DNA, 14 bp, Homo sapiens
tacatacctctctc

SEQ ID NO: 2795138 - DNA, 14 bp, Homo sapiens
tacatatcagaaaa

SEQ ID NO: 2795139 - DNA, 17 bp, Homo sapiens
tacatatcagaaaagta

SEQ ID NO: 2795140 - DNA, 22 bp, Homo sapiens
tacatatcagaaaagtagaatt

SEQ ID NO: 2795141 - DNA, 13 bp, Homo sapiens
tacatatgaaatt

SEQ ID NO: 2795142 - DNA, 15 bp, Homo sapiens
tacatatgtaaaata

SEQ ID NO: 2795143 - DNA, 16 bp, Homo sapiens
tacatattataaataa

SEQ ID NO: 2795144 - DNA, 14 bp, Homo sapiens
tacatccagaaaga

SEQ ID NO: 2795145 - DNA, 13 bp, Homo sapiens
tacatgaaacaga

SEQ ID NO: 2795146 - DNA, 14 bp, Homo sapiens
tacatgaaacagaa

SEQ ID NO: 2795147 - DNA, 20 bp, Homo sapiens
tacatgcattactgcatgca

SEQ ID NO: 2795148 - DNA, 17 bp, Homo sapiens
tacatgctaagagaagt

SEQ ID NO: 2795149 - DNA, 19 bp, Homo sapiens
tacatgctaagagaagtag

SEQ ID NO: 2795150 - DNA, 13 bp, Homo sapiens
tacatggtattgt

SEQ ID NO: 2795151 - DNA, 14 bp, Homo sapiens
tacatgtatagtga

SEQ ID NO: 2795152 - DNA, 16 bp, Homo sapiens
tacatgtatagtgagt

SEQ ID NO: 2795153 - DNA, 19 bp, Homo sapiens
tacatgtgtagcctgtgca

SEQ ID NO: 2795154 - DNA, 19 bp, Homo sapiens
tacatgtgtagggaaagtt

SEQ ID NO: 2795155 - DNA, 12 bp, Homo sapiens
tacatgtgtgga

SEQ ID NO: 2795156 - DNA, 22 bp, Homo sapiens
tacatgtttgcacctttctagt

SEQ ID NO: 2795157 - DNA, 19 bp, Homo sapiens
tacattccctatcaaaaca

SEQ ID NO: 2795158 - DNA, 14 bp, Homo sapiens
tacattccctggcc

SEQ ID NO: 2795159 - DNA, 14 bp, Homo sapiens
tacattttatttat

SEQ ID NO: 2795160 - DNA, 14 bp, Homo sapiens
taccaaatataaac

SEQ ID NO: 2795161 - DNA, 16 bp, Homo sapiens
taccaaatataaactt

SEQ ID NO: 2795162 - DNA, 18 bp, Homo sapiens
taccaaatataaacttgt

SEQ ID NO: 2795163 - DNA, 23 bp, Homo sapiens
taccaaatataaacttgtgtatg

SEQ ID NO: 2795164 - DNA, 14 bp, Homo sapiens
taccacagtgtctg

SEQ ID NO: 2795165 - DNA, 17 bp, Homo sapiens
taccaccccttcctgtc

SEQ ID NO: 2795166 - DNA, 17 bp, Homo sapiens
taccagagggaacacgg

SEQ ID NO: 2795167 - DNA, 19 bp, Homo sapiens
taccagctcactccctggg

SEQ ID NO: 2795168 - DNA, 21 bp, Homo sapiens
taccaggcaccaaaagaagta

SEQ ID NO: 2795169 - DNA, 11 bp, Homo sapiens
taccagtgtgg

SEQ ID NO: 2795170 - DNA, 16 bp, Homo sapiens
taccatcaataaagta

SEQ ID NO: 2795171 - DNA, 14 bp, Homo sapiens
taccatctgctgcc

SEQ ID NO: 2795172 - DNA, 14 bp, Homo sapiens
taccatgttaaaga

SEQ ID NO: 2795173 - DNA, 15 bp, Homo sapiens
taccatttcagagag

SEQ ID NO: 2795174 - DNA, 13 bp, Homo sapiens
tacccaaccactc

SEQ ID NO: 2795175 - DNA, 14 bp, Homo sapiens
tacccactcctcac

SEQ ID NO: 2795176 - DNA, 17 bp, Homo sapiens
tacccagagccttctcc

SEQ ID NO: 2795177 - DNA, 22 bp, Homo sapiens
tacccagagccttctcctgcct

SEQ ID NO: 2795178 - DNA, 18 bp, Homo sapiens
tacccagcgagccctggt

SEQ ID NO: 2795179 - DNA, 19 bp, Homo sapiens
tacccagtaactcatctgt

SEQ ID NO: 2795180 - DNA, 16 bp, Homo sapiens
taccccaagtccacct

SEQ ID NO: 2795181 - DNA, 19 bp, Homo sapiens
taccccaagtccacctgcc

SEQ ID NO: 2795182 - DNA, 17 bp, Homo sapiens
taccccacctcatgcct

SEQ ID NO: 2795183 - DNA, 18 bp, Homo sapiens
taccccacctcatgcctg

SEQ ID NO: 2795184 - DNA, 21 bp, Homo sapiens
tacccccgtggtctttgaata

SEQ ID NO: 2795185 - DNA, 13 bp, Homo sapiens
tacccggcccaga

SEQ ID NO: 2795186 - DNA, 21 bp, Homo sapiens
tacccttctttaaatcaaaag

SEQ ID NO: 2795187 - DNA, 19 bp, Homo sapiens
tacctaaacagatataaat

SEQ ID NO: 2795188 - DNA, 16 bp, Homo sapiens
tacctaccacagtgtc

SEQ ID NO: 2795189 - DNA, 15 bp, Homo sapiens
tacctcactggggtc

SEQ ID NO: 2795190 - DNA, 11 bp, Homo sapiens
tacctcagcct

SEQ ID NO: 2795191 - DNA, 21 bp, Homo sapiens
tacctctcttatagaatattt

SEQ ID NO: 2795192 - DNA, 15 bp, Homo sapiens
tacctctgatacctc

SEQ ID NO: 2795193 - DNA, 21 bp, Homo sapiens
tacctctttgtcagtctgggt

SEQ ID NO: 2795194 - DNA, 21 bp, Homo sapiens
gtgcacatgcacgtgtgtgca

SEQ ID NO: 2795195 - DNA, 15 bp, Homo sapiens
gtgcacggcagcttg

SEQ ID NO: 2795196 - DNA, 15 bp, Homo sapiens
gtgcacggccagctg

SEQ ID NO: 2795197 - DNA, 21 bp, Homo sapiens
gtgcagaggtgagcagaggag

SEQ ID NO: 2795198 - DNA, 23 bp, Homo sapiens
gtgcagggaggaggtggcagccc

SEQ ID NO: 2795199 - DNA, 13 bp, Homo sapiens
gtgcatgctctct

SEQ ID NO: 2795200 - DNA, 15 bp, Homo sapiens
gtgcatgctctctgc

SEQ ID NO: 2795201 - DNA, 18 bp, Homo sapiens
gtgcatgctctctgcagc

SEQ ID NO: 2795202 - DNA, 21 bp, Homo sapiens
gtgcatgttgccatgaggcct

SEQ ID NO: 2795203 - DNA, 13 bp, Homo sapiens
gtgcatttctgtc

SEQ ID NO: 2795204 - DNA, 17 bp, Homo sapiens
gtgcattttcccagata

SEQ ID NO: 2795205 - DNA, 21 bp, Homo sapiens
gtgccaagtccaggtcctggt

SEQ ID NO: 2795206 - DNA, 14 bp, Homo sapiens
gtgccagagcctgg

SEQ ID NO: 2795207 - DNA, 18 bp, Homo sapiens
taaagttgtttgtgcctt

SEQ ID NO: 2795208 - DNA, 13 bp, Homo sapiens
taaagtttaaaaa

SEQ ID NO: 2795209 - DNA, 15 bp, Homo sapiens
taaagtttaaaaaat

SEQ ID NO: 2795210 - DNA, 19 bp, Homo sapiens
taaataaaagcagcatctg

SEQ ID NO: 2795211 - DNA, 14 bp, Homo sapiens
taaataaatgccaa

SEQ ID NO: 2795212 - DNA, 19 bp, Homo sapiens
taaataaatgccaacatac

SEQ ID NO: 2795213 - DNA, 13 bp, Homo sapiens
taaataaattcaa

SEQ ID NO: 2795214 - DNA, 15 bp, Homo sapiens
taaataagaaacttt

SEQ ID NO: 2795215 - DNA, 12 bp, Homo sapiens
taaatacatgtg

SEQ ID NO: 2795216 - DNA, 13 bp, Homo sapiens
taaatacatgtgt

SEQ ID NO: 2795217 - DNA, 15 bp, Homo sapiens
taaatacatgtgtgg

SEQ ID NO: 2795218 - DNA, 22 bp, Homo sapiens
taaatacctcaacctatggtat

SEQ ID NO: 2795219 - DNA, 17 bp, Homo sapiens
taaatagcatctgctct

SEQ ID NO: 2795220 - DNA, 12 bp, Homo sapiens
taaatagtattt

SEQ ID NO: 2795221 - DNA, 13 bp, Homo sapiens
taaatagtatttc

SEQ ID NO: 2795222 - DNA, 15 bp, Homo sapiens
taaatagttttaaat

SEQ ID NO: 2795223 - DNA, 18 bp, Homo sapiens
taaatagttttaaatatg

SEQ ID NO: 2795224 - DNA, 15 bp, Homo sapiens
taaatataattggga

SEQ ID NO: 2795225 - DNA, 18 bp, Homo sapiens
taaatataattgggattt

SEQ ID NO: 2795226 - DNA, 17 bp, Homo sapiens
taaatatatttaagata

SEQ ID NO: 2795227 - DNA, 14 bp, Homo sapiens
taaatatgaaatga

SEQ ID NO: 2795228 - DNA, 21 bp, Homo sapiens
taaatatgaaatgataaagat

SEQ ID NO: 2795229 - DNA, 17 bp, Homo sapiens
taaatatttacatatga

SEQ ID NO: 2795230 - DNA, 19 bp, Homo sapiens
taaatatttacatatgaaa

SEQ ID NO: 2795231 - DNA, 20 bp, Homo sapiens
taaatcaaaagctgcttgac

SEQ ID NO: 2795232 - DNA, 15 bp, Homo sapiens
taaatcaactccagc

SEQ ID NO: 2795233 - DNA, 16 bp, Homo sapiens
taaatcacgctttttg

SEQ ID NO: 2795234 - DNA, 19 bp, Homo sapiens
taaatcacgctttttgaaa

SEQ ID NO: 2795235 - DNA, 14 bp, Homo sapiens
taaatcattaatac

SEQ ID NO: 2795236 - DNA, 14 bp, Homo sapiens
taaatctaatcagg

SEQ ID NO: 2795237 - DNA, 16 bp, Homo sapiens
taaatcttccttgtga

SEQ ID NO: 2795238 - DNA, 23 bp, Homo sapiens
taaatcttttataggatttattt

SEQ ID NO: 2795239 - DNA, 16 bp, Homo sapiens
taaatgaatcttactc

SEQ ID NO: 2795240 - DNA, 13 bp, Homo sapiens
taaatgaatgttt

SEQ ID NO: 2795241 - DNA, 14 bp, Homo sapiens
taaatgagctcctg

SEQ ID NO: 2795242 - DNA, 16 bp, Homo sapiens
taaatgagctcctgcg

SEQ ID NO: 2795243 - DNA, 20 bp, Homo sapiens
taaatgcaaacactgtgtat

SEQ ID NO: 2795244 - DNA, 21 bp, Homo sapiens
taaatgcatgattttatacat

SEQ ID NO: 2795245 - DNA, 23 bp, Homo sapiens
taaatgcatgattttatacatag

SEQ ID NO: 2795246 - DNA, 14 bp, Homo sapiens
taaatgcctaataa

SEQ ID NO: 2795247 - DNA, 15 bp, Homo sapiens
taaatggagcttgta

SEQ ID NO: 2795248 - DNA, 21 bp, Homo sapiens
taaatggagcttgtacatatt

SEQ ID NO: 2795249 - DNA, 17 bp, Homo sapiens
taaatggtcgcccagga

SEQ ID NO: 2795250 - DNA, 22 bp, Homo sapiens
taaatgtctctttaatgtcaca

SEQ ID NO: 2795251 - DNA, 12 bp, Homo sapiens
taaatgtgtggt

SEQ ID NO: 2795252 - DNA, 20 bp, Homo sapiens
taaatgttggaattttcaaa

SEQ ID NO: 2795253 - DNA, 17 bp, Homo sapiens
taaattataacttaaaa

SEQ ID NO: 2795254 - DNA, 21 bp, Homo sapiens
taaattcaaaccatttaattc

SEQ ID NO: 2795255 - DNA, 17 bp, Homo sapiens
taaattcacaatagaaa

SEQ ID NO: 2795256 - DNA, 22 bp, Homo sapiens
taaattctctctcttgcaggaa

SEQ ID NO: 2795257 - DNA, 16 bp, Homo sapiens
taaattctttttcaaa

SEQ ID NO: 2795258 - DNA, 17 bp, Homo sapiens
taaattctttttcaaaa

SEQ ID NO: 2795259 - DNA, 18 bp, Homo sapiens
taaattctttttcaaaaa

SEQ ID NO: 2795260 - DNA, 17 bp, Homo sapiens
taaattggtgataagtg

SEQ ID NO: 2795261 - DNA, 21 bp, Homo sapiens
taaattggtgataagtggaaa

SEQ ID NO: 2795262 - DNA, 22 bp, Homo sapiens
taaattggtgataagtggaaaa

SEQ ID NO: 2795263 - DNA, 13 bp, Homo sapiens
taaatttggattt

SEQ ID NO: 2795264 - DNA, 13 bp, Homo sapiens
taacaaaatcaca

SEQ ID NO: 2795265 - DNA, 14 bp, Homo sapiens
taacaaaatcacaa

SEQ ID NO: 2795266 - DNA, 12 bp, Homo sapiens
taacaaattatg

SEQ ID NO: 2795267 - DNA, 17 bp, Homo sapiens
taacaagatctttcagg

SEQ ID NO: 2795268 - DNA, 18 bp, Homo sapiens
taacaagatctttcagga

SEQ ID NO: 2795269 - DNA, 14 bp, Homo sapiens
taacaaggttcttc

SEQ ID NO: 2795270 - DNA, 18 bp, Homo sapiens
taacacataactagaaac

SEQ ID NO: 2795271 - DNA, 14 bp, Homo sapiens
taacactcagaagc

SEQ ID NO: 2795272 - DNA, 14 bp, Homo sapiens
taacagggaaggca

SEQ ID NO: 2795273 - DNA, 23 bp, Homo sapiens
taacagggaaggcaggcagggct

SEQ ID NO: 2795274 - DNA, 13 bp, Homo sapiens
taacaggtctcct

SEQ ID NO: 2795275 - DNA, 14 bp, Homo sapiens
taacaggtctcctc

SEQ ID NO: 2795276 - DNA, 15 bp, Homo sapiens
taacaggtctcctct

SEQ ID NO: 2795277 - DNA, 18 bp, Homo sapiens
taacaggtctcctcttaa

SEQ ID NO: 2795278 - DNA, 23 bp, Homo sapiens
taacatcatcaggcttggaatga

SEQ ID NO: 2795279 - DNA, 17 bp, Homo sapiens
taacattaacatctatt

SEQ ID NO: 2795280 - DNA, 19 bp, Homo sapiens
taaccacttaaaaaatgtc

SEQ ID NO: 2795281 - DNA, 20 bp, Homo sapiens
taaccacttaaaaaatgtcc

SEQ ID NO: 2795282 - DNA, 17 bp, Homo sapiens
taaccatcagttactgg

SEQ ID NO: 2795283 - DNA, 19 bp, Homo sapiens
taacccatttttgagccaa

SEQ ID NO: 2795284 - DNA, 19 bp, Homo sapiens
taacccccagtgccacaga

SEQ ID NO: 2795285 - DNA, 20 bp, Homo sapiens
taacccccagtgccacagag

SEQ ID NO: 2795286 - DNA, 15 bp, Homo sapiens
taaccctctcttccc

SEQ ID NO: 2795287 - DNA, 16 bp, Homo sapiens
taaccgtttttcaaga

SEQ ID NO: 2795288 - DNA, 17 bp, Homo sapiens
taaccgtttttcaagaa

SEQ ID NO: 2795289 - DNA, 21 bp, Homo sapiens
taaccttaccagatttttaca

SEQ ID NO: 2795290 - DNA, 15 bp, Homo sapiens
taacgtaaatacaca

SEQ ID NO: 2795291 - DNA, 12 bp, Homo sapiens
taactaatttaa

SEQ ID NO: 2795292 - DNA, 16 bp, Homo sapiens
taactaatttaaacca

SEQ ID NO: 2795293 - DNA, 17 bp, Homo sapiens
taactacaaattatcat

SEQ ID NO: 2795294 - DNA, 17 bp, Homo sapiens
taactactttttatact

SEQ ID NO: 2795295 - DNA, 19 bp, Homo sapiens
taactactttttatactcc

SEQ ID NO: 2795296 - DNA, 18 bp, Homo sapiens
taactagaatttattcaa

SEQ ID NO: 2795297 - DNA, 13 bp, Homo sapiens
taactagatctcc

SEQ ID NO: 2795298 - DNA, 17 bp, Homo sapiens
taactagatctcctgta

SEQ ID NO: 2795299 - DNA, 14 bp, Homo sapiens
taactcatctgtca

SEQ ID NO: 2795300 - DNA, 19 bp, Homo sapiens
ggaagaaattcctgtagca

SEQ ID NO: 2795301 - DNA, 23 bp, Homo sapiens
ggaagaaattcctgtagcatctt

SEQ ID NO: 2795302 - DNA, 18 bp, Homo sapiens
ggaagacgcaagggcctg

SEQ ID NO: 2795303 - DNA, 13 bp, Homo sapiens
ggaagagaaacca

SEQ ID NO: 2795304 - DNA, 15 bp, Homo sapiens
ggaagagaaattttt

SEQ ID NO: 2795305 - DNA, 14 bp, Homo sapiens
ggaagagcaggcac

SEQ ID NO: 2795306 - DNA, 18 bp, Homo sapiens
ggaagattttaaattcac

SEQ ID NO: 2795307 - DNA, 17 bp, Homo sapiens
ggaagcacagcttcatt

SEQ ID NO: 2795308 - DNA, 12 bp, Homo sapiens
ggaagcagtgcc

SEQ ID NO: 2795309 - DNA, 20 bp, Homo sapiens
ggaagcatgtaggagaatcc

SEQ ID NO: 2795310 - DNA, 15 bp, Homo sapiens
ggaagccaggctgag

SEQ ID NO: 2795311 - DNA, 16 bp, Homo sapiens
ggaagcccaaggcagt

SEQ ID NO: 2795312 - DNA, 22 bp, Homo sapiens
ggaagctgggggaagggtggtc

SEQ ID NO: 2795313 - DNA, 18 bp, Homo sapiens
ggaaggaactctggcttc

SEQ ID NO: 2795314 - DNA, 15 bp, Homo sapiens
ggaaggagactcacc

SEQ ID NO: 2795315 - DNA, 20 bp, Homo sapiens
ggaaggagactcacctctgc

SEQ ID NO: 2795316 - DNA, 13 bp, Homo sapiens
ggaaggagtgaga

SEQ ID NO: 2795317 - DNA, 12 bp, Homo sapiens
ggaaggcaggca

SEQ ID NO: 2795318 - DNA, 13 bp, Homo sapiens
ggaaggctgctgt

SEQ ID NO: 2795319 - DNA, 15 bp, Homo sapiens
ggaaggctgctgtgt

SEQ ID NO: 2795320 - DNA, 14 bp, Homo sapiens
ggaaggctggctgg

SEQ ID NO: 2795321 - DNA, 14 bp, Homo sapiens
ggaagggcaaaacc

SEQ ID NO: 2795322 - DNA, 12 bp, Homo sapiens
ggaagggccagt

SEQ ID NO: 2795323 - DNA, 16 bp, Homo sapiens
ggaagggggtccaccc

SEQ ID NO: 2795324 - DNA, 15 bp, Homo sapiens
ggaaggtagcccagc

SEQ ID NO: 2795325 - DNA, 17 bp, Homo sapiens
ggaagtgttccctgaga

SEQ ID NO: 2795326 - DNA, 15 bp, Homo sapiens
ggaagtttctgggtg

SEQ ID NO: 2795327 - DNA, 18 bp, Homo sapiens
ggaagttttgcatttatg

SEQ ID NO: 2795328 - DNA, 21 bp, Homo sapiens
ggaagttttgtggaggagctc

SEQ ID NO: 2795329 - DNA, 12 bp, Homo sapiens
ggagagcccagc

SEQ ID NO: 2795330 - DNA, 12 bp, Homo sapiens
ggagaggctgtg

SEQ ID NO: 2795331 - DNA, 14 bp, Homo sapiens
ggagaggggcagaa

SEQ ID NO: 2795332 - DNA, 17 bp, Homo sapiens
ggagagggtctggagaa

SEQ ID NO: 2795333 - DNA, 20 bp, Homo sapiens
ggagagtacagtgagccaag

SEQ ID NO: 2795334 - DNA, 22 bp, Homo sapiens
ggagatatttatggggggagaa

SEQ ID NO: 2795335 - DNA, 13 bp, Homo sapiens
ggagatggagttc

SEQ ID NO: 2795336 - DNA, 23 bp, Homo sapiens
ggagcaaagcctgttcatggcag

SEQ ID NO: 2795337 - DNA, 18 bp, Homo sapiens
ggagcaaatgtttctgca

SEQ ID NO: 2795338 - DNA, 13 bp, Homo sapiens
ggagcactggagt

SEQ ID NO: 2795339 - DNA, 12 bp, Homo sapiens
ggagcagtgtct

SEQ ID NO: 2795340 - DNA, 17 bp, Homo sapiens
ggagcagtgtcttccat

SEQ ID NO: 2795341 - DNA, 20 bp, Homo sapiens
ggagccaacagaagcttcca

SEQ ID NO: 2795342 - DNA, 14 bp, Homo sapiens
ggagccaacagcag

SEQ ID NO: 2795343 - DNA, 15 bp, Homo sapiens
ggagcccagaaaacc

SEQ ID NO: 2795344 - DNA, 23 bp, Homo sapiens
ggagcctaccccctgaaagtgac

SEQ ID NO: 2795345 - DNA, 21 bp, Homo sapiens
ggagcctcatccgaggcaggg

SEQ ID NO: 2795346 - DNA, 20 bp, Homo sapiens
ggagcctcggtggccatgct

SEQ ID NO: 2795347 - DNA, 14 bp, Homo sapiens
ggagcctgtgaacc

SEQ ID NO: 2795348 - DNA, 13 bp, Homo sapiens
ggagcggctctcc

SEQ ID NO: 2795349 - DNA, 22 bp, Homo sapiens
ggagctacctgtgtggacagga

SEQ ID NO: 2795350 - DNA, 12 bp, Homo sapiens
ggagctgcctgt

SEQ ID NO: 2795351 - DNA, 21 bp, Homo sapiens
ggagctgcctgttcagctcca

SEQ ID NO: 2795352 - DNA, 18 bp, Homo sapiens
ggagctggttagaaatgc

SEQ ID NO: 2795353 - DNA, 22 bp, Homo sapiens
ggaggacagtgggaactggagg

SEQ ID NO: 2795354 - DNA, 13 bp, Homo sapiens
ggaggacctgagc

SEQ ID NO: 2795355 - DNA, 14 bp, Homo sapiens
ggaggacctgagcc

SEQ ID NO: 2795356 - DNA, 15 bp, Homo sapiens
ggaggacctgagcct

SEQ ID NO: 2795357 - DNA, 16 bp, Homo sapiens
ggaggagaccagctca

SEQ ID NO: 2795358 - DNA, 18 bp, Homo sapiens
ggaggagaccagctcaga

SEQ ID NO: 2795359 - DNA, 17 bp, Homo sapiens
ggaggagcttgggggat

SEQ ID NO: 2795360 - DNA, 20 bp, Homo sapiens
ggaggaggtggcagccctgt

SEQ ID NO: 2795361 - DNA, 17 bp, Homo sapiens
ggaggatcactggagcc

SEQ ID NO: 2795362 - DNA, 20 bp, Homo sapiens
ggaggatcactggagcccag

SEQ ID NO: 2795363 - DNA, 21 bp, Homo sapiens
ggaggatcactggagcccagg

SEQ ID NO: 2795364 - DNA, 13 bp, Homo sapiens
ggaggatggagag

SEQ ID NO: 2795365 - DNA, 19 bp, Homo sapiens
ggaggcagggccttgccca

SEQ ID NO: 2795366 - DNA, 21 bp, Homo sapiens
ggaggcagggccttgcccaga

SEQ ID NO: 2795367 - DNA, 14 bp, Homo sapiens
ggaggcatctgcac

SEQ ID NO: 2795368 - DNA, 21 bp, Homo sapiens
ggaggcggcacattggcagtg

SEQ ID NO: 2795369 - DNA, 14 bp, Homo sapiens
ggaggctgagacag

SEQ ID NO: 2795370 - DNA, 15 bp, Homo sapiens
ggaggctgagacagg

SEQ ID NO: 2795371 - DNA, 19 bp, Homo sapiens
ggaggctgagacaggagaa

SEQ ID NO: 2795372 - DNA, 14 bp, Homo sapiens
ggaggctgaggcag

SEQ ID NO: 2795373 - DNA, 18 bp, Homo sapiens
ggaggctgaggcagaaga

SEQ ID NO: 2795374 - DNA, 19 bp, Homo sapiens
ggaggctggtctccctcca

SEQ ID NO: 2795375 - DNA, 17 bp, Homo sapiens
ggagggacaaaggagcc

SEQ ID NO: 2795376 - DNA, 18 bp, Homo sapiens
ggagggacaaaggagcct

SEQ ID NO: 2795377 - DNA, 20 bp, Homo sapiens
ggagggacaaaggagcctgt

SEQ ID NO: 2795378 - DNA, 21 bp, Homo sapiens
ggagggacaaaggagcctgtg

SEQ ID NO: 2795379 - DNA, 14 bp, Homo sapiens
ggagggacaagaat

SEQ ID NO: 2795380 - DNA, 21 bp, Homo sapiens
ggagggatgctgcctgagtca

SEQ ID NO: 2795381 - DNA, 20 bp, Homo sapiens
ggaggggactatttatgaag

SEQ ID NO: 2795382 - DNA, 22 bp, Homo sapiens
ggaggtcttggccgactcaggg

SEQ ID NO: 2795383 - DNA, 17 bp, Homo sapiens
ggaggtgagaccacctc

SEQ ID NO: 2795384 - DNA, 14 bp, Homo sapiens
ggaggttgcagtga

SEQ ID NO: 2795385 - DNA, 15 bp, Homo sapiens
ggagtagctgagctc

SEQ ID NO: 2795386 - DNA, 12 bp, Homo sapiens
ggagtagttgga

SEQ ID NO: 2795387 - DNA, 20 bp, Homo sapiens
ggagtcccaccttggctgca

SEQ ID NO: 2795388 - DNA, 23 bp, Homo sapiens
ggagtcccaccttggctgcaggg

SEQ ID NO: 2795389 - DNA, 11 bp, Homo sapiens
ggagtgacaga

SEQ ID NO: 2795390 - DNA, 18 bp, Homo sapiens
ggagtgacagaggcagcc

SEQ ID NO: 2795391 - DNA, 12 bp, Homo sapiens
ggagtgagctgg

SEQ ID NO: 2795392 - DNA, 15 bp, Homo sapiens
ggagtgcagtgagcc

SEQ ID NO: 2795393 - DNA, 19 bp, Homo sapiens
ggcagtccagccagctcct

SEQ ID NO: 2795394 - DNA, 13 bp, Homo sapiens
ggcagtgggagct

SEQ ID NO: 2795395 - DNA, 17 bp, Homo sapiens
ggcagtgggagctgcct

SEQ ID NO: 2795396 - DNA, 18 bp, Homo sapiens
ggcagtgggagctgcctg

SEQ ID NO: 2795397 - DNA, 19 bp, Homo sapiens
ggcagtgggagctgcctgt

SEQ ID NO: 2795398 - DNA, 15 bp, Homo sapiens
ggcagttcgcagcca

SEQ ID NO: 2795399 - DNA, 16 bp, Homo sapiens
ggcagttcgcagccac

SEQ ID NO: 2795400 - DNA, 18 bp, Homo sapiens
ggcagttcgcagccaccc

SEQ ID NO: 2795401 - DNA, 19 bp, Homo sapiens
ggcagttcgcagccaccct

SEQ ID NO: 2795402 - DNA, 22 bp, Homo sapiens
ggcagttcgcagccaccctgag

SEQ ID NO: 2795403 - DNA, 21 bp, Homo sapiens
ggcatacgcctgtagtcctag

SEQ ID NO: 2795404 - DNA, 23 bp, Homo sapiens
ggcatcacagggcagagccggga

SEQ ID NO: 2795405 - DNA, 20 bp, Homo sapiens
ggcatcagtgtccttggcag

SEQ ID NO: 2795406 - DNA, 15 bp, Homo sapiens
ggcatcccaggggac

SEQ ID NO: 2795407 - DNA, 24 bp, Homo sapiens
ggcatcccatgggggtgctgcagc

SEQ ID NO: 2795408 - DNA, 15 bp, Homo sapiens
ggcatctctaattgg

SEQ ID NO: 2795409 - DNA, 18 bp, Homo sapiens
ggcatctctaattggaag

SEQ ID NO: 2795410 - DNA, 19 bp, Homo sapiens
ggcatgcgcacaaggctga

SEQ ID NO: 2795411 - DNA, 12 bp, Homo sapiens
ggcatgctgggg

SEQ ID NO: 2795412 - DNA, 23 bp, Homo sapiens
ggcatgttctctgaggacactaa

SEQ ID NO: 2795413 - DNA, 15 bp, Homo sapiens
ggcatttcctgggtg

SEQ ID NO: 2795414 - DNA, 14 bp, Homo sapiens
ggcatttttttaaa

SEQ ID NO: 2795415 - DNA, 22 bp, Homo sapiens
ggccaagctgaggtgcccagga

SEQ ID NO: 2795416 - DNA, 16 bp, Homo sapiens
ggccaattaaaatata

SEQ ID NO: 2795417 - DNA, 17 bp, Homo sapiens
ggccaattaaaatatat

SEQ ID NO: 2795418 - DNA, 11 bp, Homo sapiens
ggccaccagga

SEQ ID NO: 2795419 - DNA, 21 bp, Homo sapiens
ggccacccgttctgctggcct

SEQ ID NO: 2795420 - DNA, 24 bp, Homo sapiens
ggccacccgttctgctggcctgga

SEQ ID NO: 2795421 - DNA, 19 bp, Homo sapiens
ggccaccgctctcctgcct

SEQ ID NO: 2795422 - DNA, 21 bp, Homo sapiens
ggccaccgggacagacctgga

SEQ ID NO: 2795423 - DNA, 12 bp, Homo sapiens
ggccactcctcc

SEQ ID NO: 2795424 - DNA, 13 bp, Homo sapiens
ggccactcctcca

SEQ ID NO: 2795425 - DNA, 15 bp, Homo sapiens
ggccactccttcctg

SEQ ID NO: 2795426 - DNA, 17 bp, Homo sapiens
ggccagagggagtgaca

SEQ ID NO: 2795427 - DNA, 20 bp, Homo sapiens
ggccagatgcaccagccctt

SEQ ID NO: 2795428 - DNA, 16 bp, Homo sapiens
ggccagcctggcctcc

SEQ ID NO: 2795429 - DNA, 23 bp, Homo sapiens
ggccagctgcatctactcaggcc

SEQ ID NO: 2795430 - DNA, 16 bp, Homo sapiens
ggccaggacaggcccg

SEQ ID NO: 2795431 - DNA, 19 bp, Homo sapiens
ggccaggcaggggtgggag

SEQ ID NO: 2795432 - DNA, 11 bp, Homo sapiens
ggccaggctgg

SEQ ID NO: 2795433 - DNA, 14 bp, Homo sapiens
ggccaggctggtct

SEQ ID NO: 2795434 - DNA, 15 bp, Homo sapiens
ggccagtctgggctg

SEQ ID NO: 2795435 - DNA, 17 bp, Homo sapiens
ggccagtctgggctgcc

SEQ ID NO: 2795436 - DNA, 16 bp, Homo sapiens
ggccagtgtgacaagg

SEQ ID NO: 2795437 - DNA, 19 bp, Homo sapiens
ggccagtgtgatcccaagt

SEQ ID NO: 2795438 - DNA, 16 bp, Homo sapiens
ggccatgctgaaggga

SEQ ID NO: 2795439 - DNA, 13 bp, Homo sapiens
ggccatgggcctc

SEQ ID NO: 2795440 - DNA, 18 bp, Homo sapiens
ggcccaaagcccagctct

SEQ ID NO: 2795441 - DNA, 23 bp, Homo sapiens
ggcccaaatccagtgtgcacccc

SEQ ID NO: 2795442 - DNA, 18 bp, Homo sapiens
ggcccacagctcccaccc

SEQ ID NO: 2795443 - DNA, 20 bp, Homo sapiens
ggcccacagctcccacccca

SEQ ID NO: 2795444 - DNA, 16 bp, Homo sapiens
ggcccagaattgcatt

SEQ ID NO: 2795445 - DNA, 17 bp, Homo sapiens
ggcccagagaccccttc

SEQ ID NO: 2795446 - DNA, 23 bp, Homo sapiens
ggcccagagaccccttcctttcc

SEQ ID NO: 2795447 - DNA, 16 bp, Homo sapiens
ggccccatgacctcca

SEQ ID NO: 2795448 - DNA, 11 bp, Homo sapiens
ggcccccacag

SEQ ID NO: 2795449 - DNA, 21 bp, Homo sapiens
ggcccccgctggctcctccag

SEQ ID NO: 2795450 - DNA, 15 bp, Homo sapiens
ggccccctccatcgg

SEQ ID NO: 2795451 - DNA, 23 bp, Homo sapiens
ggccccggtcctggccccagccc

SEQ ID NO: 2795452 - DNA, 12 bp, Homo sapiens
ggcccctgccac

SEQ ID NO: 2795453 - DNA, 16 bp, Homo sapiens
ggcccctgccaccctg

SEQ ID NO: 2795454 - DNA, 17 bp, Homo sapiens
ggcccctggtctgccct

SEQ ID NO: 2795455 - DNA, 13 bp, Homo sapiens
ggcccctgtgtga

SEQ ID NO: 2795456 - DNA, 21 bp, Homo sapiens
ggcccctgttcccccgctggc

SEQ ID NO: 2795457 - DNA, 16 bp, Homo sapiens
ggcccgagcagctgag

SEQ ID NO: 2795458 - DNA, 23 bp, Homo sapiens
ggcccgagcagctgagcagggcc

SEQ ID NO: 2795459 - DNA, 20 bp, Homo sapiens
gtcctccccctgccagtgcc

SEQ ID NO: 2795460 - DNA, 22 bp, Homo sapiens
gtcctccccctgccagtgcctt

SEQ ID NO: 2795461 - DNA, 14 bp, Homo sapiens
gtcctcttattcct

SEQ ID NO: 2795462 - DNA, 14 bp, Homo sapiens
gtcctcttttctga

SEQ ID NO: 2795463 - DNA, 13 bp, Homo sapiens
gtcctgagacctg

SEQ ID NO: 2795464 - DNA, 23 bp, Homo sapiens
gtcctgagcactgccaggaggga

SEQ ID NO: 2795465 - DNA, 21 bp, Homo sapiens
gtcctgcaatctccagggctg

SEQ ID NO: 2795466 - DNA, 13 bp, Homo sapiens
gtcctggaatgaa

SEQ ID NO: 2795467 - DNA, 19 bp, Homo sapiens
gtcctggaatgaagcatgt

SEQ ID NO: 2795468 - DNA, 12 bp, Homo sapiens
gtcctggcccca

SEQ ID NO: 2795469 - DNA, 16 bp, Homo sapiens
gtcctggtggggcagc

SEQ ID NO: 2795470 - DNA, 17 bp, Homo sapiens
gtcctggtggggcagct

SEQ ID NO: 2795471 - DNA, 20 bp, Homo sapiens
gtcctggtggggcagctcct

SEQ ID NO: 2795472 - DNA, 23 bp, Homo sapiens
gtcctgtagttgcgtggactctg

SEQ ID NO: 2795473 - DNA, 20 bp, Homo sapiens
gtccttaatgatccgttcca

SEQ ID NO: 2795474 - DNA, 13 bp, Homo sapiens
gtccttactcctg

SEQ ID NO: 2795475 - DNA, 15 bp, Homo sapiens
gtccttactcctgtg

SEQ ID NO: 2795476 - DNA, 17 bp, Homo sapiens
gtccttactcctgtggg

SEQ ID NO: 2795477 - DNA, 23 bp, Homo sapiens
gtccttactcctgtgggagcctc

SEQ ID NO: 2795478 - DNA, 14 bp, Homo sapiens
gtccttccaggccc

SEQ ID NO: 2795479 - DNA, 15 bp, Homo sapiens
gtcctttgagaaaga

SEQ ID NO: 2795480 - DNA, 16 bp, Homo sapiens
gtcctttgagaaagaa

SEQ ID NO: 2795481 - DNA, 21 bp, Homo sapiens
gtcctttgagaaagaaataat

SEQ ID NO: 2795482 - DNA, 18 bp, Homo sapiens
gtcgctctgctggcctgg

SEQ ID NO: 2795483 - DNA, 22 bp, Homo sapiens
gtctaccctgggattcaggaaa

SEQ ID NO: 2795484 - DNA, 19 bp, Homo sapiens
gtctagcagagcaggggca

SEQ ID NO: 2795485 - DNA, 13 bp, Homo sapiens
gtctaggagctgg

SEQ ID NO: 2795486 - DNA, 12 bp, Homo sapiens
gtctagggagag

SEQ ID NO: 2795487 - DNA, 22 bp, Homo sapiens
gtctataatggaaacatttaca

SEQ ID NO: 2795488 - DNA, 14 bp, Homo sapiens
gtctatgggactca

SEQ ID NO: 2795489 - DNA, 14 bp, Homo sapiens
gtctcaaaaaaaca

SEQ ID NO: 2795490 - DNA, 22 bp, Homo sapiens
gtctcaaactcttgacctcagg

SEQ ID NO: 2795491 - DNA, 20 bp, Homo sapiens
gtctcaagcactaaaaagtg

SEQ ID NO: 2795492 - DNA, 19 bp, Homo sapiens
gtctcactatgttgcccag

SEQ ID NO: 2795493 - DNA, 21 bp, Homo sapiens
gtctcactatgttgcccaggc

SEQ ID NO: 2795494 - DNA, 22 bp, Homo sapiens
gtctcactctgtcgcccagtct

SEQ ID NO: 2795495 - DNA, 19 bp, Homo sapiens
gtctcactgttgcccaggc

SEQ ID NO: 2795496 - DNA, 23 bp, Homo sapiens
gtctcactgttgcccaggctggc

SEQ ID NO: 2795497 - DNA, 22 bp, Homo sapiens
gtctcacttgtgcagtgttgac

SEQ ID NO: 2795498 - DNA, 12 bp, Homo sapiens
gtctcaggagca

SEQ ID NO: 2795499 - DNA, 16 bp, Homo sapiens
gtctcaggagcatggg

SEQ ID NO: 2795500 - DNA, 15 bp, Homo sapiens
gtctcaggtccctgc

SEQ ID NO: 2795501 - DNA, 15 bp, Homo sapiens
gtctcaggttctgtg

SEQ ID NO: 2795502 - DNA, 14 bp, Homo sapiens
gtctccaagaatac

SEQ ID NO: 2795503 - DNA, 21 bp, Homo sapiens
gtctccactaaatgagctcct

SEQ ID NO: 2795504 - DNA, 16 bp, Homo sapiens
gtctccatcaacactg

SEQ ID NO: 2795505 - DNA, 16 bp, Homo sapiens
gtctccctaaaataaa

SEQ ID NO: 2795506 - DNA, 14 bp, Homo sapiens
gtctccctccagct

SEQ ID NO: 2795507 - DNA, 16 bp, Homo sapiens
gtctccctctcctgcc

SEQ ID NO: 2795508 - DNA, 22 bp, Homo sapiens
gtctccctctcctgcctactca

SEQ ID NO: 2795509 - DNA, 16 bp, Homo sapiens
gtctccctggagtgca

SEQ ID NO: 2795510 - DNA, 18 bp, Homo sapiens
gtctcgagcgccctgcag

SEQ ID NO: 2795511 - DNA, 21 bp, Homo sapiens
gtctcgagcgccctgcagacc

SEQ ID NO: 2795512 - DNA, 17 bp, Homo sapiens
gtctctatgccagctca

SEQ ID NO: 2795513 - DNA, 16 bp, Homo sapiens
gtctctcatgaacctc

SEQ ID NO: 2795514 - DNA, 14 bp, Homo sapiens
gtctctccactgct

SEQ ID NO: 2795515 - DNA, 20 bp, Homo sapiens
gtctctccactgctctcagc

SEQ ID NO: 2795516 - DNA, 23 bp, Homo sapiens
gtctctccactgctctcagcctc

SEQ ID NO: 2795517 - DNA, 19 bp, Homo sapiens
gtctctctctctctacaaa

SEQ ID NO: 2795518 - DNA, 21 bp, Homo sapiens
gtctctggaacccaggacctc

SEQ ID NO: 2795519 - DNA, 22 bp, Homo sapiens
gtctctgtccctcactgccttc

SEQ ID NO: 2795520 - DNA, 14 bp, Homo sapiens
gtctctgtgctttg

SEQ ID NO: 2795521 - DNA, 14 bp, Homo sapiens
gtctcttttgttcc

SEQ ID NO: 2795522 - DNA, 12 bp, Homo sapiens
gtctgacaggca

SEQ ID NO: 2795523 - DNA, 14 bp, Homo sapiens
gtctgacaggcaat

SEQ ID NO: 2795524 - DNA, 21 bp, Homo sapiens
gtctgacaggcaatgctggct

SEQ ID NO: 2795525 - DNA, 19 bp, Homo sapiens
gtctgaggtcctgagcact

SEQ ID NO: 2795526 - DNA, 21 bp, Homo sapiens
gtctgattcccaagctctgct

SEQ ID NO: 2795527 - DNA, 20 bp, Homo sapiens
gtctgattggctcacccaag

SEQ ID NO: 2795528 - DNA, 13 bp, Homo sapiens
gtctgcacccagg

SEQ ID NO: 2795529 - DNA, 15 bp, Homo sapiens
gtctgcacccagggg

SEQ ID NO: 2795530 - DNA, 14 bp, Homo sapiens
gtctgccagccagc

SEQ ID NO: 2795531 - DNA, 23 bp, Homo sapiens
gtctgctcagacagaacccctac

SEQ ID NO: 2795532 - DNA, 12 bp, Homo sapiens
gtctgctcagga

SEQ ID NO: 2795533 - DNA, 18 bp, Homo sapiens
gtctggaatgcagtggta

SEQ ID NO: 2795534 - DNA, 19 bp, Homo sapiens
gtctggcagtttatattta

SEQ ID NO: 2795535 - DNA, 20 bp, Homo sapiens
gtctggggttcagcccctcc

SEQ ID NO: 2795536 - DNA, 13 bp, Homo sapiens
gtctggtgttctg

SEQ ID NO: 2795537 - DNA, 16 bp, Homo sapiens
gtctgtctgtctgtcc

SEQ ID NO: 2795538 - DNA, 12 bp, Homo sapiens
gtctgtgcagct

SEQ ID NO: 2795539 - DNA, 16 bp, Homo sapiens
gtctgtggattttttc

SEQ ID NO: 2795540 - DNA, 22 bp, Homo sapiens
gtcttagaagtggaccaggaca

SEQ ID NO: 2795541 - DNA, 17 bp, Homo sapiens
gtcttcaaattgtcttt

SEQ ID NO: 2795542 - DNA, 15 bp, Homo sapiens
gtcttccataatgta

SEQ ID NO: 2795543 - DNA, 13 bp, Homo sapiens
gtcttctctccat

SEQ ID NO: 2795544 - DNA, 20 bp, Homo sapiens
gtcttgaactcctggcctca

SEQ ID NO: 2795545 - DNA, 19 bp, Homo sapiens
gtcttgatgtgtcatctaa

SEQ ID NO: 2795546 - DNA, 15 bp, Homo sapiens
gtcttgccagccaga

SEQ ID NO: 2795547 - DNA, 16 bp, Homo sapiens
gtcttgccagccagaa

SEQ ID NO: 2795548 - DNA, 14 bp, Homo sapiens
gtcttggacactgt

SEQ ID NO: 2795549 - DNA, 21 bp, Homo sapiens
gtcttggccgactcagggacc

SEQ ID NO: 2795550 - DNA, 15 bp, Homo sapiens
gcttcccctcgctgt

SEQ ID NO: 2795551 - DNA, 17 bp, Homo sapiens
gcttcccctcgctgtcc

SEQ ID NO: 2795552 - DNA, 19 bp, Homo sapiens
gcttcccctcgctgtcctg

SEQ ID NO: 2795553 - DNA, 22 bp, Homo sapiens
gcttcccctcgctgtcctgctg

SEQ ID NO: 2795554 - DNA, 18 bp, Homo sapiens
gcttcggggcaagtgaga

SEQ ID NO: 2795555 - DNA, 12 bp, Homo sapiens
gcttctatccca

SEQ ID NO: 2795556 - DNA, 13 bp, Homo sapiens
gcttctcagcccc

SEQ ID NO: 2795557 - DNA, 16 bp, Homo sapiens
gcttctgtccaaggca

SEQ ID NO: 2795558 - DNA, 16 bp, Homo sapiens
gcttcttcagatcagt

SEQ ID NO: 2795559 - DNA, 19 bp, Homo sapiens
gcttcttcagatcagtgct

SEQ ID NO: 2795560 - DNA, 12 bp, Homo sapiens
gcttcttgcccc

SEQ ID NO: 2795561 - DNA, 16 bp, Homo sapiens
gcttcttgccccttgg

SEQ ID NO: 2795562 - DNA, 21 bp, Homo sapiens
gcttcttgccccttgggcctc

SEQ ID NO: 2795563 - DNA, 22 bp, Homo sapiens
gcttcttgccccttgggcctcc

SEQ ID NO: 2795564 - DNA, 23 bp, Homo sapiens
gcttcttttagttgtatctcttt

SEQ ID NO: 2795565 - DNA, 15 bp, Homo sapiens
gcttgaaggaacagt

SEQ ID NO: 2795566 - DNA, 22 bp, Homo sapiens
gcttgactatcacatacaattt

SEQ ID NO: 2795567 - DNA, 21 bp, Homo sapiens
gcttgagagggcaaacccaaa

SEQ ID NO: 2795568 - DNA, 14 bp, Homo sapiens
gcttgagcccagga

SEQ ID NO: 2795569 - DNA, 16 bp, Homo sapiens
gcttgagcccaggagt

SEQ ID NO: 2795570 - DNA, 18 bp, Homo sapiens
gcttgagggttgggctgg

SEQ ID NO: 2795571 - DNA, 20 bp, Homo sapiens
gcttgagggttgggctggtg

SEQ ID NO: 2795572 - DNA, 13 bp, Homo sapiens
gcttggcagctga

SEQ ID NO: 2795573 - DNA, 15 bp, Homo sapiens
gcttgggccctgcac

SEQ ID NO: 2795574 - DNA, 16 bp, Homo sapiens
gcttgggccctgcaca

SEQ ID NO: 2795575 - DNA, 21 bp, Homo sapiens
gcttgggccctgcacagatat

SEQ ID NO: 2795576 - DNA, 22 bp, Homo sapiens
gcttgggtgtaacaggtctcct

SEQ ID NO: 2795577 - DNA, 19 bp, Homo sapiens
gcttgtaaatagctcaggt

SEQ ID NO: 2795578 - DNA, 15 bp, Homo sapiens
gcttgtaactccacc

SEQ ID NO: 2795579 - DNA, 13 bp, Homo sapiens
gcttgtagccagc

SEQ ID NO: 2795580 - DNA, 18 bp, Homo sapiens
gcttgtcactagcagctg

SEQ ID NO: 2795581 - DNA, 22 bp, Homo sapiens
gcctgtgtagctgtgacctgct

SEQ ID NO: 2795582 - DNA, 13 bp, Homo sapiens
gcctgtgtgagca

SEQ ID NO: 2795583 - DNA, 22 bp, Homo sapiens
gcctgtgtgagcatctctgtgt

SEQ ID NO: 2795584 - DNA, 16 bp, Homo sapiens
gcctgttcatggcaga

SEQ ID NO: 2795585 - DNA, 19 bp, Homo sapiens
gcctgttcccattcttgca

SEQ ID NO: 2795586 - DNA, 19 bp, Homo sapiens
gcctgttggacccgctctg

SEQ ID NO: 2795587 - DNA, 21 bp, Homo sapiens
gcctgttggacccgctctgga

SEQ ID NO: 2795588 - DNA, 14 bp, Homo sapiens
gccttacctcctgc

SEQ ID NO: 2795589 - DNA, 15 bp, Homo sapiens
gccttacctcctgcc

SEQ ID NO: 2795590 - DNA, 21 bp, Homo sapiens
gccttacctcctgcccaggag

SEQ ID NO: 2795591 - DNA, 19 bp, Homo sapiens
gccttagaagtcacacagt

SEQ ID NO: 2795592 - DNA, 21 bp, Homo sapiens
gccttcacaaccagccacaca

SEQ ID NO: 2795593 - DNA, 14 bp, Homo sapiens
gccttccataatta

SEQ ID NO: 2795594 - DNA, 16 bp, Homo sapiens
gccttccataattatg

SEQ ID NO: 2795595 - DNA, 16 bp, Homo sapiens
gccttccccttgccca

SEQ ID NO: 2795596 - DNA, 18 bp, Homo sapiens
gccttccccttgcccagg

SEQ ID NO: 2795597 - DNA, 16 bp, Homo sapiens
gccttctcaaacttta

SEQ ID NO: 2795598 - DNA, 14 bp, Homo sapiens
gccttctcctgcct

SEQ ID NO: 2795599 - DNA, 19 bp, Homo sapiens
gccttcttattctcactcc

SEQ ID NO: 2795600 - DNA, 23 bp, Homo sapiens
gccttcttattctcactccacca

SEQ ID NO: 2795601 - DNA, 15 bp, Homo sapiens
gccttcttcacccag

SEQ ID NO: 2795602 - DNA, 17 bp, Homo sapiens
gccttcttcacccagct

SEQ ID NO: 2795603 - DNA, 14 bp, Homo sapiens
gccttgaagccact

SEQ ID NO: 2795604 - DNA, 20 bp, Homo sapiens
gccttgccacatctgtgtct

SEQ ID NO: 2795605 - DNA, 22 bp, Homo sapiens
gccttgcccggattctgggagg

SEQ ID NO: 2795606 - DNA, 19 bp, Homo sapiens
gccttggataatgctgttg

SEQ ID NO: 2795607 - DNA, 23 bp, Homo sapiens
gccttggataatgctgttgcctc

SEQ ID NO: 2795608 - DNA, 20 bp, Homo sapiens
gccttgtaattctaaatgaa

SEQ ID NO: 2795609 - DNA, 22 bp, Homo sapiens
gcctttccataaggaatgtagc

SEQ ID NO: 2795610 - DNA, 15 bp, Homo sapiens
gcctttccccagtgt

SEQ ID NO: 2795611 - DNA, 22 bp, Homo sapiens
gcctttcttatttgcaataaaa

SEQ ID NO: 2795612 - DNA, 20 bp, Homo sapiens
gcctttggatgaccagaaca

SEQ ID NO: 2795613 - DNA, 16 bp, Homo sapiens
gccttttatttcttaa

SEQ ID NO: 2795614 - DNA, 23 bp, Homo sapiens
gcctttttcacaattccatttcc

SEQ ID NO: 2795615 - DNA, 22 bp, Homo sapiens
gcgaaaaaatcaggtggctttt

SEQ ID NO: 2795616 - DNA, 14 bp, Homo sapiens
gcgaaggggccctg

SEQ ID NO: 2795617 - DNA, 23 bp, Homo sapiens
gcgacagagcgagagtctgtctc

SEQ ID NO: 2795618 - DNA, 14 bp, Homo sapiens
gcgacccctcagtg

SEQ ID NO: 2795619 - DNA, 21 bp, Homo sapiens
gcgactctatagactctagga

SEQ ID NO: 2795620 - DNA, 20 bp, Homo sapiens
gcgagagaggtgggcagcag

SEQ ID NO: 2795621 - DNA, 15 bp, Homo sapiens
ggcctcggagcctca

SEQ ID NO: 2795622 - DNA, 22 bp, Homo sapiens
ggcctcggagcctcatccgagg

SEQ ID NO: 2795623 - DNA, 17 bp, Homo sapiens
ggcctcttggacctctg

SEQ ID NO: 2795624 - DNA, 22 bp, Homo sapiens
ggcctcttggacctctgctctg

SEQ ID NO: 2795625 - DNA, 14 bp, Homo sapiens
ggcctgatgacaga

SEQ ID NO: 2795626 - DNA, 18 bp, Homo sapiens
ggcctgatgacagagcga

SEQ ID NO: 2795627 - DNA, 17 bp, Homo sapiens
ggcctgcccagtgcact

SEQ ID NO: 2795628 - DNA, 16 bp, Homo sapiens
ggcctgccctcaggga

SEQ ID NO: 2795629 - DNA, 17 bp, Homo sapiens
ggcctgctcccagcagc

SEQ ID NO: 2795630 - DNA, 14 bp, Homo sapiens
ggcctgctgctgag

SEQ ID NO: 2795631 - DNA, 19 bp, Homo sapiens
ggcctgctgggctctccac

SEQ ID NO: 2795632 - DNA, 20 bp, Homo sapiens
ggcctgctgggctctccacc

SEQ ID NO: 2795633 - DNA, 21 bp, Homo sapiens
ggcctgctgggctctccacct

SEQ ID NO: 2795634 - DNA, 12 bp, Homo sapiens
ggcctggccaga

SEQ ID NO: 2795635 - DNA, 15 bp, Homo sapiens
ggcctggccagatgc

SEQ ID NO: 2795636 - DNA, 17 bp, Homo sapiens
ggcctggctggctgagg

SEQ ID NO: 2795637 - DNA, 19 bp, Homo sapiens
ggcctggctggctgagggc

SEQ ID NO: 2795638 - DNA, 11 bp, Homo sapiens
ggcctggggtg

SEQ ID NO: 2795639 - DNA, 15 bp, Homo sapiens
ggcctggggtgaccc

SEQ ID NO: 2795640 - DNA, 18 bp, Homo sapiens
ggcctggggtgacccggc

SEQ ID NO: 2795641 - DNA, 22 bp, Homo sapiens
ggcctggtggccatgtcgcctg

SEQ ID NO: 2795642 - DNA, 19 bp, Homo sapiens
ggcctgtgtagctgtgacc

SEQ ID NO: 2795643 - DNA, 20 bp, Homo sapiens
ggcctgtgtagctgtgacct

SEQ ID NO: 2795644 - DNA, 23 bp, Homo sapiens
ggcctgtgtagctgtgacctgct

SEQ ID NO: 2795645 - DNA, 15 bp, Homo sapiens
ggccttctctgaagg

SEQ ID NO: 2795646 - DNA, 16 bp, Homo sapiens
ggccttctctgaagga

SEQ ID NO: 2795647 - DNA, 13 bp, Homo sapiens
ggccttgcccaga

SEQ ID NO: 2795648 - DNA, 16 bp, Homo sapiens
ggccttgcccagagat

SEQ ID NO: 2795649 - DNA, 18 bp, Homo sapiens
ggccttgttctgtcacca

SEQ ID NO: 2795650 - DNA, 15 bp, Homo sapiens
ggcgacccctcagtg

SEQ ID NO: 2795651 - DNA, 19 bp, Homo sapiens
ggcgacctgcacgcactgc

SEQ ID NO: 2795652 - DNA, 15 bp, Homo sapiens
ggcgagtgccaggac

SEQ ID NO: 2795653 - DNA, 19 bp, Homo sapiens
ggcgccccaacccgtggag

SEQ ID NO: 2795654 - DNA, 23 bp, Homo sapiens
ggcgccccaacccgtggaggctg

SEQ ID NO: 2795655 - DNA, 19 bp, Homo sapiens
ggcgcggtggctcacgcct

SEQ ID NO: 2795656 - DNA, 17 bp, Homo sapiens
ggcgctattgcactcca

SEQ ID NO: 2795657 - DNA, 13 bp, Homo sapiens
ggcgctctgccct

SEQ ID NO: 2795658 - DNA, 21 bp, Homo sapiens
ggcggaggttccagtgagccg

SEQ ID NO: 2795659 - DNA, 18 bp, Homo sapiens
ggcggcacattggcagtg

SEQ ID NO: 2795660 - DNA, 20 bp, Homo sapiens
ggcggctactcagcagccct

SEQ ID NO: 2795661 - DNA, 21 bp, Homo sapiens
ggcggctactcagcagccctc

SEQ ID NO: 2795662 - DNA, 17 bp, Homo sapiens
ggcgggagtgggggctg

SEQ ID NO: 2795663 - DNA, 16 bp, Homo sapiens
ggcgggcagcccagcc

SEQ ID NO: 2795664 - DNA, 14 bp, Homo sapiens
ggcggggctatgcc

SEQ ID NO: 2795665 - DNA, 21 bp, Homo sapiens
ggcgggggagccaacagcagc

SEQ ID NO: 2795666 - DNA, 19 bp, Homo sapiens
ggcgtgcagtggtgcgatc

SEQ ID NO: 2795667 - DNA, 16 bp, Homo sapiens
ggcgtggtggcgggca

SEQ ID NO: 2795668 - DNA, 20 bp, Homo sapiens
ggctaagagctagcgctgcc

SEQ ID NO: 2795669 - DNA, 13 bp, Homo sapiens
ggctactctgtgc

SEQ ID NO: 2795670 - DNA, 16 bp, Homo sapiens
ggctactctgtgccag

SEQ ID NO: 2795671 - DNA, 20 bp, Homo sapiens
ggctactctgtgccagagcc

SEQ ID NO: 2795672 - DNA, 21 bp, Homo sapiens
ggctactctgtgccagagcct

SEQ ID NO: 2795673 - DNA, 22 bp, Homo sapiens
ggctactctgtgccagagcctg

SEQ ID NO: 2795674 - DNA, 15 bp, Homo sapiens
ggctagttgggcttc

SEQ ID NO: 2795675 - DNA, 16 bp, Homo sapiens
ggctagttgggcttcc

SEQ ID NO: 2795676 - DNA, 21 bp, Homo sapiens
ggctcaagtcctcttttctga

SEQ ID NO: 2795677 - DNA, 20 bp, Homo sapiens
ggctcacgcctatgatccca

SEQ ID NO: 2795678 - DNA, 13 bp, Homo sapiens
ggctcactgcagc

SEQ ID NO: 2795679 - DNA, 16 bp, Homo sapiens
ggctcactgcagcctc

SEQ ID NO: 2795680 - DNA, 19 bp, Homo sapiens
ggctcagcggggacagctc

SEQ ID NO: 2795681 - DNA, 23 bp, Homo sapiens
ggctcagcggggacagctccttc

SEQ ID NO: 2795682 - DNA, 15 bp, Homo sapiens
ggctcagtctcagga

SEQ ID NO: 2795683 - DNA, 17 bp, Homo sapiens
ggctcagtctcaggagc

SEQ ID NO: 2795684 - DNA, 22 bp, Homo sapiens
ggctccacctgttcaggagctg

SEQ ID NO: 2795685 - DNA, 14 bp, Homo sapiens
ggctccaggctcct

SEQ ID NO: 2795686 - DNA, 16 bp, Homo sapiens
ggctccaggctccttt

SEQ ID NO: 2795687 - DNA, 23 bp, Homo sapiens
ggctccccctgcttctcagcccc

SEQ ID NO: 2795688 - DNA, 13 bp, Homo sapiens
ggctcctggaaag

SEQ ID NO: 2795689 - DNA, 17 bp, Homo sapiens
ggctcctggaaccaatc

SEQ ID NO: 2795690 - DNA, 19 bp, Homo sapiens
ggctcctttctccagccag

SEQ ID NO: 2795691 - DNA, 21 bp, Homo sapiens
ggctcctttctccagccagca

SEQ ID NO: 2795692 - DNA, 15 bp, Homo sapiens
ggctctaacgcctga

SEQ ID NO: 2795693 - DNA, 17 bp, Homo sapiens
ggctctaacgcctgagc

SEQ ID NO: 2795694 - DNA, 12 bp, Homo sapiens
ggctctccacct

SEQ ID NO: 2795695 - DNA, 17 bp, Homo sapiens
ggctctccacctcagcc

SEQ ID NO: 2795696 - DNA, 18 bp, Homo sapiens
ggctctccacctcagcct

SEQ ID NO: 2795697 - DNA, 22 bp, Homo sapiens
ggctctccacctcagccttgga

SEQ ID NO: 2795698 - DNA, 20 bp, Homo sapiens
ggctctcctcagaagaaaga

SEQ ID NO: 2795699 - DNA, 23 bp, Homo sapiens
ggctctcctgagaggtgctgcag

SEQ ID NO: 2795700 - DNA, 16 bp, Homo sapiens
ggctctcctggcttcc

SEQ ID NO: 2795701 - DNA, 14 bp, Homo sapiens
ggctctgaaagcca

SEQ ID NO: 2795702 - DNA, 14 bp, Homo sapiens
ggctctgaggcgcc

SEQ ID NO: 2795703 - DNA, 21 bp, Homo sapiens
ggctcttctccttggaggaca

SEQ ID NO: 2795704 - DNA, 23 bp, Homo sapiens
ggctcttctccttggaggacagt

SEQ ID NO: 2795705 - DNA, 15 bp, Homo sapiens
ggctgaacggggaga

SEQ ID NO: 2795706 - DNA, 18 bp, Homo sapiens
ggctgacccagtccctgg

SEQ ID NO: 2795707 - DNA, 22 bp, Homo sapiens
ggctgacccagtccctggggga

SEQ ID NO: 2795708 - DNA, 18 bp, Homo sapiens
ggctgaccccaaagagcc

SEQ ID NO: 2795709 - DNA, 19 bp, Homo sapiens
ggctgaccccaaagagcct

SEQ ID NO: 2795710 - DNA, 20 bp, Homo sapiens
ggctgaccccaaagagcctg

SEQ ID NO: 2795711 - DNA, 15 bp, Homo sapiens
ggctgagacaggaga

SEQ ID NO: 2795712 - DNA, 18 bp, Homo sapiens
ggctgagacaggagaatc

SEQ ID NO: 2795713 - DNA, 12 bp, Homo sapiens
ggctgagccctg

SEQ ID NO: 2795714 - DNA, 15 bp, Homo sapiens
ggctgagccctggca

SEQ ID NO: 2795715 - DNA, 16 bp, Homo sapiens
ggctgagccctggcag

SEQ ID NO: 2795716 - DNA, 21 bp, Homo sapiens
ggctgagggcagttcgcagcc

SEQ ID NO: 2795717 - DNA, 22 bp, Homo sapiens
ggctgagggcagttcgcagcca

SEQ ID NO: 2795718 - DNA, 15 bp, Homo sapiens
ggctgataattttaa

SEQ ID NO: 2795719 - DNA, 18 bp, Homo sapiens
ggctgcaaagggtatcag

SEQ ID NO: 2795720 - DNA, 17 bp, Homo sapiens
ggctgcagggagtccga

SEQ ID NO: 2795721 - DNA, 22 bp, Homo sapiens
ggctgcagtgacgtgcacctgt

SEQ ID NO: 2795722 - DNA, 23 bp, Homo sapiens
ggctgcatctgggattcccacca

SEQ ID NO: 2795723 - DNA, 12 bp, Homo sapiens
ggctgccctgcc

SEQ ID NO: 2795724 - DNA, 21 bp, Homo sapiens
ggctgccgggttctagtctcc

SEQ ID NO: 2795725 - DNA, 22 bp, Homo sapiens
ggctgcggaatgaaccacatct

SEQ ID NO: 2795726 - DNA, 16 bp, Homo sapiens
ggctgctacccagaaa

SEQ ID NO: 2795727 - DNA, 12 bp, Homo sapiens
ggctgctcctcc

SEQ ID NO: 2795728 - DNA, 23 bp, Homo sapiens
ggctgctcctccagggccacgtg

SEQ ID NO: 2795729 - DNA, 20 bp, Homo sapiens
ggctggaaaagtcacacaga

SEQ ID NO: 2795730 - DNA, 19 bp, Homo sapiens
ggctggatgtggtggcata

SEQ ID NO: 2795731 - DNA, 20 bp, Homo sapiens
ggctggcggctactcagcag

SEQ ID NO: 2795732 - DNA, 12 bp, Homo sapiens
ggctgggcttca

SEQ ID NO: 2795733 - DNA, 16 bp, Homo sapiens
ggctgggggcctcagt

SEQ ID NO: 2795734 - DNA, 19 bp, Homo sapiens
ggctgggggcctcagtgcc

SEQ ID NO: 2795735 - DNA, 17 bp, Homo sapiens
ggctgtaaacagctctg

SEQ ID NO: 2795736 - DNA, 18 bp, Homo sapiens
ggctgtatcccatgagcc

SEQ ID NO: 2795737 - DNA, 20 bp, Homo sapiens
ggctgtatcccatgagcctc

SEQ ID NO: 2795738 - DNA, 23 bp, Homo sapiens
ggctgtatcccatgagcctcagc

SEQ ID NO: 2795739 - DNA, 17 bp, Homo sapiens
ggctgtatttttagaga

SEQ ID NO: 2795740 - DNA, 16 bp, Homo sapiens
ggctgtgcctctgcct

SEQ ID NO: 2795741 - DNA, 20 bp, Homo sapiens
ggctgtggtggctgtctctg

SEQ ID NO: 2795742 - DNA, 15 bp, Homo sapiens
ggctgttggctgggg

SEQ ID NO: 2795743 - DNA, 16 bp, Homo sapiens
ggctgttggctggggg

SEQ ID NO: 2795744 - DNA, 14 bp, Homo sapiens
ggcttaaatgcaat

SEQ ID NO: 2795745 - DNA, 21 bp, Homo sapiens
ggcttagacttcgactcagga

SEQ ID NO: 2795746 - DNA, 21 bp, Homo sapiens
ggcttccagaaaaccccagca

SEQ ID NO: 2795747 - DNA, 22 bp, Homo sapiens
ggcttccagagagtcctctgga

SEQ ID NO: 2795748 - DNA, 13 bp, Homo sapiens
ggcttctggagcc

SEQ ID NO: 2795749 - DNA, 16 bp, Homo sapiens
ggcttctggagccctt

SEQ ID NO: 2795750 - DNA, 17 bp, Homo sapiens
ggcttgtaactccacca

SEQ ID NO: 2795751 - DNA, 19 bp, Homo sapiens
ggctttaaccgtttttcaa

SEQ ID NO: 2795752 - DNA, 12 bp, Homo sapiens
ggctttctggag

SEQ ID NO: 2795753 - DNA, 14 bp, Homo sapiens
ggctttctggagag

SEQ ID NO: 2795754 - DNA, 19 bp, Homo sapiens
gggaacagacaacagaagt

SEQ ID NO: 2795755 - DNA, 12 bp, Homo sapiens
gggaacagtgtt

SEQ ID NO: 2795756 - DNA, 20 bp, Homo sapiens
gggaacagtgtttcccataa

SEQ ID NO: 2795757 - DNA, 20 bp, Homo sapiens
gggaacccgactgtgaaagt

SEQ ID NO: 2795758 - DNA, 13 bp, Homo sapiens
gggaactcctgga

SEQ ID NO: 2795759 - DNA, 12 bp, Homo sapiens
gggaactggcca

SEQ ID NO: 2795760 - DNA, 13 bp, Homo sapiens
gggaactggccaa

SEQ ID NO: 2795761 - DNA, 15 bp, Homo sapiens
gggaactggccaagc

SEQ ID NO: 2795762 - DNA, 16 bp, Homo sapiens
gggaactggccaagct

SEQ ID NO: 2795763 - DNA, 14 bp, Homo sapiens
gggaaggcaggcag

SEQ ID NO: 2795764 - DNA, 15 bp, Homo sapiens
gggaaggcaggcagg

SEQ ID NO: 2795765 - DNA, 21 bp, Homo sapiens
gggaaggcaggcagggctctc

SEQ ID NO: 2795766 - DNA, 13 bp, Homo sapiens
gggaagggagagc

SEQ ID NO: 2795767 - DNA, 22 bp, Homo sapiens
gggaagggccagtctgggctgc

SEQ ID NO: 2795768 - DNA, 20 bp, Homo sapiens
gggaatcggttcatcaattt

SEQ ID NO: 2795769 - DNA, 19 bp, Homo sapiens
gggaatgtttgcctctgcc

SEQ ID NO: 2795770 - DNA, 17 bp, Homo sapiens
gggacaaaggagcctgt

SEQ ID NO: 2795771 - DNA, 17 bp, Homo sapiens
gggacagagacacctgc

SEQ ID NO: 2795772 - DNA, 12 bp, Homo sapiens
gggacagctcct

SEQ ID NO: 2795773 - DNA, 13 bp, Homo sapiens
gggacagctcctt

SEQ ID NO: 2795774 - DNA, 15 bp, Homo sapiens
gggacatttccctcc

SEQ ID NO: 2795775 - DNA, 18 bp, Homo sapiens
gggacatttccctcctgg

SEQ ID NO: 2795776 - DNA, 13 bp, Homo sapiens
gggaccagggcat

SEQ ID NO: 2795777 - DNA, 15 bp, Homo sapiens
gggaccagggcatat

SEQ ID NO: 2795778 - DNA, 20 bp, Homo sapiens
gggacccatagatcttctga

SEQ ID NO: 2795779 - DNA, 18 bp, Homo sapiens
gggaccggtacagaaagg

SEQ ID NO: 2795780 - DNA, 13 bp, Homo sapiens
gggacgaagaaag

SEQ ID NO: 2795781 - DNA, 19 bp, Homo sapiens
gggactcaatgcactgaca

SEQ ID NO: 2795782 - DNA, 23 bp, Homo sapiens
gggactcaatgcactgacattgt

SEQ ID NO: 2795783 - DNA, 15 bp, Homo sapiens
gggacttggaagctc

SEQ ID NO: 2795784 - DNA, 23 bp, Homo sapiens
gggagacatattcttggagaact

SEQ ID NO: 2795785 - DNA, 9 bp, Homo sapiens
gggagacct

SEQ ID NO: 2795786 - DNA, 11 bp, Homo sapiens
gggagacctgg

SEQ ID NO: 2795787 - DNA, 15 bp, Homo sapiens
gggagagccagctct

SEQ ID NO: 2795788 - DNA, 12 bp, Homo sapiens
gggagagcccag

SEQ ID NO: 2795789 - DNA, 17 bp, Homo sapiens
gggagaggcatggctgg

SEQ ID NO: 2795790 - DNA, 15 bp, Homo sapiens
gggagagggtctgga

SEQ ID NO: 2795791 - DNA, 19 bp, Homo sapiens
gggagatggagttcttgtg

SEQ ID NO: 2795792 - DNA, 15 bp, Homo sapiens
gggagccaacagcag

SEQ ID NO: 2795793 - DNA, 23 bp, Homo sapiens
gggaggaagcaggttgaggggct

SEQ ID NO: 2795794 - DNA, 14 bp, Homo sapiens
gggaggagaatgag

SEQ ID NO: 2795795 - DNA, 21 bp, Homo sapiens
gggaggagaggggaagggcca

SEQ ID NO: 2795796 - DNA, 20 bp, Homo sapiens
gggaggaggtggcagccctg

SEQ ID NO: 2795797 - DNA, 19 bp, Homo sapiens
gggaggatcactggagccc

SEQ ID NO: 2795798 - DNA, 20 bp, Homo sapiens
gggaggcggagagtacagtg

SEQ ID NO: 2795799 - DNA, 10 bp, Homo sapiens
gggaggctga

SEQ ID NO: 2795800 - DNA, 12 bp, Homo sapiens
gggagggctctg

SEQ ID NO: 2795801 - DNA, 14 bp, Homo sapiens
gggagggctctgag

SEQ ID NO: 2795802 - DNA, 18 bp, Homo sapiens
ggggagggctgcctgaaa

SEQ ID NO: 2795803 - DNA, 21 bp, Homo sapiens
ggggaggggcctagggagccg

SEQ ID NO: 2795804 - DNA, 20 bp, Homo sapiens
ggggattcttccatctgatt

SEQ ID NO: 2795805 - DNA, 18 bp, Homo sapiens
ggggattggagggaagac

SEQ ID NO: 2795806 - DNA, 20 bp, Homo sapiens
ggggattggagggaagacag

SEQ ID NO: 2795807 - DNA, 14 bp, Homo sapiens
ggggatttttttgt

SEQ ID NO: 2795808 - DNA, 16 bp, Homo sapiens
ggggcacgcctgccca

SEQ ID NO: 2795809 - DNA, 22 bp, Homo sapiens
ggggcagagggcagaggctgga

SEQ ID NO: 2795810 - DNA, 11 bp, Homo sapiens
ggggcaggagt

SEQ ID NO: 2795811 - DNA, 17 bp, Homo sapiens
ggggcaggagtagctga

SEQ ID NO: 2795812 - DNA, 19 bp, Homo sapiens
ggggcaggagtagctgagc

SEQ ID NO: 2795813 - DNA, 23 bp, Homo sapiens
ggggccaggcaggggtgggagag

SEQ ID NO: 2795814 - DNA, 14 bp, Homo sapiens
ggggccccagggct

SEQ ID NO: 2795815 - DNA, 18 bp, Homo sapiens
ggggccccggtcctggcc

SEQ ID NO: 2795816 - DNA, 23 bp, Homo sapiens
ggggcctgcccagtgcacttgct

SEQ ID NO: 2795817 - DNA, 12 bp, Homo sapiens
ggggctcctgga

SEQ ID NO: 2795818 - DNA, 21 bp, Homo sapiens
ggggctcctggaaaggctcag

SEQ ID NO: 2795819 - DNA, 21 bp, Homo sapiens
ggggctctaacgcctgagccc

SEQ ID NO: 2795820 - DNA, 22 bp, Homo sapiens
ggggctctaacgcctgagccca

SEQ ID NO: 2795821 - DNA, 18 bp, Homo sapiens
ggggctgaacggggagaa

SEQ ID NO: 2795822 - DNA, 11 bp, Homo sapiens
gggggcagagg

SEQ ID NO: 2795823 - DNA, 12 bp, Homo sapiens
gggggcagaggg

SEQ ID NO: 2795824 - DNA, 12 bp, Homo sapiens
gggggcctcagt

SEQ ID NO: 2795825 - DNA, 13 bp, Homo sapiens
gggggcctggctg

SEQ ID NO: 2795826 - DNA, 20 bp, Homo sapiens
gggggcctggctggctgagg

SEQ ID NO: 2795827 - DNA, 18 bp, Homo sapiens
gggggtgatgagggcagc

SEQ ID NO: 2795828 - DNA, 22 bp, Homo sapiens
gggggtgatgagggcagcagcc

SEQ ID NO: 2795829 - DNA, 18 bp, Homo sapiens
gggggtttttactccagt

SEQ ID NO: 2795830 - DNA, 24 bp, Homo sapiens
gggggtttttactccagtggtgaa

SEQ ID NO: 2795831 - DNA, 19 bp, Homo sapiens
ggggtacaggtttggggag

SEQ ID NO: 2795832 - DNA, 22 bp, Homo sapiens
ggggtatttaccacagcagctg

SEQ ID NO: 2795833 - DNA, 18 bp, Homo sapiens
ggggtccacccagcaaag

SEQ ID NO: 2795834 - DNA, 23 bp, Homo sapiens
ggggtccccatcatcccagctgc

SEQ ID NO: 2795835 - DNA, 17 bp, Homo sapiens
ggggtgatgagggcagc

SEQ ID NO: 2795836 - DNA, 21 bp, Homo sapiens
ggggtgatgatgaccaagaat

SEQ ID NO: 2795837 - DNA, 14 bp, Homo sapiens
ggggtgcacaggag

SEQ ID NO: 2795838 - DNA, 16 bp, Homo sapiens
ggggtgcacaggaggg

SEQ ID NO: 2795839 - DNA, 17 bp, Homo sapiens
ggggttgtgaggcctgg

SEQ ID NO: 2795840 - DNA, 12 bp, Homo sapiens
gggtaggcggga

SEQ ID NO: 2795841 - DNA, 13 bp, Homo sapiens
gggtcagccaggg

SEQ ID NO: 2795842 - DNA, 19 bp, Homo sapiens
gggtcagccagggccaggg

SEQ ID NO: 2795843 - DNA, 21 bp, Homo sapiens
gggtcaggcggggtgctgtgg

SEQ ID NO: 2795844 - DNA, 20 bp, Homo sapiens
gggtccacccagcaaagagt

SEQ ID NO: 2795845 - DNA, 14 bp, Homo sapiens
gggtccccagctcc

SEQ ID NO: 2795846 - DNA, 14 bp, Homo sapiens
gggtcctgagtggc

SEQ ID NO: 2795847 - DNA, 20 bp, Homo sapiens
gggtcctgcaatctccaggg

SEQ ID NO: 2795848 - DNA, 13 bp, Homo sapiens
gggtcctgcaatt

SEQ ID NO: 2795849 - DNA, 20 bp, Homo sapiens
gggtcgccacacccggctcc

SEQ ID NO: 2795850 - DNA, 22 bp, Homo sapiens
gggtctcactatgttgcccagg

SEQ ID NO: 2795851 - DNA, 23 bp, Homo sapiens
gggtctcactatgttgcccaggc

SEQ ID NO: 2795852 - DNA, 12 bp, Homo sapiens
gggtctcactct

SEQ ID NO: 2795853 - DNA, 15 bp, Homo sapiens
gggtctccctctcct

SEQ ID NO: 2795854 - DNA, 19 bp, Homo sapiens
gggtctccctctcctgcct

SEQ ID NO: 2795855 - DNA, 20 bp, Homo sapiens
gggtctccctctcctgccta

SEQ ID NO: 2795856 - DNA, 21 bp, Homo sapiens
gggtctgaggaatccagaccc

SEQ ID NO: 2795857 - DNA, 15 bp, Homo sapiens
gggtctggctgagct

SEQ ID NO: 2795858 - DNA, 20 bp, Homo sapiens
gggtgacccggcaccccctg

SEQ ID NO: 2795859 - DNA, 17 bp, Homo sapiens
gggtgagaggaagggtg

SEQ ID NO: 2795860 - DNA, 14 bp, Homo sapiens
gggtgatgagggca

SEQ ID NO: 2795861 - DNA, 16 bp, Homo sapiens
gggtgcacaggagggg

SEQ ID NO: 2795862 - DNA, 19 bp, Homo sapiens
gggtgcacaggagggggtc

SEQ ID NO: 2795863 - DNA, 14 bp, Homo sapiens
gggtgcgagagagg

SEQ ID NO: 2795864 - DNA, 16 bp, Homo sapiens
gggtggctagtcagag

SEQ ID NO: 2795865 - DNA, 16 bp, Homo sapiens
gggtgggagagccagc

SEQ ID NO: 2795866 - DNA, 19 bp, Homo sapiens
gggtgggagagcccagcca

SEQ ID NO: 2795867 - DNA, 12 bp, Homo sapiens
gggtgggcaggg

SEQ ID NO: 2795868 - DNA, 22 bp, Homo sapiens
gggtggggaatgtttgggcaga

SEQ ID NO: 2795869 - DNA, 12 bp, Homo sapiens
gggtggggctgc

SEQ ID NO: 2795870 - DNA, 14 bp, Homo sapiens
gggtggggctgctc

SEQ ID NO: 2795871 - DNA, 16 bp, Homo sapiens
gggtggtgggtgctgg

SEQ ID NO: 2795872 - DNA, 17 bp, Homo sapiens
gggtgttaaggcagtga

SEQ ID NO: 2795873 - DNA, 22 bp, Homo sapiens
gggttcaagcgattcttctgct

SEQ ID NO: 2795874 - DNA, 19 bp, Homo sapiens
gggttcagagactcagggc

SEQ ID NO: 2795875 - DNA, 14 bp, Homo sapiens
gggttcctcttccc

SEQ ID NO: 2795876 - DNA, 14 bp, Homo sapiens
gggttctttcttcc

SEQ ID NO: 2795877 - DNA, 15 bp, Homo sapiens
gggttgggctggtgt

SEQ ID NO: 2795878 - DNA, 21 bp, Homo sapiens
gggttgggttcatctgagcaa

SEQ ID NO: 2795879 - DNA, 21 bp, Homo sapiens
gggttgtgaggcctggccagg

SEQ ID NO: 2795880 - DNA, 17 bp, Homo sapiens
gggttttccaccctgga

SEQ ID NO: 2795881 - DNA, 23 bp, Homo sapiens
ggtaaaaagattatatatcataa

SEQ ID NO: 2795882 - DNA, 13 bp, Homo sapiens
ggtaacaggcaga

SEQ ID NO: 2795883 - DNA, 19 bp, Homo sapiens
ggtaataagtactgtgtac

SEQ ID NO: 2795884 - DNA, 22 bp, Homo sapiens
ggtaattgttgctaatcttctt

SEQ ID NO: 2795885 - DNA, 23 bp, Homo sapiens
ggtacagcaacaggaatctcaga

SEQ ID NO: 2795886 - DNA, 14 bp, Homo sapiens
ggtaccactgattt

SEQ ID NO: 2795887 - DNA, 13 bp, Homo sapiens
ggtaccagctcac

SEQ ID NO: 2795888 - DNA, 12 bp, Homo sapiens
ggtacctcagtt

SEQ ID NO: 2795889 - DNA, 12 bp, Homo sapiens
ggtaccttgaac

SEQ ID NO: 2795890 - DNA, 23 bp, Homo sapiens
ggtactactgctgcaaagtgcaa

SEQ ID NO: 2795891 - DNA, 21 bp, Homo sapiens
ggtacttgtggacacagctct

SEQ ID NO: 2795892 - DNA, 19 bp, Homo sapiens
ggtgctgtggccagggtga

SEQ ID NO: 2795893 - DNA, 17 bp, Homo sapiens
ggtgctgtggtggggag

SEQ ID NO: 2795894 - DNA, 14 bp, Homo sapiens
ggtggacagtcctg

SEQ ID NO: 2795895 - DNA, 15 bp, Homo sapiens
ggtggacagtcctgg

SEQ ID NO: 2795896 - DNA, 18 bp, Homo sapiens
ggtggacagtcctgggag

SEQ ID NO: 2795897 - DNA, 19 bp, Homo sapiens
ggtggaggttgcagtgagc

SEQ ID NO: 2795898 - DNA, 20 bp, Homo sapiens
ggtggaggttgcagtgagct

SEQ ID NO: 2795899 - DNA, 17 bp, Homo sapiens
ggtggatcacagaggct

SEQ ID NO: 2795900 - DNA, 16 bp, Homo sapiens
ggtggatcacctgagg

SEQ ID NO: 2795901 - DNA, 13 bp, Homo sapiens
ggtggatgcctgg

SEQ ID NO: 2795902 - DNA, 15 bp, Homo sapiens
ggtggcaggaccagg

SEQ ID NO: 2795903 - DNA, 19 bp, Homo sapiens
ggtggcagtgggagctgcc

SEQ ID NO: 2795904 - DNA, 15 bp, Homo sapiens
ggtggccatgcttct

SEQ ID NO: 2795905 - DNA, 19 bp, Homo sapiens
ggtggccatgtcgcctgcc

SEQ ID NO: 2795906 - DNA, 18 bp, Homo sapiens
ggtggctactctgtgcca

SEQ ID NO: 2795907 - DNA, 15 bp, Homo sapiens
ggtggctgacccagt

SEQ ID NO: 2795908 - DNA, 14 bp, Homo sapiens
ggtggctgtctctg

SEQ ID NO: 2795909 - DNA, 23 bp, Homo sapiens
ggtggcttttgcggttcaggaaa

SEQ ID NO: 2795910 - DNA, 12 bp, Homo sapiens
ggtgggaatcag

SEQ ID NO: 2795911 - DNA, 19 bp, Homo sapiens
ggtgggcagcagctcagcc

SEQ ID NO: 2795912 - DNA, 12 bp, Homo sapiens
ggtgggcagggc

SEQ ID NO: 2795913 - DNA, 15 bp, Homo sapiens
ggtgggcagggctgg

SEQ ID NO: 2795914 - DNA, 17 bp, Homo sapiens
ggtgggcagggctggga

SEQ ID NO: 2795915 - DNA, 13 bp, Homo sapiens
ggtgggctgagcc

SEQ ID NO: 2795916 - DNA, 12 bp, Homo sapiens
ggtggggcagct

SEQ ID NO: 2795917 - DNA, 13 bp, Homo sapiens
ggtggggcagctt

SEQ ID NO: 2795918 - DNA, 17 bp, Homo sapiens
ggtggggcagcttgagg

SEQ ID NO: 2795919 - DNA, 17 bp, Homo sapiens
ggtgggttttcttccca

SEQ ID NO: 2795920 - DNA, 15 bp, Homo sapiens
ggtggtgacctctgc

SEQ ID NO: 2795921 - DNA, 14 bp, Homo sapiens
ggtggtggatctgt

SEQ ID NO: 2795922 - DNA, 21 bp, Homo sapiens
ggtggtggatctgtccaagga

SEQ ID NO: 2795923 - DNA, 21 bp, Homo sapiens
ggtgtaattaataaacgaaga

SEQ ID NO: 2795924 - DNA, 17 bp, Homo sapiens
ggtgtcaagagggtctg

SEQ ID NO: 2795925 - DNA, 19 bp, Homo sapiens
ggtgtcaagagggtctgag

SEQ ID NO: 2795926 - DNA, 15 bp, Homo sapiens
ggtgtgccaaactac

SEQ ID NO: 2795927 - DNA, 13 bp, Homo sapiens
ggtgtgccaggct

SEQ ID NO: 2795928 - DNA, 17 bp, Homo sapiens
ggtgtttcaaaagtgga

SEQ ID NO: 2795929 - DNA, 22 bp, Homo sapiens
ggttcaagcgattcttctgctt

SEQ ID NO: 2795930 - DNA, 17 bp, Homo sapiens
ggttcagcccctcctct

SEQ ID NO: 2795931 - DNA, 21 bp, Homo sapiens
ggttcagggttggcccctgcc

SEQ ID NO: 2795932 - DNA, 13 bp, Homo sapiens
ggttccatgcctg

SEQ ID NO: 2795933 - DNA, 14 bp, Homo sapiens
ggttccatgcctga

SEQ ID NO: 2795934 - DNA, 16 bp, Homo sapiens
ggttcccaataaaagt

SEQ ID NO: 2795935 - DNA, 17 bp, Homo sapiens
ggttcccaataaaagtg

SEQ ID NO: 2795936 - DNA, 16 bp, Homo sapiens
ggttccctctgagaat

SEQ ID NO: 2795937 - DNA, 16 bp, Homo sapiens
ggttcttagtgtcact

SEQ ID NO: 2795938 - DNA, 16 bp, Homo sapiens
ggttgactttcaggta

SEQ ID NO: 2795939 - DNA, 19 bp, Homo sapiens
ggttgaggtggaagccctc

SEQ ID NO: 2795940 - DNA, 22 bp, Homo sapiens
ggttgctgttgatgaggcctct

SEQ ID NO: 2795941 - DNA, 14 bp, Homo sapiens
ggttgggctggtgt

SEQ ID NO: 2795942 - DNA, 14 bp, Homo sapiens
ggttgtgaggcctg

SEQ ID NO: 2795943 - DNA, 19 bp, Homo sapiens
ggtttaatgttttggccaa

SEQ ID NO: 2795944 - DNA, 19 bp, Homo sapiens
ggtttacattcatctcatt

SEQ ID NO: 2795945 - DNA, 13 bp, Homo sapiens
ggtttactgctgt

SEQ ID NO: 2795946 - DNA, 14 bp, Homo sapiens
ggtttactgctgtc

SEQ ID NO: 2795947 - DNA, 18 bp, Homo sapiens
ggtttactgctgtcattg

SEQ ID NO: 2795948 - DNA, 20 bp, Homo sapiens
ggtttcaccatgttggccag

SEQ ID NO: 2795949 - DNA, 17 bp, Homo sapiens
ggtttctgagttcctgc

SEQ ID NO: 2795950 - DNA, 12 bp, Homo sapiens
ggtttgaaagcc

SEQ ID NO: 2795951 - DNA, 15 bp, Homo sapiens
ggtttgaatataaac

SEQ ID NO: 2795952 - DNA, 17 bp, Homo sapiens
ggtttgtttttcaaagc

SEQ ID NO: 2795953 - DNA, 15 bp, Homo sapiens
gtaaaaagattatat

SEQ ID NO: 2795954 - DNA, 21 bp, Homo sapiens
gtaaaaagattatatatcata

SEQ ID NO: 2795955 - DNA, 11 bp, Homo sapiens
gtaaaacattt

SEQ ID NO: 2795956 - DNA, 12 bp, Homo sapiens
gtaaaagcaaaa

SEQ ID NO: 2795957 - DNA, 18 bp, Homo sapiens
gtaaaagcaaaaaagaaa

SEQ ID NO: 2795958 - DNA, 15 bp, Homo sapiens
gtaaacagtgcctgc

SEQ ID NO: 2795959 - DNA, 20 bp, Homo sapiens
gtaaacagtgcctgctgaat

SEQ ID NO: 2795960 - DNA, 14 bp, Homo sapiens
gtaaagaataaatg

SEQ ID NO: 2795961 - DNA, 15 bp, Homo sapiens
gtaaagaataaatga

SEQ ID NO: 2795962 - DNA, 15 bp, Homo sapiens
gtaaagtcaaggaga

SEQ ID NO: 2795963 - DNA, 16 bp, Homo sapiens
gtaaatacatgtgtgg

SEQ ID NO: 2795964 - DNA, 20 bp, Homo sapiens
gtaaatagttttaaatatga

SEQ ID NO: 2795965 - DNA, 12 bp, Homo sapiens
gtaaatatttat

SEQ ID NO: 2795966 - DNA, 23 bp, Homo sapiens
gtaaatattttaaagaattgtgt

SEQ ID NO: 2795967 - DNA, 17 bp, Homo sapiens
gtaaatggagcttgtac

SEQ ID NO: 2795968 - DNA, 19 bp, Homo sapiens
gtaaatttagcatatcaat

SEQ ID NO: 2795969 - DNA, 14 bp, Homo sapiens
gtaacaagccagat

SEQ ID NO: 2795970 - DNA, 11 bp, Homo sapiens
gtaacatcctt

SEQ ID NO: 2795971 - DNA, 17 bp, Homo sapiens
gtaacatcctttctatt

SEQ ID NO: 2795972 - DNA, 17 bp, Homo sapiens
gtaactactttttatac

SEQ ID NO: 2795973 - DNA, 19 bp, Homo sapiens
gtaactactttttatactc

SEQ ID NO: 2795974 - DNA, 20 bp, Homo sapiens
gtaactactttttatactcc

SEQ ID NO: 2795975 - DNA, 23 bp, Homo sapiens
gtaactactttttatactccata

SEQ ID NO: 2795976 - DNA, 23 bp, Homo sapiens
gtaactctaattcccattttgca

SEQ ID NO: 2795977 - DNA, 18 bp, Homo sapiens
gtaacttttacaaaacat

SEQ ID NO: 2795978 - DNA, 14 bp, Homo sapiens
gtaacttttgtaag

SEQ ID NO: 2795979 - DNA, 17 bp, Homo sapiens
gtaacttttgtaagaca

SEQ ID NO: 2795980 - DNA, 23 bp, Homo sapiens
gtaagagctgatgtgagtgtgtg

SEQ ID NO: 2795981 - DNA, 19 bp, Homo sapiens
gtaagatggcttatttgta

SEQ ID NO: 2795982 - DNA, 17 bp, Homo sapiens
gtaagctctggctttct

SEQ ID NO: 2795983 - DNA, 18 bp, Homo sapiens
gtcaccaggaatgttaaa

SEQ ID NO: 2795984 - DNA, 21 bp, Homo sapiens
gtcaccgtggaccttcctgcc

SEQ ID NO: 2795985 - DNA, 16 bp, Homo sapiens
gtcacctcagagacat

SEQ ID NO: 2795986 - DNA, 16 bp, Homo sapiens
gtcacgcagccaccag

SEQ ID NO: 2795987 - DNA, 13 bp, Homo sapiens
gtcactagcagct

SEQ ID NO: 2795988 - DNA, 14 bp, Homo sapiens
gtcactagcagctg

SEQ ID NO: 2795989 - DNA, 12 bp, Homo sapiens
gtcactcccaga

SEQ ID NO: 2795990 - DNA, 20 bp, Homo sapiens
gtcactcttcctgcaaggac

SEQ ID NO: 2795991 - DNA, 19 bp, Homo sapiens
gtcagaacagcagactcag

SEQ ID NO: 2795992 - DNA, 24 bp, Homo sapiens
gtcagactgctgggactggccagg

SEQ ID NO: 2795993 - DNA, 15 bp, Homo sapiens
gtcagactttaaaga

SEQ ID NO: 2795994 - DNA, 16 bp, Homo sapiens
gtcagagcctgcagtt

SEQ ID NO: 2795995 - DNA, 15 bp, Homo sapiens
gtcagccaaatgtaa

SEQ ID NO: 2795996 - DNA, 12 bp, Homo sapiens
gtcagccagggc

SEQ ID NO: 2795997 - DNA, 16 bp, Homo sapiens
gtcaggaacagaagga

SEQ ID NO: 2795998 - DNA, 17 bp, Homo sapiens
gtcaggaacagaaggat

SEQ ID NO: 2795999 - DNA, 15 bp, Homo sapiens
gtcaggacctggctt

SEQ ID NO: 2796000 - DNA, 16 bp, Homo sapiens
gtcaggtggggcagct

SEQ ID NO: 2796001 - DNA, 18 bp, Homo sapiens
gtcataactaaataaagc

SEQ ID NO: 2796002 - DNA, 22 bp, Homo sapiens
gtcatagaaattacacccaaag

SEQ ID NO: 2796003 - DNA, 14 bp, Homo sapiens
gtcatatattcatg

SEQ ID NO: 2796004 - DNA, 20 bp, Homo sapiens
gtcatattaaacttctgatt

SEQ ID NO: 2796005 - DNA, 13 bp, Homo sapiens
gtcatcatacatg

SEQ ID NO: 2796006 - DNA, 12 bp, Homo sapiens
gtcatccacagc

SEQ ID NO: 2796007 - DNA, 23 bp, Homo sapiens
gtcatccagaaaatgtgtcagca

SEQ ID NO: 2796008 - DNA, 15 bp, Homo sapiens
gtcatcccgctcctg

SEQ ID NO: 2796009 - DNA, 20 bp, Homo sapiens
gtcatctcagggtccagacc

SEQ ID NO: 2796010 - DNA, 18 bp, Homo sapiens
gtcatctttttctctaaa

SEQ ID NO: 2796011 - DNA, 15 bp, Homo sapiens
gtcatgatctccctg

SEQ ID NO: 2796012 - DNA, 16 bp, Homo sapiens
gtcatgatctccctgc

SEQ ID NO: 2796013 - DNA, 14 bp, Homo sapiens
gtcatgtaccatca

SEQ ID NO: 2796014 - DNA, 15 bp, Homo sapiens
gtcatgtaccatcaa

SEQ ID NO: 2796015 - DNA, 15 bp, Homo sapiens
gtcatgtgacaggta

SEQ ID NO: 2796016 - DNA, 14 bp, Homo sapiens
gtcattaaaataaa

SEQ ID NO: 2796017 - DNA, 22 bp, Homo sapiens
gtcattaaaataaataaatgca

SEQ ID NO: 2796018 - DNA, 11 bp, Homo sapiens
gtcattaaatg

SEQ ID NO: 2796019 - DNA, 21 bp, Homo sapiens
gtcatttgagcagggctcagc

SEQ ID NO: 2796020 - DNA, 22 bp, Homo sapiens
gtcatttgagcagggctcagcg

SEQ ID NO: 2796021 - DNA, 22 bp, Homo sapiens
gtcatttgctgagcatgtactg

SEQ ID NO: 2796022 - DNA, 18 bp, Homo sapiens
gtcattttggtactttgg

SEQ ID NO: 2796023 - DNA, 20 bp, Homo sapiens
gtcattttggtactttggtg

SEQ ID NO: 2796024 - DNA, 14 bp, Homo sapiens
gtccacccagcaaa

SEQ ID NO: 2796025 - DNA, 14 bp, Homo sapiens
gtccacccaggagc

SEQ ID NO: 2796026 - DNA, 15 bp, Homo sapiens
gtccacctgcctatc

SEQ ID NO: 2796027 - DNA, 15 bp, Homo sapiens
gtccagaagaatatt

SEQ ID NO: 2796028 - DNA, 16 bp, Homo sapiens
gtccagaataagtgct

SEQ ID NO: 2796029 - DNA, 19 bp, Homo sapiens
gtccagaataagtgctgtt

SEQ ID NO: 2796030 - DNA, 14 bp, Homo sapiens
gtccagaccctgaa

SEQ ID NO: 2796031 - DNA, 14 bp, Homo sapiens
gtccagggccctga

SEQ ID NO: 2796032 - DNA, 20 bp, Homo sapiens
gtccagggccctgagctcgg

SEQ ID NO: 2796033 - DNA, 21 bp, Homo sapiens
gtccagggcgggagtgggggc

SEQ ID NO: 2796034 - DNA, 17 bp, Homo sapiens
gtccatatcagacctct

SEQ ID NO: 2796035 - DNA, 23 bp, Homo sapiens
gtcccaaggaaagccccagcact

SEQ ID NO: 2796036 - DNA, 17 bp, Homo sapiens
gtcccacactggtgact

SEQ ID NO: 2796037 - DNA, 14 bp, Homo sapiens
gtcccacatccctg

SEQ ID NO: 2796038 - DNA, 18 bp, Homo sapiens
gtcccacatccctgggcc

SEQ ID NO: 2796039 - DNA, 20 bp, Homo sapiens
gtcccacatccctgggcctg

SEQ ID NO: 2796040 - DNA, 22 bp, Homo sapiens
gtcccacatccctgggcctgct

SEQ ID NO: 2796041 - DNA, 12 bp, Homo sapiens
gtcccacctctt

SEQ ID NO: 2796042 - DNA, 14 bp, Homo sapiens
gtcccacctcttct

SEQ ID NO: 2796043 - DNA, 21 bp, Homo sapiens
gtcccacctcttctcttcctg

SEQ ID NO: 2796044 - DNA, 15 bp, Homo sapiens
gtcccaccttggctg

SEQ ID NO: 2796045 - DNA, 17 bp, Homo sapiens
gtcccaccttggctgca

SEQ ID NO: 2796046 - DNA, 14 bp, Homo sapiens
gtcccactcagtcc

SEQ ID NO: 2796047 - DNA, 22 bp, Homo sapiens
gtcccagaaaaagcatcatggc

SEQ ID NO: 2796048 - DNA, 12 bp, Homo sapiens
gtcccaggcaga

SEQ ID NO: 2796049 - DNA, 14 bp, Homo sapiens
gtcccatctgctcc

SEQ ID NO: 2796050 - DNA, 16 bp, Homo sapiens
gtcccatctgctcctc

SEQ ID NO: 2796051 - DNA, 15 bp, Homo sapiens
gtcccatttccttgg

SEQ ID NO: 2796052 - DNA, 21 bp, Homo sapiens
gtccccccccaacctttccct

SEQ ID NO: 2796053 - DNA, 20 bp, Homo sapiens
gtccctcaaatgacccaaag

SEQ ID NO: 2796054 - DNA, 21 bp, Homo sapiens
gtccctctcggaaggctggct

SEQ ID NO: 2796055 - DNA, 20 bp, Homo sapiens
gtccctctttgcctgtgtga

SEQ ID NO: 2796056 - DNA, 23 bp, Homo sapiens
gtccctctttgcctgtgtgagca

SEQ ID NO: 2796057 - DNA, 17 bp, Homo sapiens
gcctcggagcctcatcc

SEQ ID NO: 2796058 - DNA, 23 bp, Homo sapiens
gcctcggagcctcatccgaggca

SEQ ID NO: 2796059 - DNA, 21 bp, Homo sapiens
gcctcggtggccatgcttctt

SEQ ID NO: 2796060 - DNA, 18 bp, Homo sapiens
gcctctactgggaaggct

SEQ ID NO: 2796061 - DNA, 19 bp, Homo sapiens
gcctctgacacacagctct

SEQ ID NO: 2796062 - DNA, 12 bp, Homo sapiens
gcctctgaggcc

SEQ ID NO: 2796063 - DNA, 15 bp, Homo sapiens
gcctctgaggccagc

SEQ ID NO: 2796064 - DNA, 13 bp, Homo sapiens
gcctctgcctccc

SEQ ID NO: 2796065 - DNA, 14 bp, Homo sapiens
gcctctgtccctct

SEQ ID NO: 2796066 - DNA, 20 bp, Homo sapiens
gcctcttaaagctgcctgta

SEQ ID NO: 2796067 - DNA, 21 bp, Homo sapiens
gcctcttggacctctgctctg

SEQ ID NO: 2796068 - DNA, 12 bp, Homo sapiens
gcctcttttctc

SEQ ID NO: 2796069 - DNA, 15 bp, Homo sapiens
gcctgaagtcacaca

SEQ ID NO: 2796070 - DNA, 18 bp, Homo sapiens
gcctgaagtcacacagtg

SEQ ID NO: 2796071 - DNA, 12 bp, Homo sapiens
gcctgagcccag

SEQ ID NO: 2796072 - DNA, 15 bp, Homo sapiens
gcctgagcccaggga

SEQ ID NO: 2796073 - DNA, 20 bp, Homo sapiens
gcctgagcccagggaggccg

SEQ ID NO: 2796074 - DNA, 13 bp, Homo sapiens
gcctgaggctgag

SEQ ID NO: 2796075 - DNA, 14 bp, Homo sapiens
gcctgaggctgaga

SEQ ID NO: 2796076 - DNA, 12 bp, Homo sapiens
gcctgagggtgg

SEQ ID NO: 2796077 - DNA, 15 bp, Homo sapiens
gcctgagggtggaga

SEQ ID NO: 2796078 - DNA, 15 bp, Homo sapiens
gcctgagtctcctgt

SEQ ID NO: 2796079 - DNA, 12 bp, Homo sapiens
gcctgcagagag

SEQ ID NO: 2796080 - DNA, 18 bp, Homo sapiens
gcctgcagagagaagcct

SEQ ID NO: 2796081 - DNA, 10 bp, Homo sapiens
gcctgcagcc

SEQ ID NO: 2796082 - DNA, 20 bp, Homo sapiens
gcctgcatcatgacaaagtt

SEQ ID NO: 2796083 - DNA, 13 bp, Homo sapiens
gcctgccagggcc

SEQ ID NO: 2796084 - DNA, 18 bp, Homo sapiens
gcctgccagggcccctgt

SEQ ID NO: 2796085 - DNA, 22 bp, Homo sapiens
gcctgcccagcctcgcatgcca

SEQ ID NO: 2796086 - DNA, 14 bp, Homo sapiens
gcctgccgagcaac

SEQ ID NO: 2796087 - DNA, 20 bp, Homo sapiens
gcctgccgagcaaccgtggc

SEQ ID NO: 2796088 - DNA, 20 bp, Homo sapiens
gcctgcctcagctgctcgca

SEQ ID NO: 2796089 - DNA, 12 bp, Homo sapiens
gcctgcctctga

SEQ ID NO: 2796090 - DNA, 17 bp, Homo sapiens
gcctgcctgttcccatt

SEQ ID NO: 2796091 - DNA, 23 bp, Homo sapiens
gcctgccttgaagccactgaagc

SEQ ID NO: 2796092 - DNA, 20 bp, Homo sapiens
gcctgcgttttggaagctct

SEQ ID NO: 2796093 - DNA, 17 bp, Homo sapiens
gcctgctaattccccag

SEQ ID NO: 2796094 - DNA, 20 bp, Homo sapiens
gcctgctatttgaagtgtaa

SEQ ID NO: 2796095 - DNA, 16 bp, Homo sapiens
gcctgctcccagcagc

SEQ ID NO: 2796096 - DNA, 17 bp, Homo sapiens
gcctgctcccccacccc

SEQ ID NO: 2796097 - DNA, 18 bp, Homo sapiens
gcctgctgctgagaacct

SEQ ID NO: 2796098 - DNA, 20 bp, Homo sapiens
gcctgctgctgagaacctgg

SEQ ID NO: 2796099 - DNA, 13 bp, Homo sapiens
gcctgctgggctc

SEQ ID NO: 2796100 - DNA, 21 bp, Homo sapiens
gcctgctgggctctccacctc

SEQ ID NO: 2796101 - DNA, 21 bp, Homo sapiens
gcctggaagggaagtgagaaa

SEQ ID NO: 2796102 - DNA, 15 bp, Homo sapiens
gcctggagaagctga

SEQ ID NO: 2796103 - DNA, 13 bp, Homo sapiens
gcctggaggacct

SEQ ID NO: 2796104 - DNA, 18 bp, Homo sapiens
gcctggaggacctgagcc

SEQ ID NO: 2796105 - DNA, 20 bp, Homo sapiens
gcctggaggacctgagcctg

SEQ ID NO: 2796106 - DNA, 14 bp, Homo sapiens
gcctggccagatgc

SEQ ID NO: 2796107 - DNA, 15 bp, Homo sapiens
gcctggccagatgca

SEQ ID NO: 2796108 - DNA, 13 bp, Homo sapiens
gcctggccaggca

SEQ ID NO: 2796109 - DNA, 19 bp, Homo sapiens
gcctggcccccctccaggc

SEQ ID NO: 2796110 - DNA, 15 bp, Homo sapiens
gcctggccggcaacc

SEQ ID NO: 2796111 - DNA, 18 bp, Homo sapiens
gcctggccggcaacccca

SEQ ID NO: 2796112 - DNA, 15 bp, Homo sapiens
gcctggccggctcca

SEQ ID NO: 2796113 - DNA, 13 bp, Homo sapiens
gcctggcctggca

SEQ ID NO: 2796114 - DNA, 12 bp, Homo sapiens
gcctggctggct

SEQ ID NO: 2796115 - DNA, 17 bp, Homo sapiens
gcctggctggctgaggg

SEQ ID NO: 2796116 - DNA, 13 bp, Homo sapiens
gcctggcttctgg

SEQ ID NO: 2796117 - DNA, 23 bp, Homo sapiens
gcctggcttctggagcccttggg

SEQ ID NO: 2796118 - DNA, 12 bp, Homo sapiens
gcctgggcaaga

SEQ ID NO: 2796119 - DNA, 20 bp, Homo sapiens
gcctgggcctatggagagcc

SEQ ID NO: 2796120 - DNA, 20 bp, Homo sapiens
gcctggggctctaacgcctg

SEQ ID NO: 2796121 - DNA, 21 bp, Homo sapiens
gcctggggctctaacgcctga

SEQ ID NO: 2796122 - DNA, 22 bp, Homo sapiens
gcctggggctctaacgcctgag

SEQ ID NO: 2796123 - DNA, 23 bp, Homo sapiens
gcctggggctctaacgcctgagc

SEQ ID NO: 2796124 - DNA, 13 bp, Homo sapiens
gcctgggggcctg

SEQ ID NO: 2796125 - DNA, 14 bp, Homo sapiens
gcctgggggcctgg

SEQ ID NO: 2796126 - DNA, 18 bp, Homo sapiens
gcctggggtgacccggca

SEQ ID NO: 2796127 - DNA, 15 bp, Homo sapiens
gcctgggtggggctg

SEQ ID NO: 2796128 - DNA, 19 bp, Homo sapiens
gcctgggtggggctgctcc

SEQ ID NO: 2796129 - DNA, 22 bp, Homo sapiens
gcctgggtggggctgctcctcc

SEQ ID NO: 2796130 - DNA, 24 bp, Homo sapiens
gcctgggtggggctgctcctccag

SEQ ID NO: 2796131 - DNA, 14 bp, Homo sapiens
gcctggtggcagct

SEQ ID NO: 2796132 - DNA, 18 bp, Homo sapiens
gcctggtggcagctgcgg

SEQ ID NO: 2796133 - DNA, 18 bp, Homo sapiens
gcctggtgggccacgtgt

SEQ ID NO: 2796134 - DNA, 15 bp, Homo sapiens
gcctgtaatcccagc

SEQ ID NO: 2796135 - DNA, 17 bp, Homo sapiens
gcctgtactgcctgctt

SEQ ID NO: 2796136 - DNA, 20 bp, Homo sapiens
gcctgtactgcctgcttggg

SEQ ID NO: 2796137 - DNA, 16 bp, Homo sapiens
gcctgtagttaggaaa

SEQ ID NO: 2796138 - DNA, 17 bp, Homo sapiens
gcctgtagttaggaaat

SEQ ID NO: 2796139 - DNA, 19 bp, Homo sapiens
gcctgtagttaggaaataa

SEQ ID NO: 2796140 - DNA, 14 bp, Homo sapiens
gcctgtgaacccag

SEQ ID NO: 2796141 - DNA, 15 bp, Homo sapiens
gcctgtgaacccagg

SEQ ID NO: 2796142 - DNA, 18 bp, Homo sapiens
gcctgtgaacccaggaca

SEQ ID NO: 2796143 - DNA, 15 bp, Homo sapiens
gcctgtgctgcccgt

SEQ ID NO: 2796144 - DNA, 16 bp, Homo sapiens
gcctgtgctgcccgtc

SEQ ID NO: 2796145 - DNA, 19 bp, Homo sapiens
gcctgtggcggtgcctggg

SEQ ID NO: 2796146 - DNA, 20 bp, Homo sapiens
gcctgtgtagctgtgacctg

SEQ ID NO: 2796147 - DNA, 21 bp, Homo sapiens
gcctgtgtagctgtgacctgc

SEQ ID NO: 2796148 - DNA, 19 bp, Homo sapiens
gagaggggaacagactgga

SEQ ID NO: 2796149 - DNA, 13 bp, Homo sapiens
gagagggtctgga

SEQ ID NO: 2796150 - DNA, 19 bp, Homo sapiens
gagagtacagtgagccaag

SEQ ID NO: 2796151 - DNA, 15 bp, Homo sapiens
gagagtcctctggat

SEQ ID NO: 2796152 - DNA, 24 bp, Homo sapiens
gagataaccacaaccaggaagaac

SEQ ID NO: 2796153 - DNA, 16 bp, Homo sapiens
gagatatggcagcgaa

SEQ ID NO: 2796154 - DNA, 17 bp, Homo sapiens
gagatatggcagcgaaa

SEQ ID NO: 2796155 - DNA, 12 bp, Homo sapiens
gagatcagagtc

SEQ ID NO: 2796156 - DNA, 17 bp, Homo sapiens
gagatcccgcctcttct

SEQ ID NO: 2796157 - DNA, 22 bp, Homo sapiens
gagatcgtgccgttactctcca

SEQ ID NO: 2796158 - DNA, 13 bp, Homo sapiens
gagatgactgagt

SEQ ID NO: 2796159 - DNA, 16 bp, Homo sapiens
gagatgactgagtcct

SEQ ID NO: 2796160 - DNA, 14 bp, Homo sapiens
gagatgcctccacc

SEQ ID NO: 2796161 - DNA, 23 bp, Homo sapiens
gagatgcctccaccgctgcctaa

SEQ ID NO: 2796162 - DNA, 20 bp, Homo sapiens
gagatggaagttgcagtgag

SEQ ID NO: 2796163 - DNA, 18 bp, Homo sapiens
gagatggagttcttgtgc

SEQ ID NO: 2796164 - DNA, 18 bp, Homo sapiens
gagatgggcttgttttct

SEQ ID NO: 2796165 - DNA, 21 bp, Homo sapiens
gagattgcgccactgcactcc

SEQ ID NO: 2796166 - DNA, 16 bp, Homo sapiens
gagatttgtatttata

SEQ ID NO: 2796167 - DNA, 12 bp, Homo sapiens
gagcaaagcctg

SEQ ID NO: 2796168 - DNA, 22 bp, Homo sapiens
gagcaaagcctgttcatggcag

SEQ ID NO: 2796169 - DNA, 15 bp, Homo sapiens
gagcaaatgtttctg

SEQ ID NO: 2796170 - DNA, 20 bp, Homo sapiens
gagcaaccgtggcccttcct

SEQ ID NO: 2796171 - DNA, 22 bp, Homo sapiens
gagcaaccgtggcccttcctgg

SEQ ID NO: 2796172 - DNA, 12 bp, Homo sapiens
gagcaagactct

SEQ ID NO: 2796173 - DNA, 15 bp, Homo sapiens
gagcaagagaacatt

SEQ ID NO: 2796174 - DNA, 13 bp, Homo sapiens
gagcaagagctgg

SEQ ID NO: 2796175 - DNA, 17 bp, Homo sapiens
gagcaattcatttcact

SEQ ID NO: 2796176 - DNA, 21 bp, Homo sapiens
gagcacacaggtacagcaaca

SEQ ID NO: 2796177 - DNA, 13 bp, Homo sapiens
gagcacaggcagc

SEQ ID NO: 2796178 - DNA, 14 bp, Homo sapiens
gagcacaggcagct

SEQ ID NO: 2796179 - DNA, 15 bp, Homo sapiens
gagcacaggcagctg

SEQ ID NO: 2796180 - DNA, 23 bp, Homo sapiens
gagcaccaggcacgaacccacct

SEQ ID NO: 2796181 - DNA, 12 bp, Homo sapiens
gagcacctgctt

SEQ ID NO: 2796182 - DNA, 21 bp, Homo sapiens
gagcactaaggtgtgctctga

SEQ ID NO: 2796183 - DNA, 13 bp, Homo sapiens
gagcactgccagg

SEQ ID NO: 2796184 - DNA, 16 bp, Homo sapiens
gagcactgccaggagg

SEQ ID NO: 2796185 - DNA, 18 bp, Homo sapiens
gagcactgccaggaggga

SEQ ID NO: 2796186 - DNA, 14 bp, Homo sapiens
gagcactggagtgc

SEQ ID NO: 2796187 - DNA, 20 bp, Homo sapiens
gagcactggagtgcagggag

SEQ ID NO: 2796188 - DNA, 19 bp, Homo sapiens
gagcagaaagccagggtcc

SEQ ID NO: 2796189 - DNA, 19 bp, Homo sapiens
gagcagaggagtccagggc

SEQ ID NO: 2796190 - DNA, 13 bp, Homo sapiens
gagcagctgagca

SEQ ID NO: 2796191 - DNA, 15 bp, Homo sapiens
gagcagctgagcagg

SEQ ID NO: 2796192 - DNA, 18 bp, Homo sapiens
gagcagctgagcagggcc

SEQ ID NO: 2796193 - DNA, 15 bp, Homo sapiens
gagcaggcacatgga

SEQ ID NO: 2796194 - DNA, 21 bp, Homo sapiens
gagcagggccggggaactggc

SEQ ID NO: 2796195 - DNA, 16 bp, Homo sapiens
gagcaggggcagggtg

SEQ ID NO: 2796196 - DNA, 16 bp, Homo sapiens
gagcagtcacactgtt

SEQ ID NO: 2796197 - DNA, 11 bp, Homo sapiens
gagcagtgtct

SEQ ID NO: 2796198 - DNA, 17 bp, Homo sapiens
gagcatcatgcctctga

SEQ ID NO: 2796199 - DNA, 21 bp, Homo sapiens
gagcatcatgcctctgaggcc

SEQ ID NO: 2796200 - DNA, 23 bp, Homo sapiens
gagcatcatgcctctgaggccag

SEQ ID NO: 2796201 - DNA, 18 bp, Homo sapiens
gagcattacgtgagccag

SEQ ID NO: 2796202 - DNA, 21 bp, Homo sapiens
gagcattacgtgagccaggta

SEQ ID NO: 2796203 - DNA, 24 bp, Homo sapiens
gagcatttccctcccgggagagga

SEQ ID NO: 2796204 - DNA, 20 bp, Homo sapiens
gagccaacagaagcttccat

SEQ ID NO: 2796205 - DNA, 14 bp, Homo sapiens
gagccaacagcagc

SEQ ID NO: 2796206 - DNA, 23 bp, Homo sapiens
gagccaactcactcttatgaaat

SEQ ID NO: 2796207 - DNA, 21 bp, Homo sapiens
gagccaagatcgcgccactgc

SEQ ID NO: 2796208 - DNA, 12 bp, Homo sapiens
gagccagccctc

SEQ ID NO: 2796209 - DNA, 13 bp, Homo sapiens
gagccagccctcc

SEQ ID NO: 2796210 - DNA, 14 bp, Homo sapiens
gagccagccctccc

SEQ ID NO: 2796211 - DNA, 20 bp, Homo sapiens
gagccagccctccctgtcct

SEQ ID NO: 2796212 - DNA, 21 bp, Homo sapiens
gagccagccctccctgtcctc

SEQ ID NO: 2796213 - DNA, 19 bp, Homo sapiens
gagccagggtctcactatg

SEQ ID NO: 2796214 - DNA, 19 bp, Homo sapiens
gagccaggtaatgagggac

SEQ ID NO: 2796215 - DNA, 22 bp, Homo sapiens
gagccaggtaatgagggactgg

SEQ ID NO: 2796216 - DNA, 15 bp, Homo sapiens
gagccatgtaccagt

SEQ ID NO: 2796217 - DNA, 15 bp, Homo sapiens
gagcccaccttggct

SEQ ID NO: 2796218 - DNA, 17 bp, Homo sapiens
gagcccaccttggctca

SEQ ID NO: 2796219 - DNA, 20 bp, Homo sapiens
gagcccagaaaacctccagt

SEQ ID NO: 2796220 - DNA, 16 bp, Homo sapiens
gagccccacacggagg

SEQ ID NO: 2796221 - DNA, 13 bp, Homo sapiens
gagccccccacaa

SEQ ID NO: 2796222 - DNA, 14 bp, Homo sapiens
gagccccgaggcct

SEQ ID NO: 2796223 - DNA, 23 bp, Homo sapiens
gagccctgcagccaaacagagcc

SEQ ID NO: 2796224 - DNA, 12 bp, Homo sapiens
gagccctgggac

SEQ ID NO: 2796225 - DNA, 13 bp, Homo sapiens
gagccctggtggc

SEQ ID NO: 2796226 - DNA, 14 bp, Homo sapiens
gagccctggtggca

SEQ ID NO: 2796227 - DNA, 18 bp, Homo sapiens
gagccctggtggcagtgg

SEQ ID NO: 2796228 - DNA, 19 bp, Homo sapiens
gagccgagatcacgccact

SEQ ID NO: 2796229 - DNA, 21 bp, Homo sapiens
gagccgcatcttctccatctg

SEQ ID NO: 2796230 - DNA, 23 bp, Homo sapiens
gagccggcacctacatccccagg

SEQ ID NO: 2796231 - DNA, 20 bp, Homo sapiens
gagccgggcctggggctcct

SEQ ID NO: 2796232 - DNA, 15 bp, Homo sapiens
gagcctaaatctaat

SEQ ID NO: 2796233 - DNA, 17 bp, Homo sapiens
gagcctcagcatcctgg

SEQ ID NO: 2796234 - DNA, 22 bp, Homo sapiens
gagcctcctctctcaaactggg

SEQ ID NO: 2796235 - DNA, 16 bp, Homo sapiens
gagcctcggtggccat

SEQ ID NO: 2796236 - DNA, 21 bp, Homo sapiens
gagcctgcaaactcactgctc

SEQ ID NO: 2796237 - DNA, 13 bp, Homo sapiens
gagcctgccgagc

SEQ ID NO: 2796238 - DNA, 15 bp, Homo sapiens
gcctcacagaagaat

SEQ ID NO: 2796239 - DNA, 16 bp, Homo sapiens
gcctcacgcccagcct

SEQ ID NO: 2796240 - DNA, 23 bp, Homo sapiens
gcctcacgcccagcctcctccca

SEQ ID NO: 2796241 - DNA, 20 bp, Homo sapiens
gcctcacttgaatgtgtcac

SEQ ID NO: 2796242 - DNA, 23 bp, Homo sapiens
gcctcacttttaatgaacaaatg

SEQ ID NO: 2796243 - DNA, 20 bp, Homo sapiens
gcctcagaccaactctctcc

SEQ ID NO: 2796244 - DNA, 15 bp, Homo sapiens
gcctcagcatcctgg

SEQ ID NO: 2796245 - DNA, 16 bp, Homo sapiens
gcctcagcatcctggc

SEQ ID NO: 2796246 - DNA, 16 bp, Homo sapiens
gcctcagctgctcgca

SEQ ID NO: 2796247 - DNA, 20 bp, Homo sapiens
gcctcagctgctcgcacaga

SEQ ID NO: 2796248 - DNA, 12 bp, Homo sapiens
gcctcagtgcca

SEQ ID NO: 2796249 - DNA, 16 bp, Homo sapiens
gcctcatccgaggcag

SEQ ID NO: 2796250 - DNA, 19 bp, Homo sapiens
gcctcatttttttccttgc

SEQ ID NO: 2796251 - DNA, 17 bp, Homo sapiens
gcctccaaatgccaact

SEQ ID NO: 2796252 - DNA, 22 bp, Homo sapiens
gcctccaaatgccaacttgtcc

SEQ ID NO: 2796253 - DNA, 18 bp, Homo sapiens
gcctccaccgctgcctaa

SEQ ID NO: 2796254 - DNA, 18 bp, Homo sapiens
gcctccaggagcctaccc

SEQ ID NO: 2796255 - DNA, 17 bp, Homo sapiens
gcctccattctgaccat

SEQ ID NO: 2796256 - DNA, 17 bp, Homo sapiens
gcctccatttagttctt

SEQ ID NO: 2796257 - DNA, 16 bp, Homo sapiens
gcctccatttctggct

SEQ ID NO: 2796258 - DNA, 17 bp, Homo sapiens
gcctcccaataaagctg

SEQ ID NO: 2796259 - DNA, 20 bp, Homo sapiens
gcctcccaataaagctggac

SEQ ID NO: 2796260 - DNA, 15 bp, Homo sapiens
gcctccccccgctgg

SEQ ID NO: 2796261 - DNA, 18 bp, Homo sapiens
gcctccccgaaacaggct

SEQ ID NO: 2796262 - DNA, 20 bp, Homo sapiens
gcctcccgaatagctgggac

SEQ ID NO: 2796263 - DNA, 21 bp, Homo sapiens
gcctcccgaatagctgggact

SEQ ID NO: 2796264 - DNA, 15 bp, Homo sapiens
gcctcccgagtagct

SEQ ID NO: 2796265 - DNA, 20 bp, Homo sapiens
gcctcccgagtagctgggac

SEQ ID NO: 2796266 - DNA, 13 bp, Homo sapiens
gcctccctcaacc

SEQ ID NO: 2796267 - DNA, 14 bp, Homo sapiens
gcctccctccaccc

SEQ ID NO: 2796268 - DNA, 17 bp, Homo sapiens
gcctccctccaccccag

SEQ ID NO: 2796269 - DNA, 21 bp, Homo sapiens
gcctccctccaccccaggacg

SEQ ID NO: 2796270 - DNA, 16 bp, Homo sapiens
gcctcctcacccccag

SEQ ID NO: 2796271 - DNA, 18 bp, Homo sapiens
gcctcctcacccccagct

SEQ ID NO: 2796272 - DNA, 19 bp, Homo sapiens
gcctcctcacccccagctt

SEQ ID NO: 2796273 - DNA, 13 bp, Homo sapiens
gcctcctcccacc

SEQ ID NO: 2796274 - DNA, 13 bp, Homo sapiens
gcctcctcctgac

SEQ ID NO: 2796275 - DNA, 12 bp, Homo sapiens
gcctcctgcctc

SEQ ID NO: 2796276 - DNA, 23 bp, Homo sapiens
gcctcctgtgtgtgcgcctacag

SEQ ID NO: 2796277 - DNA, 20 bp, Homo sapiens
gcctccttccttgctgtcct

SEQ ID NO: 2796278 - DNA, 16 bp, Homo sapiens
gcctcgaactggctgc

SEQ ID NO: 2796279 - DNA, 22 bp, Homo sapiens
gcctcgaactggctgcaaaggg

SEQ ID NO: 2796280 - DNA, 24 bp, Homo sapiens
gcctcgctccccactctgctctga

SEQ ID NO: 2796281 - DNA, 14 bp, Homo sapiens
gactatcacataca

SEQ ID NO: 2796282 - DNA, 15 bp, Homo sapiens
gactatcacatacaa

SEQ ID NO: 2796283 - DNA, 17 bp, Homo sapiens
gactatcttactatttc

SEQ ID NO: 2796284 - DNA, 14 bp, Homo sapiens
gactcaagccccgg

SEQ ID NO: 2796285 - DNA, 15 bp, Homo sapiens
gactcaataaaatca

SEQ ID NO: 2796286 - DNA, 14 bp, Homo sapiens
gactcaatgcactg

SEQ ID NO: 2796287 - DNA, 15 bp, Homo sapiens
gactcacctctgcct

SEQ ID NO: 2796288 - DNA, 16 bp, Homo sapiens
gactcagactccattt

SEQ ID NO: 2796289 - DNA, 15 bp, Homo sapiens
gactcagtttgtcag

SEQ ID NO: 2796290 - DNA, 9 bp, Homo sapiens
gactccagc

SEQ ID NO: 2796291 - DNA, 14 bp, Homo sapiens
gactccagccagcg

SEQ ID NO: 2796292 - DNA, 15 bp, Homo sapiens
gactccagccagcgc

SEQ ID NO: 2796293 - DNA, 16 bp, Homo sapiens
gactccagccagcgcc

SEQ ID NO: 2796294 - DNA, 19 bp, Homo sapiens
gactccagccagcgcctcc

SEQ ID NO: 2796295 - DNA, 22 bp, Homo sapiens
gactccagccagcgcctccctc

SEQ ID NO: 2796296 - DNA, 23 bp, Homo sapiens
gactccagccagcgcctccctcc

SEQ ID NO: 2796297 - DNA, 16 bp, Homo sapiens
gactccccaggccagg

SEQ ID NO: 2796298 - DNA, 14 bp, Homo sapiens
gactcctctgtcca

SEQ ID NO: 2796299 - DNA, 12 bp, Homo sapiens
gactcctgggct

SEQ ID NO: 2796300 - DNA, 15 bp, Homo sapiens
gactctacagaggcc

SEQ ID NO: 2796301 - DNA, 13 bp, Homo sapiens
gactctctgtgac

SEQ ID NO: 2796302 - DNA, 17 bp, Homo sapiens
gactctgtggggccttg

SEQ ID NO: 2796303 - DNA, 18 bp, Homo sapiens
gactctgtggggccttgg

SEQ ID NO: 2796304 - DNA, 16 bp, Homo sapiens
gactgacacctcactg

SEQ ID NO: 2796305 - DNA, 14 bp, Homo sapiens
gactgagcacctgc

SEQ ID NO: 2796306 - DNA, 18 bp, Homo sapiens
gactgatgacaaacccag

SEQ ID NO: 2796307 - DNA, 21 bp, Homo sapiens
gactgatgttgagggaacaga

SEQ ID NO: 2796308 - DNA, 20 bp, Homo sapiens
gactgcgatcttcagagcag

SEQ ID NO: 2796309 - DNA, 22 bp, Homo sapiens
gactgcgggatggtcctggggc

SEQ ID NO: 2796310 - DNA, 13 bp, Homo sapiens
gactggacagctt

SEQ ID NO: 2796311 - DNA, 15 bp, Homo sapiens
gactgtcatagaaat

SEQ ID NO: 2796312 - DNA, 15 bp, Homo sapiens
gactgtggctgcaga

SEQ ID NO: 2796313 - DNA, 19 bp, Homo sapiens
gactgtttttatatgcaca

SEQ ID NO: 2796314 - DNA, 18 bp, Homo sapiens
gactgtttttcggacagt

SEQ ID NO: 2796315 - DNA, 14 bp, Homo sapiens
gacttaacggctcc

SEQ ID NO: 2796316 - DNA, 16 bp, Homo sapiens
gacttacatgattcat

SEQ ID NO: 2796317 - DNA, 18 bp, Homo sapiens
gacttacatgattcattt

SEQ ID NO: 2796318 - DNA, 19 bp, Homo sapiens
gacttacatgattcatttt

SEQ ID NO: 2796319 - DNA, 15 bp, Homo sapiens
gacttcacaaaatgc

SEQ ID NO: 2796320 - DNA, 13 bp, Homo sapiens
gacttcacactgc

SEQ ID NO: 2796321 - DNA, 14 bp, Homo sapiens
gacttcacactgca

SEQ ID NO: 2796322 - DNA, 16 bp, Homo sapiens
gacttcacactgcaag

SEQ ID NO: 2796323 - DNA, 18 bp, Homo sapiens
gacttcctcgcctctccc

SEQ ID NO: 2796324 - DNA, 16 bp, Homo sapiens
gacttcgactcaggat

SEQ ID NO: 2796325 - DNA, 15 bp, Homo sapiens
gacttctctttctta

SEQ ID NO: 2796326 - DNA, 16 bp, Homo sapiens
gacttgacagtggaac

SEQ ID NO: 2796327 - DNA, 15 bp, Homo sapiens
gacttgagcctccat

SEQ ID NO: 2796328 - DNA, 13 bp, Homo sapiens
gacttggaagctc

SEQ ID NO: 2796329 - DNA, 14 bp, Homo sapiens
gacttgggcacccc

SEQ ID NO: 2796330 - DNA, 15 bp, Homo sapiens
cttttaatgccttcc

SEQ ID NO: 2796331 - DNA, 20 bp, Homo sapiens
cttttactcctttgcattcc

SEQ ID NO: 2796332 - DNA, 21 bp, Homo sapiens
cttttagttgtatctcttttg

SEQ ID NO: 2796333 - DNA, 21 bp, Homo sapiens
cttttagttttagttgcagaa

SEQ ID NO: 2796334 - DNA, 19 bp, Homo sapiens
cttttatcacgatattatt

SEQ ID NO: 2796335 - DNA, 18 bp, Homo sapiens
cttttattcattagctgt

SEQ ID NO: 2796336 - DNA, 22 bp, Homo sapiens
cttttcataacctagccttaga

SEQ ID NO: 2796337 - DNA, 18 bp, Homo sapiens
cttttctggaatgtaatc

SEQ ID NO: 2796338 - DNA, 23 bp, Homo sapiens
cttttgaatccatgcttgggtgt

SEQ ID NO: 2796339 - DNA, 22 bp, Homo sapiens
cttttgctcttagctgtctgct

SEQ ID NO: 2796340 - DNA, 13 bp, Homo sapiens
cttttgtaaatgt

SEQ ID NO: 2796341 - DNA, 17 bp, Homo sapiens
cttttgtcatgtggcta

SEQ ID NO: 2796342 - DNA, 12 bp, Homo sapiens
cttttgtggatt

SEQ ID NO: 2796343 - DNA, 23 bp, Homo sapiens
cttttgtgtacagtgtgtaaagt

SEQ ID NO: 2796344 - DNA, 17 bp, Homo sapiens
ctttttaagcttattta

SEQ ID NO: 2796345 - DNA, 13 bp, Homo sapiens
ctttttatactcc

SEQ ID NO: 2796346 - DNA, 22 bp, Homo sapiens
ctttttcaaaaattacactaca

SEQ ID NO: 2796347 - DNA, 17 bp, Homo sapiens
ctttttccccaaagtct

SEQ ID NO: 2796348 - DNA, 15 bp, Homo sapiens
cttttttcttgagta

SEQ ID NO: 2796349 - DNA, 20 bp, Homo sapiens
gaaaaaaaatgttctttggg

SEQ ID NO: 2796350 - DNA, 18 bp, Homo sapiens
gaaaaaaagtttgccaga

SEQ ID NO: 2796351 - DNA, 20 bp, Homo sapiens
gaaaaaaagtttgccagaag

SEQ ID NO: 2796352 - DNA, 16 bp, Homo sapiens
gaaaaaaatgactaaa

SEQ ID NO: 2796353 - DNA, 21 bp, Homo sapiens
gaaaaaataattgatttcaag

SEQ ID NO: 2796354 - DNA, 13 bp, Homo sapiens
gaaaaaatacatt

SEQ ID NO: 2796355 - DNA, 21 bp, Homo sapiens
gaaaaacaaactcgtttttta

SEQ ID NO: 2796356 - DNA, 23 bp, Homo sapiens
gaaaaaccaatgattcataacaa

SEQ ID NO: 2796357 - DNA, 23 bp, Homo sapiens
gaaaaactcttctactttcatct

SEQ ID NO: 2796358 - DNA, 13 bp, Homo sapiens
gaaaaagcgaaaa

SEQ ID NO: 2796359 - DNA, 13 bp, Homo sapiens
gaaaaatatttaa

SEQ ID NO: 2796360 - DNA, 14 bp, Homo sapiens
gaaaaatatttaag

SEQ ID NO: 2796361 - DNA, 17 bp, Homo sapiens
gaaaaatccagaaagaa

SEQ ID NO: 2796362 - DNA, 17 bp, Homo sapiens
gaaaacagatgcccccg

SEQ ID NO: 2796363 - DNA, 21 bp, Homo sapiens
gaaaacataatatcttgaaga

SEQ ID NO: 2796364 - DNA, 14 bp, Homo sapiens
gaaaaccccagcat

SEQ ID NO: 2796365 - DNA, 20 bp, Homo sapiens
gaaaactcctttagcaggtg

SEQ ID NO: 2796366 - DNA, 21 bp, Homo sapiens
gaaaactgtttatggtatttt

SEQ ID NO: 2796367 - DNA, 21 bp, Homo sapiens
gaaaagaatccctgcagcctg

SEQ ID NO: 2796368 - DNA, 12 bp, Homo sapiens
gaaaagaggagt

SEQ ID NO: 2796369 - DNA, 21 bp, Homo sapiens
gaaaagaggagtttcgaggta

SEQ ID NO: 2796370 - DNA, 18 bp, Homo sapiens
gaaaagataggtttgagt

SEQ ID NO: 2796371 - DNA, 16 bp, Homo sapiens
gaaaagcacctgccga

SEQ ID NO: 2796372 - DNA, 13 bp, Homo sapiens
gaaaagctgctga

SEQ ID NO: 2796373 - DNA, 22 bp, Homo sapiens
gaaaaggtttatgaaaaagaag

SEQ ID NO: 2796374 - DNA, 23 bp, Homo sapiens
gaaaaggtttatgaaaaagaaga

SEQ ID NO: 2796375 - DNA, 15 bp, Homo sapiens
gaaaagtagaattat

SEQ ID NO: 2796376 - DNA, 19 bp, Homo sapiens
gaaaagtcacacagacaca

SEQ ID NO: 2796377 - DNA, 20 bp, Homo sapiens
gaaaagtcacacagacacac

SEQ ID NO: 2796378 - DNA, 22 bp, Homo sapiens
gaacatctcactttgccccagt

SEQ ID NO: 2796379 - DNA, 20 bp, Homo sapiens
gaacatgtcggagtagaaat

SEQ ID NO: 2796380 - DNA, 13 bp, Homo sapiens
gaacatttgcttt

SEQ ID NO: 2796381 - DNA, 21 bp, Homo sapiens
gaaccaaagagactggagcat

SEQ ID NO: 2796382 - DNA, 13 bp, Homo sapiens
gaaccaatatttg

SEQ ID NO: 2796383 - DNA, 20 bp, Homo sapiens
gaaccacatcttgctctgct

SEQ ID NO: 2796384 - DNA, 21 bp, Homo sapiens
gaaccaccacacccagcccac

SEQ ID NO: 2796385 - DNA, 22 bp, Homo sapiens
gaaccaccacacccagcccact

SEQ ID NO: 2796386 - DNA, 19 bp, Homo sapiens
gaaccagtttcaggtgttt

SEQ ID NO: 2796387 - DNA, 15 bp, Homo sapiens
gaaccatccttccca

SEQ ID NO: 2796388 - DNA, 16 bp, Homo sapiens
gaaccatccttcccat

SEQ ID NO: 2796389 - DNA, 16 bp, Homo sapiens
gaacccaggacaagca

SEQ ID NO: 2796390 - DNA, 21 bp, Homo sapiens
gaacccctacatgaaacagaa

SEQ ID NO: 2796391 - DNA, 10 bp, Homo sapiens
gaacccctgt

SEQ ID NO: 2796392 - DNA, 19 bp, Homo sapiens
gaacccctgtgtccctttt

SEQ ID NO: 2796393 - DNA, 15 bp, Homo sapiens
gaaccgtgtccagca

SEQ ID NO: 2796394 - DNA, 18 bp, Homo sapiens
gaaccgtgtccagcacag

SEQ ID NO: 2796395 - DNA, 14 bp, Homo sapiens
gaacctcaaactgg

SEQ ID NO: 2796396 - DNA, 14 bp, Homo sapiens
gaacctcaggcttc

SEQ ID NO: 2796397 - DNA, 18 bp, Homo sapiens
gaacctcaggcttccttg

SEQ ID NO: 2796398 - DNA, 11 bp, Homo sapiens
gaacctggcct

SEQ ID NO: 2796399 - DNA, 12 bp, Homo sapiens
gaacctggcctt

SEQ ID NO: 2796400 - DNA, 23 bp, Homo sapiens
gaacctgggaaccatgaagctgg

SEQ ID NO: 2796401 - DNA, 18 bp, Homo sapiens
gaacgatttagaaagaag

SEQ ID NO: 2796402 - DNA, 15 bp, Homo sapiens
gaacggggagaaaag

SEQ ID NO: 2796403 - DNA, 16 bp, Homo sapiens
gaacggggtccttcaa

SEQ ID NO: 2796404 - DNA, 22 bp, Homo sapiens
gaacgtgactgccccaactcct

SEQ ID NO: 2796405 - DNA, 15 bp, Homo sapiens
gaactaataaaagca

SEQ ID NO: 2796406 - DNA, 15 bp, Homo sapiens
gaactatgaactaca

SEQ ID NO: 2796407 - DNA, 15 bp, Homo sapiens
gaactattggagggt

SEQ ID NO: 2796408 - DNA, 17 bp, Homo sapiens
gaactcaagctgcgttt

SEQ ID NO: 2796409 - DNA, 13 bp, Homo sapiens
gaactcctggcct

SEQ ID NO: 2796410 - DNA, 15 bp, Homo sapiens
gaactccttgatttt

SEQ ID NO: 2796411 - DNA, 22 bp, Homo sapiens
gaactccttgattttagccttc

SEQ ID NO: 2796412 - DNA, 18 bp, Homo sapiens
gaactctaccctggtagg

SEQ ID NO: 2796413 - DNA, 21 bp, Homo sapiens
gaactctaccctggtaggaaa

SEQ ID NO: 2796414 - DNA, 14 bp, Homo sapiens
gaactgagcctagc

SEQ ID NO: 2796415 - DNA, 15 bp, Homo sapiens
gaactgccaagaaaa

SEQ ID NO: 2796416 - DNA, 17 bp, Homo sapiens
gaactgcctctttcctg

SEQ ID NO: 2796417 - DNA, 20 bp, Homo sapiens
gaactgcttactagccctgc

SEQ ID NO: 2796418 - DNA, 16 bp, Homo sapiens
gaactggacgcccagc

SEQ ID NO: 2796419 - DNA, 18 bp, Homo sapiens
gaactgggatttgaaccc

SEQ ID NO: 2796420 - DNA, 22 bp, Homo sapiens
gaactgggtacttgtggacaca

SEQ ID NO: 2796421 - DNA, 22 bp, Homo sapiens
gaactgttctggcctcagacca

SEQ ID NO: 2796422 - DNA, 18 bp, Homo sapiens
gaacttaaataaatgtca

SEQ ID NO: 2796423 - DNA, 15 bp, Homo sapiens
gaacttgaactgatt

SEQ ID NO: 2796424 - DNA, 14 bp, Homo sapiens
gaacttgaggacac

SEQ ID NO: 2796425 - DNA, 17 bp, Homo sapiens
gaacttgaggacacatg

SEQ ID NO: 2796426 - DNA, 13 bp, Homo sapiens
gaagaaaaaatac

SEQ ID NO: 2796427 - DNA, 13 bp, Homo sapiens
gaagaaaaagaag

SEQ ID NO: 2796428 - DNA, 16 bp, Homo sapiens
gaagaaacaggggatc

SEQ ID NO: 2796429 - DNA, 18 bp, Homo sapiens
gaagaagacacattccta

SEQ ID NO: 2796430 - DNA, 20 bp, Homo sapiens
gaagaagaggcctagcctga

SEQ ID NO: 2796431 - DNA, 18 bp, Homo sapiens
gaagaatacaaacatatt

SEQ ID NO: 2796432 - DNA, 19 bp, Homo sapiens
gaagaatacaaacatattt

SEQ ID NO: 2796433 - DNA, 22 bp, Homo sapiens
gaagaatgttaagacttgacag

SEQ ID NO: 2796434 - DNA, 23 bp, Homo sapiens
gaagaattgaacccaggaggtgg

SEQ ID NO: 2796435 - DNA, 21 bp, Homo sapiens
gaagaattttcagaccccagc

SEQ ID NO: 2796436 - DNA, 15 bp, Homo sapiens
gaagacatggagact

SEQ ID NO: 2796437 - DNA, 16 bp, Homo sapiens
gaagactcattcttct

SEQ ID NO: 2796438 - DNA, 21 bp, Homo sapiens
gaagactcattcttctgtacg

SEQ ID NO: 2796439 - DNA, 12 bp, Homo sapiens
gaagactgtggc

SEQ ID NO: 2796440 - DNA, 14 bp, Homo sapiens
gaagagagagaccc

SEQ ID NO: 2796441 - DNA, 15 bp, Homo sapiens
gaagagcaggcacat

SEQ ID NO: 2796442 - DNA, 15 bp, Homo sapiens
gaagagcctgactgt

SEQ ID NO: 2796443 - DNA, 18 bp, Homo sapiens
gaagaggcctagcctgag

SEQ ID NO: 2796444 - DNA, 16 bp, Homo sapiens
gaagaggctggtgctg

SEQ ID NO: 2796445 - DNA, 17 bp, Homo sapiens
gaagaggggaggggcct

SEQ ID NO: 2796446 - DNA, 15 bp, Homo sapiens
gaagatcttttaaaa

SEQ ID NO: 2796447 - DNA, 23 bp, Homo sapiens
gaagatcttttaaaaaggcagta

SEQ ID NO: 2796448 - DNA, 12 bp, Homo sapiens
gaagatgtaagg

SEQ ID NO: 2796449 - DNA, 18 bp, Homo sapiens
gaagcaagacgtcctgga

SEQ ID NO: 2796450 - DNA, 18 bp, Homo sapiens
gaagcagtgccttccata

SEQ ID NO: 2796451 - DNA, 19 bp, Homo sapiens
gaagcatttgtttctactt

SEQ ID NO: 2796452 - DNA, 12 bp, Homo sapiens
gaagccaggagc

SEQ ID NO: 2796453 - DNA, 14 bp, Homo sapiens
gaagccaggagcaa

SEQ ID NO: 2796454 - DNA, 15 bp, Homo sapiens
gaagcccaagtgaaa

SEQ ID NO: 2796455 - DNA, 19 bp, Homo sapiens
gaagcccaataaacctctt

SEQ ID NO: 2796456 - DNA, 18 bp, Homo sapiens
gaagcccatggagcaggg

SEQ ID NO: 2796457 - DNA, 11 bp, Homo sapiens
gaagccctcct

SEQ ID NO: 2796458 - DNA, 16 bp, Homo sapiens
gaagccctccttccac

SEQ ID NO: 2796459 - DNA, 19 bp, Homo sapiens
gaagccctccttccacgga

SEQ ID NO: 2796460 - DNA, 19 bp, Homo sapiens
gaagccctggatttcagaa

SEQ ID NO: 2796461 - DNA, 14 bp, Homo sapiens
gaagcccttccagt

SEQ ID NO: 2796462 - DNA, 14 bp, Homo sapiens
gaagccgcagggac

SEQ ID NO: 2796463 - DNA, 15 bp, Homo sapiens
gaagcctctgcctcc

SEQ ID NO: 2796464 - DNA, 12 bp, Homo sapiens
gaagcctggggg

SEQ ID NO: 2796465 - DNA, 16 bp, Homo sapiens
gaagcctgggggcctg

SEQ ID NO: 2796466 - DNA, 18 bp, Homo sapiens
gaagcctgggggcctggc

SEQ ID NO: 2796467 - DNA, 20 bp, Homo sapiens
gaagcctgggggcctggctg

SEQ ID NO: 2796468 - DNA, 20 bp, Homo sapiens
gaagcctgttttgttggaag

SEQ ID NO: 2796469 - DNA, 15 bp, Homo sapiens
gaatcagattattaa

SEQ ID NO: 2796470 - DNA, 19 bp, Homo sapiens
gaatcagctgcagctgctt

SEQ ID NO: 2796471 - DNA, 21 bp, Homo sapiens
gaatcagcttttaataaaatt

SEQ ID NO: 2796472 - DNA, 10 bp, Homo sapiens
gaatcataat

SEQ ID NO: 2796473 - DNA, 23 bp, Homo sapiens
gaatcatgatctgactttaattg

SEQ ID NO: 2796474 - DNA, 20 bp, Homo sapiens
gaatccagacccggctgcgt

SEQ ID NO: 2796475 - DNA, 16 bp, Homo sapiens
gaatccatcaggactt

SEQ ID NO: 2796476 - DNA, 13 bp, Homo sapiens
gaatccatgcttg

SEQ ID NO: 2796477 - DNA, 13 bp, Homo sapiens
gaatctatattta

SEQ ID NO: 2796478 - DNA, 23 bp, Homo sapiens
gaatctgtgcagatgagcagtca

SEQ ID NO: 2796479 - DNA, 19 bp, Homo sapiens
gaatgaaagggcccagaga

SEQ ID NO: 2796480 - DNA, 23 bp, Homo sapiens
gaatgaaatcctgcttcagtgta

SEQ ID NO: 2796481 - DNA, 13 bp, Homo sapiens
gaatgaagcatgt

SEQ ID NO: 2796482 - DNA, 14 bp, Homo sapiens
gaatgaagcatgta

SEQ ID NO: 2796483 - DNA, 16 bp, Homo sapiens
gaatgaattaaataaa

SEQ ID NO: 2796484 - DNA, 18 bp, Homo sapiens
gaatgaccttgttgcatg

SEQ ID NO: 2796485 - DNA, 16 bp, Homo sapiens
gaatgaggtcccaggc

SEQ ID NO: 2796486 - DNA, 19 bp, Homo sapiens
gaatgaggtcccaggcaga

SEQ ID NO: 2796487 - DNA, 21 bp, Homo sapiens
gaatgaggtcccaggcagaga

SEQ ID NO: 2796488 - DNA, 16 bp, Homo sapiens
gaatgatttccaaaga

SEQ ID NO: 2796489 - DNA, 22 bp, Homo sapiens
gaatgcacactagcctctccag

SEQ ID NO: 2796490 - DNA, 22 bp, Homo sapiens
gaatgcccacaggcaaatgcat

SEQ ID NO: 2796491 - DNA, 13 bp, Homo sapiens
gaatgcctcctcc

SEQ ID NO: 2796492 - DNA, 17 bp, Homo sapiens
gaatgctggttttccta

SEQ ID NO: 2796493 - DNA, 22 bp, Homo sapiens
gaatggcacagcccaaagaagg

SEQ ID NO: 2796494 - DNA, 19 bp, Homo sapiens
gaatggctatgtttttaat

SEQ ID NO: 2796495 - DNA, 13 bp, Homo sapiens
gaatggtccaggg

SEQ ID NO: 2796496 - DNA, 15 bp, Homo sapiens
gaatggtccagggtt

SEQ ID NO: 2796497 - DNA, 22 bp, Homo sapiens
gaatggttccatgcctgagggt

SEQ ID NO: 2796498 - DNA, 20 bp, Homo sapiens
gaatgtaaagcttgtctgat

SEQ ID NO: 2796499 - DNA, 20 bp, Homo sapiens
gaatgtagctggtttcctca

SEQ ID NO: 2796500 - DNA, 20 bp, Homo sapiens
gaatgtttacactctttgta

SEQ ID NO: 2796501 - DNA, 21 bp, Homo sapiens
gaatgtttacactctttgtaa

SEQ ID NO: 2796502 - DNA, 16 bp, Homo sapiens
gaatgtttgaactgcc

SEQ ID NO: 2796503 - DNA, 16 bp, Homo sapiens
gaatgtttgcctctgc

SEQ ID NO: 2796504 - DNA, 12 bp, Homo sapiens
gaattaaataaa

SEQ ID NO: 2796505 - DNA, 13 bp, Homo sapiens
gaattaaatttaa

SEQ ID NO: 2796506 - DNA, 21 bp, Homo sapiens
gaattaagttagggaatggca

SEQ ID NO: 2796507 - DNA, 17 bp, Homo sapiens
gaattatatctaattta

SEQ ID NO: 2796508 - DNA, 19 bp, Homo sapiens
gaattatatctaatttata

SEQ ID NO: 2796509 - DNA, 20 bp, Homo sapiens
gaattatatctaatttatac

SEQ ID NO: 2796510 - DNA, 19 bp, Homo sapiens
gaattattttgttgtgatt

SEQ ID NO: 2796511 - DNA, 22 bp, Homo sapiens
gaattatttttgtgtttctaaa

SEQ ID NO: 2796512 - DNA, 13 bp, Homo sapiens
gaattccaaggag

SEQ ID NO: 2796513 - DNA, 11 bp, Homo sapiens
gaattcccagg

SEQ ID NO: 2796514 - DNA, 19 bp, Homo sapiens
gaattctaagattgtacat

SEQ ID NO: 2796515 - DNA, 17 bp, Homo sapiens
gaattctggaggaagaa

SEQ ID NO: 2796516 - DNA, 13 bp, Homo sapiens
gaattctgtgaag

SEQ ID NO: 2796517 - DNA, 15 bp, Homo sapiens
gaattgaacccagga

SEQ ID NO: 2796518 - DNA, 21 bp, Homo sapiens
gaattgcctgcagagagaagc

SEQ ID NO: 2796519 - DNA, 14 bp, Homo sapiens
gaattgctgctctc

SEQ ID NO: 2796520 - DNA, 14 bp, Homo sapiens
gaattgtccccagt

SEQ ID NO: 2796521 - DNA, 18 bp, Homo sapiens
gaattgtgaccaagttat

SEQ ID NO: 2796522 - DNA, 21 bp, Homo sapiens
gaatttaaggagggacaagaa

SEQ ID NO: 2796523 - DNA, 23 bp, Homo sapiens
gaatttattcaattcctctggga

SEQ ID NO: 2796524 - DNA, 12 bp, Homo sapiens
gaatttcttggt

SEQ ID NO: 2796525 - DNA, 21 bp, Homo sapiens
gaatttcttggtaagaagccg

SEQ ID NO: 2796526 - DNA, 19 bp, Homo sapiens
gaatttggcctgcactaat

SEQ ID NO: 2796527 - DNA, 20 bp, Homo sapiens
gaatttggtgtggctgtatt

SEQ ID NO: 2796528 - DNA, 15 bp, Homo sapiens
gaattttaagtgctt

SEQ ID NO: 2796529 - DNA, 22 bp, Homo sapiens
gaattttattttacagagcttg

SEQ ID NO: 2796530 - DNA, 17 bp, Homo sapiens
gaatttttaaacaagta

SEQ ID NO: 2796531 - DNA, 16 bp, Homo sapiens
gaattttttgagtaat

SEQ ID NO: 2796532 - DNA, 17 bp, Homo sapiens
gacaaaaacagcctcac

SEQ ID NO: 2796533 - DNA, 18 bp, Homo sapiens
gacaaaaacagcctcaca

SEQ ID NO: 2796534 - DNA, 22 bp, Homo sapiens
gacaaagagaataaagacttca

SEQ ID NO: 2796535 - DNA, 14 bp, Homo sapiens
gacaaaggagcctg

SEQ ID NO: 2796536 - DNA, 21 bp, Homo sapiens
gacaacaaattaggttttgta

SEQ ID NO: 2796537 - DNA, 23 bp, Homo sapiens
gacaacaaattaggttttgtaca

SEQ ID NO: 2796538 - DNA, 14 bp, Homo sapiens
gacaacagaagtca

SEQ ID NO: 2796539 - DNA, 17 bp, Homo sapiens
gacaacagaagtcatga

SEQ ID NO: 2796540 - DNA, 16 bp, Homo sapiens
gacaacattttattac

SEQ ID NO: 2796541 - DNA, 11 bp, Homo sapiens
gacaacccaga

SEQ ID NO: 2796542 - DNA, 14 bp, Homo sapiens
gacaacctttgtgt

SEQ ID NO: 2796543 - DNA, 17 bp, Homo sapiens
gacaacctttgtgtaat

SEQ ID NO: 2796544 - DNA, 20 bp, Homo sapiens
gacaacctttgtgtaataaa

SEQ ID NO: 2796545 - DNA, 14 bp, Homo sapiens
gacaagaagctgct

SEQ ID NO: 2796546 - DNA, 19 bp, Homo sapiens
gacaagccaacttgtaaat

SEQ ID NO: 2796547 - DNA, 21 bp, Homo sapiens
gacaaggattgctactgtcct

SEQ ID NO: 2796548 - DNA, 22 bp, Homo sapiens
gacaaggattgctactgtccta

SEQ ID NO: 2796549 - DNA, 14 bp, Homo sapiens
gacaataaaacatt

SEQ ID NO: 2796550 - DNA, 22 bp, Homo sapiens
gacaatcacagctcctcgctgc

SEQ ID NO: 2796551 - DNA, 16 bp, Homo sapiens
gacaattcacttcatt

SEQ ID NO: 2796552 - DNA, 14 bp, Homo sapiens
gacacacagcactc

SEQ ID NO: 2796553 - DNA, 14 bp, Homo sapiens
gacacacagctctg

SEQ ID NO: 2796554 - DNA, 15 bp, Homo sapiens
gacacacagctctgt

SEQ ID NO: 2796555 - DNA, 19 bp, Homo sapiens
gacacacagctctgtcctg

SEQ ID NO: 2796556 - DNA, 21 bp, Homo sapiens
gacacacagctctgtcctggg

SEQ ID NO: 2796557 - DNA, 22 bp, Homo sapiens
gacacaccccccagtcgagccc

SEQ ID NO: 2796558 - DNA, 14 bp, Homo sapiens
gacacagctcttct

SEQ ID NO: 2796559 - DNA, 20 bp, Homo sapiens
cttgcagactctacagaggc

SEQ ID NO: 2796560 - DNA, 21 bp, Homo sapiens
cttgcagactctacagaggcc

SEQ ID NO: 2796561 - DNA, 21 bp, Homo sapiens
cttgcagagttcatggaatgt

SEQ ID NO: 2796562 - DNA, 16 bp, Homo sapiens
cttgcagtcatcagaa

SEQ ID NO: 2796563 - DNA, 17 bp, Homo sapiens
cttgcagtcatcagaag

SEQ ID NO: 2796564 - DNA, 14 bp, Homo sapiens
cttgcattcccagt

SEQ ID NO: 2796565 - DNA, 22 bp, Homo sapiens
cttgccaatgaggtctgaaatg

SEQ ID NO: 2796566 - DNA, 23 bp, Homo sapiens
cttgccaatgaggtctgaaatgg

SEQ ID NO: 2796567 - DNA, 15 bp, Homo sapiens
cttgccactgcctct

SEQ ID NO: 2796568 - DNA, 13 bp, Homo sapiens
cttgccagccaga

SEQ ID NO: 2796569 - DNA, 22 bp, Homo sapiens
cttgcccagagatgcctccacc

SEQ ID NO: 2796570 - DNA, 23 bp, Homo sapiens
cttgcccagagatgcctccaccg

SEQ ID NO: 2796571 - DNA, 15 bp, Homo sapiens
cttgccccttgggcc

SEQ ID NO: 2796572 - DNA, 17 bp, Homo sapiens
cttgcccggattctggg

SEQ ID NO: 2796573 - DNA, 17 bp, Homo sapiens
cttgcccttgccctgac

SEQ ID NO: 2796574 - DNA, 23 bp, Homo sapiens
cttgcctcatttttttccttgca

SEQ ID NO: 2796575 - DNA, 18 bp, Homo sapiens
cttgcctgaatccatcag

SEQ ID NO: 2796576 - DNA, 23 bp, Homo sapiens
cttgcctgaatccatcaggactt

SEQ ID NO: 2796577 - DNA, 20 bp, Homo sapiens
cttgccttcttcacccagct

SEQ ID NO: 2796578 - DNA, 22 bp, Homo sapiens
cttgcctttccacctgctttct

SEQ ID NO: 2796579 - DNA, 16 bp, Homo sapiens
cttgcgaccatgtgta

SEQ ID NO: 2796580 - DNA, 14 bp, Homo sapiens
cttgctctgctgac

SEQ ID NO: 2796581 - DNA, 14 bp, Homo sapiens
cttgctgtcctagg

SEQ ID NO: 2796582 - DNA, 22 bp, Homo sapiens
cttggaaaaatccagaaagaaa

SEQ ID NO: 2796583 - DNA, 22 bp, Homo sapiens
cttggaaagcatcacctcaggc

SEQ ID NO: 2796584 - DNA, 15 bp, Homo sapiens
cttggaactgaaggg

SEQ ID NO: 2796585 - DNA, 13 bp, Homo sapiens
cttggacactgta

SEQ ID NO: 2796586 - DNA, 15 bp, Homo sapiens
cttggacctctgctc

SEQ ID NO: 2796587 - DNA, 19 bp, Homo sapiens
cttggacctctgctctgag

SEQ ID NO: 2796588 - DNA, 14 bp, Homo sapiens
cttggactattata

SEQ ID NO: 2796589 - DNA, 22 bp, Homo sapiens
cttggactattataatttaatg

SEQ ID NO: 2796590 - DNA, 13 bp, Homo sapiens
cttggactcctcc

SEQ ID NO: 2796591 - DNA, 16 bp, Homo sapiens
cttggactcctcccac

SEQ ID NO: 2796592 - DNA, 13 bp, Homo sapiens
cttggaggacagt

SEQ ID NO: 2796593 - DNA, 14 bp, Homo sapiens
cttggaggacagtg

SEQ ID NO: 2796594 - DNA, 17 bp, Homo sapiens
cttggaggccaccggga

SEQ ID NO: 2796595 - DNA, 23 bp, Homo sapiens
cttggctcaagtcctcttttctg

SEQ ID NO: 2796596 - DNA, 21 bp, Homo sapiens
cttggctcaatcctctaagct

SEQ ID NO: 2796597 - DNA, 14 bp, Homo sapiens
cttggctgcaggga

SEQ ID NO: 2796598 - DNA, 16 bp, Homo sapiens
cttggctgcagggagt

SEQ ID NO: 2796599 - DNA, 22 bp, Homo sapiens
cttggctttaaccgtttttcaa

SEQ ID NO: 2796600 - DNA, 22 bp, Homo sapiens
cttgggaaacagagaaccctgt

SEQ ID NO: 2796601 - DNA, 13 bp, Homo sapiens
cttgggcaccccc

SEQ ID NO: 2796602 - DNA, 21 bp, Homo sapiens
cttgggcacccccagcctggg

SEQ ID NO: 2796603 - DNA, 14 bp, Homo sapiens
cttgggccctgcac

SEQ ID NO: 2796604 - DNA, 15 bp, Homo sapiens
cttgggccctgcaca

SEQ ID NO: 2796605 - DNA, 17 bp, Homo sapiens
cttgggccctgcacaga

SEQ ID NO: 2796606 - DNA, 21 bp, Homo sapiens
cttgggcctccccccagcccc

SEQ ID NO: 2796607 - DNA, 19 bp, Homo sapiens
cttggggattcttccatct

SEQ ID NO: 2796608 - DNA, 21 bp, Homo sapiens
cttggggattcttccatctga

SEQ ID NO: 2796609 - DNA, 22 bp, Homo sapiens
cttggggggtgatgagggcagc

SEQ ID NO: 2796610 - DNA, 15 bp, Homo sapiens
cttggtcatgcttca

SEQ ID NO: 2796611 - DNA, 20 bp, Homo sapiens
cttggtctgatttcaggata

SEQ ID NO: 2796612 - DNA, 20 bp, Homo sapiens
cttggtgaatttttttttcc

SEQ ID NO: 2796613 - DNA, 22 bp, Homo sapiens
cttggtgaatttttttttccta

SEQ ID NO: 2796614 - DNA, 19 bp, Homo sapiens
cttggtgtgaccctctgaa

SEQ ID NO: 2796615 - DNA, 12 bp, Homo sapiens
cttgtaaataca

SEQ ID NO: 2796616 - DNA, 15 bp, Homo sapiens
cttgtaaatacacca

SEQ ID NO: 2796617 - DNA, 18 bp, Homo sapiens
cttgtaaatagctcaggt

SEQ ID NO: 2796618 - DNA, 13 bp, Homo sapiens
cttgtaatttcta

SEQ ID NO: 2796619 - DNA, 12 bp, Homo sapiens
cttgtacaaaat

SEQ ID NO: 2796620 - DNA, 13 bp, Homo sapiens
cttgtacaaaata

SEQ ID NO: 2796621 - DNA, 22 bp, Homo sapiens
cttgtacatgtgtagcctgtgc

SEQ ID NO: 2796622 - DNA, 16 bp, Homo sapiens
cttgtagccagccggg

SEQ ID NO: 2796623 - DNA, 21 bp, Homo sapiens
cttgtagccagccggggcgag

SEQ ID NO: 2796624 - DNA, 17 bp, Homo sapiens
cttgtagggatgccttt

SEQ ID NO: 2796625 - DNA, 15 bp, Homo sapiens
cttgtatatacatat

SEQ ID NO: 2796626 - DNA, 20 bp, Homo sapiens
cttgtatatacatattataa

SEQ ID NO: 2796627 - DNA, 12 bp, Homo sapiens
cttgtatttaaa

SEQ ID NO: 2796628 - DNA, 23 bp, Homo sapiens
cttgtattttcttcccatttgta

SEQ ID NO: 2796629 - DNA, 23 bp, Homo sapiens
cttgtcactggtagaccaaaata

SEQ ID NO: 2796630 - DNA, 23 bp, Homo sapiens
cttgtctgattggctcacccaag

SEQ ID NO: 2796631 - DNA, 15 bp, Homo sapiens
cttgtggacacagct

SEQ ID NO: 2796632 - DNA, 14 bp, Homo sapiens
cttgtggtttatgt

SEQ ID NO: 2796633 - DNA, 21 bp, Homo sapiens
cttgtgtctctgtgcttttaa

SEQ ID NO: 2796634 - DNA, 14 bp, Homo sapiens
cttgtgtctgtaca

SEQ ID NO: 2796635 - DNA, 15 bp, Homo sapiens
cttgtgtctgtacac

SEQ ID NO: 2796636 - DNA, 22 bp, Homo sapiens
cttgttacctttcccatgctga

SEQ ID NO: 2796637 - DNA, 15 bp, Homo sapiens
cttgttatttataac

SEQ ID NO: 2796638 - DNA, 14 bp, Homo sapiens
cttgttgtcaagta

SEQ ID NO: 2796639 - DNA, 15 bp, Homo sapiens
cttgttgtcaagtat

SEQ ID NO: 2796640 - DNA, 16 bp, Homo sapiens
cttgttgtcaagtata

SEQ ID NO: 2796641 - DNA, 23 bp, Homo sapiens
cttgtttgattttagctgcagaa

SEQ ID NO: 2796642 - DNA, 18 bp, Homo sapiens
cttgttttcttgccaatg

SEQ ID NO: 2796643 - DNA, 16 bp, Homo sapiens
ctttaaaaagcagtcc

SEQ ID NO: 2796644 - DNA, 18 bp, Homo sapiens
ctttaaaaagcagtcctc

SEQ ID NO: 2796645 - DNA, 18 bp, Homo sapiens
ctttaaagtacctgtagt

SEQ ID NO: 2796646 - DNA, 18 bp, Homo sapiens
ctttaaatcaaaagctgc

SEQ ID NO: 2796647 - DNA, 18 bp, Homo sapiens
ctttaacaaaacaagaaa

SEQ ID NO: 2796648 - DNA, 21 bp, Homo sapiens
ctttaacaaaacaagaaagaa

SEQ ID NO: 2796649 - DNA, 16 bp, Homo sapiens
ctgggagtgagctggt

SEQ ID NO: 2796650 - DNA, 15 bp, Homo sapiens
ctgggattcccacca

SEQ ID NO: 2796651 - DNA, 14 bp, Homo sapiens
ctgggattcctccc

SEQ ID NO: 2796652 - DNA, 19 bp, Homo sapiens
ctgggcaatgatggcaatt

SEQ ID NO: 2796653 - DNA, 16 bp, Homo sapiens
ctgggccccaccacct

SEQ ID NO: 2796654 - DNA, 18 bp, Homo sapiens
cttctatttaaaaaataa

SEQ ID NO: 2796655 - DNA, 20 bp, Homo sapiens
cttctatttaaaaaataaaa

SEQ ID NO: 2796656 - DNA, 14 bp, Homo sapiens
cttctattttgtaa

SEQ ID NO: 2796657 - DNA, 23 bp, Homo sapiens
cttctcagccccgggcctgcctc

SEQ ID NO: 2796658 - DNA, 18 bp, Homo sapiens
cttctcaggacacaggcc

SEQ ID NO: 2796659 - DNA, 21 bp, Homo sapiens
cttctcatcatattgtatgta

SEQ ID NO: 2796660 - DNA, 16 bp, Homo sapiens
cttctccaccctgctc

SEQ ID NO: 2796661 - DNA, 19 bp, Homo sapiens
cttctcctgacccagtccc

SEQ ID NO: 2796662 - DNA, 14 bp, Homo sapiens
cttctcgcattttc

SEQ ID NO: 2796663 - DNA, 15 bp, Homo sapiens
cttctctacagactt

SEQ ID NO: 2796664 - DNA, 21 bp, Homo sapiens
cttctctacccatctccccca

SEQ ID NO: 2796665 - DNA, 17 bp, Homo sapiens
cttctctactctggaag

SEQ ID NO: 2796666 - DNA, 20 bp, Homo sapiens
cttctctccaggctgtttct

SEQ ID NO: 2796667 - DNA, 21 bp, Homo sapiens
cttctctcggggcgacccctc

SEQ ID NO: 2796668 - DNA, 12 bp, Homo sapiens
cttctctctctg

SEQ ID NO: 2796669 - DNA, 13 bp, Homo sapiens
cttctctctctgg

SEQ ID NO: 2796670 - DNA, 13 bp, Homo sapiens
cttctctgttcat

SEQ ID NO: 2796671 - DNA, 14 bp, Homo sapiens
cttctctgttcatt

SEQ ID NO: 2796672 - DNA, 13 bp, Homo sapiens
cttctcttcctgt

SEQ ID NO: 2796673 - DNA, 15 bp, Homo sapiens
cttctctttgcctca

SEQ ID NO: 2796674 - DNA, 12 bp, Homo sapiens
cttctgaactca

SEQ ID NO: 2796675 - DNA, 17 bp, Homo sapiens
cttctgaactcaagctg

SEQ ID NO: 2796676 - DNA, 15 bp, Homo sapiens
cttctgaagatctca

SEQ ID NO: 2796677 - DNA, 21 bp, Homo sapiens
cttctgccatattctgttggc

SEQ ID NO: 2796678 - DNA, 15 bp, Homo sapiens
cttctgctggataaa

SEQ ID NO: 2796679 - DNA, 19 bp, Homo sapiens
cttctgctggataaaatga

SEQ ID NO: 2796680 - DNA, 16 bp, Homo sapiens
cttctgcttcagcctc

SEQ ID NO: 2796681 - DNA, 18 bp, Homo sapiens
cttctgtacgtctgacag

SEQ ID NO: 2796682 - DNA, 20 bp, Homo sapiens
cttctgtacgtctgacaggc

SEQ ID NO: 2796683 - DNA, 23 bp, Homo sapiens
cttctgtcatcccgctcctgctg

SEQ ID NO: 2796684 - DNA, 15 bp, Homo sapiens
cttctgtccaaggca

SEQ ID NO: 2796685 - DNA, 18 bp, Homo sapiens
cttctgtcctactctgtg

SEQ ID NO: 2796686 - DNA, 19 bp, Homo sapiens
cttctgtcctactctgtgt

SEQ ID NO: 2796687 - DNA, 15 bp, Homo sapiens
cttctgttctcaaat

SEQ ID NO: 2796688 - DNA, 22 bp, Homo sapiens
cttcttaatgctttcctccctg

SEQ ID NO: 2796689 - DNA, 21 bp, Homo sapiens
cttcttacttggaactgaagg

SEQ ID NO: 2796690 - DNA, 14 bp, Homo sapiens
cttcttattctcac

SEQ ID NO: 2796691 - DNA, 22 bp, Homo sapiens
cttcttattctcactccaccac

SEQ ID NO: 2796692 - DNA, 22 bp, Homo sapiens
cttcttcacccagctaatctgt

SEQ ID NO: 2796693 - DNA, 18 bp, Homo sapiens
cttcttcagatcagtgct

SEQ ID NO: 2796694 - DNA, 19 bp, Homo sapiens
cttcttcgctgctagagaa

SEQ ID NO: 2796695 - DNA, 14 bp, Homo sapiens
cttcttcttcagaa

SEQ ID NO: 2796696 - DNA, 13 bp, Homo sapiens
cttcttgcccctt

SEQ ID NO: 2796697 - DNA, 17 bp, Homo sapiens
cttcttgccccttgggc

SEQ ID NO: 2796698 - DNA, 16 bp, Homo sapiens
cttcttggtcttattt

SEQ ID NO: 2796699 - DNA, 20 bp, Homo sapiens
cttcttggtcttatttatta

SEQ ID NO: 2796700 - DNA, 17 bp, Homo sapiens
cttctttaaatcaaaag

SEQ ID NO: 2796701 - DNA, 22 bp, Homo sapiens
cttctttaaatcaaaagctgct

SEQ ID NO: 2796702 - DNA, 16 bp, Homo sapiens
cttctttgtcttagct

SEQ ID NO: 2796703 - DNA, 12 bp, Homo sapiens
cttgaaaaacaa

SEQ ID NO: 2796704 - DNA, 19 bp, Homo sapiens
cttgaaaacctcatttacc

SEQ ID NO: 2796705 - DNA, 17 bp, Homo sapiens
cttgaaataccagtgaa

SEQ ID NO: 2796706 - DNA, 15 bp, Homo sapiens
cttgaacactggggg

SEQ ID NO: 2796707 - DNA, 15 bp, Homo sapiens
cttgaactcctggcc

SEQ ID NO: 2796708 - DNA, 18 bp, Homo sapiens
cttgaactgggtacttgt

SEQ ID NO: 2796709 - DNA, 20 bp, Homo sapiens
cttgaactgggtacttgtgg

SEQ ID NO: 2796710 - DNA, 21 bp, Homo sapiens
cttgaactgttctggcctcag

SEQ ID NO: 2796711 - DNA, 23 bp, Homo sapiens
cttgaactgttctggcctcagac

SEQ ID NO: 2796712 - DNA, 20 bp, Homo sapiens
cttgaagatcgttagtatct

SEQ ID NO: 2796713 - DNA, 16 bp, Homo sapiens
cttgacagaacactgt

SEQ ID NO: 2796714 - DNA, 17 bp, Homo sapiens
cttgacagaacactgtc

SEQ ID NO: 2796715 - DNA, 14 bp, Homo sapiens
cttgacagggcaca

SEQ ID NO: 2796716 - DNA, 22 bp, Homo sapiens
cttgactatcacatacaatttg

SEQ ID NO: 2796717 - DNA, 13 bp, Homo sapiens
cttgactccttgt

SEQ ID NO: 2796718 - DNA, 13 bp, Homo sapiens
cttgagaaacctt

SEQ ID NO: 2796719 - DNA, 14 bp, Homo sapiens
cttgagacctcagc

SEQ ID NO: 2796720 - DNA, 15 bp, Homo sapiens
cttgagatgtcttct

SEQ ID NO: 2796721 - DNA, 14 bp, Homo sapiens
cttgagcctccatt

SEQ ID NO: 2796722 - DNA, 19 bp, Homo sapiens
cttgagcctccatttctgg

SEQ ID NO: 2796723 - DNA, 14 bp, Homo sapiens
cttgagctccccaa

SEQ ID NO: 2796724 - DNA, 12 bp, Homo sapiens
cttgaggacaca

SEQ ID NO: 2796725 - DNA, 15 bp, Homo sapiens
cttgaggacacatgt

SEQ ID NO: 2796726 - DNA, 17 bp, Homo sapiens
cttgaggacacatgtcc

SEQ ID NO: 2796727 - DNA, 18 bp, Homo sapiens
cttgaggacacatgtcca

SEQ ID NO: 2796728 - DNA, 14 bp, Homo sapiens
cttgaggagtgtga

SEQ ID NO: 2796729 - DNA, 22 bp, Homo sapiens
cttgaggagtgtgagaatcaaa

SEQ ID NO: 2796730 - DNA, 18 bp, Homo sapiens
cttgaggctggcactccc

SEQ ID NO: 2796731 - DNA, 15 bp, Homo sapiens
cttgagggttgggct

SEQ ID NO: 2796732 - DNA, 19 bp, Homo sapiens
cttgagggttgggctggtg

SEQ ID NO: 2796733 - DNA, 16 bp, Homo sapiens
cttgatgtgtcatcta

SEQ ID NO: 2796734 - DNA, 14 bp, Homo sapiens
cttgatgttgctta

SEQ ID NO: 2796735 - DNA, 18 bp, Homo sapiens
cttgattcacaatgaaat

SEQ ID NO: 2796736 - DNA, 20 bp, Homo sapiens
cttgatttcaggtcaataac

SEQ ID NO: 2796737 - DNA, 20 bp, Homo sapiens
cttgattttagccttctctg

SEQ ID NO: 2796738 - DNA, 14 bp, Homo sapiens
cttgcaatggcagc

SEQ ID NO: 2796739 - DNA, 18 bp, Homo sapiens
cttgcaatggcagccttg

SEQ ID NO: 2796740 - DNA, 17 bp, Homo sapiens
cttgcacaagcttgtat

SEQ ID NO: 2796741 - DNA, 19 bp, Homo sapiens
cttgcacaagcttgtatat

SEQ ID NO: 2796742 - DNA, 20 bp, Homo sapiens
cttgcacaagcttgtatata

SEQ ID NO: 2796743 - DNA, 14 bp, Homo sapiens
cttgcacctgcatc

SEQ ID NO: 2796744 - DNA, 16 bp, Homo sapiens
ctcagcagccctcctc

SEQ ID NO: 2796745 - DNA, 17 bp, Homo sapiens
ctcagcagccctcctca

SEQ ID NO: 2796746 - DNA, 18 bp, Homo sapiens
ctcagcagccctcctcac

SEQ ID NO: 2796747 - DNA, 13 bp, Homo sapiens
ctcagcatcctgg

SEQ ID NO: 2796748 - DNA, 15 bp, Homo sapiens
ctcagcatcctggca

SEQ ID NO: 2796749 - DNA, 22 bp, Homo sapiens
ctcagcatcctggcacccggcc

SEQ ID NO: 2796750 - DNA, 21 bp, Homo sapiens
ctcagccccgggcctgcctct

SEQ ID NO: 2796751 - DNA, 23 bp, Homo sapiens
ctcagccccgggcctgcctctga

SEQ ID NO: 2796752 - DNA, 18 bp, Homo sapiens
ctcagccctgactggtgc

SEQ ID NO: 2796753 - DNA, 12 bp, Homo sapiens
ctcagccctggg

SEQ ID NO: 2796754 - DNA, 13 bp, Homo sapiens
ctcagccctgggc

SEQ ID NO: 2796755 - DNA, 14 bp, Homo sapiens
ctcagccctgggcc

SEQ ID NO: 2796756 - DNA, 19 bp, Homo sapiens
ctcagccctgggccccacc

SEQ ID NO: 2796757 - DNA, 21 bp, Homo sapiens
ctcagcctcccaaagtgctgg

SEQ ID NO: 2796758 - DNA, 22 bp, Homo sapiens
ctcagcctcccaaagtgctggg

SEQ ID NO: 2796759 - DNA, 20 bp, Homo sapiens
ctcagcctcccaaccccagg

SEQ ID NO: 2796760 - DNA, 15 bp, Homo sapiens
ctcagcctccccccg

SEQ ID NO: 2796761 - DNA, 21 bp, Homo sapiens
ctcagcctcccgaatagctgg

SEQ ID NO: 2796762 - DNA, 19 bp, Homo sapiens
ctcagcctggtgggcctcc

SEQ ID NO: 2796763 - DNA, 14 bp, Homo sapiens
ctcagcctgtgctg

SEQ ID NO: 2796764 - DNA, 23 bp, Homo sapiens
ctcagccttccccttgcccaggg

SEQ ID NO: 2796765 - DNA, 18 bp, Homo sapiens
ctcagcggggacagctcc

SEQ ID NO: 2796766 - DNA, 22 bp, Homo sapiens
ctcagctccagaataccttctt

SEQ ID NO: 2796767 - DNA, 23 bp, Homo sapiens
ctcagctccagaataccttcttc

SEQ ID NO: 2796768 - DNA, 16 bp, Homo sapiens
ctcagctgtctgtggc

SEQ ID NO: 2796769 - DNA, 16 bp, Homo sapiens
ctcaggacacaggcct

SEQ ID NO: 2796770 - DNA, 14 bp, Homo sapiens
ctcaggagcacagg

SEQ ID NO: 2796771 - DNA, 17 bp, Homo sapiens
ctcaggagcacaggcag

SEQ ID NO: 2796772 - DNA, 19 bp, Homo sapiens
ctcaggaggctgaggcaga

SEQ ID NO: 2796773 - DNA, 20 bp, Homo sapiens
ctcaggaggctgaggcagaa

SEQ ID NO: 2796774 - DNA, 15 bp, Homo sapiens
ctcaggccaggtgca

SEQ ID NO: 2796775 - DNA, 18 bp, Homo sapiens
ctcaggccaggtgcagtg

SEQ ID NO: 2796776 - DNA, 21 bp, Homo sapiens
ctcaggcccccacctggctca

SEQ ID NO: 2796777 - DNA, 14 bp, Homo sapiens
ctcagggacagaga

SEQ ID NO: 2796778 - DNA, 23 bp, Homo sapiens
ctcagggacagagacacctgcac

SEQ ID NO: 2796779 - DNA, 13 bp, Homo sapiens
ctcagggccccag

SEQ ID NO: 2796780 - DNA, 18 bp, Homo sapiens
ctgacctccctctaattt

SEQ ID NO: 2796781 - DNA, 19 bp, Homo sapiens
ctgacctcctcctgccctc

SEQ ID NO: 2796782 - DNA, 12 bp, Homo sapiens
ctgacctgcagg

SEQ ID NO: 2796783 - DNA, 13 bp, Homo sapiens
ctgacctgcaggc

SEQ ID NO: 2796784 - DNA, 24 bp, Homo sapiens
ctgacgtcagtagtttgagaccag

SEQ ID NO: 2796785 - DNA, 14 bp, Homo sapiens
ctgactcacaagaa

SEQ ID NO: 2796786 - DNA, 15 bp, Homo sapiens
ctgactcacaagaag

SEQ ID NO: 2796787 - DNA, 17 bp, Homo sapiens
ctgactcacaagaagac

SEQ ID NO: 2796788 - DNA, 15 bp, Homo sapiens
ctgactccttagaga

SEQ ID NO: 2796789 - DNA, 16 bp, Homo sapiens
ctgactcttgcctttc

SEQ ID NO: 2796790 - DNA, 17 bp, Homo sapiens
ctgactcttgcctttcc

SEQ ID NO: 2796791 - DNA, 15 bp, Homo sapiens
ctgactgatgacaaa

SEQ ID NO: 2796792 - DNA, 19 bp, Homo sapiens
ctgactgatgttgagggaa

SEQ ID NO: 2796793 - DNA, 22 bp, Homo sapiens
ctgactgtgttcagtgccttgg

SEQ ID NO: 2796794 - DNA, 23 bp, Homo sapiens
ctgagaaacccaccagcctaaga

SEQ ID NO: 2796795 - DNA, 16 bp, Homo sapiens
ctgagaacctggcctt

SEQ ID NO: 2796796 - DNA, 17 bp, Homo sapiens
ctgagaacctggccttc

SEQ ID NO: 2796797 - DNA, 17 bp, Homo sapiens
ctgagaagtgtatatag

SEQ ID NO: 2796798 - DNA, 15 bp, Homo sapiens
ctgagaattccaagg

SEQ ID NO: 2796799 - DNA, 15 bp, Homo sapiens
ctgagacaggagaat

SEQ ID NO: 2796800 - DNA, 23 bp, Homo sapiens
ctgagaccagttgggagcactgg

SEQ ID NO: 2796801 - DNA, 17 bp, Homo sapiens
ctgagagacccaaggag

SEQ ID NO: 2796802 - DNA, 21 bp, Homo sapiens
ctgagcaaatgtggctcctgg

SEQ ID NO: 2796803 - DNA, 24 bp, Homo sapiens
ctgagcaacagagtgagaccctgt

SEQ ID NO: 2796804 - DNA, 14 bp, Homo sapiens
ctgagcaagagctg

SEQ ID NO: 2796805 - DNA, 15 bp, Homo sapiens
ctgagcaagagctgg

SEQ ID NO: 2796806 - DNA, 14 bp, Homo sapiens
ctcctctgtctctg

SEQ ID NO: 2796807 - DNA, 17 bp, Homo sapiens
ctcctctgtctctgctc

SEQ ID NO: 2796808 - DNA, 21 bp, Homo sapiens
ctcctcttaaaaaataaaaac

SEQ ID NO: 2796809 - DNA, 18 bp, Homo sapiens
ctcctcttcaactgacca

SEQ ID NO: 2796810 - DNA, 12 bp, Homo sapiens
ctcctcttgcca

SEQ ID NO: 2796811 - DNA, 12 bp, Homo sapiens
ctcctgccctgt

SEQ ID NO: 2796812 - DNA, 13 bp, Homo sapiens
ctcctgcctacat

SEQ ID NO: 2796813 - DNA, 19 bp, Homo sapiens
ctcctgcctacattccctg

SEQ ID NO: 2796814 - DNA, 22 bp, Homo sapiens
ctcctgcctacattccctggcc

SEQ ID NO: 2796815 - DNA, 23 bp, Homo sapiens
ctcctgcctacattccctggcct

SEQ ID NO: 2796816 - DNA, 13 bp, Homo sapiens
ctcctgcctcagc

SEQ ID NO: 2796817 - DNA, 17 bp, Homo sapiens
ctcctgcctcagcctcc

SEQ ID NO: 2796818 - DNA, 23 bp, Homo sapiens
ctcctgcgggagtagttggaaag

SEQ ID NO: 2796819 - DNA, 20 bp, Homo sapiens
ctcctggaaaggctcagtct

SEQ ID NO: 2796820 - DNA, 17 bp, Homo sapiens
ctcctggaagctgtgtc

SEQ ID NO: 2796821 - DNA, 13 bp, Homo sapiens
ctcctgggagaga

SEQ ID NO: 2796822 - DNA, 23 bp, Homo sapiens
ctcctgggcagcttgagagggca

SEQ ID NO: 2796823 - DNA, 20 bp, Homo sapiens
ctcctgggcccgctttgcct

SEQ ID NO: 2796824 - DNA, 22 bp, Homo sapiens
ctcctgggcccgctttgcctgc

SEQ ID NO: 2796825 - DNA, 14 bp, Homo sapiens
ctcctgtcttatgg

SEQ ID NO: 2796826 - DNA, 18 bp, Homo sapiens
ctcctgtgggagcctcgc

SEQ ID NO: 2796827 - DNA, 21 bp, Homo sapiens
ctccttagagacatcaaaatc

SEQ ID NO: 2796828 - DNA, 21 bp, Homo sapiens
ctccttcaacaattctaaaat

SEQ ID NO: 2796829 - DNA, 19 bp, Homo sapiens
ctccttcctcagtcctgga

SEQ ID NO: 2796830 - DNA, 15 bp, Homo sapiens
ctccttcctgcccca

SEQ ID NO: 2796831 - DNA, 20 bp, Homo sapiens
ctccttctgtcctactctgt

SEQ ID NO: 2796832 - DNA, 19 bp, Homo sapiens
ctccttgactccttgtggt

SEQ ID NO: 2796833 - DNA, 12 bp, Homo sapiens
ctccttggagga

SEQ ID NO: 2796834 - DNA, 15 bp, Homo sapiens
ctccttggaggacag

SEQ ID NO: 2796835 - DNA, 15 bp, Homo sapiens
ctccttgggtcctgc

SEQ ID NO: 2796836 - DNA, 15 bp, Homo sapiens
ctccttggtgcctgg

SEQ ID NO: 2796837 - DNA, 17 bp, Homo sapiens
ctccttgtggtttatgt

SEQ ID NO: 2796838 - DNA, 20 bp, Homo sapiens
ctcctttagcaggtggtcct

SEQ ID NO: 2796839 - DNA, 18 bp, Homo sapiens
ctcctttattgctcctgt

SEQ ID NO: 2796840 - DNA, 15 bp, Homo sapiens
ctcctttcaccacat

SEQ ID NO: 2796841 - DNA, 14 bp, Homo sapiens
ctcctttctttcta

SEQ ID NO: 2796842 - DNA, 14 bp, Homo sapiens
ctcctttgcactga

SEQ ID NO: 2796843 - DNA, 20 bp, Homo sapiens
ctcctttgcactgagggcca

SEQ ID NO: 2796844 - DNA, 15 bp, Homo sapiens
ctcctttgcattcca

SEQ ID NO: 2796845 - DNA, 16 bp, Homo sapiens
ctcgaactggctgcaa

SEQ ID NO: 2796846 - DNA, 15 bp, Homo sapiens
ctcgaagaacaatgt

SEQ ID NO: 2796847 - DNA, 16 bp, Homo sapiens
ctcgaagcccttccag

SEQ ID NO: 2796848 - DNA, 17 bp, Homo sapiens
ctcgaagcccttccagt

SEQ ID NO: 2796849 - DNA, 18 bp, Homo sapiens
ctcgaagcccttccagtg

SEQ ID NO: 2796850 - DNA, 23 bp, Homo sapiens
ctcgagcgccctgcagaccctgc

SEQ ID NO: 2796851 - DNA, 15 bp, Homo sapiens
ctcgccgtctgtgaa

SEQ ID NO: 2796852 - DNA, 13 bp, Homo sapiens
ctcgcctctccca

SEQ ID NO: 2796853 - DNA, 14 bp, Homo sapiens
ctcgcctctcccac

SEQ ID NO: 2796854 - DNA, 16 bp, Homo sapiens
ctcgctccccactctg

SEQ ID NO: 2796855 - DNA, 15 bp, Homo sapiens
ctcgctgtcctgctg

SEQ ID NO: 2796856 - DNA, 16 bp, Homo sapiens
ctcggaaggctggctg

SEQ ID NO: 2796857 - DNA, 16 bp, Homo sapiens
ctcggagagggctgcg

SEQ ID NO: 2796858 - DNA, 12 bp, Homo sapiens
ctcggagcctca

SEQ ID NO: 2796859 - DNA, 22 bp, Homo sapiens
ctcggagcctcatccgaggcag

SEQ ID NO: 2796860 - DNA, 23 bp, Homo sapiens
ctcggagcctcatccgaggcagg

SEQ ID NO: 2796861 - DNA, 21 bp, Homo sapiens
ctcggcacctccccggcctct

SEQ ID NO: 2796862 - DNA, 15 bp, Homo sapiens
ctcgggaggctgaga

SEQ ID NO: 2796863 - DNA, 18 bp, Homo sapiens
ctcggggtgcacaggagg

SEQ ID NO: 2796864 - DNA, 19 bp, Homo sapiens
ctcggggtgcacaggaggg

SEQ ID NO: 2796865 - DNA, 15 bp, Homo sapiens
ctcggtggccatgct

SEQ ID NO: 2796866 - DNA, 14 bp, Homo sapiens
ctcgtagccatctc

SEQ ID NO: 2796867 - DNA, 18 bp, Homo sapiens
ctcgtatatgtctcaggt

SEQ ID NO: 2796868 - DNA, 15 bp, Homo sapiens
ctcgtcctccccctg

SEQ ID NO: 2796869 - DNA, 20 bp, Homo sapiens
ctcgtcctccccctgccagt

SEQ ID NO: 2796870 - DNA, 24 bp, Homo sapiens
ctcgtcctccccctgccagtgcct

SEQ ID NO: 2796871 - DNA, 14 bp, Homo sapiens
ctcgtggacacctg

SEQ ID NO: 2796872 - DNA, 19 bp, Homo sapiens
ctcgtggacacctgccctg

SEQ ID NO: 2796873 - DNA, 18 bp, Homo sapiens
ctctaaaaataaaatgat

SEQ ID NO: 2796874 - DNA, 19 bp, Homo sapiens
ctctaaaaataaaatgatg

SEQ ID NO: 2796875 - DNA, 18 bp, Homo sapiens
ctctaaactgctgttaat

SEQ ID NO: 2796876 - DNA, 15 bp, Homo sapiens
ctctaaatcttcctt

SEQ ID NO: 2796877 - DNA, 19 bp, Homo sapiens
ctctaaatcttccttgtga

SEQ ID NO: 2796878 - DNA, 14 bp, Homo sapiens
ctctacccatctcc

SEQ ID NO: 2796879 - DNA, 11 bp, Homo sapiens
ctctagaacat

SEQ ID NO: 2796880 - DNA, 17 bp, Homo sapiens
ctctagaacatgcacat

SEQ ID NO: 2796881 - DNA, 13 bp, Homo sapiens
ctctagagaacat

SEQ ID NO: 2796882 - DNA, 13 bp, Homo sapiens
ctctagcctgggc

SEQ ID NO: 2796883 - DNA, 17 bp, Homo sapiens
ctctaggggtcaggctc

SEQ ID NO: 2796884 - DNA, 21 bp, Homo sapiens
ctctattgtagcatttcttga

SEQ ID NO: 2796885 - DNA, 19 bp, Homo sapiens
ctctcaatattcaataaag

SEQ ID NO: 2796886 - DNA, 16 bp, Homo sapiens
ctctcagaaggtattc

SEQ ID NO: 2796887 - DNA, 13 bp, Homo sapiens
ctctcaggagcac

SEQ ID NO: 2796888 - DNA, 17 bp, Homo sapiens
ctctcaggagcacaggc

SEQ ID NO: 2796889 - DNA, 18 bp, Homo sapiens
ctctcaggagcacaggca

SEQ ID NO: 2796890 - DNA, 20 bp, Homo sapiens
ctctcaggagcacaggcagc

SEQ ID NO: 2796891 - DNA, 14 bp, Homo sapiens
ctctcaggatcaag

SEQ ID NO: 2796892 - DNA, 14 bp, Homo sapiens
ctctcatgaacctc

SEQ ID NO: 2796893 - DNA, 16 bp, Homo sapiens
ctctccaacctggaca

SEQ ID NO: 2796894 - DNA, 17 bp, Homo sapiens
ctctccaattgtaaaaa

SEQ ID NO: 2796895 - DNA, 10 bp, Homo sapiens
ctctccacct

SEQ ID NO: 2796896 - DNA, 14 bp, Homo sapiens
ctctccacctcagc

SEQ ID NO: 2796897 - DNA, 18 bp, Homo sapiens
ctccagggctgcccctgt

SEQ ID NO: 2796898 - DNA, 16 bp, Homo sapiens
ctccagtggttgctgt

SEQ ID NO: 2796899 - DNA, 14 bp, Homo sapiens
ctccagtttcccca

SEQ ID NO: 2796900 - DNA, 16 bp, Homo sapiens
ctccatgctgcctcca

SEQ ID NO: 2796901 - DNA, 14 bp, Homo sapiens
ctccattctgacca

SEQ ID NO: 2796902 - DNA, 20 bp, Homo sapiens
ctccattctgaccatttcag

SEQ ID NO: 2796903 - DNA, 15 bp, Homo sapiens
ctccatttagttctt

SEQ ID NO: 2796904 - DNA, 14 bp, Homo sapiens
ctccatttctggct

SEQ ID NO: 2796905 - DNA, 16 bp, Homo sapiens
ctcccaaagtgctggg

SEQ ID NO: 2796906 - DNA, 17 bp, Homo sapiens
ctcccaaagtgctggga

SEQ ID NO: 2796907 - DNA, 23 bp, Homo sapiens
ctcccaaagtgctgggattacag

SEQ ID NO: 2796908 - DNA, 14 bp, Homo sapiens
ctcccacaatctgg

SEQ ID NO: 2796909 - DNA, 15 bp, Homo sapiens
ctcccaccaccctcc

SEQ ID NO: 2796910 - DNA, 19 bp, Homo sapiens
ctcccaccccacccccttc

SEQ ID NO: 2796911 - DNA, 13 bp, Homo sapiens
ctcccacctcagc

SEQ ID NO: 2796912 - DNA, 17 bp, Homo sapiens
ctcccacctcagcctcc

SEQ ID NO: 2796913 - DNA, 16 bp, Homo sapiens
ctcccagaccacctcc

SEQ ID NO: 2796914 - DNA, 16 bp, Homo sapiens
ctcccaggccccatga

SEQ ID NO: 2796915 - DNA, 23 bp, Homo sapiens
ctcccagggccagggccctgcag

SEQ ID NO: 2796916 - DNA, 17 bp, Homo sapiens
ctccccaccttccccag

SEQ ID NO: 2796917 - DNA, 12 bp, Homo sapiens
ctccccactcta

SEQ ID NO: 2796918 - DNA, 17 bp, Homo sapiens
ctccccactctgctctg

SEQ ID NO: 2796919 - DNA, 12 bp, Homo sapiens
ctccccagcaag

SEQ ID NO: 2796920 - DNA, 15 bp, Homo sapiens
ctccccaggccaggc

SEQ ID NO: 2796921 - DNA, 21 bp, Homo sapiens
ctccccaggccaggccaccag

SEQ ID NO: 2796922 - DNA, 20 bp, Homo sapiens
ctccccagtgctacctctct

SEQ ID NO: 2796923 - DNA, 14 bp, Homo sapiens
ctcccccaccccct

SEQ ID NO: 2796924 - DNA, 19 bp, Homo sapiens
ctcccccaccccctcccca

SEQ ID NO: 2796925 - DNA, 14 bp, Homo sapiens
ctccccccactgca

SEQ ID NO: 2796926 - DNA, 13 bp, Homo sapiens
ctccccctgccag

SEQ ID NO: 2796927 - DNA, 16 bp, Homo sapiens
ctccccctgccagtgc

SEQ ID NO: 2796928 - DNA, 17 bp, Homo sapiens
ctccccctgccagtgcc

SEQ ID NO: 2796929 - DNA, 18 bp, Homo sapiens
ctccccctgccagtgcct

SEQ ID NO: 2796930 - DNA, 19 bp, Homo sapiens
ctccccctgccagtgcctt

SEQ ID NO: 2796931 - DNA, 13 bp, Homo sapiens
ctccccctgggct

SEQ ID NO: 2796932 - DNA, 23 bp, Homo sapiens
ctccccctgggctctgccccagc

SEQ ID NO: 2796933 - DNA, 23 bp, Homo sapiens
ctcccctatccacccagcccatt

SEQ ID NO: 2796934 - DNA, 16 bp, Homo sapiens
ctcccctcccccctgt

SEQ ID NO: 2796935 - DNA, 16 bp, Homo sapiens
ctcccctccctcttcc

SEQ ID NO: 2796936 - DNA, 16 bp, Homo sapiens
ctcccctgccctgctg

SEQ ID NO: 2796937 - DNA, 18 bp, Homo sapiens
ctccccttcctgcacccg

SEQ ID NO: 2796938 - DNA, 20 bp, Homo sapiens
ctcccgaatagctgggacta

SEQ ID NO: 2796939 - DNA, 15 bp, Homo sapiens
ctcccgagtagctgg

SEQ ID NO: 2796940 - DNA, 15 bp, Homo sapiens
ctcccgcaccaggcc

SEQ ID NO: 2796941 - DNA, 16 bp, Homo sapiens
ctccctaaaataaaaa

SEQ ID NO: 2796942 - DNA, 17 bp, Homo sapiens
ctccctaaaataaaaac

SEQ ID NO: 2796943 - DNA, 21 bp, Homo sapiens
ctccctaaaataaaaaccaga

SEQ ID NO: 2796944 - DNA, 18 bp, Homo sapiens
ctccctagtggcttcctc

SEQ ID NO: 2796945 - DNA, 23 bp, Homo sapiens
ctccctcagtgccctcattttat

SEQ ID NO: 2796946 - DNA, 15 bp, Homo sapiens
ctccctccaccccag

SEQ ID NO: 2796947 - DNA, 18 bp, Homo sapiens
ctccctccaccccaggac

SEQ ID NO: 2796948 - DNA, 20 bp, Homo sapiens
ctccctctggccctgccttc

SEQ ID NO: 2796949 - DNA, 15 bp, Homo sapiens
ctccctcttccttcc

SEQ ID NO: 2796950 - DNA, 16 bp, Homo sapiens
ctccctcttccttccc

SEQ ID NO: 2796951 - DNA, 19 bp, Homo sapiens
ctccctgaaccatccctga

SEQ ID NO: 2796952 - DNA, 14 bp, Homo sapiens
ctccctgccctgtc

SEQ ID NO: 2796953 - DNA, 20 bp, Homo sapiens
ctccctgccctgtcctccag

SEQ ID NO: 2796954 - DNA, 15 bp, Homo sapiens
ctccctgccgcctca

SEQ ID NO: 2796955 - DNA, 18 bp, Homo sapiens
ctccctgccgcctcaatg

SEQ ID NO: 2796956 - DNA, 19 bp, Homo sapiens
ctccctgccgcctcaatgt

SEQ ID NO: 2796957 - DNA, 23 bp, Homo sapiens
ctccctggcatgaccatcctgtc

SEQ ID NO: 2796958 - DNA, 16 bp, Homo sapiens
ctccctggctctcaga

SEQ ID NO: 2796959 - DNA, 11 bp, Homo sapiens
ctccctgtcct

SEQ ID NO: 2796960 - DNA, 15 bp, Homo sapiens
ctccgaccagacacc

SEQ ID NO: 2796961 - DNA, 18 bp, Homo sapiens
ctccgctgggaggaacct

SEQ ID NO: 2796962 - DNA, 23 bp, Homo sapiens
ctccgctgggaggaacctgaacc

SEQ ID NO: 2796963 - DNA, 19 bp, Homo sapiens
ctccgctttctacccagcg

SEQ ID NO: 2796964 - DNA, 22 bp, Homo sapiens
ctccgctttctacccagcgagc

SEQ ID NO: 2796965 - DNA, 23 bp, Homo sapiens
ctccgctttctacccagcgagcc

SEQ ID NO: 2796966 - DNA, 13 bp, Homo sapiens
ctccggtgtgcct

SEQ ID NO: 2796967 - DNA, 18 bp, Homo sapiens
ctccggtgtgcctgcagc

SEQ ID NO: 2796968 - DNA, 23 bp, Homo sapiens
ctccggtgtgcctgcagccccgc

SEQ ID NO: 2796969 - DNA, 22 bp, Homo sapiens
ctccgtaggagctcacagtcta

SEQ ID NO: 2796970 - DNA, 18 bp, Homo sapiens
ctccgtccaggagcctgg

SEQ ID NO: 2796971 - DNA, 22 bp, Homo sapiens
ctccgtcttagaagtggaccag

SEQ ID NO: 2796972 - DNA, 15 bp, Homo sapiens
ctcctacctcagcct

SEQ ID NO: 2796973 - DNA, 16 bp, Homo sapiens
ctcctacctcagccta

SEQ ID NO: 2796974 - DNA, 15 bp, Homo sapiens
ctcctcacccccagc

SEQ ID NO: 2796975 - DNA, 13 bp, Homo sapiens
ctcctccagggcc

SEQ ID NO: 2796976 - DNA, 14 bp, Homo sapiens
ctcctcccattccc

SEQ ID NO: 2796977 - DNA, 15 bp, Homo sapiens
ctcctcccattcccc

SEQ ID NO: 2796978 - DNA, 16 bp, Homo sapiens
ctcctccccttcctgc

SEQ ID NO: 2796979 - DNA, 19 bp, Homo sapiens
ctcctccttggtgcctggc

SEQ ID NO: 2796980 - DNA, 14 bp, Homo sapiens
ctcctcctttgcct

SEQ ID NO: 2796981 - DNA, 20 bp, Homo sapiens
ctcctcctttgcctaggagg

SEQ ID NO: 2796982 - DNA, 19 bp, Homo sapiens
ctcctcggccccctccatc

SEQ ID NO: 2796983 - DNA, 11 bp, Homo sapiens
ctcctctccag

SEQ ID NO: 2796984 - DNA, 12 bp, Homo sapiens
ctcctctccagg

SEQ ID NO: 2796985 - DNA, 14 bp, Homo sapiens
ctcctctgtccagg

SEQ ID NO: 2796986 - DNA, 15 bp, Homo sapiens
ctcctctgtccaggg

SEQ ID NO: 2796987 - DNA, 17 bp, Homo sapiens
ctcctctgtccagggcc

SEQ ID NO: 2796988 - DNA, 17 bp, Homo sapiens
ctcaggggcctgcccag

SEQ ID NO: 2796989 - DNA, 17 bp, Homo sapiens
ctcagggtccagaccct

SEQ ID NO: 2796990 - DNA, 16 bp, Homo sapiens
ctcaggtgtccctgca

SEQ ID NO: 2796991 - DNA, 13 bp, Homo sapiens
ctcagtaatttag

SEQ ID NO: 2796992 - DNA, 22 bp, Homo sapiens
ctcagtaatttagaaatcattt

SEQ ID NO: 2796993 - DNA, 15 bp, Homo sapiens
ctcagtccatagcag

SEQ ID NO: 2796994 - DNA, 17 bp, Homo sapiens
ctcagtccatagcagag

SEQ ID NO: 2796995 - DNA, 13 bp, Homo sapiens
ctcagtctcagga

SEQ ID NO: 2796996 - DNA, 15 bp, Homo sapiens
ctcagtctcaggagc

SEQ ID NO: 2796997 - DNA, 16 bp, Homo sapiens
ctcagtctcaggagca

SEQ ID NO: 2796998 - DNA, 13 bp, Homo sapiens
ctcagtgccacta

SEQ ID NO: 2796999 - DNA, 20 bp, Homo sapiens
ctcagtgctcggcagtcata

SEQ ID NO: 2797000 - DNA, 21 bp, Homo sapiens
ctcagtgctctcctaccccac

SEQ ID NO: 2797001 - DNA, 20 bp, Homo sapiens
ctcagtgggacaaaccagag

SEQ ID NO: 2797002 - DNA, 14 bp, Homo sapiens
ctcagtgtcattta

SEQ ID NO: 2797003 - DNA, 22 bp, Homo sapiens
ctcagtgtcatttatgaaaaga

SEQ ID NO: 2797004 - DNA, 15 bp, Homo sapiens
ctcataccatctgct

SEQ ID NO: 2797005 - DNA, 21 bp, Homo sapiens
ctcatatgctatgttagaagt

SEQ ID NO: 2797006 - DNA, 15 bp, Homo sapiens
ctcatcataaaataa

SEQ ID NO: 2797007 - DNA, 17 bp, Homo sapiens
ctcatcatattgtatgt

SEQ ID NO: 2797008 - DNA, 22 bp, Homo sapiens
ctcatcatattgtatgtaagta

SEQ ID NO: 2797009 - DNA, 14 bp, Homo sapiens
ctcatccgaggcag

SEQ ID NO: 2797010 - DNA, 14 bp, Homo sapiens
ctcatctgtcacca

SEQ ID NO: 2797011 - DNA, 19 bp, Homo sapiens
ctcatgacagccagagcct

SEQ ID NO: 2797012 - DNA, 20 bp, Homo sapiens
ctcatgacagccagagcctg

SEQ ID NO: 2797013 - DNA, 20 bp, Homo sapiens
ctcatgaccctcctgtccag

SEQ ID NO: 2797014 - DNA, 22 bp, Homo sapiens
ctcatgaccctcctgtccagca

SEQ ID NO: 2797015 - DNA, 14 bp, Homo sapiens
ctcatgcctggccc

SEQ ID NO: 2797016 - DNA, 20 bp, Homo sapiens
ctcatgcctggcccccctcc

SEQ ID NO: 2797017 - DNA, 17 bp, Homo sapiens
ctcatggaaactggcca

SEQ ID NO: 2797018 - DNA, 14 bp, Homo sapiens
ctcatgtgatcctt

SEQ ID NO: 2797019 - DNA, 12 bp, Homo sapiens
ctcattagactg

SEQ ID NO: 2797020 - DNA, 18 bp, Homo sapiens
ctcattccaccttcccat

SEQ ID NO: 2797021 - DNA, 21 bp, Homo sapiens
ctcattccaccttcccatgcc

SEQ ID NO: 2797022 - DNA, 12 bp, Homo sapiens
ctcattccccag

SEQ ID NO: 2797023 - DNA, 12 bp, Homo sapiens
ctcattcccctc

SEQ ID NO: 2797024 - DNA, 12 bp, Homo sapiens
ctcattcttctg

SEQ ID NO: 2797025 - DNA, 17 bp, Homo sapiens
ctcatttaagggaaaaa

SEQ ID NO: 2797026 - DNA, 18 bp, Homo sapiens
ctcatttaagggaaaaat

SEQ ID NO: 2797027 - DNA, 22 bp, Homo sapiens
ctcatttaagggaaaaatatat

SEQ ID NO: 2797028 - DNA, 16 bp, Homo sapiens
ctcatttcatctcatt

SEQ ID NO: 2797029 - DNA, 18 bp, Homo sapiens
ctcatttcatctcattta

SEQ ID NO: 2797030 - DNA, 22 bp, Homo sapiens
ctcatttttccgtaaaaatgat

SEQ ID NO: 2797031 - DNA, 18 bp, Homo sapiens
ctccaaacaccggcagaa

SEQ ID NO: 2797032 - DNA, 16 bp, Homo sapiens
ctccaaagttatccag

SEQ ID NO: 2797033 - DNA, 12 bp, Homo sapiens
ctccaaatgatt

SEQ ID NO: 2797034 - DNA, 20 bp, Homo sapiens
ctccaacaataaagagctca

SEQ ID NO: 2797035 - DNA, 20 bp, Homo sapiens
ctccaagagctacataattt

SEQ ID NO: 2797036 - DNA, 19 bp, Homo sapiens
ctccaagctccatctccac

SEQ ID NO: 2797037 - DNA, 21 bp, Homo sapiens
ctccaaggggctttgtcctgg

SEQ ID NO: 2797038 - DNA, 15 bp, Homo sapiens
ctccaattccacagt

SEQ ID NO: 2797039 - DNA, 16 bp, Homo sapiens
ctccaattgtaaaaaa

SEQ ID NO: 2797040 - DNA, 15 bp, Homo sapiens
ctccacagccgcagc

SEQ ID NO: 2797041 - DNA, 12 bp, Homo sapiens
ctccaccaccca

SEQ ID NO: 2797042 - DNA, 14 bp, Homo sapiens
ctccaccccaggac

SEQ ID NO: 2797043 - DNA, 16 bp, Homo sapiens
ctccaccctgagcctg

SEQ ID NO: 2797044 - DNA, 11 bp, Homo sapiens
ctccaccctgc

SEQ ID NO: 2797045 - DNA, 14 bp, Homo sapiens
ctccaccgctgcct

SEQ ID NO: 2797046 - DNA, 15 bp, Homo sapiens
ctccaccgctgccta

SEQ ID NO: 2797047 - DNA, 16 bp, Homo sapiens
ctccaccgctgcctaa

SEQ ID NO: 2797048 - DNA, 16 bp, Homo sapiens
ctccacctcagccttg

SEQ ID NO: 2797049 - DNA, 18 bp, Homo sapiens
ctccacctcagccttgga

SEQ ID NO: 2797050 - DNA, 19 bp, Homo sapiens
ctccacctgttcaggagct

SEQ ID NO: 2797051 - DNA, 17 bp, Homo sapiens
ctccactaaatgagctc

SEQ ID NO: 2797052 - DNA, 18 bp, Homo sapiens
ctccactaaatgagctcc

SEQ ID NO: 2797053 - DNA, 21 bp, Homo sapiens
ctccactaaatgagctcctgc

SEQ ID NO: 2797054 - DNA, 15 bp, Homo sapiens
ctccactgctctcag

SEQ ID NO: 2797055 - DNA, 19 bp, Homo sapiens
ctccactgctctcagcctc

SEQ ID NO: 2797056 - DNA, 18 bp, Homo sapiens
ctccagaataccttcttc

SEQ ID NO: 2797057 - DNA, 11 bp, Homo sapiens
ctccagccagc

SEQ ID NO: 2797058 - DNA, 14 bp, Homo sapiens
ctccagccagcgcc

SEQ ID NO: 2797059 - DNA, 23 bp, Homo sapiens
ctccagccagcgcctccctccac

SEQ ID NO: 2797060 - DNA, 23 bp, Homo sapiens
ctccagccatcaagagactgagt

SEQ ID NO: 2797061 - DNA, 13 bp, Homo sapiens
ctccagcctgagc

SEQ ID NO: 2797062 - DNA, 14 bp, Homo sapiens
ctccagcctgagca

SEQ ID NO: 2797063 - DNA, 13 bp, Homo sapiens
ctccagcctgggc

SEQ ID NO: 2797064 - DNA, 14 bp, Homo sapiens
ctccagcctgggca

SEQ ID NO: 2797065 - DNA, 14 bp, Homo sapiens
ctccagctcaccag

SEQ ID NO: 2797066 - DNA, 19 bp, Homo sapiens
ctccagctcaccagcccca

SEQ ID NO: 2797067 - DNA, 11 bp, Homo sapiens
ctccagctccc

SEQ ID NO: 2797068 - DNA, 14 bp, Homo sapiens
ctccagcttcccct

SEQ ID NO: 2797069 - DNA, 16 bp, Homo sapiens
ctccaggaaaactgtt

SEQ ID NO: 2797070 - DNA, 19 bp, Homo sapiens
ctccaggaaggtagcccag

SEQ ID NO: 2797071 - DNA, 22 bp, Homo sapiens
ctccaggaaggtagcccagcac

SEQ ID NO: 2797072 - DNA, 19 bp, Homo sapiens
ctccaggattgaagagcat

SEQ ID NO: 2797073 - DNA, 16 bp, Homo sapiens
ctccaggcacccttct

SEQ ID NO: 2797074 - DNA, 19 bp, Homo sapiens
ctccaggcatgctggcctc

SEQ ID NO: 2797075 - DNA, 15 bp, Homo sapiens
ctccaggctccttta

SEQ ID NO: 2797076 - DNA, 20 bp, Homo sapiens
ctccaggctgtatcccatga

SEQ ID NO: 2797077 - DNA, 19 bp, Homo sapiens
ctccagggccacgtgccag

SEQ ID NO: 2797078 - DNA, 14 bp, Homo sapiens
ctccagggctgccc

SEQ ID NO: 2797079 - DNA, 21 bp, Homo sapiens
cggagtcccaccttggctgca

SEQ ID NO: 2797080 - DNA, 23 bp, Homo sapiens
cggatcaccgagagtagccgaga

SEQ ID NO: 2797081 - DNA, 19 bp, Homo sapiens
cggatgtcccatctgctcc

SEQ ID NO: 2797082 - DNA, 22 bp, Homo sapiens
cggatgtcccatctgctcctcc

SEQ ID NO: 2797083 - DNA, 21 bp, Homo sapiens
cggcaaccccagttctgctcc

SEQ ID NO: 2797084 - DNA, 18 bp, Homo sapiens
cggcacctacatccccag

SEQ ID NO: 2797085 - DNA, 13 bp, Homo sapiens
cggcacctgggcc

SEQ ID NO: 2797086 - DNA, 17 bp, Homo sapiens
cggcacctgggccctgg

SEQ ID NO: 2797087 - DNA, 19 bp, Homo sapiens
cggcacctgggccctgggg

SEQ ID NO: 2797088 - DNA, 16 bp, Homo sapiens
cggcacgtcccatgtg

SEQ ID NO: 2797089 - DNA, 17 bp, Homo sapiens
cggcagcttgagcctgt

SEQ ID NO: 2797090 - DNA, 15 bp, Homo sapiens
cggcccacagctccc

SEQ ID NO: 2797091 - DNA, 19 bp, Homo sapiens
cggcccagagaccccttcc

SEQ ID NO: 2797092 - DNA, 18 bp, Homo sapiens
cggccccatcagaggctg

SEQ ID NO: 2797093 - DNA, 17 bp, Homo sapiens
cggccccctccatcggg

SEQ ID NO: 2797094 - DNA, 18 bp, Homo sapiens
cggcccctgctggttcag

SEQ ID NO: 2797095 - DNA, 19 bp, Homo sapiens
cggcccctgctggttcagg

SEQ ID NO: 2797096 - DNA, 18 bp, Homo sapiens
cggcctatgacttgggca

SEQ ID NO: 2797097 - DNA, 22 bp, Homo sapiens
cggcctccgtccaggagcctgg

SEQ ID NO: 2797098 - DNA, 15 bp, Homo sapiens
cggcctgctcccagc

SEQ ID NO: 2797099 - DNA, 19 bp, Homo sapiens
cggcctgctcccagcagcc

SEQ ID NO: 2797100 - DNA, 13 bp, Homo sapiens
cggcgcggtggct

SEQ ID NO: 2797101 - DNA, 13 bp, Homo sapiens
cggctactcagca

SEQ ID NO: 2797102 - DNA, 19 bp, Homo sapiens
cggctactcagcagccctc

SEQ ID NO: 2797103 - DNA, 20 bp, Homo sapiens
cggctactcagcagccctcc

SEQ ID NO: 2797104 - DNA, 21 bp, Homo sapiens
cggctactcagcagccctcct

SEQ ID NO: 2797105 - DNA, 14 bp, Homo sapiens
cggctcactgcagc

SEQ ID NO: 2797106 - DNA, 16 bp, Homo sapiens
cggctccaggctcctt

SEQ ID NO: 2797107 - DNA, 14 bp, Homo sapiens
cggctctcctgaga

SEQ ID NO: 2797108 - DNA, 14 bp, Homo sapiens
cgggaaggagggtt

SEQ ID NO: 2797109 - DNA, 20 bp, Homo sapiens
cgggagcagtgtcttccata

SEQ ID NO: 2797110 - DNA, 23 bp, Homo sapiens
cgggagcagtgtcttccataatg

SEQ ID NO: 2797111 - DNA, 24 bp, Homo sapiens
cgggagcctctccttgcctggtga

SEQ ID NO: 2797112 - DNA, 19 bp, Homo sapiens
cgggaggctgagacaggag

SEQ ID NO: 2797113 - DNA, 20 bp, Homo sapiens
cgggaggctgagacaggaga

SEQ ID NO: 2797114 - DNA, 18 bp, Homo sapiens
cgggataacaaaatcaca

SEQ ID NO: 2797115 - DNA, 16 bp, Homo sapiens
cgggatggtcctgggg

SEQ ID NO: 2797116 - DNA, 19 bp, Homo sapiens
cgggcacctatagtcccag

SEQ ID NO: 2797117 - DNA, 17 bp, Homo sapiens
cgggcagcccagcctct

SEQ ID NO: 2797118 - DNA, 21 bp, Homo sapiens
cgggcagcccagcctctgtcc

SEQ ID NO: 2797119 - DNA, 12 bp, Homo sapiens
cgggccacagag

SEQ ID NO: 2797120 - DNA, 18 bp, Homo sapiens
cgggccactccttcctgc

SEQ ID NO: 2797121 - DNA, 20 bp, Homo sapiens
cgggccactccttcctgccc

SEQ ID NO: 2797122 - DNA, 11 bp, Homo sapiens
cgggctcagca

SEQ ID NO: 2797123 - DNA, 16 bp, Homo sapiens
cggggaactcctggaa

SEQ ID NO: 2797124 - DNA, 20 bp, Homo sapiens
cggggaagctggcagcactc

SEQ ID NO: 2797125 - DNA, 22 bp, Homo sapiens
cggggacagctccttctgtcct

SEQ ID NO: 2797126 - DNA, 16 bp, Homo sapiens
cggggcatgctggggc

SEQ ID NO: 2797127 - DNA, 18 bp, Homo sapiens
cggggcgacccctcagtg

SEQ ID NO: 2797128 - DNA, 14 bp, Homo sapiens
cgggggaggaaggg

SEQ ID NO: 2797129 - DNA, 18 bp, Homo sapiens
cggggtgcacaggagggg

SEQ ID NO: 2797130 - DNA, 15 bp, Homo sapiens
cgggtccccagctcc

SEQ ID NO: 2797131 - DNA, 19 bp, Homo sapiens
cgggtccccagctccccag

SEQ ID NO: 2797132 - DNA, 19 bp, Homo sapiens
cgggtggatcacctgaggt

SEQ ID NO: 2797133 - DNA, 17 bp, Homo sapiens
cgggttgtgtgtctgtt

SEQ ID NO: 2797134 - DNA, 16 bp, Homo sapiens
cggtccacccaggagc

SEQ ID NO: 2797135 - DNA, 20 bp, Homo sapiens
cggtccacccaggagccccg

SEQ ID NO: 2797136 - DNA, 14 bp, Homo sapiens
cggtcccacactgg

SEQ ID NO: 2797137 - DNA, 21 bp, Homo sapiens
cggtcccttgagacctcagcc

SEQ ID NO: 2797138 - DNA, 13 bp, Homo sapiens
cggtggccatgct

SEQ ID NO: 2797139 - DNA, 15 bp, Homo sapiens
cggtggccatgcttc

SEQ ID NO: 2797140 - DNA, 20 bp, Homo sapiens
cggtggccatgcttcttgcc

SEQ ID NO: 2797141 - DNA, 20 bp, Homo sapiens
cggtggctcacgcctgtaat

SEQ ID NO: 2797142 - DNA, 20 bp, Homo sapiens
cggtggctcaggcctataac

SEQ ID NO: 2797143 - DNA, 23 bp, Homo sapiens
ctactcaggaggctgaggcagaa

SEQ ID NO: 2797144 - DNA, 19 bp, Homo sapiens
ctactcataagttggacca

SEQ ID NO: 2797145 - DNA, 15 bp, Homo sapiens
ctactcctacctcag

SEQ ID NO: 2797146 - DNA, 13 bp, Homo sapiens
ctactctgtgcca

SEQ ID NO: 2797147 - DNA, 12 bp, Homo sapiens
ctactctgtgtc

SEQ ID NO: 2797148 - DNA, 13 bp, Homo sapiens
ctactctgtgtca

SEQ ID NO: 2797149 - DNA, 21 bp, Homo sapiens
ctactctgtgtcaggtggggc

SEQ ID NO: 2797150 - DNA, 17 bp, Homo sapiens
ctactgataaagaaaga

SEQ ID NO: 2797151 - DNA, 14 bp, Homo sapiens
ctactgctgcaaag

SEQ ID NO: 2797152 - DNA, 18 bp, Homo sapiens
ctactgctgcaaagtgca

SEQ ID NO: 2797153 - DNA, 18 bp, Homo sapiens
ctactgtggaaaaatatt

SEQ ID NO: 2797154 - DNA, 22 bp, Homo sapiens
ctacttacatgcattactgcat

SEQ ID NO: 2797155 - DNA, 23 bp, Homo sapiens
ctacttcattttcagagtgacac

SEQ ID NO: 2797156 - DNA, 22 bp, Homo sapiens
ctacttttgtaccagtgtgaat

SEQ ID NO: 2797157 - DNA, 21 bp, Homo sapiens
ctagaacacaggcaaaatcct

SEQ ID NO: 2797158 - DNA, 20 bp, Homo sapiens
ctagaagaaagggcaagaag

SEQ ID NO: 2797159 - DNA, 21 bp, Homo sapiens
ctagaagcggtttccaggcca

SEQ ID NO: 2797160 - DNA, 13 bp, Homo sapiens
ctagaaggccaca

SEQ ID NO: 2797161 - DNA, 14 bp, Homo sapiens
ctagaaggccacat

SEQ ID NO: 2797162 - DNA, 16 bp, Homo sapiens
ctagaattgagtgttt

SEQ ID NO: 2797163 - DNA, 22 bp, Homo sapiens
ctagaatttattcaattcctct

SEQ ID NO: 2797164 - DNA, 23 bp, Homo sapiens
ctagaatttattcaattcctctg

SEQ ID NO: 2797165 - DNA, 18 bp, Homo sapiens
ctagaatttgtattttgc

SEQ ID NO: 2797166 - DNA, 19 bp, Homo sapiens
ctagagaagaggctggtgc

SEQ ID NO: 2797167 - DNA, 18 bp, Homo sapiens
ctagaggcttccttcatt

SEQ ID NO: 2797168 - DNA, 21 bp, Homo sapiens
ctagaggcttccttcatttcc

SEQ ID NO: 2797169 - DNA, 23 bp, Homo sapiens
ctagaggcttccttcatttcctc

SEQ ID NO: 2797170 - DNA, 18 bp, Homo sapiens
ctagatcaattaattctt

SEQ ID NO: 2797171 - DNA, 20 bp, Homo sapiens
ctagattctacatattcttt

SEQ ID NO: 2797172 - DNA, 13 bp, Homo sapiens
ctagcagctgcag

SEQ ID NO: 2797173 - DNA, 16 bp, Homo sapiens
ctagcaggcacaggac

SEQ ID NO: 2797174 - DNA, 23 bp, Homo sapiens
ctagcaggcacaggacacctggc

SEQ ID NO: 2797175 - DNA, 16 bp, Homo sapiens
ctagcatctcatgagt

SEQ ID NO: 2797176 - DNA, 13 bp, Homo sapiens
ctagccctctcac

SEQ ID NO: 2797177 - DNA, 16 bp, Homo sapiens
ctagccctgcggagcc

SEQ ID NO: 2797178 - DNA, 21 bp, Homo sapiens
ctagccctgcggagccggcac

SEQ ID NO: 2797179 - DNA, 13 bp, Homo sapiens
ctagccgacctca

SEQ ID NO: 2797180 - DNA, 16 bp, Homo sapiens
ctagccgacctcagcc

SEQ ID NO: 2797181 - DNA, 22 bp, Homo sapiens
ctagccttaatcaggtcctcag

SEQ ID NO: 2797182 - DNA, 21 bp, Homo sapiens
ctagccttagaagtcacacag

SEQ ID NO: 2797183 - DNA, 22 bp, Homo sapiens
ctagccttagaagtcacacagt

SEQ ID NO: 2797184 - DNA, 19 bp, Homo sapiens
ctagccttgaggagtgtga

SEQ ID NO: 2797185 - DNA, 12 bp, Homo sapiens
ctagcgctgccg

SEQ ID NO: 2797186 - DNA, 18 bp, Homo sapiens
ctagctgttgagctgttt

SEQ ID NO: 2797187 - DNA, 17 bp, Homo sapiens
ctaggaatgaaatcctg

SEQ ID NO: 2797188 - DNA, 22 bp, Homo sapiens
ctaggacccctccatgtgggct

SEQ ID NO: 2797189 - DNA, 12 bp, Homo sapiens
ctaggactctga

SEQ ID NO: 2797190 - DNA, 15 bp, Homo sapiens
ctaggactctgaggc

SEQ ID NO: 2797191 - DNA, 22 bp, Homo sapiens
ctaggactctgaggctctttct

SEQ ID NO: 2797192 - DNA, 15 bp, Homo sapiens
ctaggagcaaagcct

SEQ ID NO: 2797193 - DNA, 16 bp, Homo sapiens
ctaggagcaaagcctg

SEQ ID NO: 2797194 - DNA, 16 bp, Homo sapiens
ctaggagctgggagga

SEQ ID NO: 2797195 - DNA, 18 bp, Homo sapiens
ctaggaggccttctcgca

SEQ ID NO: 2797196 - DNA, 22 bp, Homo sapiens
ctaggatgtgcattctccagcc

SEQ ID NO: 2797197 - DNA, 18 bp, Homo sapiens
ctaggcatcccaggggac

SEQ ID NO: 2797198 - DNA, 19 bp, Homo sapiens
ctaggcatcccaggggacc

SEQ ID NO: 2797199 - DNA, 14 bp, Homo sapiens
ctaggccactcctc

SEQ ID NO: 2797200 - DNA, 16 bp, Homo sapiens
ctaggccactcctcca

SEQ ID NO: 2797201 - DNA, 14 bp, Homo sapiens
ctaggcctggccag

SEQ ID NO: 2797202 - DNA, 15 bp, Homo sapiens
ctaggcctggccaga

SEQ ID NO: 2797203 - DNA, 20 bp, Homo sapiens
ctaggcgagtgccaggactc

SEQ ID NO: 2797204 - DNA, 13 bp, Homo sapiens
ctaggctgccccg

SEQ ID NO: 2797205 - DNA, 16 bp, Homo sapiens
ctaggctgttttctcc

SEQ ID NO: 2797206 - DNA, 14 bp, Homo sapiens
ctagggagagaccc

SEQ ID NO: 2797207 - DNA, 23 bp, Homo sapiens
ctaggggccgagggaaatgctgt

SEQ ID NO: 2797208 - DNA, 22 bp, Homo sapiens
ctagtacttgggagacctgtaa

SEQ ID NO: 2797209 - DNA, 15 bp, Homo sapiens
ctagtctcctttgca

SEQ ID NO: 2797210 - DNA, 19 bp, Homo sapiens
ctagtctcctttgcactga

SEQ ID NO: 2797211 - DNA, 22 bp, Homo sapiens
ctagtggcaataagttccatgt

SEQ ID NO: 2797212 - DNA, 19 bp, Homo sapiens
ctagtggggtctccctctc

SEQ ID NO: 2797213 - DNA, 21 bp, Homo sapiens
ctagtggggtctccctctcct

SEQ ID NO: 2797214 - DNA, 22 bp, Homo sapiens
ctagtggggtctccctctcctg

SEQ ID NO: 2797215 - DNA, 16 bp, Homo sapiens
ctagtgtaacactgca

SEQ ID NO: 2797216 - DNA, 22 bp, Homo sapiens
ctagtgtaacactgcaagaagt

SEQ ID NO: 2797217 - DNA, 14 bp, Homo sapiens
ctagtgttgcttgg

SEQ ID NO: 2797218 - DNA, 16 bp, Homo sapiens
ctagttagcaggaaat

SEQ ID NO: 2797219 - DNA, 20 bp, Homo sapiens
ctagttagctgctttaaatc

SEQ ID NO: 2797220 - DNA, 21 bp, Homo sapiens
ctagttccccgtgaacttcct

SEQ ID NO: 2797221 - DNA, 23 bp, Homo sapiens
ctagttccccgtgaacttccttt

SEQ ID NO: 2797222 - DNA, 17 bp, Homo sapiens
ctagttttctcctccca

SEQ ID NO: 2797223 - DNA, 18 bp, Homo sapiens
ctataaatggtgtttttt

SEQ ID NO: 2797224 - DNA, 16 bp, Homo sapiens
ctataaccagacacat

SEQ ID NO: 2797225 - DNA, 22 bp, Homo sapiens
ctataaccccagctccctagga

SEQ ID NO: 2797226 - DNA, 22 bp, Homo sapiens
ctataagcaagaaggcaaaaat

SEQ ID NO: 2797227 - DNA, 15 bp, Homo sapiens
ctatacatttctgtt

SEQ ID NO: 2797228 - DNA, 19 bp, Homo sapiens
ctatagccaaaaatagcta

SEQ ID NO: 2797229 - DNA, 15 bp, Homo sapiens
ctatagcccaggtcc

SEQ ID NO: 2797230 - DNA, 19 bp, Homo sapiens
ctatagctcttctatttaa

SEQ ID NO: 2797231 - DNA, 20 bp, Homo sapiens
ctatagctcttctatttaaa

SEQ ID NO: 2797232 - DNA, 21 bp, Homo sapiens
ctatagctcttctatttaaaa

SEQ ID NO: 2797233 - DNA, 17 bp, Homo sapiens
ctataggctggagaagc

SEQ ID NO: 2797234 - DNA, 19 bp, Homo sapiens
ctatagtagtcaattagta

SEQ ID NO: 2797235 - DNA, 22 bp, Homo sapiens
ctatagtagtcaattagtacag

SEQ ID NO: 2797236 - DNA, 15 bp, Homo sapiens
ctatatatacatgta

SEQ ID NO: 2797237 - DNA, 22 bp, Homo sapiens
ctatatcatcctttatccctga

SEQ ID NO: 2797238 - DNA, 13 bp, Homo sapiens
ctatattgtacac

SEQ ID NO: 2797239 - DNA, 15 bp, Homo sapiens
ctatcaaaacatatc

SEQ ID NO: 2797240 - DNA, 21 bp, Homo sapiens
ctatcaaaacatatcaattca

SEQ ID NO: 2797241 - DNA, 22 bp, Homo sapiens
ctatcaaaacatatcaattcaa

SEQ ID NO: 2797242 - DNA, 16 bp, Homo sapiens
ctatcaaactgaagcc

SEQ ID NO: 2797243 - DNA, 17 bp, Homo sapiens
ctatcaaccccagacac

SEQ ID NO: 2797244 - DNA, 20 bp, Homo sapiens
ctatcaaccccagacactgg

SEQ ID NO: 2797245 - DNA, 20 bp, Homo sapiens
ctatcaacctaagcaacaga

SEQ ID NO: 2797246 - DNA, 16 bp, Homo sapiens
ctatcaatagtcaaga

SEQ ID NO: 2797247 - DNA, 20 bp, Homo sapiens
ctatcaatagtcaagaaaaa

SEQ ID NO: 2797248 - DNA, 13 bp, Homo sapiens
ctatcacatacaa

SEQ ID NO: 2797249 - DNA, 12 bp, Homo sapiens
ctatcatttctt

SEQ ID NO: 2797250 - DNA, 19 bp, Homo sapiens
ctatcatttcttttccaaa

SEQ ID NO: 2797251 - DNA, 15 bp, Homo sapiens
ctatccaaaggaatc

SEQ ID NO: 2797252 - DNA, 12 bp, Homo sapiens
ctatccacccag

SEQ ID NO: 2797253 - DNA, 14 bp, Homo sapiens
ctatccacccagcc

SEQ ID NO: 2797254 - DNA, 13 bp, Homo sapiens
ctatccatcctgc

SEQ ID NO: 2797255 - DNA, 18 bp, Homo sapiens
ctatctgcatttataaat

SEQ ID NO: 2797256 - DNA, 22 bp, Homo sapiens
ctatctgcatttataaatgtgt

SEQ ID NO: 2797257 - DNA, 17 bp, Homo sapiens
ctatctgtattttcatt

SEQ ID NO: 2797258 - DNA, 18 bp, Homo sapiens
ctatcttactatttcaca

SEQ ID NO: 2797259 - DNA, 18 bp, Homo sapiens
ccttagcttagacctcag

SEQ ID NO: 2797260 - DNA, 20 bp, Homo sapiens
ccttagcttagacctcagcc

SEQ ID NO: 2797261 - DNA, 14 bp, Homo sapiens
ccttatcaggcaaa

SEQ ID NO: 2797262 - DNA, 15 bp, Homo sapiens
ccttatccaggactc

SEQ ID NO: 2797263 - DNA, 22 bp, Homo sapiens
ccttatgtttgaagagaaacct

SEQ ID NO: 2797264 - DNA, 16 bp, Homo sapiens
ccttattgtacctctc

SEQ ID NO: 2797265 - DNA, 24 bp, Homo sapiens
ccttcaactgaaaagactcagtgt

SEQ ID NO: 2797266 - DNA, 20 bp, Homo sapiens
ccttcaagcaccctgttccc

SEQ ID NO: 2797267 - DNA, 14 bp, Homo sapiens
ccttcaataaagta

SEQ ID NO: 2797268 - DNA, 16 bp, Homo sapiens
ccttcaattcctgggc

SEQ ID NO: 2797269 - DNA, 18 bp, Homo sapiens
ccttcacaaccagccaca

SEQ ID NO: 2797270 - DNA, 18 bp, Homo sapiens
ccttcactccctccctgg

SEQ ID NO: 2797271 - DNA, 14 bp, Homo sapiens
ccttcactccggtg

SEQ ID NO: 2797272 - DNA, 23 bp, Homo sapiens
ccttcactccggtgtgcctgcag

SEQ ID NO: 2797273 - DNA, 11 bp, Homo sapiens
ccttcagtgcc

SEQ ID NO: 2797274 - DNA, 14 bp, Homo sapiens
ccttcagtgcccac

SEQ ID NO: 2797275 - DNA, 15 bp, Homo sapiens
ccttcatttcctccg

SEQ ID NO: 2797276 - DNA, 13 bp, Homo sapiens
ccttccaggcccc

SEQ ID NO: 2797277 - DNA, 21 bp, Homo sapiens
ccttccagtggtaccagctca

SEQ ID NO: 2797278 - DNA, 11 bp, Homo sapiens
ccttccataat

SEQ ID NO: 2797279 - DNA, 18 bp, Homo sapiens
ccttccatgtcgcctctg

SEQ ID NO: 2797280 - DNA, 22 bp, Homo sapiens
ccttcccacagcattcctccat

SEQ ID NO: 2797281 - DNA, 13 bp, Homo sapiens
ccttcccagctct

SEQ ID NO: 2797282 - DNA, 19 bp, Homo sapiens
ccttcccagctctccctct

SEQ ID NO: 2797283 - DNA, 18 bp, Homo sapiens
ccttcccatgatgccgct

SEQ ID NO: 2797284 - DNA, 19 bp, Homo sapiens
ccttcccatgatgccgctc

SEQ ID NO: 2797285 - DNA, 14 bp, Homo sapiens
ccttccccagactc

SEQ ID NO: 2797286 - DNA, 23 bp, Homo sapiens
ccttcccccatcccctttcctcc

SEQ ID NO: 2797287 - DNA, 14 bp, Homo sapiens
ccttccctgctttg

SEQ ID NO: 2797288 - DNA, 18 bp, Homo sapiens
ccttccgatgacagtgct

SEQ ID NO: 2797289 - DNA, 21 bp, Homo sapiens
ccttccgatgacagtgctcta

SEQ ID NO: 2797290 - DNA, 16 bp, Homo sapiens
ccttcctcctcctttg

SEQ ID NO: 2797291 - DNA, 17 bp, Homo sapiens
ccttcctgccaccagtc

SEQ ID NO: 2797292 - DNA, 21 bp, Homo sapiens
ccttcctggacagctgtgcct

SEQ ID NO: 2797293 - DNA, 19 bp, Homo sapiens
ccttcctggggcatctggc

SEQ ID NO: 2797294 - DNA, 19 bp, Homo sapiens
ccttcctgtcccacctctt

SEQ ID NO: 2797295 - DNA, 17 bp, Homo sapiens
ccttcctttcctctgca

SEQ ID NO: 2797296 - DNA, 19 bp, Homo sapiens
ccttcctttcctctgcagc

SEQ ID NO: 2797297 - DNA, 14 bp, Homo sapiens
ccttcgctcctgtg

SEQ ID NO: 2797298 - DNA, 14 bp, Homo sapiens
ccttctactgagcc

SEQ ID NO: 2797299 - DNA, 15 bp, Homo sapiens
ccttctccaaatgag

SEQ ID NO: 2797300 - DNA, 15 bp, Homo sapiens
ccttctcgcattttc

SEQ ID NO: 2797301 - DNA, 19 bp, Homo sapiens
ccttctcgcattttctcta

SEQ ID NO: 2797302 - DNA, 18 bp, Homo sapiens
ccttctctacccatctcc

SEQ ID NO: 2797303 - DNA, 14 bp, Homo sapiens
ccttctctctctgg

SEQ ID NO: 2797304 - DNA, 15 bp, Homo sapiens
ccttctctctctggt

SEQ ID NO: 2797305 - DNA, 14 bp, Homo sapiens
ccttctctgaagga

SEQ ID NO: 2797306 - DNA, 16 bp, Homo sapiens
ccttctctgaaggaca

SEQ ID NO: 2797307 - DNA, 16 bp, Homo sapiens
ccttctctgcccccag

SEQ ID NO: 2797308 - DNA, 17 bp, Homo sapiens
ccttctctgttcatttc

SEQ ID NO: 2797309 - DNA, 18 bp, Homo sapiens
ccttctctgttcatttcc

SEQ ID NO: 2797310 - DNA, 16 bp, Homo sapiens
ccttctgaagatctca

SEQ ID NO: 2797311 - DNA, 19 bp, Homo sapiens
ccttctggtacaatccttt

SEQ ID NO: 2797312 - DNA, 20 bp, Homo sapiens
ccttcttattctcactccac

SEQ ID NO: 2797313 - DNA, 14 bp, Homo sapiens
ccttcttcgctgct

SEQ ID NO: 2797314 - DNA, 23 bp, Homo sapiens
ccttctttaaatcaaaagctgct

SEQ ID NO: 2797315 - DNA, 19 bp, Homo sapiens
ccttctttctaccctgctg

SEQ ID NO: 2797316 - DNA, 14 bp, Homo sapiens
ccttctttttcttc

SEQ ID NO: 2797317 - DNA, 19 bp, Homo sapiens
ccttgaaaaacaagtcttt

SEQ ID NO: 2797318 - DNA, 13 bp, Homo sapiens
ccttgaacactgg

SEQ ID NO: 2797319 - DNA, 19 bp, Homo sapiens
ccttgaagaggggaggggc

SEQ ID NO: 2797320 - DNA, 14 bp, Homo sapiens
ccttgaagccactg

SEQ ID NO: 2797321 - DNA, 21 bp, Homo sapiens
ccttgaagggtaaagaagttt

SEQ ID NO: 2797322 - DNA, 13 bp, Homo sapiens
ccttgacagggca

SEQ ID NO: 2797323 - DNA, 21 bp, Homo sapiens
ccttgacagggcacaccgggc

SEQ ID NO: 2797324 - DNA, 17 bp, Homo sapiens
ccttgagacctcagcca

SEQ ID NO: 2797325 - DNA, 20 bp, Homo sapiens
ccttgattttagccttctct

SEQ ID NO: 2797326 - DNA, 23 bp, Homo sapiens
ccttgcaaagaccataaagtcca

SEQ ID NO: 2797327 - DNA, 14 bp, Homo sapiens
ccttgcattagaaa

SEQ ID NO: 2797328 - DNA, 18 bp, Homo sapiens
ccttgccaagctttcttc

SEQ ID NO: 2797329 - DNA, 17 bp, Homo sapiens
ccttgcccagggctcag

SEQ ID NO: 2797330 - DNA, 22 bp, Homo sapiens
ccttgcccagggctcagcctgg

SEQ ID NO: 2797331 - DNA, 12 bp, Homo sapiens
ccttgccctgac

SEQ ID NO: 2797332 - DNA, 19 bp, Homo sapiens
ccttgccctgacctcccag

SEQ ID NO: 2797333 - DNA, 23 bp, Homo sapiens
ccttgccctgacctcccagccct

SEQ ID NO: 2797334 - DNA, 18 bp, Homo sapiens
ccttgcccttgccctgac

SEQ ID NO: 2797335 - DNA, 18 bp, Homo sapiens
ccttgctcaccaagctgt

SEQ ID NO: 2797336 - DNA, 15 bp, Homo sapiens
ctcaacctcctgggc

SEQ ID NO: 2797337 - DNA, 17 bp, Homo sapiens
ctcaacctcctgggcta

SEQ ID NO: 2797338 - DNA, 18 bp, Homo sapiens
ctcaacgttgctccccat

SEQ ID NO: 2797339 - DNA, 20 bp, Homo sapiens
ctcaagaagacatggagact

SEQ ID NO: 2797340 - DNA, 21 bp, Homo sapiens
ctcaagaagacatggagactc

SEQ ID NO: 2797341 - DNA, 22 bp, Homo sapiens
ctcaagaagacatggagactcc

SEQ ID NO: 2797342 - DNA, 16 bp, Homo sapiens
ctcaagatgaaggcaa

SEQ ID NO: 2797343 - DNA, 16 bp, Homo sapiens
ctcaagatgacagctc

SEQ ID NO: 2797344 - DNA, 17 bp, Homo sapiens
ctcaagatgacagctct

SEQ ID NO: 2797345 - DNA, 21 bp, Homo sapiens
ctcaagtcctcttttctgaga

SEQ ID NO: 2797346 - DNA, 17 bp, Homo sapiens
ctcaagtcttccctgat

SEQ ID NO: 2797347 - DNA, 20 bp, Homo sapiens
ctcaagtgattctcctgcct

SEQ ID NO: 2797348 - DNA, 18 bp, Homo sapiens
ctcaagtttttcagaaag

SEQ ID NO: 2797349 - DNA, 19 bp, Homo sapiens
ctcaatattcaataaagct

SEQ ID NO: 2797350 - DNA, 13 bp, Homo sapiens
ctcaatattttcc

SEQ ID NO: 2797351 - DNA, 19 bp, Homo sapiens
ctcaatattttccatgaaa

SEQ ID NO: 2797352 - DNA, 13 bp, Homo sapiens
ctcaatgcactga

SEQ ID NO: 2797353 - DNA, 15 bp, Homo sapiens
ctcaatgcactgaca

SEQ ID NO: 2797354 - DNA, 16 bp, Homo sapiens
ctcaatgtgaccaggg

SEQ ID NO: 2797355 - DNA, 13 bp, Homo sapiens
ctcacaactgttt

SEQ ID NO: 2797356 - DNA, 14 bp, Homo sapiens
ctcacaaggcagca

SEQ ID NO: 2797357 - DNA, 15 bp, Homo sapiens
ctcacaaggcagcaa

SEQ ID NO: 2797358 - DNA, 21 bp, Homo sapiens
ctcacaaggcagcaaggcccg

SEQ ID NO: 2797359 - DNA, 12 bp, Homo sapiens
ctcacacaggca

SEQ ID NO: 2797360 - DNA, 22 bp, Homo sapiens
ctcacactggtggaggagctgg

SEQ ID NO: 2797361 - DNA, 20 bp, Homo sapiens
ctcacacttgggcgctctgc

SEQ ID NO: 2797362 - DNA, 21 bp, Homo sapiens
ctcacacttgggcgctctgcc

SEQ ID NO: 2797363 - DNA, 16 bp, Homo sapiens
ctcacagttcctcgcc

SEQ ID NO: 2797364 - DNA, 17 bp, Homo sapiens
ctcacagttcctcgccc

SEQ ID NO: 2797365 - DNA, 11 bp, Homo sapiens
ctcacatgccg

SEQ ID NO: 2797366 - DNA, 17 bp, Homo sapiens
ctcacatgccgccccca

SEQ ID NO: 2797367 - DNA, 22 bp, Homo sapiens
ctcacatttattctgctcacat

SEQ ID NO: 2797368 - DNA, 17 bp, Homo sapiens
ctcaccaataacttcag

SEQ ID NO: 2797369 - DNA, 18 bp, Homo sapiens
ctcaccagccccagtgcc

SEQ ID NO: 2797370 - DNA, 20 bp, Homo sapiens
ctcaccagccccagtgccca

SEQ ID NO: 2797371 - DNA, 19 bp, Homo sapiens
cgattccctctcccaggcc

SEQ ID NO: 2797372 - DNA, 13 bp, Homo sapiens
cgcaacccgtgcc

SEQ ID NO: 2797373 - DNA, 14 bp, Homo sapiens
cgcaacccgtgcca

SEQ ID NO: 2797374 - DNA, 21 bp, Homo sapiens
cgcaagagaacatttctagaa

SEQ ID NO: 2797375 - DNA, 12 bp, Homo sapiens
cgcacctccatc

SEQ ID NO: 2797376 - DNA, 17 bp, Homo sapiens
cgcacctgccccctggt

SEQ ID NO: 2797377 - DNA, 22 bp, Homo sapiens
cgcaccttgtcatgtaccatca

SEQ ID NO: 2797378 - DNA, 18 bp, Homo sapiens
cgcactcacccatgtgcc

SEQ ID NO: 2797379 - DNA, 16 bp, Homo sapiens
cgcagcaccctgcaga

SEQ ID NO: 2797380 - DNA, 13 bp, Homo sapiens
cgcagccaccctg

SEQ ID NO: 2797381 - DNA, 15 bp, Homo sapiens
cgcaggaactcccag

SEQ ID NO: 2797382 - DNA, 17 bp, Homo sapiens
cgcaggaactcccagca

SEQ ID NO: 2797383 - DNA, 18 bp, Homo sapiens
cgcaggaactcccagcaa

SEQ ID NO: 2797384 - DNA, 13 bp, Homo sapiens
cgcatcttctcca

SEQ ID NO: 2797385 - DNA, 21 bp, Homo sapiens
cgcatcttctccatctggcag

SEQ ID NO: 2797386 - DNA, 15 bp, Homo sapiens
cgcatgccagagcct

SEQ ID NO: 2797387 - DNA, 13 bp, Homo sapiens
cgcattccctgag

SEQ ID NO: 2797388 - DNA, 17 bp, Homo sapiens
cgccactcatttcatct

SEQ ID NO: 2797389 - DNA, 21 bp, Homo sapiens
cgccactgcactccagcctgg

SEQ ID NO: 2797390 - DNA, 20 bp, Homo sapiens
cgccactgcactccggcctg

SEQ ID NO: 2797391 - DNA, 16 bp, Homo sapiens
cgccagtttcaccatt

SEQ ID NO: 2797392 - DNA, 13 bp, Homo sapiens
cgccatccttcac

SEQ ID NO: 2797393 - DNA, 17 bp, Homo sapiens
cgccatccttcaccaga

SEQ ID NO: 2797394 - DNA, 24 bp, Homo sapiens
cgccatccttcaccagagcccatg

SEQ ID NO: 2797395 - DNA, 20 bp, Homo sapiens
cgcccagctgcacctgccag

SEQ ID NO: 2797396 - DNA, 21 bp, Homo sapiens
cgcccctcatttatccctcaa

SEQ ID NO: 2797397 - DNA, 12 bp, Homo sapiens
cgccctgcagac

SEQ ID NO: 2797398 - DNA, 16 bp, Homo sapiens
cgccctgcagaccctg

SEQ ID NO: 2797399 - DNA, 13 bp, Homo sapiens
cgccgtggagcat

SEQ ID NO: 2797400 - DNA, 14 bp, Homo sapiens
cgcctacaggagtg

SEQ ID NO: 2797401 - DNA, 17 bp, Homo sapiens
cgcctcaatgtggttgc

SEQ ID NO: 2797402 - DNA, 14 bp, Homo sapiens
cgcctcccagcctg

SEQ ID NO: 2797403 - DNA, 22 bp, Homo sapiens
cgcctccccgaaacaggctact

SEQ ID NO: 2797404 - DNA, 13 bp, Homo sapiens
cgcctccctccac

SEQ ID NO: 2797405 - DNA, 19 bp, Homo sapiens
cgcctcttcttcttcagaa

SEQ ID NO: 2797406 - DNA, 13 bp, Homo sapiens
cgcctgagcccag

SEQ ID NO: 2797407 - DNA, 14 bp, Homo sapiens
cgcctgagcccagg

SEQ ID NO: 2797408 - DNA, 15 bp, Homo sapiens
cgcctgagcccaggg

SEQ ID NO: 2797409 - DNA, 16 bp, Homo sapiens
cgcctgagcccaggga

SEQ ID NO: 2797410 - DNA, 17 bp, Homo sapiens
cgcctgagcccagggag

SEQ ID NO: 2797411 - DNA, 14 bp, Homo sapiens
cgcctgcccagcct

SEQ ID NO: 2797412 - DNA, 23 bp, Homo sapiens
cgcctgcccccagcactcctctg

SEQ ID NO: 2797413 - DNA, 16 bp, Homo sapiens
cgcctggccggctcca

SEQ ID NO: 2797414 - DNA, 16 bp, Homo sapiens
cgcctgtaatcccagc

SEQ ID NO: 2797415 - DNA, 17 bp, Homo sapiens
cgcctgtaatcccagca

SEQ ID NO: 2797416 - DNA, 19 bp, Homo sapiens
cgcctgtaatcccagcact

SEQ ID NO: 2797417 - DNA, 18 bp, Homo sapiens
cgcctgtaatcccagcag

SEQ ID NO: 2797418 - DNA, 17 bp, Homo sapiens
cgcctgtaatcccagct

SEQ ID NO: 2797419 - DNA, 17 bp, Homo sapiens
cgcctgtagtcctagcc

SEQ ID NO: 2797420 - DNA, 18 bp, Homo sapiens
cgcctgtgcccacgtgtg

SEQ ID NO: 2797421 - DNA, 21 bp, Homo sapiens
cgcctgtgcccacgtgtgcag

SEQ ID NO: 2797422 - DNA, 22 bp, Homo sapiens
cgcgcatgtaatcccagctact

SEQ ID NO: 2797423 - DNA, 17 bp, Homo sapiens
cgcgtctaccctgggat

SEQ ID NO: 2797424 - DNA, 16 bp, Homo sapiens
cgcgtgcacacaccag

SEQ ID NO: 2797425 - DNA, 20 bp, Homo sapiens
cgcgtgcacacaccagagcc

SEQ ID NO: 2797426 - DNA, 16 bp, Homo sapiens
cgctacaccactctgg

SEQ ID NO: 2797427 - DNA, 23 bp, Homo sapiens
cgctacaccactctggcagccac

SEQ ID NO: 2797428 - DNA, 11 bp, Homo sapiens
cgctacccact

SEQ ID NO: 2797429 - DNA, 19 bp, Homo sapiens
cgctccccactctgctctg

SEQ ID NO: 2797430 - DNA, 20 bp, Homo sapiens
cgctcctgtctgccagccag

SEQ ID NO: 2797431 - DNA, 15 bp, Homo sapiens
cgctctgccctccct

SEQ ID NO: 2797432 - DNA, 18 bp, Homo sapiens
cgctctgccctccctggc

SEQ ID NO: 2797433 - DNA, 16 bp, Homo sapiens
cgctctgctggcctgg

SEQ ID NO: 2797434 - DNA, 17 bp, Homo sapiens
cgctctgctggcctggc

SEQ ID NO: 2797435 - DNA, 18 bp, Homo sapiens
cgctctgctggcctggcc

SEQ ID NO: 2797436 - DNA, 21 bp, Homo sapiens
cgctctgctggcctggccggc

SEQ ID NO: 2797437 - DNA, 21 bp, Homo sapiens
cgctcttggcaggtactcagc

SEQ ID NO: 2797438 - DNA, 13 bp, Homo sapiens
cgctgccgcaccc

SEQ ID NO: 2797439 - DNA, 15 bp, Homo sapiens
cgctgccttgccatg

SEQ ID NO: 2797440 - DNA, 18 bp, Homo sapiens
cgctgctcaacctctctc

SEQ ID NO: 2797441 - DNA, 18 bp, Homo sapiens
cgctgcttcgtgggatac

SEQ ID NO: 2797442 - DNA, 14 bp, Homo sapiens
cgctggcagagaag

SEQ ID NO: 2797443 - DNA, 14 bp, Homo sapiens
cgctgttcacccac

SEQ ID NO: 2797444 - DNA, 17 bp, Homo sapiens
cgcttgtccagcgccta

SEQ ID NO: 2797445 - DNA, 16 bp, Homo sapiens
cgctttctacccagcg

SEQ ID NO: 2797446 - DNA, 14 bp, Homo sapiens
cggaaagactgaaa

SEQ ID NO: 2797447 - DNA, 16 bp, Homo sapiens
cggaaagactgaaaga

SEQ ID NO: 2797448 - DNA, 20 bp, Homo sapiens
cggaagcagtgccttccata

SEQ ID NO: 2797449 - DNA, 13 bp, Homo sapiens
cggacaagtttta

SEQ ID NO: 2797450 - DNA, 19 bp, Homo sapiens
cggacagaatgatgccaaa

SEQ ID NO: 2797451 - DNA, 20 bp, Homo sapiens
cggacagccacggccaggcc

SEQ ID NO: 2797452 - DNA, 21 bp, Homo sapiens
cggacagccacggccaggcca

SEQ ID NO: 2797453 - DNA, 15 bp, Homo sapiens
cggacgtttccatca

SEQ ID NO: 2797454 - DNA, 15 bp, Homo sapiens
cggagacggagtccc

SEQ ID NO: 2797455 - DNA, 17 bp, Homo sapiens
cggagagtacagtgagc

SEQ ID NO: 2797456 - DNA, 21 bp, Homo sapiens
cggagagtacagtgagccaag

SEQ ID NO: 2797457 - DNA, 21 bp, Homo sapiens
cggagcctcatccgaggcagg

SEQ ID NO: 2797458 - DNA, 22 bp, Homo sapiens
cggagcctcatccgaggcaggg

SEQ ID NO: 2797459 - DNA, 22 bp, Homo sapiens
cggaggagaccagctcagaggc

SEQ ID NO: 2797460 - DNA, 13 bp, Homo sapiens
cggaggttgcagg

SEQ ID NO: 2797461 - DNA, 20 bp, Homo sapiens
cggagtcccaccttggctgc

SEQ ID NO: 2797462 - DNA, 12 bp, Homo sapiens
cctggggctcta

SEQ ID NO: 2797463 - DNA, 21 bp, Homo sapiens
cctggggctctaacgcctgag

SEQ ID NO: 2797464 - DNA, 17 bp, Homo sapiens
cctggggcttctcctga

SEQ ID NO: 2797465 - DNA, 18 bp, Homo sapiens
cctggggcttctcctgac

SEQ ID NO: 2797466 - DNA, 17 bp, Homo sapiens
cctgggggaagccctgg

SEQ ID NO: 2797467 - DNA, 22 bp, Homo sapiens
cctgggggatgtgcacggcagc

SEQ ID NO: 2797468 - DNA, 13 bp, Homo sapiens
cctgggggcctgg

SEQ ID NO: 2797469 - DNA, 23 bp, Homo sapiens
cctgggggcctggctggctgagg

SEQ ID NO: 2797470 - DNA, 23 bp, Homo sapiens
cctgggggttctttcttcctctg

SEQ ID NO: 2797471 - DNA, 14 bp, Homo sapiens
cctgggtggctact

SEQ ID NO: 2797472 - DNA, 17 bp, Homo sapiens
cctgggtggctactctg

SEQ ID NO: 2797473 - DNA, 19 bp, Homo sapiens
cctgggtggctactctgtg

SEQ ID NO: 2797474 - DNA, 21 bp, Homo sapiens
cctgggtggctactctgtgcc

SEQ ID NO: 2797475 - DNA, 23 bp, Homo sapiens
cctgggtggctactctgtgccag

SEQ ID NO: 2797476 - DNA, 15 bp, Homo sapiens
cctgggtgggcagga

SEQ ID NO: 2797477 - DNA, 17 bp, Homo sapiens
cctgggtggggctgctc

SEQ ID NO: 2797478 - DNA, 18 bp, Homo sapiens
cctggtagaattgggaag

SEQ ID NO: 2797479 - DNA, 15 bp, Homo sapiens
cctggtaggaaagca

SEQ ID NO: 2797480 - DNA, 16 bp, Homo sapiens
cctggtaggaaagcac

SEQ ID NO: 2797481 - DNA, 15 bp, Homo sapiens
cctggtctgccctgg

SEQ ID NO: 2797482 - DNA, 23 bp, Homo sapiens
cctggtctgctcaggaattgaag

SEQ ID NO: 2797483 - DNA, 16 bp, Homo sapiens
cctggtcttgagatgt

SEQ ID NO: 2797484 - DNA, 22 bp, Homo sapiens
cctggtgattctgatgcagcct

SEQ ID NO: 2797485 - DNA, 12 bp, Homo sapiens
cctggtggacag

SEQ ID NO: 2797486 - DNA, 12 bp, Homo sapiens
cctggtggcagc

SEQ ID NO: 2797487 - DNA, 14 bp, Homo sapiens
cctggtggcagctg

SEQ ID NO: 2797488 - DNA, 15 bp, Homo sapiens
cctggtggcagctgc

SEQ ID NO: 2797489 - DNA, 17 bp, Homo sapiens
cctggtggcagctgcgg

SEQ ID NO: 2797490 - DNA, 14 bp, Homo sapiens
cctggtggcagtgg

SEQ ID NO: 2797491 - DNA, 19 bp, Homo sapiens
cctggtggcagtgggagct

SEQ ID NO: 2797492 - DNA, 22 bp, Homo sapiens
cctggtggccatgtcgcctgcc

SEQ ID NO: 2797493 - DNA, 18 bp, Homo sapiens
cctggtgggcctcctctg

SEQ ID NO: 2797494 - DNA, 22 bp, Homo sapiens
cctggttggccgtggtccagct

SEQ ID NO: 2797495 - DNA, 21 bp, Homo sapiens
cctgtaaatagttttaaatat

SEQ ID NO: 2797496 - DNA, 19 bp, Homo sapiens
cctgtaacacaagccacag

SEQ ID NO: 2797497 - DNA, 13 bp, Homo sapiens
cctgtaatcccag

SEQ ID NO: 2797498 - DNA, 23 bp, Homo sapiens
cctgtaatcccagcactttggga

SEQ ID NO: 2797499 - DNA, 18 bp, Homo sapiens
cctgtaatcccagctact

SEQ ID NO: 2797500 - DNA, 15 bp, Homo sapiens
cctgtacaatattta

SEQ ID NO: 2797501 - DNA, 17 bp, Homo sapiens
cctgtaccccagcactt

SEQ ID NO: 2797502 - DNA, 22 bp, Homo sapiens
cctgtactcaggaggctgaggg

SEQ ID NO: 2797503 - DNA, 14 bp, Homo sapiens
cctgtactgcctgc

SEQ ID NO: 2797504 - DNA, 16 bp, Homo sapiens
cctgtactgcctgctt

SEQ ID NO: 2797505 - DNA, 17 bp, Homo sapiens
cctgtactgcctgcttg

SEQ ID NO: 2797506 - DNA, 13 bp, Homo sapiens
cctgtagcatctt

SEQ ID NO: 2797507 - DNA, 15 bp, Homo sapiens
cctgtagcatcttct

SEQ ID NO: 2797508 - DNA, 20 bp, Homo sapiens
cctgtagccccagtgacagc

SEQ ID NO: 2797509 - DNA, 18 bp, Homo sapiens
cctgtagtcccagccact

SEQ ID NO: 2797510 - DNA, 23 bp, Homo sapiens
cctgtagtgccccctctaacccc

SEQ ID NO: 2797511 - DNA, 21 bp, Homo sapiens
cctgtagttaggaaataaaac

SEQ ID NO: 2797512 - DNA, 17 bp, Homo sapiens
cctgtataaccccacct

SEQ ID NO: 2797513 - DNA, 23 bp, Homo sapiens
cctgtatattatggtgtaatgca

SEQ ID NO: 2797514 - DNA, 21 bp, Homo sapiens
cctgtatttgttcccaagagc

SEQ ID NO: 2797515 - DNA, 22 bp, Homo sapiens
cctgtccccctgagatcagagt

SEQ ID NO: 2797516 - DNA, 23 bp, Homo sapiens
cctgtccccctgagatcagagtc

SEQ ID NO: 2797517 - DNA, 14 bp, Homo sapiens
cctgtcctcctcgg

SEQ ID NO: 2797518 - DNA, 20 bp, Homo sapiens
cctgtcgagacacttgcctt

SEQ ID NO: 2797519 - DNA, 16 bp, Homo sapiens
cctgtctgccagccag

SEQ ID NO: 2797520 - DNA, 20 bp, Homo sapiens
cctgtctgtctgtctgtccc

SEQ ID NO: 2797521 - DNA, 21 bp, Homo sapiens
cctgtctgtctgtctgtccca

SEQ ID NO: 2797522 - DNA, 22 bp, Homo sapiens
cctgtctgtctgtctgtcccaa

SEQ ID NO: 2797523 - DNA, 14 bp, Homo sapiens
cctgtgaacccagg

SEQ ID NO: 2797524 - DNA, 17 bp, Homo sapiens
cctgtgaacccaggaca

SEQ ID NO: 2797525 - DNA, 18 bp, Homo sapiens
cctgtgaacccaggacaa

SEQ ID NO: 2797526 - DNA, 20 bp, Homo sapiens
cctgtgaataaaaaccctgt

SEQ ID NO: 2797527 - DNA, 17 bp, Homo sapiens
cctgtgaggcaggggcg

SEQ ID NO: 2797528 - DNA, 20 bp, Homo sapiens
cctgtgcatgtatgtcttgg

SEQ ID NO: 2797529 - DNA, 23 bp, Homo sapiens
cctgtgcccacatcccaggcttc

SEQ ID NO: 2797530 - DNA, 21 bp, Homo sapiens
cctgtgccctctggattctct

SEQ ID NO: 2797531 - DNA, 21 bp, Homo sapiens
cctgtgctgcccgtcttcagc

SEQ ID NO: 2797532 - DNA, 15 bp, Homo sapiens
cctgtggcggtgcct

SEQ ID NO: 2797533 - DNA, 16 bp, Homo sapiens
cctgtgggagcctcgc

SEQ ID NO: 2797534 - DNA, 17 bp, Homo sapiens
cctgtgggagcctcgca

SEQ ID NO: 2797535 - DNA, 16 bp, Homo sapiens
cctgtgggggcggctg

SEQ ID NO: 2797536 - DNA, 17 bp, Homo sapiens
cctgtgtagctgtgacc

SEQ ID NO: 2797537 - DNA, 19 bp, Homo sapiens
cctgtgtagctgtgacctg

SEQ ID NO: 2797538 - DNA, 15 bp, Homo sapiens
cctgtgtggacagga

SEQ ID NO: 2797539 - DNA, 19 bp, Homo sapiens
cctgtgtttcttgcctcat

SEQ ID NO: 2797540 - DNA, 22 bp, Homo sapiens
cctgttacttgaaataccagtg

SEQ ID NO: 2797541 - DNA, 20 bp, Homo sapiens
cctgttaggggaaaatagta

SEQ ID NO: 2797542 - DNA, 20 bp, Homo sapiens
cctgttcaccttatgtatta

SEQ ID NO: 2797543 - DNA, 13 bp, Homo sapiens
cctgttcagctcc

SEQ ID NO: 2797544 - DNA, 14 bp, Homo sapiens
cctgttcagctcca

SEQ ID NO: 2797545 - DNA, 20 bp, Homo sapiens
cctgttcagctccagctcac

SEQ ID NO: 2797546 - DNA, 21 bp, Homo sapiens
cctgttcagctccagctcacc

SEQ ID NO: 2797547 - DNA, 18 bp, Homo sapiens
cctgttcatggcagatgt

SEQ ID NO: 2797548 - DNA, 12 bp, Homo sapiens
cctgttcccatt

SEQ ID NO: 2797549 - DNA, 19 bp, Homo sapiens
cctgttggacccgctctgg

SEQ ID NO: 2797550 - DNA, 19 bp, Homo sapiens
cctgttttatactgtactt

SEQ ID NO: 2797551 - DNA, 17 bp, Homo sapiens
ccttaaaataatgattt

SEQ ID NO: 2797552 - DNA, 23 bp, Homo sapiens
ccttaatcaggtcctcagagaat

SEQ ID NO: 2797553 - DNA, 17 bp, Homo sapiens
ccttacctcctgcccag

SEQ ID NO: 2797554 - DNA, 19 bp, Homo sapiens
ccttactatgatctcagga

SEQ ID NO: 2797555 - DNA, 13 bp, Homo sapiens
ccttactcctgtg

SEQ ID NO: 2797556 - DNA, 15 bp, Homo sapiens
ccttactcctgtggg

SEQ ID NO: 2797557 - DNA, 20 bp, Homo sapiens
ccttactcctgtgggagcct

SEQ ID NO: 2797558 - DNA, 16 bp, Homo sapiens
ccttagagacatcaaa

SEQ ID NO: 2797559 - DNA, 16 bp, Homo sapiens
ccttagattagctctg

SEQ ID NO: 2797560 - DNA, 20 bp, Homo sapiens
ccttagcagggaaacagcta

SEQ ID NO: 2797561 - DNA, 18 bp, Homo sapiens
gctggagtgcagtgagcc

SEQ ID NO: 2797562 - DNA, 22 bp, Homo sapiens
gctggagtgcagtgagccgaga

SEQ ID NO: 2797563 - DNA, 15 bp, Homo sapiens
gctggataaaatgag

SEQ ID NO: 2797564 - DNA, 15 bp, Homo sapiens
gctggcagcactcag

SEQ ID NO: 2797565 - DNA, 19 bp, Homo sapiens
gctggcagcactcagtgag

SEQ ID NO: 2797566 - DNA, 20 bp, Homo sapiens
gctggcctcccaataaagct

SEQ ID NO: 2797567 - DNA, 22 bp, Homo sapiens
gctggcctcccaataaagctgg

SEQ ID NO: 2797568 - DNA, 12 bp, Homo sapiens
gctggcctggat

SEQ ID NO: 2797569 - DNA, 21 bp, Homo sapiens
gctggcggctactcagcagcc

SEQ ID NO: 2797570 - DNA, 15 bp, Homo sapiens
gctggcgtgcagtgg

SEQ ID NO: 2797571 - DNA, 16 bp, Homo sapiens
gctggctgagggcagt

SEQ ID NO: 2797572 - DNA, 14 bp, Homo sapiens
gctggctgcagtga

SEQ ID NO: 2797573 - DNA, 15 bp, Homo sapiens
gctggctgggcatgg

SEQ ID NO: 2797574 - DNA, 16 bp, Homo sapiens
gctggctgttggctgg

SEQ ID NO: 2797575 - DNA, 18 bp, Homo sapiens
gctggctgttggctgggg

SEQ ID NO: 2797576 - DNA, 19 bp, Homo sapiens
gctgggactacaggcaccc

SEQ ID NO: 2797577 - DNA, 15 bp, Homo sapiens
gctgggactggccag

SEQ ID NO: 2797578 - DNA, 16 bp, Homo sapiens
gctgggactggccagg

SEQ ID NO: 2797579 - DNA, 15 bp, Homo sapiens
gctgggagctctgca

SEQ ID NO: 2797580 - DNA, 16 bp, Homo sapiens
gctgggattacaggtg

SEQ ID NO: 2797581 - DNA, 18 bp, Homo sapiens
gctgggattacaggtgtg

SEQ ID NO: 2797582 - DNA, 14 bp, Homo sapiens
gctgggctctccac

SEQ ID NO: 2797583 - DNA, 15 bp, Homo sapiens
gctgggctctccacc

SEQ ID NO: 2797584 - DNA, 19 bp, Homo sapiens
gctgggctctccacctcag

SEQ ID NO: 2797585 - DNA, 22 bp, Homo sapiens
gctgggcttcagtggcagctgc

SEQ ID NO: 2797586 - DNA, 18 bp, Homo sapiens
gctgggggcctcagtgcc

SEQ ID NO: 2797587 - DNA, 20 bp, Homo sapiens
gctgggggcctcagtgccac

SEQ ID NO: 2797588 - DNA, 21 bp, Homo sapiens
gctgggttggagggtgtccca

SEQ ID NO: 2797589 - DNA, 15 bp, Homo sapiens
gctggtctccctcca

SEQ ID NO: 2797590 - DNA, 12 bp, Homo sapiens
gctggtctttat

SEQ ID NO: 2797591 - DNA, 16 bp, Homo sapiens
gctggtgtcacctgaa

SEQ ID NO: 2797592 - DNA, 14 bp, Homo sapiens
gctggttagaaatg

SEQ ID NO: 2797593 - DNA, 21 bp, Homo sapiens
tatttattgtcattactgcct

SEQ ID NO: 2797594 - DNA, 23 bp, Homo sapiens
tatttattgtcattactgccttt

SEQ ID NO: 2797595 - DNA, 18 bp, Homo sapiens
tatttccacataaaggta

SEQ ID NO: 2797596 - DNA, 19 bp, Homo sapiens
tatttccacataaaggtat

SEQ ID NO: 2797597 - DNA, 21 bp, Homo sapiens
tatttctgagaaggtccttaa

SEQ ID NO: 2797598 - DNA, 16 bp, Homo sapiens
tatttgaatatcatta

SEQ ID NO: 2797599 - DNA, 9 bp, Homo sapiens
tatttgcaa

SEQ ID NO: 2797600 - DNA, 13 bp, Homo sapiens
tatttgcttattt

SEQ ID NO: 2797601 - DNA, 14 bp, Homo sapiens
tatttgcttattta

SEQ ID NO: 2797602 - DNA, 20 bp, Homo sapiens
tatttgtaatagatgtttga

SEQ ID NO: 2797603 - DNA, 15 bp, Homo sapiens
tatttgtttggtcac

SEQ ID NO: 2797604 - DNA, 17 bp, Homo sapiens
tattttaaaaccatgca

SEQ ID NO: 2797605 - DNA, 13 bp, Homo sapiens
tattttaaagaat

SEQ ID NO: 2797606 - DNA, 14 bp, Homo sapiens
tattttaaagaatt

SEQ ID NO: 2797607 - DNA, 21 bp, Homo sapiens
tattttacagagcttgaaaac

SEQ ID NO: 2797608 - DNA, 15 bp, Homo sapiens
tattttagagaatgg

SEQ ID NO: 2797609 - DNA, 17 bp, Homo sapiens
tattttaggagacagtc

SEQ ID NO: 2797610 - DNA, 13 bp, Homo sapiens
tattttatgattt

SEQ ID NO: 2797611 - DNA, 13 bp, Homo sapiens
tattttattccct

SEQ ID NO: 2797612 - DNA, 13 bp, Homo sapiens
tattttcaagaaa

SEQ ID NO: 2797613 - DNA, 18 bp, Homo sapiens
tggcctcaagtgattctc

SEQ ID NO: 2797614 - DNA, 13 bp, Homo sapiens
tggcctcagacca

SEQ ID NO: 2797615 - DNA, 18 bp, Homo sapiens
tggcctcccaataaagct

SEQ ID NO: 2797616 - DNA, 13 bp, Homo sapiens
tggcctcctgcct

SEQ ID NO: 2797617 - DNA, 22 bp, Homo sapiens
tggcctgctgggctctccacct

SEQ ID NO: 2797618 - DNA, 14 bp, Homo sapiens
tggcctggatctcc

SEQ ID NO: 2797619 - DNA, 12 bp, Homo sapiens
tggcctggcaca

SEQ ID NO: 2797620 - DNA, 18 bp, Homo sapiens
tggcctggcacacatcag

SEQ ID NO: 2797621 - DNA, 13 bp, Homo sapiens
tggcctggccggc

SEQ ID NO: 2797622 - DNA, 12 bp, Homo sapiens
tggcctggctct

SEQ ID NO: 2797623 - DNA, 20 bp, Homo sapiens
tggcctgggtgggcaggaac

SEQ ID NO: 2797624 - DNA, 15 bp, Homo sapiens
tggcggctactcagc

SEQ ID NO: 2797625 - DNA, 21 bp, Homo sapiens
tggcggctactcagcagccct

SEQ ID NO: 2797626 - DNA, 15 bp, Homo sapiens
tggcgggcagcccag

SEQ ID NO: 2797627 - DNA, 17 bp, Homo sapiens
tggcgggcgcctgtagt

SEQ ID NO: 2797628 - DNA, 22 bp, Homo sapiens
tggcgtgcagtggtgcgatctg

SEQ ID NO: 2797629 - DNA, 18 bp, Homo sapiens
tggcgtgtccctctcgga

SEQ ID NO: 2797630 - DNA, 16 bp, Homo sapiens
tggctaattcaattta

SEQ ID NO: 2797631 - DNA, 14 bp, Homo sapiens
tggctactctgtgc

SEQ ID NO: 2797632 - DNA, 15 bp, Homo sapiens
tggctactctgtgcc

SEQ ID NO: 2797633 - DNA, 21 bp, Homo sapiens
tggctactctgtgccagagcc

SEQ ID NO: 2797634 - DNA, 22 bp, Homo sapiens
tggctactctgtgccagagcct

SEQ ID NO: 2797635 - DNA, 23 bp, Homo sapiens
tggctactctgtgccagagcctg

SEQ ID NO: 2797636 - DNA, 24 bp, Homo sapiens
tggctactctgtgccagagcctgg

SEQ ID NO: 2797637 - DNA, 16 bp, Homo sapiens
tggctagtcagagaga

SEQ ID NO: 2797638 - DNA, 22 bp, Homo sapiens
tggctattagagatcaacccct

SEQ ID NO: 2797639 - DNA, 16 bp, Homo sapiens
tggctctcctgtagct

SEQ ID NO: 2797640 - DNA, 18 bp, Homo sapiens
tggctgaaaatcactata

SEQ ID NO: 2797641 - DNA, 15 bp, Homo sapiens
tggctgacccagtcc

SEQ ID NO: 2797642 - DNA, 21 bp, Homo sapiens
tggctgacccagtccctgggg

SEQ ID NO: 2797643 - DNA, 21 bp, Homo sapiens
tggctgaccccaaagagcctg

SEQ ID NO: 2797644 - DNA, 15 bp, Homo sapiens
tggctgagggcagtt

SEQ ID NO: 2797645 - DNA, 19 bp, Homo sapiens
tggctgataattttaaatt

SEQ ID NO: 2797646 - DNA, 12 bp, Homo sapiens
tggctgcaaagg

SEQ ID NO: 2797647 - DNA, 15 bp, Homo sapiens
tggctgcagagacct

SEQ ID NO: 2797648 - DNA, 14 bp, Homo sapiens
tggctgctgactga

SEQ ID NO: 2797649 - DNA, 12 bp, Homo sapiens
tggctggctgag

SEQ ID NO: 2797650 - DNA, 17 bp, Homo sapiens
tggctgggggcctcagt

SEQ ID NO: 2797651 - DNA, 12 bp, Homo sapiens
tggctgtattca

SEQ ID NO: 2797652 - DNA, 12 bp, Homo sapiens
tggctgtctctg

SEQ ID NO: 2797653 - DNA, 13 bp, Homo sapiens
tggctgtctctgt

SEQ ID NO: 2797654 - DNA, 15 bp, Homo sapiens
tggctgtctctgtcc

SEQ ID NO: 2797655 - DNA, 14 bp, Homo sapiens
tggctgtgcctctg

SEQ ID NO: 2797656 - DNA, 15 bp, Homo sapiens
tggctgtgcctctgc

SEQ ID NO: 2797657 - DNA, 17 bp, Homo sapiens
tggctgtgcctctgcct

SEQ ID NO: 2797658 - DNA, 18 bp, Homo sapiens
tggctgtgcctctgcctg

SEQ ID NO: 2797659 - DNA, 15 bp, Homo sapiens
tggctgttggctggg

SEQ ID NO: 2797660 - DNA, 18 bp, Homo sapiens
tggctgttggctgggggc

SEQ ID NO: 2797661 - DNA, 20 bp, Homo sapiens
tggcttagttaagtcatcca

SEQ ID NO: 2797662 - DNA, 23 bp, Homo sapiens
tggcttccagaaaaccccagcat

SEQ ID NO: 2797663 - DNA, 15 bp, Homo sapiens
tggcttccaggtatc

SEQ ID NO: 2797664 - DNA, 21 bp, Homo sapiens
tggcttccaggtatctccagg

SEQ ID NO: 2797665 - DNA, 15 bp, Homo sapiens
tggcttcccatcccc

SEQ ID NO: 2797666 - DNA, 16 bp, Homo sapiens
tggcttcctccgtctg

SEQ ID NO: 2797667 - DNA, 13 bp, Homo sapiens
tggcttggcttta

SEQ ID NO: 2797668 - DNA, 17 bp, Homo sapiens
tggcttgtaactccacc

SEQ ID NO: 2797669 - DNA, 17 bp, Homo sapiens
tggctttaggagcagtg

SEQ ID NO: 2797670 - DNA, 23 bp, Homo sapiens
tggctttctccgactgctaggga

SEQ ID NO: 2797671 - DNA, 18 bp, Homo sapiens
tggctttgacatgaaaag

SEQ ID NO: 2797672 - DNA, 17 bp, Homo sapiens
tgggaaaagtgttatta

SEQ ID NO: 2797673 - DNA, 21 bp, Homo sapiens
tgggaaagaaggcaaagtccc

SEQ ID NO: 2797674 - DNA, 22 bp, Homo sapiens
tgggaaatggtatgagctgagg

SEQ ID NO: 2797675 - DNA, 20 bp, Homo sapiens
tgggaaccccttcatcctct

SEQ ID NO: 2797676 - DNA, 16 bp, Homo sapiens
tgggaacgtgactgcc

SEQ ID NO: 2797677 - DNA, 18 bp, Homo sapiens
tgggaacgtgactgcccc

SEQ ID NO: 2797678 - DNA, 17 bp, Homo sapiens
tgggaactggagggtga

SEQ ID NO: 2797679 - DNA, 12 bp, Homo sapiens
tgggaagctggg

SEQ ID NO: 2797680 - DNA, 13 bp, Homo sapiens
tgggaagggagag

SEQ ID NO: 2797681 - DNA, 21 bp, Homo sapiens
tgggaagggagagcggggcag

SEQ ID NO: 2797682 - DNA, 14 bp, Homo sapiens
tgggaattgcatgc

SEQ ID NO: 2797683 - DNA, 23 bp, Homo sapiens
tgggacaaaccagagcagagagc

SEQ ID NO: 2797684 - DNA, 20 bp, Homo sapiens
tgggaccaacacccctccca

SEQ ID NO: 2797685 - DNA, 14 bp, Homo sapiens
tgggaccagggcat

SEQ ID NO: 2797686 - DNA, 14 bp, Homo sapiens
tgggaccctttcct

SEQ ID NO: 2797687 - DNA, 18 bp, Homo sapiens
tgggactacaggcaccca

SEQ ID NO: 2797688 - DNA, 20 bp, Homo sapiens
tgggactcaatgcactgaca

SEQ ID NO: 2797689 - DNA, 15 bp, Homo sapiens
tgggagaacctcagg

SEQ ID NO: 2797690 - DNA, 22 bp, Homo sapiens
tgggagaacctcaggcttcctt

SEQ ID NO: 2797691 - DNA, 23 bp, Homo sapiens
tgggagaacctcaggcttccttg

SEQ ID NO: 2797692 - DNA, 14 bp, Homo sapiens
tgggagagccagct

SEQ ID NO: 2797693 - DNA, 14 bp, Homo sapiens
tgggagagcccagc

SEQ ID NO: 2797694 - DNA, 13 bp, Homo sapiens
tgggagcactgga

SEQ ID NO: 2797695 - DNA, 22 bp, Homo sapiens
tgggattacaagcgtgagccac

SEQ ID NO: 2797696 - DNA, 16 bp, Homo sapiens
tgggattacaggtgtg

SEQ ID NO: 2797697 - DNA, 22 bp, Homo sapiens
tgggattcaggaaaaggcctgg

SEQ ID NO: 2797698 - DNA, 10 bp, Homo sapiens
tgggattgct

SEQ ID NO: 2797699 - DNA, 16 bp, Homo sapiens
tgggattttaaaaaca

SEQ ID NO: 2797700 - DNA, 14 bp, Homo sapiens
tgggcaacagagca

SEQ ID NO: 2797701 - DNA, 16 bp, Homo sapiens
tgggcaacccccagcc

SEQ ID NO: 2797702 - DNA, 19 bp, Homo sapiens
tgggcaatgatggcaattt

SEQ ID NO: 2797703 - DNA, 19 bp, Homo sapiens
tgggcaccacaggctgcct

SEQ ID NO: 2797704 - DNA, 19 bp, Homo sapiens
tgggcagaagggagaagga

SEQ ID NO: 2797705 - DNA, 17 bp, Homo sapiens
tgggcagcagctcagcc

SEQ ID NO: 2797706 - DNA, 19 bp, Homo sapiens
tgggcagcagctcagcctc

SEQ ID NO: 2797707 - DNA, 16 bp, Homo sapiens
tgggcagcatagcaag

SEQ ID NO: 2797708 - DNA, 16 bp, Homo sapiens
tgggcagcttgagagg

SEQ ID NO: 2797709 - DNA, 12 bp, Homo sapiens
tgggcagggctg

SEQ ID NO: 2797710 - DNA, 14 bp, Homo sapiens
tgggccactctccc

SEQ ID NO: 2797711 - DNA, 18 bp, Homo sapiens
tgggccaggacaggcccg

SEQ ID NO: 2797712 - DNA, 17 bp, Homo sapiens
tgggcccgctttgcctg

SEQ ID NO: 2797713 - DNA, 15 bp, Homo sapiens
tgggccctgcacaga

SEQ ID NO: 2797714 - DNA, 22 bp, Homo sapiens
tgggccctggggcctgtactgc

SEQ ID NO: 2797715 - DNA, 15 bp, Homo sapiens
tgggcctatggagag

SEQ ID NO: 2797716 - DNA, 17 bp, Homo sapiens
tgggcctatggagagcc

SEQ ID NO: 2797717 - DNA, 21 bp, Homo sapiens
tgggcctatggagagccctgg

SEQ ID NO: 2797718 - DNA, 22 bp, Homo sapiens
tgggcctatggagagccctggg

SEQ ID NO: 2797719 - DNA, 20 bp, Homo sapiens
tgggcctccccccagcccct

SEQ ID NO: 2797720 - DNA, 14 bp, Homo sapiens
tgggcctcctgtgt

SEQ ID NO: 2797721 - DNA, 12 bp, Homo sapiens
tgggcctgctgc

SEQ ID NO: 2797722 - DNA, 13 bp, Homo sapiens
tgggcgctctgcc

SEQ ID NO: 2797723 - DNA, 16 bp, Homo sapiens
tgggctagttgggctt

SEQ ID NO: 2797724 - DNA, 19 bp, Homo sapiens
tgggctctccacctcagcc

SEQ ID NO: 2797725 - DNA, 20 bp, Homo sapiens
tgggctctccacctcagcct

SEQ ID NO: 2797726 - DNA, 23 bp, Homo sapiens
tgggctctccacctcagccttgg

SEQ ID NO: 2797727 - DNA, 20 bp, Homo sapiens
tgggctctgccccagctctg

SEQ ID NO: 2797728 - DNA, 21 bp, Homo sapiens
tgggctctgccccagctctgg

SEQ ID NO: 2797729 - DNA, 23 bp, Homo sapiens
tgggctctgccccagctctggct

SEQ ID NO: 2797730 - DNA, 18 bp, Homo sapiens
tgggctgaactgagccta

SEQ ID NO: 2797731 - DNA, 21 bp, Homo sapiens
tgggctgaactgagcctagct

SEQ ID NO: 2797732 - DNA, 17 bp, Homo sapiens
tgggctgagccctggca

SEQ ID NO: 2797733 - DNA, 18 bp, Homo sapiens
tgggctgagccctggcag

SEQ ID NO: 2797734 - DNA, 17 bp, Homo sapiens
tgggctggtgtcacctg

SEQ ID NO: 2797735 - DNA, 18 bp, Homo sapiens
tgggcttcagtggcagct

SEQ ID NO: 2797736 - DNA, 20 bp, Homo sapiens
tgggcttctgaaacttcata

SEQ ID NO: 2797737 - DNA, 23 bp, Homo sapiens
tgggctttaacaaaacaagaaag

SEQ ID NO: 2797738 - DNA, 22 bp, Homo sapiens
tggggaagcaagacgtcctgga

SEQ ID NO: 2797739 - DNA, 16 bp, Homo sapiens
tggggagccaacagaa

SEQ ID NO: 2797740 - DNA, 14 bp, Homo sapiens
tggggagggggaag

SEQ ID NO: 2797741 - DNA, 20 bp, Homo sapiens
tggggagttataaaaataca

SEQ ID NO: 2797742 - DNA, 23 bp, Homo sapiens
tggggatgagaaaggttgaagca

SEQ ID NO: 2797743 - DNA, 19 bp, Homo sapiens
tggggcaacgacggtttca

SEQ ID NO: 2797744 - DNA, 13 bp, Homo sapiens
tggggcaggagta

SEQ ID NO: 2797745 - DNA, 17 bp, Homo sapiens
tggggcaggctggctgg

SEQ ID NO: 2797746 - DNA, 11 bp, Homo sapiens
tggggcagtgg

SEQ ID NO: 2797747 - DNA, 18 bp, Homo sapiens
tggggcctagatccacac

SEQ ID NO: 2797748 - DNA, 11 bp, Homo sapiens
tggggcctgta

SEQ ID NO: 2797749 - DNA, 17 bp, Homo sapiens
tggggctctgtgcaggg

SEQ ID NO: 2797750 - DNA, 11 bp, Homo sapiens
tggggctgaac

SEQ ID NO: 2797751 - DNA, 13 bp, Homo sapiens
tggggctgcggga

SEQ ID NO: 2797752 - DNA, 20 bp, Homo sapiens
tggggctgcgggacagagga

SEQ ID NO: 2797753 - DNA, 21 bp, Homo sapiens
tggggctgcgggacagaggac

SEQ ID NO: 2797754 - DNA, 15 bp, Homo sapiens
tggggctgctcctcc

SEQ ID NO: 2797755 - DNA, 16 bp, Homo sapiens
tggggctgctcctcca

SEQ ID NO: 2797756 - DNA, 17 bp, Homo sapiens
tggggctgctcctccag

SEQ ID NO: 2797757 - DNA, 16 bp, Homo sapiens
tggggcttctcctgac

SEQ ID NO: 2797758 - DNA, 16 bp, Homo sapiens
tgggggaagccctgga

SEQ ID NO: 2797759 - DNA, 14 bp, Homo sapiens
tgggggacttacat

SEQ ID NO: 2797760 - DNA, 16 bp, Homo sapiens
tgggggcagagggcag

SEQ ID NO: 2797761 - DNA, 17 bp, Homo sapiens
tgggggcagagggcaga

SEQ ID NO: 2797762 - DNA, 12 bp, Homo sapiens
tgggggcctggc

SEQ ID NO: 2797763 - DNA, 20 bp, Homo sapiens
tgggggcctggctggctgag

SEQ ID NO: 2797764 - DNA, 24 bp, Homo sapiens
tggggggtgatgagggcagcagcc

SEQ ID NO: 2797765 - DNA, 22 bp, Homo sapiens
tgggggttctttcttcctctgc

SEQ ID NO: 2797766 - DNA, 20 bp, Homo sapiens
tggggtacaggtttggggag

SEQ ID NO: 2797767 - DNA, 14 bp, Homo sapiens
tggggtcagccagg

SEQ ID NO: 2797768 - DNA, 15 bp, Homo sapiens
tggggtcagccaggg

SEQ ID NO: 2797769 - DNA, 19 bp, Homo sapiens
tggggtcagccagggccag

SEQ ID NO: 2797770 - DNA, 16 bp, Homo sapiens
tggggtcctggggcct

SEQ ID NO: 2797771 - DNA, 13 bp, Homo sapiens
tggggtctccctc

SEQ ID NO: 2797772 - DNA, 19 bp, Homo sapiens
tggggtctccctctcctgc

SEQ ID NO: 2797773 - DNA, 22 bp, Homo sapiens
tggggtctccctctcctgccta

SEQ ID NO: 2797774 - DNA, 13 bp, Homo sapiens
aagcactttacag

SEQ ID NO: 2797775 - DNA, 14 bp, Homo sapiens
aagcagcctttctg

SEQ ID NO: 2797776 - DNA, 22 bp, Homo sapiens
aagcaggttgaggggctcctgg

SEQ ID NO: 2797777 - DNA, 20 bp, Homo sapiens
aagcagtcctcttattccta

SEQ ID NO: 2797778 - DNA, 18 bp, Homo sapiens
aagcagtgcttgtaaacc

SEQ ID NO: 2797779 - DNA, 14 bp, Homo sapiens
aagcagtgttttca

SEQ ID NO: 2797780 - DNA, 18 bp, Homo sapiens
aagcatatgcctacttgt

SEQ ID NO: 2797781 - DNA, 19 bp, Homo sapiens
aagcatatgcctacttgta

SEQ ID NO: 2797782 - DNA, 16 bp, Homo sapiens
aagaagagtttgcaaa

SEQ ID NO: 2797783 - DNA, 16 bp, Homo sapiens
aagaaggacacttgta

SEQ ID NO: 2797784 - DNA, 15 bp, Homo sapiens
aagaaggcaaaaata

SEQ ID NO: 2797785 - DNA, 21 bp, Homo sapiens
aagaaggcacaggtgtaaata

SEQ ID NO: 2797786 - DNA, 19 bp, Homo sapiens
aagaaggcagcaggtggca

SEQ ID NO: 2797787 - DNA, 21 bp, Homo sapiens
aagaagggaaattcacactgt

SEQ ID NO: 2797788 - DNA, 14 bp, Homo sapiens
aagaagtaaaagct

SEQ ID NO: 2797789 - DNA, 12 bp, Homo sapiens
aagaataaatga

SEQ ID NO: 2797790 - DNA, 21 bp, Homo sapiens
aagaataatatgctgccaaat

SEQ ID NO: 2797791 - DNA, 23 bp, Homo sapiens
aatagacaactcttccatttatt

SEQ ID NO: 2797792 - DNA, 21 bp, Homo sapiens
aatagagagtatgtaatcttt

SEQ ID NO: 2797793 - DNA, 11 bp, Homo sapiens
aatagatgttt

SEQ ID NO: 2797794 - DNA, 22 bp, Homo sapiens
aatagatgtttgatagattttc

SEQ ID NO: 2797795 - DNA, 18 bp, Homo sapiens
aatagcaaagaattgact

SEQ ID NO: 2797796 - DNA, 20 bp, Homo sapiens
aatagccacttaccttcaat

SEQ ID NO: 2797797 - DNA, 14 bp, Homo sapiens
aatagctattgcat

SEQ ID NO: 2797798 - DNA, 19 bp, Homo sapiens
aatagctattgcatgtaaa

SEQ ID NO: 2797799 - DNA, 14 bp, Homo sapiens
aatagctgggacta

SEQ ID NO: 2797800 - DNA, 14 bp, Homo sapiens
aatagtttggatat

SEQ ID NO: 2797801 - DNA, 16 bp, Homo sapiens
aatagttttaaatatg

SEQ ID NO: 2797802 - DNA, 14 bp, Homo sapiens
aatataaacactat

SEQ ID NO: 2797803 - DNA, 19 bp, Homo sapiens
aatataaataaataaaaat

SEQ ID NO: 2797804 - DNA, 13 bp, Homo sapiens
aatataaatgcat

SEQ ID NO: 2797805 - DNA, 17 bp, Homo sapiens
aatataaatgcatgatt

SEQ ID NO: 2797806 - DNA, 18 bp, Homo sapiens
aatataaatgcatgattt

SEQ ID NO: 2797807 - DNA, 11 bp, Homo sapiens
aatataattat

SEQ ID NO: 2797808 - DNA, 14 bp, Homo sapiens
aatataattatcgg

SEQ ID NO: 2797809 - DNA, 16 bp, Homo sapiens
aatatacaaacatgtg

SEQ ID NO: 2797810 - DNA, 14 bp, Homo sapiens
aatataggaagcat

SEQ ID NO: 2797811 - DNA, 21 bp, Homo sapiens
aatatataatggtttactgct

SEQ ID NO: 2797812 - DNA, 14 bp, Homo sapiens
aatatatataaata

SEQ ID NO: 2797813 - DNA, 22 bp, Homo sapiens
aatatatatctatctatttgag

SEQ ID NO: 2797814 - DNA, 14 bp, Homo sapiens
aatatatttaattg

SEQ ID NO: 2797815 - DNA, 15 bp, Homo sapiens
aatatatttaattgt

SEQ ID NO: 2797816 - DNA, 15 bp, Homo sapiens
aatatcagactagtg

SEQ ID NO: 2797817 - DNA, 15 bp, Homo sapiens
aatatcctaaacatc

SEQ ID NO: 2797818 - DNA, 20 bp, Homo sapiens
aatatctgtgaggtgctgat

SEQ ID NO: 2797819 - DNA, 22 bp, Homo sapiens
aatatctgtgaggtgctgatga

SEQ ID NO: 2797820 - DNA, 17 bp, Homo sapiens
aatatcttgaagaatat

SEQ ID NO: 2797821 - DNA, 15 bp, Homo sapiens
aatatgaaatgataa

SEQ ID NO: 2797822 - DNA, 10 bp, Homo sapiens
aatatgaaca

SEQ ID NO: 2797823 - DNA, 12 bp, Homo sapiens
aatatgaacaaa

SEQ ID NO: 2797824 - DNA, 18 bp, Homo sapiens
aatatgaatacagggcat

SEQ ID NO: 2797825 - DNA, 14 bp, Homo sapiens
aatatgctgccaaa

SEQ ID NO: 2797826 - DNA, 15 bp, Homo sapiens
aatatggacaaagaa

SEQ ID NO: 2797827 - DNA, 16 bp, Homo sapiens
aatatgttagcaaaga

SEQ ID NO: 2797828 - DNA, 13 bp, Homo sapiens
aatatgttcatta

SEQ ID NO: 2797829 - DNA, 22 bp, Homo sapiens
aatatgttcattaaattttcta

SEQ ID NO: 2797830 - DNA, 13 bp, Homo sapiens
aatattaaataca

SEQ ID NO: 2797831 - DNA, 12 bp, Homo sapiens
aatattaatccc

SEQ ID NO: 2797832 - DNA, 14 bp, Homo sapiens
aatattaccaaaaa

SEQ ID NO: 2797833 - DNA, 20 bp, Homo sapiens
aatattcccctatctctaga

SEQ ID NO: 2797834 - DNA, 15 bp, Homo sapiens
aatattgaataagta

SEQ ID NO: 2797835 - DNA, 16 bp, Homo sapiens
aatatttaagtatata

SEQ ID NO: 2797836 - DNA, 15 bp, Homo sapiens
aatatttattacctc

SEQ ID NO: 2797837 - DNA, 20 bp, Homo sapiens
aatatttattattttcacct

SEQ ID NO: 2797838 - DNA, 16 bp, Homo sapiens
aatattttatatgaaa

SEQ ID NO: 2797839 - DNA, 23 bp, Homo sapiens
aatattttatatgaaatgtttca

SEQ ID NO: 2797840 - DNA, 20 bp, Homo sapiens
aatatttttagctctgttct

SEQ ID NO: 2797841 - DNA, 22 bp, Homo sapiens
aatatttttagctctgttcttt

SEQ ID NO: 2797842 - DNA, 10 bp, Homo sapiens
aatcaaaact

SEQ ID NO: 2797843 - DNA, 13 bp, Homo sapiens
aatcaataaaaat

SEQ ID NO: 2797844 - DNA, 14 bp, Homo sapiens
aatcacaagcaata

SEQ ID NO: 2797845 - DNA, 20 bp, Homo sapiens
aatcaccacaccaaacctct

SEQ ID NO: 2797846 - DNA, 17 bp, Homo sapiens
aatcagaagtgcaaagg

SEQ ID NO: 2797847 - DNA, 18 bp, Homo sapiens
aatcagtcctttgattcc

SEQ ID NO: 2797848 - DNA, 17 bp, Homo sapiens
aatcagtctcagaatgt

SEQ ID NO: 2797849 - DNA, 24 bp, Homo sapiens
aatcagtctcagaatgtcattttg

SEQ ID NO: 2797850 - DNA, 17 bp, Homo sapiens
aatcataaactgtgtgc

SEQ ID NO: 2797851 - DNA, 20 bp, Homo sapiens
aatcatagctggttcacact

SEQ ID NO: 2797852 - DNA, 18 bp, Homo sapiens
aatcatataataaatgta

SEQ ID NO: 2797853 - DNA, 23 bp, Homo sapiens
aatcatgaatatttcaaaataaa

SEQ ID NO: 2797854 - DNA, 23 bp, Homo sapiens
aatcatgatctgactttaattgt

SEQ ID NO: 2797855 - DNA, 16 bp, Homo sapiens
aatcatgtacatttct

SEQ ID NO: 2797856 - DNA, 14 bp, Homo sapiens
aatcattcaatatc

SEQ ID NO: 2797857 - DNA, 16 bp, Homo sapiens
aatcatttaaatatta

SEQ ID NO: 2797858 - DNA, 20 bp, Homo sapiens
aatcattttacccttggctc

SEQ ID NO: 2797859 - DNA, 19 bp, Homo sapiens
aatcattttgcctcttttc

SEQ ID NO: 2797860 - DNA, 15 bp, Homo sapiens
aatccaaagaaaaag

SEQ ID NO: 2797861 - DNA, 17 bp, Homo sapiens
aatccagaaagaaaaaa

SEQ ID NO: 2797862 - DNA, 22 bp, Homo sapiens
aatccagaattgaccttttgac

SEQ ID NO: 2797863 - DNA, 19 bp, Homo sapiens
aatccagacccggctgcgt

SEQ ID NO: 2797864 - DNA, 17 bp, Homo sapiens
aatcccacccacatgtg

SEQ ID NO: 2797865 - DNA, 18 bp, Homo sapiens
aatcccagctactcagga

SEQ ID NO: 2797866 - DNA, 18 bp, Homo sapiens
aatcctctctctgtgtta

SEQ ID NO: 2797867 - DNA, 11 bp, Homo sapiens
aatcctctggc

SEQ ID NO: 2797868 - DNA, 18 bp, Homo sapiens
aatcgatctgtactgtaa

SEQ ID NO: 2797869 - DNA, 20 bp, Homo sapiens
aatcgatctgtactgtaatt

SEQ ID NO: 2797870 - DNA, 17 bp, Homo sapiens
aatcgttatgtgtgtat

SEQ ID NO: 2797871 - DNA, 14 bp, Homo sapiens
aatctaaaagcttt

SEQ ID NO: 2797872 - DNA, 17 bp, Homo sapiens
aatctaatgtaagaaaa

SEQ ID NO: 2797873 - DNA, 18 bp, Homo sapiens
aatctattcagacaagca

SEQ ID NO: 2797874 - DNA, 13 bp, Homo sapiens
aatctcagagaca

SEQ ID NO: 2797875 - DNA, 19 bp, Homo sapiens
aatctccagggctgcccct

SEQ ID NO: 2797876 - DNA, 20 bp, Homo sapiens
aatctccagggctgcccctg

SEQ ID NO: 2797877 - DNA, 23 bp, Homo sapiens
aatctccagggctgcccctgtag

SEQ ID NO: 2797878 - DNA, 22 bp, Homo sapiens
aagttacttcactttaattctc

SEQ ID NO: 2797879 - DNA, 23 bp, Homo sapiens
aagttacttcactttaattctca

SEQ ID NO: 2797880 - DNA, 21 bp, Homo sapiens
aagttagctgagcgtggtggc

SEQ ID NO: 2797881 - DNA, 16 bp, Homo sapiens
aagttaggttataaga

SEQ ID NO: 2797882 - DNA, 18 bp, Homo sapiens
aagttataaatcaatgtc

SEQ ID NO: 2797883 - DNA, 12 bp, Homo sapiens
aagttatattta

SEQ ID NO: 2797884 - DNA, 14 bp, Homo sapiens
aagttcatagggtc

SEQ ID NO: 2797885 - DNA, 14 bp, Homo sapiens
aagttcctctagtg

SEQ ID NO: 2797886 - DNA, 17 bp, Homo sapiens
aagttcctgttcacctt

SEQ ID NO: 2797887 - DNA, 23 bp, Homo sapiens
aagttcctgttcaccttatgtat

SEQ ID NO: 2797888 - DNA, 15 bp, Homo sapiens
aagttcgaaagaaaa

SEQ ID NO: 2797889 - DNA, 18 bp, Homo sapiens
aagttctgaaaactgttt

SEQ ID NO: 2797890 - DNA, 20 bp, Homo sapiens
aagttgaaagagtcctattt

SEQ ID NO: 2797891 - DNA, 17 bp, Homo sapiens
aagttgaaatcagaagc

SEQ ID NO: 2797892 - DNA, 21 bp, Homo sapiens
aagttgaatggcctgccttga

SEQ ID NO: 2797893 - DNA, 22 bp, Homo sapiens
aagttgcagtgagctgatatca

SEQ ID NO: 2797894 - DNA, 17 bp, Homo sapiens
aagttgttaactaaatt

SEQ ID NO: 2797895 - DNA, 17 bp, Homo sapiens
aagtttaataaatttat

SEQ ID NO: 2797896 - DNA, 15 bp, Homo sapiens
aagtttcatcatttt

SEQ ID NO: 2797897 - DNA, 11 bp, Homo sapiens
aagttttcagg

SEQ ID NO: 2797898 - DNA, 14 bp, Homo sapiens
aataaaaaaataca

SEQ ID NO: 2797899 - DNA, 15 bp, Homo sapiens
aataaaaaaatacag

SEQ ID NO: 2797900 - DNA, 13 bp, Homo sapiens
aataaaaaccaga

SEQ ID NO: 2797901 - DNA, 21 bp, Homo sapiens
aataaaaaccagaatcataat

SEQ ID NO: 2797902 - DNA, 13 bp, Homo sapiens
aataaaaatttgt

SEQ ID NO: 2797903 - DNA, 16 bp, Homo sapiens
aataaaaatttgttta

SEQ ID NO: 2797904 - DNA, 12 bp, Homo sapiens
aataaaacattc

SEQ ID NO: 2797905 - DNA, 13 bp, Homo sapiens
aataaaaccagct

SEQ ID NO: 2797906 - DNA, 13 bp, Homo sapiens
aataaaacctttc

SEQ ID NO: 2797907 - DNA, 14 bp, Homo sapiens
aataaaacctttca

SEQ ID NO: 2797908 - DNA, 15 bp, Homo sapiens
aataaaacctttcaa

SEQ ID NO: 2797909 - DNA, 13 bp, Homo sapiens
aataaaagtgact

SEQ ID NO: 2797910 - DNA, 21 bp, Homo sapiens
aataaaatagtattgaaagtg

SEQ ID NO: 2797911 - DNA, 12 bp, Homo sapiens
aataaaatgatg

SEQ ID NO: 2797912 - DNA, 14 bp, Homo sapiens
aataaaatgatgta

SEQ ID NO: 2797913 - DNA, 12 bp, Homo sapiens
aataaaattttc

SEQ ID NO: 2797914 - DNA, 13 bp, Homo sapiens
aataaacgaagat

SEQ ID NO: 2797915 - DNA, 17 bp, Homo sapiens
aataaagacttcatgtt

SEQ ID NO: 2797916 - DNA, 13 bp, Homo sapiens
aataaagagctca

SEQ ID NO: 2797917 - DNA, 11 bp, Homo sapiens
aataaagctgg

SEQ ID NO: 2797918 - DNA, 12 bp, Homo sapiens
aataaagctgga

SEQ ID NO: 2797919 - DNA, 14 bp, Homo sapiens
aataaagtatctac

SEQ ID NO: 2797920 - DNA, 15 bp, Homo sapiens
aataaagtatctaca

SEQ ID NO: 2797921 - DNA, 19 bp, Homo sapiens
aataaagttctgagtgttt

SEQ ID NO: 2797922 - DNA, 17 bp, Homo sapiens
aataaatgcaatatgta

SEQ ID NO: 2797923 - DNA, 13 bp, Homo sapiens
aataaatgccaac

SEQ ID NO: 2797924 - DNA, 20 bp, Homo sapiens
aataaatgtatcttattcac

SEQ ID NO: 2797925 - DNA, 17 bp, Homo sapiens
aataaatgtgtaaatgt

SEQ ID NO: 2797926 - DNA, 19 bp, Homo sapiens
aataaattcaaaccattta

SEQ ID NO: 2797927 - DNA, 19 bp, Homo sapiens
aataaattggtgataagtg

SEQ ID NO: 2797928 - DNA, 20 bp, Homo sapiens
aataaattggtgataagtgg

SEQ ID NO: 2797929 - DNA, 22 bp, Homo sapiens
aataaattggtgataagtggaa

SEQ ID NO: 2797930 - DNA, 19 bp, Homo sapiens
aataacaatgtgctctcgg

SEQ ID NO: 2797931 - DNA, 14 bp, Homo sapiens
aataaccacttaaa

SEQ ID NO: 2797932 - DNA, 21 bp, Homo sapiens
aataaccacttaaaaaatgtc

SEQ ID NO: 2797933 - DNA, 22 bp, Homo sapiens
aataacgtttaagccaaaacaa

SEQ ID NO: 2797934 - DNA, 19 bp, Homo sapiens
aataactagatctcctgta

SEQ ID NO: 2797935 - DNA, 19 bp, Homo sapiens
aataactagtgttgcttgg

SEQ ID NO: 2797936 - DNA, 16 bp, Homo sapiens
aataacttcagagaag

SEQ ID NO: 2797937 - DNA, 19 bp, Homo sapiens
aataacttcagagaagtca

SEQ ID NO: 2797938 - DNA, 19 bp, Homo sapiens
aataacttgtcctatgtca

SEQ ID NO: 2797939 - DNA, 15 bp, Homo sapiens
aataagagaaagaaa

SEQ ID NO: 2797940 - DNA, 15 bp, Homo sapiens
aataaggtacaagaa

SEQ ID NO: 2797941 - DNA, 21 bp, Homo sapiens
aataataattatccagagttt

SEQ ID NO: 2797942 - DNA, 18 bp, Homo sapiens
aataatacctaagccttc

SEQ ID NO: 2797943 - DNA, 17 bp, Homo sapiens
aataatcacattgactt

SEQ ID NO: 2797944 - DNA, 16 bp, Homo sapiens
aataatcggcccacag

SEQ ID NO: 2797945 - DNA, 15 bp, Homo sapiens
aataatgttctgtca

SEQ ID NO: 2797946 - DNA, 12 bp, Homo sapiens
aataattgtgta

SEQ ID NO: 2797947 - DNA, 14 bp, Homo sapiens
aataattgtgtaca

SEQ ID NO: 2797948 - DNA, 16 bp, Homo sapiens
aataattgtgtacaaa

SEQ ID NO: 2797949 - DNA, 23 bp, Homo sapiens
aataatttaactaatttaaacca

SEQ ID NO: 2797950 - DNA, 12 bp, Homo sapiens
aataatttagac

SEQ ID NO: 2797951 - DNA, 20 bp, Homo sapiens
aatacaaaataaaattatgg

SEQ ID NO: 2797952 - DNA, 17 bp, Homo sapiens
aatacaccacgaatttg

SEQ ID NO: 2797953 - DNA, 13 bp, Homo sapiens
aatacagacacta

SEQ ID NO: 2797954 - DNA, 20 bp, Homo sapiens
aatacagacactaagttata

SEQ ID NO: 2797955 - DNA, 14 bp, Homo sapiens
aatacagtaaagtt

SEQ ID NO: 2797956 - DNA, 22 bp, Homo sapiens
aatacagtaaagtttaaaaaat

SEQ ID NO: 2797957 - DNA, 19 bp, Homo sapiens
aatacagtaagctgctcta

SEQ ID NO: 2797958 - DNA, 12 bp, Homo sapiens
aatacagtgtta

SEQ ID NO: 2797959 - DNA, 22 bp, Homo sapiens
aatacatgctaagagaagtaga

SEQ ID NO: 2797960 - DNA, 14 bp, Homo sapiens
aatacctctgtgtg

SEQ ID NO: 2797961 - DNA, 15 bp, Homo sapiens
aatacctctgtgtgc

SEQ ID NO: 2797962 - DNA, 20 bp, Homo sapiens
aatacttaacattgatttat

SEQ ID NO: 2797963 - DNA, 22 bp, Homo sapiens
aatacttaacattgatttattt

SEQ ID NO: 2797964 - DNA, 11 bp, Homo sapiens
aatacttcatg

SEQ ID NO: 2797965 - DNA, 21 bp, Homo sapiens
aaggggccctggtccttccag

SEQ ID NO: 2797966 - DNA, 22 bp, Homo sapiens
aagggggcggcctatgacttgg

SEQ ID NO: 2797967 - DNA, 16 bp, Homo sapiens
aagggggtccacccag

SEQ ID NO: 2797968 - DNA, 20 bp, Homo sapiens
aaggggttggttgaggtgga

SEQ ID NO: 2797969 - DNA, 17 bp, Homo sapiens
aagggtatcaggtgctg

SEQ ID NO: 2797970 - DNA, 16 bp, Homo sapiens
aagggtctagggagag

SEQ ID NO: 2797971 - DNA, 14 bp, Homo sapiens
aagggttatatttt

SEQ ID NO: 2797972 - DNA, 19 bp, Homo sapiens
aagggttttccaccctgga

SEQ ID NO: 2797973 - DNA, 19 bp, Homo sapiens
aaggtaatttctgtgtatt

SEQ ID NO: 2797974 - DNA, 19 bp, Homo sapiens
aaggtacaagaagcatttt

SEQ ID NO: 2797975 - DNA, 20 bp, Homo sapiens
aaggtcattgtggctatctg

SEQ ID NO: 2797976 - DNA, 14 bp, Homo sapiens
aaggtcttgcctga

SEQ ID NO: 2797977 - DNA, 13 bp, Homo sapiens
aaggtctttggtt

SEQ ID NO: 2797978 - DNA, 19 bp, Homo sapiens
aaggtctttggttcagcta

SEQ ID NO: 2797979 - DNA, 19 bp, Homo sapiens
aaggtgggctgagccctgg

SEQ ID NO: 2797980 - DNA, 23 bp, Homo sapiens
aaggtggggtatttaccacagca

SEQ ID NO: 2797981 - DNA, 21 bp, Homo sapiens
aaggtggggtctttgtgagag

SEQ ID NO: 2797982 - DNA, 17 bp, Homo sapiens
aaggttgactcaagttt

SEQ ID NO: 2797983 - DNA, 17 bp, Homo sapiens
aaggtttatgaaaaaga

SEQ ID NO: 2797984 - DNA, 17 bp, Homo sapiens
aaggtttgtatattgtc

SEQ ID NO: 2797985 - DNA, 20 bp, Homo sapiens
aaggttttcctcttctattt

SEQ ID NO: 2797986 - DNA, 13 bp, Homo sapiens
aaggttttctcca

SEQ ID NO: 2797987 - DNA, 20 bp, Homo sapiens
aagtaagtaccactcaggcc

SEQ ID NO: 2797988 - DNA, 15 bp, Homo sapiens
aagtaattatcggga

SEQ ID NO: 2797989 - DNA, 20 bp, Homo sapiens
aagtaattgcatttctgctc

SEQ ID NO: 2797990 - DNA, 17 bp, Homo sapiens
aagtactgctgtaaata

SEQ ID NO: 2797991 - DNA, 23 bp, Homo sapiens
aagtactgctgtaaataaatgct

SEQ ID NO: 2797992 - DNA, 21 bp, Homo sapiens
aagtacttctccaccctgctc

SEQ ID NO: 2797993 - DNA, 22 bp, Homo sapiens
aagtacttctccaccctgctct

SEQ ID NO: 2797994 - DNA, 23 bp, Homo sapiens
aagtacttctccaccctgctctc

SEQ ID NO: 2797995 - DNA, 15 bp, Homo sapiens
aagtagaaatcatag

SEQ ID NO: 2797996 - DNA, 21 bp, Homo sapiens
aagtagaattatatctaattt

SEQ ID NO: 2797997 - DNA, 22 bp, Homo sapiens
aagtagaattatatctaattta

SEQ ID NO: 2797998 - DNA, 14 bp, Homo sapiens
aagtagagaagtat

SEQ ID NO: 2797999 - DNA, 15 bp, Homo sapiens
aagtaggcatgaggg

SEQ ID NO: 2798000 - DNA, 14 bp, Homo sapiens
aagtagtagtgtct

SEQ ID NO: 2798001 - DNA, 11 bp, Homo sapiens
aagtatatata

SEQ ID NO: 2798002 - DNA, 16 bp, Homo sapiens
aagtatatatagaatc

SEQ ID NO: 2798003 - DNA, 14 bp, Homo sapiens
aagtatatattcta

SEQ ID NO: 2798004 - DNA, 18 bp, Homo sapiens
aagtatccaattatgtga

SEQ ID NO: 2798005 - DNA, 21 bp, Homo sapiens
aagtatccaattatgtgacaa

SEQ ID NO: 2798006 - DNA, 21 bp, Homo sapiens
aagtatgagggaaaatgagta

SEQ ID NO: 2798007 - DNA, 10 bp, Homo sapiens
aagtatttag

SEQ ID NO: 2798008 - DNA, 17 bp, Homo sapiens
aagtatttatatattta

SEQ ID NO: 2798009 - DNA, 18 bp, Homo sapiens
aagtatttatatatttat

SEQ ID NO: 2798010 - DNA, 20 bp, Homo sapiens
aagtatttatatatttataa

SEQ ID NO: 2798011 - DNA, 21 bp, Homo sapiens
aagtatttatatatttataac

SEQ ID NO: 2798012 - DNA, 16 bp, Homo sapiens
aagtcaaccaatgtag

SEQ ID NO: 2798013 - DNA, 15 bp, Homo sapiens
aagtcacacagacac

SEQ ID NO: 2798014 - DNA, 18 bp, Homo sapiens
aagtcacacagacacaca

SEQ ID NO: 2798015 - DNA, 14 bp, Homo sapiens
aagtcaccggagct

SEQ ID NO: 2798016 - DNA, 16 bp, Homo sapiens
aagtcagactgctggg

SEQ ID NO: 2798017 - DNA, 17 bp, Homo sapiens
aagtcagactgctggga

SEQ ID NO: 2798018 - DNA, 17 bp, Homo sapiens
aagtcagttggagaaaa

SEQ ID NO: 2798019 - DNA, 23 bp, Homo sapiens
aagtcatgaagcccaagtgaaat

SEQ ID NO: 2798020 - DNA, 20 bp, Homo sapiens
aagtcattttaactttatca

SEQ ID NO: 2798021 - DNA, 22 bp, Homo sapiens
aagtcattttaactttatcaca

SEQ ID NO: 2798022 - DNA, 17 bp, Homo sapiens
aagtccacctgcctatc

SEQ ID NO: 2798023 - DNA, 17 bp, Homo sapiens
aagtcctacaagctaaa

SEQ ID NO: 2798024 - DNA, 20 bp, Homo sapiens
aagtcgtccttactcctgtg

SEQ ID NO: 2798025 - DNA, 14 bp, Homo sapiens
aagtctccttcccc

SEQ ID NO: 2798026 - DNA, 22 bp, Homo sapiens
aagtctctgactcttgcctttc

SEQ ID NO: 2798027 - DNA, 23 bp, Homo sapiens
aagtcttaaaataacttatatca

SEQ ID NO: 2798028 - DNA, 16 bp, Homo sapiens
aagtcttgagaaaaag

SEQ ID NO: 2798029 - DNA, 13 bp, Homo sapiens
aagtgaataaact

SEQ ID NO: 2798030 - DNA, 17 bp, Homo sapiens
aagtgaataaacttcag

SEQ ID NO: 2798031 - DNA, 18 bp, Homo sapiens
aagtgaataaacttcagc

SEQ ID NO: 2798032 - DNA, 18 bp, Homo sapiens
aagtgaatgctcaagttt

SEQ ID NO: 2798033 - DNA, 15 bp, Homo sapiens
aagtgaatttgcctg

SEQ ID NO: 2798034 - DNA, 15 bp, Homo sapiens
aagtgataatttctg

SEQ ID NO: 2798035 - DNA, 14 bp, Homo sapiens
aagtgatatatgta

SEQ ID NO: 2798036 - DNA, 16 bp, Homo sapiens
aagtgatatatgtatt

SEQ ID NO: 2798037 - DNA, 16 bp, Homo sapiens
aagtgatgatggatga

SEQ ID NO: 2798038 - DNA, 21 bp, Homo sapiens
aagtgcaaatactccaagctt

SEQ ID NO: 2798039 - DNA, 12 bp, Homo sapiens
aagtgctgggat

SEQ ID NO: 2798040 - DNA, 15 bp, Homo sapiens
aagtgctgtttgaga

SEQ ID NO: 2798041 - DNA, 16 bp, Homo sapiens
aagtggaccaggacag

SEQ ID NO: 2798042 - DNA, 12 bp, Homo sapiens
aagtggctgctg

SEQ ID NO: 2798043 - DNA, 16 bp, Homo sapiens
aagtgggccaggacag

SEQ ID NO: 2798044 - DNA, 20 bp, Homo sapiens
aagtggggttgcaaccactg

SEQ ID NO: 2798045 - DNA, 16 bp, Homo sapiens
aagtgtaatagattat

SEQ ID NO: 2798046 - DNA, 22 bp, Homo sapiens
aagtgtcatatgtaggtgtctg

SEQ ID NO: 2798047 - DNA, 17 bp, Homo sapiens
aagtgtgtttccttcag

SEQ ID NO: 2798048 - DNA, 14 bp, Homo sapiens
aagtgttgaagaag

SEQ ID NO: 2798049 - DNA, 20 bp, Homo sapiens
aagtgttgtaaatatttatg

SEQ ID NO: 2798050 - DNA, 18 bp, Homo sapiens
aatctgagcctaaatcta

SEQ ID NO: 2798051 - DNA, 18 bp, Homo sapiens
aatctgattggacatttt

SEQ ID NO: 2798052 - DNA, 21 bp, Homo sapiens
aattccactggacttgagctt

SEQ ID NO: 2798053 - DNA, 17 bp, Homo sapiens
aattcccattttgcaaa

SEQ ID NO: 2798054 - DNA, 19 bp, Homo sapiens
aattcccattttgcaaaat

SEQ ID NO: 2798055 - DNA, 22 bp, Homo sapiens
aattccctatcttttagtttta

SEQ ID NO: 2798056 - DNA, 13 bp, Homo sapiens
aattcctctggga

SEQ ID NO: 2798057 - DNA, 14 bp, Homo sapiens
aattcctctgggaa

SEQ ID NO: 2798058 - DNA, 13 bp, Homo sapiens
aattccttagctt

SEQ ID NO: 2798059 - DNA, 13 bp, Homo sapiens
aattctaaatgaa

SEQ ID NO: 2798060 - DNA, 19 bp, Homo sapiens
aattctaaatgaatgttta

SEQ ID NO: 2798061 - DNA, 21 bp, Homo sapiens
aattctaagattgtacatatg

SEQ ID NO: 2798062 - DNA, 22 bp, Homo sapiens
aattctcaacctaccacccctt

SEQ ID NO: 2798063 - DNA, 21 bp, Homo sapiens
aattctcatttgtcacacact

SEQ ID NO: 2798064 - DNA, 17 bp, Homo sapiens
aattctgagctggccct

SEQ ID NO: 2798065 - DNA, 22 bp, Homo sapiens
aattctgagctggccctttcca

SEQ ID NO: 2798066 - DNA, 13 bp, Homo sapiens
aattctgtgaaga

SEQ ID NO: 2798067 - DNA, 15 bp, Homo sapiens
aattctgtgaagaat

SEQ ID NO: 2798068 - DNA, 18 bp, Homo sapiens
aattctgtgaagaatgaa

SEQ ID NO: 2798069 - DNA, 17 bp, Homo sapiens
aattcttacaaacatgt

SEQ ID NO: 2798070 - DNA, 14 bp, Homo sapiens
aattcttgtatatt

SEQ ID NO: 2798071 - DNA, 13 bp, Homo sapiens
aattctttttcaa

SEQ ID NO: 2798072 - DNA, 21 bp, Homo sapiens
aattgaacttaaataaatgtc

SEQ ID NO: 2798073 - DNA, 16 bp, Homo sapiens
aattgaagataggaga

SEQ ID NO: 2798074 - DNA, 15 bp, Homo sapiens
aattgagaaggaaaa

SEQ ID NO: 2798075 - DNA, 20 bp, Homo sapiens
aattgagataatatctgtga

SEQ ID NO: 2798076 - DNA, 18 bp, Homo sapiens
aattgagtgtttaaagtt

SEQ ID NO: 2798077 - DNA, 10 bp, Homo sapiens
aattgcacaa

SEQ ID NO: 2798078 - DNA, 17 bp, Homo sapiens
aattgcacaatttgagc

SEQ ID NO: 2798079 - DNA, 21 bp, Homo sapiens
aattgcacaatttgagcaatt

SEQ ID NO: 2798080 - DNA, 20 bp, Homo sapiens
aattgcattctgaatgaata

SEQ ID NO: 2798081 - DNA, 23 bp, Homo sapiens
aattgcctgacgaactccttgat

SEQ ID NO: 2798082 - DNA, 19 bp, Homo sapiens
aattgcctgcagagagaag

SEQ ID NO: 2798083 - DNA, 19 bp, Homo sapiens
aattgggattttaaaaaca

SEQ ID NO: 2798084 - DNA, 18 bp, Homo sapiens
aattggtatcaagaaagt

SEQ ID NO: 2798085 - DNA, 16 bp, Homo sapiens
aattggtgataagtgg

SEQ ID NO: 2798086 - DNA, 18 bp, Homo sapiens
aattggtgataagtggaa

SEQ ID NO: 2798087 - DNA, 20 bp, Homo sapiens
aattggtgataagtggaaaa

SEQ ID NO: 2798088 - DNA, 16 bp, Homo sapiens
aattgtagatggaaat

SEQ ID NO: 2798089 - DNA, 19 bp, Homo sapiens
aattgtagatggaaatcag

SEQ ID NO: 2798090 - DNA, 13 bp, Homo sapiens
aattgtccccagt

SEQ ID NO: 2798091 - DNA, 22 bp, Homo sapiens
aattgtgtacaaagtagagaag

SEQ ID NO: 2798092 - DNA, 17 bp, Homo sapiens
aattgttcctgatgtgc

SEQ ID NO: 2798093 - DNA, 15 bp, Homo sapiens
aattgtttaagtgtt

SEQ ID NO: 2798094 - DNA, 22 bp, Homo sapiens
aattgtttggggatgagaaagg

SEQ ID NO: 2798095 - DNA, 13 bp, Homo sapiens
aatttaaaccagc

SEQ ID NO: 2798096 - DNA, 14 bp, Homo sapiens
aatttaaaccagca

SEQ ID NO: 2798097 - DNA, 12 bp, Homo sapiens
aatttaaagcaa

SEQ ID NO: 2798098 - DNA, 14 bp, Homo sapiens
aatttaactaattt

SEQ ID NO: 2798099 - DNA, 17 bp, Homo sapiens
aatttaactaatttaaa

SEQ ID NO: 2798100 - DNA, 18 bp, Homo sapiens
aatttaactaatttaaac

SEQ ID NO: 2798101 - DNA, 15 bp, Homo sapiens
aatttaattaatcga

SEQ ID NO: 2798102 - DNA, 12 bp, Homo sapiens
aatttaattcca

SEQ ID NO: 2798103 - DNA, 18 bp, Homo sapiens
aatttagaaaacattcat

SEQ ID NO: 2798104 - DNA, 21 bp, Homo sapiens
aatttagaaaacattcatcca

SEQ ID NO: 2798105 - DNA, 15 bp, Homo sapiens
aatttagaaaacttt

SEQ ID NO: 2798106 - DNA, 21 bp, Homo sapiens
aatttagaaatcattttgcaa

SEQ ID NO: 2798107 - DNA, 22 bp, Homo sapiens
aatttagtttcatataaagtat

SEQ ID NO: 2798108 - DNA, 13 bp, Homo sapiens
aatttatacaaaa

SEQ ID NO: 2798109 - DNA, 15 bp, Homo sapiens
aatttatacaaaata

SEQ ID NO: 2798110 - DNA, 16 bp, Homo sapiens
aatttatacaaaataa

SEQ ID NO: 2798111 - DNA, 17 bp, Homo sapiens
aatttatacaaaataat

SEQ ID NO: 2798112 - DNA, 20 bp, Homo sapiens
aatttatcttgtctctgggc

SEQ ID NO: 2798113 - DNA, 16 bp, Homo sapiens
aatttatgagtttttg

SEQ ID NO: 2798114 - DNA, 12 bp, Homo sapiens
aatttattcaat

SEQ ID NO: 2798115 - DNA, 20 bp, Homo sapiens
aatttcaggttttgtaaaga

SEQ ID NO: 2798116 - DNA, 22 bp, Homo sapiens
aatttcaggttttgtaaagatg

SEQ ID NO: 2798117 - DNA, 18 bp, Homo sapiens
aatttcgccgttgaagag

SEQ ID NO: 2798118 - DNA, 17 bp, Homo sapiens
aatttcttggtaagaag

SEQ ID NO: 2798119 - DNA, 20 bp, Homo sapiens
aatttcttggtaagaagccg

SEQ ID NO: 2798120 - DNA, 19 bp, Homo sapiens
aatttctttgtcattcaag

SEQ ID NO: 2798121 - DNA, 18 bp, Homo sapiens
aatttgaaaataattgtt

SEQ ID NO: 2798122 - DNA, 14 bp, Homo sapiens
aatttgaaatttag

SEQ ID NO: 2798123 - DNA, 14 bp, Homo sapiens
aatttgagcaattc

SEQ ID NO: 2798124 - DNA, 22 bp, Homo sapiens
aatttgagcaattcatttcact

SEQ ID NO: 2798125 - DNA, 21 bp, Homo sapiens
aatttgatagtattgtgcata

SEQ ID NO: 2798126 - DNA, 14 bp, Homo sapiens
aatttgcactgtta

SEQ ID NO: 2798127 - DNA, 23 bp, Homo sapiens
aatttggatttacgactgaagaa

SEQ ID NO: 2798128 - DNA, 17 bp, Homo sapiens
aatttggttctaggccg

SEQ ID NO: 2798129 - DNA, 20 bp, Homo sapiens
aatttgtacatatgtaaaat

SEQ ID NO: 2798130 - DNA, 14 bp, Homo sapiens
aatttgtatatcat

SEQ ID NO: 2798131 - DNA, 14 bp, Homo sapiens
aattttaaacaaag

SEQ ID NO: 2798132 - DNA, 18 bp, Homo sapiens
aattttactgacagaaat

SEQ ID NO: 2798133 - DNA, 19 bp, Homo sapiens
aattttatagctcagttta

SEQ ID NO: 2798134 - DNA, 12 bp, Homo sapiens
aattttatgaat

SEQ ID NO: 2798135 - DNA, 20 bp, Homo sapiens
aattttcaagagaagaaaaa

SEQ ID NO: 2798136 - DNA, 20 bp, Homo sapiens
aattttcacttgcttaaaaa

SEQ ID NO: 2798137 - DNA, 20 bp, Homo sapiens
aattttcagtataatttaac

SEQ ID NO: 2798138 - DNA, 13 bp, Homo sapiens
aattttcttcatg

SEQ ID NO: 2798139 - DNA, 20 bp, Homo sapiens
aattttgcagattattttag

SEQ ID NO: 2798140 - DNA, 15 bp, Homo sapiens
aattttgcagcagaa

SEQ ID NO: 2798141 - DNA, 12 bp, Homo sapiens
aattttgtaaaa

SEQ ID NO: 2798142 - DNA, 20 bp, Homo sapiens
acaatttagaaaacattcat

SEQ ID NO: 2798143 - DNA, 12 bp, Homo sapiens
acaatttatatt

SEQ ID NO: 2798144 - DNA, 17 bp, Homo sapiens
acaatttgagcaattca

SEQ ID NO: 2798145 - DNA, 19 bp, Homo sapiens
acaatttgagcaattcatt

SEQ ID NO: 2798146 - DNA, 23 bp, Homo sapiens
acaatttgcactgttacttttta

SEQ ID NO: 2798147 - DNA, 19 bp, Homo sapiens
acacaagccacagaagcca

SEQ ID NO: 2798148 - DNA, 14 bp, Homo sapiens
acacaatatgaata

SEQ ID NO: 2798149 - DNA, 14 bp, Homo sapiens
acacacacatacac

SEQ ID NO: 2798150 - DNA, 13 bp, Homo sapiens
acacacagaggaa

SEQ ID NO: 2798151 - DNA, 13 bp, Homo sapiens
acacacagcactc

SEQ ID NO: 2798152 - DNA, 13 bp, Homo sapiens
acacacagctctg

SEQ ID NO: 2798153 - DNA, 12 bp, Homo sapiens
acacacccccca

SEQ ID NO: 2798154 - DNA, 13 bp, Homo sapiens
acacacccctcaa

SEQ ID NO: 2798155 - DNA, 21 bp, Homo sapiens
acacacgcaggaactcccagc

SEQ ID NO: 2798156 - DNA, 17 bp, Homo sapiens
acacacgtatttatatt

SEQ ID NO: 2798157 - DNA, 23 bp, Homo sapiens
acacagactgcgatttgtcccag

SEQ ID NO: 2798158 - DNA, 21 bp, Homo sapiens
acacagaggaagagcaggcac

SEQ ID NO: 2798159 - DNA, 21 bp, Homo sapiens
acacagcctgggaccagggca

SEQ ID NO: 2798160 - DNA, 14 bp, Homo sapiens
acacagctctgtcc

SEQ ID NO: 2798161 - DNA, 13 bp, Homo sapiens
acacagctcttct

SEQ ID NO: 2798162 - DNA, 16 bp, Homo sapiens
acacagctcttctcca

SEQ ID NO: 2798163 - DNA, 18 bp, Homo sapiens
acacagctcttctccagg

SEQ ID NO: 2798164 - DNA, 19 bp, Homo sapiens
acacagctcttctccaggc

SEQ ID NO: 2798165 - DNA, 15 bp, Homo sapiens
acacaggcaactgag

SEQ ID NO: 2798166 - DNA, 16 bp, Homo sapiens
acacaggcaactgagg

SEQ ID NO: 2798167 - DNA, 18 bp, Homo sapiens
acacaggcatttcctggg

SEQ ID NO: 2798168 - DNA, 20 bp, Homo sapiens
acacaggcatttcctgggtg

SEQ ID NO: 2798169 - DNA, 13 bp, Homo sapiens
acacaggcctgtg

SEQ ID NO: 2798170 - DNA, 16 bp, Homo sapiens
acacaggcctgtgtag

SEQ ID NO: 2798171 - DNA, 22 bp, Homo sapiens
acacaggcctgtgtagctgtga

SEQ ID NO: 2798172 - DNA, 15 bp, Homo sapiens
acacagttgctgtca

SEQ ID NO: 2798173 - DNA, 16 bp, Homo sapiens
acacataactagaaac

SEQ ID NO: 2798174 - DNA, 22 bp, Homo sapiens
acacatactcatttttcatgat

SEQ ID NO: 2798175 - DNA, 22 bp, Homo sapiens
acacatgaaccatccttcccat

SEQ ID NO: 2798176 - DNA, 20 bp, Homo sapiens
acacattatcgggagcagtg

SEQ ID NO: 2798177 - DNA, 23 bp, Homo sapiens
acacattatcgggagcagtgtct

SEQ ID NO: 2798178 - DNA, 13 bp, Homo sapiens
acaccactctggc

SEQ ID NO: 2798179 - DNA, 20 bp, Homo sapiens
acaccactctggcagccaca

SEQ ID NO: 2798180 - DNA, 18 bp, Homo sapiens
acaccactttgtctctga

SEQ ID NO: 2798181 - DNA, 21 bp, Homo sapiens
acaccagagtgtagaataata

SEQ ID NO: 2798182 - DNA, 17 bp, Homo sapiens
acaccaggagtccctgg

SEQ ID NO: 2798183 - DNA, 20 bp, Homo sapiens
acacccaaagaggtatttat

SEQ ID NO: 2798184 - DNA, 15 bp, Homo sapiens
acacccaagagggct

SEQ ID NO: 2798185 - DNA, 13 bp, Homo sapiens
acacccagcccac

SEQ ID NO: 2798186 - DNA, 19 bp, Homo sapiens
acacccagcccacttctgc

SEQ ID NO: 2798187 - DNA, 20 bp, Homo sapiens
acacccagcccacttctgcc

SEQ ID NO: 2798188 - DNA, 21 bp, Homo sapiens
acacccagcccacttctgcca

SEQ ID NO: 2798189 - DNA, 17 bp, Homo sapiens
acacccgactcctcaaa

SEQ ID NO: 2798190 - DNA, 13 bp, Homo sapiens
acaccctccccat

SEQ ID NO: 2798191 - DNA, 18 bp, Homo sapiens
acacctaccaaaaaataa

SEQ ID NO: 2798192 - DNA, 20 bp, Homo sapiens
acacctatgtcatttcattt

SEQ ID NO: 2798193 - DNA, 18 bp, Homo sapiens
acacctcactgaggaagg

SEQ ID NO: 2798194 - DNA, 11 bp, Homo sapiens
acacctcccag

SEQ ID NO: 2798195 - DNA, 19 bp, Homo sapiens
acacctcccaggagacagt

SEQ ID NO: 2798196 - DNA, 16 bp, Homo sapiens
acacctccctgaacca

SEQ ID NO: 2798197 - DNA, 22 bp, Homo sapiens
acacctccctgaaccatccctg

SEQ ID NO: 2798198 - DNA, 12 bp, Homo sapiens
acacctgacaca

SEQ ID NO: 2798199 - DNA, 19 bp, Homo sapiens
acacctgcacctcccccca

SEQ ID NO: 2798200 - DNA, 24 bp, Homo sapiens
acacctgcacctccccccactgca

SEQ ID NO: 2798201 - DNA, 14 bp, Homo sapiens
acacctgccctgcc

SEQ ID NO: 2798202 - DNA, 20 bp, Homo sapiens
acacctgccctgccctgcca

SEQ ID NO: 2798203 - DNA, 23 bp, Homo sapiens
acacctgccctgccctgccacct

SEQ ID NO: 2798204 - DNA, 18 bp, Homo sapiens
acacctggccgcctccag

SEQ ID NO: 2798205 - DNA, 19 bp, Homo sapiens
acacctgtcagcccaagca

SEQ ID NO: 2798206 - DNA, 16 bp, Homo sapiens
acaccttgacagggca

SEQ ID NO: 2798207 - DNA, 14 bp, Homo sapiens
acacggaggcatct

SEQ ID NO: 2798208 - DNA, 14 bp, Homo sapiens
acactaagggtgta

SEQ ID NO: 2798209 - DNA, 13 bp, Homo sapiens
acactacttaaaa

SEQ ID NO: 2798210 - DNA, 23 bp, Homo sapiens
acactagttttgtgccagccgtg

SEQ ID NO: 2798211 - DNA, 22 bp, Homo sapiens
acactatggtatttgagtgttt

SEQ ID NO: 2798212 - DNA, 17 bp, Homo sapiens
acactcagaagcctggg

SEQ ID NO: 2798213 - DNA, 16 bp, Homo sapiens
acactccagcctgagc

SEQ ID NO: 2798214 - DNA, 16 bp, Homo sapiens
acactctttgtaagag

SEQ ID NO: 2798215 - DNA, 19 bp, Homo sapiens
acactgcttgtgtttttaa

SEQ ID NO: 2798216 - DNA, 14 bp, Homo sapiens
acactggtgactgc

SEQ ID NO: 2798217 - DNA, 19 bp, Homo sapiens
acactgtccccacagcagg

SEQ ID NO: 2798218 - DNA, 22 bp, Homo sapiens
acactgttactccacagcggag

SEQ ID NO: 2798219 - DNA, 18 bp, Homo sapiens
acacttcatggaccaaga

SEQ ID NO: 2798220 - DNA, 14 bp, Homo sapiens
acacttccataatc

SEQ ID NO: 2798221 - DNA, 20 bp, Homo sapiens
acacttctcatcatattgta

SEQ ID NO: 2798222 - DNA, 17 bp, Homo sapiens
acagaaacaaaaacact

SEQ ID NO: 2798223 - DNA, 14 bp, Homo sapiens
acagaacactgtct

SEQ ID NO: 2798224 - DNA, 17 bp, Homo sapiens
acagaacccctacatga

SEQ ID NO: 2798225 - DNA, 18 bp, Homo sapiens
acagaaggaatctgtgca

SEQ ID NO: 2798226 - DNA, 20 bp, Homo sapiens
acagaaggaatctgtgcaga

SEQ ID NO: 2798227 - DNA, 20 bp, Homo sapiens
acagaatttttaatgacttt

SEQ ID NO: 2798228 - DNA, 14 bp, Homo sapiens
acagacaacagaag

SEQ ID NO: 2798229 - DNA, 15 bp, Homo sapiens
acagacacaggcccg

SEQ ID NO: 2798230 - DNA, 18 bp, Homo sapiens
acagacacaggcccggct

SEQ ID NO: 2798231 - DNA, 21 bp, Homo sapiens
acagacagatcccatccatca

SEQ ID NO: 2798232 - DNA, 11 bp, Homo sapiens
acagacaggag

SEQ ID NO: 2798233 - DNA, 13 bp, Homo sapiens
acagacaggagaa

SEQ ID NO: 2798234 - DNA, 14 bp, Homo sapiens
acagacaggagaaa

SEQ ID NO: 2798235 - DNA, 20 bp, Homo sapiens
acagaccacctgcttctgaa

SEQ ID NO: 2798236 - DNA, 13 bp, Homo sapiens
acagacctggaca

SEQ ID NO: 2798237 - DNA, 14 bp, Homo sapiens
acagactggaagca

SEQ ID NO: 2798238 - DNA, 17 bp, Homo sapiens
acagactggaagcacag

SEQ ID NO: 2798239 - DNA, 15 bp, Homo sapiens
acagacttctccaga

SEQ ID NO: 2798240 - DNA, 14 bp, Homo sapiens
acagactttagctt

SEQ ID NO: 2798241 - DNA, 17 bp, Homo sapiens
acagagaaagagagaga

SEQ ID NO: 2798242 - DNA, 14 bp, Homo sapiens
acagagaaggcagg

SEQ ID NO: 2798243 - DNA, 16 bp, Homo sapiens
acagagaaggcaggaa

SEQ ID NO: 2798244 - DNA, 21 bp, Homo sapiens
acagagacacctgcacctccc

SEQ ID NO: 2798245 - DNA, 23 bp, Homo sapiens
acagagacaggcccaagagatga

SEQ ID NO: 2798246 - DNA, 15 bp, Homo sapiens
acagagcaagactct

SEQ ID NO: 2798247 - DNA, 12 bp, Homo sapiens
acagagcctgcc

SEQ ID NO: 2798248 - DNA, 15 bp, Homo sapiens
acagagcctgcctca

SEQ ID NO: 2798249 - DNA, 17 bp, Homo sapiens
acagagccttcacaacc

SEQ ID NO: 2798250 - DNA, 10 bp, Homo sapiens
acagagctgg

SEQ ID NO: 2798251 - DNA, 14 bp, Homo sapiens
acagagcttgaaaa

SEQ ID NO: 2798252 - DNA, 18 bp, Homo sapiens
acagaggaagagcaggca

SEQ ID NO: 2798253 - DNA, 23 bp, Homo sapiens
acagaggcagctgtgtgggctgc

SEQ ID NO: 2798254 - DNA, 21 bp, Homo sapiens
acagaggccatgggcctcctg

SEQ ID NO: 2798255 - DNA, 14 bp, Homo sapiens
acagagtatatatg

SEQ ID NO: 2798256 - DNA, 18 bp, Homo sapiens
acagagtatatatgtaca

SEQ ID NO: 2798257 - DNA, 14 bp, Homo sapiens
acagagtctcactg

SEQ ID NO: 2798258 - DNA, 17 bp, Homo sapiens
acagagtctcactgttg

SEQ ID NO: 2798259 - DNA, 15 bp, Homo sapiens
acagagtgagactct

SEQ ID NO: 2798260 - DNA, 19 bp, Homo sapiens
acagagtgagactctgtct

SEQ ID NO: 2798261 - DNA, 21 bp, Homo sapiens
acagagtgagactctgtctca

SEQ ID NO: 2798262 - DNA, 18 bp, Homo sapiens
acagataactgaaaatta

SEQ ID NO: 2798263 - DNA, 21 bp, Homo sapiens
acagatactggaagttttgca

SEQ ID NO: 2798264 - DNA, 14 bp, Homo sapiens
acagatataaatgg

SEQ ID NO: 2798265 - DNA, 23 bp, Homo sapiens
acagatatttccatttcttcctc

SEQ ID NO: 2798266 - DNA, 22 bp, Homo sapiens
acagatcccatccatcagctcc

SEQ ID NO: 2798267 - DNA, 19 bp, Homo sapiens
acagatgggtattaaactt

SEQ ID NO: 2798268 - DNA, 20 bp, Homo sapiens
acagatgtcagccgagccgg

SEQ ID NO: 2798269 - DNA, 12 bp, Homo sapiens
acagatgttgaa

SEQ ID NO: 2798270 - DNA, 14 bp, Homo sapiens
acagattgtttgca

SEQ ID NO: 2798271 - DNA, 19 bp, Homo sapiens
acagcaacaggaatctcag

SEQ ID NO: 2798272 - DNA, 23 bp, Homo sapiens
acagcactctctaaatcttcctt

SEQ ID NO: 2798273 - DNA, 13 bp, Homo sapiens
acagcagactcag

SEQ ID NO: 2798274 - DNA, 13 bp, Homo sapiens
acagccagaagcc

SEQ ID NO: 2798275 - DNA, 15 bp, Homo sapiens
acagccagagcctgt

SEQ ID NO: 2798276 - DNA, 19 bp, Homo sapiens
acagcccaaagaaggaaaa

SEQ ID NO: 2798277 - DNA, 18 bp, Homo sapiens
acagccgctcctgtctgc

SEQ ID NO: 2798278 - DNA, 23 bp, Homo sapiens
acagccgctcctgtctgccagcc

SEQ ID NO: 2798279 - DNA, 17 bp, Homo sapiens
acagccgtcagccaaat

SEQ ID NO: 2798280 - DNA, 20 bp, Homo sapiens
acagcctgacaacatttcta

SEQ ID NO: 2798281 - DNA, 16 bp, Homo sapiens
acagcctggttttcac

SEQ ID NO: 2798282 - DNA, 21 bp, Homo sapiens
acagcctgtggcggtgcctgg

SEQ ID NO: 2798283 - DNA, 22 bp, Homo sapiens
acagcgagaggcagagaaagaa

SEQ ID NO: 2798284 - DNA, 15 bp, Homo sapiens
acagcggaggagacc

SEQ ID NO: 2798285 - DNA, 21 bp, Homo sapiens
acagcggaggagaccagctca

SEQ ID NO: 2798286 - DNA, 13 bp, Homo sapiens
acagctcccaccc

SEQ ID NO: 2798287 - DNA, 14 bp, Homo sapiens
acagctcccacccc

SEQ ID NO: 2798288 - DNA, 16 bp, Homo sapiens
acagctcccaccccac

SEQ ID NO: 2798289 - DNA, 13 bp, Homo sapiens
acagctccttctg

SEQ ID NO: 2798290 - DNA, 13 bp, Homo sapiens
acagctctgtcct

SEQ ID NO: 2798291 - DNA, 17 bp, Homo sapiens
acagctctgtcctggga

SEQ ID NO: 2798292 - DNA, 20 bp, Homo sapiens
acagctcttctccaggctgt

SEQ ID NO: 2798293 - DNA, 16 bp, Homo sapiens
acagctgtccctgtca

SEQ ID NO: 2798294 - DNA, 12 bp, Homo sapiens
acagctgtgcct

SEQ ID NO: 2798295 - DNA, 19 bp, Homo sapiens
acagctttacaacttccat

SEQ ID NO: 2798296 - DNA, 20 bp, Homo sapiens
acaggaaaagctgctgacag

SEQ ID NO: 2798297 - DNA, 21 bp, Homo sapiens
acaggaaaagctgctgacagt

SEQ ID NO: 2798298 - DNA, 15 bp, Homo sapiens
acaggaatctcagag

SEQ ID NO: 2798299 - DNA, 17 bp, Homo sapiens
acaggaatctcagagac

SEQ ID NO: 2798300 - DNA, 15 bp, Homo sapiens
acaggacacctggcc

SEQ ID NO: 2798301 - DNA, 19 bp, Homo sapiens
acaggacacctggccgcct

SEQ ID NO: 2798302 - DNA, 16 bp, Homo sapiens
acaggactaacactca

SEQ ID NO: 2798303 - DNA, 18 bp, Homo sapiens
acaggactaacactcaga

SEQ ID NO: 2798304 - DNA, 21 bp, Homo sapiens
acaggactaacactcagaagc

SEQ ID NO: 2798305 - DNA, 24 bp, Homo sapiens
acaggactaacactcagaagcctg

SEQ ID NO: 2798306 - DNA, 11 bp, Homo sapiens
acaggagaaat

SEQ ID NO: 2798307 - DNA, 19 bp, Homo sapiens
acaggagggagagaactta

SEQ ID NO: 2798308 - DNA, 18 bp, Homo sapiens
acaggagggcaagggcca

SEQ ID NO: 2798309 - DNA, 19 bp, Homo sapiens
acaggataaagatatcaat

SEQ ID NO: 2798310 - DNA, 22 bp, Homo sapiens
acaggatcctattctcaccagg

SEQ ID NO: 2798311 - DNA, 16 bp, Homo sapiens
acaggcaactgaggca

SEQ ID NO: 2798312 - DNA, 20 bp, Homo sapiens
acatccatttcatctatttc

SEQ ID NO: 2798313 - DNA, 18 bp, Homo sapiens
acatcccattgccctggt

SEQ ID NO: 2798314 - DNA, 18 bp, Homo sapiens
acatctaagcctgttgag

SEQ ID NO: 2798315 - DNA, 14 bp, Homo sapiens
acatctcactttgc

SEQ ID NO: 2798316 - DNA, 12 bp, Homo sapiens
acatctcatttt

SEQ ID NO: 2798317 - DNA, 20 bp, Homo sapiens
acatctctttgatgtcatat

SEQ ID NO: 2798318 - DNA, 17 bp, Homo sapiens
acatctgtgtctctgga

SEQ ID NO: 2798319 - DNA, 16 bp, Homo sapiens
acatctgttttaaatt

SEQ ID NO: 2798320 - DNA, 13 bp, Homo sapiens
acatcttcaaagc

SEQ ID NO: 2798321 - DNA, 14 bp, Homo sapiens
acatcttgctctgc

SEQ ID NO: 2798322 - DNA, 18 bp, Homo sapiens
acatcttgctctgctgac

SEQ ID NO: 2798323 - DNA, 21 bp, Homo sapiens
acatcttgctctgctgacaga

SEQ ID NO: 2798324 - DNA, 15 bp, Homo sapiens
aattttgtaacgaag

SEQ ID NO: 2798325 - DNA, 18 bp, Homo sapiens
aatttttaaactagtaat

SEQ ID NO: 2798326 - DNA, 19 bp, Homo sapiens
aatttttaaagtatatatt

SEQ ID NO: 2798327 - DNA, 22 bp, Homo sapiens
aatttttaaagtatatatttat

SEQ ID NO: 2798328 - DNA, 14 bp, Homo sapiens
aatttttaatgact

SEQ ID NO: 2798329 - DNA, 21 bp, Homo sapiens
aatttttaatgactttttata

SEQ ID NO: 2798330 - DNA, 15 bp, Homo sapiens
aatttttatacatat

SEQ ID NO: 2798331 - DNA, 22 bp, Homo sapiens
aatttttatacatatcagaaaa

SEQ ID NO: 2798332 - DNA, 20 bp, Homo sapiens
aatttttcattgatatgaaa

SEQ ID NO: 2798333 - DNA, 23 bp, Homo sapiens
aatttttcattgatatgaaaaat

SEQ ID NO: 2798334 - DNA, 19 bp, Homo sapiens
aatttttgcaattattcta

SEQ ID NO: 2798335 - DNA, 13 bp, Homo sapiens
aattttttgagta

SEQ ID NO: 2798336 - DNA, 18 bp, Homo sapiens
aatttttttgtattttag

SEQ ID NO: 2798337 - DNA, 16 bp, Homo sapiens
acaaaaacaaaaccag

SEQ ID NO: 2798338 - DNA, 21 bp, Homo sapiens
acaaaaacagcctcacagaag

SEQ ID NO: 2798339 - DNA, 12 bp, Homo sapiens
acaaaaataaca

SEQ ID NO: 2798340 - DNA, 16 bp, Homo sapiens
acaaaacaagaaagaa

SEQ ID NO: 2798341 - DNA, 13 bp, Homo sapiens
acaaaaccagctg

SEQ ID NO: 2798342 - DNA, 21 bp, Homo sapiens
acaaaaccagctgctactcat

SEQ ID NO: 2798343 - DNA, 16 bp, Homo sapiens
acaaaactagagactc

SEQ ID NO: 2798344 - DNA, 16 bp, Homo sapiens
acaaaataaaattatg

SEQ ID NO: 2798345 - DNA, 13 bp, Homo sapiens
acaaaataattta

SEQ ID NO: 2798346 - DNA, 16 bp, Homo sapiens
acaaaataatttaact

SEQ ID NO: 2798347 - DNA, 15 bp, Homo sapiens
acaaaatcacaagca

SEQ ID NO: 2798348 - DNA, 22 bp, Homo sapiens
acaaaatcacaagcaataatta

SEQ ID NO: 2798349 - DNA, 15 bp, Homo sapiens
acaaacaaataaata

SEQ ID NO: 2798350 - DNA, 15 bp, Homo sapiens
acaaacacctcccag

SEQ ID NO: 2798351 - DNA, 19 bp, Homo sapiens
acaaacatgtggttaatgc

SEQ ID NO: 2798352 - DNA, 17 bp, Homo sapiens
acaaacctctatatgtt

SEQ ID NO: 2798353 - DNA, 22 bp, Homo sapiens
acaaacctctatatgttgctga

SEQ ID NO: 2798354 - DNA, 21 bp, Homo sapiens
acaaagaacggcatgtgaatt

SEQ ID NO: 2798355 - DNA, 15 bp, Homo sapiens
acaaagcccttttat

SEQ ID NO: 2798356 - DNA, 20 bp, Homo sapiens
acaaagcttctatcccagga

SEQ ID NO: 2798357 - DNA, 14 bp, Homo sapiens
acaaaggagcctgt

SEQ ID NO: 2798358 - DNA, 14 bp, Homo sapiens
acaaagtagagaag

SEQ ID NO: 2798359 - DNA, 15 bp, Homo sapiens
acaaagtagagaagt

SEQ ID NO: 2798360 - DNA, 16 bp, Homo sapiens
acaaataacaatgtgc

SEQ ID NO: 2798361 - DNA, 18 bp, Homo sapiens
acaaatatatttaattgt

SEQ ID NO: 2798362 - DNA, 21 bp, Homo sapiens
acaaatctgggcattgagcaa

SEQ ID NO: 2798363 - DNA, 11 bp, Homo sapiens
acaacagaagt

SEQ ID NO: 2798364 - DNA, 17 bp, Homo sapiens
acaaccagagcccccca

SEQ ID NO: 2798365 - DNA, 17 bp, Homo sapiens
acaaccagccacacaga

SEQ ID NO: 2798366 - DNA, 14 bp, Homo sapiens
acaaccattccaga

SEQ ID NO: 2798367 - DNA, 17 bp, Homo sapiens
acaaccctgttttatac

SEQ ID NO: 2798368 - DNA, 23 bp, Homo sapiens
acaactaatcaagagtgagtgaa

SEQ ID NO: 2798369 - DNA, 15 bp, Homo sapiens
acaactccaggaaaa

SEQ ID NO: 2798370 - DNA, 17 bp, Homo sapiens
acaactgtttttgaaga

SEQ ID NO: 2798371 - DNA, 22 bp, Homo sapiens
acaacttgtctattacctgtta

SEQ ID NO: 2798372 - DNA, 17 bp, Homo sapiens
acaagaagcattttgta

SEQ ID NO: 2798373 - DNA, 20 bp, Homo sapiens
acaagaagccacagacctag

SEQ ID NO: 2798374 - DNA, 13 bp, Homo sapiens
acaagaagctgct

SEQ ID NO: 2798375 - DNA, 14 bp, Homo sapiens
acaagaagctgcta

SEQ ID NO: 2798376 - DNA, 13 bp, Homo sapiens
acaagagcccagc

SEQ ID NO: 2798377 - DNA, 16 bp, Homo sapiens
acaagaggaagagaga

SEQ ID NO: 2798378 - DNA, 20 bp, Homo sapiens
acaagaggaagagagagacc

SEQ ID NO: 2798379 - DNA, 16 bp, Homo sapiens
acaagatctttcagga

SEQ ID NO: 2798380 - DNA, 17 bp, Homo sapiens
acaagcaacataaaaca

SEQ ID NO: 2798381 - DNA, 12 bp, Homo sapiens
acaagcacaaag

SEQ ID NO: 2798382 - DNA, 16 bp, Homo sapiens
acaagcacagttttaa

SEQ ID NO: 2798383 - DNA, 16 bp, Homo sapiens
acaagctcctggtctt

SEQ ID NO: 2798384 - DNA, 18 bp, Homo sapiens
acaagctggaagcacatg

SEQ ID NO: 2798385 - DNA, 12 bp, Homo sapiens
acaagcttgtat

SEQ ID NO: 2798386 - DNA, 20 bp, Homo sapiens
acaagcttgtatatacatat

SEQ ID NO: 2798387 - DNA, 22 bp, Homo sapiens
acaagcttgtatatacatatta

SEQ ID NO: 2798388 - DNA, 16 bp, Homo sapiens
acaaggattgctactg

SEQ ID NO: 2798389 - DNA, 20 bp, Homo sapiens
acaaggctgaccaagagaga

SEQ ID NO: 2798390 - DNA, 17 bp, Homo sapiens
acaagggtctagggaga

SEQ ID NO: 2798391 - DNA, 14 bp, Homo sapiens
acaagtatttgtta

SEQ ID NO: 2798392 - DNA, 20 bp, Homo sapiens
acaagtatttgttaatttag

SEQ ID NO: 2798393 - DNA, 22 bp, Homo sapiens
acaagtatttgttaatttagaa

SEQ ID NO: 2798394 - DNA, 17 bp, Homo sapiens
acaagttatttaaatct

SEQ ID NO: 2798395 - DNA, 13 bp, Homo sapiens
acaataaaacatt

SEQ ID NO: 2798396 - DNA, 16 bp, Homo sapiens
acaataaagagctcaa

SEQ ID NO: 2798397 - DNA, 15 bp, Homo sapiens
acaataaatattctg

SEQ ID NO: 2798398 - DNA, 18 bp, Homo sapiens
acaataaatattctgcat

SEQ ID NO: 2798399 - DNA, 13 bp, Homo sapiens
acaataatttcag

SEQ ID NO: 2798400 - DNA, 12 bp, Homo sapiens
acaatagctatt

SEQ ID NO: 2798401 - DNA, 17 bp, Homo sapiens
acaatagctattgcatg

SEQ ID NO: 2798402 - DNA, 15 bp, Homo sapiens
acaatatgaatacag

SEQ ID NO: 2798403 - DNA, 21 bp, Homo sapiens
acaatatgaatacagggcatg

SEQ ID NO: 2798404 - DNA, 13 bp, Homo sapiens
acaatatttaaaa

SEQ ID NO: 2798405 - DNA, 14 bp, Homo sapiens
acaatatttaaaat

SEQ ID NO: 2798406 - DNA, 17 bp, Homo sapiens
acaatattttgtggctt

SEQ ID NO: 2798407 - DNA, 14 bp, Homo sapiens
acaatcctgtccct

SEQ ID NO: 2798408 - DNA, 16 bp, Homo sapiens
acaattaaagctgtta

SEQ ID NO: 2798409 - DNA, 17 bp, Homo sapiens
acctgcacctcccccca

SEQ ID NO: 2798410 - DNA, 18 bp, Homo sapiens
acctgcacctccccccac

SEQ ID NO: 2798411 - DNA, 19 bp, Homo sapiens
acctgcaggccaagagcag

SEQ ID NO: 2798412 - DNA, 15 bp, Homo sapiens
acctgccagcctggc

SEQ ID NO: 2798413 - DNA, 19 bp, Homo sapiens
acctgccatttgcaccctc

SEQ ID NO: 2798414 - DNA, 13 bp, Homo sapiens
acctgcccaacct

SEQ ID NO: 2798415 - DNA, 13 bp, Homo sapiens
acctgccccctgg

SEQ ID NO: 2798416 - DNA, 17 bp, Homo sapiens
acctgccccgcccagct

SEQ ID NO: 2798417 - DNA, 23 bp, Homo sapiens
acctgccccgcccagctgcacct

SEQ ID NO: 2798418 - DNA, 16 bp, Homo sapiens
acctgccctgccctgc

SEQ ID NO: 2798419 - DNA, 18 bp, Homo sapiens
acctgccctgccctgcca

SEQ ID NO: 2798420 - DNA, 21 bp, Homo sapiens
acctgccctgccctgccacct

SEQ ID NO: 2798421 - DNA, 14 bp, Homo sapiens
acctgcctgccctc

SEQ ID NO: 2798422 - DNA, 11 bp, Homo sapiens
acctgctgagc

SEQ ID NO: 2798423 - DNA, 12 bp, Homo sapiens
acctgctgagct

SEQ ID NO: 2798424 - DNA, 17 bp, Homo sapiens
acctgctgagctctgag

SEQ ID NO: 2798425 - DNA, 23 bp, Homo sapiens
acctgctgagctctgagaggccc

SEQ ID NO: 2798426 - DNA, 19 bp, Homo sapiens
acctgcttcatgctcagcc

SEQ ID NO: 2798427 - DNA, 23 bp, Homo sapiens
acctgcttcatgctcagccctga

SEQ ID NO: 2798428 - DNA, 15 bp, Homo sapiens
acctgctttctcctg

SEQ ID NO: 2798429 - DNA, 18 bp, Homo sapiens
acctggaagcatttgttt

SEQ ID NO: 2798430 - DNA, 21 bp, Homo sapiens
acctggccccatgtctctcag

SEQ ID NO: 2798431 - DNA, 14 bp, Homo sapiens
agaatgatttcatg

SEQ ID NO: 2798432 - DNA, 13 bp, Homo sapiens
agaatgctggttt

SEQ ID NO: 2798433 - DNA, 18 bp, Homo sapiens
agaatgctggttttccta

SEQ ID NO: 2798434 - DNA, 20 bp, Homo sapiens
agaatgcttaatcagataga

SEQ ID NO: 2798435 - DNA, 13 bp, Homo sapiens
agaatggcagctg

SEQ ID NO: 2798436 - DNA, 21 bp, Homo sapiens
agaatggcagctggaatttaa

SEQ ID NO: 2798437 - DNA, 15 bp, Homo sapiens
agaatggggtgcatg

SEQ ID NO: 2798438 - DNA, 20 bp, Homo sapiens
agaatgtcattttggtactt

SEQ ID NO: 2798439 - DNA, 21 bp, Homo sapiens
agaatgttaagacttgacagt

SEQ ID NO: 2798440 - DNA, 13 bp, Homo sapiens
agaattatatcta

SEQ ID NO: 2798441 - DNA, 14 bp, Homo sapiens
agaattatatctaa

SEQ ID NO: 2798442 - DNA, 21 bp, Homo sapiens
agaattatatctaatttatac

SEQ ID NO: 2798443 - DNA, 22 bp, Homo sapiens
agaattatatctaatttataca

SEQ ID NO: 2798444 - DNA, 16 bp, Homo sapiens
agaattatttttgtgt

SEQ ID NO: 2798445 - DNA, 12 bp, Homo sapiens
agaattcacttt

SEQ ID NO: 2798446 - DNA, 13 bp, Homo sapiens
agaattccaagga

SEQ ID NO: 2798447 - DNA, 15 bp, Homo sapiens
agaattcccagctgt

SEQ ID NO: 2798448 - DNA, 20 bp, Homo sapiens
agaattctgctacctcactg

SEQ ID NO: 2798449 - DNA, 18 bp, Homo sapiens
agaattgaacccaggagg

SEQ ID NO: 2798450 - DNA, 14 bp, Homo sapiens
agaattgagtgttt

SEQ ID NO: 2798451 - DNA, 21 bp, Homo sapiens
agaattggagagtaaaaactg

SEQ ID NO: 2798452 - DNA, 13 bp, Homo sapiens
agaattgggaagc

SEQ ID NO: 2798453 - DNA, 15 bp, Homo sapiens
agaattgtatcattt

SEQ ID NO: 2798454 - DNA, 22 bp, Homo sapiens
agaattgtgcgacttcacaaaa

SEQ ID NO: 2798455 - DNA, 23 bp, Homo sapiens
agaattgtgtcagactgtttagt

SEQ ID NO: 2798456 - DNA, 20 bp, Homo sapiens
agaatttaaattctttttca

SEQ ID NO: 2798457 - DNA, 13 bp, Homo sapiens
agaatttattcaa

SEQ ID NO: 2798458 - DNA, 21 bp, Homo sapiens
agaatttctaccatttcagag

SEQ ID NO: 2798459 - DNA, 21 bp, Homo sapiens
agaatttcttggtaagaagcc

SEQ ID NO: 2798460 - DNA, 17 bp, Homo sapiens
agaatttgtattttgct

SEQ ID NO: 2798461 - DNA, 18 bp, Homo sapiens
agaattttaaattataac

SEQ ID NO: 2798462 - DNA, 16 bp, Homo sapiens
agaattttaagtgctt

SEQ ID NO: 2798463 - DNA, 14 bp, Homo sapiens
agaatttttaatga

SEQ ID NO: 2798464 - DNA, 20 bp, Homo sapiens
agaatttttaatgacttttt

SEQ ID NO: 2798465 - DNA, 17 bp, Homo sapiens
agacaaaaacagcctca

SEQ ID NO: 2798466 - DNA, 22 bp, Homo sapiens
agacaaaaacagcctcacagaa

SEQ ID NO: 2798467 - DNA, 10 bp, Homo sapiens
agacacaccc

SEQ ID NO: 2798468 - DNA, 16 bp, Homo sapiens
agacacaccccccagt

SEQ ID NO: 2798469 - DNA, 19 bp, Homo sapiens
agacacaggcccggctcca

SEQ ID NO: 2798470 - DNA, 21 bp, Homo sapiens
agacacaggcccggctccagg

SEQ ID NO: 2798471 - DNA, 16 bp, Homo sapiens
agacacatactcattt

SEQ ID NO: 2798472 - DNA, 21 bp, Homo sapiens
agacaccatcttttgtgagat

SEQ ID NO: 2798473 - DNA, 22 bp, Homo sapiens
agacttcaagcatggctatttt

SEQ ID NO: 2798474 - DNA, 19 bp, Homo sapiens
agacttcagtcctggtctg

SEQ ID NO: 2798475 - DNA, 20 bp, Homo sapiens
agacttccaaacctgacaga

SEQ ID NO: 2798476 - DNA, 15 bp, Homo sapiens
agacttccctgaatg

SEQ ID NO: 2798477 - DNA, 16 bp, Homo sapiens
agacttcgactcagga

SEQ ID NO: 2798478 - DNA, 16 bp, Homo sapiens
agacttctctttgcct

SEQ ID NO: 2798479 - DNA, 17 bp, Homo sapiens
agacttctctttgcctc

SEQ ID NO: 2798480 - DNA, 20 bp, Homo sapiens
agacttctctttgcctcaaa

SEQ ID NO: 2798481 - DNA, 16 bp, Homo sapiens
agagaaaaaccaatga

SEQ ID NO: 2798482 - DNA, 18 bp, Homo sapiens
agagaaaaaccaatgatt

SEQ ID NO: 2798483 - DNA, 19 bp, Homo sapiens
agagaaaagattaaaatta

SEQ ID NO: 2798484 - DNA, 17 bp, Homo sapiens
agagaaagaagagacag

SEQ ID NO: 2798485 - DNA, 18 bp, Homo sapiens
agagaaagtacttctcca

SEQ ID NO: 2798486 - DNA, 21 bp, Homo sapiens
agagaaatttttatttttgaa

SEQ ID NO: 2798487 - DNA, 16 bp, Homo sapiens
agagaacatttctaga

SEQ ID NO: 2798488 - DNA, 12 bp, Homo sapiens
agagaagaggct

SEQ ID NO: 2798489 - DNA, 17 bp, Homo sapiens
agagaaggagatcaggg

SEQ ID NO: 2798490 - DNA, 19 bp, Homo sapiens
agagaagtcagttggagaa

SEQ ID NO: 2798491 - DNA, 22 bp, Homo sapiens
agagaagtcagttggagaaaat

SEQ ID NO: 2798492 - DNA, 13 bp, Homo sapiens
agagaataaagac

SEQ ID NO: 2798493 - DNA, 18 bp, Homo sapiens
agagaatgaaagggccca

SEQ ID NO: 2798494 - DNA, 16 bp, Homo sapiens
agagaattcactttac

SEQ ID NO: 2798495 - DNA, 23 bp, Homo sapiens
agagaatttctaccatttcagag

SEQ ID NO: 2798496 - DNA, 21 bp, Homo sapiens
agagacaaacacctcccagga

SEQ ID NO: 2798497 - DNA, 17 bp, Homo sapiens
agagacaataaaacatt

SEQ ID NO: 2798498 - DNA, 20 bp, Homo sapiens
agagacacctgcacctcccc

SEQ ID NO: 2798499 - DNA, 15 bp, Homo sapiens
agagacaggagggca

SEQ ID NO: 2798500 - DNA, 14 bp, Homo sapiens
agagacccagatct

SEQ ID NO: 2798501 - DNA, 23 bp, Homo sapiens
agagaccctcactgctggggagt

SEQ ID NO: 2798502 - DNA, 13 bp, Homo sapiens
agagactggagca

SEQ ID NO: 2798503 - DNA, 21 bp, Homo sapiens
agagagaaagaagtaggcatg

SEQ ID NO: 2798504 - DNA, 14 bp, Homo sapiens
agagagagaccctc

SEQ ID NO: 2798505 - DNA, 14 bp, Homo sapiens
agagaggaatcaga

SEQ ID NO: 2798506 - DNA, 17 bp, Homo sapiens
agagaggaatcagactt

SEQ ID NO: 2798507 - DNA, 20 bp, Homo sapiens
agagaggccttttggaatgt

SEQ ID NO: 2798508 - DNA, 20 bp, Homo sapiens
agagagggtggtgacctctg

SEQ ID NO: 2798509 - DNA, 20 bp, Homo sapiens
agagaggtggagaactggga

SEQ ID NO: 2798510 - DNA, 15 bp, Homo sapiens
agagaggtgggcagc

SEQ ID NO: 2798511 - DNA, 15 bp, Homo sapiens
agagagtcctctgga

SEQ ID NO: 2798512 - DNA, 16 bp, Homo sapiens
agagagtcctctggat

SEQ ID NO: 2798513 - DNA, 21 bp, Homo sapiens
agagatacattccctatcaaa

SEQ ID NO: 2798514 - DNA, 14 bp, Homo sapiens
agagatatatctga

SEQ ID NO: 2798515 - DNA, 17 bp, Homo sapiens
agagatgactgagtcct

SEQ ID NO: 2798516 - DNA, 23 bp, Homo sapiens
agagatgatcgtgcctataaata

SEQ ID NO: 2798517 - DNA, 22 bp, Homo sapiens
agagatgattcggatttgacaa

SEQ ID NO: 2798518 - DNA, 14 bp, Homo sapiens
agagatgcctccac

SEQ ID NO: 2798519 - DNA, 21 bp, Homo sapiens
agagatgcctccaccgctgcc

SEQ ID NO: 2798520 - DNA, 19 bp, Homo sapiens
agagattaatttgtgtaga

SEQ ID NO: 2798521 - DNA, 17 bp, Homo sapiens
agagcaagactccgtct

SEQ ID NO: 2798522 - DNA, 15 bp, Homo sapiens
actgtaattggtgac

SEQ ID NO: 2798523 - DNA, 22 bp, Homo sapiens
actgtaattggtgacaatgtca

SEQ ID NO: 2798524 - DNA, 14 bp, Homo sapiens
actgtaattttgtt

SEQ ID NO: 2798525 - DNA, 18 bp, Homo sapiens
actgtaattttgtttgta

SEQ ID NO: 2798526 - DNA, 22 bp, Homo sapiens
actgtaattttgtttgtaatcc

SEQ ID NO: 2798527 - DNA, 18 bp, Homo sapiens
actgtagaatgatttcat

SEQ ID NO: 2798528 - DNA, 20 bp, Homo sapiens
actgtagaatgatttcatgc

SEQ ID NO: 2798529 - DNA, 22 bp, Homo sapiens
actgtagcctcgccgtctgtga

SEQ ID NO: 2798530 - DNA, 23 bp, Homo sapiens
actgtccctcaaatgacccaaag

SEQ ID NO: 2798531 - DNA, 17 bp, Homo sapiens
actgtcctacccaccct

SEQ ID NO: 2798532 - DNA, 23 bp, Homo sapiens
actgtcctacccaccctcctttc

SEQ ID NO: 2798533 - DNA, 13 bp, Homo sapiens
actgtcgctgctt

SEQ ID NO: 2798534 - DNA, 18 bp, Homo sapiens
actgtcgtgtttacaaaa

SEQ ID NO: 2798535 - DNA, 17 bp, Homo sapiens
actgtctgtaagagaat

SEQ ID NO: 2798536 - DNA, 17 bp, Homo sapiens
actgtgaagacccagca

SEQ ID NO: 2798537 - DNA, 11 bp, Homo sapiens
actgtgacagg

SEQ ID NO: 2798538 - DNA, 23 bp, Homo sapiens
actgtgatcaggctatgtatgga

SEQ ID NO: 2798539 - DNA, 23 bp, Homo sapiens
actgtgatggggtgggcagggct

SEQ ID NO: 2798540 - DNA, 13 bp, Homo sapiens
actgtgcaggagt

SEQ ID NO: 2798541 - DNA, 20 bp, Homo sapiens
actgtgttcagtgccttgga

SEQ ID NO: 2798542 - DNA, 16 bp, Homo sapiens
actgttactccacagc

SEQ ID NO: 2798543 - DNA, 17 bp, Homo sapiens
actgttactttttagtc

SEQ ID NO: 2798544 - DNA, 12 bp, Homo sapiens
actgttgcccag

SEQ ID NO: 2798545 - DNA, 18 bp, Homo sapiens
actgtttatggtattttc

SEQ ID NO: 2798546 - DNA, 19 bp, Homo sapiens
actgtttatggtattttcg

SEQ ID NO: 2798547 - DNA, 14 bp, Homo sapiens
actgtttcttacct

SEQ ID NO: 2798548 - DNA, 14 bp, Homo sapiens
actgtttttgaaga

SEQ ID NO: 2798549 - DNA, 22 bp, Homo sapiens
actgtttttgaagaagggaaat

SEQ ID NO: 2798550 - DNA, 14 bp, Homo sapiens
acttaaaaaatgtc

SEQ ID NO: 2798551 - DNA, 16 bp, Homo sapiens
acttaaaaaatgtcca

SEQ ID NO: 2798552 - DNA, 22 bp, Homo sapiens
acttaaaatattcctgcatttg

SEQ ID NO: 2798553 - DNA, 12 bp, Homo sapiens
acttaaatcact

SEQ ID NO: 2798554 - DNA, 13 bp, Homo sapiens
acttaaatcactg

SEQ ID NO: 2798555 - DNA, 15 bp, Homo sapiens
acttaacggctccag

SEQ ID NO: 2798556 - DNA, 17 bp, Homo sapiens
acttaacggctccagga

SEQ ID NO: 2798557 - DNA, 19 bp, Homo sapiens
acttaacggctccaggatt

SEQ ID NO: 2798558 - DNA, 21 bp, Homo sapiens
acttaactgtgtgaagaaatg

SEQ ID NO: 2798559 - DNA, 17 bp, Homo sapiens
acttaataaattcagat

SEQ ID NO: 2798560 - DNA, 19 bp, Homo sapiens
acttaattacatccagaaa

SEQ ID NO: 2798561 - DNA, 12 bp, Homo sapiens
acttacatgatt

SEQ ID NO: 2798562 - DNA, 17 bp, Homo sapiens
acttacatgattcattt

SEQ ID NO: 2798563 - DNA, 18 bp, Homo sapiens
acttacatgattcatttt

SEQ ID NO: 2798564 - DNA, 18 bp, Homo sapiens
acttaccaggcaccaaaa

SEQ ID NO: 2798565 - DNA, 22 bp, Homo sapiens
acttaccaggcaccaaaagaag

SEQ ID NO: 2798566 - DNA, 15 bp, Homo sapiens
acttaccttcaataa

SEQ ID NO: 2798567 - DNA, 16 bp, Homo sapiens
acttaccttcaataaa

SEQ ID NO: 2798568 - DNA, 15 bp, Homo sapiens
actcagcagccctcc

SEQ ID NO: 2798569 - DNA, 19 bp, Homo sapiens
actcagcagccctcctcac

SEQ ID NO: 2798570 - DNA, 20 bp, Homo sapiens
actcagcagccctcctcacc

SEQ ID NO: 2798571 - DNA, 22 bp, Homo sapiens
actcagcagccctcctcacccc

SEQ ID NO: 2798572 - DNA, 11 bp, Homo sapiens
actcagccctg

SEQ ID NO: 2798573 - DNA, 14 bp, Homo sapiens
actcagccctgggc

SEQ ID NO: 2798574 - DNA, 16 bp, Homo sapiens
actcagccctgggccc

SEQ ID NO: 2798575 - DNA, 21 bp, Homo sapiens
actcagccctgggccccacca

SEQ ID NO: 2798576 - DNA, 22 bp, Homo sapiens
actcagccctgggccccaccac

SEQ ID NO: 2798577 - DNA, 19 bp, Homo sapiens
actcaggaggctgaggcag

SEQ ID NO: 2798578 - DNA, 22 bp, Homo sapiens
actcaggcccccacctggctca

SEQ ID NO: 2798579 - DNA, 15 bp, Homo sapiens
actcagggccccagc

SEQ ID NO: 2798580 - DNA, 18 bp, Homo sapiens
actcagggccccagcact

SEQ ID NO: 2798581 - DNA, 19 bp, Homo sapiens
actcagtccatagcagaga

SEQ ID NO: 2798582 - DNA, 23 bp, Homo sapiens
actcagtcccccaccacactgaa

SEQ ID NO: 2798583 - DNA, 15 bp, Homo sapiens
actcagtgaggccgc

SEQ ID NO: 2798584 - DNA, 15 bp, Homo sapiens
actcagtttgtcaga

SEQ ID NO: 2798585 - DNA, 13 bp, Homo sapiens
actcatctgttat

SEQ ID NO: 2798586 - DNA, 14 bp, Homo sapiens
actcatctgttatc

SEQ ID NO: 2798587 - DNA, 13 bp, Homo sapiens
actcatttcatct

SEQ ID NO: 2798588 - DNA, 15 bp, Homo sapiens
actcatttcatctca

SEQ ID NO: 2798589 - DNA, 19 bp, Homo sapiens
actcatttttcatgataat

SEQ ID NO: 2798590 - DNA, 23 bp, Homo sapiens
actccaagcttcaagtgatatat

SEQ ID NO: 2798591 - DNA, 21 bp, Homo sapiens
actccacagcggaggagacca

SEQ ID NO: 2798592 - DNA, 23 bp, Homo sapiens
actccacagcggaggagaccagc

SEQ ID NO: 2798593 - DNA, 13 bp, Homo sapiens
actccaccaccca

SEQ ID NO: 2798594 - DNA, 12 bp, Homo sapiens
actccagccagc

SEQ ID NO: 2798595 - DNA, 16 bp, Homo sapiens
actccagccagcgcct

SEQ ID NO: 2798596 - DNA, 19 bp, Homo sapiens
actccagccagcgcctccc

SEQ ID NO: 2798597 - DNA, 13 bp, Homo sapiens
actccagcctgag

SEQ ID NO: 2798598 - DNA, 14 bp, Homo sapiens
actccagcctgagc

SEQ ID NO: 2798599 - DNA, 17 bp, Homo sapiens
actccaggaaaactgtt

SEQ ID NO: 2798600 - DNA, 16 bp, Homo sapiens
actccatacataactt

SEQ ID NO: 2798601 - DNA, 18 bp, Homo sapiens
actccattactaaagaca

SEQ ID NO: 2798602 - DNA, 17 bp, Homo sapiens
actcccagaccacctcc

SEQ ID NO: 2798603 - DNA, 20 bp, Homo sapiens
actcccagaccacctccctg

SEQ ID NO: 2798604 - DNA, 10 bp, Homo sapiens
actccctccc

SEQ ID NO: 2798605 - DNA, 18 bp, Homo sapiens
actccctggctctcagaa

SEQ ID NO: 2798606 - DNA, 20 bp, Homo sapiens
actccggtgtgcctgcagcc

SEQ ID NO: 2798607 - DNA, 16 bp, Homo sapiens
actcctacctcagcct

SEQ ID NO: 2798608 - DNA, 19 bp, Homo sapiens
actcctcactgccccacca

SEQ ID NO: 2798609 - DNA, 22 bp, Homo sapiens
actcctcactgccccaccagcc

SEQ ID NO: 2798610 - DNA, 12 bp, Homo sapiens
actcctcccaca

SEQ ID NO: 2798611 - DNA, 13 bp, Homo sapiens
actcctcccacaa

SEQ ID NO: 2798612 - DNA, 21 bp, Homo sapiens
actcctctaagccactcttcc

SEQ ID NO: 2798613 - DNA, 13 bp, Homo sapiens
actcctctgtcca

SEQ ID NO: 2798614 - DNA, 14 bp, Homo sapiens
actcctctgtccag

SEQ ID NO: 2798615 - DNA, 16 bp, Homo sapiens
actcctctgtctctgc

SEQ ID NO: 2798616 - DNA, 23 bp, Homo sapiens
actcctctgtctctgctcttgcc

SEQ ID NO: 2798617 - DNA, 14 bp, Homo sapiens
actcctgccctgtt

SEQ ID NO: 2798618 - DNA, 16 bp, Homo sapiens
actcctggaagctgtg

SEQ ID NO: 2798619 - DNA, 12 bp, Homo sapiens
actcctggcctc

SEQ ID NO: 2798620 - DNA, 13 bp, Homo sapiens
actcctggcctca

SEQ ID NO: 2798621 - DNA, 14 bp, Homo sapiens
actcctggcctcaa

SEQ ID NO: 2798622 - DNA, 19 bp, Homo sapiens
actcctgtgggagcctcgc

SEQ ID NO: 2798623 - DNA, 20 bp, Homo sapiens
actcctgttacttacctaaa

SEQ ID NO: 2798624 - DNA, 22 bp, Homo sapiens
actccttcaacaattctaaaat

SEQ ID NO: 2798625 - DNA, 12 bp, Homo sapiens
actccttccagc

SEQ ID NO: 2798626 - DNA, 13 bp, Homo sapiens
actccttcctgcc

SEQ ID NO: 2798627 - DNA, 21 bp, Homo sapiens
actccttgtggtttatgtcat

SEQ ID NO: 2798628 - DNA, 19 bp, Homo sapiens
actcctttgcattccatga

SEQ ID NO: 2798629 - DNA, 20 bp, Homo sapiens
actcctttgcattccatgat

SEQ ID NO: 2798630 - DNA, 17 bp, Homo sapiens
actcgaagcccttccag

SEQ ID NO: 2798631 - DNA, 22 bp, Homo sapiens
actcgaagcccttccagtggta

SEQ ID NO: 2798632 - DNA, 15 bp, Homo sapiens
actcgatgaatgtgt

SEQ ID NO: 2798633 - DNA, 22 bp, Homo sapiens
actcggcctcccaaagtgctgg

SEQ ID NO: 2798634 - DNA, 22 bp, Homo sapiens
actcgggaggctgagacaggag

SEQ ID NO: 2798635 - DNA, 22 bp, Homo sapiens
actctaattcccattttgcaaa

SEQ ID NO: 2798636 - DNA, 22 bp, Homo sapiens
actctaccctggtaggaaagca

SEQ ID NO: 2798637 - DNA, 23 bp, Homo sapiens
actctaccctggtaggaaagcac

SEQ ID NO: 2798638 - DNA, 20 bp, Homo sapiens
actctactgcaagacttaaa

SEQ ID NO: 2798639 - DNA, 20 bp, Homo sapiens
actctagaacatgcacattt

SEQ ID NO: 2798640 - DNA, 16 bp, Homo sapiens
actctagcctggcaac

SEQ ID NO: 2798641 - DNA, 21 bp, Homo sapiens
actctcattccccaggtggct

SEQ ID NO: 2798642 - DNA, 14 bp, Homo sapiens
actctccaacctgg

SEQ ID NO: 2798643 - DNA, 11 bp, Homo sapiens
actctcccctc

SEQ ID NO: 2798644 - DNA, 23 bp, Homo sapiens
actctctaaatcttccttgtgag

SEQ ID NO: 2798645 - DNA, 13 bp, Homo sapiens
actctctccaccc

SEQ ID NO: 2798646 - DNA, 21 bp, Homo sapiens
actctgcacatgtcttgtaca

SEQ ID NO: 2798647 - DNA, 16 bp, Homo sapiens
actctgcattctagta

SEQ ID NO: 2798648 - DNA, 11 bp, Homo sapiens
actctgctctg

SEQ ID NO: 2798649 - DNA, 13 bp, Homo sapiens
actctggcagcca

SEQ ID NO: 2798650 - DNA, 14 bp, Homo sapiens
actctggcagccac

SEQ ID NO: 2798651 - DNA, 16 bp, Homo sapiens
actctggcagccacac

SEQ ID NO: 2798652 - DNA, 15 bp, Homo sapiens
actctggcttccagg

SEQ ID NO: 2798653 - DNA, 23 bp, Homo sapiens
actctgtcaatttccctgactcc

SEQ ID NO: 2798654 - DNA, 14 bp, Homo sapiens
actctgtcagatgg

SEQ ID NO: 2798655 - DNA, 16 bp, Homo sapiens
actctgtcagatggga

SEQ ID NO: 2798656 - DNA, 15 bp, Homo sapiens
actctgtgccagagc

SEQ ID NO: 2798657 - DNA, 18 bp, Homo sapiens
actctgtgccagagcctg

SEQ ID NO: 2798658 - DNA, 15 bp, Homo sapiens
cagagacacctgcac

SEQ ID NO: 2798659 - DNA, 16 bp, Homo sapiens
cagagacacctgcacc

SEQ ID NO: 2798660 - DNA, 22 bp, Homo sapiens
cagagacacctgcacctccccc

SEQ ID NO: 2798661 - DNA, 13 bp, Homo sapiens
cagagacaggaaa

SEQ ID NO: 2798662 - DNA, 23 bp, Homo sapiens
cagagacaggaaaatcctctggc

SEQ ID NO: 2798663 - DNA, 19 bp, Homo sapiens
cagagacccagatctcatg

SEQ ID NO: 2798664 - DNA, 15 bp, Homo sapiens
cagagaccccttcct

SEQ ID NO: 2798665 - DNA, 22 bp, Homo sapiens
cagagactcagggccccagcac

SEQ ID NO: 2798666 - DNA, 20 bp, Homo sapiens
cagagaggccttttggaatg

SEQ ID NO: 2798667 - DNA, 17 bp, Homo sapiens
cagagaggggacatttc

SEQ ID NO: 2798668 - DNA, 19 bp, Homo sapiens
cagagaggggacatttccc

SEQ ID NO: 2798669 - DNA, 20 bp, Homo sapiens
cagagaggggacatttccct

SEQ ID NO: 2798670 - DNA, 21 bp, Homo sapiens
cagagaggtggagaactggga

SEQ ID NO: 2798671 - DNA, 15 bp, Homo sapiens
cagagatgcctccac

SEQ ID NO: 2798672 - DNA, 14 bp, Homo sapiens
cagagcaaaataat

SEQ ID NO: 2798673 - DNA, 18 bp, Homo sapiens
cagagcaagatcctgtct

SEQ ID NO: 2798674 - DNA, 13 bp, Homo sapiens
cagagcagagagc

SEQ ID NO: 2798675 - DNA, 15 bp, Homo sapiens
cagagcaggggcagg

SEQ ID NO: 2798676 - DNA, 19 bp, Homo sapiens
cagagcattacgtgagcca

SEQ ID NO: 2798677 - DNA, 23 bp, Homo sapiens
cagagcattacgtgagccaggta

SEQ ID NO: 2798678 - DNA, 15 bp, Homo sapiens
cagagcccaccttgg

SEQ ID NO: 2798679 - DNA, 19 bp, Homo sapiens
cagagcccaccttggctca

SEQ ID NO: 2798680 - DNA, 20 bp, Homo sapiens
cagagcccaccttggctcaa

SEQ ID NO: 2798681 - DNA, 22 bp, Homo sapiens
cagagcccagggcatcccatgg

SEQ ID NO: 2798682 - DNA, 15 bp, Homo sapiens
cagagcccatgctca

SEQ ID NO: 2798683 - DNA, 16 bp, Homo sapiens
cagagccccacacgga

SEQ ID NO: 2798684 - DNA, 12 bp, Homo sapiens
cagagcctgcag

SEQ ID NO: 2798685 - DNA, 14 bp, Homo sapiens
cagagcctgcagtt

SEQ ID NO: 2798686 - DNA, 23 bp, Homo sapiens
cagagccttcacaaccagccaca

SEQ ID NO: 2798687 - DNA, 15 bp, Homo sapiens
cagagccttctcctg

SEQ ID NO: 2798688 - DNA, 19 bp, Homo sapiens
cagagccttctcctgccta

SEQ ID NO: 2798689 - DNA, 18 bp, Homo sapiens
cagagcctttggatgacc

SEQ ID NO: 2798690 - DNA, 19 bp, Homo sapiens
cagagcctttggatgacca

SEQ ID NO: 2798691 - DNA, 15 bp, Homo sapiens
cagagctcccttcct

SEQ ID NO: 2798692 - DNA, 9 bp, Homo sapiens
cagagctgg

SEQ ID NO: 2798693 - DNA, 13 bp, Homo sapiens
cagagctggaaca

SEQ ID NO: 2798694 - DNA, 12 bp, Homo sapiens
cagaggaagagc

SEQ ID NO: 2798695 - DNA, 17 bp, Homo sapiens
cagaggagtccagggcg

SEQ ID NO: 2798696 - DNA, 13 bp, Homo sapiens
cagaggcagcccc

SEQ ID NO: 2798697 - DNA, 15 bp, Homo sapiens
cagaggcagccccat

SEQ ID NO: 2798698 - DNA, 19 bp, Homo sapiens
cagaggcagccccattctg

SEQ ID NO: 2798699 - DNA, 15 bp, Homo sapiens
cagaaaccagttatg

SEQ ID NO: 2798700 - DNA, 21 bp, Homo sapiens
cagaaaggatgttttgtccca

SEQ ID NO: 2798701 - DNA, 15 bp, Homo sapiens
cagaaagggagggct

SEQ ID NO: 2798702 - DNA, 22 bp, Homo sapiens
cagaaagggagggctctgaggc

SEQ ID NO: 2798703 - DNA, 20 bp, Homo sapiens
cagaacaaacctctatatgt

SEQ ID NO: 2798704 - DNA, 14 bp, Homo sapiens
cagaacagcagagg

SEQ ID NO: 2798705 - DNA, 20 bp, Homo sapiens
cagaacagccgctcctgtct

SEQ ID NO: 2798706 - DNA, 21 bp, Homo sapiens
cagaacatagacagaagaaac

SEQ ID NO: 2798707 - DNA, 14 bp, Homo sapiens
cagaacatcctcca

SEQ ID NO: 2798708 - DNA, 16 bp, Homo sapiens
cagaacatcctccaat

SEQ ID NO: 2798709 - DNA, 23 bp, Homo sapiens
cagaacccctacatgaaacagaa

SEQ ID NO: 2798710 - DNA, 17 bp, Homo sapiens
cagaactgcttactagc

SEQ ID NO: 2798711 - DNA, 18 bp, Homo sapiens
cagaagaatatgacagct

SEQ ID NO: 2798712 - DNA, 18 bp, Homo sapiens
cagaagaatattcaggac

SEQ ID NO: 2798713 - DNA, 19 bp, Homo sapiens
cagaagaatattcaggact

SEQ ID NO: 2798714 - DNA, 20 bp, Homo sapiens
cagaagaatattcaggactt

SEQ ID NO: 2798715 - DNA, 21 bp, Homo sapiens
cagaagacactgatgggcaac

SEQ ID NO: 2798716 - DNA, 20 bp, Homo sapiens
cagaagagatgggcttgttt

SEQ ID NO: 2798717 - DNA, 14 bp, Homo sapiens
cagaagccaaattt

SEQ ID NO: 2798718 - DNA, 15 bp, Homo sapiens
cagaagccaggagca

SEQ ID NO: 2798719 - DNA, 17 bp, Homo sapiens
cagaagccaggagcaaa

SEQ ID NO: 2798720 - DNA, 19 bp, Homo sapiens
cagaagccaggagcaaatg

SEQ ID NO: 2798721 - DNA, 23 bp, Homo sapiens
cagaagcccatggagcagggatg

SEQ ID NO: 2798722 - DNA, 14 bp, Homo sapiens
cagaagcctggggg

SEQ ID NO: 2798723 - DNA, 22 bp, Homo sapiens
cagaagcctgggggcctggctg

SEQ ID NO: 2798724 - DNA, 14 bp, Homo sapiens
cagaaggaatctgt

SEQ ID NO: 2798725 - DNA, 18 bp, Homo sapiens
cagaaggaatctgtgcag

SEQ ID NO: 2798726 - DNA, 13 bp, Homo sapiens
cagaaggcaggga

SEQ ID NO: 2798727 - DNA, 20 bp, Homo sapiens
cagaaggggcacgcctgccc

SEQ ID NO: 2798728 - DNA, 14 bp, Homo sapiens
cagaagtgcaaagg

SEQ ID NO: 2798729 - DNA, 15 bp, Homo sapiens
cagaatcataatttt

SEQ ID NO: 2798730 - DNA, 18 bp, Homo sapiens
cagaatcataattttcaa

SEQ ID NO: 2798731 - DNA, 18 bp, Homo sapiens
cagaatgaggaataataa

SEQ ID NO: 2798732 - DNA, 14 bp, Homo sapiens
cagaatgtatatta

SEQ ID NO: 2798733 - DNA, 21 bp, Homo sapiens
cagaatgtcattttggtactt

SEQ ID NO: 2798734 - DNA, 15 bp, Homo sapiens
cagaattcccagctg

SEQ ID NO: 2798735 - DNA, 21 bp, Homo sapiens
cagaattctgctacctcactg

SEQ ID NO: 2798736 - DNA, 16 bp, Homo sapiens
cagaattgaaggagaa

SEQ ID NO: 2798737 - DNA, 12 bp, Homo sapiens
cagaattttacc

SEQ ID NO: 2798738 - DNA, 17 bp, Homo sapiens
cagaggcagctgtgtgg

SEQ ID NO: 2798739 - DNA, 16 bp, Homo sapiens
cagaggccatgggcct

SEQ ID NO: 2798740 - DNA, 20 bp, Homo sapiens
cagaggccatgggcctcctg

SEQ ID NO: 2798741 - DNA, 13 bp, Homo sapiens
cagaggctgcagg

SEQ ID NO: 2798742 - DNA, 14 bp, Homo sapiens
cagaggctggaggc

SEQ ID NO: 2798743 - DNA, 16 bp, Homo sapiens
cagaggctggaggcag

SEQ ID NO: 2798744 - DNA, 21 bp, Homo sapiens
cagaggctggaggcagggcct

SEQ ID NO: 2798745 - DNA, 20 bp, Homo sapiens
cagaggcttcttcagatcag

SEQ ID NO: 2798746 - DNA, 22 bp, Homo sapiens
cagagggagtgacagaggcagc

SEQ ID NO: 2798747 - DNA, 16 bp, Homo sapiens
cagagggcccaggcag

SEQ ID NO: 2798748 - DNA, 23 bp, Homo sapiens
cagaggggaaaccagtgtagcct

SEQ ID NO: 2798749 - DNA, 23 bp, Homo sapiens
cagaggggccccggtcctggccc

SEQ ID NO: 2798750 - DNA, 18 bp, Homo sapiens
cagaggggctttctggag

SEQ ID NO: 2798751 - DNA, 17 bp, Homo sapiens
cagagggttgtgatttt

SEQ ID NO: 2798752 - DNA, 20 bp, Homo sapiens
cagaggtaaaagtgtgagca

SEQ ID NO: 2798753 - DNA, 14 bp, Homo sapiens
cagaggtgagcaga

SEQ ID NO: 2798754 - DNA, 17 bp, Homo sapiens
cagaggtgagcagagga

SEQ ID NO: 2798755 - DNA, 15 bp, Homo sapiens
cagagtatatatgta

SEQ ID NO: 2798756 - DNA, 18 bp, Homo sapiens
cagagtatatatgtacag

SEQ ID NO: 2798757 - DNA, 19 bp, Homo sapiens
cagagtctcactgttgccc

SEQ ID NO: 2798758 - DNA, 20 bp, Homo sapiens
cagagtctcactgttgccca

SEQ ID NO: 2798759 - DNA, 22 bp, Homo sapiens
cagagtctcactgttgcccagg

SEQ ID NO: 2798760 - DNA, 23 bp, Homo sapiens
cagagtctcactgttgcccaggc

SEQ ID NO: 2798761 - DNA, 17 bp, Homo sapiens
cagagtgattcaggggc

SEQ ID NO: 2798762 - DNA, 19 bp, Homo sapiens
cagagtgtgggaagggaga

SEQ ID NO: 2798763 - DNA, 16 bp, Homo sapiens
cagataatcagcctct

SEQ ID NO: 2798764 - DNA, 17 bp, Homo sapiens
cagataatcagcctctt

SEQ ID NO: 2798765 - DNA, 18 bp, Homo sapiens
cagatataaatggctggt

SEQ ID NO: 2798766 - DNA, 16 bp, Homo sapiens
cagatatatttttcac

SEQ ID NO: 2798767 - DNA, 15 bp, Homo sapiens
cagatatgatatgta

SEQ ID NO: 2798768 - DNA, 21 bp, Homo sapiens
cagatatttccatttcttcct

SEQ ID NO: 2798769 - DNA, 20 bp, Homo sapiens
cagatattttttcagaaata

SEQ ID NO: 2798770 - DNA, 23 bp, Homo sapiens
cagatcccatccatcagctccct

SEQ ID NO: 2798771 - DNA, 15 bp, Homo sapiens
cagatcgtattaatt

SEQ ID NO: 2798772 - DNA, 17 bp, Homo sapiens
cagatcgtattaattat

SEQ ID NO: 2798773 - DNA, 22 bp, Homo sapiens
cagatctcatggaaactggcca

SEQ ID NO: 2798774 - DNA, 16 bp, Homo sapiens
cagatctttttgtgaa

SEQ ID NO: 2798775 - DNA, 14 bp, Homo sapiens
cagatgagaagtta

SEQ ID NO: 2798776 - DNA, 18 bp, Homo sapiens
cagatgagcagtcacact

SEQ ID NO: 2798777 - DNA, 20 bp, Homo sapiens
cagatgagcagtcacactgt

SEQ ID NO: 2798778 - DNA, 23 bp, Homo sapiens
cagatgagcagtcacactgttac

SEQ ID NO: 2798779 - DNA, 16 bp, Homo sapiens
cagatgcaccccaaca

SEQ ID NO: 2798780 - DNA, 22 bp, Homo sapiens
cagatgcccagagggcccaggc

SEQ ID NO: 2798781 - DNA, 17 bp, Homo sapiens
cagatgggtattaaact

SEQ ID NO: 2798782 - DNA, 15 bp, Homo sapiens
cagatgtaggaggga

SEQ ID NO: 2798783 - DNA, 20 bp, Homo sapiens
cagatgtggagtctgtgtct

SEQ ID NO: 2798784 - DNA, 18 bp, Homo sapiens
cagattacttcagggctg

SEQ ID NO: 2798785 - DNA, 17 bp, Homo sapiens
cagattgcaacaggctg

SEQ ID NO: 2798786 - DNA, 16 bp, Homo sapiens
cagatttttacacatg

SEQ ID NO: 2798787 - DNA, 17 bp, Homo sapiens
cagcaaagtgtcagtgt

SEQ ID NO: 2798788 - DNA, 17 bp, Homo sapiens
cagcaacacaagctgga

SEQ ID NO: 2798789 - DNA, 20 bp, Homo sapiens
cagcaacaggaatctcagag

SEQ ID NO: 2798790 - DNA, 21 bp, Homo sapiens
cagcaacaggaatctcagaga

SEQ ID NO: 2798791 - DNA, 17 bp, Homo sapiens
cagcaagagcacaagag

SEQ ID NO: 2798792 - DNA, 15 bp, Homo sapiens
cagcaaggcccgagc

SEQ ID NO: 2798793 - DNA, 22 bp, Homo sapiens
cagcaaggcccgagcagctgag

SEQ ID NO: 2798794 - DNA, 14 bp, Homo sapiens
cagcaagtgagagc

SEQ ID NO: 2798795 - DNA, 16 bp, Homo sapiens
cagcaagtgagagctg

SEQ ID NO: 2798796 - DNA, 23 bp, Homo sapiens
cagcacagaaggaatctgtgcag

SEQ ID NO: 2798797 - DNA, 14 bp, Homo sapiens
cagcaccagaatgt

SEQ ID NO: 2798798 - DNA, 14 bp, Homo sapiens
cagcaccctgcaga

SEQ ID NO: 2798799 - DNA, 14 bp, Homo sapiens
cagcactaaagcag

SEQ ID NO: 2798800 - DNA, 10 bp, Homo sapiens
cagcactaac

SEQ ID NO: 2798801 - DNA, 11 bp, Homo sapiens
cagcactgtga

SEQ ID NO: 2798802 - DNA, 22 bp, Homo sapiens
cagcactgtgaagacccagcag

SEQ ID NO: 2798803 - DNA, 18 bp, Homo sapiens
cagcactttgggaggctg

SEQ ID NO: 2798804 - DNA, 22 bp, Homo sapiens
cagcactttgggaggctgaggc

SEQ ID NO: 2798805 - DNA, 23 bp, Homo sapiens
cagcactttgggaggctgaggcg

SEQ ID NO: 2798806 - DNA, 14 bp, Homo sapiens
cagcagaaaagtgc

SEQ ID NO: 2798807 - DNA, 11 bp, Homo sapiens
cagcagaagcc

SEQ ID NO: 2798808 - DNA, 15 bp, Homo sapiens
cagcagactcagctc

SEQ ID NO: 2798809 - DNA, 21 bp, Homo sapiens
cagcagactcagctctgacat

SEQ ID NO: 2798810 - DNA, 17 bp, Homo sapiens
cagcagatggaaagaaa

SEQ ID NO: 2798811 - DNA, 13 bp, Homo sapiens
cagcagccagccc

SEQ ID NO: 2798812 - DNA, 20 bp, Homo sapiens
cagcagccagccctgcctgg

SEQ ID NO: 2798813 - DNA, 22 bp, Homo sapiens
cagcagccagccctgcctggag

SEQ ID NO: 2798814 - DNA, 23 bp, Homo sapiens
cagcagccagccctgcctggagg

SEQ ID NO: 2798815 - DNA, 13 bp, Homo sapiens
cagcagccagctc

SEQ ID NO: 2798816 - DNA, 14 bp, Homo sapiens
cagcagccagctct

SEQ ID NO: 2798817 - DNA, 15 bp, Homo sapiens
cagcagccagctctc

SEQ ID NO: 2798818 - DNA, 18 bp, Homo sapiens
cagcagccagctctcagc

SEQ ID NO: 2798819 - DNA, 16 bp, Homo sapiens
cagcagcccctgcaca

SEQ ID NO: 2798820 - DNA, 11 bp, Homo sapiens
cagcagcccta

SEQ ID NO: 2798821 - DNA, 23 bp, Homo sapiens
cagcagccctaaggatctctcag

SEQ ID NO: 2798822 - DNA, 12 bp, Homo sapiens
cagcagccctcc

SEQ ID NO: 2798823 - DNA, 19 bp, Homo sapiens
cagcagccctcctcacccc

SEQ ID NO: 2798824 - DNA, 17 bp, Homo sapiens
cagcagctcagcctccc

SEQ ID NO: 2798825 - DNA, 15 bp, Homo sapiens
cagcagctcaggcac

SEQ ID NO: 2798826 - DNA, 18 bp, Homo sapiens
cagcagctgaacagccaa

SEQ ID NO: 2798827 - DNA, 17 bp, Homo sapiens
cagcagcttttaataca

SEQ ID NO: 2798828 - DNA, 17 bp, Homo sapiens
caaggcccgagcagctg

SEQ ID NO: 2798829 - DNA, 20 bp, Homo sapiens
caaggccctctatttctctc

SEQ ID NO: 2798830 - DNA, 21 bp, Homo sapiens
caaggctcttctccttggagg

SEQ ID NO: 2798831 - DNA, 14 bp, Homo sapiens
caagggccatgctg

SEQ ID NO: 2798832 - DNA, 20 bp, Homo sapiens
caagggccatgctgaaggga

SEQ ID NO: 2798833 - DNA, 23 bp, Homo sapiens
caaggggaatgtttgcctctgcc

SEQ ID NO: 2798834 - DNA, 16 bp, Homo sapiens
caagggtctagggaga

SEQ ID NO: 2798835 - DNA, 18 bp, Homo sapiens
caaggtgggctgagccct

SEQ ID NO: 2798836 - DNA, 19 bp, Homo sapiens
caaggtgggctgagccctg

SEQ ID NO: 2798837 - DNA, 15 bp, Homo sapiens
caaggttccctctga

SEQ ID NO: 2798838 - DNA, 17 bp, Homo sapiens
caaggttccctctgaga

SEQ ID NO: 2798839 - DNA, 19 bp, Homo sapiens
caaggttccctctgagaat

SEQ ID NO: 2798840 - DNA, 15 bp, Homo sapiens
caaggttcttctaaa

SEQ ID NO: 2798841 - DNA, 17 bp, Homo sapiens
caagtataaagtcagga

SEQ ID NO: 2798842 - DNA, 20 bp, Homo sapiens
caagtatttgttaatttaga

SEQ ID NO: 2798843 - DNA, 22 bp, Homo sapiens
caagtatttgttaatttagaaa

SEQ ID NO: 2798844 - DNA, 20 bp, Homo sapiens
caagtccctgactctctgtg

SEQ ID NO: 2798845 - DNA, 14 bp, Homo sapiens
caagtcctcttttc

SEQ ID NO: 2798846 - DNA, 13 bp, Homo sapiens
caagtctgcagcc

SEQ ID NO: 2798847 - DNA, 13 bp, Homo sapiens
caagtctggatct

SEQ ID NO: 2798848 - DNA, 14 bp, Homo sapiens
caagtcttccctga

SEQ ID NO: 2798849 - DNA, 13 bp, Homo sapiens
caagtgaatctaa

SEQ ID NO: 2798850 - DNA, 16 bp, Homo sapiens
caagtgacatctcttt

SEQ ID NO: 2798851 - DNA, 21 bp, Homo sapiens
caagtgacctatacctgtgtt

SEQ ID NO: 2798852 - DNA, 16 bp, Homo sapiens
caagtgatatatgtat

SEQ ID NO: 2798853 - DNA, 20 bp, Homo sapiens
caagtgatatatgtatttat

SEQ ID NO: 2798854 - DNA, 16 bp, Homo sapiens
caagtgattctcctgc

SEQ ID NO: 2798855 - DNA, 19 bp, Homo sapiens
caagtgattgaaaatagta

SEQ ID NO: 2798856 - DNA, 19 bp, Homo sapiens
caagtgcatgctctctgca

SEQ ID NO: 2798857 - DNA, 22 bp, Homo sapiens
caagtgtggtagggacttaaaa

SEQ ID NO: 2798858 - DNA, 23 bp, Homo sapiens
caagtgtgttgggaattgcatgc

SEQ ID NO: 2798859 - DNA, 14 bp, Homo sapiens
caagttagctcagg

SEQ ID NO: 2798860 - DNA, 16 bp, Homo sapiens
caagttagctcaggag

SEQ ID NO: 2798861 - DNA, 20 bp, Homo sapiens
caagttataaatcaatgtca

SEQ ID NO: 2798862 - DNA, 21 bp, Homo sapiens
caagttctagagaagaggctg

SEQ ID NO: 2798863 - DNA, 18 bp, Homo sapiens
caagttgaaatcagaagc

SEQ ID NO: 2798864 - DNA, 19 bp, Homo sapiens
caagtttttacaaaatact

SEQ ID NO: 2798865 - DNA, 18 bp, Homo sapiens
caataaaaatctttgatt

SEQ ID NO: 2798866 - DNA, 11 bp, Homo sapiens
caataaaagtg

SEQ ID NO: 2798867 - DNA, 13 bp, Homo sapiens
caataaaagtgac

SEQ ID NO: 2798868 - DNA, 18 bp, Homo sapiens
caataaaagtgactctca

SEQ ID NO: 2798869 - DNA, 14 bp, Homo sapiens
caataaaatagtat

SEQ ID NO: 2798870 - DNA, 20 bp, Homo sapiens
caataaaatcttgaaaatgc

SEQ ID NO: 2798871 - DNA, 15 bp, Homo sapiens
caataaaattttcaa

SEQ ID NO: 2798872 - DNA, 20 bp, Homo sapiens
caataaaattttcaaacttt

SEQ ID NO: 2798873 - DNA, 14 bp, Homo sapiens
caataaagagctca

SEQ ID NO: 2798874 - DNA, 13 bp, Homo sapiens
caataaagctgga

SEQ ID NO: 2798875 - DNA, 12 bp, Homo sapiens
caataaagtatc

SEQ ID NO: 2798876 - DNA, 14 bp, Homo sapiens
caataaatgtctgt

SEQ ID NO: 2798877 - DNA, 15 bp, Homo sapiens
caataaatgtctgtt

SEQ ID NO: 2798878 - DNA, 17 bp, Homo sapiens
caataaatgtgcttatg

SEQ ID NO: 2798879 - DNA, 21 bp, Homo sapiens
caataacttcagagaagtcag

SEQ ID NO: 2798880 - DNA, 18 bp, Homo sapiens
caataaggtcaatgccag

SEQ ID NO: 2798881 - DNA, 17 bp, Homo sapiens
caataattaggatctat

SEQ ID NO: 2798882 - DNA, 14 bp, Homo sapiens
caataatttcaggt

SEQ ID NO: 2798883 - DNA, 23 bp, Homo sapiens
caataccccaagtccacctgcct

SEQ ID NO: 2798884 - DNA, 14 bp, Homo sapiens
caatacttcatgat

SEQ ID NO: 2798885 - DNA, 23 bp, Homo sapiens
caatagactgtacttattttcca

SEQ ID NO: 2798886 - DNA, 16 bp, Homo sapiens
caatagctattgcatg

SEQ ID NO: 2798887 - DNA, 21 bp, Homo sapiens
caatagctattgcatgtaaaa

SEQ ID NO: 2798888 - DNA, 16 bp, Homo sapiens
caatataaattggctt

SEQ ID NO: 2798889 - DNA, 22 bp, Homo sapiens
caatatgtattaatattcattg

SEQ ID NO: 2798890 - DNA, 12 bp, Homo sapiens
caatattaaata

SEQ ID NO: 2798891 - DNA, 15 bp, Homo sapiens
caatattaaatacag

SEQ ID NO: 2798892 - DNA, 14 bp, Homo sapiens
caatattataattt

SEQ ID NO: 2798893 - DNA, 13 bp, Homo sapiens
caatattcaaatg

SEQ ID NO: 2798894 - DNA, 15 bp, Homo sapiens
caatattcaaatgcg

SEQ ID NO: 2798895 - DNA, 19 bp, Homo sapiens
caatatttattattttcac

SEQ ID NO: 2798896 - DNA, 11 bp, Homo sapiens
caatattttcc

SEQ ID NO: 2798897 - DNA, 13 bp, Homo sapiens
caatattttccat

SEQ ID NO: 2798898 - DNA, 19 bp, Homo sapiens
caatattttccatgaaaat

SEQ ID NO: 2798899 - DNA, 22 bp, Homo sapiens
caatattttccatgaaaatgca

SEQ ID NO: 2798900 - DNA, 17 bp, Homo sapiens
caatcctaacacattat

SEQ ID NO: 2798901 - DNA, 22 bp, Homo sapiens
caatcctaacacattatcggga

SEQ ID NO: 2798902 - DNA, 13 bp, Homo sapiens
caatcctctaagc

SEQ ID NO: 2798903 - DNA, 14 bp, Homo sapiens
caatctctgtgact

SEQ ID NO: 2798904 - DNA, 15 bp, Homo sapiens
caatctctgtgactc

SEQ ID NO: 2798905 - DNA, 20 bp, Homo sapiens
caatctctgtgactcgctta

SEQ ID NO: 2798906 - DNA, 18 bp, Homo sapiens
caatctgggactttcact

SEQ ID NO: 2798907 - DNA, 23 bp, Homo sapiens
caatgaaatacacaagtaaacat

SEQ ID NO: 2798908 - DNA, 19 bp, Homo sapiens
caatgaaatgctctccttt

SEQ ID NO: 2798909 - DNA, 19 bp, Homo sapiens
caatgacatcttcaaagct

SEQ ID NO: 2798910 - DNA, 18 bp, Homo sapiens
caatgaggtctgaaatgg

SEQ ID NO: 2798911 - DNA, 21 bp, Homo sapiens
caatgatgattaaacacctga

SEQ ID NO: 2798912 - DNA, 13 bp, Homo sapiens
caatgatggcaat

SEQ ID NO: 2798913 - DNA, 15 bp, Homo sapiens
caatgattcataaca

SEQ ID NO: 2798914 - DNA, 12 bp, Homo sapiens
caatgctggctg

SEQ ID NO: 2798915 - DNA, 23 bp, Homo sapiens
caatgctggctgttggctggggg

SEQ ID NO: 2798916 - DNA, 17 bp, Homo sapiens
caatggagttcagagat

SEQ ID NO: 2798917 - DNA, 16 bp, Homo sapiens
caatggcagccttggc

SEQ ID NO: 2798918 - DNA, 14 bp, Homo sapiens
cacattcaggaaga

SEQ ID NO: 2798919 - DNA, 22 bp, Homo sapiens
cacattcttaacacatgtcctt

SEQ ID NO: 2798920 - DNA, 20 bp, Homo sapiens
cacattggcagtgtgtcaca

SEQ ID NO: 2798921 - DNA, 21 bp, Homo sapiens
cacatttatatatatatgtat

SEQ ID NO: 2798922 - DNA, 18 bp, Homo sapiens
cacatttgatgtacatgt

SEQ ID NO: 2798923 - DNA, 20 bp, Homo sapiens
cacatttgatgtacatgtgt

SEQ ID NO: 2798924 - DNA, 23 bp, Homo sapiens
caccaacatcccattgccctggt

SEQ ID NO: 2798925 - DNA, 12 bp, Homo sapiens
caccaagcccag

SEQ ID NO: 2798926 - DNA, 15 bp, Homo sapiens
caccaagcccagtta

SEQ ID NO: 2798927 - DNA, 14 bp, Homo sapiens
caccaagctcacag

SEQ ID NO: 2798928 - DNA, 15 bp, Homo sapiens
caccaagctcacagt

SEQ ID NO: 2798929 - DNA, 15 bp, Homo sapiens
caccaaggtcttcag

SEQ ID NO: 2798930 - DNA, 20 bp, Homo sapiens
caccaaggtcttcagccatc

SEQ ID NO: 2798931 - DNA, 21 bp, Homo sapiens
caccaaggtcttcagccatca

SEQ ID NO: 2798932 - DNA, 12 bp, Homo sapiens
caccaataactt

SEQ ID NO: 2798933 - DNA, 23 bp, Homo sapiens
caccaataacttcagagaagtca

SEQ ID NO: 2798934 - DNA, 16 bp, Homo sapiens
caccacctcactcctg

SEQ ID NO: 2798935 - DNA, 17 bp, Homo sapiens
caccacctcactcctgt

SEQ ID NO: 2798936 - DNA, 14 bp, Homo sapiens
caccaccttcccag

SEQ ID NO: 2798937 - DNA, 19 bp, Homo sapiens
caccaccttcccagctctc

SEQ ID NO: 2798938 - DNA, 21 bp, Homo sapiens
caccaccttcccagctctccc

SEQ ID NO: 2798939 - DNA, 15 bp, Homo sapiens
caccacgatgtggcc

SEQ ID NO: 2798940 - DNA, 19 bp, Homo sapiens
caccacgatgtggccctgg

SEQ ID NO: 2798941 - DNA, 20 bp, Homo sapiens
caccacgatgtggccctggc

SEQ ID NO: 2798942 - DNA, 12 bp, Homo sapiens
caccactctggc

SEQ ID NO: 2798943 - DNA, 13 bp, Homo sapiens
caccactctggca

SEQ ID NO: 2798944 - DNA, 18 bp, Homo sapiens
caccactgcactccagcc

SEQ ID NO: 2798945 - DNA, 20 bp, Homo sapiens
caccagagcccaccttggct

SEQ ID NO: 2798946 - DNA, 13 bp, Homo sapiens
caccagagcccat

SEQ ID NO: 2798947 - DNA, 20 bp, Homo sapiens
caccagaggctgcagaaggc

SEQ ID NO: 2798948 - DNA, 18 bp, Homo sapiens
caccagccccagtgccca

SEQ ID NO: 2798949 - DNA, 19 bp, Homo sapiens
caccagcccttagcaggga

SEQ ID NO: 2798950 - DNA, 21 bp, Homo sapiens
caccagcccttagcagggaaa

SEQ ID NO: 2798951 - DNA, 14 bp, Homo sapiens
caccagcccttccc

SEQ ID NO: 2798952 - DNA, 15 bp, Homo sapiens
caccagcccttccct

SEQ ID NO: 2798953 - DNA, 14 bp, Homo sapiens
caccagcctaagaa

SEQ ID NO: 2798954 - DNA, 16 bp, Homo sapiens
caccagcttctccagg

SEQ ID NO: 2798955 - DNA, 17 bp, Homo sapiens
caccagcttctccaggc

SEQ ID NO: 2798956 - DNA, 17 bp, Homo sapiens
caccaggagtccctggt

SEQ ID NO: 2798957 - DNA, 21 bp, Homo sapiens
caccaggatggcccttcccac

SEQ ID NO: 2798958 - DNA, 19 bp, Homo sapiens
caccaggcacgaacccacc

SEQ ID NO: 2798959 - DNA, 23 bp, Homo sapiens
caccaggcacgaacccacctgct

SEQ ID NO: 2798960 - DNA, 16 bp, Homo sapiens
caccaggtagaacaca

SEQ ID NO: 2798961 - DNA, 17 bp, Homo sapiens
caccataggtagaatgt

SEQ ID NO: 2798962 - DNA, 16 bp, Homo sapiens
caccatattcagtgct

SEQ ID NO: 2798963 - DNA, 15 bp, Homo sapiens
caccatcatgtctgg

SEQ ID NO: 2798964 - DNA, 13 bp, Homo sapiens
caccatcctgctg

SEQ ID NO: 2798965 - DNA, 23 bp, Homo sapiens
cacccaaaagtcaaaaggtgcct

SEQ ID NO: 2798966 - DNA, 14 bp, Homo sapiens
cacccaagagggct

SEQ ID NO: 2798967 - DNA, 21 bp, Homo sapiens
cacccaagagggctgcttccc

SEQ ID NO: 2798968 - DNA, 16 bp, Homo sapiens
cacccaagcaaggcca

SEQ ID NO: 2798969 - DNA, 23 bp, Homo sapiens
cacccaataaacattaagattga

SEQ ID NO: 2798970 - DNA, 21 bp, Homo sapiens
cacccacatgtgacacatatg

SEQ ID NO: 2798971 - DNA, 17 bp, Homo sapiens
cacccacctcagcctcc

SEQ ID NO: 2798972 - DNA, 16 bp, Homo sapiens
cacccagcccacttct

SEQ ID NO: 2798973 - DNA, 17 bp, Homo sapiens
cacccagcccacttctg

SEQ ID NO: 2798974 - DNA, 22 bp, Homo sapiens
cacccagcccattctctctcct

SEQ ID NO: 2798975 - DNA, 14 bp, Homo sapiens
cacccatgaagaca

SEQ ID NO: 2798976 - DNA, 15 bp, Homo sapiens
cacccatgaatcaaa

SEQ ID NO: 2798977 - DNA, 22 bp, Homo sapiens
caccccacccccttcagtgccc

SEQ ID NO: 2798978 - DNA, 18 bp, Homo sapiens
caccccaggacgccactc

SEQ ID NO: 2798979 - DNA, 12 bp, Homo sapiens
cacccccagccc

SEQ ID NO: 2798980 - DNA, 13 bp, Homo sapiens
cacccccagcccc

SEQ ID NO: 2798981 - DNA, 19 bp, Homo sapiens
cacccccagccccgactcc

SEQ ID NO: 2798982 - DNA, 21 bp, Homo sapiens
cacccccagccccgactccag

SEQ ID NO: 2798983 - DNA, 12 bp, Homo sapiens
cacccccagcct

SEQ ID NO: 2798984 - DNA, 13 bp, Homo sapiens
cacccccagcctg

SEQ ID NO: 2798985 - DNA, 14 bp, Homo sapiens
cacccccagcctgg

SEQ ID NO: 2798986 - DNA, 16 bp, Homo sapiens
caccccctaccccaga

SEQ ID NO: 2798987 - DNA, 16 bp, Homo sapiens
caccccctcattcccc

SEQ ID NO: 2798988 - DNA, 11 bp, Homo sapiens
caccccctccc

SEQ ID NO: 2798989 - DNA, 14 bp, Homo sapiens
caccccctcccacc

SEQ ID NO: 2798990 - DNA, 15 bp, Homo sapiens
caccccctcccaccc

SEQ ID NO: 2798991 - DNA, 15 bp, Homo sapiens
caccccctccccagg

SEQ ID NO: 2798992 - DNA, 17 bp, Homo sapiens
caccccctccccagggg

SEQ ID NO: 2798993 - DNA, 17 bp, Homo sapiens
caccccctgcagcttgt

SEQ ID NO: 2798994 - DNA, 15 bp, Homo sapiens
cacccctcccctgcc

SEQ ID NO: 2798995 - DNA, 16 bp, Homo sapiens
cacccgactcctcaaa

SEQ ID NO: 2798996 - DNA, 12 bp, Homo sapiens
cacccggcccct

SEQ ID NO: 2798997 - DNA, 21 bp, Homo sapiens
cacccggcccctgctggttca

SEQ ID NO: 2798998 - DNA, 18 bp, Homo sapiens
cacccggctccccctgct

SEQ ID NO: 2798999 - DNA, 23 bp, Homo sapiens
cacccgtacccccgtggtctttg

SEQ ID NO: 2799000 - DNA, 18 bp, Homo sapiens
caccctcccaccatgcgc

SEQ ID NO: 2799001 - DNA, 18 bp, Homo sapiens
caccctcgtggacacctg

SEQ ID NO: 2799002 - DNA, 15 bp, Homo sapiens
caccctgaggagtct

SEQ ID NO: 2799003 - DNA, 16 bp, Homo sapiens
caccctgaggagtctg

SEQ ID NO: 2799004 - DNA, 16 bp, Homo sapiens
caccctgttccctctt

SEQ ID NO: 2799005 - DNA, 22 bp, Homo sapiens
cacccttcacataccctccccc

SEQ ID NO: 2799006 - DNA, 13 bp, Homo sapiens
cacccttctttcc

SEQ ID NO: 2799007 - DNA, 15 bp, Homo sapiens
cacccttctttcctc

SEQ ID NO: 2799008 - DNA, 20 bp, Homo sapiens
cacccttctttcctcttccc

SEQ ID NO: 2799009 - DNA, 21 bp, Homo sapiens
caccgagagtagccgagagcc

SEQ ID NO: 2799010 - DNA, 22 bp, Homo sapiens
caccgctgcctaagtggctgct

SEQ ID NO: 2799011 - DNA, 14 bp, Homo sapiens
caccgggcactcag

SEQ ID NO: 2799012 - DNA, 15 bp, Homo sapiens
caccgggcactcaga

SEQ ID NO: 2799013 - DNA, 15 bp, Homo sapiens
caccgggccacagag

SEQ ID NO: 2799014 - DNA, 14 bp, Homo sapiens
caccgggccactcc

SEQ ID NO: 2799015 - DNA, 18 bp, Homo sapiens
caccgtctacagatggct

SEQ ID NO: 2799016 - DNA, 24 bp, Homo sapiens
caccgtgcccagccctaaacatca

SEQ ID NO: 2799017 - DNA, 15 bp, Homo sapiens
caccgtggaccttcc

SEQ ID NO: 2799018 - DNA, 17 bp, Homo sapiens
caccgtggaccttcctg

SEQ ID NO: 2799019 - DNA, 19 bp, Homo sapiens
caccgtggaccttcctgcc

SEQ ID NO: 2799020 - DNA, 12 bp, Homo sapiens
cacctaaagaaa

SEQ ID NO: 2799021 - DNA, 17 bp, Homo sapiens
cacctactcacacaggc

SEQ ID NO: 2799022 - DNA, 18 bp, Homo sapiens
cacctactcacacaggca

SEQ ID NO: 2799023 - DNA, 16 bp, Homo sapiens
cacctatagtcccagc

SEQ ID NO: 2799024 - DNA, 20 bp, Homo sapiens
cacctatgtcatttcatttc

SEQ ID NO: 2799025 - DNA, 15 bp, Homo sapiens
cacctcactgaggaa

SEQ ID NO: 2799026 - DNA, 19 bp, Homo sapiens
cacctcatgcctggccccc

SEQ ID NO: 2799027 - DNA, 23 bp, Homo sapiens
cacctcatgcctggcccccctcc

SEQ ID NO: 2799028 - DNA, 22 bp, Homo sapiens
cacctccccccactgcaggccc

SEQ ID NO: 2799029 - DNA, 13 bp, Homo sapiens
cacctcccctatc

SEQ ID NO: 2799030 - DNA, 20 bp, Homo sapiens
cacctccgccccagacacac

SEQ ID NO: 2799031 - DNA, 21 bp, Homo sapiens
cacctccgctgggaggaacct

SEQ ID NO: 2799032 - DNA, 21 bp, Homo sapiens
cacctctcaatattcaataaa

SEQ ID NO: 2799033 - DNA, 23 bp, Homo sapiens
cacctcttgggcatgctcagccc

SEQ ID NO: 2799034 - DNA, 15 bp, Homo sapiens
cacctgaagactcat

SEQ ID NO: 2799035 - DNA, 13 bp, Homo sapiens
cacctgacacatc

SEQ ID NO: 2799036 - DNA, 11 bp, Homo sapiens
cacctgcacct

SEQ ID NO: 2799037 - DNA, 13 bp, Homo sapiens
cacctgcacctcc

SEQ ID NO: 2799038 - DNA, 14 bp, Homo sapiens
cacctgcacctccc

SEQ ID NO: 2799039 - DNA, 17 bp, Homo sapiens
cacctgcacctcccccc

SEQ ID NO: 2799040 - DNA, 19 bp, Homo sapiens
cacctgcacctccccccac

SEQ ID NO: 2799041 - DNA, 22 bp, Homo sapiens
cacctgcatccgtagttccctg

SEQ ID NO: 2799042 - DNA, 19 bp, Homo sapiens
cacctgcccaacctgctct

SEQ ID NO: 2799043 - DNA, 21 bp, Homo sapiens
cacctgccccctggtggacag

SEQ ID NO: 2799044 - DNA, 23 bp, Homo sapiens
cacctgccctgccctgccacctg

SEQ ID NO: 2799045 - DNA, 23 bp, Homo sapiens
cacctgccgacctcgtcctcccc

SEQ ID NO: 2799046 - DNA, 14 bp, Homo sapiens
cacctgcttctgaa

SEQ ID NO: 2799047 - DNA, 18 bp, Homo sapiens
cacctgcttctgaactca

SEQ ID NO: 2799048 - DNA, 17 bp, Homo sapiens
cacctgctttctcctgg

SEQ ID NO: 2799049 - DNA, 21 bp, Homo sapiens
cacctggaagcatttgtttct

SEQ ID NO: 2799050 - DNA, 20 bp, Homo sapiens
cacctggccgcctccaggag

SEQ ID NO: 2799051 - DNA, 17 bp, Homo sapiens
cacctgggccctggggc

SEQ ID NO: 2799052 - DNA, 22 bp, Homo sapiens
cacctgtactcaggaggctgag

SEQ ID NO: 2799053 - DNA, 14 bp, Homo sapiens
cacctgtcccagaa

SEQ ID NO: 2799054 - DNA, 14 bp, Homo sapiens
cacctgtctgtctg

SEQ ID NO: 2799055 - DNA, 22 bp, Homo sapiens
cacctgtctgtctgtctgtccc

SEQ ID NO: 2799056 - DNA, 11 bp, Homo sapiens
cacctgtgcac

SEQ ID NO: 2799057 - DNA, 22 bp, Homo sapiens
cacctgttaaaatgtacactgg

SEQ ID NO: 2799058 - DNA, 19 bp, Homo sapiens
cacctgtttttaagctgtt

SEQ ID NO: 2799059 - DNA, 17 bp, Homo sapiens
caccttcaattcctggg

SEQ ID NO: 2799060 - DNA, 17 bp, Homo sapiens
caccttcccagctctcc

SEQ ID NO: 2799061 - DNA, 21 bp, Homo sapiens
caccttcccagctctccctct

SEQ ID NO: 2799062 - DNA, 15 bp, Homo sapiens
caccttccccagact

SEQ ID NO: 2799063 - DNA, 16 bp, Homo sapiens
caccttccccagactc

SEQ ID NO: 2799064 - DNA, 21 bp, Homo sapiens
caccttccccagactcagctc

SEQ ID NO: 2799065 - DNA, 13 bp, Homo sapiens
caccttgacaggg

SEQ ID NO: 2799066 - DNA, 16 bp, Homo sapiens
caccttgacagggcac

SEQ ID NO: 2799067 - DNA, 18 bp, Homo sapiens
caccttgccaagctttct

SEQ ID NO: 2799068 - DNA, 22 bp, Homo sapiens
caccttggactcctcccacaat

SEQ ID NO: 2799069 - DNA, 14 bp, Homo sapiens
caccttggctcaag

SEQ ID NO: 2799070 - DNA, 18 bp, Homo sapiens
caccttggctgcagggag

SEQ ID NO: 2799071 - DNA, 22 bp, Homo sapiens
caccttgtcatgtaccatcaat

SEQ ID NO: 2799072 - DNA, 23 bp, Homo sapiens
caccttgtcatgtaccatcaata

SEQ ID NO: 2799073 - DNA, 23 bp, Homo sapiens
caccttgtgctggggacaggtcc

SEQ ID NO: 2799074 - DNA, 15 bp, Homo sapiens
caccttgtgtctgta

SEQ ID NO: 2799075 - DNA, 21 bp, Homo sapiens
caccttgtgtctgtacacgtg

SEQ ID NO: 2799076 - DNA, 17 bp, Homo sapiens
cacctttctagttgaaa

SEQ ID NO: 2799077 - DNA, 16 bp, Homo sapiens
cacgaaatgttatttt

SEQ ID NO: 2799078 - DNA, 18 bp, Homo sapiens
cacgaacccacctgctga

SEQ ID NO: 2799079 - DNA, 13 bp, Homo sapiens
cacgaggagcttc

SEQ ID NO: 2799080 - DNA, 21 bp, Homo sapiens
cacgaggagcttccagtgcat

SEQ ID NO: 2799081 - DNA, 20 bp, Homo sapiens
cacgataaataatcggccca

SEQ ID NO: 2799082 - DNA, 15 bp, Homo sapiens
cacgatgtggccctg

SEQ ID NO: 2799083 - DNA, 18 bp, Homo sapiens
cacgatgtggccctggcc

SEQ ID NO: 2799084 - DNA, 22 bp, Homo sapiens
cacgatgtggccctggcctgct

SEQ ID NO: 2799085 - DNA, 20 bp, Homo sapiens
cacgcactgcgtagagcctg

SEQ ID NO: 2799086 - DNA, 20 bp, Homo sapiens
cacgcaggaactcccagcaa

SEQ ID NO: 2799087 - DNA, 13 bp, Homo sapiens
cacgccactgcac

SEQ ID NO: 2799088 - DNA, 15 bp, Homo sapiens
cacgccactgcacta

SEQ ID NO: 2799089 - DNA, 13 bp, Homo sapiens
cacgcccagcctc

SEQ ID NO: 2799090 - DNA, 22 bp, Homo sapiens
cacgcccagcctcctcccacca

SEQ ID NO: 2799091 - DNA, 17 bp, Homo sapiens
cacgcctataatcccag

SEQ ID NO: 2799092 - DNA, 19 bp, Homo sapiens
cacgcctataatcccagca

SEQ ID NO: 2799093 - DNA, 15 bp, Homo sapiens
cacgcctgcccagcc

SEQ ID NO: 2799094 - DNA, 17 bp, Homo sapiens
cacgcctgtaatcccag

SEQ ID NO: 2799095 - DNA, 19 bp, Homo sapiens
cacgcctgtaatcccagca

SEQ ID NO: 2799096 - DNA, 21 bp, Homo sapiens
cacgcctgtaatcccagcact

SEQ ID NO: 2799097 - DNA, 16 bp, Homo sapiens
cacgctggagtgcagt

SEQ ID NO: 2799098 - DNA, 17 bp, Homo sapiens
cacgctttctagctgtt

SEQ ID NO: 2799099 - DNA, 14 bp, Homo sapiens
attactgcatgcac

SEQ ID NO: 2799100 - DNA, 15 bp, Homo sapiens
attacttatttttga

SEQ ID NO: 2799101 - DNA, 13 bp, Homo sapiens
attacttcagggc

SEQ ID NO: 2799102 - DNA, 12 bp, Homo sapiens
attacttctgct

SEQ ID NO: 2799103 - DNA, 20 bp, Homo sapiens
attagaaattagctgtgtga

SEQ ID NO: 2799104 - DNA, 23 bp, Homo sapiens
attagaaattagctgtgtgaaat

SEQ ID NO: 2799105 - DNA, 18 bp, Homo sapiens
attagaacaggcaagtga

SEQ ID NO: 2799106 - DNA, 23 bp, Homo sapiens
attagaacaggcaagtgaagaaa

SEQ ID NO: 2799107 - DNA, 15 bp, Homo sapiens
attagactggaactt

SEQ ID NO: 2799108 - DNA, 14 bp, Homo sapiens
attagactggacag

SEQ ID NO: 2799109 - DNA, 16 bp, Homo sapiens
attagatgttttacaa

SEQ ID NO: 2799110 - DNA, 16 bp, Homo sapiens
attagattttcttgca

SEQ ID NO: 2799111 - DNA, 17 bp, Homo sapiens
attagcaactgtgctac

SEQ ID NO: 2799112 - DNA, 18 bp, Homo sapiens
attagccgggcatggtgg

SEQ ID NO: 2799113 - DNA, 22 bp, Homo sapiens
attagctacttttcagaattga

SEQ ID NO: 2799114 - DNA, 13 bp, Homo sapiens
attagctctggac

SEQ ID NO: 2799115 - DNA, 15 bp, Homo sapiens
attagctgtgatttt

SEQ ID NO: 2799116 - DNA, 22 bp, Homo sapiens
attagctgtgatttttgttgat

SEQ ID NO: 2799117 - DNA, 23 bp, Homo sapiens
attaggaacagagtatatatgta

SEQ ID NO: 2799118 - DNA, 21 bp, Homo sapiens
attagtacagtagcttaaata

SEQ ID NO: 2799119 - DNA, 14 bp, Homo sapiens
attagtatcctgtt

SEQ ID NO: 2799120 - DNA, 15 bp, Homo sapiens
attagtatcctgtta

SEQ ID NO: 2799121 - DNA, 15 bp, Homo sapiens
attagtgagatttgt

SEQ ID NO: 2799122 - DNA, 19 bp, Homo sapiens
attagtgagatttgtattt

SEQ ID NO: 2799123 - DNA, 22 bp, Homo sapiens
attagtttgatttaatatctga

SEQ ID NO: 2799124 - DNA, 12 bp, Homo sapiens
attataaaacca

SEQ ID NO: 2799125 - DNA, 13 bp, Homo sapiens
attataaaaccat

SEQ ID NO: 2799126 - DNA, 14 bp, Homo sapiens
attataaaaccatg

SEQ ID NO: 2799127 - DNA, 16 bp, Homo sapiens
attataaataaatgcc

SEQ ID NO: 2799128 - DNA, 21 bp, Homo sapiens
attataactgaaggagaaggt

SEQ ID NO: 2799129 - DNA, 15 bp, Homo sapiens
attataacttaaaat

SEQ ID NO: 2799130 - DNA, 20 bp, Homo sapiens
attataacttaaaatatttt

SEQ ID NO: 2799131 - DNA, 12 bp, Homo sapiens
attatatatcat

SEQ ID NO: 2799132 - DNA, 17 bp, Homo sapiens
attatatatcataaagt

SEQ ID NO: 2799133 - DNA, 18 bp, Homo sapiens
attatatctgtggtcttc

SEQ ID NO: 2799134 - DNA, 16 bp, Homo sapiens
attatcggaagcagtg

SEQ ID NO: 2799135 - DNA, 16 bp, Homo sapiens
attatcgggaacagtg

SEQ ID NO: 2799136 - DNA, 18 bp, Homo sapiens
attatcgggaacagtgtt

SEQ ID NO: 2799137 - DNA, 20 bp, Homo sapiens
attatcgggaacagtgtttc

SEQ ID NO: 2799138 - DNA, 16 bp, Homo sapiens
attatcgggagcagtg

SEQ ID NO: 2799139 - DNA, 19 bp, Homo sapiens
attatcgggagcagtgtct

SEQ ID NO: 2799140 - DNA, 20 bp, Homo sapiens
attatcgggagcagtgtctt

SEQ ID NO: 2799141 - DNA, 16 bp, Homo sapiens
attatgacagttatac

SEQ ID NO: 2799142 - DNA, 19 bp, Homo sapiens
attatgacagttatactgt

SEQ ID NO: 2799143 - DNA, 16 bp, Homo sapiens
attatggaagatttta

SEQ ID NO: 2799144 - DNA, 17 bp, Homo sapiens
attatggaagattttaa

SEQ ID NO: 2799145 - DNA, 15 bp, Homo sapiens
attatggtgtaatgc

SEQ ID NO: 2799146 - DNA, 18 bp, Homo sapiens
attatggtgtaatgcaca

SEQ ID NO: 2799147 - DNA, 19 bp, Homo sapiens
attatggtgtaatgcacaa

SEQ ID NO: 2799148 - DNA, 22 bp, Homo sapiens
attatggtgtaatgcacaattt

SEQ ID NO: 2799149 - DNA, 16 bp, Homo sapiens
attatgtctcaaaata

SEQ ID NO: 2799150 - DNA, 24 bp, Homo sapiens
attatgtgacaacctttgtgtaat

SEQ ID NO: 2799151 - DNA, 16 bp, Homo sapiens
attattattcttcata

SEQ ID NO: 2799152 - DNA, 14 bp, Homo sapiens
attattcactagta

SEQ ID NO: 2799153 - DNA, 13 bp, Homo sapiens
attattgctgttg

SEQ ID NO: 2799154 - DNA, 22 bp, Homo sapiens
attatttaaaccgctaaaagaa

SEQ ID NO: 2799155 - DNA, 16 bp, Homo sapiens
attatttatatatgta

SEQ ID NO: 2799156 - DNA, 16 bp, Homo sapiens
attattttctatagct

SEQ ID NO: 2799157 - DNA, 14 bp, Homo sapiens
attatttttgtgtt

SEQ ID NO: 2799158 - DNA, 20 bp, Homo sapiens
attatttttgtgtttctaaa

SEQ ID NO: 2799159 - DNA, 21 bp, Homo sapiens
attcaaaccatttaattcata

SEQ ID NO: 2799160 - DNA, 15 bp, Homo sapiens
attcaacacattact

SEQ ID NO: 2799161 - DNA, 16 bp, Homo sapiens
attcaacacattactt

SEQ ID NO: 2799162 - DNA, 21 bp, Homo sapiens
attcaacacattacttgcaca

SEQ ID NO: 2799163 - DNA, 23 bp, Homo sapiens
attcaacacattacttgcacaag

SEQ ID NO: 2799164 - DNA, 22 bp, Homo sapiens
attcaaccactgtaaaatgaaa

SEQ ID NO: 2799165 - DNA, 14 bp, Homo sapiens
attcaacctgtgtc

SEQ ID NO: 2799166 - DNA, 16 bp, Homo sapiens
attcaagcctgtgaat

SEQ ID NO: 2799167 - DNA, 17 bp, Homo sapiens
attcaaggagatataaa

SEQ ID NO: 2799168 - DNA, 16 bp, Homo sapiens
attcaattcaaagctg

SEQ ID NO: 2799169 - DNA, 23 bp, Homo sapiens
atttgttaatttagaaaacttta

SEQ ID NO: 2799170 - DNA, 22 bp, Homo sapiens
atttgttgagagtgtgaccaaa

SEQ ID NO: 2799171 - DNA, 14 bp, Homo sapiens
atttgttggaatga

SEQ ID NO: 2799172 - DNA, 15 bp, Homo sapiens
atttgttggaatgaa

SEQ ID NO: 2799173 - DNA, 20 bp, Homo sapiens
attttaaaaacatgagaaat

SEQ ID NO: 2799174 - DNA, 21 bp, Homo sapiens
attttaaaaacatgagaaatg

SEQ ID NO: 2799175 - DNA, 23 bp, Homo sapiens
attttaaaaacatgagaaatgtg

SEQ ID NO: 2799176 - DNA, 19 bp, Homo sapiens
attttaaaaagatttgttt

SEQ ID NO: 2799177 - DNA, 15 bp, Homo sapiens
attttaaaaccatgc

SEQ ID NO: 2799178 - DNA, 12 bp, Homo sapiens
attttaaaagtt

SEQ ID NO: 2799179 - DNA, 17 bp, Homo sapiens
attttaaaattttatct

SEQ ID NO: 2799180 - DNA, 13 bp, Homo sapiens
attttaacaaaag

SEQ ID NO: 2799181 - DNA, 17 bp, Homo sapiens
attttaactttatcaca

SEQ ID NO: 2799182 - DNA, 12 bp, Homo sapiens
attttaagtgct

SEQ ID NO: 2799183 - DNA, 18 bp, Homo sapiens
attttaagtgctttgtaa

SEQ ID NO: 2799184 - DNA, 13 bp, Homo sapiens
attttaattatta

SEQ ID NO: 2799185 - DNA, 17 bp, Homo sapiens
attttactactgtggaa

SEQ ID NO: 2799186 - DNA, 18 bp, Homo sapiens
attttactactgtggaaa

SEQ ID NO: 2799187 - DNA, 22 bp, Homo sapiens
attttactacttgttacctttc

SEQ ID NO: 2799188 - DNA, 18 bp, Homo sapiens
attttacttctagagata

SEQ ID NO: 2799189 - DNA, 13 bp, Homo sapiens
attttagcagaga

SEQ ID NO: 2799190 - DNA, 17 bp, Homo sapiens
attttagccttctctgt

SEQ ID NO: 2799191 - DNA, 21 bp, Homo sapiens
attttagccttctctgttcat

SEQ ID NO: 2799192 - DNA, 18 bp, Homo sapiens
attttagcgtgctcactg

SEQ ID NO: 2799193 - DNA, 16 bp, Homo sapiens
attttagctgcagaac

SEQ ID NO: 2799194 - DNA, 16 bp, Homo sapiens
attttaggagacagtc

SEQ ID NO: 2799195 - DNA, 17 bp, Homo sapiens
attttagtctgtcatcc

SEQ ID NO: 2799196 - DNA, 21 bp, Homo sapiens
attttatacatagtcacaaaa

SEQ ID NO: 2799197 - DNA, 18 bp, Homo sapiens
attttatatatagagaaa

SEQ ID NO: 2799198 - DNA, 16 bp, Homo sapiens
attttatatctggatt

SEQ ID NO: 2799199 - DNA, 20 bp, Homo sapiens
attttatatgaaatgtttca

SEQ ID NO: 2799200 - DNA, 22 bp, Homo sapiens
attttatatgaaatgtttcact

SEQ ID NO: 2799201 - DNA, 15 bp, Homo sapiens
attttatctcttatt

SEQ ID NO: 2799202 - DNA, 16 bp, Homo sapiens
attttatgaatgtctt

SEQ ID NO: 2799203 - DNA, 23 bp, Homo sapiens
attttcaagaaactgaggaattt

SEQ ID NO: 2799204 - DNA, 13 bp, Homo sapiens
attttcactgtag

SEQ ID NO: 2799205 - DNA, 14 bp, Homo sapiens
attttcatcaattt

SEQ ID NO: 2799206 - DNA, 20 bp, Homo sapiens
attttccacaagattcccag

SEQ ID NO: 2799207 - DNA, 21 bp, Homo sapiens
attttccacaagattcccaga

SEQ ID NO: 2799208 - DNA, 17 bp, Homo sapiens
attttccagggcaatca

SEQ ID NO: 2799209 - DNA, 11 bp, Homo sapiens
attttcctcct

SEQ ID NO: 2799210 - DNA, 21 bp, Homo sapiens
attttcctcctaaacaaaaac

SEQ ID NO: 2799211 - DNA, 19 bp, Homo sapiens
attttcctgaatattaatc

SEQ ID NO: 2799212 - DNA, 16 bp, Homo sapiens
attttcgtgcatttgt

SEQ ID NO: 2799213 - DNA, 17 bp, Homo sapiens
attttcgtgcatttgtg

SEQ ID NO: 2799214 - DNA, 21 bp, Homo sapiens
attttctacctggtctctcct

SEQ ID NO: 2799215 - DNA, 22 bp, Homo sapiens
attttctatttttcttctaaaa

SEQ ID NO: 2799216 - DNA, 15 bp, Homo sapiens
attttctctttaaaa

SEQ ID NO: 2799217 - DNA, 19 bp, Homo sapiens
attttctggaatacatgaa

SEQ ID NO: 2799218 - DNA, 17 bp, Homo sapiens
attttcttcccatttgt

SEQ ID NO: 2799219 - DNA, 16 bp, Homo sapiens
attttctttctgtaac

SEQ ID NO: 2799220 - DNA, 23 bp, Homo sapiens
attttctttgtgtagctttgctc

SEQ ID NO: 2799221 - DNA, 19 bp, Homo sapiens
attttcttttgtaaatgtt

SEQ ID NO: 2799222 - DNA, 18 bp, Homo sapiens
attttgatccaagctggt

SEQ ID NO: 2799223 - DNA, 19 bp, Homo sapiens
attttgatccaagctggtc

SEQ ID NO: 2799224 - DNA, 14 bp, Homo sapiens
attttgcaaaattt

SEQ ID NO: 2799225 - DNA, 15 bp, Homo sapiens
attttgcaaaatttc

SEQ ID NO: 2799226 - DNA, 21 bp, Homo sapiens
attttgcaatcccttaatatc

SEQ ID NO: 2799227 - DNA, 19 bp, Homo sapiens
attttgcagattattttag

SEQ ID NO: 2799228 - DNA, 12 bp, Homo sapiens
attttgcagcag

SEQ ID NO: 2799229 - DNA, 16 bp, Homo sapiens
attttgcagcagtgag

SEQ ID NO: 2799230 - DNA, 16 bp, Homo sapiens
attttgcatttgaata

SEQ ID NO: 2799231 - DNA, 22 bp, Homo sapiens
attttggggtacccactgctct

SEQ ID NO: 2799232 - DNA, 23 bp, Homo sapiens
attttggggtacccactgctctg

SEQ ID NO: 2799233 - DNA, 22 bp, Homo sapiens
attttggtaaaatacttcttga

SEQ ID NO: 2799234 - DNA, 10 bp, Homo sapiens
attttgtaaa

SEQ ID NO: 2799235 - DNA, 12 bp, Homo sapiens
caaagcaccagc

SEQ ID NO: 2799236 - DNA, 16 bp, Homo sapiens
caaagcatgaaatgga

SEQ ID NO: 2799237 - DNA, 21 bp, Homo sapiens
caaagccaaagctaggcctgg

SEQ ID NO: 2799238 - DNA, 22 bp, Homo sapiens
caaagccaaagctaggcctggc

SEQ ID NO: 2799239 - DNA, 23 bp, Homo sapiens
caaagcccagctctttgttcagt

SEQ ID NO: 2799240 - DNA, 19 bp, Homo sapiens
caaagcctgttcatggcag

SEQ ID NO: 2799241 - DNA, 22 bp, Homo sapiens
caaagcctgttcatggcagatg

SEQ ID NO: 2799242 - DNA, 14 bp, Homo sapiens
caaagctaggcctg

SEQ ID NO: 2799243 - DNA, 16 bp, Homo sapiens
caaagctaggcctggc

SEQ ID NO: 2799244 - DNA, 12 bp, Homo sapiens
caaaggagcctg

SEQ ID NO: 2799245 - DNA, 16 bp, Homo sapiens
caaaggagtagaaaga

SEQ ID NO: 2799246 - DNA, 14 bp, Homo sapiens
caaaggccctacca

SEQ ID NO: 2799247 - DNA, 22 bp, Homo sapiens
caaagggagcactgggttgact

SEQ ID NO: 2799248 - DNA, 16 bp, Homo sapiens
caaagggcagtaaagt

SEQ ID NO: 2799249 - DNA, 23 bp, Homo sapiens
caaagggtatcaggtgctgccat

SEQ ID NO: 2799250 - DNA, 17 bp, Homo sapiens
caaaggtgtgcaaactt

SEQ ID NO: 2799251 - DNA, 16 bp, Homo sapiens
caaagtaaaacttgct

SEQ ID NO: 2799252 - DNA, 18 bp, Homo sapiens
caaagtaaaacttgctgc

SEQ ID NO: 2799253 - DNA, 21 bp, Homo sapiens
caaagtaaaacttgctgcctg

SEQ ID NO: 2799254 - DNA, 14 bp, Homo sapiens
caaagtagagaagt

SEQ ID NO: 2799255 - DNA, 22 bp, Homo sapiens
caaagtagagaagtatccaatt

SEQ ID NO: 2799256 - DNA, 22 bp, Homo sapiens
caaagtcttaaaataacttata

SEQ ID NO: 2799257 - DNA, 16 bp, Homo sapiens
caaagtgcaaatactc

SEQ ID NO: 2799258 - DNA, 23 bp, Homo sapiens
caaagtgctgggattacaggtgt

SEQ ID NO: 2799259 - DNA, 11 bp, Homo sapiens
caaagtgttaa

SEQ ID NO: 2799260 - DNA, 14 bp, Homo sapiens
caaagttatattta

SEQ ID NO: 2799261 - DNA, 17 bp, Homo sapiens
caaataaaaagtgcttt

SEQ ID NO: 2799262 - DNA, 14 bp, Homo sapiens
caaataaatgtgta

SEQ ID NO: 2799263 - DNA, 15 bp, Homo sapiens
caaataaatgtgtaa

SEQ ID NO: 2799264 - DNA, 20 bp, Homo sapiens
caaataaatgtgtaaatgtg

SEQ ID NO: 2799265 - DNA, 14 bp, Homo sapiens
caaataataagcaa

SEQ ID NO: 2799266 - DNA, 19 bp, Homo sapiens
caaatactccaagcttcaa

SEQ ID NO: 2799267 - DNA, 21 bp, Homo sapiens
caaatactccaagcttcaagt

SEQ ID NO: 2799268 - DNA, 22 bp, Homo sapiens
caaatactccaagcttcaagtg

SEQ ID NO: 2799269 - DNA, 14 bp, Homo sapiens
caaatactcttagg

SEQ ID NO: 2799270 - DNA, 13 bp, Homo sapiens
caaatataaactt

SEQ ID NO: 2799271 - DNA, 12 bp, Homo sapiens
caaatatttatt

SEQ ID NO: 2799272 - DNA, 14 bp, Homo sapiens
caaatatttatttt

SEQ ID NO: 2799273 - DNA, 16 bp, Homo sapiens
caaatatttattttct

SEQ ID NO: 2799274 - DNA, 20 bp, Homo sapiens
caaatatttattttctttct

SEQ ID NO: 2799275 - DNA, 20 bp, Homo sapiens
caaatctattcagacaagca

SEQ ID NO: 2799276 - DNA, 17 bp, Homo sapiens
caaatgacccaaagacc

SEQ ID NO: 2799277 - DNA, 20 bp, Homo sapiens
caaatgagatctaagccttt

SEQ ID NO: 2799278 - DNA, 20 bp, Homo sapiens
caaatgagcattagctactt

SEQ ID NO: 2799279 - DNA, 21 bp, Homo sapiens
caaatgattttcatcaattta

SEQ ID NO: 2799280 - DNA, 17 bp, Homo sapiens
caaatgctaaatgcaaa

SEQ ID NO: 2799281 - DNA, 15 bp, Homo sapiens
caaatggctctgtga

SEQ ID NO: 2799282 - DNA, 15 bp, Homo sapiens
caaattaatctttct

SEQ ID NO: 2799283 - DNA, 21 bp, Homo sapiens
caaattcaaggagatataaaa

SEQ ID NO: 2799284 - DNA, 17 bp, Homo sapiens
caaattggacagaagat

SEQ ID NO: 2799285 - DNA, 22 bp, Homo sapiens
caaattgtcttttgtcatgtgg

SEQ ID NO: 2799286 - DNA, 16 bp, Homo sapiens
caaatttaattttgca

SEQ ID NO: 2799287 - DNA, 12 bp, Homo sapiens
caaatttatatg

SEQ ID NO: 2799288 - DNA, 13 bp, Homo sapiens
caaattttggcca

SEQ ID NO: 2799289 - DNA, 15 bp, Homo sapiens
caaattttggccaaa

SEQ ID NO: 2799290 - DNA, 14 bp, Homo sapiens
caacaaagaaatat

SEQ ID NO: 2799291 - DNA, 19 bp, Homo sapiens
caacaaagccaacagtcaa

SEQ ID NO: 2799292 - DNA, 14 bp, Homo sapiens
caacaactccagga

SEQ ID NO: 2799293 - DNA, 18 bp, Homo sapiens
caacaactccaggaaaac

SEQ ID NO: 2799294 - DNA, 14 bp, Homo sapiens
caacaataaagagc

SEQ ID NO: 2799295 - DNA, 17 bp, Homo sapiens
caacaataaagagctca

SEQ ID NO: 2799296 - DNA, 22 bp, Homo sapiens
caacactcacatttattctgct

SEQ ID NO: 2799297 - DNA, 17 bp, Homo sapiens
attcatctctctttaat

SEQ ID NO: 2799298 - DNA, 22 bp, Homo sapiens
attcatctctctttaatataaa

SEQ ID NO: 2799299 - DNA, 20 bp, Homo sapiens
attcatctgtttttcttttt

SEQ ID NO: 2799300 - DNA, 13 bp, Homo sapiens
attcatgtaataa

SEQ ID NO: 2799301 - DNA, 19 bp, Homo sapiens
attcattgtataaaaatag

SEQ ID NO: 2799302 - DNA, 15 bp, Homo sapiens
attcatttcacttta

SEQ ID NO: 2799303 - DNA, 21 bp, Homo sapiens
attcattttaacatctgagaa

SEQ ID NO: 2799304 - DNA, 16 bp, Homo sapiens
attccacagtctctgg

SEQ ID NO: 2799305 - DNA, 12 bp, Homo sapiens
attccactggac

SEQ ID NO: 2799306 - DNA, 17 bp, Homo sapiens
attccagacctgaagaa

SEQ ID NO: 2799307 - DNA, 14 bp, Homo sapiens
attccatccatata

SEQ ID NO: 2799308 - DNA, 12 bp, Homo sapiens
attccatgattt

SEQ ID NO: 2799309 - DNA, 14 bp, Homo sapiens
attccatgatttta

SEQ ID NO: 2799310 - DNA, 23 bp, Homo sapiens
attccatttttactaaagcagtg

SEQ ID NO: 2799311 - DNA, 14 bp, Homo sapiens
attcccaagctctg

SEQ ID NO: 2799312 - DNA, 17 bp, Homo sapiens
attcccaagctctgctc

SEQ ID NO: 2799313 - DNA, 19 bp, Homo sapiens
attcccagagacaggaaaa

SEQ ID NO: 2799314 - DNA, 17 bp, Homo sapiens
attcccagagcaaaata

SEQ ID NO: 2799315 - DNA, 14 bp, Homo sapiens
attccccattcttc

SEQ ID NO: 2799316 - DNA, 15 bp, Homo sapiens
attccccattcttcc

SEQ ID NO: 2799317 - DNA, 14 bp, Homo sapiens
attccctatcaaaa

SEQ ID NO: 2799318 - DNA, 15 bp, Homo sapiens
attccctatcaaaac

SEQ ID NO: 2799319 - DNA, 17 bp, Homo sapiens
attccctatcaaaacat

SEQ ID NO: 2799320 - DNA, 21 bp, Homo sapiens
attccctatcttttagtttta

SEQ ID NO: 2799321 - DNA, 22 bp, Homo sapiens
attccctatcttttagttttag

SEQ ID NO: 2799322 - DNA, 19 bp, Homo sapiens
attccctgagtcaccagga

SEQ ID NO: 2799323 - DNA, 20 bp, Homo sapiens
attccctgagtcaccaggaa

SEQ ID NO: 2799324 - DNA, 13 bp, Homo sapiens
attcctgaaagaa

SEQ ID NO: 2799325 - DNA, 16 bp, Homo sapiens
attcctggtattattt

SEQ ID NO: 2799326 - DNA, 22 bp, Homo sapiens
attccttagcttagacctcagc

SEQ ID NO: 2799327 - DNA, 24 bp, Homo sapiens
attccttagcttagacctcagcct

SEQ ID NO: 2799328 - DNA, 16 bp, Homo sapiens
attctaaaatgattgt

SEQ ID NO: 2799329 - DNA, 15 bp, Homo sapiens
attctaaatgaatgt

SEQ ID NO: 2799330 - DNA, 18 bp, Homo sapiens
attctaagattgtacata

SEQ ID NO: 2799331 - DNA, 23 bp, Homo sapiens
attctaattttatatatagagaa

SEQ ID NO: 2799332 - DNA, 15 bp, Homo sapiens
attctacagtttctt

SEQ ID NO: 2799333 - DNA, 14 bp, Homo sapiens
attctactaaatat

SEQ ID NO: 2799334 - DNA, 18 bp, Homo sapiens
attctactaaatatttta

SEQ ID NO: 2799335 - DNA, 16 bp, Homo sapiens
attctagccaaactat

SEQ ID NO: 2799336 - DNA, 20 bp, Homo sapiens
attctagccaaactattcta

SEQ ID NO: 2799337 - DNA, 20 bp, Homo sapiens
attctaggcatcccagggga

SEQ ID NO: 2799338 - DNA, 14 bp, Homo sapiens
attctcactccacc

SEQ ID NO: 2799339 - DNA, 16 bp, Homo sapiens
attctcactccaccac

SEQ ID NO: 2799340 - DNA, 14 bp, Homo sapiens
attctccaaatgat

SEQ ID NO: 2799341 - DNA, 21 bp, Homo sapiens
attctccaggattccaaagtt

SEQ ID NO: 2799342 - DNA, 11 bp, Homo sapiens
attctcctgcc

SEQ ID NO: 2799343 - DNA, 14 bp, Homo sapiens
attctcctgcctca

SEQ ID NO: 2799344 - DNA, 17 bp, Homo sapiens
attctcctgcctcagcc

SEQ ID NO: 2799345 - DNA, 18 bp, Homo sapiens
attctctcctcagactgc

SEQ ID NO: 2799346 - DNA, 14 bp, Homo sapiens
attctgcctgccca

SEQ ID NO: 2799347 - DNA, 16 bp, Homo sapiens
attctgcctgcccagg

SEQ ID NO: 2799348 - DNA, 18 bp, Homo sapiens
attctgcctgcccaggcc

SEQ ID NO: 2799349 - DNA, 20 bp, Homo sapiens
attctgcctgcccaggcccc

SEQ ID NO: 2799350 - DNA, 21 bp, Homo sapiens
attctgcctgcccaggcccct

SEQ ID NO: 2799351 - DNA, 15 bp, Homo sapiens
attctgctacctcac

SEQ ID NO: 2799352 - DNA, 15 bp, Homo sapiens
attctggaggaagaa

SEQ ID NO: 2799353 - DNA, 18 bp, Homo sapiens
attctggaggaagaagac

SEQ ID NO: 2799354 - DNA, 22 bp, Homo sapiens
attctggatggatttgaagcaa

SEQ ID NO: 2799355 - DNA, 14 bp, Homo sapiens
attctgtaaaatgt

SEQ ID NO: 2799356 - DNA, 14 bp, Homo sapiens
attctgtcttgaag

SEQ ID NO: 2799357 - DNA, 19 bp, Homo sapiens
attctgttggccagtgtga

SEQ ID NO: 2799358 - DNA, 20 bp, Homo sapiens
attcttaaaatatatttcag

SEQ ID NO: 2799359 - DNA, 16 bp, Homo sapiens
attcttacaaacatgt

SEQ ID NO: 2799360 - DNA, 13 bp, Homo sapiens
attcttccatctg

SEQ ID NO: 2799361 - DNA, 17 bp, Homo sapiens
attctttaaatttcatc

SEQ ID NO: 2799362 - DNA, 17 bp, Homo sapiens
attctttatcttgacat

SEQ ID NO: 2799363 - DNA, 13 bp, Homo sapiens
attctttgtacca

SEQ ID NO: 2799364 - DNA, 15 bp, Homo sapiens
attgaaaaatcacca

SEQ ID NO: 2799365 - DNA, 19 bp, Homo sapiens
attgaacttaaataaatgt

SEQ ID NO: 2799366 - DNA, 16 bp, Homo sapiens
attgaagaaaagcact

SEQ ID NO: 2799367 - DNA, 23 bp, Homo sapiens
attgaagagagatatatctgaaa

SEQ ID NO: 2799368 - DNA, 17 bp, Homo sapiens
attgaaggagaaaatgc

SEQ ID NO: 2799369 - DNA, 19 bp, Homo sapiens
attgaataaagttgaagct

SEQ ID NO: 2799370 - DNA, 21 bp, Homo sapiens
attgaatggctatgtttttaa

SEQ ID NO: 2799371 - DNA, 22 bp, Homo sapiens
attgaatggctatgtttttaat

SEQ ID NO: 2799372 - DNA, 13 bp, Homo sapiens
attgacaacattt

SEQ ID NO: 2799373 - DNA, 15 bp, Homo sapiens
attgacaacatttta

SEQ ID NO: 2799374 - DNA, 16 bp, Homo sapiens
attgacaacattttat

SEQ ID NO: 2799375 - DNA, 15 bp, Homo sapiens
attgacaagtcattt

SEQ ID NO: 2799376 - DNA, 17 bp, Homo sapiens
attgacaataatttcag

SEQ ID NO: 2799377 - DNA, 16 bp, Homo sapiens
attgacacacagcact

SEQ ID NO: 2799378 - DNA, 18 bp, Homo sapiens
attgactatcaaactgaa

SEQ ID NO: 2799379 - DNA, 17 bp, Homo sapiens
attgagaattttaaatt

SEQ ID NO: 2799380 - DNA, 12 bp, Homo sapiens
attgaggcctgc

SEQ ID NO: 2799381 - DNA, 22 bp, Homo sapiens
attgagggaaaacataatatct

SEQ ID NO: 2799382 - DNA, 15 bp, Homo sapiens
attgatatgaaaaat

SEQ ID NO: 2799383 - DNA, 20 bp, Homo sapiens
attgatgtttccagaaaata

SEQ ID NO: 2799384 - DNA, 14 bp, Homo sapiens
attgattaaaatct

SEQ ID NO: 2799385 - DNA, 22 bp, Homo sapiens
attgatttctacgttatgaaaa

SEQ ID NO: 2799386 - DNA, 23 bp, Homo sapiens
attgatttctacgttatgaaaac

SEQ ID NO: 2799387 - DNA, 17 bp, Homo sapiens
caatggctaattcccag

SEQ ID NO: 2799388 - DNA, 18 bp, Homo sapiens
caatggctaattcccaga

SEQ ID NO: 2799389 - DNA, 17 bp, Homo sapiens
caatggtgttgccctga

SEQ ID NO: 2799390 - DNA, 16 bp, Homo sapiens
caatggtttgcaagga

SEQ ID NO: 2799391 - DNA, 18 bp, Homo sapiens
caatggtttgcaaggaag

SEQ ID NO: 2799392 - DNA, 17 bp, Homo sapiens
caatgtacccaccgggc

SEQ ID NO: 2799393 - DNA, 21 bp, Homo sapiens
caatgtcaggaacagaaggat

SEQ ID NO: 2799394 - DNA, 18 bp, Homo sapiens
caatgtgaatcagaccct

SEQ ID NO: 2799395 - DNA, 19 bp, Homo sapiens
caatgtgaatcagacccta

SEQ ID NO: 2799396 - DNA, 13 bp, Homo sapiens
caatgtgaccagg

SEQ ID NO: 2799397 - DNA, 21 bp, Homo sapiens
caatgtggcctaaaaatgcaa

SEQ ID NO: 2799398 - DNA, 20 bp, Homo sapiens
caatgtttatgcaaggaagg

SEQ ID NO: 2799399 - DNA, 18 bp, Homo sapiens
caatgtttcttttatcac

SEQ ID NO: 2799400 - DNA, 20 bp, Homo sapiens
caattaaaatatatataaat

SEQ ID NO: 2799401 - DNA, 15 bp, Homo sapiens
caattaataaaaaat

SEQ ID NO: 2799402 - DNA, 18 bp, Homo sapiens
caattaataaaaaatgga

SEQ ID NO: 2799403 - DNA, 21 bp, Homo sapiens
caattagcaattgactgtcac

SEQ ID NO: 2799404 - DNA, 14 bp, Homo sapiens
caattagtacagta

SEQ ID NO: 2799405 - DNA, 17 bp, Homo sapiens
caattatcttatttaat

SEQ ID NO: 2799406 - DNA, 14 bp, Homo sapiens
caattatgtgacaa

SEQ ID NO: 2799407 - DNA, 15 bp, Homo sapiens
caattatgtgacaac

SEQ ID NO: 2799408 - DNA, 21 bp, Homo sapiens
caattatgtgacaacctttgt

SEQ ID NO: 2799409 - DNA, 13 bp, Homo sapiens
caattattctaat

SEQ ID NO: 2799410 - DNA, 12 bp, Homo sapiens
caattcaaaaca

SEQ ID NO: 2799411 - DNA, 23 bp, Homo sapiens
caattcaacacattacttgcaca

SEQ ID NO: 2799412 - DNA, 17 bp, Homo sapiens
caattcatttcacttta

SEQ ID NO: 2799413 - DNA, 17 bp, Homo sapiens
caattccacagtctctg

SEQ ID NO: 2799414 - DNA, 12 bp, Homo sapiens
caattcctgggc

SEQ ID NO: 2799415 - DNA, 21 bp, Homo sapiens
caattgaacttaaataaatgt

SEQ ID NO: 2799416 - DNA, 23 bp, Homo sapiens
caattgcacgcggagtgagtttt

SEQ ID NO: 2799417 - DNA, 14 bp, Homo sapiens
caattgtaaaaaaa

SEQ ID NO: 2799418 - DNA, 15 bp, Homo sapiens
caatttagaaaacat

SEQ ID NO: 2799419 - DNA, 13 bp, Homo sapiens
caatttctgaaca

SEQ ID NO: 2799420 - DNA, 18 bp, Homo sapiens
caatttgagcaattcatt

SEQ ID NO: 2799421 - DNA, 19 bp, Homo sapiens
caatttgagcaattcattt

SEQ ID NO: 2799422 - DNA, 14 bp, Homo sapiens
caatttgtatatca

SEQ ID NO: 2799423 - DNA, 19 bp, Homo sapiens
caatttgtatatcatgaaa

SEQ ID NO: 2799424 - DNA, 12 bp, Homo sapiens
caatttttaaac

SEQ ID NO: 2799425 - DNA, 17 bp, Homo sapiens
caatttttaaactagta

SEQ ID NO: 2799426 - DNA, 20 bp, Homo sapiens
caatttttatacatatcaga

SEQ ID NO: 2799427 - DNA, 12 bp, Homo sapiens
cacaaaaatgaa

SEQ ID NO: 2799428 - DNA, 16 bp, Homo sapiens
cacaaaagtttctctt

SEQ ID NO: 2799429 - DNA, 21 bp, Homo sapiens
cacaaagctcaagatgacagc

SEQ ID NO: 2799430 - DNA, 23 bp, Homo sapiens
cacaacagcctgacaacatttct

SEQ ID NO: 2799431 - DNA, 20 bp, Homo sapiens
cacaactgtttttgaagaag

SEQ ID NO: 2799432 - DNA, 15 bp, Homo sapiens
cacaagaggaagaga

SEQ ID NO: 2799433 - DNA, 17 bp, Homo sapiens
cacaagcacaaagctca

SEQ ID NO: 2799434 - DNA, 13 bp, Homo sapiens
cacaagctggaag

SEQ ID NO: 2799435 - DNA, 13 bp, Homo sapiens
cacaagcttgtat

SEQ ID NO: 2799436 - DNA, 16 bp, Homo sapiens
cacaagcttgtatata

SEQ ID NO: 2799437 - DNA, 15 bp, Homo sapiens
cacaaggcagcaagg

SEQ ID NO: 2799438 - DNA, 17 bp, Homo sapiens
cacaaggcagcaaggcc

SEQ ID NO: 2799439 - DNA, 18 bp, Homo sapiens
cacaaggcagcaaggccc

SEQ ID NO: 2799440 - DNA, 22 bp, Homo sapiens
cacaaggcagcaaggcccgagc

SEQ ID NO: 2799441 - DNA, 19 bp, Homo sapiens
cacaaggctgaccaagaga

SEQ ID NO: 2799442 - DNA, 21 bp, Homo sapiens
cacaaggctgaccaagagaga

SEQ ID NO: 2799443 - DNA, 11 bp, Homo sapiens
cacaatatttt

SEQ ID NO: 2799444 - DNA, 22 bp, Homo sapiens
cacaatcctaacacattatcgg

SEQ ID NO: 2799445 - DNA, 23 bp, Homo sapiens
cacaatcctaacacattatcggg

SEQ ID NO: 2799446 - DNA, 22 bp, Homo sapiens
cacaatgaaatgctctcctttc

SEQ ID NO: 2799447 - DNA, 20 bp, Homo sapiens
cacaatgatgattaaacacc

SEQ ID NO: 2799448 - DNA, 20 bp, Homo sapiens
cacaatggctaattcccaga

SEQ ID NO: 2799449 - DNA, 21 bp, Homo sapiens
cacaatggctaattcccagag

SEQ ID NO: 2799450 - DNA, 21 bp, Homo sapiens
cacaattccatttccagttca

SEQ ID NO: 2799451 - DNA, 16 bp, Homo sapiens
cacaatttagaaaaca

SEQ ID NO: 2799452 - DNA, 21 bp, Homo sapiens
cacaatttagaaaacattcat

SEQ ID NO: 2799453 - DNA, 22 bp, Homo sapiens
cacaatttagaaaacattcatc

SEQ ID NO: 2799454 - DNA, 13 bp, Homo sapiens
cacaatttatatt

SEQ ID NO: 2799455 - DNA, 19 bp, Homo sapiens
cacaatttgagcaattcat

SEQ ID NO: 2799456 - DNA, 14 bp, Homo sapiens
cacacacagaggaa

SEQ ID NO: 2799457 - DNA, 14 bp, Homo sapiens
cacacagacacaca

SEQ ID NO: 2799458 - DNA, 21 bp, Homo sapiens
cacacagactacagccagaag

SEQ ID NO: 2799459 - DNA, 12 bp, Homo sapiens
cacacagaggaa

SEQ ID NO: 2799460 - DNA, 14 bp, Homo sapiens
cacacagcactctc

SEQ ID NO: 2799461 - DNA, 12 bp, Homo sapiens
cacacagctctg

SEQ ID NO: 2799462 - DNA, 20 bp, Homo sapiens
cacacagctctgtcctggga

SEQ ID NO: 2799463 - DNA, 18 bp, Homo sapiens
cacacaggcatttcctgg

SEQ ID NO: 2799464 - DNA, 18 bp, Homo sapiens
cacacaggtacagcaaca

SEQ ID NO: 2799465 - DNA, 23 bp, Homo sapiens
cacacagtattacttctgctaca

SEQ ID NO: 2799466 - DNA, 18 bp, Homo sapiens
cacacagtgagtcgagga

SEQ ID NO: 2799467 - DNA, 21 bp, Homo sapiens
cacacagtgagtcgaggacag

SEQ ID NO: 2799468 - DNA, 12 bp, Homo sapiens
cacaccagagcc

SEQ ID NO: 2799469 - DNA, 15 bp, Homo sapiens
cacaccagagcccac

SEQ ID NO: 2799470 - DNA, 22 bp, Homo sapiens
cacaccagagcccaccttggct

SEQ ID NO: 2799471 - DNA, 13 bp, Homo sapiens
cacacccagccca

SEQ ID NO: 2799472 - DNA, 14 bp, Homo sapiens
cacacccagcccac

SEQ ID NO: 2799473 - DNA, 18 bp, Homo sapiens
cacaccccatctctcttc

SEQ ID NO: 2799474 - DNA, 19 bp, Homo sapiens
cacaccccatctctcttcc

SEQ ID NO: 2799475 - DNA, 22 bp, Homo sapiens
cacacccggctccccctgcttc

SEQ ID NO: 2799476 - DNA, 14 bp, Homo sapiens
cacaccctccccat

SEQ ID NO: 2799477 - DNA, 15 bp, Homo sapiens
attgcaacaggctgg

SEQ ID NO: 2799478 - DNA, 12 bp, Homo sapiens
attgcacaattt

SEQ ID NO: 2799479 - DNA, 18 bp, Homo sapiens
attgcatgtaaaatgcag

SEQ ID NO: 2799480 - DNA, 21 bp, Homo sapiens
attgcccacgctggagtgcag

SEQ ID NO: 2799481 - DNA, 11 bp, Homo sapiens
attgccctggt

SEQ ID NO: 2799482 - DNA, 12 bp, Homo sapiens
attgctccttga

SEQ ID NO: 2799483 - DNA, 17 bp, Homo sapiens
attgcttatgtctctac

SEQ ID NO: 2799484 - DNA, 17 bp, Homo sapiens
attgcttgagcccagga

SEQ ID NO: 2799485 - DNA, 19 bp, Homo sapiens
attggaagaaattcctgta

SEQ ID NO: 2799486 - DNA, 15 bp, Homo sapiens
attggaattctggat

SEQ ID NO: 2799487 - DNA, 17 bp, Homo sapiens
attggacattttcttca

SEQ ID NO: 2799488 - DNA, 23 bp, Homo sapiens
attggagggtgggagagcccagc

SEQ ID NO: 2799489 - DNA, 21 bp, Homo sapiens
attggctcacccaagcaaggc

SEQ ID NO: 2799490 - DNA, 15 bp, Homo sapiens
attgggattttaaaa

SEQ ID NO: 2799491 - DNA, 16 bp, Homo sapiens
attggtaacatccttt

SEQ ID NO: 2799492 - DNA, 13 bp, Homo sapiens
attggtgataagt

SEQ ID NO: 2799493 - DNA, 13 bp, Homo sapiens
attgtaatgaata

SEQ ID NO: 2799494 - DNA, 19 bp, Homo sapiens
attgtacacaccttatatt

SEQ ID NO: 2799495 - DNA, 19 bp, Homo sapiens
attgtacctctcttataga

SEQ ID NO: 2799496 - DNA, 15 bp, Homo sapiens
attgtagcatttctt

SEQ ID NO: 2799497 - DNA, 21 bp, Homo sapiens
attgtaggtcaatgaaatatt

SEQ ID NO: 2799498 - DNA, 21 bp, Homo sapiens
attgtataagattagaatgaa

SEQ ID NO: 2799499 - DNA, 14 bp, Homo sapiens
attgtatgtaagta

SEQ ID NO: 2799500 - DNA, 15 bp, Homo sapiens
attgtcattactgcc

SEQ ID NO: 2799501 - DNA, 13 bp, Homo sapiens
attgtcatttata

SEQ ID NO: 2799502 - DNA, 16 bp, Homo sapiens
attgtcttaatattgt

SEQ ID NO: 2799503 - DNA, 15 bp, Homo sapiens
attgtgaccaagtta

SEQ ID NO: 2799504 - DNA, 22 bp, Homo sapiens
attgtgccatgtcaaacaaata

SEQ ID NO: 2799505 - DNA, 16 bp, Homo sapiens
attgtgggtgttaatt

SEQ ID NO: 2799506 - DNA, 17 bp, Homo sapiens
attgtgtcatattaaac

SEQ ID NO: 2799507 - DNA, 19 bp, Homo sapiens
attgtgttgccttagcact

SEQ ID NO: 2799508 - DNA, 21 bp, Homo sapiens
attgtgttgccttagcacttc

SEQ ID NO: 2799509 - DNA, 23 bp, Homo sapiens
attgtgttgccttagcacttctt

SEQ ID NO: 2799510 - DNA, 12 bp, Homo sapiens
attgttgcatta

SEQ ID NO: 2799511 - DNA, 17 bp, Homo sapiens
attgtttatttatcagt

SEQ ID NO: 2799512 - DNA, 18 bp, Homo sapiens
attgtttatttatcagtg

SEQ ID NO: 2799513 - DNA, 21 bp, Homo sapiens
attgtttggggatgagaaagg

SEQ ID NO: 2799514 - DNA, 20 bp, Homo sapiens
attgtttgtctgtcttcata

SEQ ID NO: 2799515 - DNA, 13 bp, Homo sapiens
atttaaaaaacta

SEQ ID NO: 2799516 - DNA, 23 bp, Homo sapiens
atttaaaaaataaaaaaatacag

SEQ ID NO: 2799517 - DNA, 13 bp, Homo sapiens
atttaaaatagca

SEQ ID NO: 2799518 - DNA, 15 bp, Homo sapiens
atttaaaatagcaaa

SEQ ID NO: 2799519 - DNA, 18 bp, Homo sapiens
atttaaaatagcaaaaga

SEQ ID NO: 2799520 - DNA, 22 bp, Homo sapiens
atttaaaatagcaaaagaagaa

SEQ ID NO: 2799521 - DNA, 14 bp, Homo sapiens
atttaaaccagcag

SEQ ID NO: 2799522 - DNA, 15 bp, Homo sapiens
atttaaaccagcaga

SEQ ID NO: 2799523 - DNA, 17 bp, Homo sapiens
atttaaaccagcagaaa

SEQ ID NO: 2799524 - DNA, 20 bp, Homo sapiens
atttaaaccagcagaaaagt

SEQ ID NO: 2799525 - DNA, 23 bp, Homo sapiens
atttaaaccagcagaaaagtgct

SEQ ID NO: 2799526 - DNA, 19 bp, Homo sapiens
atttaaaccgctaaaagaa

SEQ ID NO: 2799527 - DNA, 20 bp, Homo sapiens
atttaaaccgctaaaagaaa

SEQ ID NO: 2799528 - DNA, 21 bp, Homo sapiens
atttaaaccgctaaaagaaac

SEQ ID NO: 2799529 - DNA, 20 bp, Homo sapiens
atttaaactataagcaagaa

SEQ ID NO: 2799530 - DNA, 17 bp, Homo sapiens
atttaactaatttaaac

SEQ ID NO: 2799531 - DNA, 21 bp, Homo sapiens
atttaactaatttaaaccagc

SEQ ID NO: 2799532 - DNA, 13 bp, Homo sapiens
atttaactggctt

SEQ ID NO: 2799533 - DNA, 21 bp, Homo sapiens
atttaacttaacattctgtaa

SEQ ID NO: 2799534 - DNA, 15 bp, Homo sapiens
atttaagatagtttt

SEQ ID NO: 2799535 - DNA, 15 bp, Homo sapiens
atttaagcattttac

SEQ ID NO: 2799536 - DNA, 14 bp, Homo sapiens
atttaagggaaaaa

SEQ ID NO: 2799537 - DNA, 16 bp, Homo sapiens
atttaagggaaaaata

SEQ ID NO: 2799538 - DNA, 18 bp, Homo sapiens
atttaagggaaaaatata

SEQ ID NO: 2799539 - DNA, 23 bp, Homo sapiens
atttaagtatatagtatatttat

SEQ ID NO: 2799540 - DNA, 14 bp, Homo sapiens
atttaataaatgta

SEQ ID NO: 2799541 - DNA, 17 bp, Homo sapiens
atttaatagcaaagaat

SEQ ID NO: 2799542 - DNA, 16 bp, Homo sapiens
atttaatatagctatt

SEQ ID NO: 2799543 - DNA, 19 bp, Homo sapiens
atttaatatagctattttt

SEQ ID NO: 2799544 - DNA, 19 bp, Homo sapiens
atttaatggccaaatggtt

SEQ ID NO: 2799545 - DNA, 22 bp, Homo sapiens
atttaattttcctggaaagact

SEQ ID NO: 2799546 - DNA, 15 bp, Homo sapiens
atttaatttttgcaa

SEQ ID NO: 2799547 - DNA, 14 bp, Homo sapiens
atttacaataaata

SEQ ID NO: 2799548 - DNA, 17 bp, Homo sapiens
atttacaataaatattc

SEQ ID NO: 2799549 - DNA, 21 bp, Homo sapiens
atttacaataaatattctgca

SEQ ID NO: 2799550 - DNA, 21 bp, Homo sapiens
atttacagcctcacttgaatg

SEQ ID NO: 2799551 - DNA, 15 bp, Homo sapiens
atttaccacagcagc

SEQ ID NO: 2799552 - DNA, 17 bp, Homo sapiens
atttaccacagcagctg

SEQ ID NO: 2799553 - DNA, 21 bp, Homo sapiens
atttaccacagcagctgaaca

SEQ ID NO: 2799554 - DNA, 16 bp, Homo sapiens
atttacgactgaagaa

SEQ ID NO: 2799555 - DNA, 14 bp, Homo sapiens
atttactaaaagaa

SEQ ID NO: 2799556 - DNA, 19 bp, Homo sapiens
atttacttaatgggtacaa

SEQ ID NO: 2799557 - DNA, 12 bp, Homo sapiens
atttagaaaaca

SEQ ID NO: 2799558 - DNA, 22 bp, Homo sapiens
atttagaaagaagcccaatatt

SEQ ID NO: 2799559 - DNA, 17 bp, Homo sapiens
atttagagatgaattaa

SEQ ID NO: 2799560 - DNA, 22 bp, Homo sapiens
atttagagatgaattaaattta

SEQ ID NO: 2799561 - DNA, 14 bp, Homo sapiens
atttaggtttctga

SEQ ID NO: 2799562 - DNA, 20 bp, Homo sapiens
atttagtgaaagctagagat

SEQ ID NO: 2799563 - DNA, 14 bp, Homo sapiens
atttataaatgtgt

SEQ ID NO: 2799564 - DNA, 16 bp, Homo sapiens
atttataactcatcat

SEQ ID NO: 2799565 - DNA, 20 bp, Homo sapiens
atttataactcatcataaaa

SEQ ID NO: 2799566 - DNA, 22 bp, Homo sapiens
atttataactcatcataaaata

SEQ ID NO: 2799567 - DNA, 11 bp, Homo sapiens
atttatactct

SEQ ID NO: 2799568 - DNA, 23 bp, Homo sapiens
atttatactctagaacatgcaca

SEQ ID NO: 2799569 - DNA, 15 bp, Homo sapiens
atttatatatatatg

SEQ ID NO: 2799570 - DNA, 17 bp, Homo sapiens
atttatatatatatgta

SEQ ID NO: 2799571 - DNA, 12 bp, Homo sapiens
atttatatattt

SEQ ID NO: 2799572 - DNA, 15 bp, Homo sapiens
atttatatatttata

SEQ ID NO: 2799573 - DNA, 20 bp, Homo sapiens
atttatatatttataactca

SEQ ID NO: 2799574 - DNA, 13 bp, Homo sapiens
atttatatatttg

SEQ ID NO: 2799575 - DNA, 12 bp, Homo sapiens
atttatatctat

SEQ ID NO: 2799576 - DNA, 16 bp, Homo sapiens
atttatatctatagta

SEQ ID NO: 2799577 - DNA, 15 bp, Homo sapiens
atttatattcagaga

SEQ ID NO: 2799578 - DNA, 19 bp, Homo sapiens
atttatattcagagatgta

SEQ ID NO: 2799579 - DNA, 15 bp, Homo sapiens
atttatatttggaaa

SEQ ID NO: 2799580 - DNA, 17 bp, Homo sapiens
atttatatttggaaaga

SEQ ID NO: 2799581 - DNA, 14 bp, Homo sapiens
atttatattttccc

SEQ ID NO: 2799582 - DNA, 13 bp, Homo sapiens
atttatgaaaaga

SEQ ID NO: 2799583 - DNA, 12 bp, Homo sapiens
atttatgtaaac

SEQ ID NO: 2799584 - DNA, 15 bp, Homo sapiens
atttattacctctga

SEQ ID NO: 2799585 - DNA, 14 bp, Homo sapiens
atttattagctgta

SEQ ID NO: 2799586 - DNA, 16 bp, Homo sapiens
atttattagctgtaaa

SEQ ID NO: 2799587 - DNA, 23 bp, Homo sapiens
atttattagttaggtgtgccaaa

SEQ ID NO: 2799588 - DNA, 14 bp, Homo sapiens
atttattattttca

SEQ ID NO: 2799589 - DNA, 19 bp, Homo sapiens
atttattgtcattactgcc

SEQ ID NO: 2799590 - DNA, 15 bp, Homo sapiens
atttatttaatgtta

SEQ ID NO: 2799591 - DNA, 17 bp, Homo sapiens
atttatttaatgttatg

SEQ ID NO: 2799592 - DNA, 14 bp, Homo sapiens
atttatttcaaaaa

SEQ ID NO: 2799593 - DNA, 12 bp, Homo sapiens
atttattttgac

SEQ ID NO: 2799594 - DNA, 12 bp, Homo sapiens
atttcaaaataa

SEQ ID NO: 2799595 - DNA, 15 bp, Homo sapiens
atttcaagaccttct

SEQ ID NO: 2799596 - DNA, 22 bp, Homo sapiens
atttcagagaggccttttggaa

SEQ ID NO: 2799597 - DNA, 17 bp, Homo sapiens
atttcagaggctgcagg

SEQ ID NO: 2799598 - DNA, 18 bp, Homo sapiens
atttcagattcccagagc

SEQ ID NO: 2799599 - DNA, 22 bp, Homo sapiens
atttcaggatactctgtcagat

SEQ ID NO: 2799600 - DNA, 22 bp, Homo sapiens
atttcaggggtcgtcaccacct

SEQ ID NO: 2799601 - DNA, 14 bp, Homo sapiens
atttcatctatttc

SEQ ID NO: 2799602 - DNA, 19 bp, Homo sapiens
atttcatctatttctgaga

SEQ ID NO: 2799603 - DNA, 23 bp, Homo sapiens
atttcatctcatttaagggaaaa

SEQ ID NO: 2799604 - DNA, 18 bp, Homo sapiens
atttcatttcaactgttt

SEQ ID NO: 2799605 - DNA, 16 bp, Homo sapiens
atttccaaagagaaaa

SEQ ID NO: 2799606 - DNA, 13 bp, Homo sapiens
atttccaaatgaa

SEQ ID NO: 2799607 - DNA, 15 bp, Homo sapiens
atttccaagagctga

SEQ ID NO: 2799608 - DNA, 17 bp, Homo sapiens
atttccacataaaggta

SEQ ID NO: 2799609 - DNA, 13 bp, Homo sapiens
atttccagtacct

SEQ ID NO: 2799610 - DNA, 17 bp, Homo sapiens
atttccagtacctttgt

SEQ ID NO: 2799611 - DNA, 16 bp, Homo sapiens
atttccatttcttcct

SEQ ID NO: 2799612 - DNA, 19 bp, Homo sapiens
atttcctattttaaaacca

SEQ ID NO: 2799613 - DNA, 19 bp, Homo sapiens
atttcctatttttggaaga

SEQ ID NO: 2799614 - DNA, 11 bp, Homo sapiens
atttccttgga

SEQ ID NO: 2799615 - DNA, 17 bp, Homo sapiens
atttctatagccaaaaa

SEQ ID NO: 2799616 - DNA, 12 bp, Homo sapiens
atttctatttat

SEQ ID NO: 2799617 - DNA, 13 bp, Homo sapiens
atttctatttatt

SEQ ID NO: 2799618 - DNA, 18 bp, Homo sapiens
atttctatttttgtagaa

SEQ ID NO: 2799619 - DNA, 23 bp, Homo sapiens
atttctctctttcttggtgtctg

SEQ ID NO: 2799620 - DNA, 20 bp, Homo sapiens
atttctgaaatgacctcaag

SEQ ID NO: 2799621 - DNA, 11 bp, Homo sapiens
atttctgagaa

SEQ ID NO: 2799622 - DNA, 23 bp, Homo sapiens
atttctgagaaggtccttaatga

SEQ ID NO: 2799623 - DNA, 15 bp, Homo sapiens
atttctgctcttcca

SEQ ID NO: 2799624 - DNA, 20 bp, Homo sapiens
atttctgctcttccaaagct

SEQ ID NO: 2799625 - DNA, 16 bp, Homo sapiens
atttctggcttctagt

SEQ ID NO: 2799626 - DNA, 13 bp, Homo sapiens
atttcttaaacaa

SEQ ID NO: 2799627 - DNA, 24 bp, Homo sapiens
atttcttatttgtttggtcactgc

SEQ ID NO: 2799628 - DNA, 18 bp, Homo sapiens
atttcttcctcactatga

SEQ ID NO: 2799629 - DNA, 20 bp, Homo sapiens
atttcttggtaagaagccgg

SEQ ID NO: 2799630 - DNA, 15 bp, Homo sapiens
atttgaaatttagct

SEQ ID NO: 2799631 - DNA, 16 bp, Homo sapiens
atttgaagcaaagcac

SEQ ID NO: 2799632 - DNA, 16 bp, Homo sapiens
atttgaagctgtaccc

SEQ ID NO: 2799633 - DNA, 22 bp, Homo sapiens
atttgaatatcattaaattgga

SEQ ID NO: 2799634 - DNA, 15 bp, Homo sapiens
atttgagcagggctc

SEQ ID NO: 2799635 - DNA, 16 bp, Homo sapiens
atttgagcagggctca

SEQ ID NO: 2799636 - DNA, 17 bp, Homo sapiens
atttgagcagggctcag

SEQ ID NO: 2799637 - DNA, 15 bp, Homo sapiens
atttgcagagacagg

SEQ ID NO: 2799638 - DNA, 19 bp, Homo sapiens
atttgcagagacaggacct

SEQ ID NO: 2799639 - DNA, 13 bp, Homo sapiens
atttgcttattta

SEQ ID NO: 2799640 - DNA, 14 bp, Homo sapiens
atttgcttatttat

SEQ ID NO: 2799641 - DNA, 18 bp, Homo sapiens
atttgcttatttatattc

SEQ ID NO: 2799642 - DNA, 16 bp, Homo sapiens
atttggcctgcactaa

SEQ ID NO: 2799643 - DNA, 21 bp, Homo sapiens
atttggggcttgcatgccaaa

SEQ ID NO: 2799644 - DNA, 21 bp, Homo sapiens
atttggtaaattagtatttat

SEQ ID NO: 2799645 - DNA, 20 bp, Homo sapiens
atttggtgtggctgtattca

SEQ ID NO: 2799646 - DNA, 22 bp, Homo sapiens
atttgtaatagatgtttgatag

SEQ ID NO: 2799647 - DNA, 16 bp, Homo sapiens
atttgtaatgtatctt

SEQ ID NO: 2799648 - DNA, 22 bp, Homo sapiens
atttgtaatgtatcttatttat

SEQ ID NO: 2799649 - DNA, 20 bp, Homo sapiens
atttgtagaagggttatatt

SEQ ID NO: 2799650 - DNA, 14 bp, Homo sapiens
atttgtatatcatg

SEQ ID NO: 2799651 - DNA, 16 bp, Homo sapiens
atttgtatatcatgaa

SEQ ID NO: 2799652 - DNA, 21 bp, Homo sapiens
atttgtatttatattagagtg

SEQ ID NO: 2799653 - DNA, 18 bp, Homo sapiens
atttgtgagccaaagaga

SEQ ID NO: 2799654 - DNA, 18 bp, Homo sapiens
atttgtgtagattgtgta

SEQ ID NO: 2799655 - DNA, 17 bp, Homo sapiens
atttgttaaatatttac

SEQ ID NO: 2799656 - DNA, 12 bp, Homo sapiens
atttgttaatgg

SEQ ID NO: 2799657 - DNA, 19 bp, Homo sapiens
atttgttaatttagaaaac

SEQ ID NO: 2799658 - DNA, 22 bp, Homo sapiens
atgcatttttgatgggaagaaa

SEQ ID NO: 2799659 - DNA, 18 bp, Homo sapiens
atgccaaaaaaaaataca

SEQ ID NO: 2799660 - DNA, 22 bp, Homo sapiens
atgccaacatacccttctttaa

SEQ ID NO: 2799661 - DNA, 14 bp, Homo sapiens
atgccaacttgtcc

SEQ ID NO: 2799662 - DNA, 23 bp, Homo sapiens
atgccatctccaccctgagcctg

SEQ ID NO: 2799663 - DNA, 19 bp, Homo sapiens
atgccatggacagaagaag

SEQ ID NO: 2799664 - DNA, 22 bp, Homo sapiens
atgcccagagggcccaggcagg

SEQ ID NO: 2799665 - DNA, 20 bp, Homo sapiens
atgcccctgtactccagcct

SEQ ID NO: 2799666 - DNA, 13 bp, Homo sapiens
atgccctctctga

SEQ ID NO: 2799667 - DNA, 20 bp, Homo sapiens
atgccgctcttctgtcatcc

SEQ ID NO: 2799668 - DNA, 21 bp, Homo sapiens
atgccgctcttctgtcatccc

SEQ ID NO: 2799669 - DNA, 22 bp, Homo sapiens
atgccgctcttctgtcatcccg

SEQ ID NO: 2799670 - DNA, 13 bp, Homo sapiens
atgcctaataaac

SEQ ID NO: 2799671 - DNA, 13 bp, Homo sapiens
atgcctacagata

SEQ ID NO: 2799672 - DNA, 13 bp, Homo sapiens
atgcctccaccgc

SEQ ID NO: 2799673 - DNA, 21 bp, Homo sapiens
atgcctccaccgctgcctaag

SEQ ID NO: 2799674 - DNA, 23 bp, Homo sapiens
atgcctctcccgcaccaggccgg

SEQ ID NO: 2799675 - DNA, 13 bp, Homo sapiens
atgcctctgaggc

SEQ ID NO: 2799676 - DNA, 14 bp, Homo sapiens
atgcctctgaggcc

SEQ ID NO: 2799677 - DNA, 17 bp, Homo sapiens
atgcctgagggtggaga

SEQ ID NO: 2799678 - DNA, 16 bp, Homo sapiens
atgcctgattttaaaa

SEQ ID NO: 2799679 - DNA, 21 bp, Homo sapiens
atgcctggcccccctccaggc

SEQ ID NO: 2799680 - DNA, 22 bp, Homo sapiens
atgcctggcccccctccaggca

SEQ ID NO: 2799681 - DNA, 12 bp, Homo sapiens
atgcctggtggc

SEQ ID NO: 2799682 - DNA, 14 bp, Homo sapiens
atgcctggtggcag

SEQ ID NO: 2799683 - DNA, 17 bp, Homo sapiens
atgcctggtggcagctg

SEQ ID NO: 2799684 - DNA, 14 bp, Homo sapiens
atgccttttatttc

SEQ ID NO: 2799685 - DNA, 19 bp, Homo sapiens
atgcggccgcattccctga

SEQ ID NO: 2799686 - DNA, 20 bp, Homo sapiens
atgctaaatgcaaacactgt

SEQ ID NO: 2799687 - DNA, 16 bp, Homo sapiens
atgctaagagaagtag

SEQ ID NO: 2799688 - DNA, 17 bp, Homo sapiens
atgctaagagaagtaga

SEQ ID NO: 2799689 - DNA, 22 bp, Homo sapiens
atgctaagagaagtagaaatca

SEQ ID NO: 2799690 - DNA, 16 bp, Homo sapiens
atgctcaaccactgtg

SEQ ID NO: 2799691 - DNA, 17 bp, Homo sapiens
atgctcaaccactgtgg

SEQ ID NO: 2799692 - DNA, 14 bp, Homo sapiens
atgctcaagttttt

SEQ ID NO: 2799693 - DNA, 12 bp, Homo sapiens
atgctgaaggga

SEQ ID NO: 2799694 - DNA, 15 bp, Homo sapiens
atgctgaattatttt

SEQ ID NO: 2799695 - DNA, 21 bp, Homo sapiens
atgctggacggcattcctgct

SEQ ID NO: 2799696 - DNA, 23 bp, Homo sapiens
atgctggcctcccaataaagctg

SEQ ID NO: 2799697 - DNA, 18 bp, Homo sapiens
atgctggctgttggctgg

SEQ ID NO: 2799698 - DNA, 19 bp, Homo sapiens
atgctggctgttggctggg

SEQ ID NO: 2799699 - DNA, 20 bp, Homo sapiens
atgctggctgttggctgggg

SEQ ID NO: 2799700 - DNA, 14 bp, Homo sapiens
atgctgtatatgtt

SEQ ID NO: 2799701 - DNA, 20 bp, Homo sapiens
atgctgtcaactatgatatg

SEQ ID NO: 2799702 - DNA, 22 bp, Homo sapiens
atgctgtcaactatgatatggt

SEQ ID NO: 2799703 - DNA, 17 bp, Homo sapiens
atgctgttgcctcatct

SEQ ID NO: 2799704 - DNA, 16 bp, Homo sapiens
atgctgttttaataat

SEQ ID NO: 2799705 - DNA, 17 bp, Homo sapiens
atgcttcagttgtactt

SEQ ID NO: 2799706 - DNA, 21 bp, Homo sapiens
atgcttcttgccccttgggcc

SEQ ID NO: 2799707 - DNA, 20 bp, Homo sapiens
atgctttcccaccagcatgt

SEQ ID NO: 2799708 - DNA, 13 bp, Homo sapiens
atgctttcctccc

SEQ ID NO: 2799709 - DNA, 16 bp, Homo sapiens
atgctttgtgtgattg

SEQ ID NO: 2799710 - DNA, 15 bp, Homo sapiens
atgcttttattcaag

SEQ ID NO: 2799711 - DNA, 21 bp, Homo sapiens
atgcttttctagcaactgttg

SEQ ID NO: 2799712 - DNA, 16 bp, Homo sapiens
atggaaaaatactgcc

SEQ ID NO: 2799713 - DNA, 15 bp, Homo sapiens
atggaatacagtgtt

SEQ ID NO: 2799714 - DNA, 22 bp, Homo sapiens
atggaatacagtgttattttct

SEQ ID NO: 2799715 - DNA, 17 bp, Homo sapiens
atggacgaacaggggcc

SEQ ID NO: 2799716 - DNA, 22 bp, Homo sapiens
atggacggccccgtcagccaca

SEQ ID NO: 2799717 - DNA, 18 bp, Homo sapiens
atggagactcctgccctg

SEQ ID NO: 2799718 - DNA, 23 bp, Homo sapiens
atggagcgcacctgccccctggt

SEQ ID NO: 2799719 - DNA, 14 bp, Homo sapiens
atggagcttgtaca

SEQ ID NO: 2799720 - DNA, 16 bp, Homo sapiens
atggaggatggagaga

SEQ ID NO: 2799721 - DNA, 16 bp, Homo sapiens
atggagtgagcagtag

SEQ ID NO: 2799722 - DNA, 21 bp, Homo sapiens
atggagtgtcaccagctgcca

SEQ ID NO: 2799723 - DNA, 15 bp, Homo sapiens
atggagttcttgtgc

SEQ ID NO: 2799724 - DNA, 16 bp, Homo sapiens
atggatcctggaggat

SEQ ID NO: 2799725 - DNA, 19 bp, Homo sapiens
atggcaaggactgcaggga

SEQ ID NO: 2799726 - DNA, 15 bp, Homo sapiens
atggcaattttgtaa

SEQ ID NO: 2799727 - DNA, 19 bp, Homo sapiens
atggcagaggaatatcaat

SEQ ID NO: 2799728 - DNA, 21 bp, Homo sapiens
atggcagatgtaggagggact

SEQ ID NO: 2799729 - DNA, 14 bp, Homo sapiens
atggcagtccagcc

SEQ ID NO: 2799730 - DNA, 16 bp, Homo sapiens
atggcagtccagccag

SEQ ID NO: 2799731 - DNA, 20 bp, Homo sapiens
atggcagtccagccagctcc

SEQ ID NO: 2799732 - DNA, 20 bp, Homo sapiens
atggcgtgtccctctcggaa

SEQ ID NO: 2799733 - DNA, 13 bp, Homo sapiens
atggctattttat

SEQ ID NO: 2799734 - DNA, 13 bp, Homo sapiens
atggctgtatttt

SEQ ID NO: 2799735 - DNA, 16 bp, Homo sapiens
atggctgtatttttag

SEQ ID NO: 2799736 - DNA, 18 bp, Homo sapiens
atggctgtgcctctgcct

SEQ ID NO: 2799737 - DNA, 16 bp, Homo sapiens
atgggagtgagacaga

SEQ ID NO: 2799738 - DNA, 23 bp, Homo sapiens
atgggatctgtaaggaactggaa

SEQ ID NO: 2799739 - DNA, 18 bp, Homo sapiens
atgggcaacccccagcct

SEQ ID NO: 2799740 - DNA, 17 bp, Homo sapiens
atgggccaattaaaata

SEQ ID NO: 2799741 - DNA, 22 bp, Homo sapiens
atgggccaattaaaatatatat

SEQ ID NO: 2799742 - DNA, 17 bp, Homo sapiens
atgggcctcctgtgtgt

SEQ ID NO: 2799743 - DNA, 19 bp, Homo sapiens
atggggctgaacggggaga

SEQ ID NO: 2799744 - DNA, 22 bp, Homo sapiens
atgggggtgctgcagccaggag

SEQ ID NO: 2799745 - DNA, 18 bp, Homo sapiens
atgggtaatataaagtgt

SEQ ID NO: 2799746 - DNA, 22 bp, Homo sapiens
atgggtattaaacttgtcagaa

SEQ ID NO: 2799747 - DNA, 13 bp, Homo sapiens
atgggtgtgtgtt

SEQ ID NO: 2799748 - DNA, 23 bp, Homo sapiens
atgaaccacatcttgctctgctg

SEQ ID NO: 2799749 - DNA, 13 bp, Homo sapiens
atgaaccatcctt

SEQ ID NO: 2799750 - DNA, 13 bp, Homo sapiens
atgaactgtgaca

SEQ ID NO: 2799751 - DNA, 16 bp, Homo sapiens
atgaacttgaggacac

SEQ ID NO: 2799752 - DNA, 20 bp, Homo sapiens
atgaagaaaaaatacatttt

SEQ ID NO: 2799753 - DNA, 16 bp, Homo sapiens
atgaagacaggacagt

SEQ ID NO: 2799754 - DNA, 21 bp, Homo sapiens
atgaagacaggacagtgcttc

SEQ ID NO: 2799755 - DNA, 20 bp, Homo sapiens
atgaagacccagtgtaaaga

SEQ ID NO: 2799756 - DNA, 12 bp, Homo sapiens
atgaagcccaag

SEQ ID NO: 2799757 - DNA, 22 bp, Homo sapiens
atgaagctggaagcactgctgt

SEQ ID NO: 2799758 - DNA, 23 bp, Homo sapiens
atgaagctggaagcactgctgtg

SEQ ID NO: 2799759 - DNA, 17 bp, Homo sapiens
atgaagggaaaggatat

SEQ ID NO: 2799760 - DNA, 18 bp, Homo sapiens
atgaaggtgtcatacaga

SEQ ID NO: 2799761 - DNA, 15 bp, Homo sapiens
ataaagtatgccttc

SEQ ID NO: 2799762 - DNA, 13 bp, Homo sapiens
ataaagtctgagt

SEQ ID NO: 2799763 - DNA, 15 bp, Homo sapiens
ataaagtctgagtgg

SEQ ID NO: 2799764 - DNA, 18 bp, Homo sapiens
ataaagttggtgacagat

SEQ ID NO: 2799765 - DNA, 14 bp, Homo sapiens
ataaataaaaatat

SEQ ID NO: 2799766 - DNA, 13 bp, Homo sapiens
ataaataaatgcc

SEQ ID NO: 2799767 - DNA, 21 bp, Homo sapiens
ataaataatcggcccacagct

SEQ ID NO: 2799768 - DNA, 14 bp, Homo sapiens
ataaatataattgg

SEQ ID NO: 2799769 - DNA, 22 bp, Homo sapiens
ataaatatatatttttcaacca

SEQ ID NO: 2799770 - DNA, 14 bp, Homo sapiens
ataaatcaatgtca

SEQ ID NO: 2799771 - DNA, 15 bp, Homo sapiens
ataaatcaatgtcac

SEQ ID NO: 2799772 - DNA, 20 bp, Homo sapiens
ataaatgcaatatgtattaa

SEQ ID NO: 2799773 - DNA, 17 bp, Homo sapiens
ataaatgccaacatacc

SEQ ID NO: 2799774 - DNA, 13 bp, Homo sapiens
ataaatggctggt

SEQ ID NO: 2799775 - DNA, 13 bp, Homo sapiens
ataaatgtatcat

SEQ ID NO: 2799776 - DNA, 15 bp, Homo sapiens
ataaatgtatcttat

SEQ ID NO: 2799777 - DNA, 18 bp, Homo sapiens
ataaatgtatcttattca

SEQ ID NO: 2799778 - DNA, 15 bp, Homo sapiens
ataaattccactgga

SEQ ID NO: 2799779 - DNA, 13 bp, Homo sapiens
ataaattgaaata

SEQ ID NO: 2799780 - DNA, 14 bp, Homo sapiens
ataaattgaaatat

SEQ ID NO: 2799781 - DNA, 18 bp, Homo sapiens
ataaattgctccttgaca

SEQ ID NO: 2799782 - DNA, 19 bp, Homo sapiens
ataaattggtgataagtgg

SEQ ID NO: 2799783 - DNA, 20 bp, Homo sapiens
ataaattggtgataagtgga

SEQ ID NO: 2799784 - DNA, 20 bp, Homo sapiens
ataaatttggttctaataga

SEQ ID NO: 2799785 - DNA, 23 bp, Homo sapiens
ataacaaaatcacaagcaataat

SEQ ID NO: 2799786 - DNA, 14 bp, Homo sapiens
ataacaacttcata

SEQ ID NO: 2799787 - DNA, 16 bp, Homo sapiens
ataacaatgtgctctc

SEQ ID NO: 2799788 - DNA, 20 bp, Homo sapiens
ataacatttgagtatccgat

SEQ ID NO: 2799789 - DNA, 13 bp, Homo sapiens
ataaccacttaaa

SEQ ID NO: 2799790 - DNA, 20 bp, Homo sapiens
ataaccatcagttactggtt

SEQ ID NO: 2799791 - DNA, 13 bp, Homo sapiens
ataaccccacctt

SEQ ID NO: 2799792 - DNA, 17 bp, Homo sapiens
ataacgtttaagccaaa

SEQ ID NO: 2799793 - DNA, 20 bp, Homo sapiens
ataactagatctcctgtaat

SEQ ID NO: 2799794 - DNA, 22 bp, Homo sapiens
ataactagatctcctgtaattt

SEQ ID NO: 2799795 - DNA, 14 bp, Homo sapiens
ataactgaaaatta

SEQ ID NO: 2799796 - DNA, 21 bp, Homo sapiens
ataactgaaaattatttaaac

SEQ ID NO: 2799797 - DNA, 12 bp, Homo sapiens
ataacttaaaaa

SEQ ID NO: 2799798 - DNA, 12 bp, Homo sapiens
ataacttaaaat

SEQ ID NO: 2799799 - DNA, 13 bp, Homo sapiens
ataagaaactttt

SEQ ID NO: 2799800 - DNA, 14 bp, Homo sapiens
ataagaaacttttt

SEQ ID NO: 2799801 - DNA, 11 bp, Homo sapiens
ataagaagaat

SEQ ID NO: 2799802 - DNA, 13 bp, Homo sapiens
ataagattagaat

SEQ ID NO: 2799803 - DNA, 21 bp, Homo sapiens
ataagcaagaaggcaaaaata

SEQ ID NO: 2799804 - DNA, 23 bp, Homo sapiens
ataagcaagaaggcaaaaatagt

SEQ ID NO: 2799805 - DNA, 17 bp, Homo sapiens
ataagcatctgtgtaac

SEQ ID NO: 2799806 - DNA, 21 bp, Homo sapiens
ataagcatctgtgtaacctcc

SEQ ID NO: 2799807 - DNA, 23 bp, Homo sapiens
ataagcatgatcttgttaatgca

SEQ ID NO: 2799808 - DNA, 19 bp, Homo sapiens
ataagcccaaatggctctg

SEQ ID NO: 2799809 - DNA, 13 bp, Homo sapiens
ataagtaagtttg

SEQ ID NO: 2799810 - DNA, 18 bp, Homo sapiens
ataagtactgtgtacaga

SEQ ID NO: 2799811 - DNA, 12 bp, Homo sapiens
ataagtgctgtt

SEQ ID NO: 2799812 - DNA, 16 bp, Homo sapiens
ataagtgctgtttgag

SEQ ID NO: 2799813 - DNA, 13 bp, Homo sapiens
ataagtggaaaaa

SEQ ID NO: 2799814 - DNA, 21 bp, Homo sapiens
ataagtggaaaaaagagaaaa

SEQ ID NO: 2799815 - DNA, 14 bp, Homo sapiens
ataataatgttctc

SEQ ID NO: 2799816 - DNA, 13 bp, Homo sapiens
ataatagaagaac

SEQ ID NO: 2799817 - DNA, 21 bp, Homo sapiens
ataatatctgtgaggtgctga

SEQ ID NO: 2799818 - DNA, 15 bp, Homo sapiens
ataatctagaacaca

SEQ ID NO: 2799819 - DNA, 17 bp, Homo sapiens
ataatggaaacatttac

SEQ ID NO: 2799820 - DNA, 19 bp, Homo sapiens
ataatggtgttactaaagt

SEQ ID NO: 2799821 - DNA, 15 bp, Homo sapiens
ataatggtttactgc

SEQ ID NO: 2799822 - DNA, 16 bp, Homo sapiens
ataatggtttactgct

SEQ ID NO: 2799823 - DNA, 22 bp, Homo sapiens
ataatgtataaagaacaaggta

SEQ ID NO: 2799824 - DNA, 14 bp, Homo sapiens
ataatgtttgctat

SEQ ID NO: 2799825 - DNA, 13 bp, Homo sapiens
ataattagaacaa

SEQ ID NO: 2799826 - DNA, 16 bp, Homo sapiens
ataattaggatctatg

SEQ ID NO: 2799827 - DNA, 19 bp, Homo sapiens
ataattaggatctatgcaa

SEQ ID NO: 2799828 - DNA, 23 bp, Homo sapiens
ataattaggatctatgcaatttt

SEQ ID NO: 2799829 - DNA, 21 bp, Homo sapiens
ataattatcggaagcagtgcc

SEQ ID NO: 2799830 - DNA, 22 bp, Homo sapiens
ataattatcggaagcagtgcct

SEQ ID NO: 2799831 - DNA, 20 bp, Homo sapiens
ataattatgacagttatact

SEQ ID NO: 2799832 - DNA, 17 bp, Homo sapiens
ataattccctatctttt

SEQ ID NO: 2799833 - DNA, 20 bp, Homo sapiens
ataattccctatcttttagt

SEQ ID NO: 2799834 - DNA, 14 bp, Homo sapiens
ataattcttgtata

SEQ ID NO: 2799835 - DNA, 14 bp, Homo sapiens
ataattgtgtacaa

SEQ ID NO: 2799836 - DNA, 12 bp, Homo sapiens
ataatttaacta

SEQ ID NO: 2799837 - DNA, 13 bp, Homo sapiens
ataatttaactaa

SEQ ID NO: 2799838 - DNA, 22 bp, Homo sapiens
ataatttaactaatttaaacca

SEQ ID NO: 2799839 - DNA, 15 bp, Homo sapiens
ataatttaatgcatg

SEQ ID NO: 2799840 - DNA, 17 bp, Homo sapiens
ataatttagtttcatat

SEQ ID NO: 2799841 - DNA, 15 bp, Homo sapiens
ataatttattttgta

SEQ ID NO: 2799842 - DNA, 19 bp, Homo sapiens
ataatttgtacatatgtaa

SEQ ID NO: 2799843 - DNA, 20 bp, Homo sapiens
ataattttcaagagaagaaa

SEQ ID NO: 2799844 - DNA, 21 bp, Homo sapiens
ataattttcaagagaagaaaa

SEQ ID NO: 2799845 - DNA, 13 bp, Homo sapiens
ataattttcttca

SEQ ID NO: 2799846 - DNA, 22 bp, Homo sapiens
ataattttcttcatgcaatgac

SEQ ID NO: 2799847 - DNA, 21 bp, Homo sapiens
ataatttttttcaatatttat

SEQ ID NO: 2799848 - DNA, 13 bp, Homo sapiens
atacaaaataatt

SEQ ID NO: 2799849 - DNA, 14 bp, Homo sapiens
atacaaaataattt

SEQ ID NO: 2799850 - DNA, 20 bp, Homo sapiens
atacaaaataatttaactaa

SEQ ID NO: 2799851 - DNA, 14 bp, Homo sapiens
atagtattcatttt

SEQ ID NO: 2799852 - DNA, 20 bp, Homo sapiens
atagtcaaaccataaacttc

SEQ ID NO: 2799853 - DNA, 15 bp, Homo sapiens
agtgggagctgcctg

SEQ ID NO: 2799854 - DNA, 18 bp, Homo sapiens
agggcccagagagggtgg

SEQ ID NO: 2799855 - DNA, 15 bp, Homo sapiens
agggcccaggcaggc

SEQ ID NO: 2799856 - DNA, 14 bp, Homo sapiens
agggccccagcact

SEQ ID NO: 2799857 - DNA, 18 bp, Homo sapiens
agggccccagcactaaag

SEQ ID NO: 2799858 - DNA, 23 bp, Homo sapiens
aggatgaggaacctcaaactggg

SEQ ID NO: 2799859 - DNA, 22 bp, Homo sapiens
aggatggacgaacaggggccaa

SEQ ID NO: 2799860 - DNA, 15 bp, Homo sapiens
aggatggagagaggg

SEQ ID NO: 2799861 - DNA, 17 bp, Homo sapiens
aggatggagagagggga

SEQ ID NO: 2799862 - DNA, 19 bp, Homo sapiens
aggatgtaaacagtgcctg

SEQ ID NO: 2799863 - DNA, 18 bp, Homo sapiens
aggatgttctgggacaca

SEQ ID NO: 2799864 - DNA, 18 bp, Homo sapiens
aggattatgggtcctgca

SEQ ID NO: 2799865 - DNA, 19 bp, Homo sapiens
aggattatgggtcctgcaa

SEQ ID NO: 2799866 - DNA, 15 bp, Homo sapiens
aggattccaaagttt

SEQ ID NO: 2799867 - DNA, 18 bp, Homo sapiens
aggattgctactgtccta

SEQ ID NO: 2799868 - DNA, 22 bp, Homo sapiens
aggattgctactgtcctaccca

SEQ ID NO: 2799869 - DNA, 19 bp, Homo sapiens
aggattgcttgagcccagg

SEQ ID NO: 2799870 - DNA, 17 bp, Homo sapiens
aggatttatttaaaata

SEQ ID NO: 2799871 - DNA, 16 bp, Homo sapiens
aggattttgtgttttt

SEQ ID NO: 2799872 - DNA, 19 bp, Homo sapiens
aggcaaaatccttgcttat

SEQ ID NO: 2799873 - DNA, 20 bp, Homo sapiens
aggcaaaggccagcagcaga

SEQ ID NO: 2799874 - DNA, 14 bp, Homo sapiens
aggcaactgaggca

SEQ ID NO: 2799875 - DNA, 17 bp, Homo sapiens
aggcaactgaggcagac

SEQ ID NO: 2799876 - DNA, 14 bp, Homo sapiens
aggcaagcacctcc

SEQ ID NO: 2799877 - DNA, 19 bp, Homo sapiens
aggcaagcacctcctgcct

SEQ ID NO: 2799878 - DNA, 17 bp, Homo sapiens
aggcaagtgaagaaaag

SEQ ID NO: 2799879 - DNA, 15 bp, Homo sapiens
aggcaatgctggctg

SEQ ID NO: 2799880 - DNA, 16 bp, Homo sapiens
aggcaatgctggctgt

SEQ ID NO: 2799881 - DNA, 15 bp, Homo sapiens
aggcacacttcttct

SEQ ID NO: 2799882 - DNA, 16 bp, Homo sapiens
aggcacacttcttctt

SEQ ID NO: 2799883 - DNA, 14 bp, Homo sapiens
aggcacgaacccac

SEQ ID NO: 2799884 - DNA, 15 bp, Homo sapiens
aggcagaagaattga

SEQ ID NO: 2799885 - DNA, 22 bp, Homo sapiens
aggcagaagaattgaacccagg

SEQ ID NO: 2799886 - DNA, 13 bp, Homo sapiens
aggcagacagcag

SEQ ID NO: 2799887 - DNA, 18 bp, Homo sapiens
aggcagacagcagctcag

SEQ ID NO: 2799888 - DNA, 16 bp, Homo sapiens
aggcagccccattctg

SEQ ID NO: 2799889 - DNA, 19 bp, Homo sapiens
aggcagccccattctgcct

SEQ ID NO: 2799890 - DNA, 18 bp, Homo sapiens
aggcagctggatgagact

SEQ ID NO: 2799891 - DNA, 22 bp, Homo sapiens
aggcagctggatgagacttcca

SEQ ID NO: 2799892 - DNA, 22 bp, Homo sapiens
aggcagctgtgtgggctgcaga

SEQ ID NO: 2799893 - DNA, 14 bp, Homo sapiens
aggcaggcagggct

SEQ ID NO: 2799894 - DNA, 15 bp, Homo sapiens
aggcaggcagggctc

SEQ ID NO: 2799895 - DNA, 18 bp, Homo sapiens
aggcaggcagggctctcc

SEQ ID NO: 2799896 - DNA, 22 bp, Homo sapiens
aggcagggaaaggctctgaaag

SEQ ID NO: 2799897 - DNA, 21 bp, Homo sapiens
aggcagggccttgcccagaga

SEQ ID NO: 2799898 - DNA, 22 bp, Homo sapiens
aggcagggccttgcccagagat

SEQ ID NO: 2799899 - DNA, 12 bp, Homo sapiens
aggcagggctct

SEQ ID NO: 2799900 - DNA, 14 bp, Homo sapiens
aggcagggctctcc

SEQ ID NO: 2799901 - DNA, 19 bp, Homo sapiens
aggcagggctctcctggct

SEQ ID NO: 2799902 - DNA, 15 bp, Homo sapiens
aggcaggggtgggag

SEQ ID NO: 2799903 - DNA, 19 bp, Homo sapiens
aggcaggggtgggagagcc

SEQ ID NO: 2799904 - DNA, 14 bp, Homo sapiens
aggcagggtcagga

SEQ ID NO: 2799905 - DNA, 17 bp, Homo sapiens
aggcagggtcaggagag

SEQ ID NO: 2799906 - DNA, 19 bp, Homo sapiens
aggcagggtcaggagaggg

SEQ ID NO: 2799907 - DNA, 18 bp, Homo sapiens
aggcagggtctcactctg

SEQ ID NO: 2799908 - DNA, 21 bp, Homo sapiens
aggcagggtctcactctgtcg

SEQ ID NO: 2799909 - DNA, 14 bp, Homo sapiens
aggcaggtccaggg

SEQ ID NO: 2799910 - DNA, 18 bp, Homo sapiens
aggcatgctggcctccca

SEQ ID NO: 2799911 - DNA, 13 bp, Homo sapiens
aggcatggagaca

SEQ ID NO: 2799912 - DNA, 20 bp, Homo sapiens
aggcatgttctctgaggaca

SEQ ID NO: 2799913 - DNA, 13 bp, Homo sapiens
aggcatttcctgg

SEQ ID NO: 2799914 - DNA, 20 bp, Homo sapiens
aggcatttctatcacatatt

SEQ ID NO: 2799915 - DNA, 23 bp, Homo sapiens
aggcatttttactactattctgt

SEQ ID NO: 2799916 - DNA, 18 bp, Homo sapiens
aggccaccgggacagacc

SEQ ID NO: 2799917 - DNA, 19 bp, Homo sapiens
aggccactcctccaaagga

SEQ ID NO: 2799918 - DNA, 14 bp, Homo sapiens
aggccagagggagt

SEQ ID NO: 2799919 - DNA, 16 bp, Homo sapiens
aggccagcctggcctc

SEQ ID NO: 2799920 - DNA, 17 bp, Homo sapiens
aggccagcctggcctcc

SEQ ID NO: 2799921 - DNA, 11 bp, Homo sapiens
aggccaggagt

SEQ ID NO: 2799922 - DNA, 19 bp, Homo sapiens
aggccaggccaccaggatg

SEQ ID NO: 2799923 - DNA, 14 bp, Homo sapiens
aggccatgggcctc

SEQ ID NO: 2799924 - DNA, 18 bp, Homo sapiens
aggccatgggcctcctgt

SEQ ID NO: 2799925 - DNA, 18 bp, Homo sapiens
aggcccactgcagagatg

SEQ ID NO: 2799926 - DNA, 16 bp, Homo sapiens
aggccccatgacctcc

SEQ ID NO: 2799927 - DNA, 19 bp, Homo sapiens
aggcccccacctggctcac

SEQ ID NO: 2799928 - DNA, 19 bp, Homo sapiens
aggccccccgcagcaccct

SEQ ID NO: 2799929 - DNA, 22 bp, Homo sapiens
aggccccccgcagcaccctgca

SEQ ID NO: 2799930 - DNA, 15 bp, Homo sapiens
aggccccgcttgtcc

SEQ ID NO: 2799931 - DNA, 20 bp, Homo sapiens
aggccccgcttgtccagcgc

SEQ ID NO: 2799932 - DNA, 15 bp, Homo sapiens
aggcccctgccaccc

SEQ ID NO: 2799933 - DNA, 18 bp, Homo sapiens
aggcccgagcagctgagc

SEQ ID NO: 2799934 - DNA, 20 bp, Homo sapiens
aggcccggctccaggctcct

SEQ ID NO: 2799935 - DNA, 13 bp, Homo sapiens
aggcccggggctg

SEQ ID NO: 2799936 - DNA, 22 bp, Homo sapiens
aggccctggagaggggctgtcc

SEQ ID NO: 2799937 - DNA, 21 bp, Homo sapiens
aggccctggatcagcgtggcc

SEQ ID NO: 2799938 - DNA, 23 bp, Homo sapiens
aggccgaagctaacagggaaggc

SEQ ID NO: 2799939 - DNA, 19 bp, Homo sapiens
aggccgctgccccagcccc

SEQ ID NO: 2799940 - DNA, 21 bp, Homo sapiens
aggccgggcttgggccctgca

SEQ ID NO: 2799941 - DNA, 16 bp, Homo sapiens
agaacaatagctattg

SEQ ID NO: 2799942 - DNA, 18 bp, Homo sapiens
agaacagacgttaccaat

SEQ ID NO: 2799943 - DNA, 16 bp, Homo sapiens
agaacaggcaagtgaa

SEQ ID NO: 2799944 - DNA, 13 bp, Homo sapiens
agaacagtaaaca

SEQ ID NO: 2799945 - DNA, 17 bp, Homo sapiens
agaacagtttgtacaga

SEQ ID NO: 2799946 - DNA, 18 bp, Homo sapiens
agaacatccaaggagaaa

SEQ ID NO: 2799947 - DNA, 21 bp, Homo sapiens
agaacatgagtttatgggaat

SEQ ID NO: 2799948 - DNA, 13 bp, Homo sapiens
agaacatgcacat

SEQ ID NO: 2799949 - DNA, 19 bp, Homo sapiens
agaacccctacatgaaaca

SEQ ID NO: 2799950 - DNA, 12 bp, Homo sapiens
agaacctcaggc

SEQ ID NO: 2799951 - DNA, 21 bp, Homo sapiens
agaacctcaggcttccttggc

SEQ ID NO: 2799952 - DNA, 14 bp, Homo sapiens
agaacctcctattt

SEQ ID NO: 2799953 - DNA, 18 bp, Homo sapiens
agaacctcctattttaat

SEQ ID NO: 2799954 - DNA, 12 bp, Homo sapiens
agaacctggcct

SEQ ID NO: 2799955 - DNA, 17 bp, Homo sapiens
agaactcagttttaact

SEQ ID NO: 2799956 - DNA, 18 bp, Homo sapiens
agaactcgaagcccttcc

SEQ ID NO: 2799957 - DNA, 18 bp, Homo sapiens
agaactgaacgtcctgca

SEQ ID NO: 2799958 - DNA, 14 bp, Homo sapiens
agaactgggatttg

SEQ ID NO: 2799959 - DNA, 21 bp, Homo sapiens
agaacttcgaccctttctctg

SEQ ID NO: 2799960 - DNA, 13 bp, Homo sapiens
agaagaaacaagg

SEQ ID NO: 2799961 - DNA, 13 bp, Homo sapiens
agaagaacatcca

SEQ ID NO: 2799962 - DNA, 21 bp, Homo sapiens
agaagaaggcagcaggtggca

SEQ ID NO: 2799963 - DNA, 15 bp, Homo sapiens
agaagaatattcagg

SEQ ID NO: 2799964 - DNA, 16 bp, Homo sapiens
agaagacatggagact

SEQ ID NO: 2799965 - DNA, 20 bp, Homo sapiens
agaagacatggagactcctg

SEQ ID NO: 2799966 - DNA, 21 bp, Homo sapiens
agaagacgggatttgaagctg

SEQ ID NO: 2799967 - DNA, 15 bp, Homo sapiens
agaagagagaaatag

SEQ ID NO: 2799968 - DNA, 22 bp, Homo sapiens
agaagagatgggcttgttttct

SEQ ID NO: 2799969 - DNA, 12 bp, Homo sapiens
agaagagcctga

SEQ ID NO: 2799970 - DNA, 13 bp, Homo sapiens
agaagcagtgagc

SEQ ID NO: 2799971 - DNA, 17 bp, Homo sapiens
agaagcagtgagccgca

SEQ ID NO: 2799972 - DNA, 14 bp, Homo sapiens
agaagccaaatttt

SEQ ID NO: 2799973 - DNA, 12 bp, Homo sapiens
agaagccaggag

SEQ ID NO: 2799974 - DNA, 20 bp, Homo sapiens
agaagccaggagcaaatgtt

SEQ ID NO: 2799975 - DNA, 18 bp, Homo sapiens
agaagcccaatattataa

SEQ ID NO: 2799976 - DNA, 21 bp, Homo sapiens
agaagcccaatattataattt

SEQ ID NO: 2799977 - DNA, 16 bp, Homo sapiens
agaagccgggaacaga

SEQ ID NO: 2799978 - DNA, 16 bp, Homo sapiens
agaagcctctgcctcc

SEQ ID NO: 2799979 - DNA, 12 bp, Homo sapiens
agaagcctgagg

SEQ ID NO: 2799980 - DNA, 11 bp, Homo sapiens
agaagcctggg

SEQ ID NO: 2799981 - DNA, 12 bp, Homo sapiens
agaagcctgggg

SEQ ID NO: 2799982 - DNA, 23 bp, Homo sapiens
agaagcgggacgagaccctacag

SEQ ID NO: 2799983 - DNA, 19 bp, Homo sapiens
agaagcggtttccaggcca

SEQ ID NO: 2799984 - DNA, 20 bp, Homo sapiens
agaagcggtttccaggccac

SEQ ID NO: 2799985 - DNA, 22 bp, Homo sapiens
aggaattctaggcatcccaggg

SEQ ID NO: 2799986 - DNA, 13 bp, Homo sapiens
aggacaagcatgg

SEQ ID NO: 2799987 - DNA, 13 bp, Homo sapiens
aggacacactaat

SEQ ID NO: 2799988 - DNA, 12 bp, Homo sapiens
aggacacaggcc

SEQ ID NO: 2799989 - DNA, 12 bp, Homo sapiens
aggacacatgtc

SEQ ID NO: 2799990 - DNA, 13 bp, Homo sapiens
aggacacatgtcc

SEQ ID NO: 2799991 - DNA, 23 bp, Homo sapiens
aggacactaaccacgctggacct

SEQ ID NO: 2799992 - DNA, 22 bp, Homo sapiens
aggacagcctgtggcggtgcct

SEQ ID NO: 2799993 - DNA, 21 bp, Homo sapiens
aggacagtgcttcagcctgag

SEQ ID NO: 2799994 - DNA, 15 bp, Homo sapiens
aggacattgcggaca

SEQ ID NO: 2799995 - DNA, 18 bp, Homo sapiens
aggacattgcggacagcc

SEQ ID NO: 2799996 - DNA, 16 bp, Homo sapiens
aggaccctggctcttc

SEQ ID NO: 2799997 - DNA, 19 bp, Homo sapiens
aggaccctggctcttctct

SEQ ID NO: 2799998 - DNA, 13 bp, Homo sapiens
aggacctgagcct

SEQ ID NO: 2799999 - DNA, 17 bp, Homo sapiens
aggacctgagcctgccg

SEQ ID NO: 2800000 - DNA, 18 bp, Homo sapiens
aggacctgagcctgccga

SEQ ID NO: 2800001 - DNA, 20 bp, Homo sapiens
aggacgccactcatttcatc

SEQ ID NO: 2800002 - DNA, 17 bp, Homo sapiens
aggactaacactcagaa

SEQ ID NO: 2800003 - DNA, 21 bp, Homo sapiens
aggactaacactcagaagcct

SEQ ID NO: 2800004 - DNA, 23 bp, Homo sapiens
aggactaacactcagaagcctgg

SEQ ID NO: 2800005 - DNA, 16 bp, Homo sapiens
aggactatgggtacat

SEQ ID NO: 2800006 - DNA, 18 bp, Homo sapiens
aggactccccaggccagg

SEQ ID NO: 2800007 - DNA, 19 bp, Homo sapiens
aggactccccaggccaggc

SEQ ID NO: 2800008 - DNA, 14 bp, Homo sapiens
aggactctgcctcc

SEQ ID NO: 2800009 - DNA, 16 bp, Homo sapiens
aggactctgcctcctc

SEQ ID NO: 2800010 - DNA, 17 bp, Homo sapiens
aggactctgcctcctct

SEQ ID NO: 2800011 - DNA, 17 bp, Homo sapiens
aggactgaattgtcccc

SEQ ID NO: 2800012 - DNA, 18 bp, Homo sapiens
aggacttaacggctccag

SEQ ID NO: 2800013 - DNA, 20 bp, Homo sapiens
aggacttaacggctccagga

SEQ ID NO: 2800014 - DNA, 15 bp, Homo sapiens
aggacttctgcctga

SEQ ID NO: 2800015 - DNA, 13 bp, Homo sapiens
aggacttgtgtct

SEQ ID NO: 2800016 - DNA, 16 bp, Homo sapiens
aggacttgtgtctctg

SEQ ID NO: 2800017 - DNA, 14 bp, Homo sapiens
aggagaaaatgcat

SEQ ID NO: 2800018 - DNA, 12 bp, Homo sapiens
aggagaaggaag

SEQ ID NO: 2800019 - DNA, 19 bp, Homo sapiens
aggagaattgcttgaaccg

SEQ ID NO: 2800020 - DNA, 14 bp, Homo sapiens
aggagaccaaggcg

SEQ ID NO: 2800021 - DNA, 15 bp, Homo sapiens
aggagaccagctcag

SEQ ID NO: 2800022 - DNA, 16 bp, Homo sapiens
aggagactcacctctg

SEQ ID NO: 2800023 - DNA, 21 bp, Homo sapiens
aggagactcacctctgcctca

SEQ ID NO: 2800024 - DNA, 14 bp, Homo sapiens
aggagagccagccc

SEQ ID NO: 2800025 - DNA, 18 bp, Homo sapiens
aggagaggggaagggcca

SEQ ID NO: 2800026 - DNA, 13 bp, Homo sapiens
aggagaggggcag

SEQ ID NO: 2800027 - DNA, 18 bp, Homo sapiens
aggagaggggcagaacag

SEQ ID NO: 2800028 - DNA, 19 bp, Homo sapiens
aggagaggggcagaacagc

SEQ ID NO: 2800029 - DNA, 13 bp, Homo sapiens
aggagatcagggc

SEQ ID NO: 2800030 - DNA, 20 bp, Homo sapiens
aggagatggaagttgcagtg

SEQ ID NO: 2800031 - DNA, 17 bp, Homo sapiens
aggagcaaatgtttctg

SEQ ID NO: 2800032 - DNA, 22 bp, Homo sapiens
aggagcaaatgtttctgcagta

SEQ ID NO: 2800033 - DNA, 15 bp, Homo sapiens
aggagcacaggcagc

SEQ ID NO: 2800034 - DNA, 22 bp, Homo sapiens
aggagcacaggcagctggatga

SEQ ID NO: 2800035 - DNA, 17 bp, Homo sapiens
aggagcccagaaaacct

SEQ ID NO: 2800036 - DNA, 22 bp, Homo sapiens
aggagccccgaggccttctctg

SEQ ID NO: 2800037 - DNA, 11 bp, Homo sapiens
aggagcctgtg

SEQ ID NO: 2800038 - DNA, 12 bp, Homo sapiens
aggagcctgtga

SEQ ID NO: 2800039 - DNA, 21 bp, Homo sapiens
aggagcctgtgaacccaggac

SEQ ID NO: 2800040 - DNA, 17 bp, Homo sapiens
aggagctacctgtgtgg

SEQ ID NO: 2800041 - DNA, 22 bp, Homo sapiens
aggagctacctgtgtggacagg

SEQ ID NO: 2800042 - DNA, 21 bp, Homo sapiens
aggagcttccagtgcatgttg

SEQ ID NO: 2800043 - DNA, 20 bp, Homo sapiens
aggaggattgcttgagccca

SEQ ID NO: 2800044 - DNA, 16 bp, Homo sapiens
aggaggctgaggcaga

SEQ ID NO: 2800045 - DNA, 19 bp, Homo sapiens
aggaggctgaggcaggagg

SEQ ID NO: 2800046 - DNA, 18 bp, Homo sapiens
aggagggacaaaggagcc

SEQ ID NO: 2800047 - DNA, 14 bp, Homo sapiens
aggagggacaagaa

SEQ ID NO: 2800048 - DNA, 19 bp, Homo sapiens
aggagggatgctgcctgag

SEQ ID NO: 2800049 - DNA, 20 bp, Homo sapiens
aggagggcaagggccatgct

SEQ ID NO: 2800050 - DNA, 17 bp, Homo sapiens
aggaggggatagagaga

SEQ ID NO: 2800051 - DNA, 20 bp, Homo sapiens
aggagggggtcgtggagagc

SEQ ID NO: 2800052 - DNA, 14 bp, Homo sapiens
aggaggtgagggat

SEQ ID NO: 2800053 - DNA, 14 bp, Homo sapiens
aggaggtttggatg

SEQ ID NO: 2800054 - DNA, 22 bp, Homo sapiens
aggagtctgaggtcctgagcac

SEQ ID NO: 2800055 - DNA, 23 bp, Homo sapiens
aggagtctgaggtcctgagcact

SEQ ID NO: 2800056 - DNA, 21 bp, Homo sapiens
aggagttcgagaccagcccag

SEQ ID NO: 2800057 - DNA, 16 bp, Homo sapiens
aggagttcgaggctgc

SEQ ID NO: 2800058 - DNA, 17 bp, Homo sapiens
aggagttcgaggctgca

SEQ ID NO: 2800059 - DNA, 19 bp, Homo sapiens
aggagtttgagaccagcct

SEQ ID NO: 2800060 - DNA, 20 bp, Homo sapiens
aggagtttgaggctgcagcg

SEQ ID NO: 2800061 - DNA, 21 bp, Homo sapiens
aggagtttgtgtgtcttttat

SEQ ID NO: 2800062 - DNA, 15 bp, Homo sapiens
aggataccatataca

SEQ ID NO: 2800063 - DNA, 15 bp, Homo sapiens
aggatcaagaaagtg

SEQ ID NO: 2800064 - DNA, 20 bp, Homo sapiens
aggatcactggagcccagga

SEQ ID NO: 2800065 - DNA, 22 bp, Homo sapiens
aggatcactggagcccaggagt

SEQ ID NO: 2800066 - DNA, 22 bp, Homo sapiens
aggatcctattctcaccaggaa

SEQ ID NO: 2800067 - DNA, 19 bp, Homo sapiens
gacaaggattgctactgtc

SEQ ID NO: 2800068 - DNA, 13 bp, Homo sapiens
gacaataaaacat

SEQ ID NO: 2800069 - DNA, 13 bp, Homo sapiens
gacacacagcact

SEQ ID NO: 2800070 - DNA, 22 bp, Homo sapiens
gacacacgtatttatatttgga

SEQ ID NO: 2800071 - DNA, 12 bp, Homo sapiens
gacacagctctt

SEQ ID NO: 2800072 - DNA, 20 bp, Homo sapiens
gacacagctcttctccaggc

SEQ ID NO: 2800073 - DNA, 22 bp, Homo sapiens
gacacagctcttctccaggctg

SEQ ID NO: 2800074 - DNA, 12 bp, Homo sapiens
gacacaggcccg

SEQ ID NO: 2800075 - DNA, 20 bp, Homo sapiens
gacacaggcccggctccagg

SEQ ID NO: 2800076 - DNA, 21 bp, Homo sapiens
gacacaggcccggctccaggc

SEQ ID NO: 2800077 - DNA, 17 bp, Homo sapiens
gacacaggcctgtgtag

SEQ ID NO: 2800078 - DNA, 21 bp, Homo sapiens
gacacaggcctgtgtagctgt

SEQ ID NO: 2800079 - DNA, 21 bp, Homo sapiens
gacacagtttctattgtaaat

SEQ ID NO: 2800080 - DNA, 22 bp, Homo sapiens
gacacatatgcaccttgtgtct

SEQ ID NO: 2800081 - DNA, 17 bp, Homo sapiens
gacacctgcacctcccc

SEQ ID NO: 2800082 - DNA, 22 bp, Homo sapiens
gacacctgcacctccccccact

SEQ ID NO: 2800083 - DNA, 11 bp, Homo sapiens
gacacctgccc

SEQ ID NO: 2800084 - DNA, 15 bp, Homo sapiens
gacacctgccctgcc

SEQ ID NO: 2800085 - DNA, 23 bp, Homo sapiens
gacacctgccctgccctgccacc

SEQ ID NO: 2800086 - DNA, 17 bp, Homo sapiens
gacacctgtgcacccca

SEQ ID NO: 2800087 - DNA, 15 bp, Homo sapiens
gacactaaccacgct

SEQ ID NO: 2800088 - DNA, 17 bp, Homo sapiens
gacactaaccacgctgg

SEQ ID NO: 2800089 - DNA, 18 bp, Homo sapiens
gacactaaccacgctgga

SEQ ID NO: 2800090 - DNA, 20 bp, Homo sapiens
gacactaagttatagtatat

SEQ ID NO: 2800091 - DNA, 13 bp, Homo sapiens
gacactgatgggc

SEQ ID NO: 2800092 - DNA, 15 bp, Homo sapiens
gacactgatgggcaa

SEQ ID NO: 2800093 - DNA, 13 bp, Homo sapiens
gacactgtacaag

SEQ ID NO: 2800094 - DNA, 23 bp, Homo sapiens
gacagacacttctaaatgaagtg

SEQ ID NO: 2800095 - DNA, 16 bp, Homo sapiens
gacagagacacctgca

SEQ ID NO: 2800096 - DNA, 22 bp, Homo sapiens
gacagagacacctgcacctccc

SEQ ID NO: 2800097 - DNA, 15 bp, Homo sapiens
gacagagacccagat

SEQ ID NO: 2800098 - DNA, 14 bp, Homo sapiens
gacagaggcagccc

SEQ ID NO: 2800099 - DNA, 13 bp, Homo sapiens
gacagataactct

SEQ ID NO: 2800100 - DNA, 17 bp, Homo sapiens
gacagatgtcagccgag

SEQ ID NO: 2800101 - DNA, 14 bp, Homo sapiens
gacagcagctcagg

SEQ ID NO: 2800102 - DNA, 20 bp, Homo sapiens
gacagcagctcaggcacact

SEQ ID NO: 2800103 - DNA, 12 bp, Homo sapiens
gacagcaggtgg

SEQ ID NO: 2800104 - DNA, 13 bp, Homo sapiens
gacagccacggcc

SEQ ID NO: 2800105 - DNA, 14 bp, Homo sapiens
gacagccacggcca

SEQ ID NO: 2800106 - DNA, 17 bp, Homo sapiens
gacagccacggccaggc

SEQ ID NO: 2800107 - DNA, 17 bp, Homo sapiens
gacagccagagcctgtc

SEQ ID NO: 2800108 - DNA, 19 bp, Homo sapiens
gacagcgaactagaagaaa

SEQ ID NO: 2800109 - DNA, 14 bp, Homo sapiens
gacagcgccacctc

SEQ ID NO: 2800110 - DNA, 18 bp, Homo sapiens
gacagctccttctgtcct

SEQ ID NO: 2800111 - DNA, 18 bp, Homo sapiens
gacagctgtccctgtcac

SEQ ID NO: 2800112 - DNA, 22 bp, Homo sapiens
gacagctgtccctgtcaccaag

SEQ ID NO: 2800113 - DNA, 14 bp, Homo sapiens
gacagctgtgcctc

SEQ ID NO: 2800114 - DNA, 15 bp, Homo sapiens
gacagctgtgcctcg

SEQ ID NO: 2800115 - DNA, 23 bp, Homo sapiens
gacaggacagtgcttcagcctga

SEQ ID NO: 2800116 - DNA, 15 bp, Homo sapiens
gacaggacctgacta

SEQ ID NO: 2800117 - DNA, 11 bp, Homo sapiens
gacaggagaaa

SEQ ID NO: 2800118 - DNA, 12 bp, Homo sapiens
gacaggagaaat

SEQ ID NO: 2800119 - DNA, 24 bp, Homo sapiens
gacaggagaaatgcatccattcct

SEQ ID NO: 2800120 - DNA, 17 bp, Homo sapiens
gacaggagggcaagggc

SEQ ID NO: 2800121 - DNA, 20 bp, Homo sapiens
gacaggcatgttctctgagg

SEQ ID NO: 2800122 - DNA, 21 bp, Homo sapiens
gacaggcatgttctctgagga

SEQ ID NO: 2800123 - DNA, 22 bp, Homo sapiens
gacaggcatgttctctgaggac

SEQ ID NO: 2800124 - DNA, 18 bp, Homo sapiens
gacaggcccaagagatga

SEQ ID NO: 2800125 - DNA, 22 bp, Homo sapiens
gacaggcccaagagatgaagag

SEQ ID NO: 2800126 - DNA, 20 bp, Homo sapiens
gacagggttttgccatgttg

SEQ ID NO: 2800127 - DNA, 22 bp, Homo sapiens
gacagggttttgccatgttggc

SEQ ID NO: 2800128 - DNA, 20 bp, Homo sapiens
gacaggtctagactttctca

SEQ ID NO: 2800129 - DNA, 14 bp, Homo sapiens
gacagtattctcag

SEQ ID NO: 2800130 - DNA, 21 bp, Homo sapiens
gacagtccgtcaaaacagatt

SEQ ID NO: 2800131 - DNA, 18 bp, Homo sapiens
gacagtcctgggagaacc

SEQ ID NO: 2800132 - DNA, 21 bp, Homo sapiens
gacagtgatctccatatgtta

SEQ ID NO: 2800133 - DNA, 21 bp, Homo sapiens
gacagtgctctaggctgcccc

SEQ ID NO: 2800134 - DNA, 16 bp, Homo sapiens
gacagtgcttcagcct

SEQ ID NO: 2800135 - DNA, 17 bp, Homo sapiens
gacagttactcttcagt

SEQ ID NO: 2800136 - DNA, 17 bp, Homo sapiens
gacagttcatatgtacc

SEQ ID NO: 2800137 - DNA, 21 bp, Homo sapiens
gacatattcttggagaacttt

SEQ ID NO: 2800138 - DNA, 14 bp, Homo sapiens
gacattaactcatt

SEQ ID NO: 2800139 - DNA, 14 bp, Homo sapiens
gacattgcggacag

SEQ ID NO: 2800140 - DNA, 17 bp, Homo sapiens
gacattgcggacagcca

SEQ ID NO: 2800141 - DNA, 15 bp, Homo sapiens
gacattttcttcaga

SEQ ID NO: 2800142 - DNA, 17 bp, Homo sapiens
gaccaacatggagaaac

SEQ ID NO: 2800143 - DNA, 18 bp, Homo sapiens
gaccaaccctgtttcctg

SEQ ID NO: 2800144 - DNA, 14 bp, Homo sapiens
gaccaagttataaa

SEQ ID NO: 2800145 - DNA, 18 bp, Homo sapiens
gaccaatattcaaatgcg

SEQ ID NO: 2800146 - DNA, 15 bp, Homo sapiens
gaccaatctctgtga

SEQ ID NO: 2800147 - DNA, 21 bp, Homo sapiens
gaccacaggcatctacacagc

SEQ ID NO: 2800148 - DNA, 23 bp, Homo sapiens
gaccacctccctgccctgtcctc

SEQ ID NO: 2800149 - DNA, 14 bp, Homo sapiens
gaccacctgcttct

SEQ ID NO: 2800150 - DNA, 21 bp, Homo sapiens
gaccacctgcttctgaactca

SEQ ID NO: 2800151 - DNA, 17 bp, Homo sapiens
gactatagcccaggtcc

SEQ ID NO: 2800152 - DNA, 20 bp, Homo sapiens
gactatcacatacaatttgc

SEQ ID NO: 2800153 - DNA, 13 bp, Homo sapiens
gactatttatgaa

SEQ ID NO: 2800154 - DNA, 17 bp, Homo sapiens
gactcaataaaatcatg

SEQ ID NO: 2800155 - DNA, 17 bp, Homo sapiens
gactcaatgcactgaca

SEQ ID NO: 2800156 - DNA, 21 bp, Homo sapiens
gactcacaagaagaccagact

SEQ ID NO: 2800157 - DNA, 21 bp, Homo sapiens
ctgatcgggataacaaaatca

SEQ ID NO: 2800158 - DNA, 19 bp, Homo sapiens
ctgatcgtgctaaattttc

SEQ ID NO: 2800159 - DNA, 24 bp, Homo sapiens
ctgatgacaaacccaggagtttgt

SEQ ID NO: 2800160 - DNA, 21 bp, Homo sapiens
ctgatgagtgattgacacaca

SEQ ID NO: 2800161 - DNA, 22 bp, Homo sapiens
ctgatgagtgattgacacacag

SEQ ID NO: 2800162 - DNA, 22 bp, Homo sapiens
ctgatgcatcagaaagggaggg

SEQ ID NO: 2800163 - DNA, 21 bp, Homo sapiens
ctgatgggcaacccccagcct

SEQ ID NO: 2800164 - DNA, 22 bp, Homo sapiens
ctgatgggcaacccccagcctg

SEQ ID NO: 2800165 - DNA, 15 bp, Homo sapiens
ctttcctaaatgttt

SEQ ID NO: 2800166 - DNA, 11 bp, Homo sapiens
ctttcctcccc

SEQ ID NO: 2800167 - DNA, 20 bp, Homo sapiens
ctttcctccccaccttcccc

SEQ ID NO: 2800168 - DNA, 13 bp, Homo sapiens
ctttcctccctgg

SEQ ID NO: 2800169 - DNA, 16 bp, Homo sapiens
ctttcctctgcagcac

SEQ ID NO: 2800170 - DNA, 11 bp, Homo sapiens
ctttccttcct

SEQ ID NO: 2800171 - DNA, 16 bp, Homo sapiens
ctttccttccttccct

SEQ ID NO: 2800172 - DNA, 15 bp, Homo sapiens
ctttctacccagcga

SEQ ID NO: 2800173 - DNA, 17 bp, Homo sapiens
ctttctacccagcgagc

SEQ ID NO: 2800174 - DNA, 14 bp, Homo sapiens
ctttctagctgttg

SEQ ID NO: 2800175 - DNA, 16 bp, Homo sapiens
ctttctattgaaaaat

SEQ ID NO: 2800176 - DNA, 17 bp, Homo sapiens
ctttctcactaaatctt

SEQ ID NO: 2800177 - DNA, 23 bp, Homo sapiens
ctttctccaaagttatccagagg

SEQ ID NO: 2800178 - DNA, 14 bp, Homo sapiens
ctttctccagccag

SEQ ID NO: 2800179 - DNA, 15 bp, Homo sapiens
ctttctccagccagc

SEQ ID NO: 2800180 - DNA, 20 bp, Homo sapiens
ctttctctgagagagatgat

SEQ ID NO: 2800181 - DNA, 13 bp, Homo sapiens
ctttctggctctc

SEQ ID NO: 2800182 - DNA, 20 bp, Homo sapiens
ctttctgtgcttctctttgt

SEQ ID NO: 2800183 - DNA, 20 bp, Homo sapiens
ctttcttattttgtaataaa

SEQ ID NO: 2800184 - DNA, 22 bp, Homo sapiens
ctttcttattttgtaataaact

SEQ ID NO: 2800185 - DNA, 23 bp, Homo sapiens
ctttcttattttgtaataaactc

SEQ ID NO: 2800186 - DNA, 12 bp, Homo sapiens
ctttcttcctct

SEQ ID NO: 2800187 - DNA, 22 bp, Homo sapiens
ctttcttctacaaccagagccc

SEQ ID NO: 2800188 - DNA, 17 bp, Homo sapiens
ctttctttacctgagac

SEQ ID NO: 2800189 - DNA, 18 bp, Homo sapiens
ctttctttacctgagacc

SEQ ID NO: 2800190 - DNA, 16 bp, Homo sapiens
ctttcttttgtgttgg

SEQ ID NO: 2800191 - DNA, 11 bp, Homo sapiens
ctttgaataaa

SEQ ID NO: 2800192 - DNA, 13 bp, Homo sapiens
ctttgaataaagt

SEQ ID NO: 2800193 - DNA, 14 bp, Homo sapiens
ctttgaataaagtc

SEQ ID NO: 2800194 - DNA, 15 bp, Homo sapiens
ctttgaataaagtct

SEQ ID NO: 2800195 - DNA, 16 bp, Homo sapiens
ctttgaataaagtctg

SEQ ID NO: 2800196 - DNA, 20 bp, Homo sapiens
ctttgaataaagtctgagtg

SEQ ID NO: 2800197 - DNA, 18 bp, Homo sapiens
ctttgaatcctctctctg

SEQ ID NO: 2800198 - DNA, 13 bp, Homo sapiens
ctttgacatgaaa

SEQ ID NO: 2800199 - DNA, 15 bp, Homo sapiens
ctttgacatgaaaag

SEQ ID NO: 2800200 - DNA, 23 bp, Homo sapiens
ctttgacatttccttctttgtct

SEQ ID NO: 2800201 - DNA, 16 bp, Homo sapiens
ctttgagaaagaaata

SEQ ID NO: 2800202 - DNA, 18 bp, Homo sapiens
ctttgatgtcatatggaa

SEQ ID NO: 2800203 - DNA, 14 bp, Homo sapiens
ctttgcactgaggg

SEQ ID NO: 2800204 - DNA, 18 bp, Homo sapiens
ctttgcactgagggccac

SEQ ID NO: 2800205 - DNA, 23 bp, Homo sapiens
ctttgcactgagggccacactat

SEQ ID NO: 2800206 - DNA, 15 bp, Homo sapiens
ctttgcagacaggca

SEQ ID NO: 2800207 - DNA, 20 bp, Homo sapiens
ctttgcagacaggcaagcac

SEQ ID NO: 2800208 - DNA, 15 bp, Homo sapiens
ctttgccccagttac

SEQ ID NO: 2800209 - DNA, 12 bp, Homo sapiens
ctttgcctgctt

SEQ ID NO: 2800210 - DNA, 12 bp, Homo sapiens
ctttgcctgtgt

SEQ ID NO: 2800211 - DNA, 20 bp, Homo sapiens
ctttgcctgtgtgagcatct

SEQ ID NO: 2800212 - DNA, 17 bp, Homo sapiens
ctttggaaacaggacca

SEQ ID NO: 2800213 - DNA, 15 bp, Homo sapiens
ctttggaaggagtga

SEQ ID NO: 2800214 - DNA, 23 bp, Homo sapiens
ctttggaatgactataaacatta

SEQ ID NO: 2800215 - DNA, 15 bp, Homo sapiens
ctttggaggaacagc

SEQ ID NO: 2800216 - DNA, 18 bp, Homo sapiens
ctttggaggaacagctcc

SEQ ID NO: 2800217 - DNA, 14 bp, Homo sapiens
ctttgggaggctga

SEQ ID NO: 2800218 - DNA, 22 bp, Homo sapiens
ctttggtacatggccagtgtga

SEQ ID NO: 2800219 - DNA, 14 bp, Homo sapiens
ctttggttcagcta

SEQ ID NO: 2800220 - DNA, 22 bp, Homo sapiens
ctttgtacagtggagaaatatt

SEQ ID NO: 2800221 - DNA, 13 bp, Homo sapiens
ctttgtggcttcc

SEQ ID NO: 2800222 - DNA, 16 bp, Homo sapiens
ctttgtgtagctttgc

SEQ ID NO: 2800223 - DNA, 15 bp, Homo sapiens
ctttgtgtgattgaa

SEQ ID NO: 2800224 - DNA, 19 bp, Homo sapiens
ctttgttaaaaatattttc

SEQ ID NO: 2800225 - DNA, 16 bp, Homo sapiens
ctttgttcagttgact

SEQ ID NO: 2800226 - DNA, 18 bp, Homo sapiens
ctttgtttttatgaagaa

SEQ ID NO: 2800227 - DNA, 19 bp, Homo sapiens
cttttaaaagaaaaagtat

SEQ ID NO: 2800228 - DNA, 17 bp, Homo sapiens
cttttaaaccattttct

SEQ ID NO: 2800229 - DNA, 22 bp, Homo sapiens
cttttaaaggggcagaaaaact

SEQ ID NO: 2800230 - DNA, 16 bp, Homo sapiens
cttttaatacagggta

SEQ ID NO: 2800231 - DNA, 16 bp, Homo sapiens
cttttaatgccttcca

SEQ ID NO: 2800232 - DNA, 19 bp, Homo sapiens
cttttagttgtatctcttt

SEQ ID NO: 2800233 - DNA, 20 bp, Homo sapiens
cttttagttgtatctctttt

SEQ ID NO: 2800234 - DNA, 22 bp, Homo sapiens
cttttagttttagttgcagaaa

SEQ ID NO: 2800235 - DNA, 21 bp, Homo sapiens
cttttataggatttatttaaa

SEQ ID NO: 2800236 - DNA, 17 bp, Homo sapiens
cttttatttcttaaaca

SEQ ID NO: 2800237 - DNA, 20 bp, Homo sapiens
cttttcataacctagcctta

SEQ ID NO: 2800238 - DNA, 18 bp, Homo sapiens
cttttcccaaaatgttga

SEQ ID NO: 2800239 - DNA, 14 bp, Homo sapiens
cttttccccggtcc

SEQ ID NO: 2800240 - DNA, 13 bp, Homo sapiens
cttttctaatctt

SEQ ID NO: 2800241 - DNA, 19 bp, Homo sapiens
cttttctttttcccttgaa

SEQ ID NO: 2800242 - DNA, 19 bp, Homo sapiens
cttttgaatccatgcttgg

SEQ ID NO: 2800243 - DNA, 18 bp, Homo sapiens
cttttgcaacaagacaaa

SEQ ID NO: 2800244 - DNA, 17 bp, Homo sapiens
cttttgccattaaactt

SEQ ID NO: 2800245 - DNA, 20 bp, Homo sapiens
cttttgcccttcacagtgtt

SEQ ID NO: 2800246 - DNA, 21 bp, Homo sapiens
cttttgcccttcacagtgttt

SEQ ID NO: 2800247 - DNA, 23 bp, Homo sapiens
cttttgcggttcaggaaaattga

SEQ ID NO: 2800248 - DNA, 15 bp, Homo sapiens
cttttggcactgaga

SEQ ID NO: 2800249 - DNA, 13 bp, Homo sapiens
cttttgtaagaca

SEQ ID NO: 2800250 - DNA, 16 bp, Homo sapiens
cttttgtggattgaca

SEQ ID NO: 2800251 - DNA, 14 bp, Homo sapiens
cttttgtgtacagt

SEQ ID NO: 2800252 - DNA, 21 bp, Homo sapiens
gaaatatcagttactcagccc

SEQ ID NO: 2800253 - DNA, 21 bp, Homo sapiens
gaaatgaatttatctgaatat

SEQ ID NO: 2800254 - DNA, 20 bp, Homo sapiens
gaaatgcattattttgaatg

SEQ ID NO: 2800255 - DNA, 18 bp, Homo sapiens
gaaatgctgttggtgaga

SEQ ID NO: 2800256 - DNA, 20 bp, Homo sapiens
gagcatcatgcctctgaggc

SEQ ID NO: 2800257 - DNA, 19 bp, Homo sapiens
gagcatctcttgaggccag

SEQ ID NO: 2800258 - DNA, 20 bp, Homo sapiens
gagcatctcttgaggccagg

SEQ ID NO: 2800259 - DNA, 23 bp, Homo sapiens
gagcatctcttgaggccaggagt

SEQ ID NO: 2800260 - DNA, 20 bp, Homo sapiens
gagcattacgtgagccaggt

SEQ ID NO: 2800261 - DNA, 23 bp, Homo sapiens
gagcatttccctcccgggagagg

SEQ ID NO: 2800262 - DNA, 19 bp, Homo sapiens
gagccaagggttcagagac

SEQ ID NO: 2800263 - DNA, 16 bp, Homo sapiens
gagccacagaccacct

SEQ ID NO: 2800264 - DNA, 18 bp, Homo sapiens
gagccacagaccacctgc

SEQ ID NO: 2800265 - DNA, 18 bp, Homo sapiens
gagccactgcaccgggcc

SEQ ID NO: 2800266 - DNA, 20 bp, Homo sapiens
gagccactgcaccgggccac

SEQ ID NO: 2800267 - DNA, 22 bp, Homo sapiens
gagccactgcaccgggccacag

SEQ ID NO: 2800268 - DNA, 19 bp, Homo sapiens
gagccagccctccctgtcc

SEQ ID NO: 2800269 - DNA, 14 bp, Homo sapiens
gagccagggtctca

SEQ ID NO: 2800270 - DNA, 18 bp, Homo sapiens
gagccaggtaatgaggga

SEQ ID NO: 2800271 - DNA, 22 bp, Homo sapiens
gagcccagccattaccatggag

SEQ ID NO: 2800272 - DNA, 23 bp, Homo sapiens
gagcccaggagttcgaggctgca

SEQ ID NO: 2800273 - DNA, 11 bp, Homo sapiens
gagcccaggga

SEQ ID NO: 2800274 - DNA, 15 bp, Homo sapiens
gagcccagggaggcc

SEQ ID NO: 2800275 - DNA, 17 bp, Homo sapiens
gagcccagggaggccga

SEQ ID NO: 2800276 - DNA, 17 bp, Homo sapiens
gagcccagggcatccca

SEQ ID NO: 2800277 - DNA, 23 bp, Homo sapiens
gagcccatgctcaaccactgtgg

SEQ ID NO: 2800278 - DNA, 14 bp, Homo sapiens
gagccccacacgga

SEQ ID NO: 2800279 - DNA, 13 bp, Homo sapiens
gagccctggcagg

SEQ ID NO: 2800280 - DNA, 15 bp, Homo sapiens
gagccctggtggcag

SEQ ID NO: 2800281 - DNA, 20 bp, Homo sapiens
gagccgagatcacgccactg

SEQ ID NO: 2800282 - DNA, 22 bp, Homo sapiens
gagccgcatcttctccatctgg

SEQ ID NO: 2800283 - DNA, 19 bp, Homo sapiens
gagcctcagcatcctggca

SEQ ID NO: 2800284 - DNA, 21 bp, Homo sapiens
gagcctcagcatcctggcacc

SEQ ID NO: 2800285 - DNA, 15 bp, Homo sapiens
gagcctccatttctg

SEQ ID NO: 2800286 - DNA, 20 bp, Homo sapiens
gagcctcgcaacccgtgcca

SEQ ID NO: 2800287 - DNA, 19 bp, Homo sapiens
gagcctcggtggccatgct

SEQ ID NO: 2800288 - DNA, 15 bp, Homo sapiens
gagcctgcagttatt

SEQ ID NO: 2800289 - DNA, 15 bp, Homo sapiens
gagcctgccgagcaa

SEQ ID NO: 2800290 - DNA, 18 bp, Homo sapiens
gagcctgctcccccaccc

SEQ ID NO: 2800291 - DNA, 14 bp, Homo sapiens
gagcctggagaagc

SEQ ID NO: 2800292 - DNA, 18 bp, Homo sapiens
gagcctgtcacgtggtca

SEQ ID NO: 2800293 - DNA, 16 bp, Homo sapiens
gagcctgtgaacccag

SEQ ID NO: 2800294 - DNA, 19 bp, Homo sapiens
gagcctgtgaacccaggac

SEQ ID NO: 2800295 - DNA, 17 bp, Homo sapiens
gagccttcacaaccagc

SEQ ID NO: 2800296 - DNA, 20 bp, Homo sapiens
gagccttcacaaccagccac

SEQ ID NO: 2800297 - DNA, 13 bp, Homo sapiens
gagccttctcctg

SEQ ID NO: 2800298 - DNA, 20 bp, Homo sapiens
gagccttggtgtccacctgg

SEQ ID NO: 2800299 - DNA, 13 bp, Homo sapiens
gagcgaaactccg

SEQ ID NO: 2800300 - DNA, 16 bp, Homo sapiens
gagcgagcgctaccca

SEQ ID NO: 2800301 - DNA, 16 bp, Homo sapiens
gagcgccctgcagacc

SEQ ID NO: 2800302 - DNA, 19 bp, Homo sapiens
gagcgccctgcagaccctg

SEQ ID NO: 2800303 - DNA, 21 bp, Homo sapiens
gagcgccctgcagaccctgcc

SEQ ID NO: 2800304 - DNA, 15 bp, Homo sapiens
gagcgctacccactt

SEQ ID NO: 2800305 - DNA, 14 bp, Homo sapiens
gagcggctctcctg

SEQ ID NO: 2800306 - DNA, 15 bp, Homo sapiens
gagctacataattta

SEQ ID NO: 2800307 - DNA, 19 bp, Homo sapiens
gagctacctgtgtggacag

SEQ ID NO: 2800308 - DNA, 19 bp, Homo sapiens
gagctagcgctgccgcacc

SEQ ID NO: 2800309 - DNA, 20 bp, Homo sapiens
gagctaggagcaaagcctgt

SEQ ID NO: 2800310 - DNA, 20 bp, Homo sapiens
gagctaggcatggtggcaca

SEQ ID NO: 2800311 - DNA, 17 bp, Homo sapiens
gagctcacaaggcagca

SEQ ID NO: 2800312 - DNA, 20 bp, Homo sapiens
gagctcacaaggcagcaagg

SEQ ID NO: 2800313 - DNA, 21 bp, Homo sapiens
gagctcacaaggcagcaaggc

SEQ ID NO: 2800314 - DNA, 22 bp, Homo sapiens
gagctcacaaggcagcaaggcc

SEQ ID NO: 2800315 - DNA, 23 bp, Homo sapiens
gagctcacaaggcagcaaggccc

SEQ ID NO: 2800316 - DNA, 15 bp, Homo sapiens
gagctcagaccccca

SEQ ID NO: 2800317 - DNA, 21 bp, Homo sapiens
gagctcagacccccactctca

SEQ ID NO: 2800318 - DNA, 15 bp, Homo sapiens
gagctcccttcctga

SEQ ID NO: 2800319 - DNA, 14 bp, Homo sapiens
gagctctgagaggc

SEQ ID NO: 2800320 - DNA, 15 bp, Homo sapiens
gagctctgagaggcc

SEQ ID NO: 2800321 - DNA, 17 bp, Homo sapiens
gagctctgagaggccct

SEQ ID NO: 2800322 - DNA, 18 bp, Homo sapiens
gagctctgagaggccctg

SEQ ID NO: 2800323 - DNA, 19 bp, Homo sapiens
gagctctgagaggccctgg

SEQ ID NO: 2800324 - DNA, 20 bp, Homo sapiens
gagctctgagaggccctgga

SEQ ID NO: 2800325 - DNA, 23 bp, Homo sapiens
gagctctgagaggccctggatca

SEQ ID NO: 2800326 - DNA, 13 bp, Homo sapiens
gagctgagatcgt

SEQ ID NO: 2800327 - DNA, 23 bp, Homo sapiens
gagctgaggggggccgtgcccag

SEQ ID NO: 2800328 - DNA, 22 bp, Homo sapiens
gagctgcctgttcagctccagc

SEQ ID NO: 2800329 - DNA, 17 bp, Homo sapiens
gagctgttggcctgggt

SEQ ID NO: 2800330 - DNA, 17 bp, Homo sapiens
gagcttccagtgcatgt

SEQ ID NO: 2800331 - DNA, 20 bp, Homo sapiens
gagcttctacagattttaga

SEQ ID NO: 2800332 - DNA, 16 bp, Homo sapiens
gagcttctctgtgaac

SEQ ID NO: 2800333 - DNA, 14 bp, Homo sapiens
gagcttgcaagaag

SEQ ID NO: 2800334 - DNA, 14 bp, Homo sapiens
gaggagaccagctc

SEQ ID NO: 2800335 - DNA, 18 bp, Homo sapiens
gaggagctcaggacacta

SEQ ID NO: 2800336 - DNA, 15 bp, Homo sapiens
gaggagcttggggga

SEQ ID NO: 2800337 - DNA, 15 bp, Homo sapiens
gaggaggtggcagcc

SEQ ID NO: 2800338 - DNA, 22 bp, Homo sapiens
gaggaggtggcagccctgtagg

SEQ ID NO: 2800339 - DNA, 20 bp, Homo sapiens
gaggaggtttggggtctgcc

SEQ ID NO: 2800340 - DNA, 19 bp, Homo sapiens
gaggagtccagggcgggag

SEQ ID NO: 2800341 - DNA, 13 bp, Homo sapiens
gaggagtctgagg

SEQ ID NO: 2800342 - DNA, 14 bp, Homo sapiens
gaggagtctgaggt

SEQ ID NO: 2800343 - DNA, 15 bp, Homo sapiens
gaggagtctgaggtc

SEQ ID NO: 2800344 - DNA, 20 bp, Homo sapiens
gaggagtctgaggtcctgag

SEQ ID NO: 2800345 - DNA, 16 bp, Homo sapiens
gaggagtttcgaggta

SEQ ID NO: 2800346 - DNA, 20 bp, Homo sapiens
gaggagtttcgaggtagagt

SEQ ID NO: 2800347 - DNA, 20 bp, Homo sapiens
gaggatcactggagcccagg

SEQ ID NO: 2800348 - DNA, 13 bp, Homo sapiens
gaggatggagaga

SEQ ID NO: 2800349 - DNA, 14 bp, Homo sapiens
gaggatggagagag

SEQ ID NO: 2800350 - DNA, 15 bp, Homo sapiens
gaggatggagagagg

SEQ ID NO: 2800351 - DNA, 17 bp, Homo sapiens
gaggatgttctgggaca

SEQ ID NO: 2800352 - DNA, 19 bp, Homo sapiens
gaggattatgggtcctgca

SEQ ID NO: 2800353 - DNA, 15 bp, Homo sapiens
gaggatttcaagcct

SEQ ID NO: 2800354 - DNA, 21 bp, Homo sapiens
gaggcaatgtcaggaacagaa

SEQ ID NO: 2800355 - DNA, 12 bp, Homo sapiens
gaggcagacagc

SEQ ID NO: 2800356 - DNA, 17 bp, Homo sapiens
gaggcagagaaagaaga

SEQ ID NO: 2800357 - DNA, 21 bp, Homo sapiens
gaggcagagaaagaagagaca

SEQ ID NO: 2800358 - DNA, 13 bp, Homo sapiens
gaggcagccccat

SEQ ID NO: 2800359 - DNA, 20 bp, Homo sapiens
gaggcagccccattctgcct

SEQ ID NO: 2800360 - DNA, 23 bp, Homo sapiens
gaggcaggaggattgcttgagcc

SEQ ID NO: 2800361 - DNA, 15 bp, Homo sapiens
gaggcagggccttgc

SEQ ID NO: 2800362 - DNA, 18 bp, Homo sapiens
gaggcagggccttgccca

SEQ ID NO: 2800363 - DNA, 21 bp, Homo sapiens
gaggcagggccttgcccagag

SEQ ID NO: 2800364 - DNA, 23 bp, Homo sapiens
gaggcagggccttgcccagagat

SEQ ID NO: 2800365 - DNA, 15 bp, Homo sapiens
gaggcaggggcggag

SEQ ID NO: 2800366 - DNA, 18 bp, Homo sapiens
gaggcagggtctcactct

SEQ ID NO: 2800367 - DNA, 12 bp, Homo sapiens
gaggccaaggtg

SEQ ID NO: 2800368 - DNA, 13 bp, Homo sapiens
gaggccaccggga

SEQ ID NO: 2800369 - DNA, 11 bp, Homo sapiens
gaggccagcct

SEQ ID NO: 2800370 - DNA, 16 bp, Homo sapiens
gaggccagcctggcct

SEQ ID NO: 2800371 - DNA, 17 bp, Homo sapiens
gaggccagcctggcctc

SEQ ID NO: 2800372 - DNA, 14 bp, Homo sapiens
gaggccatgggcct

SEQ ID NO: 2800373 - DNA, 17 bp, Homo sapiens
gaggccatgggcctcct

SEQ ID NO: 2800374 - DNA, 23 bp, Homo sapiens
gaggccatgggcctcctgtgtgt

SEQ ID NO: 2800375 - DNA, 19 bp, Homo sapiens
gaggcctaaaagtaaacat

SEQ ID NO: 2800376 - DNA, 13 bp, Homo sapiens
gaggcctggccag

SEQ ID NO: 2800377 - DNA, 12 bp, Homo sapiens
gaggccttctcg

SEQ ID NO: 2800378 - DNA, 14 bp, Homo sapiens
gaggccttctctga

SEQ ID NO: 2800379 - DNA, 17 bp, Homo sapiens
gaggcgccccaacccgt

SEQ ID NO: 2800380 - DNA, 21 bp, Homo sapiens
gaggcgccccaacccgtggag

SEQ ID NO: 2800381 - DNA, 19 bp, Homo sapiens
gaggcggagagtacagtga

SEQ ID NO: 2800382 - DNA, 13 bp, Homo sapiens
gaggctcctgtcc

SEQ ID NO: 2800383 - DNA, 14 bp, Homo sapiens
gaggctgagacagg

SEQ ID NO: 2800384 - DNA, 16 bp, Homo sapiens
gaggctgagacaggag

SEQ ID NO: 2800385 - DNA, 16 bp, Homo sapiens
gaggctgaggcagaag

SEQ ID NO: 2800386 - DNA, 12 bp, Homo sapiens
gaggctgaggcg

SEQ ID NO: 2800387 - DNA, 20 bp, Homo sapiens
gaggctgcagaaggccaaga

SEQ ID NO: 2800388 - DNA, 18 bp, Homo sapiens
gaggctgctcggggtgca

SEQ ID NO: 2800389 - DNA, 14 bp, Homo sapiens
gaggctggaggcag

SEQ ID NO: 2800390 - DNA, 17 bp, Homo sapiens
gaggctggaggcagggc

SEQ ID NO: 2800391 - DNA, 18 bp, Homo sapiens
gaggctggcactcccctg

SEQ ID NO: 2800392 - DNA, 22 bp, Homo sapiens
gaggctggtgctgtggccaggg

SEQ ID NO: 2800393 - DNA, 15 bp, Homo sapiens
gagggaacagacagg

SEQ ID NO: 2800394 - DNA, 18 bp, Homo sapiens
gagggaacagacaggaga

SEQ ID NO: 2800395 - DNA, 19 bp, Homo sapiens
gagggacaaaggagcctgt

SEQ ID NO: 2800396 - DNA, 18 bp, Homo sapiens
gagggactgtcgctgctt

SEQ ID NO: 2800397 - DNA, 23 bp, Homo sapiens
gagggactgtcgctgcttcgtgg

SEQ ID NO: 2800398 - DNA, 14 bp, Homo sapiens
gagggagtgacaga

SEQ ID NO: 2800399 - DNA, 15 bp, Homo sapiens
gagggatcacagggc

SEQ ID NO: 2800400 - DNA, 18 bp, Homo sapiens
gagggatgggatttcatg

SEQ ID NO: 2800401 - DNA, 20 bp, Homo sapiens
gagggcaaggggtttccaca

SEQ ID NO: 2800402 - DNA, 18 bp, Homo sapiens
gagggcactcacatgccg

SEQ ID NO: 2800403 - DNA, 14 bp, Homo sapiens
gagggcagaggctg

SEQ ID NO: 2800404 - DNA, 13 bp, Homo sapiens
gagggcagcagcc

SEQ ID NO: 2800405 - DNA, 18 bp, Homo sapiens
gagggcagttcgcagcca

SEQ ID NO: 2800406 - DNA, 13 bp, Homo sapiens
gagggcccaggca

SEQ ID NO: 2800407 - DNA, 14 bp, Homo sapiens
gagggctctgaggc

SEQ ID NO: 2800408 - DNA, 14 bp, Homo sapiens
gagggctgcgagca

SEQ ID NO: 2800409 - DNA, 14 bp, Homo sapiens
gagggctgtaggaa

SEQ ID NO: 2800410 - DNA, 14 bp, Homo sapiens
gaggggaagggcca

SEQ ID NO: 2800411 - DNA, 19 bp, Homo sapiens
gaggggaggggcctaggga

SEQ ID NO: 2800412 - DNA, 17 bp, Homo sapiens
gatctccatatgttaca

SEQ ID NO: 2800413 - DNA, 12 bp, Homo sapiens
gatctccctgcc

SEQ ID NO: 2800414 - DNA, 20 bp, Homo sapiens
gatctcctgtaattttgtag

SEQ ID NO: 2800415 - DNA, 12 bp, Homo sapiens
gatctctcagga

SEQ ID NO: 2800416 - DNA, 14 bp, Homo sapiens
gatctctcaggagc

SEQ ID NO: 2800417 - DNA, 17 bp, Homo sapiens
gatctctcaggagcaca

SEQ ID NO: 2800418 - DNA, 20 bp, Homo sapiens
gatctctcaggagcacaggc

SEQ ID NO: 2800419 - DNA, 22 bp, Homo sapiens
gatctgggaccctttccttcct

SEQ ID NO: 2800420 - DNA, 18 bp, Homo sapiens
gatctggggctctgggat

SEQ ID NO: 2800421 - DNA, 18 bp, Homo sapiens
gatctgggttcactgcaa

SEQ ID NO: 2800422 - DNA, 14 bp, Homo sapiens
gatctgtactgtaa

SEQ ID NO: 2800423 - DNA, 18 bp, Homo sapiens
gatctgtactgtaatttt

SEQ ID NO: 2800424 - DNA, 15 bp, Homo sapiens
gatctgtccaaggaa

SEQ ID NO: 2800425 - DNA, 21 bp, Homo sapiens
gatctgtttttaaaaatcata

SEQ ID NO: 2800426 - DNA, 15 bp, Homo sapiens
gatcttctgaaatga

SEQ ID NO: 2800427 - DNA, 23 bp, Homo sapiens
gagaatgaaagggcccagagagg

SEQ ID NO: 2800428 - DNA, 17 bp, Homo sapiens
gagaatgagggccaaga

SEQ ID NO: 2800429 - DNA, 18 bp, Homo sapiens
gagaattgcttgaaccca

SEQ ID NO: 2800430 - DNA, 21 bp, Homo sapiens
gagaattgtatcatttgaaca

SEQ ID NO: 2800431 - DNA, 16 bp, Homo sapiens
gagaattttaaattat

SEQ ID NO: 2800432 - DNA, 14 bp, Homo sapiens
gagacaataaaaca

SEQ ID NO: 2800433 - DNA, 19 bp, Homo sapiens
gagacagagttttcactct

SEQ ID NO: 2800434 - DNA, 15 bp, Homo sapiens
gagaccaacctgacc

SEQ ID NO: 2800435 - DNA, 16 bp, Homo sapiens
gcaatttttaaactag

SEQ ID NO: 2800436 - DNA, 13 bp, Homo sapiens
gcacaaatattta

SEQ ID NO: 2800437 - DNA, 19 bp, Homo sapiens
gcacaagaggaagagagag

SEQ ID NO: 2800438 - DNA, 16 bp, Homo sapiens
gcacaatttagaaaac

SEQ ID NO: 2800439 - DNA, 19 bp, Homo sapiens
gcacaatttagaaaacatt

SEQ ID NO: 2800440 - DNA, 18 bp, Homo sapiens
gcacaatttatattttcc

SEQ ID NO: 2800441 - DNA, 21 bp, Homo sapiens
gcacaatttgagcaattcatt

SEQ ID NO: 2800442 - DNA, 12 bp, Homo sapiens
gcacacaccaga

SEQ ID NO: 2800443 - DNA, 19 bp, Homo sapiens
gcacacaccagagcccacc

SEQ ID NO: 2800444 - DNA, 22 bp, Homo sapiens
gcacacaggtacagcaacagga

SEQ ID NO: 2800445 - DNA, 14 bp, Homo sapiens
gcacaccgggcact

SEQ ID NO: 2800446 - DNA, 23 bp, Homo sapiens
gcacacgaaccctgccaggcccc

SEQ ID NO: 2800447 - DNA, 20 bp, Homo sapiens
gcacagattacttcagggct

SEQ ID NO: 2800448 - DNA, 17 bp, Homo sapiens
gcacagcccaaagaagg

SEQ ID NO: 2800449 - DNA, 16 bp, Homo sapiens
gcacagctatgaaggc

SEQ ID NO: 2800450 - DNA, 16 bp, Homo sapiens
gcacagcttcatttcc

SEQ ID NO: 2800451 - DNA, 15 bp, Homo sapiens
gcacaggagctacct

SEQ ID NO: 2800452 - DNA, 12 bp, Homo sapiens
gcacatctggga

SEQ ID NO: 2800453 - DNA, 16 bp, Homo sapiens
gcacatttatatatat

SEQ ID NO: 2800454 - DNA, 18 bp, Homo sapiens
gcaccactgtgtatttaa

SEQ ID NO: 2800455 - DNA, 16 bp, Homo sapiens
gcaccagaatgtatat

SEQ ID NO: 2800456 - DNA, 15 bp, Homo sapiens
gcaccagcccttccc

SEQ ID NO: 2800457 - DNA, 16 bp, Homo sapiens
gcaccagcttctccag

SEQ ID NO: 2800458 - DNA, 18 bp, Homo sapiens
gcaccagcttctccaggc

SEQ ID NO: 2800459 - DNA, 21 bp, Homo sapiens
gcaccaggcacgaacccacct

SEQ ID NO: 2800460 - DNA, 20 bp, Homo sapiens
gcaccaggccgggcttgggc

SEQ ID NO: 2800461 - DNA, 23 bp, Homo sapiens
gcaccccatgagtagtgcccact

SEQ ID NO: 2800462 - DNA, 13 bp, Homo sapiens
gcacccccagcct

SEQ ID NO: 2800463 - DNA, 16 bp, Homo sapiens
gcacccccagcctggg

SEQ ID NO: 2800464 - DNA, 19 bp, Homo sapiens
gcacccccagcctgggcct

SEQ ID NO: 2800465 - DNA, 20 bp, Homo sapiens
gcacccccagcctgggccta

SEQ ID NO: 2800466 - DNA, 17 bp, Homo sapiens
gcaccccctcattcccc

SEQ ID NO: 2800467 - DNA, 20 bp, Homo sapiens
gcaccccctcattcccctcg

SEQ ID NO: 2800468 - DNA, 22 bp, Homo sapiens
gcacccctccccattcacagag

SEQ ID NO: 2800469 - DNA, 14 bp, Homo sapiens
gcacccggcccctg

SEQ ID NO: 2800470 - DNA, 18 bp, Homo sapiens
gcacccggcccctgctgg

SEQ ID NO: 2800471 - DNA, 20 bp, Homo sapiens
gcacccgtacccccgtggtc

SEQ ID NO: 2800472 - DNA, 16 bp, Homo sapiens
gcaccctccgccttca

SEQ ID NO: 2800473 - DNA, 19 bp, Homo sapiens
gcaccctcgatgaagccca

SEQ ID NO: 2800474 - DNA, 24 bp, Homo sapiens
gcaccctgcagagcacacaggtac

SEQ ID NO: 2800475 - DNA, 16 bp, Homo sapiens
gcaccctgttccctct

SEQ ID NO: 2800476 - DNA, 20 bp, Homo sapiens
gcacccttcctcctcctttg

SEQ ID NO: 2800477 - DNA, 16 bp, Homo sapiens
gcacccttctttcctc

SEQ ID NO: 2800478 - DNA, 23 bp, Homo sapiens
gcaccgagaactcgaagcccttc

SEQ ID NO: 2800479 - DNA, 15 bp, Homo sapiens
gcaccgcagcatgtg

SEQ ID NO: 2800480 - DNA, 17 bp, Homo sapiens
gcaccgcagcatgtggg

SEQ ID NO: 2800481 - DNA, 18 bp, Homo sapiens
gcacctacatccccaggt

SEQ ID NO: 2800482 - DNA, 18 bp, Homo sapiens
gcacctatagtcccagct

SEQ ID NO: 2800483 - DNA, 23 bp, Homo sapiens
gcacctcccagtttgctgggttt

SEQ ID NO: 2800484 - DNA, 17 bp, Homo sapiens
gcacctccccccactgc

SEQ ID NO: 2800485 - DNA, 14 bp, Homo sapiens
gcacctcctgcctc

SEQ ID NO: 2800486 - DNA, 23 bp, Homo sapiens
gcacctgcatccgtagttccctg

SEQ ID NO: 2800487 - DNA, 16 bp, Homo sapiens
gcacctgccagcctgg

SEQ ID NO: 2800488 - DNA, 22 bp, Homo sapiens
gcacctgccagcctggcttctg

SEQ ID NO: 2800489 - DNA, 16 bp, Homo sapiens
gcacctgccccctggt

SEQ ID NO: 2800490 - DNA, 18 bp, Homo sapiens
gcacctgggccctggggc

SEQ ID NO: 2800491 - DNA, 19 bp, Homo sapiens
gcacctgggccctggggcc

SEQ ID NO: 2800492 - DNA, 22 bp, Homo sapiens
gcacctgggccctggggcctgt

SEQ ID NO: 2800493 - DNA, 19 bp, Homo sapiens
gcacctgtactcaggaggc

SEQ ID NO: 2800494 - DNA, 14 bp, Homo sapiens
gcaccttgtgtctg

SEQ ID NO: 2800495 - DNA, 20 bp, Homo sapiens
gcaccttgtgtctgtacacg

SEQ ID NO: 2800496 - DNA, 17 bp, Homo sapiens
gcacctttctagttgaa

SEQ ID NO: 2800497 - DNA, 23 bp, Homo sapiens
gcacgaacccacctgctgagaga

SEQ ID NO: 2800498 - DNA, 17 bp, Homo sapiens
gcacgcctgcccagcct

SEQ ID NO: 2800499 - DNA, 16 bp, Homo sapiens
gcacggcagcttgagc

SEQ ID NO: 2800500 - DNA, 22 bp, Homo sapiens
gcactaaaaagtggctaattca

SEQ ID NO: 2800501 - DNA, 20 bp, Homo sapiens
gcactaaggtgtgctctgat

SEQ ID NO: 2800502 - DNA, 20 bp, Homo sapiens
gcactcaaccaacctccccg

SEQ ID NO: 2800503 - DNA, 19 bp, Homo sapiens
gcactcacccatgtgccaa

SEQ ID NO: 2800504 - DNA, 23 bp, Homo sapiens
gcactcacccatgtgccaaggtg

SEQ ID NO: 2800505 - DNA, 17 bp, Homo sapiens
gcactcagaagacactg

SEQ ID NO: 2800506 - DNA, 20 bp, Homo sapiens
gcactcagaagacactgatg

SEQ ID NO: 2800507 - DNA, 14 bp, Homo sapiens
gcactcagtgaggc

SEQ ID NO: 2800508 - DNA, 16 bp, Homo sapiens
gcactccagcctgggc

SEQ ID NO: 2800509 - DNA, 13 bp, Homo sapiens
gcactcctctgtc

SEQ ID NO: 2800510 - DNA, 16 bp, Homo sapiens
gcactcctctgtctct

SEQ ID NO: 2800511 - DNA, 21 bp, Homo sapiens
gcactcctctgtctctgctct

SEQ ID NO: 2800512 - DNA, 20 bp, Homo sapiens
gcactctctaaatcttcctt

SEQ ID NO: 2800513 - DNA, 20 bp, Homo sapiens
gcactgacccacagcctctg

SEQ ID NO: 2800514 - DNA, 11 bp, Homo sapiens
gcactgagggc

SEQ ID NO: 2800515 - DNA, 13 bp, Homo sapiens
gcactgagggcca

SEQ ID NO: 2800516 - DNA, 15 bp, Homo sapiens
gcactgagggccaca

SEQ ID NO: 2800517 - DNA, 20 bp, Homo sapiens
gcactgagggccacactatt

SEQ ID NO: 2800518 - DNA, 17 bp, Homo sapiens
gcactgatcaatccttc

SEQ ID NO: 2800519 - DNA, 15 bp, Homo sapiens
gcactgccaggaggg

SEQ ID NO: 2800520 - DNA, 12 bp, Homo sapiens
gcactgctgccc

SEQ ID NO: 2800521 - DNA, 15 bp, Homo sapiens
gcactgctgcccagc

SEQ ID NO: 2800522 - DNA, 18 bp, Homo sapiens
gcactgggttgactttca

SEQ ID NO: 2800523 - DNA, 15 bp, Homo sapiens
gcactgtatgctgga

SEQ ID NO: 2800524 - DNA, 16 bp, Homo sapiens
gcacttgcagactcta

SEQ ID NO: 2800525 - DNA, 20 bp, Homo sapiens
gcccagccattaccatggag

SEQ ID NO: 2800526 - DNA, 14 bp, Homo sapiens
gcccagcctctgtc

SEQ ID NO: 2800527 - DNA, 14 bp, Homo sapiens
gcccagctctttgt

SEQ ID NO: 2800528 - DNA, 11 bp, Homo sapiens
gcccaggagac

SEQ ID NO: 2800529 - DNA, 21 bp, Homo sapiens
gcccaggagagccagccctcc

SEQ ID NO: 2800530 - DNA, 17 bp, Homo sapiens
gcccaggcccctgccac

SEQ ID NO: 2800531 - DNA, 22 bp, Homo sapiens
gcccaggcccctgccaccctgg

SEQ ID NO: 2800532 - DNA, 11 bp, Homo sapiens
gcccaggctgg

SEQ ID NO: 2800533 - DNA, 20 bp, Homo sapiens
gcccaggctggagtgcagtg

SEQ ID NO: 2800534 - DNA, 22 bp, Homo sapiens
gcccaggctggcgtgcagtggt

SEQ ID NO: 2800535 - DNA, 17 bp, Homo sapiens
gcccagggcatcccatg

SEQ ID NO: 2800536 - DNA, 18 bp, Homo sapiens
gcccagggctcagcctgg

SEQ ID NO: 2800537 - DNA, 20 bp, Homo sapiens
gcccagtctggaatgcagtg

SEQ ID NO: 2800538 - DNA, 22 bp, Homo sapiens
gcccagtgcacttgctggaaga

SEQ ID NO: 2800539 - DNA, 19 bp, Homo sapiens
gcccagttgggtggatgcc

SEQ ID NO: 2800540 - DNA, 22 bp, Homo sapiens
gcccagttgggtggatgcctgg

SEQ ID NO: 2800541 - DNA, 20 bp, Homo sapiens
gcccatgctcaaccactgtg

SEQ ID NO: 2800542 - DNA, 15 bp, Homo sapiens
gcccatgctttccca

SEQ ID NO: 2800543 - DNA, 15 bp, Homo sapiens
gcccattctctctcc

SEQ ID NO: 2800544 - DNA, 22 bp, Homo sapiens
gccccaactcctggaagctgtg

SEQ ID NO: 2800545 - DNA, 19 bp, Homo sapiens
gccccaactccttccagct

SEQ ID NO: 2800546 - DNA, 20 bp, Homo sapiens
gccccaactccttccagcta

SEQ ID NO: 2800547 - DNA, 19 bp, Homo sapiens
gccccaaggggtttctgtt

SEQ ID NO: 2800548 - DNA, 13 bp, Homo sapiens
gccccaccaccta

SEQ ID NO: 2800549 - DNA, 15 bp, Homo sapiens
gccccaccacctagg

SEQ ID NO: 2800550 - DNA, 20 bp, Homo sapiens
gccccaccctcgtggacacc

SEQ ID NO: 2800551 - DNA, 15 bp, Homo sapiens
gccccagaaggcagg

SEQ ID NO: 2800552 - DNA, 12 bp, Homo sapiens
gccccagacaca

SEQ ID NO: 2800553 - DNA, 14 bp, Homo sapiens
gccccagacacacc

SEQ ID NO: 2800554 - DNA, 23 bp, Homo sapiens
gccccagacacaccccccagtcg

SEQ ID NO: 2800555 - DNA, 12 bp, Homo sapiens
gccccagagagg

SEQ ID NO: 2800556 - DNA, 21 bp, Homo sapiens
gccccagagaggggacatttc

SEQ ID NO: 2800557 - DNA, 12 bp, Homo sapiens
gccccagcacta

SEQ ID NO: 2800558 - DNA, 17 bp, Homo sapiens
gccccagcactaaagca

SEQ ID NO: 2800559 - DNA, 19 bp, Homo sapiens
gccccagcactaaagcagt

SEQ ID NO: 2800560 - DNA, 16 bp, Homo sapiens
gccccagtgcccacag

SEQ ID NO: 2800561 - DNA, 15 bp, Homo sapiens
gccccatgtctctca

SEQ ID NO: 2800562 - DNA, 18 bp, Homo sapiens
gccccattctgcctgccc

SEQ ID NO: 2800563 - DNA, 20 bp, Homo sapiens
gccccattctgcctgcccag

SEQ ID NO: 2800564 - DNA, 23 bp, Homo sapiens
gccccattctgcctgcccaggcc

SEQ ID NO: 2800565 - DNA, 19 bp, Homo sapiens
gccccccgcagcaccctgc

SEQ ID NO: 2800566 - DNA, 14 bp, Homo sapiens
gcccccctccaggc

SEQ ID NO: 2800567 - DNA, 21 bp, Homo sapiens
gccccctggtggacagtcctg

SEQ ID NO: 2800568 - DNA, 12 bp, Homo sapiens
gccccgactcca

SEQ ID NO: 2800569 - DNA, 15 bp, Homo sapiens
gccccgactccagcc

SEQ ID NO: 2800570 - DNA, 16 bp, Homo sapiens
gccccgactccagcca

SEQ ID NO: 2800571 - DNA, 18 bp, Homo sapiens
gccccgactccagccagc

SEQ ID NO: 2800572 - DNA, 20 bp, Homo sapiens
gccccgactccagccagcgc

SEQ ID NO: 2800573 - DNA, 15 bp, Homo sapiens
gccccgaggccttct

SEQ ID NO: 2800574 - DNA, 22 bp, Homo sapiens
gccccgaggccttctctgaagg

SEQ ID NO: 2800575 - DNA, 20 bp, Homo sapiens
gccccgcttccccacagaac

SEQ ID NO: 2800576 - DNA, 20 bp, Homo sapiens
gccccgcttgtccagcgcct

SEQ ID NO: 2800577 - DNA, 14 bp, Homo sapiens
gccccgggcctgcc

SEQ ID NO: 2800578 - DNA, 15 bp, Homo sapiens
gccccgggcctgcct

SEQ ID NO: 2800579 - DNA, 15 bp, Homo sapiens
gccccgggtccccag

SEQ ID NO: 2800580 - DNA, 21 bp, Homo sapiens
gccccgggtccccagctcccc

SEQ ID NO: 2800581 - DNA, 23 bp, Homo sapiens
gccccgggtccccagctccccag

SEQ ID NO: 2800582 - DNA, 16 bp, Homo sapiens
gcccctcctctgccac

SEQ ID NO: 2800583 - DNA, 20 bp, Homo sapiens
gcccctcctctgccacctcc

SEQ ID NO: 2800584 - DNA, 16 bp, Homo sapiens
gcccctgccaccctgg

SEQ ID NO: 2800585 - DNA, 12 bp, Homo sapiens
gcccctgctggt

SEQ ID NO: 2800586 - DNA, 21 bp, Homo sapiens
gcccctgctggttcagggttg

SEQ ID NO: 2800587 - DNA, 17 bp, Homo sapiens
gcccctggtctgccctg

SEQ ID NO: 2800588 - DNA, 18 bp, Homo sapiens
gcccctgtaggttgctta

SEQ ID NO: 2800589 - DNA, 12 bp, Homo sapiens
gcccctgtgtga

SEQ ID NO: 2800590 - DNA, 24 bp, Homo sapiens
gcccctgttcccccgctggcagcc

SEQ ID NO: 2800591 - DNA, 20 bp, Homo sapiens
gccccttactatgatctcag

SEQ ID NO: 2800592 - DNA, 13 bp, Homo sapiens
gcccgagcagctg

SEQ ID NO: 2800593 - DNA, 21 bp, Homo sapiens
gattattttagtctgtcatcc

SEQ ID NO: 2800594 - DNA, 19 bp, Homo sapiens
gattcaaactgctccaagt

SEQ ID NO: 2800595 - DNA, 18 bp, Homo sapiens
gattcacaatgaaatgct

SEQ ID NO: 2800596 - DNA, 22 bp, Homo sapiens
gattcacaatgaaatgctctcc

SEQ ID NO: 2800597 - DNA, 19 bp, Homo sapiens
gattcaggaaaaggcctgg

SEQ ID NO: 2800598 - DNA, 20 bp, Homo sapiens
gattcaggaaaaggcctggg

SEQ ID NO: 2800599 - DNA, 22 bp, Homo sapiens
gattcaggaaaaggcctggggt

SEQ ID NO: 2800600 - DNA, 16 bp, Homo sapiens
gattcaggggctcccc

SEQ ID NO: 2800601 - DNA, 11 bp, Homo sapiens
gattcataaca

SEQ ID NO: 2800602 - DNA, 11 bp, Homo sapiens
gattcatgtgg

SEQ ID NO: 2800603 - DNA, 15 bp, Homo sapiens
gattcccaagctctg

SEQ ID NO: 2800604 - DNA, 16 bp, Homo sapiens
gattcccaagctctgc

SEQ ID NO: 2800605 - DNA, 21 bp, Homo sapiens
gattcccaagctctgctcctc

SEQ ID NO: 2800606 - DNA, 14 bp, Homo sapiens
gattcccagagaca

SEQ ID NO: 2800607 - DNA, 14 bp, Homo sapiens
gattccctctccca

SEQ ID NO: 2800608 - DNA, 14 bp, Homo sapiens
gcagggctctcctg

SEQ ID NO: 2800609 - DNA, 18 bp, Homo sapiens
gcagggctctcctggctt

SEQ ID NO: 2800610 - DNA, 17 bp, Homo sapiens
gcagggtcaggagaggg

SEQ ID NO: 2800611 - DNA, 22 bp, Homo sapiens
gcaggtccagggtttgagttca

SEQ ID NO: 2800612 - DNA, 17 bp, Homo sapiens
gcaggtggcatctctaa

SEQ ID NO: 2800613 - DNA, 11 bp, Homo sapiens
gcaggtgtcta

SEQ ID NO: 2800614 - DNA, 21 bp, Homo sapiens
gcagtcaacagttcaaagaag

SEQ ID NO: 2800615 - DNA, 14 bp, Homo sapiens
gcagtcatcagaag

SEQ ID NO: 2800616 - DNA, 19 bp, Homo sapiens
gcagtccagaataagtgct

SEQ ID NO: 2800617 - DNA, 13 bp, Homo sapiens
gcagtccagccag

SEQ ID NO: 2800618 - DNA, 16 bp, Homo sapiens
gcagtccagccagctc

SEQ ID NO: 2800619 - DNA, 17 bp, Homo sapiens
gcagtccagccagctcc

SEQ ID NO: 2800620 - DNA, 18 bp, Homo sapiens
gcagtccagccagctcct

SEQ ID NO: 2800621 - DNA, 14 bp, Homo sapiens
gcagtgaattgtga

SEQ ID NO: 2800622 - DNA, 21 bp, Homo sapiens
gcagtgaattgtgaccaagtt

SEQ ID NO: 2800623 - DNA, 18 bp, Homo sapiens
gcagtgacgtgcacctgt

SEQ ID NO: 2800624 - DNA, 21 bp, Homo sapiens
gcagtgagccgcatcttctcc

SEQ ID NO: 2800625 - DNA, 14 bp, Homo sapiens
gcagtgagctgaga

SEQ ID NO: 2800626 - DNA, 22 bp, Homo sapiens
gcagtgccttccataattatga

SEQ ID NO: 2800627 - DNA, 18 bp, Homo sapiens
gcagtgggagggtaccag

SEQ ID NO: 2800628 - DNA, 18 bp, Homo sapiens
gcagtggtaagctctggc

SEQ ID NO: 2800629 - DNA, 20 bp, Homo sapiens
gcagtggtgcgatctgggtt

SEQ ID NO: 2800630 - DNA, 22 bp, Homo sapiens
gcagtggtgcgatctgggttca

SEQ ID NO: 2800631 - DNA, 11 bp, Homo sapiens
gcagtgtcttc

SEQ ID NO: 2800632 - DNA, 20 bp, Homo sapiens
gcagtgtgtcacactgagct

SEQ ID NO: 2800633 - DNA, 20 bp, Homo sapiens
gcagtgttttcacctcatat

SEQ ID NO: 2800634 - DNA, 15 bp, Homo sapiens
gcagttcgcagccac

SEQ ID NO: 2800635 - DNA, 18 bp, Homo sapiens
gcagttcgcagccaccct

SEQ ID NO: 2800636 - DNA, 19 bp, Homo sapiens
gcagttcgcagccaccctg

SEQ ID NO: 2800637 - DNA, 22 bp, Homo sapiens
gcagtttttttatggcattttt

SEQ ID NO: 2800638 - DNA, 13 bp, Homo sapiens
gcatacctttatt

SEQ ID NO: 2800639 - DNA, 16 bp, Homo sapiens
gcatacctttattgtg

SEQ ID NO: 2800640 - DNA, 20 bp, Homo sapiens
gcatacctttattgtgatct

SEQ ID NO: 2800641 - DNA, 20 bp, Homo sapiens
gcatagtaccaatcatttta

SEQ ID NO: 2800642 - DNA, 15 bp, Homo sapiens
gcatattaaaggctt

SEQ ID NO: 2800643 - DNA, 23 bp, Homo sapiens
gcatatttatagcaatccatgtt

SEQ ID NO: 2800644 - DNA, 14 bp, Homo sapiens
gcatcacagggcag

SEQ ID NO: 2800645 - DNA, 16 bp, Homo sapiens
gcatcacagggcagag

SEQ ID NO: 2800646 - DNA, 14 bp, Homo sapiens
gcatcacctcaggc

SEQ ID NO: 2800647 - DNA, 16 bp, Homo sapiens
gcatcagaaagggagg

SEQ ID NO: 2800648 - DNA, 21 bp, Homo sapiens
gcatcagaaagggagggctct

SEQ ID NO: 2800649 - DNA, 22 bp, Homo sapiens
gcatcagaaagggagggctctg

SEQ ID NO: 2800650 - DNA, 12 bp, Homo sapiens
gcatcatgcctc

SEQ ID NO: 2800651 - DNA, 15 bp, Homo sapiens
gcatcatgcctctga

SEQ ID NO: 2800652 - DNA, 17 bp, Homo sapiens
gcatccatctgggctac

SEQ ID NO: 2800653 - DNA, 14 bp, Homo sapiens
gcatccattcctca

SEQ ID NO: 2800654 - DNA, 13 bp, Homo sapiens
gcatcccagggga

SEQ ID NO: 2800655 - DNA, 13 bp, Homo sapiens
gcatcccatgggg

SEQ ID NO: 2800656 - DNA, 22 bp, Homo sapiens
gcatcctggcacccggcccctg

SEQ ID NO: 2800657 - DNA, 19 bp, Homo sapiens
gcatctacacagcctggac

SEQ ID NO: 2800658 - DNA, 20 bp, Homo sapiens
gcatctacacagcctggact

SEQ ID NO: 2800659 - DNA, 21 bp, Homo sapiens
gcatctacacagcctggactt

SEQ ID NO: 2800660 - DNA, 22 bp, Homo sapiens
gcatctagaggcttccttcatt

SEQ ID NO: 2800661 - DNA, 23 bp, Homo sapiens
gcatctagaggcttccttcattt

SEQ ID NO: 2800662 - DNA, 14 bp, Homo sapiens
gcatctcttgaggc

SEQ ID NO: 2800663 - DNA, 12 bp, Homo sapiens
gcatctgcaccc

SEQ ID NO: 2800664 - DNA, 16 bp, Homo sapiens
gcatctgggattccca

SEQ ID NO: 2800665 - DNA, 14 bp, Homo sapiens
gcatcttctccatc

SEQ ID NO: 2800666 - DNA, 23 bp, Homo sapiens
gcatcttctggagtctccagtgg

SEQ ID NO: 2800667 - DNA, 19 bp, Homo sapiens
gcatgagggatcacagggc

SEQ ID NO: 2800668 - DNA, 20 bp, Homo sapiens
gcatgatgttaaccagaata

SEQ ID NO: 2800669 - DNA, 13 bp, Homo sapiens
gcatgattttata

SEQ ID NO: 2800670 - DNA, 21 bp, Homo sapiens
gcatgcattttgcagcagtga

SEQ ID NO: 2800671 - DNA, 20 bp, Homo sapiens
gcatgccagagcctggggca

SEQ ID NO: 2800672 - DNA, 14 bp, Homo sapiens
gcatgcgcacaagg

SEQ ID NO: 2800673 - DNA, 21 bp, Homo sapiens
gcatgcgcacaaggctgacca

SEQ ID NO: 2800674 - DNA, 22 bp, Homo sapiens
gcatgctcagcccttcctagaa

SEQ ID NO: 2800675 - DNA, 15 bp, Homo sapiens
gcatgctggggcaag

SEQ ID NO: 2800676 - DNA, 15 bp, Homo sapiens
gcatggagaataaac

SEQ ID NO: 2800677 - DNA, 19 bp, Homo sapiens
gcatggtcccacatccctg

SEQ ID NO: 2800678 - DNA, 17 bp, Homo sapiens
gcatgtaaaatgcagtc

SEQ ID NO: 2800679 - DNA, 16 bp, Homo sapiens
ggcagccaaacccatg

SEQ ID NO: 2800680 - DNA, 18 bp, Homo sapiens
ggcagccaaacccatgag

SEQ ID NO: 2800681 - DNA, 20 bp, Homo sapiens
ggcagccaaacccatgaggc

SEQ ID NO: 2800682 - DNA, 18 bp, Homo sapiens
ggcagcccagcctctgtc

SEQ ID NO: 2800683 - DNA, 16 bp, Homo sapiens
ggcagccccattctgc

SEQ ID NO: 2800684 - DNA, 13 bp, Homo sapiens
ggcagccctgtag

SEQ ID NO: 2800685 - DNA, 20 bp, Homo sapiens
ggcagcctcaggggcctcag

SEQ ID NO: 2800686 - DNA, 22 bp, Homo sapiens
ggcagctgcttttgtctatggg

SEQ ID NO: 2800687 - DNA, 16 bp, Homo sapiens
ggcagctggatgagac

SEQ ID NO: 2800688 - DNA, 19 bp, Homo sapiens
ggcagcttgagcctgtcac

SEQ ID NO: 2800689 - DNA, 20 bp, Homo sapiens
ggcagcttgagcctgtcacg

SEQ ID NO: 2800690 - DNA, 22 bp, Homo sapiens
ggcaggaactgcagtatggcca

SEQ ID NO: 2800691 - DNA, 23 bp, Homo sapiens
ggcaggaactgcagtatggccat

SEQ ID NO: 2800692 - DNA, 15 bp, Homo sapiens
ggcaggaccaggact

SEQ ID NO: 2800693 - DNA, 19 bp, Homo sapiens
ggcaggcagggctctcctg

SEQ ID NO: 2800694 - DNA, 18 bp, Homo sapiens
ggcagggaaaggctctga

SEQ ID NO: 2800695 - DNA, 13 bp, Homo sapiens
ggcagggagggga

SEQ ID NO: 2800696 - DNA, 19 bp, Homo sapiens
ggcagggccttgcccagag

SEQ ID NO: 2800697 - DNA, 21 bp, Homo sapiens
ggcagggccttgcccagagat

SEQ ID NO: 2800698 - DNA, 12 bp, Homo sapiens
ggcagggctctc

SEQ ID NO: 2800699 - DNA, 13 bp, Homo sapiens
ggcagggctctcc

SEQ ID NO: 2800700 - DNA, 19 bp, Homo sapiens
ggcagggctctcctggctt

SEQ ID NO: 2800701 - DNA, 20 bp, Homo sapiens
ggcagggctctcctggcttc

SEQ ID NO: 2800702 - DNA, 12 bp, Homo sapiens
ggcaggggcgga

SEQ ID NO: 2800703 - DNA, 15 bp, Homo sapiens
ggcagggtcaggaga

SEQ ID NO: 2800704 - DNA, 17 bp, Homo sapiens
ggcagggtcaggagagg

SEQ ID NO: 2800705 - DNA, 17 bp, Homo sapiens
ggcagggtctcactctg

SEQ ID NO: 2800706 - DNA, 19 bp, Homo sapiens
ggcagggtctcactctgtc

SEQ ID NO: 2800707 - DNA, 20 bp, Homo sapiens
ggcagggtctcactctgtcg

SEQ ID NO: 2800708 - DNA, 16 bp, Homo sapiens
ggcagggtgggatgga

SEQ ID NO: 2800709 - DNA, 24 bp, Homo sapiens
ggcaggtgccctctgctccccagt

SEQ ID NO: 2800710 - DNA, 23 bp, Homo sapiens
ggcagtagctgtggtgaggtggg

SEQ ID NO: 2800711 - DNA, 17 bp, Homo sapiens
ggcagtcatactggggt

SEQ ID NO: 2800712 - DNA, 20 bp, Homo sapiens
ggcagtccagccagctcctg

SEQ ID NO: 2800713 - DNA, 20 bp, Homo sapiens
ggcagttcgcagccaccctg

SEQ ID NO: 2800714 - DNA, 21 bp, Homo sapiens
ggcagttcgcagccaccctga

SEQ ID NO: 2800715 - DNA, 16 bp, Homo sapiens
ggcatcacagggcaga

SEQ ID NO: 2800716 - DNA, 22 bp, Homo sapiens
ggcatcacagggcagagccggg

SEQ ID NO: 2800717 - DNA, 22 bp, Homo sapiens
ggcatctacacagcctggactt

SEQ ID NO: 2800718 - DNA, 13 bp, Homo sapiens
ggatctatgcaat

SEQ ID NO: 2800719 - DNA, 18 bp, Homo sapiens
ggatctatgcaattttta

SEQ ID NO: 2800720 - DNA, 13 bp, Homo sapiens
ggatctccaagga

SEQ ID NO: 2800721 - DNA, 22 bp, Homo sapiens
ggatctctcaggagcacaggca

SEQ ID NO: 2800722 - DNA, 19 bp, Homo sapiens
ggatctgggaccctttcct

SEQ ID NO: 2800723 - DNA, 18 bp, Homo sapiens
ggatctggggctctggga

SEQ ID NO: 2800724 - DNA, 16 bp, Homo sapiens
ggatcttgcattccca

SEQ ID NO: 2800725 - DNA, 18 bp, Homo sapiens
ggatgaatgaggtcccag

SEQ ID NO: 2800726 - DNA, 13 bp, Homo sapiens
ggatgcagcatta

SEQ ID NO: 2800727 - DNA, 17 bp, Homo sapiens
ggatgcctggtggcagc

SEQ ID NO: 2800728 - DNA, 23 bp, Homo sapiens
ggatgcgtgccctgacccctgca

SEQ ID NO: 2800729 - DNA, 14 bp, Homo sapiens
ggatgctgcctgag

SEQ ID NO: 2800730 - DNA, 16 bp, Homo sapiens
ggatggagagagggga

SEQ ID NO: 2800731 - DNA, 14 bp, Homo sapiens
ggatggaggagaag

SEQ ID NO: 2800732 - DNA, 15 bp, Homo sapiens
ggatggcaccagagg

SEQ ID NO: 2800733 - DNA, 15 bp, Homo sapiens
ggatgggatttcatg

SEQ ID NO: 2800734 - DNA, 21 bp, Homo sapiens
ggatggggtatggattctaaa

SEQ ID NO: 2800735 - DNA, 18 bp, Homo sapiens
ggatgtaaacagtgcctg

SEQ ID NO: 2800736 - DNA, 21 bp, Homo sapiens
ggatgtaaacagtgcctgctg

SEQ ID NO: 2800737 - DNA, 20 bp, Homo sapiens
ggatgtcccatctgctcctc

SEQ ID NO: 2800738 - DNA, 22 bp, Homo sapiens
ggatgtgcacggcagcttgagc

SEQ ID NO: 2800739 - DNA, 15 bp, Homo sapiens
ggatgttctgggaca

SEQ ID NO: 2800740 - DNA, 16 bp, Homo sapiens
ggatgttctgggacac

SEQ ID NO: 2800741 - DNA, 18 bp, Homo sapiens
ggatgtttttcatgaaaa

SEQ ID NO: 2800742 - DNA, 19 bp, Homo sapiens
ggattacaagcgtgagcca

SEQ ID NO: 2800743 - DNA, 19 bp, Homo sapiens
ggattcaggaaaaggcctg

SEQ ID NO: 2800744 - DNA, 20 bp, Homo sapiens
ggattcaggaaaaggcctgg

SEQ ID NO: 2800745 - DNA, 22 bp, Homo sapiens
ggattcccaccaaggtcttcag

SEQ ID NO: 2800746 - DNA, 16 bp, Homo sapiens
ggattcttccatctga

SEQ ID NO: 2800747 - DNA, 16 bp, Homo sapiens
ggattgctatgaatga

SEQ ID NO: 2800748 - DNA, 18 bp, Homo sapiens
ggattggggaagactgtg

SEQ ID NO: 2800749 - DNA, 17 bp, Homo sapiens
ggatttacgactgaaga

SEQ ID NO: 2800750 - DNA, 19 bp, Homo sapiens
ggatttacgactgaagaag

SEQ ID NO: 2800751 - DNA, 19 bp, Homo sapiens
ggatttatttaaaatagca

SEQ ID NO: 2800752 - DNA, 18 bp, Homo sapiens
ggatttcctattttaaaa

SEQ ID NO: 2800753 - DNA, 22 bp, Homo sapiens
ggatttgccccttcccatctct

SEQ ID NO: 2800754 - DNA, 16 bp, Homo sapiens
ggcaaaatccttgctt

SEQ ID NO: 2800755 - DNA, 16 bp, Homo sapiens
ggcaaatatcttgaaa

SEQ ID NO: 2800756 - DNA, 13 bp, Homo sapiens
ggcaacagagcaa

SEQ ID NO: 2800757 - DNA, 19 bp, Homo sapiens
ggagagccagctctctcta

SEQ ID NO: 2800758 - DNA, 11 bp, Homo sapiens
ggagagccctg

SEQ ID NO: 2800759 - DNA, 12 bp, Homo sapiens
ggagagctagga

SEQ ID NO: 2800760 - DNA, 13 bp, Homo sapiens
ggagagctaggag

SEQ ID NO: 2800761 - DNA, 14 bp, Homo sapiens
ggagagctaggagc

SEQ ID NO: 2800762 - DNA, 15 bp, Homo sapiens
ggagagctaggagca

SEQ ID NO: 2800763 - DNA, 21 bp, Homo sapiens
ggagagctaggagcaaagcct

SEQ ID NO: 2800764 - DNA, 18 bp, Homo sapiens
ggagaggggaagggccag

SEQ ID NO: 2800765 - DNA, 23 bp, Homo sapiens
ggagagggtctggagaagcagtg

SEQ ID NO: 2800766 - DNA, 21 bp, Homo sapiens
ggagagtcccctgaaggtctg

SEQ ID NO: 2800767 - DNA, 14 bp, Homo sapiens
ggagagtgcttggg

SEQ ID NO: 2800768 - DNA, 23 bp, Homo sapiens
ggagatatttatggggggagaac

SEQ ID NO: 2800769 - DNA, 14 bp, Homo sapiens
ggagcaaagcctgt

SEQ ID NO: 2800770 - DNA, 15 bp, Homo sapiens
ggagcaaagcctgtt

SEQ ID NO: 2800771 - DNA, 16 bp, Homo sapiens
ggagcaaatgtttctg

SEQ ID NO: 2800772 - DNA, 15 bp, Homo sapiens
ggagcacaggcagct

SEQ ID NO: 2800773 - DNA, 17 bp, Homo sapiens
ggagcaccaggcacgaa

SEQ ID NO: 2800774 - DNA, 18 bp, Homo sapiens
ggagcactggagtgcagg

SEQ ID NO: 2800775 - DNA, 17 bp, Homo sapiens
ggagcagaaagccaggg

SEQ ID NO: 2800776 - DNA, 16 bp, Homo sapiens
ggagcatctcttgagg

SEQ ID NO: 2800777 - DNA, 20 bp, Homo sapiens
ggagcatctcttgaggccag

SEQ ID NO: 2800778 - DNA, 21 bp, Homo sapiens
ggagcatctcttgaggccagg

SEQ ID NO: 2800779 - DNA, 14 bp, Homo sapiens
ggagcatctgactc

SEQ ID NO: 2800780 - DNA, 15 bp, Homo sapiens
ggagccaacagcagc

SEQ ID NO: 2800781 - DNA, 12 bp, Homo sapiens
ggagccagctct

SEQ ID NO: 2800782 - DNA, 13 bp, Homo sapiens
ggagcccccaccc

SEQ ID NO: 2800783 - DNA, 13 bp, Homo sapiens
ggagcccttgggt

SEQ ID NO: 2800784 - DNA, 21 bp, Homo sapiens
ggagccgagatcacgccactg

SEQ ID NO: 2800785 - DNA, 19 bp, Homo sapiens
ggagcctcatccgaggcag

SEQ ID NO: 2800786 - DNA, 21 bp, Homo sapiens
ggagcctgtgaacccaggaca

SEQ ID NO: 2800787 - DNA, 15 bp, Homo sapiens
ggagcgaaagtttct

SEQ ID NO: 2800788 - DNA, 19 bp, Homo sapiens
ggagcgcacctgccccctg

SEQ ID NO: 2800789 - DNA, 22 bp, Homo sapiens
ggagctgcctgttcagctccag

SEQ ID NO: 2800790 - DNA, 18 bp, Homo sapiens
ggagcttccagtgcatgt

SEQ ID NO: 2800791 - DNA, 15 bp, Homo sapiens
ggagcttgcaagaag

SEQ ID NO: 2800792 - DNA, 20 bp, Homo sapiens
ggagctttcaaagaaggaat

SEQ ID NO: 2800793 - DNA, 10 bp, Homo sapiens
ggaggacagt

SEQ ID NO: 2800794 - DNA, 19 bp, Homo sapiens
ggaggacctgagcctgccg

SEQ ID NO: 2800795 - DNA, 17 bp, Homo sapiens
ggaggagaccagctcag

SEQ ID NO: 2800796 - DNA, 12 bp, Homo sapiens
ggaggatggaga

SEQ ID NO: 2800797 - DNA, 12 bp, Homo sapiens
ggaatacagtgt

SEQ ID NO: 2800798 - DNA, 23 bp, Homo sapiens
ggaatcagacttcacactgcaag

SEQ ID NO: 2800799 - DNA, 17 bp, Homo sapiens
ggaatcagcttttaata

SEQ ID NO: 2800800 - DNA, 19 bp, Homo sapiens
ggaatgactataaacatta

SEQ ID NO: 2800801 - DNA, 21 bp, Homo sapiens
ggaatttaaggagggacaaga

SEQ ID NO: 2800802 - DNA, 14 bp, Homo sapiens
ggacaaaggagcct

SEQ ID NO: 2800803 - DNA, 17 bp, Homo sapiens
ggacaaaggagcctgtg

SEQ ID NO: 2800804 - DNA, 13 bp, Homo sapiens
ggacaacccagaa

SEQ ID NO: 2800805 - DNA, 14 bp, Homo sapiens
ggacaacccagaac

SEQ ID NO: 2800806 - DNA, 23 bp, Homo sapiens
ggacaagccaacttgtaaataca

SEQ ID NO: 2800807 - DNA, 11 bp, Homo sapiens
ggacacaggcc

SEQ ID NO: 2800808 - DNA, 12 bp, Homo sapiens
ggacacaggcct

SEQ ID NO: 2800809 - DNA, 16 bp, Homo sapiens
ggacacaggcctgtgt

SEQ ID NO: 2800810 - DNA, 23 bp, Homo sapiens
ggacacaggcctgtgtagctgtg

SEQ ID NO: 2800811 - DNA, 10 bp, Homo sapiens
ggacacctgc

SEQ ID NO: 2800812 - DNA, 17 bp, Homo sapiens
ggacactaaccacgctg

SEQ ID NO: 2800813 - DNA, 22 bp, Homo sapiens
ggacactaaccacgctggacct

SEQ ID NO: 2800814 - DNA, 20 bp, Homo sapiens
ggacagagacacctgcacct

SEQ ID NO: 2800815 - DNA, 21 bp, Homo sapiens
ggacagagacacctgcacctc

SEQ ID NO: 2800816 - DNA, 21 bp, Homo sapiens
ggacagcctgtggcggtgcct

SEQ ID NO: 2800817 - DNA, 16 bp, Homo sapiens
ggacagctccttctgt

SEQ ID NO: 2800818 - DNA, 12 bp, Homo sapiens
ggacagcttgtg

SEQ ID NO: 2800819 - DNA, 22 bp, Homo sapiens
ggacagcttgtggcaagtgaat

SEQ ID NO: 2800820 - DNA, 23 bp, Homo sapiens
ggacaggcatgttctctgaggac

SEQ ID NO: 2800821 - DNA, 16 bp, Homo sapiens
ggacagtcctgggaga

SEQ ID NO: 2800822 - DNA, 14 bp, Homo sapiens
ggacagtgcttcag

SEQ ID NO: 2800823 - DNA, 18 bp, Homo sapiens
ggacagtgcttcagcctg

SEQ ID NO: 2800824 - DNA, 21 bp, Homo sapiens
ggacagtgcttcagcctgagg

SEQ ID NO: 2800825 - DNA, 22 bp, Homo sapiens
ggacagtgcttcagcctgaggc

SEQ ID NO: 2800826 - DNA, 19 bp, Homo sapiens
ggacattttctctttaaaa

SEQ ID NO: 2800827 - DNA, 17 bp, Homo sapiens
ggaccaccagccccagc

SEQ ID NO: 2800828 - DNA, 17 bp, Homo sapiens
ggaccaggacaggacca

SEQ ID NO: 2800829 - DNA, 11 bp, Homo sapiens
ggaccaggact

SEQ ID NO: 2800830 - DNA, 14 bp, Homo sapiens
ggaccatcctattt

SEQ ID NO: 2800831 - DNA, 17 bp, Homo sapiens
ggacccgctctggacca

SEQ ID NO: 2800832 - DNA, 19 bp, Homo sapiens
ggacccgctctggaccaac

SEQ ID NO: 2800833 - DNA, 23 bp, Homo sapiens
ggaccctttccttccttccctgg

SEQ ID NO: 2800834 - DNA, 17 bp, Homo sapiens
ggaccggtacagaaagg

SEQ ID NO: 2800835 - DNA, 13 bp, Homo sapiens
ggacctctgctct

SEQ ID NO: 2800836 - DNA, 13 bp, Homo sapiens
gctgttgcctcat

SEQ ID NO: 2800837 - DNA, 15 bp, Homo sapiens
gctgttggctggggg

SEQ ID NO: 2800838 - DNA, 21 bp, Homo sapiens
gctgttggctgggggcctcag

SEQ ID NO: 2800839 - DNA, 12 bp, Homo sapiens
gctgtttgtcat

SEQ ID NO: 2800840 - DNA, 23 bp, Homo sapiens
gcttaattctgagctggcccttt

SEQ ID NO: 2800841 - DNA, 18 bp, Homo sapiens
gcttagaaagttattgtg

SEQ ID NO: 2800842 - DNA, 13 bp, Homo sapiens
gcttagacctcag

SEQ ID NO: 2800843 - DNA, 19 bp, Homo sapiens
gcttagacctcagcctgtg

SEQ ID NO: 2800844 - DNA, 23 bp, Homo sapiens
gcttagacttcgactcaggatcc

SEQ ID NO: 2800845 - DNA, 23 bp, Homo sapiens
gcttagtatctcatcaacaaaga

SEQ ID NO: 2800846 - DNA, 22 bp, Homo sapiens
gcttagttaagtcatccacagc

SEQ ID NO: 2800847 - DNA, 19 bp, Homo sapiens
gcttatggggtattttaag

SEQ ID NO: 2800848 - DNA, 11 bp, Homo sapiens
gcttatttaat

SEQ ID NO: 2800849 - DNA, 13 bp, Homo sapiens
gcttatttatatt

SEQ ID NO: 2800850 - DNA, 19 bp, Homo sapiens
gcttattttttaaaataat

SEQ ID NO: 2800851 - DNA, 21 bp, Homo sapiens
gcttcaagtgatatatgtatt

SEQ ID NO: 2800852 - DNA, 23 bp, Homo sapiens
gcttcaagtgatatatgtattta

SEQ ID NO: 2800853 - DNA, 22 bp, Homo sapiens
gcttcagacttttatcaaaatc

SEQ ID NO: 2800854 - DNA, 12 bp, Homo sapiens
gcttcagcctcc

SEQ ID NO: 2800855 - DNA, 12 bp, Homo sapiens
gcttcagcctga

SEQ ID NO: 2800856 - DNA, 23 bp, Homo sapiens
gcttcagcctgaggctgagactg

SEQ ID NO: 2800857 - DNA, 17 bp, Homo sapiens
gcttcagtggcagctgc

SEQ ID NO: 2800858 - DNA, 19 bp, Homo sapiens
gcttcagtggcagctgctt

SEQ ID NO: 2800859 - DNA, 20 bp, Homo sapiens
gcttcagtggcagctgcttt

SEQ ID NO: 2800860 - DNA, 16 bp, Homo sapiens
gcttcatcaattttta

SEQ ID NO: 2800861 - DNA, 17 bp, Homo sapiens
gcttcatcaatttttat

SEQ ID NO: 2800862 - DNA, 22 bp, Homo sapiens
gcttcatcaatttttatacata

SEQ ID NO: 2800863 - DNA, 14 bp, Homo sapiens
gcttcatgctcagc

SEQ ID NO: 2800864 - DNA, 19 bp, Homo sapiens
gcttccaggtatctccagg

SEQ ID NO: 2800865 - DNA, 21 bp, Homo sapiens
gcttccaggtatctccaggat

SEQ ID NO: 2800866 - DNA, 16 bp, Homo sapiens
gcttcccatccccagc

SEQ ID NO: 2800867 - DNA, 18 bp, Homo sapiens
gcttcccatccccagcga

SEQ ID NO: 2800868 - DNA, 21 bp, Homo sapiens
gcttccccacagaactgctta

SEQ ID NO: 2800869 - DNA, 24 bp, Homo sapiens
gcttccccacagaactgcttacta

SEQ ID NO: 2800870 - DNA, 22 bp, Homo sapiens
gcttcctcatagtatggtggct

SEQ ID NO: 2800871 - DNA, 17 bp, Homo sapiens
gcttccttcatttcctc

SEQ ID NO: 2800872 - DNA, 18 bp, Homo sapiens
gcttctatcccaggaggt

SEQ ID NO: 2800873 - DNA, 12 bp, Homo sapiens
gcttctcctgac

SEQ ID NO: 2800874 - DNA, 22 bp, Homo sapiens
gcttctctgtgaacgatttaga

SEQ ID NO: 2800875 - DNA, 21 bp, Homo sapiens
gcttctctgtgcccctgtaaa

SEQ ID NO: 2800876 - DNA, 16 bp, Homo sapiens
gcttctgaactcaagc

SEQ ID NO: 2800877 - DNA, 23 bp, Homo sapiens
gcttctgaactcaagctgcgttt

SEQ ID NO: 2800878 - DNA, 18 bp, Homo sapiens
gcttctggagcccttggg

SEQ ID NO: 2800879 - DNA, 14 bp, Homo sapiens
gcttcttgcccctt

SEQ ID NO: 2800880 - DNA, 13 bp, Homo sapiens
gcttgaacccagg

SEQ ID NO: 2800881 - DNA, 21 bp, Homo sapiens
gcttgactatcacatacaatt

SEQ ID NO: 2800882 - DNA, 12 bp, Homo sapiens
gcttgcaagaag

SEQ ID NO: 2800883 - DNA, 23 bp, Homo sapiens
gcttgctcttcagtgggagaaaa

SEQ ID NO: 2800884 - DNA, 14 bp, Homo sapiens
gcttgggccctgca

SEQ ID NO: 2800885 - DNA, 14 bp, Homo sapiens
gcttggggggtgat

SEQ ID NO: 2800886 - DNA, 18 bp, Homo sapiens
gcttgtaaatagctcagg

SEQ ID NO: 2800887 - DNA, 20 bp, Homo sapiens
gcttgtaaatagctcaggtg

SEQ ID NO: 2800888 - DNA, 13 bp, Homo sapiens
gcttgtacatatt

SEQ ID NO: 2800889 - DNA, 14 bp, Homo sapiens
gcttgtagccagcc

SEQ ID NO: 2800890 - DNA, 16 bp, Homo sapiens
gcttgtagccagccgg

SEQ ID NO: 2800891 - DNA, 22 bp, Homo sapiens
gcttgtatatacatattataaa

SEQ ID NO: 2800892 - DNA, 23 bp, Homo sapiens
gcttgtatatacatattataaat

SEQ ID NO: 2800893 - DNA, 14 bp, Homo sapiens
gcttgtattttcca

SEQ ID NO: 2800894 - DNA, 20 bp, Homo sapiens
gcttgtcactagcagctgca

SEQ ID NO: 2800895 - DNA, 17 bp, Homo sapiens
gcttgtcatctgccact

SEQ ID NO: 2800896 - DNA, 21 bp, Homo sapiens
gcttgtccaacaactccagga

SEQ ID NO: 2800897 - DNA, 16 bp, Homo sapiens
gcttgtccctgcccag

SEQ ID NO: 2800898 - DNA, 23 bp, Homo sapiens
gcttgttgtcaagtataaagtca

SEQ ID NO: 2800899 - DNA, 14 bp, Homo sapiens
gctttaacaaaaca

SEQ ID NO: 2800900 - DNA, 17 bp, Homo sapiens
gctttaacaaaacaaga

SEQ ID NO: 2800901 - DNA, 18 bp, Homo sapiens
gctttaacttaaatagta

SEQ ID NO: 2800902 - DNA, 23 bp, Homo sapiens
gctttattttttaagtatttata

SEQ ID NO: 2800903 - DNA, 19 bp, Homo sapiens
gctttcaacttaaatcact

SEQ ID NO: 2800904 - DNA, 20 bp, Homo sapiens
gctttcaacttaaatcactg

SEQ ID NO: 2800905 - DNA, 21 bp, Homo sapiens
gctttcaacttaaatcactga

SEQ ID NO: 2800906 - DNA, 22 bp, Homo sapiens
gctttccccgggggaggaaggg

SEQ ID NO: 2800907 - DNA, 20 bp, Homo sapiens
gctttcctccctggcatgac

SEQ ID NO: 2800908 - DNA, 19 bp, Homo sapiens
gctttctacccagcgagcc

SEQ ID NO: 2800909 - DNA, 12 bp, Homo sapiens
gctttctcctgg

SEQ ID NO: 2800910 - DNA, 23 bp, Homo sapiens
gctttcttctacaaccagagccc

SEQ ID NO: 2800911 - DNA, 21 bp, Homo sapiens
gctttgacatgaaaagatagg

SEQ ID NO: 2800912 - DNA, 14 bp, Homo sapiens
gctttgactcacct

SEQ ID NO: 2800913 - DNA, 11 bp, Homo sapiens
gctttgcctgc

SEQ ID NO: 2800914 - DNA, 19 bp, Homo sapiens
gctttgcgctggtggacca

SEQ ID NO: 2800915 - DNA, 15 bp, Homo sapiens
gctttgtgtgattga

SEQ ID NO: 2800916 - DNA, 13 bp, Homo sapiens
gcttttaataaaa

SEQ ID NO: 2800917 - DNA, 15 bp, Homo sapiens
gcttttaataaaatt

SEQ ID NO: 2800918 - DNA, 23 bp, Homo sapiens
gcttttaataaaattgacaacat

SEQ ID NO: 2800919 - DNA, 22 bp, Homo sapiens
gcttttccccggtcccttgaga

SEQ ID NO: 2800920 - DNA, 16 bp, Homo sapiens
gctttttgtcttttct

SEQ ID NO: 2800921 - DNA, 11 bp, Homo sapiens
ggaaaaatatt

SEQ ID NO: 2800922 - DNA, 13 bp, Homo sapiens
ggaaaaatattta

SEQ ID NO: 2800923 - DNA, 14 bp, Homo sapiens
ggaaaaatatttaa

SEQ ID NO: 2800924 - DNA, 19 bp, Homo sapiens
ggaaaacataatatcttga

SEQ ID NO: 2800925 - DNA, 22 bp, Homo sapiens
ggaaaagaatccctgcagcctg

SEQ ID NO: 2800926 - DNA, 18 bp, Homo sapiens
gctgcctgttcagctcca

SEQ ID NO: 2800927 - DNA, 22 bp, Homo sapiens
gctgcctgttcagctccagctc

SEQ ID NO: 2800928 - DNA, 15 bp, Homo sapiens
gctgcgagcatttcc

SEQ ID NO: 2800929 - DNA, 15 bp, Homo sapiens
gctgcggtccaccca

SEQ ID NO: 2800930 - DNA, 17 bp, Homo sapiens
gctgcggtccacccagg

SEQ ID NO: 2800931 - DNA, 22 bp, Homo sapiens
gctgcggtccacccaggagccc

SEQ ID NO: 2800932 - DNA, 12 bp, Homo sapiens
gctgctacccag

SEQ ID NO: 2800933 - DNA, 17 bp, Homo sapiens
gctgctagagaaggggg

SEQ ID NO: 2800934 - DNA, 23 bp, Homo sapiens
gctgctcaacctctctccttctg

SEQ ID NO: 2800935 - DNA, 22 bp, Homo sapiens
gctgctcagaggggccccggtc

SEQ ID NO: 2800936 - DNA, 12 bp, Homo sapiens
gctgctctggaa

SEQ ID NO: 2800937 - DNA, 12 bp, Homo sapiens
gctgctgacagt

SEQ ID NO: 2800938 - DNA, 13 bp, Homo sapiens
gctgctgagaacc

SEQ ID NO: 2800939 - DNA, 14 bp, Homo sapiens
gctgctgagaacct

SEQ ID NO: 2800940 - DNA, 16 bp, Homo sapiens
gctgctgtgtagctct

SEQ ID NO: 2800941 - DNA, 18 bp, Homo sapiens
gctggaaaagtcacacag

SEQ ID NO: 2800942 - DNA, 21 bp, Homo sapiens
gctggaagacgcaagggcctg

SEQ ID NO: 2800943 - DNA, 15 bp, Homo sapiens
gctggacaacccaga

SEQ ID NO: 2800944 - DNA, 15 bp, Homo sapiens
gctggacaagaagct

SEQ ID NO: 2800945 - DNA, 18 bp, Homo sapiens
gctggacaagaagctgct

SEQ ID NO: 2800946 - DNA, 15 bp, Homo sapiens
gctggaccttgaact

SEQ ID NO: 2800947 - DNA, 16 bp, Homo sapiens
gctggacggcattcct

SEQ ID NO: 2800948 - DNA, 16 bp, Homo sapiens
gctggactctggcacc

SEQ ID NO: 2800949 - DNA, 12 bp, Homo sapiens
gctggagaagct

SEQ ID NO: 2800950 - DNA, 16 bp, Homo sapiens
gctggagaagctcacc

SEQ ID NO: 2800951 - DNA, 20 bp, Homo sapiens
gctggagcctcggtggccat

SEQ ID NO: 2800952 - DNA, 22 bp, Homo sapiens
gctggagcctcggtggccatgc

SEQ ID NO: 2800953 - DNA, 12 bp, Homo sapiens
gctggagtgcag

SEQ ID NO: 2800954 - DNA, 14 bp, Homo sapiens
gctggagtgcagtg

SEQ ID NO: 2800955 - DNA, 20 bp, Homo sapiens
gctggagtgcagtggtgcga

SEQ ID NO: 2800956 - DNA, 14 bp, Homo sapiens
gctggataaaatga

SEQ ID NO: 2800957 - DNA, 15 bp, Homo sapiens
gctggcaaaggtggc

SEQ ID NO: 2800958 - DNA, 20 bp, Homo sapiens
gctggcaaaggtggctctcc

SEQ ID NO: 2800959 - DNA, 18 bp, Homo sapiens
gctggcctcccaataaag

SEQ ID NO: 2800960 - DNA, 21 bp, Homo sapiens
gctggcctcccaataaagctg

SEQ ID NO: 2800961 - DNA, 17 bp, Homo sapiens
gctggcctggccggcaa

SEQ ID NO: 2800962 - DNA, 20 bp, Homo sapiens
gctggcggctactcagcagc

SEQ ID NO: 2800963 - DNA, 18 bp, Homo sapiens
gctggcgtgcagtggtgc

SEQ ID NO: 2800964 - DNA, 20 bp, Homo sapiens
gctggcgtgcagtggtgcga

SEQ ID NO: 2800965 - DNA, 23 bp, Homo sapiens
gctggctcctccaggcacgtccc

SEQ ID NO: 2800966 - DNA, 15 bp, Homo sapiens
gctggctgagggcag

SEQ ID NO: 2800967 - DNA, 13 bp, Homo sapiens
gctggctgcagtg

SEQ ID NO: 2800968 - DNA, 16 bp, Homo sapiens
gctggctgggcatgga

SEQ ID NO: 2800969 - DNA, 22 bp, Homo sapiens
gctgggaccccagctagggctg

SEQ ID NO: 2800970 - DNA, 14 bp, Homo sapiens
gctgggactacagg

SEQ ID NO: 2800971 - DNA, 20 bp, Homo sapiens
gctgggactacaggcaccca

SEQ ID NO: 2800972 - DNA, 17 bp, Homo sapiens
gctgggcaccacaggct

SEQ ID NO: 2800973 - DNA, 20 bp, Homo sapiens
gctgggctctccacctcagc

SEQ ID NO: 2800974 - DNA, 22 bp, Homo sapiens
gctgggctctccacctcagcct

SEQ ID NO: 2800975 - DNA, 17 bp, Homo sapiens
gctgggcttcagtggca

SEQ ID NO: 2800976 - DNA, 19 bp, Homo sapiens
gctgggcttcagtggcagc

SEQ ID NO: 2800977 - DNA, 18 bp, Homo sapiens
gctggggacaggtcctca

SEQ ID NO: 2800978 - DNA, 14 bp, Homo sapiens
gctggggagtccct

SEQ ID NO: 2800979 - DNA, 15 bp, Homo sapiens
gctgggggaagggtg

SEQ ID NO: 2800980 - DNA, 16 bp, Homo sapiens
gctgggggaagggtgg

SEQ ID NO: 2800981 - DNA, 13 bp, Homo sapiens
gctgggggcctca

SEQ ID NO: 2800982 - DNA, 20 bp, Homo sapiens
gctgggggcgggggagccaa

SEQ ID NO: 2800983 - DNA, 13 bp, Homo sapiens
gctggtctccctc

SEQ ID NO: 2800984 - DNA, 16 bp, Homo sapiens
gctggtctccctccag

SEQ ID NO: 2800985 - DNA, 17 bp, Homo sapiens
gctggtctccctccagc

SEQ ID NO: 2800986 - DNA, 20 bp, Homo sapiens
gctggtgcagagctgaagat

SEQ ID NO: 2800987 - DNA, 17 bp, Homo sapiens
gctggtgctgtggccag

SEQ ID NO: 2800988 - DNA, 12 bp, Homo sapiens
gctggtggacca

SEQ ID NO: 2800989 - DNA, 19 bp, Homo sapiens
gctggtggaccacaggcat

SEQ ID NO: 2800990 - DNA, 23 bp, Homo sapiens
gctggttttcctaaatgcagtga

SEQ ID NO: 2800991 - DNA, 14 bp, Homo sapiens
gctgtaaaatcttg

SEQ ID NO: 2800992 - DNA, 12 bp, Homo sapiens
gctgtacactgc

SEQ ID NO: 2800993 - DNA, 16 bp, Homo sapiens
gctgtacactgcacga

SEQ ID NO: 2800994 - DNA, 17 bp, Homo sapiens
gctgtatcccatgagcc

SEQ ID NO: 2800995 - DNA, 19 bp, Homo sapiens
gctgtatcccatgagcctc

SEQ ID NO: 2800996 - DNA, 19 bp, Homo sapiens
gctgtatttttagagatta

SEQ ID NO: 2800997 - DNA, 18 bp, Homo sapiens
gctgtcatcaattaaagg

SEQ ID NO: 2800998 - DNA, 14 bp, Homo sapiens
gctgtccctgtcac

SEQ ID NO: 2800999 - DNA, 18 bp, Homo sapiens
gctgtccctgtcaccaag

SEQ ID NO: 2801000 - DNA, 14 bp, Homo sapiens
gctgtcctaggcca

SEQ ID NO: 2801001 - DNA, 12 bp, Homo sapiens
gctgtctctgtc

SEQ ID NO: 2801002 - DNA, 13 bp, Homo sapiens
gctgtctctgtcc

SEQ ID NO: 2801003 - DNA, 17 bp, Homo sapiens
gctgtctctgtccctca

SEQ ID NO: 2801004 - DNA, 20 bp, Homo sapiens
gctgtctctgtccctcactg

SEQ ID NO: 2801005 - DNA, 14 bp, Homo sapiens
gctgtctgtggctt

SEQ ID NO: 2801006 - DNA, 15 bp, Homo sapiens
gctgtctgtggcttc

SEQ ID NO: 2801007 - DNA, 22 bp, Homo sapiens
gctgtgatttttgttgattaaa

SEQ ID NO: 2801008 - DNA, 18 bp, Homo sapiens
gctgtgcctcgctcccca

SEQ ID NO: 2801009 - DNA, 14 bp, Homo sapiens
gctgtgcctctgcc

SEQ ID NO: 2801010 - DNA, 15 bp, Homo sapiens
gctgtgcctctgcct

SEQ ID NO: 2801011 - DNA, 22 bp, Homo sapiens
gctgtgggggaggtccctgcca

SEQ ID NO: 2801012 - DNA, 19 bp, Homo sapiens
gctgtggtggctgtctctg

SEQ ID NO: 2801013 - DNA, 17 bp, Homo sapiens
gctgttccacttctcta

SEQ ID NO: 2801014 - DNA, 18 bp, Homo sapiens
gctgttccacttctctag

SEQ ID NO: 2801015 - DNA, 18 bp, Homo sapiens
gctgttctggagctgctg

SEQ ID NO: 2801016 - DNA, 18 bp, Homo sapiens
gctgttgagctgttttcc

SEQ ID NO: 2801017 - DNA, 21 bp, Homo sapiens
gctagcgctgccgcaccccag

SEQ ID NO: 2801018 - DNA, 22 bp, Homo sapiens
gctaggacccctccatgtgggc

SEQ ID NO: 2801019 - DNA, 15 bp, Homo sapiens
gctaggagcaaagcc

SEQ ID NO: 2801020 - DNA, 16 bp, Homo sapiens
gctaggagcaaagcct

SEQ ID NO: 2801021 - DNA, 18 bp, Homo sapiens
gctaggagcaaagcctgt

SEQ ID NO: 2801022 - DNA, 16 bp, Homo sapiens
gctaggcctggccaga

SEQ ID NO: 2801023 - DNA, 23 bp, Homo sapiens
gctaggcctggccagatgcacca

SEQ ID NO: 2801024 - DNA, 12 bp, Homo sapiens
gctagggctgga

SEQ ID NO: 2801025 - DNA, 16 bp, Homo sapiens
gctataggctggagaa

SEQ ID NO: 2801026 - DNA, 13 bp, Homo sapiens
gctatctctgtgt

SEQ ID NO: 2801027 - DNA, 22 bp, Homo sapiens
gctatgtatggaatacagtgtt

SEQ ID NO: 2801028 - DNA, 21 bp, Homo sapiens
gctattattttcactgtagaa

SEQ ID NO: 2801029 - DNA, 18 bp, Homo sapiens
gctattgatgtttccaga

SEQ ID NO: 2801030 - DNA, 19 bp, Homo sapiens
gctattgatgtttccagaa

SEQ ID NO: 2801031 - DNA, 15 bp, Homo sapiens
gctattgcatgtaaa

SEQ ID NO: 2801032 - DNA, 18 bp, Homo sapiens
gctattgcatgtaaaatg

SEQ ID NO: 2801033 - DNA, 21 bp, Homo sapiens
gctattgcatgtaaaatgcag

SEQ ID NO: 2801034 - DNA, 22 bp, Homo sapiens
gctatttttatttgtttgtgca

SEQ ID NO: 2801035 - DNA, 13 bp, Homo sapiens
gctcaaaaagttt

SEQ ID NO: 2801036 - DNA, 17 bp, Homo sapiens
gctcaaatctattcaga

SEQ ID NO: 2801037 - DNA, 16 bp, Homo sapiens
gctcaaccactgtggc

SEQ ID NO: 2801038 - DNA, 15 bp, Homo sapiens
gctcaacctctctcc

SEQ ID NO: 2801039 - DNA, 20 bp, Homo sapiens
gctcaacctctctccttctg

SEQ ID NO: 2801040 - DNA, 14 bp, Homo sapiens
gctcaagatgacag

SEQ ID NO: 2801041 - DNA, 17 bp, Homo sapiens
gctcaagtcttccctga

SEQ ID NO: 2801042 - DNA, 16 bp, Homo sapiens
gctcaatcctctaagc

SEQ ID NO: 2801043 - DNA, 14 bp, Homo sapiens
gctcacaaaccatg

SEQ ID NO: 2801044 - DNA, 20 bp, Homo sapiens
gctcacaaggcagcaaggcc

SEQ ID NO: 2801045 - DNA, 21 bp, Homo sapiens
gctcacaaggcagcaaggccc

SEQ ID NO: 2801046 - DNA, 19 bp, Homo sapiens
gctcacagttcctcgccct

SEQ ID NO: 2801047 - DNA, 14 bp, Homo sapiens
gctcaccagcccca

SEQ ID NO: 2801048 - DNA, 20 bp, Homo sapiens
gctcaccagccccagtgccc

SEQ ID NO: 2801049 - DNA, 21 bp, Homo sapiens
gctcacgcctatgatcccagc

SEQ ID NO: 2801050 - DNA, 20 bp, Homo sapiens
gctcacgcctgtaatcccag

SEQ ID NO: 2801051 - DNA, 15 bp, Homo sapiens
gctcagacccccact

SEQ ID NO: 2801052 - DNA, 13 bp, Homo sapiens
gctcagcctcccc

SEQ ID NO: 2801053 - DNA, 17 bp, Homo sapiens
gctcagcctggtgggcc

SEQ ID NO: 2801054 - DNA, 17 bp, Homo sapiens
gctcagcggggacagct

SEQ ID NO: 2801055 - DNA, 20 bp, Homo sapiens
gctcagcggggacagctcct

SEQ ID NO: 2801056 - DNA, 21 bp, Homo sapiens
gctcagctttttgtcttttct

SEQ ID NO: 2801057 - DNA, 13 bp, Homo sapiens
gctcaggaggctt

SEQ ID NO: 2801058 - DNA, 16 bp, Homo sapiens
gctcaggaggcttgga

SEQ ID NO: 2801059 - DNA, 20 bp, Homo sapiens
gctcaggcctataaccccag

SEQ ID NO: 2801060 - DNA, 16 bp, Homo sapiens
gctcaggtgtccctgc

SEQ ID NO: 2801061 - DNA, 18 bp, Homo sapiens
gctcaggtgtccctgcac

SEQ ID NO: 2801062 - DNA, 16 bp, Homo sapiens
gctcagtaatttgagg

SEQ ID NO: 2801063 - DNA, 23 bp, Homo sapiens
gctcagtcccatcagagagcgag

SEQ ID NO: 2801064 - DNA, 17 bp, Homo sapiens
gctcagtctcaggagca

SEQ ID NO: 2801065 - DNA, 20 bp, Homo sapiens
gctcagtctcaggagcatgg

SEQ ID NO: 2801066 - DNA, 13 bp, Homo sapiens
gctccaagagaat

SEQ ID NO: 2801067 - DNA, 21 bp, Homo sapiens
gctccacctgttcaggagctg

SEQ ID NO: 2801068 - DNA, 13 bp, Homo sapiens
gctccaggctcct

SEQ ID NO: 2801069 - DNA, 24 bp, Homo sapiens
gctccaggctcctttagcgcccag

SEQ ID NO: 2801070 - DNA, 19 bp, Homo sapiens
gctccagtttccccatggg

SEQ ID NO: 2801071 - DNA, 22 bp, Homo sapiens
gctccagtttccccatggggct

SEQ ID NO: 2801072 - DNA, 23 bp, Homo sapiens
gctcccagcagccctaaggatct

SEQ ID NO: 2801073 - DNA, 14 bp, Homo sapiens
gctccccactctgc

SEQ ID NO: 2801074 - DNA, 12 bp, Homo sapiens
gctccccaggac

SEQ ID NO: 2801075 - DNA, 14 bp, Homo sapiens
gctccccaggactc

SEQ ID NO: 2801076 - DNA, 21 bp, Homo sapiens
gctccccaggactcaccctca

SEQ ID NO: 2801077 - DNA, 20 bp, Homo sapiens
gctcccccaccccctcccca

SEQ ID NO: 2801078 - DNA, 23 bp, Homo sapiens
gctccccgggggcagacacctgt

SEQ ID NO: 2801079 - DNA, 12 bp, Homo sapiens
gctcctctccag

SEQ ID NO: 2801080 - DNA, 13 bp, Homo sapiens
gctcctctccagg

SEQ ID NO: 2801081 - DNA, 14 bp, Homo sapiens
gctcctctccaggc

SEQ ID NO: 2801082 - DNA, 22 bp, Homo sapiens
gctcctctccaggcacccttct

SEQ ID NO: 2801083 - DNA, 22 bp, Homo sapiens
gctcctgctgaaacacctccca

SEQ ID NO: 2801084 - DNA, 14 bp, Homo sapiens
gctcctgtctgcca

SEQ ID NO: 2801085 - DNA, 18 bp, Homo sapiens
gctcctgtctgccagcca

SEQ ID NO: 2801086 - DNA, 13 bp, Homo sapiens
gctcctgtgtctt

SEQ ID NO: 2801087 - DNA, 15 bp, Homo sapiens
gctccttgactcctt

SEQ ID NO: 2801088 - DNA, 16 bp, Homo sapiens
gctccttgggtcctgc

SEQ ID NO: 2801089 - DNA, 17 bp, Homo sapiens
gctcctttagcgcccag

SEQ ID NO: 2801090 - DNA, 17 bp, Homo sapiens
gctcctttctccagcca

SEQ ID NO: 2801091 - DNA, 18 bp, Homo sapiens
gctcggggtgcacaggag

SEQ ID NO: 2801092 - DNA, 12 bp, Homo sapiens
gctcggtggacc

SEQ ID NO: 2801093 - DNA, 18 bp, Homo sapiens
gctcggtggacccaggga

SEQ ID NO: 2801094 - DNA, 18 bp, Homo sapiens
gctctaacgcctgagccc

SEQ ID NO: 2801095 - DNA, 21 bp, Homo sapiens
gctctaacgcctgagcccagg

SEQ ID NO: 2801096 - DNA, 23 bp, Homo sapiens
gctctagattgagagaagagaca

SEQ ID NO: 2801097 - DNA, 17 bp, Homo sapiens
gctctattgtagcattt

SEQ ID NO: 2801098 - DNA, 11 bp, Homo sapiens
gctctcagaag

SEQ ID NO: 2801099 - DNA, 17 bp, Homo sapiens
gctctcagccaacgagt

SEQ ID NO: 2801100 - DNA, 14 bp, Homo sapiens
gctctcagcctccc

SEQ ID NO: 2801101 - DNA, 21 bp, Homo sapiens
gctctcagcctcccaacccca

SEQ ID NO: 2801102 - DNA, 13 bp, Homo sapiens
gctctccacctca

SEQ ID NO: 2801103 - DNA, 14 bp, Homo sapiens
gctctccacctcag

SEQ ID NO: 2801104 - DNA, 15 bp, Homo sapiens
gctctccacctcagc

SEQ ID NO: 2801105 - DNA, 18 bp, Homo sapiens
gctctccacctcagcctt

SEQ ID NO: 2801106 - DNA, 17 bp, Homo sapiens
gctctcccatttcctga

SEQ ID NO: 2801107 - DNA, 18 bp, Homo sapiens
gctaagtgaaaaggtcat

SEQ ID NO: 2801108 - DNA, 23 bp, Homo sapiens
gctaagtgatcctcccacctcag

SEQ ID NO: 2801109 - DNA, 17 bp, Homo sapiens
gctaatctgtagggctg

SEQ ID NO: 2801110 - DNA, 18 bp, Homo sapiens
gctaatctgtagggctgg

SEQ ID NO: 2801111 - DNA, 20 bp, Homo sapiens
gctaatctgtagggctggac

SEQ ID NO: 2801112 - DNA, 16 bp, Homo sapiens
gctaatttttcatttt

SEQ ID NO: 2801113 - DNA, 21 bp, Homo sapiens
gctaatttttttgtattttag

SEQ ID NO: 2801114 - DNA, 20 bp, Homo sapiens
gctacaaatactcttaggaa

SEQ ID NO: 2801115 - DNA, 16 bp, Homo sapiens
gctacaccactctggc

SEQ ID NO: 2801116 - DNA, 17 bp, Homo sapiens
gctacaccactctggca

SEQ ID NO: 2801117 - DNA, 20 bp, Homo sapiens
gctaccaaagcaccttagct

SEQ ID NO: 2801118 - DNA, 17 bp, Homo sapiens
gctacctgtgtggacag

SEQ ID NO: 2801119 - DNA, 22 bp, Homo sapiens
gctacctgtgtggacaggacta

SEQ ID NO: 2801120 - DNA, 17 bp, Homo sapiens
gctactcaagaggctga

SEQ ID NO: 2801121 - DNA, 21 bp, Homo sapiens
gctactcaagaggctgaggca

SEQ ID NO: 2801122 - DNA, 17 bp, Homo sapiens
gctactcagaagcctga

SEQ ID NO: 2801123 - DNA, 21 bp, Homo sapiens
gctactcagaagcctgaggct

SEQ ID NO: 2801124 - DNA, 16 bp, Homo sapiens
gctactcagcagccct

SEQ ID NO: 2801125 - DNA, 17 bp, Homo sapiens
gctactcagcagccctc

SEQ ID NO: 2801126 - DNA, 19 bp, Homo sapiens
gctactcagcagccctcct

SEQ ID NO: 2801127 - DNA, 13 bp, Homo sapiens
gctactctgtgcc

SEQ ID NO: 2801128 - DNA, 15 bp, Homo sapiens
gctactctgtgccag

SEQ ID NO: 2801129 - DNA, 18 bp, Homo sapiens
gctactctgtgccagagc

SEQ ID NO: 2801130 - DNA, 21 bp, Homo sapiens
gctactctgtgccagagcctg

SEQ ID NO: 2801131 - DNA, 22 bp, Homo sapiens
gctactctgtgccagagcctgg

SEQ ID NO: 2801132 - DNA, 14 bp, Homo sapiens
gctactcttcagaa

SEQ ID NO: 2801133 - DNA, 19 bp, Homo sapiens
gctactgtcctacccaccc

SEQ ID NO: 2801134 - DNA, 16 bp, Homo sapiens
gctactttgctgctat

SEQ ID NO: 2801135 - DNA, 15 bp, Homo sapiens
gctagaaggccacat

SEQ ID NO: 2801136 - DNA, 17 bp, Homo sapiens
gctagaaggccacatgt

SEQ ID NO: 2801137 - DNA, 20 bp, Homo sapiens
gctagagatatggcagcgaa

SEQ ID NO: 2801138 - DNA, 15 bp, Homo sapiens
gctagcgctgccgca

SEQ ID NO: 2801139 - DNA, 18 bp, Homo sapiens
gctctccctctggccctg

SEQ ID NO: 2801140 - DNA, 19 bp, Homo sapiens
gctctccctctggccctgc

SEQ ID NO: 2801141 - DNA, 23 bp, Homo sapiens
gctctccctctggccctgccttc

SEQ ID NO: 2801142 - DNA, 23 bp, Homo sapiens
gctctcctgagaggtgctgcagg

SEQ ID NO: 2801143 - DNA, 15 bp, Homo sapiens
gctctcctggcttcc

SEQ ID NO: 2801144 - DNA, 12 bp, Homo sapiens
gctctcctgggg

SEQ ID NO: 2801145 - DNA, 15 bp, Homo sapiens
gctctctgcagccag

SEQ ID NO: 2801146 - DNA, 19 bp, Homo sapiens
gctctctgcagccagccca

SEQ ID NO: 2801147 - DNA, 11 bp, Homo sapiens
gctctctgtct

SEQ ID NO: 2801148 - DNA, 13 bp, Homo sapiens
gctctctgtctgg

SEQ ID NO: 2801149 - DNA, 15 bp, Homo sapiens
gctctgaaagccagc

SEQ ID NO: 2801150 - DNA, 18 bp, Homo sapiens
gctctgaggcttccagag

SEQ ID NO: 2801151 - DNA, 21 bp, Homo sapiens
gctctgaggcttccagagagt

SEQ ID NO: 2801152 - DNA, 17 bp, Homo sapiens
gctctgatcatccactg

SEQ ID NO: 2801153 - DNA, 20 bp, Homo sapiens
gctctgatcatccactgtgc

SEQ ID NO: 2801154 - DNA, 21 bp, Homo sapiens
gctctgatcatccactgtgcc

SEQ ID NO: 2801155 - DNA, 23 bp, Homo sapiens
gctctgatcatccactgtgccat

SEQ ID NO: 2801156 - DNA, 11 bp, Homo sapiens
gctctgatgca

SEQ ID NO: 2801157 - DNA, 20 bp, Homo sapiens
gctctgatgcatcagaaagg

SEQ ID NO: 2801158 - DNA, 17 bp, Homo sapiens
gctctgccctccctggc

SEQ ID NO: 2801159 - DNA, 13 bp, Homo sapiens
gctctgctcctct

SEQ ID NO: 2801160 - DNA, 14 bp, Homo sapiens
gctctgctcctctc

SEQ ID NO: 2801161 - DNA, 21 bp, Homo sapiens
gctctgctcctctccccagca

SEQ ID NO: 2801162 - DNA, 18 bp, Homo sapiens
gctctgctggcctggccg

SEQ ID NO: 2801163 - DNA, 19 bp, Homo sapiens
gctctgctggcctggccgg

SEQ ID NO: 2801164 - DNA, 21 bp, Homo sapiens
gctctgctggcctggccggca

SEQ ID NO: 2801165 - DNA, 15 bp, Homo sapiens
gctctggaagagagg

SEQ ID NO: 2801166 - DNA, 14 bp, Homo sapiens
gctctggacaggca

SEQ ID NO: 2801167 - DNA, 18 bp, Homo sapiens
gctctggccccaggcttg

SEQ ID NO: 2801168 - DNA, 14 bp, Homo sapiens
gctctgtcctggga

SEQ ID NO: 2801169 - DNA, 22 bp, Homo sapiens
gctcttctatttaaaaaataaa

SEQ ID NO: 2801170 - DNA, 14 bp, Homo sapiens
gctcttctccaggc

SEQ ID NO: 2801171 - DNA, 17 bp, Homo sapiens
gctcttctccttggagg

SEQ ID NO: 2801172 - DNA, 20 bp, Homo sapiens
gctcttctgttctcaaatgc

SEQ ID NO: 2801173 - DNA, 10 bp, Homo sapiens
gctcttgcct

SEQ ID NO: 2801174 - DNA, 18 bp, Homo sapiens
gctctttggggtcagcca

SEQ ID NO: 2801175 - DNA, 20 bp, Homo sapiens
gctctttggggtcagccagg

SEQ ID NO: 2801176 - DNA, 22 bp, Homo sapiens
gctctttggggtcagccagggc

SEQ ID NO: 2801177 - DNA, 18 bp, Homo sapiens
gctgaaacacctcccagg

SEQ ID NO: 2801178 - DNA, 16 bp, Homo sapiens
gctgaacggggagaaa

SEQ ID NO: 2801179 - DNA, 14 bp, Homo sapiens
gctgacagacacag

SEQ ID NO: 2801180 - DNA, 17 bp, Homo sapiens
gctgacagacacaggcc

SEQ ID NO: 2801181 - DNA, 18 bp, Homo sapiens
gctgacagacacaggccc

SEQ ID NO: 2801182 - DNA, 21 bp, Homo sapiens
gctgacagacacaggcccggc

SEQ ID NO: 2801183 - DNA, 15 bp, Homo sapiens
gctgaccaagagaga

SEQ ID NO: 2801184 - DNA, 16 bp, Homo sapiens
gctgaccaagagagaa

SEQ ID NO: 2801185 - DNA, 16 bp, Homo sapiens
gctgacccagtccctg

SEQ ID NO: 2801186 - DNA, 18 bp, Homo sapiens
gctgaccccaaagagcct

SEQ ID NO: 2801187 - DNA, 19 bp, Homo sapiens
gctgaccccaaagagcctg

SEQ ID NO: 2801188 - DNA, 20 bp, Homo sapiens
gctgactgatgttgagggaa

SEQ ID NO: 2801189 - DNA, 23 bp, Homo sapiens
gctgacttgcagagttcatggaa

SEQ ID NO: 2801190 - DNA, 15 bp, Homo sapiens
gctgagagacccaag

SEQ ID NO: 2801191 - DNA, 20 bp, Homo sapiens
gctgagagacccaaggagga

SEQ ID NO: 2801192 - DNA, 13 bp, Homo sapiens
gctgagcagggcc

SEQ ID NO: 2801193 - DNA, 23 bp, Homo sapiens
gctgagctcacaaggcagcaagg

SEQ ID NO: 2801194 - DNA, 13 bp, Homo sapiens
gctgagctctgag

SEQ ID NO: 2801195 - DNA, 15 bp, Homo sapiens
gctgagctctgagag

SEQ ID NO: 2801196 - DNA, 20 bp, Homo sapiens
gctgagctctgagaggccct

SEQ ID NO: 2801197 - DNA, 15 bp, Homo sapiens
gctgaggcaattcta

SEQ ID NO: 2801198 - DNA, 16 bp, Homo sapiens
gctgaggcagaagaat

SEQ ID NO: 2801199 - DNA, 12 bp, Homo sapiens
gctgaggcagga

SEQ ID NO: 2801200 - DNA, 22 bp, Homo sapiens
gctgaggggaggatcactggag

SEQ ID NO: 2801201 - DNA, 21 bp, Homo sapiens
gctgaggggggccgtgcccag

SEQ ID NO: 2801202 - DNA, 16 bp, Homo sapiens
gctgaggtgcccagga

SEQ ID NO: 2801203 - DNA, 18 bp, Homo sapiens
gctgaggtgcccaggaga

SEQ ID NO: 2801204 - DNA, 21 bp, Homo sapiens
gctgagtatgttaagctcttt

SEQ ID NO: 2801205 - DNA, 21 bp, Homo sapiens
gctgagtcatgatctccctgc

SEQ ID NO: 2801206 - DNA, 16 bp, Homo sapiens
gctgagtgagccacag

SEQ ID NO: 2801207 - DNA, 13 bp, Homo sapiens
gctgagttggtgt

SEQ ID NO: 2801208 - DNA, 19 bp, Homo sapiens
gctgcaaagtgcaaatact

SEQ ID NO: 2801209 - DNA, 13 bp, Homo sapiens
gctgcagcttcct

SEQ ID NO: 2801210 - DNA, 14 bp, Homo sapiens
gctgcagcttcctg

SEQ ID NO: 2801211 - DNA, 15 bp, Homo sapiens
gctgcaggaatcaaa

SEQ ID NO: 2801212 - DNA, 21 bp, Homo sapiens
gctgcaggaatcaaaaattga

SEQ ID NO: 2801213 - DNA, 18 bp, Homo sapiens
gctgcagtcaacagttca

SEQ ID NO: 2801214 - DNA, 20 bp, Homo sapiens
gctgcagtcaacagttcaaa

SEQ ID NO: 2801215 - DNA, 20 bp, Homo sapiens
gctgcagtgacgtgcacctg

SEQ ID NO: 2801216 - DNA, 12 bp, Homo sapiens
gctgccatccag

SEQ ID NO: 2801217 - DNA, 13 bp, Homo sapiens
gctgccatccagg

SEQ ID NO: 2801218 - DNA, 17 bp, Homo sapiens
gctgccatccaggttca

SEQ ID NO: 2801219 - DNA, 22 bp, Homo sapiens
gctgccatggcgtgtccctctc

SEQ ID NO: 2801220 - DNA, 13 bp, Homo sapiens
gctgccccgcttc

SEQ ID NO: 2801221 - DNA, 22 bp, Homo sapiens
gctgccccgcttccccacagaa

SEQ ID NO: 2801222 - DNA, 23 bp, Homo sapiens
gctgccccgcttccccacagaac

SEQ ID NO: 2801223 - DNA, 15 bp, Homo sapiens
gctgcccctgcagtt

SEQ ID NO: 2801224 - DNA, 20 bp, Homo sapiens
gctgcccctggtgcactggc

SEQ ID NO: 2801225 - DNA, 13 bp, Homo sapiens
gctgcccctgtag

SEQ ID NO: 2801226 - DNA, 18 bp, Homo sapiens
gctgcctaagtggctgct

SEQ ID NO: 2801227 - DNA, 20 bp, Homo sapiens
gctgcctcatgaccctcctg

SEQ ID NO: 2801228 - DNA, 19 bp, Homo sapiens
gctgcctgtagttaggaaa

SEQ ID NO: 2801229 - DNA, 21 bp, Homo sapiens
ctctcggttccacgtccccct

SEQ ID NO: 2801230 - DNA, 13 bp, Homo sapiens
ctctctaaaaata

SEQ ID NO: 2801231 - DNA, 16 bp, Homo sapiens
ctctctaaaaataaaa

SEQ ID NO: 2801232 - DNA, 17 bp, Homo sapiens
ctctctaaaaataaaat

SEQ ID NO: 2801233 - DNA, 21 bp, Homo sapiens
ctctctaaatcttccttgtga

SEQ ID NO: 2801234 - DNA, 20 bp, Homo sapiens
ctctctactcctacctcagc

SEQ ID NO: 2801235 - DNA, 22 bp, Homo sapiens
ctctctactcctacctcagcct

SEQ ID NO: 2801236 - DNA, 16 bp, Homo sapiens
ctctctatatatacat

SEQ ID NO: 2801237 - DNA, 22 bp, Homo sapiens
ctctctatatatacatgtatag

SEQ ID NO: 2801238 - DNA, 14 bp, Homo sapiens
ctctctccacccta

SEQ ID NO: 2801239 - DNA, 15 bp, Homo sapiens
ctctctccttctggc

SEQ ID NO: 2801240 - DNA, 14 bp, Homo sapiens
ctctctctatatat

SEQ ID NO: 2801241 - DNA, 15 bp, Homo sapiens
ctctctcttcccagc

SEQ ID NO: 2801242 - DNA, 17 bp, Homo sapiens
ctctctgcagccagccc

SEQ ID NO: 2801243 - DNA, 20 bp, Homo sapiens
ctctctgcagccagcccagc

SEQ ID NO: 2801244 - DNA, 18 bp, Homo sapiens
ctctgaataccaagtgtg

SEQ ID NO: 2801245 - DNA, 17 bp, Homo sapiens
ctctgaatggtccaggg

SEQ ID NO: 2801246 - DNA, 16 bp, Homo sapiens
ctctgacacacagctc

SEQ ID NO: 2801247 - DNA, 19 bp, Homo sapiens
ctctgacacacagctctgt

SEQ ID NO: 2801248 - DNA, 14 bp, Homo sapiens
ctctgacctgcagg

SEQ ID NO: 2801249 - DNA, 17 bp, Homo sapiens
ctctgagaggccctgga

SEQ ID NO: 2801250 - DNA, 18 bp, Homo sapiens
ctctgagaggccctggat

SEQ ID NO: 2801251 - DNA, 16 bp, Homo sapiens
ctctgaggacactaac

SEQ ID NO: 2801252 - DNA, 16 bp, Homo sapiens
ctctgaggccagcctg

SEQ ID NO: 2801253 - DNA, 17 bp, Homo sapiens
ctctgaggccagcctgg

SEQ ID NO: 2801254 - DNA, 19 bp, Homo sapiens
ctctgaggccagcctggcc

SEQ ID NO: 2801255 - DNA, 12 bp, Homo sapiens
ctctgaggcgcc

SEQ ID NO: 2801256 - DNA, 21 bp, Homo sapiens
ctctgaggcgccccaacccgt

SEQ ID NO: 2801257 - DNA, 23 bp, Homo sapiens
ctctgaggcgccccaacccgtgg

SEQ ID NO: 2801258 - DNA, 16 bp, Homo sapiens
ctctgaggcttccaga

SEQ ID NO: 2801259 - DNA, 18 bp, Homo sapiens
ctctgattttcaaagctt

SEQ ID NO: 2801260 - DNA, 20 bp, Homo sapiens
ctctgattttcaaagctttt

SEQ ID NO: 2801261 - DNA, 22 bp, Homo sapiens
ctctgattttcaaagctttttc

SEQ ID NO: 2801262 - DNA, 15 bp, Homo sapiens
ctctgcagccagccc

SEQ ID NO: 2801263 - DNA, 14 bp, Homo sapiens
ctctgcattctagt

SEQ ID NO: 2801264 - DNA, 20 bp, Homo sapiens
ctctgcccccagcctctgtc

SEQ ID NO: 2801265 - DNA, 16 bp, Homo sapiens
ctctgccctccctggc

SEQ ID NO: 2801266 - DNA, 15 bp, Homo sapiens
ctctgcctcctcttc

SEQ ID NO: 2801267 - DNA, 19 bp, Homo sapiens
ctctgcctctgacacacag

SEQ ID NO: 2801268 - DNA, 22 bp, Homo sapiens
ctctgcctgaagtcacacagtg

SEQ ID NO: 2801269 - DNA, 15 bp, Homo sapiens
ctctgctctgaggct

SEQ ID NO: 2801270 - DNA, 15 bp, Homo sapiens
ctctgctcttgcctg

SEQ ID NO: 2801271 - DNA, 14 bp, Homo sapiens
ctctgctgaaggtt

SEQ ID NO: 2801272 - DNA, 13 bp, Homo sapiens
ctctgctgacaga

SEQ ID NO: 2801273 - DNA, 19 bp, Homo sapiens
ctctgctgacagacacagg

SEQ ID NO: 2801274 - DNA, 20 bp, Homo sapiens
ctctgctgacagacacaggc

SEQ ID NO: 2801275 - DNA, 23 bp, Homo sapiens
ctctgctgacagacacaggcccg

SEQ ID NO: 2801276 - DNA, 14 bp, Homo sapiens
ctctgctggcctgg

SEQ ID NO: 2801277 - DNA, 17 bp, Homo sapiens
ctctgctggcctggccg

SEQ ID NO: 2801278 - DNA, 20 bp, Homo sapiens
ctctggaaaatgtgacccag

SEQ ID NO: 2801279 - DNA, 16 bp, Homo sapiens
ctctggaccaaccctg

SEQ ID NO: 2801280 - DNA, 22 bp, Homo sapiens
ctctggaccaaccctgtttcct

SEQ ID NO: 2801281 - DNA, 13 bp, Homo sapiens
ctctggaccagcc

SEQ ID NO: 2801282 - DNA, 15 bp, Homo sapiens
ctctggatggcacca

SEQ ID NO: 2801283 - DNA, 14 bp, Homo sapiens
ctctggcagccaca

SEQ ID NO: 2801284 - DNA, 19 bp, Homo sapiens
ctctgggaaataagagaga

SEQ ID NO: 2801285 - DNA, 20 bp, Homo sapiens
ctctggtcaggcccactgca

SEQ ID NO: 2801286 - DNA, 12 bp, Homo sapiens
ctctgtccaggc

SEQ ID NO: 2801287 - DNA, 21 bp, Homo sapiens
ctctgtccagggccctgagct

SEQ ID NO: 2801288 - DNA, 15 bp, Homo sapiens
ctctgtcctgggagt

SEQ ID NO: 2801289 - DNA, 19 bp, Homo sapiens
ctctgtcgcccagtctgga

SEQ ID NO: 2801290 - DNA, 18 bp, Homo sapiens
ctctgtctcgagcgccct

SEQ ID NO: 2801291 - DNA, 20 bp, Homo sapiens
ctctgtctcgagcgccctgc

SEQ ID NO: 2801292 - DNA, 21 bp, Homo sapiens
ctctgtctctgctcttgcctg

SEQ ID NO: 2801293 - DNA, 21 bp, Homo sapiens
ctctgtctggctgtacgtctg

SEQ ID NO: 2801294 - DNA, 21 bp, Homo sapiens
ctctgtgaacgatttagaaag

SEQ ID NO: 2801295 - DNA, 16 bp, Homo sapiens
ctctgtgccagagcct

SEQ ID NO: 2801296 - DNA, 16 bp, Homo sapiens
ctctgtgcccctgtaa

SEQ ID NO: 2801297 - DNA, 21 bp, Homo sapiens
ctctgtgctttgactcacctg

SEQ ID NO: 2801298 - DNA, 23 bp, Homo sapiens
ctctgtgctttgactcacctgtt

SEQ ID NO: 2801299 - DNA, 17 bp, Homo sapiens
ctctgtgtacccactcc

SEQ ID NO: 2801300 - DNA, 15 bp, Homo sapiens
ctctgtgtcaggtgg

SEQ ID NO: 2801301 - DNA, 15 bp, Homo sapiens
ctctgtgtgcacaaa

SEQ ID NO: 2801302 - DNA, 17 bp, Homo sapiens
ctctgtgtgcacaaata

SEQ ID NO: 2801303 - DNA, 13 bp, Homo sapiens
ctctgttcatttc

SEQ ID NO: 2801304 - DNA, 22 bp, Homo sapiens
ctctgtttataaaaacaaaaac

SEQ ID NO: 2801305 - DNA, 16 bp, Homo sapiens
ctcttacgctctctgt

SEQ ID NO: 2801306 - DNA, 13 bp, Homo sapiens
ctcttagctgtct

SEQ ID NO: 2801307 - DNA, 16 bp, Homo sapiens
ctcttatagaatattt

SEQ ID NO: 2801308 - DNA, 17 bp, Homo sapiens
ctcttatagaatattta

SEQ ID NO: 2801309 - DNA, 22 bp, Homo sapiens
ctcttatagaatatttattacc

SEQ ID NO: 2801310 - DNA, 16 bp, Homo sapiens
ctcttattcagtaaaa

SEQ ID NO: 2801311 - DNA, 19 bp, Homo sapiens
ctcttattgcccacgctgg

SEQ ID NO: 2801312 - DNA, 15 bp, Homo sapiens
ctcttcaggttctta

SEQ ID NO: 2801313 - DNA, 14 bp, Homo sapiens
ctcttccaaagctc

SEQ ID NO: 2801314 - DNA, 19 bp, Homo sapiens
ctcttcctacccaaccact

SEQ ID NO: 2801315 - DNA, 14 bp, Homo sapiens
ctcttcctgcaagg

SEQ ID NO: 2801316 - DNA, 22 bp, Homo sapiens
ctcttccttcccccatcccctt

SEQ ID NO: 2801317 - DNA, 17 bp, Homo sapiens
ctcttctatttaaaaaa

SEQ ID NO: 2801318 - DNA, 18 bp, Homo sapiens
ctcttctatttaaaaaat

SEQ ID NO: 2801319 - DNA, 12 bp, Homo sapiens
ctgactcttgcc

SEQ ID NO: 2801320 - DNA, 14 bp, Homo sapiens
ctgactcttgcctt

SEQ ID NO: 2801321 - DNA, 18 bp, Homo sapiens
ctgactgtgttcagtgcc

SEQ ID NO: 2801322 - DNA, 19 bp, Homo sapiens
ctgactgtgttcagtgcct

SEQ ID NO: 2801323 - DNA, 21 bp, Homo sapiens
ctgactttaattgtgtgtctt

SEQ ID NO: 2801324 - DNA, 18 bp, Homo sapiens
ctgactttgctctttctt

SEQ ID NO: 2801325 - DNA, 21 bp, Homo sapiens
ctgagaaaagctttgaaccct

SEQ ID NO: 2801326 - DNA, 13 bp, Homo sapiens
ctgagaacctggc

SEQ ID NO: 2801327 - DNA, 20 bp, Homo sapiens
ctgagaacctggccttcagt

SEQ ID NO: 2801328 - DNA, 17 bp, Homo sapiens
ctgagaaggtccttaat

SEQ ID NO: 2801329 - DNA, 13 bp, Homo sapiens
ctgagacaggaga

SEQ ID NO: 2801330 - DNA, 14 bp, Homo sapiens
ctgagaccagttgg

SEQ ID NO: 2801331 - DNA, 20 bp, Homo sapiens
ctgagacctgacaagcactg

SEQ ID NO: 2801332 - DNA, 16 bp, Homo sapiens
ctgagactgctaagta

SEQ ID NO: 2801333 - DNA, 20 bp, Homo sapiens
ctgagagacccaaggaggaa

SEQ ID NO: 2801334 - DNA, 14 bp, Homo sapiens
ctgagaggccctgg

SEQ ID NO: 2801335 - DNA, 15 bp, Homo sapiens
ctgagcaaatgtggc

SEQ ID NO: 2801336 - DNA, 20 bp, Homo sapiens
ctgagcaaatgtggctcctg

SEQ ID NO: 2801337 - DNA, 16 bp, Homo sapiens
ctgagcaacagagtga

SEQ ID NO: 2801338 - DNA, 17 bp, Homo sapiens
ctgagcaagagctggca

SEQ ID NO: 2801339 - DNA, 21 bp, Homo sapiens
ctgagcaagatcttgtctcca

SEQ ID NO: 2801340 - DNA, 18 bp, Homo sapiens
ctgagcaccccctcattc

SEQ ID NO: 2801341 - DNA, 13 bp, Homo sapiens
ctgagcacctgct

SEQ ID NO: 2801342 - DNA, 16 bp, Homo sapiens
ctgagcacctgcttca

SEQ ID NO: 2801343 - DNA, 13 bp, Homo sapiens
ctgagcactgcca

SEQ ID NO: 2801344 - DNA, 13 bp, Homo sapiens
ctgagcagggccg

SEQ ID NO: 2801345 - DNA, 17 bp, Homo sapiens
ctgagcagggccgggga

SEQ ID NO: 2801346 - DNA, 21 bp, Homo sapiens
ctgagcagggccggggaactg

SEQ ID NO: 2801347 - DNA, 15 bp, Homo sapiens
ctgagcccagggagg

SEQ ID NO: 2801348 - DNA, 16 bp, Homo sapiens
ctgagcccagggaggc

SEQ ID NO: 2801349 - DNA, 22 bp, Homo sapiens
ctgagcccagggaggccgaagc

SEQ ID NO: 2801350 - DNA, 13 bp, Homo sapiens
ctgagccctggca

SEQ ID NO: 2801351 - DNA, 14 bp, Homo sapiens
ctgagcctgccgag

SEQ ID NO: 2801352 - DNA, 15 bp, Homo sapiens
ctgagcctgccgagc

SEQ ID NO: 2801353 - DNA, 16 bp, Homo sapiens
ctgagcctgccgagca

SEQ ID NO: 2801354 - DNA, 14 bp, Homo sapiens
ctgagctcacaagg

SEQ ID NO: 2801355 - DNA, 20 bp, Homo sapiens
ctgagctcacaaggcagcaa

SEQ ID NO: 2801356 - DNA, 22 bp, Homo sapiens
ctgagctcacaaggcagcaagg

SEQ ID NO: 2801357 - DNA, 18 bp, Homo sapiens
ctgagctcggtggaccca

SEQ ID NO: 2801358 - DNA, 20 bp, Homo sapiens
ctgagctcggtggacccagg

SEQ ID NO: 2801359 - DNA, 19 bp, Homo sapiens
ctgagctctgagaggccct

SEQ ID NO: 2801360 - DNA, 22 bp, Homo sapiens
ctgagctctgagaggccctgga

SEQ ID NO: 2801361 - DNA, 18 bp, Homo sapiens
ctgagctggccctttcca

SEQ ID NO: 2801362 - DNA, 14 bp, Homo sapiens
ctgagctgggcacc

SEQ ID NO: 2801363 - DNA, 20 bp, Homo sapiens
ctgaggaagcacagcagcat

SEQ ID NO: 2801364 - DNA, 20 bp, Homo sapiens
ctgaggaatccagacccggc

SEQ ID NO: 2801365 - DNA, 23 bp, Homo sapiens
ctgaggacactaaccacgctgga

SEQ ID NO: 2801366 - DNA, 21 bp, Homo sapiens
ctgaggagctgttggcctggg

SEQ ID NO: 2801367 - DNA, 12 bp, Homo sapiens
ctgaggcaagag

SEQ ID NO: 2801368 - DNA, 16 bp, Homo sapiens
ctgaggccagcctggc

SEQ ID NO: 2801369 - DNA, 19 bp, Homo sapiens
ctgaggccagcctggcctc

SEQ ID NO: 2801370 - DNA, 18 bp, Homo sapiens
ctgaggccattatttcaa

SEQ ID NO: 2801371 - DNA, 18 bp, Homo sapiens
ctgaggctctttctgggc

SEQ ID NO: 2801372 - DNA, 14 bp, Homo sapiens
ctgaggcttccaga

SEQ ID NO: 2801373 - DNA, 21 bp, Homo sapiens
ctgagggcagttcgcagccac

SEQ ID NO: 2801374 - DNA, 22 bp, Homo sapiens
ctgaggggaggatcactggagc

SEQ ID NO: 2801375 - DNA, 16 bp, Homo sapiens
ctgaggggggccgtgc

SEQ ID NO: 2801376 - DNA, 15 bp, Homo sapiens
ctgagggtggagact

SEQ ID NO: 2801377 - DNA, 19 bp, Homo sapiens
ctgagggtggagactaagc

SEQ ID NO: 2801378 - DNA, 14 bp, Homo sapiens
ctgaggtcacctgg

SEQ ID NO: 2801379 - DNA, 18 bp, Homo sapiens
ctgaggtcctgagcactg

SEQ ID NO: 2801380 - DNA, 24 bp, Homo sapiens
ctgaggtcctgagcactgccagga

SEQ ID NO: 2801381 - DNA, 21 bp, Homo sapiens
ctgaggtcctgcatttctcag

SEQ ID NO: 2801382 - DNA, 14 bp, Homo sapiens
ctgaggtgcccagg

SEQ ID NO: 2801383 - DNA, 16 bp, Homo sapiens
ctgaggtgcccaggag

SEQ ID NO: 2801384 - DNA, 15 bp, Homo sapiens
ctgagtcaagttgtt

SEQ ID NO: 2801385 - DNA, 14 bp, Homo sapiens
ctgagtcaccagga

SEQ ID NO: 2801386 - DNA, 22 bp, Homo sapiens
ctgagtcacccatgaagacagg

SEQ ID NO: 2801387 - DNA, 18 bp, Homo sapiens
ctgagtcatgatctccct

SEQ ID NO: 2801388 - DNA, 13 bp, Homo sapiens
ctgagtctcctgt

SEQ ID NO: 2801389 - DNA, 21 bp, Homo sapiens
ctgagtgactctatatagctg

SEQ ID NO: 2801390 - DNA, 16 bp, Homo sapiens
ctgagtgagccacaga

SEQ ID NO: 2801391 - DNA, 23 bp, Homo sapiens
ctgagtggctgaaataaaagcct

SEQ ID NO: 2801392 - DNA, 14 bp, Homo sapiens
ctgagttcctgcat

SEQ ID NO: 2801393 - DNA, 12 bp, Homo sapiens
ctgataaacatt

SEQ ID NO: 2801394 - DNA, 17 bp, Homo sapiens
ctgataaacattaaaca

SEQ ID NO: 2801395 - DNA, 14 bp, Homo sapiens
ctgataaagaaaga

SEQ ID NO: 2801396 - DNA, 18 bp, Homo sapiens
ctgataattttaaattct

SEQ ID NO: 2801397 - DNA, 14 bp, Homo sapiens
ctgatacccagagc

SEQ ID NO: 2801398 - DNA, 22 bp, Homo sapiens
ctgatactgggtacaagagcca

SEQ ID NO: 2801399 - DNA, 18 bp, Homo sapiens
ctgatcagaattttacca

SEQ ID NO: 2801400 - DNA, 14 bp, Homo sapiens
ctatggctgcctgc

SEQ ID NO: 2801401 - DNA, 19 bp, Homo sapiens
ctatgggggcactgaggac

SEQ ID NO: 2801402 - DNA, 20 bp, Homo sapiens
ctatggttcccaataaaagt

SEQ ID NO: 2801403 - DNA, 22 bp, Homo sapiens
ctatggttcccaataaaagtga

SEQ ID NO: 2801404 - DNA, 20 bp, Homo sapiens
ctatgtcaatttgtatatca

SEQ ID NO: 2801405 - DNA, 18 bp, Homo sapiens
ctatgtcctaaggacaca

SEQ ID NO: 2801406 - DNA, 22 bp, Homo sapiens
ctatgtcctaaggacacactaa

SEQ ID NO: 2801407 - DNA, 23 bp, Homo sapiens
ctatgtcctaaggacacactaat

SEQ ID NO: 2801408 - DNA, 17 bp, Homo sapiens
ctatgtgtcatgatttc

SEQ ID NO: 2801409 - DNA, 14 bp, Homo sapiens
ctatgttgcccagg

SEQ ID NO: 2801410 - DNA, 15 bp, Homo sapiens
ctatgttgcccaggc

SEQ ID NO: 2801411 - DNA, 21 bp, Homo sapiens
ctatgttgcccaggcaggtct

SEQ ID NO: 2801412 - DNA, 22 bp, Homo sapiens
ctatgttgcccaggcaggtctt

SEQ ID NO: 2801413 - DNA, 15 bp, Homo sapiens
ctatgtttttaatgt

SEQ ID NO: 2801414 - DNA, 21 bp, Homo sapiens
ctattagatgttttacaaatt

SEQ ID NO: 2801415 - DNA, 15 bp, Homo sapiens
ctattataaaaccat

SEQ ID NO: 2801416 - DNA, 14 bp, Homo sapiens
ctattatagccaca

SEQ ID NO: 2801417 - DNA, 18 bp, Homo sapiens
ctattatagccacatccc

SEQ ID NO: 2801418 - DNA, 14 bp, Homo sapiens
ctcgaagcccttcc

SEQ ID NO: 2801419 - DNA, 19 bp, Homo sapiens
ctcgaagcccttccagtgg

SEQ ID NO: 2801420 - DNA, 20 bp, Homo sapiens
ctcgaccacttttcagttca

SEQ ID NO: 2801421 - DNA, 17 bp, Homo sapiens
ctcgagcgccctgcaga

SEQ ID NO: 2801422 - DNA, 20 bp, Homo sapiens
ctcgagcgccctgcagaccc

SEQ ID NO: 2801423 - DNA, 12 bp, Homo sapiens
ctcgcaacccgt

SEQ ID NO: 2801424 - DNA, 18 bp, Homo sapiens
ctcgcattttctctagct

SEQ ID NO: 2801425 - DNA, 16 bp, Homo sapiens
ctcgccgtctgtgaat

SEQ ID NO: 2801426 - DNA, 17 bp, Homo sapiens
ctcgctccccactctgc

SEQ ID NO: 2801427 - DNA, 15 bp, Homo sapiens
ctcgctgcgtctcca

SEQ ID NO: 2801428 - DNA, 20 bp, Homo sapiens
ctcggatcaccgagagtagc

SEQ ID NO: 2801429 - DNA, 20 bp, Homo sapiens
ctcggctgtaaacagctctg

SEQ ID NO: 2801430 - DNA, 19 bp, Homo sapiens
ctcgggaggctgagacagg

SEQ ID NO: 2801431 - DNA, 21 bp, Homo sapiens
ctcgggaggctgagacaggag

SEQ ID NO: 2801432 - DNA, 15 bp, Homo sapiens
ctcggggtgcacagg

SEQ ID NO: 2801433 - DNA, 21 bp, Homo sapiens
ctcgggtggctagtcagagag

SEQ ID NO: 2801434 - DNA, 18 bp, Homo sapiens
ctcggtggccatgcttct

SEQ ID NO: 2801435 - DNA, 19 bp, Homo sapiens
ctcggtggccatgcttctt

SEQ ID NO: 2801436 - DNA, 14 bp, Homo sapiens
ctcgtcctccccct

SEQ ID NO: 2801437 - DNA, 22 bp, Homo sapiens
ctcgtcctccccctgccagtgc

SEQ ID NO: 2801438 - DNA, 16 bp, Homo sapiens
ctcgtggacacctgcc

SEQ ID NO: 2801439 - DNA, 20 bp, Homo sapiens
ctcgtggacacctgccctgc

SEQ ID NO: 2801440 - DNA, 21 bp, Homo sapiens
ctctaacccccagtgccacag

SEQ ID NO: 2801441 - DNA, 22 bp, Homo sapiens
ctctaacccccagtgccacaga

SEQ ID NO: 2801442 - DNA, 12 bp, Homo sapiens
ctctaacgcctg

SEQ ID NO: 2801443 - DNA, 18 bp, Homo sapiens
ctctaacgcctgagccca

SEQ ID NO: 2801444 - DNA, 13 bp, Homo sapiens
ctctaagccactc

SEQ ID NO: 2801445 - DNA, 17 bp, Homo sapiens
ctctacaaactcccact

SEQ ID NO: 2801446 - DNA, 13 bp, Homo sapiens
ctctacagaggcc

SEQ ID NO: 2801447 - DNA, 19 bp, Homo sapiens
ctctacagaggccatgggc

SEQ ID NO: 2801448 - DNA, 16 bp, Homo sapiens
ctctacccatattaca

SEQ ID NO: 2801449 - DNA, 19 bp, Homo sapiens
ctctacccatattacagat

SEQ ID NO: 2801450 - DNA, 14 bp, Homo sapiens
ctctaccctggtag

SEQ ID NO: 2801451 - DNA, 17 bp, Homo sapiens
ctctaccctggtaggaa

SEQ ID NO: 2801452 - DNA, 19 bp, Homo sapiens
ctctactcctacctcagcc

SEQ ID NO: 2801453 - DNA, 16 bp, Homo sapiens
ctctactgggaaggct

SEQ ID NO: 2801454 - DNA, 23 bp, Homo sapiens
ctctagaattttaagtgctttgt

SEQ ID NO: 2801455 - DNA, 21 bp, Homo sapiens
ctctagacactgccacacagg

SEQ ID NO: 2801456 - DNA, 18 bp, Homo sapiens
ctctagcctggcaacaga

SEQ ID NO: 2801457 - DNA, 14 bp, Homo sapiens
ctctaggctgcccc

SEQ ID NO: 2801458 - DNA, 20 bp, Homo sapiens
ctctaggggtcaggctccat

SEQ ID NO: 2801459 - DNA, 15 bp, Homo sapiens
ctctagtattccaga

SEQ ID NO: 2801460 - DNA, 13 bp, Homo sapiens
ctctagtgccctc

SEQ ID NO: 2801461 - DNA, 12 bp, Homo sapiens
ctctagttcaaa

SEQ ID NO: 2801462 - DNA, 15 bp, Homo sapiens
ctctatatatacatg

SEQ ID NO: 2801463 - DNA, 17 bp, Homo sapiens
ctctatatatacatgta

SEQ ID NO: 2801464 - DNA, 21 bp, Homo sapiens
ctctatatatacatgtatagt

SEQ ID NO: 2801465 - DNA, 17 bp, Homo sapiens
ctctatgccagctcagt

SEQ ID NO: 2801466 - DNA, 21 bp, Homo sapiens
ctctatgccagctcagtccca

SEQ ID NO: 2801467 - DNA, 10 bp, Homo sapiens
ctctcaatat

SEQ ID NO: 2801468 - DNA, 21 bp, Homo sapiens
ctctcaatattcaataaagct

SEQ ID NO: 2801469 - DNA, 17 bp, Homo sapiens
ctctcagaattcttcag

SEQ ID NO: 2801470 - DNA, 19 bp, Homo sapiens
ctctcaggagcacaggcag

SEQ ID NO: 2801471 - DNA, 13 bp, Homo sapiens
ctctcatgaacct

SEQ ID NO: 2801472 - DNA, 15 bp, Homo sapiens
ctctcattccccagg

SEQ ID NO: 2801473 - DNA, 16 bp, Homo sapiens
ctctcattccccaggt

SEQ ID NO: 2801474 - DNA, 20 bp, Homo sapiens
ctctcattccccaggtggct

SEQ ID NO: 2801475 - DNA, 21 bp, Homo sapiens
ctctcattccccaggtggctg

SEQ ID NO: 2801476 - DNA, 14 bp, Homo sapiens
ctctccaacctgga

SEQ ID NO: 2801477 - DNA, 12 bp, Homo sapiens
ctctccacctca

SEQ ID NO: 2801478 - DNA, 15 bp, Homo sapiens
ctctccacctcagcc

SEQ ID NO: 2801479 - DNA, 16 bp, Homo sapiens
ctctccacctcagcct

SEQ ID NO: 2801480 - DNA, 18 bp, Homo sapiens
ctctccacctcagccttg

SEQ ID NO: 2801481 - DNA, 18 bp, Homo sapiens
ctctccactgctctcagc

SEQ ID NO: 2801482 - DNA, 13 bp, Homo sapiens
ctctccaggcacc

SEQ ID NO: 2801483 - DNA, 18 bp, Homo sapiens
ctctccaggcacccttct

SEQ ID NO: 2801484 - DNA, 13 bp, Homo sapiens
ctctcccaggccc

SEQ ID NO: 2801485 - DNA, 16 bp, Homo sapiens
ctctcccaggccccat

SEQ ID NO: 2801486 - DNA, 14 bp, Homo sapiens
ctctcccatttcct

SEQ ID NO: 2801487 - DNA, 16 bp, Homo sapiens
ctctcccctccctctt

SEQ ID NO: 2801488 - DNA, 22 bp, Homo sapiens
ctctcccctccctcttccttcc

SEQ ID NO: 2801489 - DNA, 15 bp, Homo sapiens
ctctcccctgccctg

SEQ ID NO: 2801490 - DNA, 17 bp, Homo sapiens
ctctcccctgccctgct

SEQ ID NO: 2801491 - DNA, 21 bp, Homo sapiens
ctctcccctggaactgtctct

SEQ ID NO: 2801492 - DNA, 18 bp, Homo sapiens
ctctccctctggccctgc

SEQ ID NO: 2801493 - DNA, 15 bp, Homo sapiens
ctctccggtctctct

SEQ ID NO: 2801494 - DNA, 21 bp, Homo sapiens
ctctcctaccccacctcatgc

SEQ ID NO: 2801495 - DNA, 18 bp, Homo sapiens
ctctcctcagactgctca

SEQ ID NO: 2801496 - DNA, 19 bp, Homo sapiens
ctcatagtatggtggctgg

SEQ ID NO: 2801497 - DNA, 20 bp, Homo sapiens
ctcatagtatggtggctggg

SEQ ID NO: 2801498 - DNA, 21 bp, Homo sapiens
ctcatagtatggtggctgggt

SEQ ID NO: 2801499 - DNA, 23 bp, Homo sapiens
ctcatagtatggtggctgggttg

SEQ ID NO: 2801500 - DNA, 19 bp, Homo sapiens
ctcatatatatctatctta

SEQ ID NO: 2801501 - DNA, 14 bp, Homo sapiens
ctcatcaacaaaga

SEQ ID NO: 2801502 - DNA, 18 bp, Homo sapiens
ctcatcaacaaagaaata

SEQ ID NO: 2801503 - DNA, 12 bp, Homo sapiens
ctcatcataaaa

SEQ ID NO: 2801504 - DNA, 15 bp, Homo sapiens
ctcatccgaggcagg

SEQ ID NO: 2801505 - DNA, 18 bp, Homo sapiens
ctcatctcagtgaagaat

SEQ ID NO: 2801506 - DNA, 15 bp, Homo sapiens
ctcatgacagccaga

SEQ ID NO: 2801507 - DNA, 19 bp, Homo sapiens
ctcatgaccctcctgtcca

SEQ ID NO: 2801508 - DNA, 21 bp, Homo sapiens
ctcatgaccctcctgtccagc

SEQ ID NO: 2801509 - DNA, 23 bp, Homo sapiens
ctcatgcctggcccccctccagg

SEQ ID NO: 2801510 - DNA, 18 bp, Homo sapiens
ctcatgctgacttgcaga

SEQ ID NO: 2801511 - DNA, 13 bp, Homo sapiens
ctcattagactgg

SEQ ID NO: 2801512 - DNA, 14 bp, Homo sapiens
ctcattagactgga

SEQ ID NO: 2801513 - DNA, 17 bp, Homo sapiens
ctccccttcctgcaccc

SEQ ID NO: 2801514 - DNA, 19 bp, Homo sapiens
ctccccttcctgcacccgt

SEQ ID NO: 2801515 - DNA, 17 bp, Homo sapiens
ctcccgaatagctggga

SEQ ID NO: 2801516 - DNA, 23 bp, Homo sapiens
ctcccgaatagctgggactacag

SEQ ID NO: 2801517 - DNA, 20 bp, Homo sapiens
ctcccggctatgggggcact

SEQ ID NO: 2801518 - DNA, 14 bp, Homo sapiens
ctccctcaacccca

SEQ ID NO: 2801519 - DNA, 19 bp, Homo sapiens
ctccctccaccccaggacg

SEQ ID NO: 2801520 - DNA, 12 bp, Homo sapiens
ctccctctcctg

SEQ ID NO: 2801521 - DNA, 14 bp, Homo sapiens
ctccctctcctgcc

SEQ ID NO: 2801522 - DNA, 15 bp, Homo sapiens
ctccctctcctgcct

SEQ ID NO: 2801523 - DNA, 15 bp, Homo sapiens
ctccctctggccctg

SEQ ID NO: 2801524 - DNA, 17 bp, Homo sapiens
ctccctctggccctgcc

SEQ ID NO: 2801525 - DNA, 19 bp, Homo sapiens
ctccctgccctgtcctcca

SEQ ID NO: 2801526 - DNA, 16 bp, Homo sapiens
ctccctgccgcctcaa

SEQ ID NO: 2801527 - DNA, 22 bp, Homo sapiens
ctccctggagtgcagtttccaa

SEQ ID NO: 2801528 - DNA, 14 bp, Homo sapiens
ctccctgtcctcct

SEQ ID NO: 2801529 - DNA, 16 bp, Homo sapiens
ctccctgtcctcctcg

SEQ ID NO: 2801530 - DNA, 18 bp, Homo sapiens
ctccctgtcctcctcgga

SEQ ID NO: 2801531 - DNA, 12 bp, Homo sapiens
ctcccttcctga

SEQ ID NO: 2801532 - DNA, 16 bp, Homo sapiens
ctccgactgctaggga

SEQ ID NO: 2801533 - DNA, 16 bp, Homo sapiens
ctccgccccagacaca

SEQ ID NO: 2801534 - DNA, 20 bp, Homo sapiens
ctccgctttctacccagcga

SEQ ID NO: 2801535 - DNA, 21 bp, Homo sapiens
ctccgctttctacccagcgag

SEQ ID NO: 2801536 - DNA, 20 bp, Homo sapiens
ctccgtccaggagcctgtgc

SEQ ID NO: 2801537 - DNA, 22 bp, Homo sapiens
ctccgtccaggagcctgtgcct

SEQ ID NO: 2801538 - DNA, 19 bp, Homo sapiens
ctcctattttaattggaat

SEQ ID NO: 2801539 - DNA, 17 bp, Homo sapiens
ctcctatttttcagaat

SEQ ID NO: 2801540 - DNA, 20 bp, Homo sapiens
ctcctcacccccagctttgc

SEQ ID NO: 2801541 - DNA, 18 bp, Homo sapiens
ctcctcaccccgtctggg

SEQ ID NO: 2801542 - DNA, 17 bp, Homo sapiens
ctcctcactgccccacc

SEQ ID NO: 2801543 - DNA, 19 bp, Homo sapiens
ctcctcactgccccaccag

SEQ ID NO: 2801544 - DNA, 15 bp, Homo sapiens
ctcctccaaaggaag

SEQ ID NO: 2801545 - DNA, 23 bp, Homo sapiens
ctcctccaaaggaagtctaggag

SEQ ID NO: 2801546 - DNA, 19 bp, Homo sapiens
ctcctccagggccacgtgc

SEQ ID NO: 2801547 - DNA, 22 bp, Homo sapiens
ctcctccagggccacgtgccag

SEQ ID NO: 2801548 - DNA, 13 bp, Homo sapiens
ctcctcccacaat

SEQ ID NO: 2801549 - DNA, 12 bp, Homo sapiens
ctcctcccacca

SEQ ID NO: 2801550 - DNA, 23 bp, Homo sapiens
ctcctcccaccaccctcccacca

SEQ ID NO: 2801551 - DNA, 15 bp, Homo sapiens
ctcctcctcccccag

SEQ ID NO: 2801552 - DNA, 13 bp, Homo sapiens
ctcctctccccag

SEQ ID NO: 2801553 - DNA, 14 bp, Homo sapiens
ctcctctgccacct

SEQ ID NO: 2801554 - DNA, 15 bp, Homo sapiens
ctcctctgccacctc

SEQ ID NO: 2801555 - DNA, 12 bp, Homo sapiens
ctcctctgtcca

SEQ ID NO: 2801556 - DNA, 15 bp, Homo sapiens
ctcctctgtccaggc

SEQ ID NO: 2801557 - DNA, 16 bp, Homo sapiens
ctcctctgtccagggc

SEQ ID NO: 2801558 - DNA, 23 bp, Homo sapiens
ctcctcttaaaaaataaaaactg

SEQ ID NO: 2801559 - DNA, 19 bp, Homo sapiens
ctcctcttgccactgcctc

SEQ ID NO: 2801560 - DNA, 23 bp, Homo sapiens
ctcctgacccagtccccgtgccc

SEQ ID NO: 2801561 - DNA, 16 bp, Homo sapiens
ctcctgacctgtcacc

SEQ ID NO: 2801562 - DNA, 19 bp, Homo sapiens
ctcctgagaggtgctgcag

SEQ ID NO: 2801563 - DNA, 20 bp, Homo sapiens
ctcctgagaggtgctgcagg

SEQ ID NO: 2801564 - DNA, 14 bp, Homo sapiens
ctcctgcctactca

SEQ ID NO: 2801565 - DNA, 15 bp, Homo sapiens
ctcctgcctcagcct

SEQ ID NO: 2801566 - DNA, 16 bp, Homo sapiens
ctcctgcctcagcctc

SEQ ID NO: 2801567 - DNA, 12 bp, Homo sapiens
ctcctgcctcta

SEQ ID NO: 2801568 - DNA, 15 bp, Homo sapiens
ctcctgcctctactg

SEQ ID NO: 2801569 - DNA, 22 bp, Homo sapiens
ctcctgcctctactgggaaggc

SEQ ID NO: 2801570 - DNA, 12 bp, Homo sapiens
ctcctgctgaaa

SEQ ID NO: 2801571 - DNA, 22 bp, Homo sapiens
ctcctgctgaaacacctcccag

SEQ ID NO: 2801572 - DNA, 22 bp, Homo sapiens
ctcctggaaaggctcagtctca

SEQ ID NO: 2801573 - DNA, 16 bp, Homo sapiens
ctcctggaaccaatcc

SEQ ID NO: 2801574 - DNA, 19 bp, Homo sapiens
ctcctggcctcaagtgatt

SEQ ID NO: 2801575 - DNA, 23 bp, Homo sapiens
ctcctgggcccgctttgcctgct

SEQ ID NO: 2801576 - DNA, 18 bp, Homo sapiens
ctcctgggctaagtgatc

SEQ ID NO: 2801577 - DNA, 14 bp, Homo sapiens
ctcctgggggttct

SEQ ID NO: 2801578 - DNA, 18 bp, Homo sapiens
ctcctgggggttctttct

SEQ ID NO: 2801579 - DNA, 15 bp, Homo sapiens
ctcctggtcttgaga

SEQ ID NO: 2801580 - DNA, 23 bp, Homo sapiens
ctcctggtcttgagatgtcttct

SEQ ID NO: 2801581 - DNA, 18 bp, Homo sapiens
ctcctgtaattttgtagt

SEQ ID NO: 2801582 - DNA, 17 bp, Homo sapiens
ctcctgtagctctcctg

SEQ ID NO: 2801583 - DNA, 14 bp, Homo sapiens
ctcctgtccaacct

SEQ ID NO: 2801584 - DNA, 15 bp, Homo sapiens
ctcctgtccagcagg

SEQ ID NO: 2801585 - DNA, 16 bp, Homo sapiens
ctcctgtccagcaggt

SEQ ID NO: 2801586 - DNA, 15 bp, Homo sapiens
ctcctgtctgccagc

SEQ ID NO: 2801587 - DNA, 22 bp, Homo sapiens
ctcctgtctgccagccagcagc

SEQ ID NO: 2801588 - DNA, 13 bp, Homo sapiens
ctcctgtgggagc

SEQ ID NO: 2801589 - DNA, 15 bp, Homo sapiens
ctcctgtgggagcct

SEQ ID NO: 2801590 - DNA, 16 bp, Homo sapiens
ctacacagcctggact

SEQ ID NO: 2801591 - DNA, 18 bp, Homo sapiens
ctacacatatatgtatat

SEQ ID NO: 2801592 - DNA, 16 bp, Homo sapiens
ctacaccactctggca

SEQ ID NO: 2801593 - DNA, 19 bp, Homo sapiens
ctacaccactctggcagcc

SEQ ID NO: 2801594 - DNA, 20 bp, Homo sapiens
ctacaccactctggcagcca

SEQ ID NO: 2801595 - DNA, 21 bp, Homo sapiens
ctacaccactctggcagccac

SEQ ID NO: 2801596 - DNA, 13 bp, Homo sapiens
ctacacctgaggc

SEQ ID NO: 2801597 - DNA, 20 bp, Homo sapiens
ctacaccttagcagctcttc

SEQ ID NO: 2801598 - DNA, 16 bp, Homo sapiens
ctacagaacaaagaac

SEQ ID NO: 2801599 - DNA, 16 bp, Homo sapiens
ctacagacttctccag

SEQ ID NO: 2801600 - DNA, 15 bp, Homo sapiens
ctacagaggccatgg

SEQ ID NO: 2801601 - DNA, 18 bp, Homo sapiens
ctacagaggccatgggcc

SEQ ID NO: 2801602 - DNA, 20 bp, Homo sapiens
ctacagaggccatgggcctc

SEQ ID NO: 2801603 - DNA, 22 bp, Homo sapiens
ctacagaggccatgggcctcct

SEQ ID NO: 2801604 - DNA, 21 bp, Homo sapiens
ctacagataatttattttgta

SEQ ID NO: 2801605 - DNA, 13 bp, Homo sapiens
ctacagattttag

SEQ ID NO: 2801606 - DNA, 14 bp, Homo sapiens
ctacagattttaga

SEQ ID NO: 2801607 - DNA, 13 bp, Homo sapiens
ctacagccagaag

SEQ ID NO: 2801608 - DNA, 14 bp, Homo sapiens
ctacaggagtgagc

SEQ ID NO: 2801609 - DNA, 17 bp, Homo sapiens
ctacaggcacccaccat

SEQ ID NO: 2801610 - DNA, 16 bp, Homo sapiens
ctacaggtgtgagtca

SEQ ID NO: 2801611 - DNA, 15 bp, Homo sapiens
ctacataatttagtt

SEQ ID NO: 2801612 - DNA, 13 bp, Homo sapiens
ctacatccccagg

SEQ ID NO: 2801613 - DNA, 13 bp, Homo sapiens
ctacatgaaacag

SEQ ID NO: 2801614 - DNA, 14 bp, Homo sapiens
ctacatgaaacaga

SEQ ID NO: 2801615 - DNA, 17 bp, Homo sapiens
ctacattccctggcctg

SEQ ID NO: 2801616 - DNA, 19 bp, Homo sapiens
ctaccaaatataaacttgt

SEQ ID NO: 2801617 - DNA, 21 bp, Homo sapiens
cctcgtcctccccctgccagt

SEQ ID NO: 2801618 - DNA, 23 bp, Homo sapiens
cctctaacccccagtgccacaga

SEQ ID NO: 2801619 - DNA, 22 bp, Homo sapiens
cctctactgggaaggctacttc

SEQ ID NO: 2801620 - DNA, 14 bp, Homo sapiens
cctctagtgccctc

SEQ ID NO: 2801621 - DNA, 13 bp, Homo sapiens
cctctatttctct

SEQ ID NO: 2801622 - DNA, 14 bp, Homo sapiens
cctctatttctctc

SEQ ID NO: 2801623 - DNA, 18 bp, Homo sapiens
cctctcaatattcaataa

SEQ ID NO: 2801624 - DNA, 11 bp, Homo sapiens
cctctccaggc

SEQ ID NO: 2801625 - DNA, 12 bp, Homo sapiens
cctctccaggca

SEQ ID NO: 2801626 - DNA, 14 bp, Homo sapiens
cctctccaggcacc

SEQ ID NO: 2801627 - DNA, 17 bp, Homo sapiens
cctctccaggcaccctt

SEQ ID NO: 2801628 - DNA, 14 bp, Homo sapiens
cctctcccaggccc

SEQ ID NO: 2801629 - DNA, 16 bp, Homo sapiens
cctctcctgcctactc

SEQ ID NO: 2801630 - DNA, 17 bp, Homo sapiens
cctctcggaaggctggc

SEQ ID NO: 2801631 - DNA, 19 bp, Homo sapiens
cctctctgagactgctaag

SEQ ID NO: 2801632 - DNA, 12 bp, Homo sapiens
cctctcttccct

SEQ ID NO: 2801633 - DNA, 14 bp, Homo sapiens
cctctgacacacag

SEQ ID NO: 2801634 - DNA, 15 bp, Homo sapiens
cctctgacacacagc

SEQ ID NO: 2801635 - DNA, 18 bp, Homo sapiens
cctctgacacacagctct

SEQ ID NO: 2801636 - DNA, 21 bp, Homo sapiens
cgggccactccttcctgcccc

SEQ ID NO: 2801637 - DNA, 22 bp, Homo sapiens
cgggccactccttcctgcccca

SEQ ID NO: 2801638 - DNA, 13 bp, Homo sapiens
cgggcctgcctct

SEQ ID NO: 2801639 - DNA, 14 bp, Homo sapiens
cgggctgccctgcc

SEQ ID NO: 2801640 - DNA, 16 bp, Homo sapiens
cgggctgggagctctg

SEQ ID NO: 2801641 - DNA, 16 bp, Homo sapiens
cgggcttgggccctgc

SEQ ID NO: 2801642 - DNA, 17 bp, Homo sapiens
cgggcttgggccctgca

SEQ ID NO: 2801643 - DNA, 15 bp, Homo sapiens
cgggcttttccccgg

SEQ ID NO: 2801644 - DNA, 14 bp, Homo sapiens
cggggacagctcct

SEQ ID NO: 2801645 - DNA, 15 bp, Homo sapiens
cggggacagctcctt

SEQ ID NO: 2801646 - DNA, 17 bp, Homo sapiens
cggggcatgctggggca

SEQ ID NO: 2801647 - DNA, 15 bp, Homo sapiens
cggggccccagggct

SEQ ID NO: 2801648 - DNA, 21 bp, Homo sapiens
cggggcgacccctcagtgctc

SEQ ID NO: 2801649 - DNA, 15 bp, Homo sapiens
cggggtgcacaggag

SEQ ID NO: 2801650 - DNA, 15 bp, Homo sapiens
cggtccacccaggag

SEQ ID NO: 2801651 - DNA, 16 bp, Homo sapiens
cggtcccccctcactc

SEQ ID NO: 2801652 - DNA, 23 bp, Homo sapiens
cggtcccttgagacctcagccat

SEQ ID NO: 2801653 - DNA, 13 bp, Homo sapiens
cggtcctggcccc

SEQ ID NO: 2801654 - DNA, 15 bp, Homo sapiens
cggtcctggccccag

SEQ ID NO: 2801655 - DNA, 20 bp, Homo sapiens
cggtgcctgggtggggctgc

SEQ ID NO: 2801656 - DNA, 21 bp, Homo sapiens
cggtggccatgcttcttgccc

SEQ ID NO: 2801657 - DNA, 11 bp, Homo sapiens
cggtggctcac

SEQ ID NO: 2801658 - DNA, 22 bp, Homo sapiens
cggtggctcacgcctgtaatcc

SEQ ID NO: 2801659 - DNA, 16 bp, Homo sapiens
cggtgtgggctgtgtc

SEQ ID NO: 2801660 - DNA, 19 bp, Homo sapiens
cggttcatcaattttcact

SEQ ID NO: 2801661 - DNA, 19 bp, Homo sapiens
cggttccacgtccccctgg

SEQ ID NO: 2801662 - DNA, 15 bp, Homo sapiens
cggtttccaggaaga

SEQ ID NO: 2801663 - DNA, 17 bp, Homo sapiens
cgctccccactctgctc

SEQ ID NO: 2801664 - DNA, 14 bp, Homo sapiens
cgctcctgtctgcc

SEQ ID NO: 2801665 - DNA, 16 bp, Homo sapiens
cgctcctgtctgccag

SEQ ID NO: 2801666 - DNA, 17 bp, Homo sapiens
cgctctcctttctttct

SEQ ID NO: 2801667 - DNA, 14 bp, Homo sapiens
cgctctctgtctgg

SEQ ID NO: 2801668 - DNA, 15 bp, Homo sapiens
cgctgccccagcccc

SEQ ID NO: 2801669 - DNA, 20 bp, Homo sapiens
cgctgccgcaccccagagtg

SEQ ID NO: 2801670 - DNA, 21 bp, Homo sapiens
cgctgccgcaccccagagtgt

SEQ ID NO: 2801671 - DNA, 22 bp, Homo sapiens
cgctgcgtctccatcaacactg

SEQ ID NO: 2801672 - DNA, 15 bp, Homo sapiens
cgctgctagagaagg

SEQ ID NO: 2801673 - DNA, 13 bp, Homo sapiens
cgctgctcaacct

SEQ ID NO: 2801674 - DNA, 19 bp, Homo sapiens
cgctggaccttgaactggg

SEQ ID NO: 2801675 - DNA, 23 bp, Homo sapiens
cgctggaccttgaactgggtact

SEQ ID NO: 2801676 - DNA, 17 bp, Homo sapiens
cgctggagtgcagtgag

SEQ ID NO: 2801677 - DNA, 18 bp, Homo sapiens
cgctggagtgcagtgagc

SEQ ID NO: 2801678 - DNA, 13 bp, Homo sapiens
cgctggcagagaa

SEQ ID NO: 2801679 - DNA, 22 bp, Homo sapiens
cgctggggagcgaaagtttctt

SEQ ID NO: 2801680 - DNA, 21 bp, Homo sapiens
cgctggtggaccacaggcatc

SEQ ID NO: 2801681 - DNA, 15 bp, Homo sapiens
cgctgtcctgctgtg

SEQ ID NO: 2801682 - DNA, 14 bp, Homo sapiens
cgcttccccacaga

SEQ ID NO: 2801683 - DNA, 16 bp, Homo sapiens
cgcttccccacagaac

SEQ ID NO: 2801684 - DNA, 20 bp, Homo sapiens
cgcttgtccagcgcctagtg

SEQ ID NO: 2801685 - DNA, 20 bp, Homo sapiens
cgctttcatgaacacagcct

SEQ ID NO: 2801686 - DNA, 14 bp, Homo sapiens
cgctttctacccag

SEQ ID NO: 2801687 - DNA, 11 bp, Homo sapiens
cgctttttgaa

SEQ ID NO: 2801688 - DNA, 17 bp, Homo sapiens
cggaagaatcacttgaa

SEQ ID NO: 2801689 - DNA, 22 bp, Homo sapiens
cggaagcagtgccttccataat

SEQ ID NO: 2801690 - DNA, 23 bp, Homo sapiens
cggaagcagtgccttccataatt

SEQ ID NO: 2801691 - DNA, 20 bp, Homo sapiens
cggaagcctttttccccaaa

SEQ ID NO: 2801692 - DNA, 18 bp, Homo sapiens
cggaaggctggctgggca

SEQ ID NO: 2801693 - DNA, 17 bp, Homo sapiens
cggaatagttggctagg

SEQ ID NO: 2801694 - DNA, 18 bp, Homo sapiens
cggacagccacggccagg

SEQ ID NO: 2801695 - DNA, 20 bp, Homo sapiens
cggacctgtggggccccaga

SEQ ID NO: 2801696 - DNA, 17 bp, Homo sapiens
cggagacggagtcccac

SEQ ID NO: 2801697 - DNA, 20 bp, Homo sapiens
cggagacggagtcccacctt

SEQ ID NO: 2801698 - DNA, 18 bp, Homo sapiens
cggagagtacagtgagcc

SEQ ID NO: 2801699 - DNA, 19 bp, Homo sapiens
cggagagtacagtgagcca

SEQ ID NO: 2801700 - DNA, 14 bp, Homo sapiens
cggagccggcacct

SEQ ID NO: 2801701 - DNA, 17 bp, Homo sapiens
cggaggagaccagctca

SEQ ID NO: 2801702 - DNA, 20 bp, Homo sapiens
cggaggagaccagctcagag

SEQ ID NO: 2801703 - DNA, 17 bp, Homo sapiens
cggagggattcccctaa

SEQ ID NO: 2801704 - DNA, 13 bp, Homo sapiens
cggagtagaaatt

SEQ ID NO: 2801705 - DNA, 14 bp, Homo sapiens
cggagtcccacctt

SEQ ID NO: 2801706 - DNA, 16 bp, Homo sapiens
cggagtcccaccttgg

SEQ ID NO: 2801707 - DNA, 18 bp, Homo sapiens
cggagtcccaccttggct

SEQ ID NO: 2801708 - DNA, 23 bp, Homo sapiens
cggagtcccaccttggctgcagg

SEQ ID NO: 2801709 - DNA, 18 bp, Homo sapiens
cggagtgagttttttagt

SEQ ID NO: 2801710 - DNA, 19 bp, Homo sapiens
cggcaaccccagttctgct

SEQ ID NO: 2801711 - DNA, 22 bp, Homo sapiens
cggcaaccccagttctgctcct

SEQ ID NO: 2801712 - DNA, 15 bp, Homo sapiens
cggcaccccctgcag

SEQ ID NO: 2801713 - DNA, 16 bp, Homo sapiens
cggcaccccctgcagc

SEQ ID NO: 2801714 - DNA, 20 bp, Homo sapiens
cggcaccccctgcagcttgt

SEQ ID NO: 2801715 - DNA, 19 bp, Homo sapiens
cggcacctacatccccagg

SEQ ID NO: 2801716 - DNA, 15 bp, Homo sapiens
cggcacgtcccatgt

SEQ ID NO: 2801717 - DNA, 18 bp, Homo sapiens
cggcagcttgagcctgtc

SEQ ID NO: 2801718 - DNA, 12 bp, Homo sapiens
cggcatgtttcc

SEQ ID NO: 2801719 - DNA, 14 bp, Homo sapiens
cggcattcctgctt

SEQ ID NO: 2801720 - DNA, 12 bp, Homo sapiens
cggccaggccag

SEQ ID NO: 2801721 - DNA, 24 bp, Homo sapiens
cggccaggccagagggagtgacag

SEQ ID NO: 2801722 - DNA, 12 bp, Homo sapiens
cggcccacagct

SEQ ID NO: 2801723 - DNA, 21 bp, Homo sapiens
cggcccagagaccccttcctt

SEQ ID NO: 2801724 - DNA, 14 bp, Homo sapiens
cggccccatcagag

SEQ ID NO: 2801725 - DNA, 17 bp, Homo sapiens
cggccccatcagaggct

SEQ ID NO: 2801726 - DNA, 19 bp, Homo sapiens
cggccccatcagaggctgg

SEQ ID NO: 2801727 - DNA, 13 bp, Homo sapiens
cggccgcattccc

SEQ ID NO: 2801728 - DNA, 21 bp, Homo sapiens
cggcctccgtccaggagcctg

SEQ ID NO: 2801729 - DNA, 19 bp, Homo sapiens
cggcctctctcttcccagc

SEQ ID NO: 2801730 - DNA, 14 bp, Homo sapiens
cggcctgctcccag

SEQ ID NO: 2801731 - DNA, 16 bp, Homo sapiens
cggctcactgcagcct

SEQ ID NO: 2801732 - DNA, 19 bp, Homo sapiens
cggctcactgcagcctcaa

SEQ ID NO: 2801733 - DNA, 14 bp, Homo sapiens
cggctccccctgct

SEQ ID NO: 2801734 - DNA, 22 bp, Homo sapiens
cggctccccctgcttctcagcc

SEQ ID NO: 2801735 - DNA, 20 bp, Homo sapiens
cggctgagtcatgatctccc

SEQ ID NO: 2801736 - DNA, 12 bp, Homo sapiens
cgggaagcggag

SEQ ID NO: 2801737 - DNA, 23 bp, Homo sapiens
cgggaaggagggttagggagggg

SEQ ID NO: 2801738 - DNA, 14 bp, Homo sapiens
cgggacagacctgg

SEQ ID NO: 2801739 - DNA, 14 bp, Homo sapiens
cgggagcagtgtct

SEQ ID NO: 2801740 - DNA, 15 bp, Homo sapiens
cgggagcagtgtctt

SEQ ID NO: 2801741 - DNA, 14 bp, Homo sapiens
cgggagcatctctt

SEQ ID NO: 2801742 - DNA, 21 bp, Homo sapiens
cgggaggatgttctgggacac

SEQ ID NO: 2801743 - DNA, 23 bp, Homo sapiens
cgggaggatgttctgggacacag

SEQ ID NO: 2801744 - DNA, 13 bp, Homo sapiens
cgggaggctgaga

SEQ ID NO: 2801745 - DNA, 16 bp, Homo sapiens
cgggaggctgagacag

SEQ ID NO: 2801746 - DNA, 18 bp, Homo sapiens
cgggaggctgagacagga

SEQ ID NO: 2801747 - DNA, 23 bp, Homo sapiens
cgggaggctgagacaggagaatc

SEQ ID NO: 2801748 - DNA, 14 bp, Homo sapiens
cgggcactcagaag

SEQ ID NO: 2801749 - DNA, 22 bp, Homo sapiens
cgggcactcagaagacactgat

SEQ ID NO: 2801750 - DNA, 14 bp, Homo sapiens
cgggcagcccagcc

SEQ ID NO: 2801751 - DNA, 20 bp, Homo sapiens
cgggcagcccagcctctgtc

SEQ ID NO: 2801752 - DNA, 14 bp, Homo sapiens
cgggccacagagaa

SEQ ID NO: 2801753 - DNA, 19 bp, Homo sapiens
cgaagcccttccagtggta

SEQ ID NO: 2801754 - DNA, 17 bp, Homo sapiens
cgaagctaacagggaag

SEQ ID NO: 2801755 - DNA, 13 bp, Homo sapiens
cgaaggggccctg

SEQ ID NO: 2801756 - DNA, 14 bp, Homo sapiens
cgaatcagactcat

SEQ ID NO: 2801757 - DNA, 16 bp, Homo sapiens
cgaatgacactgttca

SEQ ID NO: 2801758 - DNA, 20 bp, Homo sapiens
cgaattgagataatatctgt

SEQ ID NO: 2801759 - DNA, 21 bp, Homo sapiens
cgaccacttttcagttcagtg

SEQ ID NO: 2801760 - DNA, 16 bp, Homo sapiens
cgacccctcagtgctc

SEQ ID NO: 2801761 - DNA, 15 bp, Homo sapiens
cgaccctttctctga

SEQ ID NO: 2801762 - DNA, 23 bp, Homo sapiens
cgacctcgtcctccccctgccag

SEQ ID NO: 2801763 - DNA, 19 bp, Homo sapiens
cgacggtttcaaaccagga

SEQ ID NO: 2801764 - DNA, 11 bp, Homo sapiens
cgactcaggga

SEQ ID NO: 2801765 - DNA, 16 bp, Homo sapiens
cgactccagccagcgc

SEQ ID NO: 2801766 - DNA, 16 bp, Homo sapiens
cgactgtgaaagtatg

SEQ ID NO: 2801767 - DNA, 13 bp, Homo sapiens
cgacttcctctcc

SEQ ID NO: 2801768 - DNA, 20 bp, Homo sapiens
cgagaactcgaagcccttcc

SEQ ID NO: 2801769 - DNA, 21 bp, Homo sapiens
cgagaactcgaagcccttcca

SEQ ID NO: 2801770 - DNA, 17 bp, Homo sapiens
cgagaccaacctgacca

SEQ ID NO: 2801771 - DNA, 15 bp, Homo sapiens
cgagaccagcctggc

SEQ ID NO: 2801772 - DNA, 18 bp, Homo sapiens
cgagagaggtgggcagca

SEQ ID NO: 2801773 - DNA, 19 bp, Homo sapiens
cgagagaggtgggcagcag

SEQ ID NO: 2801774 - DNA, 22 bp, Homo sapiens
cgagagaggtgggcagcagctc

SEQ ID NO: 2801775 - DNA, 20 bp, Homo sapiens
cgagagtagccgagagcctg

SEQ ID NO: 2801776 - DNA, 18 bp, Homo sapiens
cgagatcacgccactgca

SEQ ID NO: 2801777 - DNA, 16 bp, Homo sapiens
cgagatcgctggcaga

SEQ ID NO: 2801778 - DNA, 19 bp, Homo sapiens
cgagatcgctggcagagaa

SEQ ID NO: 2801779 - DNA, 15 bp, Homo sapiens
cgagcaaccgtggcc

SEQ ID NO: 2801780 - DNA, 19 bp, Homo sapiens
cgagcagctgagcagggcc

SEQ ID NO: 2801781 - DNA, 13 bp, Homo sapiens
cgagcatttccct

SEQ ID NO: 2801782 - DNA, 20 bp, Homo sapiens
cgagcatttccctcccggga

SEQ ID NO: 2801783 - DNA, 17 bp, Homo sapiens
cgagccgggcctggggc

SEQ ID NO: 2801784 - DNA, 15 bp, Homo sapiens
cgagcgccctgcaga

SEQ ID NO: 2801785 - DNA, 16 bp, Homo sapiens
cgagcgccctgcagac

SEQ ID NO: 2801786 - DNA, 18 bp, Homo sapiens
cgagcgctttctggaaaa

SEQ ID NO: 2801787 - DNA, 23 bp, Homo sapiens
cgagcgctttctggaaaagagga

SEQ ID NO: 2801788 - DNA, 14 bp, Homo sapiens
cgaggacagggagg

SEQ ID NO: 2801789 - DNA, 16 bp, Homo sapiens
cgaggacagggaggtg

SEQ ID NO: 2801790 - DNA, 18 bp, Homo sapiens
cgaggccttctctgaagg

SEQ ID NO: 2801791 - DNA, 17 bp, Homo sapiens
cgaggtcaacagagaag

SEQ ID NO: 2801792 - DNA, 15 bp, Homo sapiens
cgagtaatatgcctg

SEQ ID NO: 2801793 - DNA, 14 bp, Homo sapiens
cgagtagctgggac

SEQ ID NO: 2801794 - DNA, 20 bp, Homo sapiens
cgagtcaatcccctcattca

SEQ ID NO: 2801795 - DNA, 22 bp, Homo sapiens
cgagttgtggaaagcctctgct

SEQ ID NO: 2801796 - DNA, 17 bp, Homo sapiens
cgagtttacttcatgag

SEQ ID NO: 2801797 - DNA, 20 bp, Homo sapiens
cgatcttggctcactgcaac

SEQ ID NO: 2801798 - DNA, 17 bp, Homo sapiens
cgatgtggccctggcct

SEQ ID NO: 2801799 - DNA, 22 bp, Homo sapiens
cgatgtggccctggcctgctgg

SEQ ID NO: 2801800 - DNA, 11 bp, Homo sapiens
cgattagactg

SEQ ID NO: 2801801 - DNA, 18 bp, Homo sapiens
cgattagactggacagct

SEQ ID NO: 2801802 - DNA, 13 bp, Homo sapiens
cgattggctttaa

SEQ ID NO: 2801803 - DNA, 15 bp, Homo sapiens
cgattggctttaaac

SEQ ID NO: 2801804 - DNA, 14 bp, Homo sapiens
cgatttgtcccagg

SEQ ID NO: 2801805 - DNA, 22 bp, Homo sapiens
cgcaacccgtgccaagtccagg

SEQ ID NO: 2801806 - DNA, 21 bp, Homo sapiens
cgcaagcctgtaatcccagct

SEQ ID NO: 2801807 - DNA, 14 bp, Homo sapiens
cgcaagtctgcagc

SEQ ID NO: 2801808 - DNA, 21 bp, Homo sapiens
cgcacaaggctgaccaagaga

SEQ ID NO: 2801809 - DNA, 22 bp, Homo sapiens
cgcacagattacttcagggctg

SEQ ID NO: 2801810 - DNA, 13 bp, Homo sapiens
cgcagagctccct

SEQ ID NO: 2801811 - DNA, 14 bp, Homo sapiens
cgcagagctccctt

SEQ ID NO: 2801812 - DNA, 18 bp, Homo sapiens
cgcagcaccctgcagagc

SEQ ID NO: 2801813 - DNA, 21 bp, Homo sapiens
cgcagccagccggtgcctggc

SEQ ID NO: 2801814 - DNA, 16 bp, Homo sapiens
cgcagggacagaactg

SEQ ID NO: 2801815 - DNA, 19 bp, Homo sapiens
cgcagtgcttctctacaga

SEQ ID NO: 2801816 - DNA, 16 bp, Homo sapiens
cgcatcttctccatct

SEQ ID NO: 2801817 - DNA, 13 bp, Homo sapiens
cgccaccatcctg

SEQ ID NO: 2801818 - DNA, 16 bp, Homo sapiens
cgccactcatttcatc

SEQ ID NO: 2801819 - DNA, 21 bp, Homo sapiens
cgccactcatttcatctcatt

SEQ ID NO: 2801820 - DNA, 19 bp, Homo sapiens
cgcccagcctcctcccacc

SEQ ID NO: 2801821 - DNA, 21 bp, Homo sapiens
cgcccagcctcctcccaccac

SEQ ID NO: 2801822 - DNA, 11 bp, Homo sapiens
cgcccaggaga

SEQ ID NO: 2801823 - DNA, 12 bp, Homo sapiens
cgcccagtctgg

SEQ ID NO: 2801824 - DNA, 13 bp, Homo sapiens
cgcccagtctgga

SEQ ID NO: 2801825 - DNA, 21 bp, Homo sapiens
cgccccagatcaccagcccgg

SEQ ID NO: 2801826 - DNA, 20 bp, Homo sapiens
cgcctagtggggtctccctc

SEQ ID NO: 2801827 - DNA, 21 bp, Homo sapiens
cgcctagtggggtctccctct

SEQ ID NO: 2801828 - DNA, 22 bp, Homo sapiens
cgcctcaatgtggttgcaaggc

SEQ ID NO: 2801829 - DNA, 14 bp, Homo sapiens
cgcctccaggagcc

SEQ ID NO: 2801830 - DNA, 19 bp, Homo sapiens
cgcctccaggagcctaccc

SEQ ID NO: 2801831 - DNA, 18 bp, Homo sapiens
cgcctccctccaccccag

SEQ ID NO: 2801832 - DNA, 20 bp, Homo sapiens
cgcctccctccaccccagga

SEQ ID NO: 2801833 - DNA, 12 bp, Homo sapiens
cgcctctcccac

SEQ ID NO: 2801834 - DNA, 21 bp, Homo sapiens
cgcctgagcccagggaggccg

SEQ ID NO: 2801835 - DNA, 15 bp, Homo sapiens
cgcctgcccagcctc

SEQ ID NO: 2801836 - DNA, 18 bp, Homo sapiens
cgcctgcccccagcactc

SEQ ID NO: 2801837 - DNA, 20 bp, Homo sapiens
cgcctgcccccagcactcct

SEQ ID NO: 2801838 - DNA, 18 bp, Homo sapiens
cgcctgtaatcccagcac

SEQ ID NO: 2801839 - DNA, 20 bp, Homo sapiens
cgcctgtagtcctagccact

SEQ ID NO: 2801840 - DNA, 15 bp, Homo sapiens
cgcctgtgcccacgt

SEQ ID NO: 2801841 - DNA, 14 bp, Homo sapiens
cgcgtctaccctgg

SEQ ID NO: 2801842 - DNA, 15 bp, Homo sapiens
cgctattgcactcca

SEQ ID NO: 2801843 - DNA, 20 bp, Homo sapiens
ccttctgtcctactctgtgt

SEQ ID NO: 2801844 - DNA, 22 bp, Homo sapiens
ccttcttattctcactccacca

SEQ ID NO: 2801845 - DNA, 15 bp, Homo sapiens
ccttcttcacccagc

SEQ ID NO: 2801846 - DNA, 19 bp, Homo sapiens
ccttcttcacccagctaat

SEQ ID NO: 2801847 - DNA, 22 bp, Homo sapiens
ccttcttcggggaactcctgga

SEQ ID NO: 2801848 - DNA, 15 bp, Homo sapiens
ccttctttaaatcaa

SEQ ID NO: 2801849 - DNA, 17 bp, Homo sapiens
ccttctttaaatcaaaa

SEQ ID NO: 2801850 - DNA, 13 bp, Homo sapiens
ccttctttctacc

SEQ ID NO: 2801851 - DNA, 20 bp, Homo sapiens
ccttgaacactgggggaggg

SEQ ID NO: 2801852 - DNA, 14 bp, Homo sapiens
ccttgaactgggta

SEQ ID NO: 2801853 - DNA, 14 bp, Homo sapiens
ccttgacagggcac

SEQ ID NO: 2801854 - DNA, 15 bp, Homo sapiens
ccttgacagggcaca

SEQ ID NO: 2801855 - DNA, 18 bp, Homo sapiens
ccttgacagggcacaccg

SEQ ID NO: 2801856 - DNA, 14 bp, Homo sapiens
ccttgagaaacctt

SEQ ID NO: 2801857 - DNA, 14 bp, Homo sapiens
ccttgagacctcag

SEQ ID NO: 2801858 - DNA, 16 bp, Homo sapiens
ccttgagacctcagcc

SEQ ID NO: 2801859 - DNA, 18 bp, Homo sapiens
ccttgagacctcagccat

SEQ ID NO: 2801860 - DNA, 19 bp, Homo sapiens
ccttgatggagatatttac

SEQ ID NO: 2801861 - DNA, 22 bp, Homo sapiens
ccttgattttagccttctctgt

SEQ ID NO: 2801862 - DNA, 20 bp, Homo sapiens
ccttgcacagcccacacatg

SEQ ID NO: 2801863 - DNA, 16 bp, Homo sapiens
ccttgcacctgcatcc

SEQ ID NO: 2801864 - DNA, 16 bp, Homo sapiens
ccttgccaagctttct

SEQ ID NO: 2801865 - DNA, 13 bp, Homo sapiens
ccttgccagacat

SEQ ID NO: 2801866 - DNA, 12 bp, Homo sapiens
ccttgcccagag

SEQ ID NO: 2801867 - DNA, 14 bp, Homo sapiens
ccttgcccagagat

SEQ ID NO: 2801868 - DNA, 21 bp, Homo sapiens
ccttgcccagagatgcctcca

SEQ ID NO: 2801869 - DNA, 18 bp, Homo sapiens
ccttgcccagggctcagc

SEQ ID NO: 2801870 - DNA, 21 bp, Homo sapiens
ccttgcccagggctcagcctg

SEQ ID NO: 2801871 - DNA, 18 bp, Homo sapiens
ccttgcccggattctggg

SEQ ID NO: 2801872 - DNA, 13 bp, Homo sapiens
ccttgccctgacc

SEQ ID NO: 2801873 - DNA, 16 bp, Homo sapiens
ccttgccctgacctcc

SEQ ID NO: 2801874 - DNA, 15 bp, Homo sapiens
ccttgcccttgccct

SEQ ID NO: 2801875 - DNA, 17 bp, Homo sapiens
ccttgcccttgccctga

SEQ ID NO: 2801876 - DNA, 22 bp, Homo sapiens
ccttgctcaccaagctgttcca

SEQ ID NO: 2801877 - DNA, 13 bp, Homo sapiens
ccttggagcagaa

SEQ ID NO: 2801878 - DNA, 17 bp, Homo sapiens
ccttggagcagaaagcc

SEQ ID NO: 2801879 - DNA, 16 bp, Homo sapiens
ccttggaggacagtgg

SEQ ID NO: 2801880 - DNA, 19 bp, Homo sapiens
ccttggcatcacagggcag

SEQ ID NO: 2801881 - DNA, 22 bp, Homo sapiens
ccttggcgggcagcccagcctc

SEQ ID NO: 2801882 - DNA, 22 bp, Homo sapiens
ccttggctcaatcctctaagct

SEQ ID NO: 2801883 - DNA, 12 bp, Homo sapiens
ccttggctgcag

SEQ ID NO: 2801884 - DNA, 18 bp, Homo sapiens
ccttggggattcttccat

SEQ ID NO: 2801885 - DNA, 17 bp, Homo sapiens
ccttggtgtccacctgg

SEQ ID NO: 2801886 - DNA, 20 bp, Homo sapiens
ccttggtgtccacctggccc

SEQ ID NO: 2801887 - DNA, 21 bp, Homo sapiens
ccttggtgtccacctggcccc

SEQ ID NO: 2801888 - DNA, 19 bp, Homo sapiens
ccttggtgtgaccctctga

SEQ ID NO: 2801889 - DNA, 17 bp, Homo sapiens
ccttggttcccttgtgt

SEQ ID NO: 2801890 - DNA, 16 bp, Homo sapiens
ccttgtcactggtaga

SEQ ID NO: 2801891 - DNA, 20 bp, Homo sapiens
ccttgtctggggaccctgta

SEQ ID NO: 2801892 - DNA, 13 bp, Homo sapiens
ccttgttgcatga

SEQ ID NO: 2801893 - DNA, 23 bp, Homo sapiens
cctttatccctgaggtcacctgg

SEQ ID NO: 2801894 - DNA, 17 bp, Homo sapiens
cctttattaatgaactg

SEQ ID NO: 2801895 - DNA, 23 bp, Homo sapiens
cctttattaatgaactgtgacag

SEQ ID NO: 2801896 - DNA, 16 bp, Homo sapiens
cctttccacctgcttt

SEQ ID NO: 2801897 - DNA, 11 bp, Homo sapiens
cctttccataa

SEQ ID NO: 2801898 - DNA, 17 bp, Homo sapiens
cctttcccatgctgaat

SEQ ID NO: 2801899 - DNA, 21 bp, Homo sapiens
cctttccctcaccccctccca

SEQ ID NO: 2801900 - DNA, 14 bp, Homo sapiens
cctttctagttgaa

SEQ ID NO: 2801901 - DNA, 15 bp, Homo sapiens
cctttctccagccag

SEQ ID NO: 2801902 - DNA, 17 bp, Homo sapiens
cctttctccagccagca

SEQ ID NO: 2801903 - DNA, 17 bp, Homo sapiens
cctttctctgagagaga

SEQ ID NO: 2801904 - DNA, 11 bp, Homo sapiens
cctttctgtgg

SEQ ID NO: 2801905 - DNA, 21 bp, Homo sapiens
cctttcttatttgcaataaaa

SEQ ID NO: 2801906 - DNA, 15 bp, Homo sapiens
cctttgagaaagaaa

SEQ ID NO: 2801907 - DNA, 19 bp, Homo sapiens
cctttgaggcaaaggccag

SEQ ID NO: 2801908 - DNA, 15 bp, Homo sapiens
cctttgattccattt

SEQ ID NO: 2801909 - DNA, 19 bp, Homo sapiens
cctttgcactgagggccac

SEQ ID NO: 2801910 - DNA, 20 bp, Homo sapiens
cctttgcattccatgatttt

SEQ ID NO: 2801911 - DNA, 17 bp, Homo sapiens
cctttgccccaaggctg

SEQ ID NO: 2801912 - DNA, 14 bp, Homo sapiens
cctttgccccctgt

SEQ ID NO: 2801913 - DNA, 22 bp, Homo sapiens
cctttgcctaggaggccttctc

SEQ ID NO: 2801914 - DNA, 17 bp, Homo sapiens
cctttggaagaaacagg

SEQ ID NO: 2801915 - DNA, 19 bp, Homo sapiens
cctttggatgaccagaaca

SEQ ID NO: 2801916 - DNA, 19 bp, Homo sapiens
cctttgggaggctgaggcg

SEQ ID NO: 2801917 - DNA, 23 bp, Homo sapiens
cctttgtcatctttcttctattt

SEQ ID NO: 2801918 - DNA, 12 bp, Homo sapiens
cctttgtgtaat

SEQ ID NO: 2801919 - DNA, 19 bp, Homo sapiens
cctttgtttttatgaagaa

SEQ ID NO: 2801920 - DNA, 15 bp, Homo sapiens
ccttttatgttattt

SEQ ID NO: 2801921 - DNA, 12 bp, Homo sapiens
ccttttctgacc

SEQ ID NO: 2801922 - DNA, 17 bp, Homo sapiens
ccttttgcataagatta

SEQ ID NO: 2801923 - DNA, 12 bp, Homo sapiens
ccttttggcact

SEQ ID NO: 2801924 - DNA, 19 bp, Homo sapiens
cgaaacctgtccataaagt

SEQ ID NO: 2801925 - DNA, 23 bp, Homo sapiens
cgaaagggacttggaagctccgc

SEQ ID NO: 2801926 - DNA, 22 bp, Homo sapiens
cgaaagtttcttggtctcagct

SEQ ID NO: 2801927 - DNA, 14 bp, Homo sapiens
cgaaatgttatttt

SEQ ID NO: 2801928 - DNA, 20 bp, Homo sapiens
cgaacatgcctgattttaaa

SEQ ID NO: 2801929 - DNA, 13 bp, Homo sapiens
cgaaccctgccag

SEQ ID NO: 2801930 - DNA, 21 bp, Homo sapiens
cgaagaacaatgtcagaaact

SEQ ID NO: 2801931 - DNA, 16 bp, Homo sapiens
cgaagaccttctgaag

SEQ ID NO: 2801932 - DNA, 22 bp, Homo sapiens
cgaagaccttctgaagatctca

SEQ ID NO: 2801933 - DNA, 18 bp, Homo sapiens
cctgcagcttgtagccag

SEQ ID NO: 2801934 - DNA, 16 bp, Homo sapiens
cctgcaggccaagagc

SEQ ID NO: 2801935 - DNA, 21 bp, Homo sapiens
cctgcaggccaagagcagagg

SEQ ID NO: 2801936 - DNA, 23 bp, Homo sapiens
cctgcatttgtgaaatgatggtg

SEQ ID NO: 2801937 - DNA, 11 bp, Homo sapiens
cctgcatttta

SEQ ID NO: 2801938 - DNA, 19 bp, Homo sapiens
cctgccaccagtcactgtc

SEQ ID NO: 2801939 - DNA, 12 bp, Homo sapiens
cctgccaccctg

SEQ ID NO: 2801940 - DNA, 14 bp, Homo sapiens
cctgccaccctggg

SEQ ID NO: 2801941 - DNA, 16 bp, Homo sapiens
cctgccacctgtctgt

SEQ ID NO: 2801942 - DNA, 16 bp, Homo sapiens
cctgccagcctggctt

SEQ ID NO: 2801943 - DNA, 21 bp, Homo sapiens
cctgccagcctggcttctgga

SEQ ID NO: 2801944 - DNA, 15 bp, Homo sapiens
cctgccagggcccct

SEQ ID NO: 2801945 - DNA, 21 bp, Homo sapiens
cctgcccagcctcgcatgcca

SEQ ID NO: 2801946 - DNA, 22 bp, Homo sapiens
cctgcccaggagagccagccct

SEQ ID NO: 2801947 - DNA, 23 bp, Homo sapiens
cctgcccaggagagccagccctc

SEQ ID NO: 2801948 - DNA, 13 bp, Homo sapiens
cctgcccaggccc

SEQ ID NO: 2801949 - DNA, 15 bp, Homo sapiens
cctgcccaggcccct

SEQ ID NO: 2801950 - DNA, 16 bp, Homo sapiens
cctgcccaggcccctg

SEQ ID NO: 2801951 - DNA, 18 bp, Homo sapiens
cctgcccagtgcacttgc

SEQ ID NO: 2801952 - DNA, 16 bp, Homo sapiens
cctgcccatgggagct

SEQ ID NO: 2801953 - DNA, 17 bp, Homo sapiens
cctgccccaactccttc

SEQ ID NO: 2801954 - DNA, 17 bp, Homo sapiens
cctgcccccagcactcc

SEQ ID NO: 2801955 - DNA, 19 bp, Homo sapiens
cctgcccctcttcccggga

SEQ ID NO: 2801956 - DNA, 19 bp, Homo sapiens
cctgccctagagcacactg

SEQ ID NO: 2801957 - DNA, 14 bp, Homo sapiens
cctgccctcaggga

SEQ ID NO: 2801958 - DNA, 14 bp, Homo sapiens
cctgccctgccacc

SEQ ID NO: 2801959 - DNA, 17 bp, Homo sapiens
cctgccctgccacctgt

SEQ ID NO: 2801960 - DNA, 16 bp, Homo sapiens
cctgccctgccctgcc

SEQ ID NO: 2801961 - DNA, 13 bp, Homo sapiens
cctgccctgctgc

SEQ ID NO: 2801962 - DNA, 15 bp, Homo sapiens
cctgcctacatccca

SEQ ID NO: 2801963 - DNA, 20 bp, Homo sapiens
cctgcctacattccctggcc

SEQ ID NO: 2801964 - DNA, 19 bp, Homo sapiens
cctgcctcgaactggctgc

SEQ ID NO: 2801965 - DNA, 11 bp, Homo sapiens
cctgcctggag

SEQ ID NO: 2801966 - DNA, 22 bp, Homo sapiens
cctgcctggaggacctgagcct

SEQ ID NO: 2801967 - DNA, 17 bp, Homo sapiens
cctgcgaaggggccctg

SEQ ID NO: 2801968 - DNA, 19 bp, Homo sapiens
cctgcgggcttttccccgg

SEQ ID NO: 2801969 - DNA, 17 bp, Homo sapiens
cctgctaattccccaga

SEQ ID NO: 2801970 - DNA, 22 bp, Homo sapiens
cctgctctccgaccagacacct

SEQ ID NO: 2801971 - DNA, 22 bp, Homo sapiens
cctgctctcctcttgccactgc

SEQ ID NO: 2801972 - DNA, 21 bp, Homo sapiens
cctgctgaaacacctcccagg

SEQ ID NO: 2801973 - DNA, 21 bp, Homo sapiens
cctgctgagagacccaaggag

SEQ ID NO: 2801974 - DNA, 13 bp, Homo sapiens
cctgctgagctct

SEQ ID NO: 2801975 - DNA, 15 bp, Homo sapiens
cctgctgagctctga

SEQ ID NO: 2801976 - DNA, 16 bp, Homo sapiens
cctgctgagctctgag

SEQ ID NO: 2801977 - DNA, 22 bp, Homo sapiens
cctgctgccgcctcccagcctg

SEQ ID NO: 2801978 - DNA, 23 bp, Homo sapiens
cctgctgccgcctcccagcctgg

SEQ ID NO: 2801979 - DNA, 20 bp, Homo sapiens
cctgctgctgagaacctggc

SEQ ID NO: 2801980 - DNA, 23 bp, Homo sapiens
cctgctgctgagaacctggcctt

SEQ ID NO: 2801981 - DNA, 24 bp, Homo sapiens
cctgctgctgagaacctggccttc

SEQ ID NO: 2801982 - DNA, 12 bp, Homo sapiens
cctgctgggctc

SEQ ID NO: 2801983 - DNA, 24 bp, Homo sapiens
cctgctgggctctccacctcagcc

SEQ ID NO: 2801984 - DNA, 19 bp, Homo sapiens
cctgctggttcagggttgg

SEQ ID NO: 2801985 - DNA, 20 bp, Homo sapiens
cctgctgtgtgaattcccag

SEQ ID NO: 2801986 - DNA, 14 bp, Homo sapiens
cctgcttcatgctc

SEQ ID NO: 2801987 - DNA, 16 bp, Homo sapiens
cctgcttcatgctcag

SEQ ID NO: 2801988 - DNA, 14 bp, Homo sapiens
cctgcttctgaact

SEQ ID NO: 2801989 - DNA, 18 bp, Homo sapiens
cctgcttgaaggaacagt

SEQ ID NO: 2801990 - DNA, 21 bp, Homo sapiens
cctgcttgaaggaacagtgct

SEQ ID NO: 2801991 - DNA, 18 bp, Homo sapiens
cctgcttgtccctgccca

SEQ ID NO: 2801992 - DNA, 23 bp, Homo sapiens
cctggaaaggctcagtctcagga

SEQ ID NO: 2801993 - DNA, 14 bp, Homo sapiens
cctggaaccaatcc

SEQ ID NO: 2801994 - DNA, 18 bp, Homo sapiens
cctggaagctgtgtcctt

SEQ ID NO: 2801995 - DNA, 23 bp, Homo sapiens
cctggaagctgtgtccttgcacc

SEQ ID NO: 2801996 - DNA, 21 bp, Homo sapiens
cctggcctcctgcctctactg

SEQ ID NO: 2801997 - DNA, 12 bp, Homo sapiens
cctggcctgctg

SEQ ID NO: 2801998 - DNA, 13 bp, Homo sapiens
cctggcctgctgg

SEQ ID NO: 2801999 - DNA, 12 bp, Homo sapiens
cctggcctggca

SEQ ID NO: 2802000 - DNA, 14 bp, Homo sapiens
cctggcctggctct

SEQ ID NO: 2802001 - DNA, 17 bp, Homo sapiens
cctggcctggctctcct

SEQ ID NO: 2802002 - DNA, 17 bp, Homo sapiens
cctggctcaccttgtgc

SEQ ID NO: 2802003 - DNA, 21 bp, Homo sapiens
cctggctccgtccaggagcct

SEQ ID NO: 2802004 - DNA, 21 bp, Homo sapiens
cctggcttcccatccccagcg

SEQ ID NO: 2802005 - DNA, 23 bp, Homo sapiens
cctggcttcccatccccagcgat

SEQ ID NO: 2802006 - DNA, 15 bp, Homo sapiens
cctggcttctggagc

SEQ ID NO: 2802007 - DNA, 22 bp, Homo sapiens
cctggcttgtaactccaccaac

SEQ ID NO: 2802008 - DNA, 18 bp, Homo sapiens
cctggctttgacatgaaa

SEQ ID NO: 2802009 - DNA, 15 bp, Homo sapiens
cctgggaaccatgaa

SEQ ID NO: 2802010 - DNA, 15 bp, Homo sapiens
cctgggaccagggca

SEQ ID NO: 2802011 - DNA, 12 bp, Homo sapiens
cctgggagagaa

SEQ ID NO: 2802012 - DNA, 14 bp, Homo sapiens
cctgggaggcggag

SEQ ID NO: 2802013 - DNA, 16 bp, Homo sapiens
cctgggagtgagctgg

SEQ ID NO: 2802014 - DNA, 16 bp, Homo sapiens
cctgggattcaggaaa

SEQ ID NO: 2802015 - DNA, 18 bp, Homo sapiens
cctgggattcaggaaaag

SEQ ID NO: 2802016 - DNA, 23 bp, Homo sapiens
cctgggattcaggaaaaggcctg

SEQ ID NO: 2802017 - DNA, 13 bp, Homo sapiens
cctgggccccacc

SEQ ID NO: 2802018 - DNA, 23 bp, Homo sapiens
cctgggcccgctttgcctgcttg

SEQ ID NO: 2802019 - DNA, 16 bp, Homo sapiens
cctgggccctggggcc

SEQ ID NO: 2802020 - DNA, 21 bp, Homo sapiens
cctgggccctggggcctgtac

SEQ ID NO: 2802021 - DNA, 18 bp, Homo sapiens
cctgggcctatggagagc

SEQ ID NO: 2802022 - DNA, 16 bp, Homo sapiens
cctgggcctgctgctg

SEQ ID NO: 2802023 - DNA, 19 bp, Homo sapiens
cctgggcctgctgctgaga

SEQ ID NO: 2802024 - DNA, 14 bp, Homo sapiens
cctgggctcatcag

SEQ ID NO: 2802025 - DNA, 14 bp, Homo sapiens
cctgggctctgccc

SEQ ID NO: 2802026 - DNA, 24 bp, Homo sapiens
cctgggctctgccccagctctggc

SEQ ID NO: 2802027 - DNA, 16 bp, Homo sapiens
cctggggcctgtactg

SEQ ID NO: 2802028 - DNA, 20 bp, Homo sapiens
cctggggcctgtactgcctg

SEQ ID NO: 2802029 - DNA, 21 bp, Homo sapiens
cctggggcctgtactgcctgc

SEQ ID NO: 2802030 - DNA, 15 bp, Homo sapiens
cctggggctcctttc

SEQ ID NO: 2802031 - DNA, 23 bp, Homo sapiens
cctggggctctaacgcctgagcc

SEQ ID NO: 2802032 - DNA, 18 bp, Homo sapiens
cctggggctctgtgcagg

SEQ ID NO: 2802033 - DNA, 21 bp, Homo sapiens
cctggggcttctcctgaccca

SEQ ID NO: 2802034 - DNA, 23 bp, Homo sapiens
cctgggggatgtgcacggcagct

SEQ ID NO: 2802035 - DNA, 14 bp, Homo sapiens
cctgggggcctggc

SEQ ID NO: 2802036 - DNA, 18 bp, Homo sapiens
cctgggggttctttcttc

SEQ ID NO: 2802037 - DNA, 21 bp, Homo sapiens
cctgggggttctttcttcctc

SEQ ID NO: 2802038 - DNA, 18 bp, Homo sapiens
cctggggtctctgctgca

SEQ ID NO: 2802039 - DNA, 15 bp, Homo sapiens
cctgggtggctactc

SEQ ID NO: 2802040 - DNA, 22 bp, Homo sapiens
cctgggtggctactctgtgcca

SEQ ID NO: 2802041 - DNA, 21 bp, Homo sapiens
cctggtcacaggactctgcct

SEQ ID NO: 2802042 - DNA, 15 bp, Homo sapiens
cctggtccttccagg

SEQ ID NO: 2802043 - DNA, 19 bp, Homo sapiens
cctggtccttccaggcccc

SEQ ID NO: 2802044 - DNA, 19 bp, Homo sapiens
cctggtgcactggccccac

SEQ ID NO: 2802045 - DNA, 20 bp, Homo sapiens
cctggtgcactggccccacc

SEQ ID NO: 2802046 - DNA, 14 bp, Homo sapiens
cctggtggacagtc

SEQ ID NO: 2802047 - DNA, 17 bp, Homo sapiens
cctggtggacagtcctg

SEQ ID NO: 2802048 - DNA, 13 bp, Homo sapiens
cctggtggcagct

SEQ ID NO: 2802049 - DNA, 16 bp, Homo sapiens
cctggtggcagctgcg

SEQ ID NO: 2802050 - DNA, 18 bp, Homo sapiens
cctggtggcagctgcggt

SEQ ID NO: 2802051 - DNA, 15 bp, Homo sapiens
cctggtggcagtggg

SEQ ID NO: 2802052 - DNA, 18 bp, Homo sapiens
cctggtggcagtgggagc

SEQ ID NO: 2802053 - DNA, 21 bp, Homo sapiens
cctggtggcagtgggagctgc

SEQ ID NO: 2802054 - DNA, 20 bp, Homo sapiens
cctggtggccatgtcgcctg

SEQ ID NO: 2802055 - DNA, 21 bp, Homo sapiens
cctggtggccatgtcgcctgc

SEQ ID NO: 2802056 - DNA, 14 bp, Homo sapiens
cctggtgggcctcc

SEQ ID NO: 2802057 - DNA, 20 bp, Homo sapiens
cctggtgggcctcctctgtc

SEQ ID NO: 2802058 - DNA, 14 bp, Homo sapiens
cctggtggggcagc

SEQ ID NO: 2802059 - DNA, 18 bp, Homo sapiens
cctggtggggcagctcct

SEQ ID NO: 2802060 - DNA, 21 bp, Homo sapiens
cctggtggggcagctcctctg

SEQ ID NO: 2802061 - DNA, 23 bp, Homo sapiens
cctggtggggcagctcctctgtc

SEQ ID NO: 2802062 - DNA, 23 bp, Homo sapiens
cctgtaaatagttttaaatatga

SEQ ID NO: 2802063 - DNA, 21 bp, Homo sapiens
cctgtaacacaagccacagaa

SEQ ID NO: 2802064 - DNA, 21 bp, Homo sapiens
cctgtaatcccagctacacct

SEQ ID NO: 2802065 - DNA, 22 bp, Homo sapiens
cctgtaatcccagctacacctg

SEQ ID NO: 2802066 - DNA, 23 bp, Homo sapiens
cctgtaatcccagctactcagga

SEQ ID NO: 2802067 - DNA, 21 bp, Homo sapiens
cctgtacaatatttaaaattt

SEQ ID NO: 2802068 - DNA, 14 bp, Homo sapiens
cctgtaccccagca

SEQ ID NO: 2802069 - DNA, 20 bp, Homo sapiens
cctgtacgaacccctcccct

SEQ ID NO: 2802070 - DNA, 13 bp, Homo sapiens
cctgtactcagga

SEQ ID NO: 2802071 - DNA, 15 bp, Homo sapiens
cctgtactcaggagg

SEQ ID NO: 2802072 - DNA, 21 bp, Homo sapiens
cctgtactcaggaggctgagg

SEQ ID NO: 2802073 - DNA, 13 bp, Homo sapiens
cctgtactgcctg

SEQ ID NO: 2802074 - DNA, 22 bp, Homo sapiens
cctgtagccccagtgacagcta

SEQ ID NO: 2802075 - DNA, 13 bp, Homo sapiens
cctgtaggttgct

SEQ ID NO: 2802076 - DNA, 13 bp, Homo sapiens
cctgtagtcctag

SEQ ID NO: 2802077 - DNA, 13 bp, Homo sapiens
cctgtagtgagaa

SEQ ID NO: 2802078 - DNA, 14 bp, Homo sapiens
cctgtagtgagaaa

SEQ ID NO: 2802079 - DNA, 16 bp, Homo sapiens
cctgtagtgccccctc

SEQ ID NO: 2802080 - DNA, 14 bp, Homo sapiens
cctgtagttaggaa

SEQ ID NO: 2802081 - DNA, 15 bp, Homo sapiens
cctgtagttaggaaa

SEQ ID NO: 2802082 - DNA, 22 bp, Homo sapiens
cctgtagttaggaaataaaacc

SEQ ID NO: 2802083 - DNA, 23 bp, Homo sapiens
cctgtagttaggaaataaaacct

SEQ ID NO: 2802084 - DNA, 20 bp, Homo sapiens
cctgtagttgcgtggactct

SEQ ID NO: 2802085 - DNA, 20 bp, Homo sapiens
cctgtataatctctctcctg

SEQ ID NO: 2802086 - DNA, 17 bp, Homo sapiens
cctcagcatcctggcac

SEQ ID NO: 2802087 - DNA, 16 bp, Homo sapiens
cctcagccatgaggag

SEQ ID NO: 2802088 - DNA, 21 bp, Homo sapiens
cctcagccatgaggagttgct

SEQ ID NO: 2802089 - DNA, 19 bp, Homo sapiens
cctcagcctagaccctcct

SEQ ID NO: 2802090 - DNA, 11 bp, Homo sapiens
cctcagcctgt

SEQ ID NO: 2802091 - DNA, 16 bp, Homo sapiens
cctcagcctgtgctgc

SEQ ID NO: 2802092 - DNA, 21 bp, Homo sapiens
cctcaggccaggtgcagtggc

SEQ ID NO: 2802093 - DNA, 16 bp, Homo sapiens
cctcaggcttccttgg

SEQ ID NO: 2802094 - DNA, 11 bp, Homo sapiens
cctcagggaca

SEQ ID NO: 2802095 - DNA, 20 bp, Homo sapiens
cctcagggacagagacacct

SEQ ID NO: 2802096 - DNA, 16 bp, Homo sapiens
cctcagtgctcggcag

SEQ ID NO: 2802097 - DNA, 20 bp, Homo sapiens
cctcagtgctcggcagtcat

SEQ ID NO: 2802098 - DNA, 12 bp, Homo sapiens
cctcagtttctc

SEQ ID NO: 2802099 - DNA, 15 bp, Homo sapiens
cctcataccatctgc

SEQ ID NO: 2802100 - DNA, 22 bp, Homo sapiens
cctcatagtatggtggctgggt

SEQ ID NO: 2802101 - DNA, 19 bp, Homo sapiens
cctcatgacagccagagcc

SEQ ID NO: 2802102 - DNA, 13 bp, Homo sapiens
cctaaggacacac

SEQ ID NO: 2802103 - DNA, 17 bp, Homo sapiens
cctaaggacacactaat

SEQ ID NO: 2802104 - DNA, 16 bp, Homo sapiens
cctaaggatctctcag

SEQ ID NO: 2802105 - DNA, 22 bp, Homo sapiens
cctaaggatctctcaggagcac

SEQ ID NO: 2802106 - DNA, 15 bp, Homo sapiens
cctaagtggctgctg

SEQ ID NO: 2802107 - DNA, 21 bp, Homo sapiens
cctaataagtttgatcaaatc

SEQ ID NO: 2802108 - DNA, 17 bp, Homo sapiens
cctaatcaggctgaggt

SEQ ID NO: 2802109 - DNA, 16 bp, Homo sapiens
cctacagatagtcaaa

SEQ ID NO: 2802110 - DNA, 15 bp, Homo sapiens
cctacagtggctgtc

SEQ ID NO: 2802111 - DNA, 16 bp, Homo sapiens
tctttaaaagaaagtt

SEQ ID NO: 2802112 - DNA, 13 bp, Homo sapiens
tctttaaatcaaa

SEQ ID NO: 2802113 - DNA, 23 bp, Homo sapiens
tctttaatcattttgcctctttt

SEQ ID NO: 2802114 - DNA, 18 bp, Homo sapiens
tctttaatgtcacaggca

SEQ ID NO: 2802115 - DNA, 18 bp, Homo sapiens
tctttacctgagaccagt

SEQ ID NO: 2802116 - DNA, 20 bp, Homo sapiens
tctttaggtgcctcctgtct

SEQ ID NO: 2802117 - DNA, 13 bp, Homo sapiens
tctttattcctcc

SEQ ID NO: 2802118 - DNA, 16 bp, Homo sapiens
tctttcaagtgaatct

SEQ ID NO: 2802119 - DNA, 18 bp, Homo sapiens
tctttcctctccaattgt

SEQ ID NO: 2802120 - DNA, 22 bp, Homo sapiens
tctttcctcttccccttgccct

SEQ ID NO: 2802121 - DNA, 18 bp, Homo sapiens
tctttcctgttgttgtta

SEQ ID NO: 2802122 - DNA, 18 bp, Homo sapiens
tctttctaatgtgtgaat

SEQ ID NO: 2802123 - DNA, 18 bp, Homo sapiens
tctttctcactaaatctt

SEQ ID NO: 2802124 - DNA, 17 bp, Homo sapiens
tctttctccaaagttat

SEQ ID NO: 2802125 - DNA, 21 bp, Homo sapiens
tctttctccaaagttatccag

SEQ ID NO: 2802126 - DNA, 17 bp, Homo sapiens
tctttcttattttgtaa

SEQ ID NO: 2802127 - DNA, 10 bp, Homo sapiens
tctttgaata

SEQ ID NO: 2802128 - DNA, 14 bp, Homo sapiens
tctttgaataaagt

SEQ ID NO: 2802129 - DNA, 15 bp, Homo sapiens
tctttgaataaagtc

SEQ ID NO: 2802130 - DNA, 13 bp, Homo sapiens
tctttgcagacag

SEQ ID NO: 2802131 - DNA, 14 bp, Homo sapiens
tctttgcctgtgtg

SEQ ID NO: 2802132 - DNA, 18 bp, Homo sapiens
tctttggggtcagccagg

SEQ ID NO: 2802133 - DNA, 23 bp, Homo sapiens
tctttgtaatcgttatgtgtgta

SEQ ID NO: 2802134 - DNA, 17 bp, Homo sapiens
tctttgtaccatctgtc

SEQ ID NO: 2802135 - DNA, 16 bp, Homo sapiens
tcttttcccacattca

SEQ ID NO: 2802136 - DNA, 21 bp, Homo sapiens
tcttttgcccttcacagtgtt

SEQ ID NO: 2802137 - DNA, 13 bp, Homo sapiens
tctttttcaaaaa

SEQ ID NO: 2802138 - DNA, 14 bp, Homo sapiens
tctttttcaaaaat

SEQ ID NO: 2802139 - DNA, 12 bp, Homo sapiens
tctttttcagtt

SEQ ID NO: 2802140 - DNA, 11 bp, Homo sapiens
tgaaaaacaag

SEQ ID NO: 2802141 - DNA, 18 bp, Homo sapiens
tgaaaacagatgcccccg

SEQ ID NO: 2802142 - DNA, 19 bp, Homo sapiens
tgaaaacatggtagaattg

SEQ ID NO: 2802143 - DNA, 21 bp, Homo sapiens
tgaaaactggaataagaagca

SEQ ID NO: 2802144 - DNA, 13 bp, Homo sapiens
tgaaaactgtaaa

SEQ ID NO: 2802145 - DNA, 22 bp, Homo sapiens
tgaaaaggtttatgaaaaagaa

SEQ ID NO: 2802146 - DNA, 17 bp, Homo sapiens
tgaaaataaagtgtata

SEQ ID NO: 2802147 - DNA, 16 bp, Homo sapiens
tgaaaatgagcctgta

SEQ ID NO: 2802148 - DNA, 22 bp, Homo sapiens
tgaaaatgagcctgtaatcctc

SEQ ID NO: 2802149 - DNA, 23 bp, Homo sapiens
tgaaaatgcaacaacatgtataa

SEQ ID NO: 2802150 - DNA, 16 bp, Homo sapiens
tgaaaattaacactgc

SEQ ID NO: 2802151 - DNA, 20 bp, Homo sapiens
tgaaaattaggatttcatga

SEQ ID NO: 2802152 - DNA, 17 bp, Homo sapiens
tgaaaattatttaaacc

SEQ ID NO: 2802153 - DNA, 17 bp, Homo sapiens
tgaaacttaattacatc

SEQ ID NO: 2802154 - DNA, 14 bp, Homo sapiens
tgaaagaaggagca

SEQ ID NO: 2802155 - DNA, 19 bp, Homo sapiens
tgaaagaccttctccaaat

SEQ ID NO: 2802156 - DNA, 23 bp, Homo sapiens
tgaaagatggctgtgcctctgcc

SEQ ID NO: 2802157 - DNA, 16 bp, Homo sapiens
tgaaagccaaatttat

SEQ ID NO: 2802158 - DNA, 23 bp, Homo sapiens
tgaaagccagctgccgaccagag

SEQ ID NO: 2802159 - DNA, 15 bp, Homo sapiens
tgaaagcctctggaa

SEQ ID NO: 2802160 - DNA, 21 bp, Homo sapiens
tgaaagggtcaacggccctgt

SEQ ID NO: 2802161 - DNA, 14 bp, Homo sapiens
tgaaagtatgtgat

SEQ ID NO: 2802162 - DNA, 17 bp, Homo sapiens
tgaaagtgacagagacc

SEQ ID NO: 2802163 - DNA, 13 bp, Homo sapiens
tgaaataattaaa

SEQ ID NO: 2802164 - DNA, 16 bp, Homo sapiens
tgaaataccagtgtgg

SEQ ID NO: 2802165 - DNA, 19 bp, Homo sapiens
tgaaatatttaagtatata

SEQ ID NO: 2802166 - DNA, 14 bp, Homo sapiens
tgaaatatttgctt

SEQ ID NO: 2802167 - DNA, 18 bp, Homo sapiens
tgaaatatttgcttattt

SEQ ID NO: 2802168 - DNA, 22 bp, Homo sapiens
tgaaatatttgcttatttatat

SEQ ID NO: 2802169 - DNA, 14 bp, Homo sapiens
tgaaatcctgcttc

SEQ ID NO: 2802170 - DNA, 21 bp, Homo sapiens
tgaaatgaaacaaataatcac

SEQ ID NO: 2802171 - DNA, 13 bp, Homo sapiens
tgaaatgtttcac

SEQ ID NO: 2802172 - DNA, 22 bp, Homo sapiens
tgaaattaactgggtaatgaaa

SEQ ID NO: 2802173 - DNA, 20 bp, Homo sapiens
tgaaattactacaaaatttg

SEQ ID NO: 2802174 - DNA, 23 bp, Homo sapiens
tgaaattactacaaaatttgaaa

SEQ ID NO: 2802175 - DNA, 22 bp, Homo sapiens
tgaaatttcagattcccagagc

SEQ ID NO: 2802176 - DNA, 12 bp, Homo sapiens
tgaacaaaagct

SEQ ID NO: 2802177 - DNA, 22 bp, Homo sapiens
tgaacaaagggattctccagga

SEQ ID NO: 2802178 - DNA, 12 bp, Homo sapiens
tgaacaagaatt

SEQ ID NO: 2802179 - DNA, 14 bp, Homo sapiens
tgaacaagaattgg

SEQ ID NO: 2802180 - DNA, 19 bp, Homo sapiens
tgaacaagttgtttcattg

SEQ ID NO: 2802181 - DNA, 22 bp, Homo sapiens
tgaacaatacgtgaaagatgca

SEQ ID NO: 2802182 - DNA, 17 bp, Homo sapiens
tgaacacatactagaaa

SEQ ID NO: 2802183 - DNA, 17 bp, Homo sapiens
tgaacaccaacttttat

SEQ ID NO: 2802184 - DNA, 16 bp, Homo sapiens
tgaacaccactttgtc

SEQ ID NO: 2802185 - DNA, 17 bp, Homo sapiens
tgaacactgggggaggg

SEQ ID NO: 2802186 - DNA, 19 bp, Homo sapiens
tgaaccacatcttgctctg

SEQ ID NO: 2802187 - DNA, 20 bp, Homo sapiens
tgaaccacatcttgctctgc

SEQ ID NO: 2802188 - DNA, 21 bp, Homo sapiens
tgaaccaccacacccagccca

SEQ ID NO: 2802189 - DNA, 22 bp, Homo sapiens
tgaaccaccacacccagcccac

SEQ ID NO: 2802190 - DNA, 21 bp, Homo sapiens
tgaaccatcattataaacgtg

SEQ ID NO: 2802191 - DNA, 15 bp, Homo sapiens
tgaaccatccttccc

SEQ ID NO: 2802192 - DNA, 22 bp, Homo sapiens
tgaacccaggacaagcatggtc

SEQ ID NO: 2802193 - DNA, 19 bp, Homo sapiens
tgaacccattttgagtgac

SEQ ID NO: 2802194 - DNA, 14 bp, Homo sapiens
tgaacccctgtgtc

SEQ ID NO: 2802195 - DNA, 14 bp, Homo sapiens
tgaaccgacttttc

SEQ ID NO: 2802196 - DNA, 22 bp, Homo sapiens
tgaaccgacttttctaaagctc

SEQ ID NO: 2802197 - DNA, 21 bp, Homo sapiens
tgaacctgggaaccatgaagc

SEQ ID NO: 2802198 - DNA, 13 bp, Homo sapiens
tgaactcaagctg

SEQ ID NO: 2802199 - DNA, 14 bp, Homo sapiens
tgaactcaagctgc

SEQ ID NO: 2802200 - DNA, 15 bp, Homo sapiens
tgaactcctggcctc

SEQ ID NO: 2802201 - DNA, 17 bp, Homo sapiens
tgaactcctggcctcaa

SEQ ID NO: 2802202 - DNA, 15 bp, Homo sapiens
tgaactcttaatcaa

SEQ ID NO: 2802203 - DNA, 16 bp, Homo sapiens
tgaactgcgtgccagt

SEQ ID NO: 2802204 - DNA, 12 bp, Homo sapiens
tgaactgtgaca

SEQ ID NO: 2802205 - DNA, 13 bp, Homo sapiens
tgaactgtgacag

SEQ ID NO: 2802206 - DNA, 16 bp, Homo sapiens
tgaactgtgacaggaa

SEQ ID NO: 2802207 - DNA, 19 bp, Homo sapiens
tgaactgtgatggggtggg

SEQ ID NO: 2802208 - DNA, 19 bp, Homo sapiens
tgaacttgaggacacatgt

SEQ ID NO: 2802209 - DNA, 18 bp, Homo sapiens
tgaagaaaaaatacattt

SEQ ID NO: 2802210 - DNA, 17 bp, Homo sapiens
tgaagaaaactccttta

SEQ ID NO: 2802211 - DNA, 13 bp, Homo sapiens
tgaagaaatggaa

SEQ ID NO: 2802212 - DNA, 20 bp, Homo sapiens
tgaagaacagtaactgccat

SEQ ID NO: 2802213 - DNA, 15 bp, Homo sapiens
tgaagaagggaaatt

SEQ ID NO: 2802214 - DNA, 16 bp, Homo sapiens
tgaagaatacttctca

SEQ ID NO: 2802215 - DNA, 13 bp, Homo sapiens
tgaagaatattgt

SEQ ID NO: 2802216 - DNA, 14 bp, Homo sapiens
tgaagacaggacag

SEQ ID NO: 2802217 - DNA, 15 bp, Homo sapiens
tgaagacccagcagg

SEQ ID NO: 2802218 - DNA, 20 bp, Homo sapiens
tgaagacccagtgtaaagaa

SEQ ID NO: 2802219 - DNA, 15 bp, Homo sapiens
tgaagagagatatat

SEQ ID NO: 2802220 - DNA, 21 bp, Homo sapiens
tgaagagagatatatctgaaa

SEQ ID NO: 2802221 - DNA, 22 bp, Homo sapiens
tgaagatctaaatagcccttgg

SEQ ID NO: 2802222 - DNA, 21 bp, Homo sapiens
tgaagatctcagataaagtga

SEQ ID NO: 2802223 - DNA, 13 bp, Homo sapiens
tgaagatttcaga

SEQ ID NO: 2802224 - DNA, 16 bp, Homo sapiens
tgaagccactgaagct

SEQ ID NO: 2802225 - DNA, 19 bp, Homo sapiens
tgaagctggaagcactgct

SEQ ID NO: 2802226 - DNA, 20 bp, Homo sapiens
tgaaggaataaattgctcct

SEQ ID NO: 2802227 - DNA, 21 bp, Homo sapiens
tgaaggaccctggctcttctc

SEQ ID NO: 2802228 - DNA, 23 bp, Homo sapiens
tgaaggaccctggctcttctctc

SEQ ID NO: 2802229 - DNA, 13 bp, Homo sapiens
tgaaggagaaaat

SEQ ID NO: 2802230 - DNA, 23 bp, Homo sapiens
tgaaggagaaaatgcattatgtg

SEQ ID NO: 2802231 - DNA, 16 bp, Homo sapiens
tgaaggagagcccttc

SEQ ID NO: 2802232 - DNA, 20 bp, Homo sapiens
tgaaggagagcccttcattt

SEQ ID NO: 2802233 - DNA, 13 bp, Homo sapiens
tgaaggaggtgag

SEQ ID NO: 2802234 - DNA, 21 bp, Homo sapiens
tgaagggaaaggatattttct

SEQ ID NO: 2802235 - DNA, 22 bp, Homo sapiens
tgaagggaaaggatattttctt

SEQ ID NO: 2802236 - DNA, 18 bp, Homo sapiens
tgaagggggcggcctatg

SEQ ID NO: 2802237 - DNA, 19 bp, Homo sapiens
tgaagtaaaggattgatca

SEQ ID NO: 2802238 - DNA, 14 bp, Homo sapiens
tgaagtcacacagt

SEQ ID NO: 2802239 - DNA, 18 bp, Homo sapiens
tgaagtgatgatggatga

SEQ ID NO: 2802240 - DNA, 16 bp, Homo sapiens
tgaagtgtgtttcctt

SEQ ID NO: 2802241 - DNA, 15 bp, Homo sapiens
tgaataaacttcagc

SEQ ID NO: 2802242 - DNA, 18 bp, Homo sapiens
tgaataaacttcagcacc

SEQ ID NO: 2802243 - DNA, 18 bp, Homo sapiens
tgaataaagcctgctttt

SEQ ID NO: 2802244 - DNA, 18 bp, Homo sapiens
tgaataaagtctgagtgg

SEQ ID NO: 2802245 - DNA, 19 bp, Homo sapiens
tgaataaagtctgagtggg

SEQ ID NO: 2802246 - DNA, 22 bp, Homo sapiens
tgaataaagttagtgtgttgtc

SEQ ID NO: 2802247 - DNA, 17 bp, Homo sapiens
tgaataaagttgaagct

SEQ ID NO: 2802248 - DNA, 18 bp, Homo sapiens
tgaatatattataatctt

SEQ ID NO: 2802249 - DNA, 18 bp, Homo sapiens
tgaatcagaccctacccc

SEQ ID NO: 2802250 - DNA, 21 bp, Homo sapiens
tgaatcagaccctaccccacc

SEQ ID NO: 2802251 - DNA, 22 bp, Homo sapiens
tgaatcagaccctaccccacca

SEQ ID NO: 2802252 - DNA, 18 bp, Homo sapiens
tgaatccatcaggacttg

SEQ ID NO: 2802253 - DNA, 20 bp, Homo sapiens
tgaatcccacccacatgtga

SEQ ID NO: 2802254 - DNA, 15 bp, Homo sapiens
tgaatcctaagggct

SEQ ID NO: 2802255 - DNA, 23 bp, Homo sapiens
tgaatctgattggacattttctt

SEQ ID NO: 2802256 - DNA, 19 bp, Homo sapiens
tgaatgaggtcccaggcag

SEQ ID NO: 2802257 - DNA, 15 bp, Homo sapiens
tgaatgctattgaaa

SEQ ID NO: 2802258 - DNA, 17 bp, Homo sapiens
tgaatggcctgccttga

SEQ ID NO: 2802259 - DNA, 17 bp, Homo sapiens
tgaatggtgcagaaaaa

SEQ ID NO: 2802260 - DNA, 19 bp, Homo sapiens
tgaatggttccatgcctga

SEQ ID NO: 2802261 - DNA, 21 bp, Homo sapiens
tgaatggttccatgcctgagg

SEQ ID NO: 2802262 - DNA, 14 bp, Homo sapiens
tgaatgtgtcacta

SEQ ID NO: 2802263 - DNA, 16 bp, Homo sapiens
tgaatgtgttgatttg

SEQ ID NO: 2802264 - DNA, 22 bp, Homo sapiens
tgaatgtttacactctttgtaa

SEQ ID NO: 2802265 - DNA, 11 bp, Homo sapiens
tgaattaaaac

SEQ ID NO: 2802266 - DNA, 11 bp, Homo sapiens
tgaattaaatt

SEQ ID NO: 2802267 - DNA, 20 bp, Homo sapiens
tgaattattttgttgtgatt

SEQ ID NO: 2802268 - DNA, 13 bp, Homo sapiens
tgaattctctcta

SEQ ID NO: 2802269 - DNA, 21 bp, Homo sapiens
tgaattctctctaaaaataaa

SEQ ID NO: 2802270 - DNA, 20 bp, Homo sapiens
tgaattctggaggaagaaga

SEQ ID NO: 2802271 - DNA, 17 bp, Homo sapiens
tgaattctgtgaagaat

SEQ ID NO: 2802272 - DNA, 20 bp, Homo sapiens
tgaattctgtgaagaatgaa

SEQ ID NO: 2802273 - DNA, 15 bp, Homo sapiens
tgaattgtccccagt

SEQ ID NO: 2802274 - DNA, 17 bp, Homo sapiens
tgaattgtgaccaagtt

SEQ ID NO: 2802275 - DNA, 14 bp, Homo sapiens
tgaatttatctgaa

SEQ ID NO: 2802276 - DNA, 13 bp, Homo sapiens
tgaatttctaaaa

SEQ ID NO: 2802277 - DNA, 14 bp, Homo sapiens
tgaatttggagact

SEQ ID NO: 2802278 - DNA, 17 bp, Homo sapiens
tgaatttggagactctg

SEQ ID NO: 2802279 - DNA, 20 bp, Homo sapiens
tgaatttggagactctgtgg

SEQ ID NO: 2802280 - DNA, 20 bp, Homo sapiens
tgaatttggcctgcactaat

SEQ ID NO: 2802281 - DNA, 21 bp, Homo sapiens
tgaatttggcctgcactaatt

SEQ ID NO: 2802282 - DNA, 19 bp, Homo sapiens
tgaatttttttttcctagc

SEQ ID NO: 2802283 - DNA, 14 bp, Homo sapiens
tgacaaaataacat

SEQ ID NO: 2802284 - DNA, 17 bp, Homo sapiens
tgacaaaataacatttg

SEQ ID NO: 2802285 - DNA, 15 bp, Homo sapiens
tgacaaagaaaccca

SEQ ID NO: 2802286 - DNA, 16 bp, Homo sapiens
tgacaacctttgtgta

SEQ ID NO: 2802287 - DNA, 18 bp, Homo sapiens
tgactgtcgtgtttacaa

SEQ ID NO: 2802288 - DNA, 17 bp, Homo sapiens
tgactgtgttcagtgcc

SEQ ID NO: 2802289 - DNA, 22 bp, Homo sapiens
tgactgtgttcagtgccttgga

SEQ ID NO: 2802290 - DNA, 19 bp, Homo sapiens
tgactgtttttcggacagt

SEQ ID NO: 2802291 - DNA, 14 bp, Homo sapiens
tgacttactgtttc

SEQ ID NO: 2802292 - DNA, 15 bp, Homo sapiens
tgacttactgtttct

SEQ ID NO: 2802293 - DNA, 21 bp, Homo sapiens
tctgtgactcgcttagctgaa

SEQ ID NO: 2802294 - DNA, 20 bp, Homo sapiens
tctgtgcagatgagcagtca

SEQ ID NO: 2802295 - DNA, 13 bp, Homo sapiens
tctgtgccagagc

SEQ ID NO: 2802296 - DNA, 18 bp, Homo sapiens
tctgtgccagagcctggg

SEQ ID NO: 2802297 - DNA, 19 bp, Homo sapiens
tctgtgccagagcctgggg

SEQ ID NO: 2802298 - DNA, 20 bp, Homo sapiens
tctgtgccagagcctggggc

SEQ ID NO: 2802299 - DNA, 22 bp, Homo sapiens
tctgtgcccctgtaaatagttt

SEQ ID NO: 2802300 - DNA, 20 bp, Homo sapiens
tctgtgctttgactcacctg

SEQ ID NO: 2802301 - DNA, 17 bp, Homo sapiens
tctgtgtcaggtggggc

SEQ ID NO: 2802302 - DNA, 21 bp, Homo sapiens
tctgtgtgcacaaatatttat

SEQ ID NO: 2802303 - DNA, 14 bp, Homo sapiens
tctgttatcctgct

SEQ ID NO: 2802304 - DNA, 16 bp, Homo sapiens
tctgtttttaaaaatc

SEQ ID NO: 2802305 - DNA, 18 bp, Homo sapiens
tcttaaaaaataaaaact

SEQ ID NO: 2802306 - DNA, 19 bp, Homo sapiens
tcttaaagctgcctgtagt

SEQ ID NO: 2802307 - DNA, 16 bp, Homo sapiens
tcttaaataagaaact

SEQ ID NO: 2802308 - DNA, 17 bp, Homo sapiens
tcttacccatatatctt

SEQ ID NO: 2802309 - DNA, 21 bp, Homo sapiens
tcttacctgtatgtctccagt

SEQ ID NO: 2802310 - DNA, 23 bp, Homo sapiens
tcttacctgtatgtctccagtat

SEQ ID NO: 2802311 - DNA, 16 bp, Homo sapiens
tcttactaaacatttt

SEQ ID NO: 2802312 - DNA, 15 bp, Homo sapiens
tcttacttggaactg

SEQ ID NO: 2802313 - DNA, 21 bp, Homo sapiens
tcttagaagtggaccaggaca

SEQ ID NO: 2802314 - DNA, 15 bp, Homo sapiens
tcttagctgtctgct

SEQ ID NO: 2802315 - DNA, 23 bp, Homo sapiens
tcttagctgtctgctcagacaga

SEQ ID NO: 2802316 - DNA, 15 bp, Homo sapiens
tcttagctttccaca

SEQ ID NO: 2802317 - DNA, 15 bp, Homo sapiens
tcttaggaagagaaa

SEQ ID NO: 2802318 - DNA, 13 bp, Homo sapiens
tcttatagaaagt

SEQ ID NO: 2802319 - DNA, 15 bp, Homo sapiens
tcttattctcactcc

SEQ ID NO: 2802320 - DNA, 19 bp, Homo sapiens
tcttatttatatatgaagt

SEQ ID NO: 2802321 - DNA, 12 bp, Homo sapiens
tcttatttgcaa

SEQ ID NO: 2802322 - DNA, 14 bp, Homo sapiens
tcttattttgtaat

SEQ ID NO: 2802323 - DNA, 15 bp, Homo sapiens
tcttattttgtaata

SEQ ID NO: 2802324 - DNA, 19 bp, Homo sapiens
tcttattttgtaataaact

SEQ ID NO: 2802325 - DNA, 18 bp, Homo sapiens
tcttcagaagacactgca

SEQ ID NO: 2802326 - DNA, 16 bp, Homo sapiens
tcttcagagcaggggt

SEQ ID NO: 2802327 - DNA, 19 bp, Homo sapiens
tcttcagccacctctcttt

SEQ ID NO: 2802328 - DNA, 16 bp, Homo sapiens
tcttcaggtggaaaaa

SEQ ID NO: 2802329 - DNA, 18 bp, Homo sapiens
tcttcagttttatcttta

SEQ ID NO: 2802330 - DNA, 20 bp, Homo sapiens
tcttcatcagcatttaataa

SEQ ID NO: 2802331 - DNA, 17 bp, Homo sapiens
tcttcatgcaatgacat

SEQ ID NO: 2802332 - DNA, 14 bp, Homo sapiens
tcttccccactccc

SEQ ID NO: 2802333 - DNA, 13 bp, Homo sapiens
tcttccccttgcc

SEQ ID NO: 2802334 - DNA, 15 bp, Homo sapiens
tcttccccttgccct

SEQ ID NO: 2802335 - DNA, 17 bp, Homo sapiens
tcttcctaccaaatata

SEQ ID NO: 2802336 - DNA, 22 bp, Homo sapiens
tcttcctaccaaatataaactt

SEQ ID NO: 2802337 - DNA, 19 bp, Homo sapiens
tcttcctagtatattagtt

SEQ ID NO: 2802338 - DNA, 21 bp, Homo sapiens
tcttcctagttttctcctccc

SEQ ID NO: 2802339 - DNA, 23 bp, Homo sapiens
tcttcctagttttctcctcccag

SEQ ID NO: 2802340 - DNA, 14 bp, Homo sapiens
tcttcctctgctga

SEQ ID NO: 2802341 - DNA, 13 bp, Homo sapiens
tcttccttccccc

SEQ ID NO: 2802342 - DNA, 13 bp, Homo sapiens
tcttcgaggtgga

SEQ ID NO: 2802343 - DNA, 19 bp, Homo sapiens
tcttcgctgctagagaagg

SEQ ID NO: 2802344 - DNA, 14 bp, Homo sapiens
tcttctaaaatgct

SEQ ID NO: 2802345 - DNA, 16 bp, Homo sapiens
tcttctaaaatgcttt

SEQ ID NO: 2802346 - DNA, 21 bp, Homo sapiens
tcttctaaaatgcttttaatt

SEQ ID NO: 2802347 - DNA, 17 bp, Homo sapiens
tcttctacaaccagagc

SEQ ID NO: 2802348 - DNA, 18 bp, Homo sapiens
tcttctacgtataaatat

SEQ ID NO: 2802349 - DNA, 19 bp, Homo sapiens
tcttctacgtataaatatg

SEQ ID NO: 2802350 - DNA, 15 bp, Homo sapiens
tcttctattttattc

SEQ ID NO: 2802351 - DNA, 12 bp, Homo sapiens
tcttctccatct

SEQ ID NO: 2802352 - DNA, 15 bp, Homo sapiens
tcttctccttggagg

SEQ ID NO: 2802353 - DNA, 12 bp, Homo sapiens
tcttctctccat

SEQ ID NO: 2802354 - DNA, 13 bp, Homo sapiens
tcttctcttcctg

SEQ ID NO: 2802355 - DNA, 12 bp, Homo sapiens
tcttctgcttca

SEQ ID NO: 2802356 - DNA, 23 bp, Homo sapiens
tcttctgtacgtctgacaggcaa

SEQ ID NO: 2802357 - DNA, 21 bp, Homo sapiens
tcttcttttaaaccattttct

SEQ ID NO: 2802358 - DNA, 17 bp, Homo sapiens
tcttctttttttgtgat

SEQ ID NO: 2802359 - DNA, 16 bp, Homo sapiens
tcttgaactcctggcc

SEQ ID NO: 2802360 - DNA, 18 bp, Homo sapiens
tcttgaactcctggcctc

SEQ ID NO: 2802361 - DNA, 11 bp, Homo sapiens
tcttgaagaat

SEQ ID NO: 2802362 - DNA, 19 bp, Homo sapiens
tcttgacattcaaggcatt

SEQ ID NO: 2802363 - DNA, 17 bp, Homo sapiens
tcttgcaatggcagcct

SEQ ID NO: 2802364 - DNA, 16 bp, Homo sapiens
tcttgccactgcctct

SEQ ID NO: 2802365 - DNA, 14 bp, Homo sapiens
tcttgccccttggg

SEQ ID NO: 2802366 - DNA, 11 bp, Homo sapiens
tcttgcctgaa

SEQ ID NO: 2802367 - DNA, 22 bp, Homo sapiens
tcttgcctttcttatttgcaat

SEQ ID NO: 2802368 - DNA, 13 bp, Homo sapiens
tcttgctctgctg

SEQ ID NO: 2802369 - DNA, 14 bp, Homo sapiens
tcttgctctgctga

SEQ ID NO: 2802370 - DNA, 15 bp, Homo sapiens
tcttgctctgctgac

SEQ ID NO: 2802371 - DNA, 16 bp, Homo sapiens
tcttggacactgtaca

SEQ ID NO: 2802372 - DNA, 14 bp, Homo sapiens
tcttggacctctgc

SEQ ID NO: 2802373 - DNA, 23 bp, Homo sapiens
tcttggacctctgctctgaggct

SEQ ID NO: 2802374 - DNA, 18 bp, Homo sapiens
tcttggagaactttccat

SEQ ID NO: 2802375 - DNA, 13 bp, Homo sapiens
tcttggcccctgt

SEQ ID NO: 2802376 - DNA, 16 bp, Homo sapiens
tcttggccgactcagg

SEQ ID NO: 2802377 - DNA, 17 bp, Homo sapiens
tcttggccgactcaggg

SEQ ID NO: 2802378 - DNA, 16 bp, Homo sapiens
tcttgggtaggcggga

SEQ ID NO: 2802379 - DNA, 17 bp, Homo sapiens
tcttggtctcagcttca

SEQ ID NO: 2802380 - DNA, 17 bp, Homo sapiens
tcttgtacatgtgtagc

SEQ ID NO: 2802381 - DNA, 18 bp, Homo sapiens
tcttgtattttcttccca

SEQ ID NO: 2802382 - DNA, 13 bp, Homo sapiens
tcttgtctctggg

SEQ ID NO: 2802383 - DNA, 14 bp, Homo sapiens
tcttgtctctgggc

SEQ ID NO: 2802384 - DNA, 14 bp, Homo sapiens
tgaggagtctgagg

SEQ ID NO: 2802385 - DNA, 21 bp, Homo sapiens
tgaggagtctgaggtcctgag

SEQ ID NO: 2802386 - DNA, 17 bp, Homo sapiens
tgaggatgcaacaaata

SEQ ID NO: 2802387 - DNA, 14 bp, Homo sapiens
tgaggcaagagaat

SEQ ID NO: 2802388 - DNA, 17 bp, Homo sapiens
tgaggcaatgtcaggaa

SEQ ID NO: 2802389 - DNA, 21 bp, Homo sapiens
tgaggcaatgtcaggaacaga

SEQ ID NO: 2802390 - DNA, 18 bp, Homo sapiens
tgaggcagaagaattgaa

SEQ ID NO: 2802391 - DNA, 14 bp, Homo sapiens
tgaggcagacagca

SEQ ID NO: 2802392 - DNA, 16 bp, Homo sapiens
tgaggcagacagcagc

SEQ ID NO: 2802393 - DNA, 13 bp, Homo sapiens
tgaggccagcctg

SEQ ID NO: 2802394 - DNA, 21 bp, Homo sapiens
tgaggccagcctggcctcctg

SEQ ID NO: 2802395 - DNA, 22 bp, Homo sapiens
tgaggccagcctggcctcctgc

SEQ ID NO: 2802396 - DNA, 14 bp, Homo sapiens
tgaggcctcttgga

SEQ ID NO: 2802397 - DNA, 17 bp, Homo sapiens
tgaggcctgccctcagg

SEQ ID NO: 2802398 - DNA, 19 bp, Homo sapiens
tgaggcctgccctcaggga

SEQ ID NO: 2802399 - DNA, 16 bp, Homo sapiens
tgaggcctggccaggc

SEQ ID NO: 2802400 - DNA, 21 bp, Homo sapiens
tgaggcctttccccagtgtgg

SEQ ID NO: 2802401 - DNA, 22 bp, Homo sapiens
tgaggcctttccccagtgtggc

SEQ ID NO: 2802402 - DNA, 16 bp, Homo sapiens
tgaggctctttctggg

SEQ ID NO: 2802403 - DNA, 18 bp, Homo sapiens
tgagggcagttcgcagcc

SEQ ID NO: 2802404 - DNA, 19 bp, Homo sapiens
tgagggcagttcgcagcca

SEQ ID NO: 2802405 - DNA, 20 bp, Homo sapiens
tgagggcagttcgcagccac

SEQ ID NO: 2802406 - DNA, 23 bp, Homo sapiens
tgagggcagttcgcagccaccct

SEQ ID NO: 2802407 - DNA, 15 bp, Homo sapiens
tgaggggctcctgga

SEQ ID NO: 2802408 - DNA, 18 bp, Homo sapiens
tgaggtcagagcctgcag

SEQ ID NO: 2802409 - DNA, 13 bp, Homo sapiens
tgaggtcccaggc

SEQ ID NO: 2802410 - DNA, 15 bp, Homo sapiens
tgaggtcccaggcag

SEQ ID NO: 2802411 - DNA, 19 bp, Homo sapiens
tgaggtcccaggcagagaa

SEQ ID NO: 2802412 - DNA, 15 bp, Homo sapiens
tgaggtcctgagcac

SEQ ID NO: 2802413 - DNA, 14 bp, Homo sapiens
tgaggtgcccagga

SEQ ID NO: 2802414 - DNA, 17 bp, Homo sapiens
tgaggtgcccaggagaa

SEQ ID NO: 2802415 - DNA, 18 bp, Homo sapiens
tgaggtgcccaggagaag

SEQ ID NO: 2802416 - DNA, 20 bp, Homo sapiens
tgaggtggaagccctccttc

SEQ ID NO: 2802417 - DNA, 21 bp, Homo sapiens
tgaggtggaagccctccttcc

SEQ ID NO: 2802418 - DNA, 22 bp, Homo sapiens
tgaggtggaagccctccttcca

SEQ ID NO: 2802419 - DNA, 12 bp, Homo sapiens
tgaggttaggag

SEQ ID NO: 2802420 - DNA, 14 bp, Homo sapiens
tgagtcaccaagcc

SEQ ID NO: 2802421 - DNA, 13 bp, Homo sapiens
tgagtcaccagga

SEQ ID NO: 2802422 - DNA, 20 bp, Homo sapiens
tgagtcaccctacctgtgcc

SEQ ID NO: 2802423 - DNA, 22 bp, Homo sapiens
tgagtcaccctacctgtgcctg

SEQ ID NO: 2802424 - DNA, 22 bp, Homo sapiens
tgagtcatgatctccctgccgc

SEQ ID NO: 2802425 - DNA, 15 bp, Homo sapiens
tgagtctcctctctg

SEQ ID NO: 2802426 - DNA, 15 bp, Homo sapiens
tgagtctcttcagaa

SEQ ID NO: 2802427 - DNA, 18 bp, Homo sapiens
tgagtgagccacagacca

SEQ ID NO: 2802428 - DNA, 15 bp, Homo sapiens
tgagtgatcctccaa

SEQ ID NO: 2802429 - DNA, 21 bp, Homo sapiens
tgagtgattgacacacagcac

SEQ ID NO: 2802430 - DNA, 23 bp, Homo sapiens
tgagtgattgacacacagcactc

SEQ ID NO: 2802431 - DNA, 22 bp, Homo sapiens
tgagtgtttttactacagttgt

SEQ ID NO: 2802432 - DNA, 23 bp, Homo sapiens
tgagttcctgtgggtgtgtctct

SEQ ID NO: 2802433 - DNA, 23 bp, Homo sapiens
tgagttgttttcagactcagact

SEQ ID NO: 2802434 - DNA, 13 bp, Homo sapiens
tgagtttttgata

SEQ ID NO: 2802435 - DNA, 15 bp, Homo sapiens
tgataaacacagagg

SEQ ID NO: 2802436 - DNA, 16 bp, Homo sapiens
tgataaactaaaagca

SEQ ID NO: 2802437 - DNA, 19 bp, Homo sapiens
tgataaagattttttaata

SEQ ID NO: 2802438 - DNA, 19 bp, Homo sapiens
tgataaattccactggact

SEQ ID NO: 2802439 - DNA, 16 bp, Homo sapiens
tgataaggatcagaac

SEQ ID NO: 2802440 - DNA, 20 bp, Homo sapiens
tgataaggatcagaacagca

SEQ ID NO: 2802441 - DNA, 12 bp, Homo sapiens
tgataagtggaa

SEQ ID NO: 2802442 - DNA, 13 bp, Homo sapiens
tgataagtggaaa

SEQ ID NO: 2802443 - DNA, 14 bp, Homo sapiens
tgatactaagcatt

SEQ ID NO: 2802444 - DNA, 20 bp, Homo sapiens
tgatactgggtacaagagcc

SEQ ID NO: 2802445 - DNA, 23 bp, Homo sapiens
tgatagctttattttttaagtat

SEQ ID NO: 2802446 - DNA, 15 bp, Homo sapiens
tgatcacggctcact

SEQ ID NO: 2802447 - DNA, 22 bp, Homo sapiens
tgatcacggctcactgcagcct

SEQ ID NO: 2802448 - DNA, 18 bp, Homo sapiens
tgatcagaccataatgtt

SEQ ID NO: 2802449 - DNA, 17 bp, Homo sapiens
tgatcagctgtttgtca

SEQ ID NO: 2802450 - DNA, 21 bp, Homo sapiens
tgatcagttttttcacctgga

SEQ ID NO: 2802451 - DNA, 21 bp, Homo sapiens
tgatccacccacctcagcctc

SEQ ID NO: 2802452 - DNA, 22 bp, Homo sapiens
tgatccacccacctcagcctcc

SEQ ID NO: 2802453 - DNA, 18 bp, Homo sapiens
tgatcctcccacctcagc

SEQ ID NO: 2802454 - DNA, 20 bp, Homo sapiens
tgatcctcccacctcagcct

SEQ ID NO: 2802455 - DNA, 20 bp, Homo sapiens
tgatcgggataacaaaatca

SEQ ID NO: 2802456 - DNA, 23 bp, Homo sapiens
tgatctcaggagcttgcaagaag

SEQ ID NO: 2802457 - DNA, 16 bp, Homo sapiens
tgatctccatatgtta

SEQ ID NO: 2802458 - DNA, 21 bp, Homo sapiens
tgatctccatatgttacacta

SEQ ID NO: 2802459 - DNA, 15 bp, Homo sapiens
tgatctccctgccgc

SEQ ID NO: 2802460 - DNA, 19 bp, Homo sapiens
tgatctgactttaattgtg

SEQ ID NO: 2802461 - DNA, 15 bp, Homo sapiens
tgatctgtatataca

SEQ ID NO: 2802462 - DNA, 22 bp, Homo sapiens
tgatctgtatatacaataacat

SEQ ID NO: 2802463 - DNA, 21 bp, Homo sapiens
tgatctttgcagacaggcaag

SEQ ID NO: 2802464 - DNA, 20 bp, Homo sapiens
tgcacaatttgagcaattca

SEQ ID NO: 2802465 - DNA, 22 bp, Homo sapiens
tgcacaatttgagcaattcatt

SEQ ID NO: 2802466 - DNA, 15 bp, Homo sapiens
tgcacacaccagagc

SEQ ID NO: 2802467 - DNA, 18 bp, Homo sapiens
tgcacacaccagagccca

SEQ ID NO: 2802468 - DNA, 22 bp, Homo sapiens
tgcacacaccagagcccacctt

SEQ ID NO: 2802469 - DNA, 21 bp, Homo sapiens
tgcacactagcctctccagga

SEQ ID NO: 2802470 - DNA, 19 bp, Homo sapiens
tgcacacttgtatattgaa

SEQ ID NO: 2802471 - DNA, 12 bp, Homo sapiens
tgcacaggaggg

SEQ ID NO: 2802472 - DNA, 13 bp, Homo sapiens
tgcacaggagggg

SEQ ID NO: 2802473 - DNA, 14 bp, Homo sapiens
tgcacatatggact

SEQ ID NO: 2802474 - DNA, 15 bp, Homo sapiens
tgcacatatggactc

SEQ ID NO: 2802475 - DNA, 21 bp, Homo sapiens
tgcacatgtaacatagattta

SEQ ID NO: 2802476 - DNA, 20 bp, Homo sapiens
tgcacattaggaacagagta

SEQ ID NO: 2802477 - DNA, 20 bp, Homo sapiens
tgcacatttatatatatatg

SEQ ID NO: 2802478 - DNA, 21 bp, Homo sapiens
tgcaccagcccttccctgctt

SEQ ID NO: 2802479 - DNA, 16 bp, Homo sapiens
tgcaccagtgccgcct

SEQ ID NO: 2802480 - DNA, 22 bp, Homo sapiens
tgcaccagtgccgcctgtgccc

SEQ ID NO: 2802481 - DNA, 16 bp, Homo sapiens
tgcaccccaacattga

SEQ ID NO: 2802482 - DNA, 14 bp, Homo sapiens
tgcacccctcccca

SEQ ID NO: 2802483 - DNA, 22 bp, Homo sapiens
tgcacccctccccattcacaga

SEQ ID NO: 2802484 - DNA, 14 bp, Homo sapiens
tgcaccctccgcct

SEQ ID NO: 2802485 - DNA, 16 bp, Homo sapiens
tgcaccctccgccttc

SEQ ID NO: 2802486 - DNA, 17 bp, Homo sapiens
tgcaccgggccacagag

SEQ ID NO: 2802487 - DNA, 14 bp, Homo sapiens
tgcacctcccccca

SEQ ID NO: 2802488 - DNA, 15 bp, Homo sapiens
tgcacctccccccac

SEQ ID NO: 2802489 - DNA, 19 bp, Homo sapiens
tgcacctccccccactgca

SEQ ID NO: 2802490 - DNA, 11 bp, Homo sapiens
tgcacctgcat

SEQ ID NO: 2802491 - DNA, 16 bp, Homo sapiens
tgcacctgccagcctg

SEQ ID NO: 2802492 - DNA, 22 bp, Homo sapiens
tgcacctgccagcctggcttct

SEQ ID NO: 2802493 - DNA, 19 bp, Homo sapiens
  misc_feature (10)..(10): n is a, c, g or t
tgcacctgcnttgtccctg

SEQ ID NO: 2802494 - DNA, 16 bp, Homo sapiens
tgcacctgtactcagg

SEQ ID NO: 2802495 - DNA, 14 bp, Homo sapiens
tgcacctttctagt

SEQ ID NO: 2802496 - DNA, 18 bp, Homo sapiens
tgcacctttctagttgaa

SEQ ID NO: 2802497 - DNA, 15 bp, Homo sapiens
tgcacggcagcttga

SEQ ID NO: 2802498 - DNA, 23 bp, Homo sapiens
tgcactatagcctaggtgacaga

SEQ ID NO: 2802499 - DNA, 12 bp, Homo sapiens
tgcactccagcc

SEQ ID NO: 2802500 - DNA, 13 bp, Homo sapiens
tgcactccagcct

SEQ ID NO: 2802501 - DNA, 15 bp, Homo sapiens
tgcactccagcctgg

SEQ ID NO: 2802502 - DNA, 18 bp, Homo sapiens
tgcactccagcctgggcg

SEQ ID NO: 2802503 - DNA, 18 bp, Homo sapiens
tgcactgacattgttggc

SEQ ID NO: 2802504 - DNA, 14 bp, Homo sapiens
tgcactgagggcca

SEQ ID NO: 2802505 - DNA, 15 bp, Homo sapiens
tgcactgagggccac

SEQ ID NO: 2802506 - DNA, 16 bp, Homo sapiens
tgcagaaaagcacctg

SEQ ID NO: 2802507 - DNA, 13 bp, Homo sapiens
tgcagacaggcaa

SEQ ID NO: 2802508 - DNA, 15 bp, Homo sapiens
tgcagaccctgccct

SEQ ID NO: 2802509 - DNA, 15 bp, Homo sapiens
tgcagactcagtttg

SEQ ID NO: 2802510 - DNA, 18 bp, Homo sapiens
tgcagactctacagaggc

SEQ ID NO: 2802511 - DNA, 19 bp, Homo sapiens
tgcagactctacagaggcc

SEQ ID NO: 2802512 - DNA, 12 bp, Homo sapiens
tgcagactgtgg

SEQ ID NO: 2802513 - DNA, 23 bp, Homo sapiens
tgcagactgtggctgcagagacc

SEQ ID NO: 2802514 - DNA, 13 bp, Homo sapiens
tgcagagagaagc

SEQ ID NO: 2802515 - DNA, 13 bp, Homo sapiens
tgcagaggattta

SEQ ID NO: 2802516 - DNA, 22 bp, Homo sapiens
tgcagaggggctttctggagag

SEQ ID NO: 2802517 - DNA, 20 bp, Homo sapiens
tgcagaggtaaaagtgtgag

SEQ ID NO: 2802518 - DNA, 16 bp, Homo sapiens
tgcagaggtgagcaga

SEQ ID NO: 2802519 - DNA, 20 bp, Homo sapiens
tgcagaggtgagcagaggag

SEQ ID NO: 2802520 - DNA, 13 bp, Homo sapiens
tgcagattcattt

SEQ ID NO: 2802521 - DNA, 18 bp, Homo sapiens
tgcagatttcctgtgtgg

SEQ ID NO: 2802522 - DNA, 22 bp, Homo sapiens
tgcagcagtgagtctcttcaga

SEQ ID NO: 2802523 - DNA, 18 bp, Homo sapiens
tgcagccaaacagagcct

SEQ ID NO: 2802524 - DNA, 21 bp, Homo sapiens
tgcagccaaacagagccttca

SEQ ID NO: 2802525 - DNA, 12 bp, Homo sapiens
tgcagccagccc

SEQ ID NO: 2802526 - DNA, 14 bp, Homo sapiens
tgcagccagcccag

SEQ ID NO: 2802527 - DNA, 21 bp, Homo sapiens
tgcagccagcccagcccagct

SEQ ID NO: 2802528 - DNA, 22 bp, Homo sapiens
tgcagcccggcgccaccatcct

SEQ ID NO: 2802529 - DNA, 14 bp, Homo sapiens
tgcagcctcctcct

SEQ ID NO: 2802530 - DNA, 19 bp, Homo sapiens
tgcagcgaaccaatatttg

SEQ ID NO: 2802531 - DNA, 11 bp, Homo sapiens
tgcagcttcat

SEQ ID NO: 2802532 - DNA, 15 bp, Homo sapiens
tgcagcttcatcaat

SEQ ID NO: 2802533 - DNA, 18 bp, Homo sapiens
tgcagcttcatcaatttt

SEQ ID NO: 2802534 - DNA, 20 bp, Homo sapiens
tgcagcttcggggcaagtga

SEQ ID NO: 2802535 - DNA, 17 bp, Homo sapiens
tgcagcttgtagccagc

SEQ ID NO: 2802536 - DNA, 19 bp, Homo sapiens
tgcagcttgtagccagccg

SEQ ID NO: 2802537 - DNA, 22 bp, Homo sapiens
tgcagcttgtagccagccgggg

SEQ ID NO: 2802538 - DNA, 16 bp, Homo sapiens
tgcaggaataaggcct

SEQ ID NO: 2802539 - DNA, 12 bp, Homo sapiens
tgcaggaatcaa

SEQ ID NO: 2802540 - DNA, 15 bp, Homo sapiens
tgcaggaatcaaaaa

SEQ ID NO: 2802541 - DNA, 20 bp, Homo sapiens
tgcaggaatcaaaaattgaa

SEQ ID NO: 2802542 - DNA, 23 bp, Homo sapiens
tgcaggccaggttatgcctcatg

SEQ ID NO: 2802543 - DNA, 10 bp, Homo sapiens
tgcaggcccc

SEQ ID NO: 2802544 - DNA, 24 bp, Homo sapiens
tgcagggaggaggtggcagccctg

SEQ ID NO: 2802545 - DNA, 18 bp, Homo sapiens
tgcagtactttacctcct

SEQ ID NO: 2802546 - DNA, 17 bp, Homo sapiens
tgcagtagccagcacgt

SEQ ID NO: 2802547 - DNA, 17 bp, Homo sapiens
tgcagtcaacagttcaa

SEQ ID NO: 2802548 - DNA, 22 bp, Homo sapiens
tgcagtcaacagttcaaagaag

SEQ ID NO: 2802549 - DNA, 21 bp, Homo sapiens
tgcagtcagtcatgatggcac

SEQ ID NO: 2802550 - DNA, 16 bp, Homo sapiens
tgcagtccagaataag

SEQ ID NO: 2802551 - DNA, 20 bp, Homo sapiens
tgcagtggtgcgatctgggt

SEQ ID NO: 2802552 - DNA, 12 bp, Homo sapiens
tgcataagatta

SEQ ID NO: 2802553 - DNA, 19 bp, Homo sapiens
tgcatagtgctaagaaagc

SEQ ID NO: 2802554 - DNA, 16 bp, Homo sapiens
tggaaagaatctaata

SEQ ID NO: 2802555 - DNA, 12 bp, Homo sapiens
tggaaagagacc

SEQ ID NO: 2802556 - DNA, 13 bp, Homo sapiens
tggaaagagacca

SEQ ID NO: 2802557 - DNA, 16 bp, Homo sapiens
tggaaagcatcacctc

SEQ ID NO: 2802558 - DNA, 19 bp, Homo sapiens
tggaaagcatcacctcagg

SEQ ID NO: 2802559 - DNA, 16 bp, Homo sapiens
tggaaagcctctgctg

SEQ ID NO: 2802560 - DNA, 13 bp, Homo sapiens
tggaaataaatgt

SEQ ID NO: 2802561 - DNA, 22 bp, Homo sapiens
tggaaatcctgttacttaaata

SEQ ID NO: 2802562 - DNA, 15 bp, Homo sapiens
tggaaatctggattt

SEQ ID NO: 2802563 - DNA, 20 bp, Homo sapiens
tggaaccgtgtccagcacag

SEQ ID NO: 2802564 - DNA, 23 bp, Homo sapiens
tggaactacattagtacacagca

SEQ ID NO: 2802565 - DNA, 18 bp, Homo sapiens
tggaactctaccctggta

SEQ ID NO: 2802566 - DNA, 13 bp, Homo sapiens
tggaactgaaggg

SEQ ID NO: 2802567 - DNA, 15 bp, Homo sapiens
tggaactgaaggggg

SEQ ID NO: 2802568 - DNA, 23 bp, Homo sapiens
tggaactgtctctcatgaacctc

SEQ ID NO: 2802569 - DNA, 13 bp, Homo sapiens
tggaacttgaact

SEQ ID NO: 2802570 - DNA, 15 bp, Homo sapiens
tggaacttgaactga

SEQ ID NO: 2802571 - DNA, 13 bp, Homo sapiens
tggaagaaacagg

SEQ ID NO: 2802572 - DNA, 17 bp, Homo sapiens
tggaagaaattcctgta

SEQ ID NO: 2802573 - DNA, 17 bp, Homo sapiens
tggaagccctccttcca

SEQ ID NO: 2802574 - DNA, 11 bp, Homo sapiens
tggaaggcatg

SEQ ID NO: 2802575 - DNA, 21 bp, Homo sapiens
tggaataataattttcctcct

SEQ ID NO: 2802576 - DNA, 16 bp, Homo sapiens
tgcaagtgacatctct

SEQ ID NO: 2802577 - DNA, 13 bp, Homo sapiens
tgcaataaaatag

SEQ ID NO: 2802578 - DNA, 14 bp, Homo sapiens
tgcaatctccaggg

SEQ ID NO: 2802579 - DNA, 22 bp, Homo sapiens
tgcaatgtaaatattttaaaga

SEQ ID NO: 2802580 - DNA, 19 bp, Homo sapiens
tgcaatgtcccttgcacag

SEQ ID NO: 2802581 - DNA, 16 bp, Homo sapiens
tgcaatttttaaacta

SEQ ID NO: 2802582 - DNA, 15 bp, Homo sapiens
tgcacaaagcccttc

SEQ ID NO: 2802583 - DNA, 22 bp, Homo sapiens
tgcacaagcttgtatatacata

SEQ ID NO: 2802584 - DNA, 9 bp, Homo sapiens
tgcacaatt

SEQ ID NO: 2802585 - DNA, 15 bp, Homo sapiens
tgcacaatttagaaa

SEQ ID NO: 2802586 - DNA, 19 bp, Homo sapiens
tgcacaatttagaaaacat

SEQ ID NO: 2802587 - DNA, 18 bp, Homo sapiens
tgcacaatttgagcaatt

SEQ ID NO: 2802588 - DNA, 19 bp, Homo sapiens
tgcacaatttgagcaattc

SEQ ID NO: 2802589 - DNA, 15 bp, Homo sapiens
tggaatacatgaaat

SEQ ID NO: 2802590 - DNA, 22 bp, Homo sapiens
tggaatataattgttttatctg

SEQ ID NO: 2802591 - DNA, 23 bp, Homo sapiens
tggaatattcccctatctctaga

SEQ ID NO: 2802592 - DNA, 16 bp, Homo sapiens
tggaatgaagcatgta

SEQ ID NO: 2802593 - DNA, 23 bp, Homo sapiens
tggaatgtggcccctgaacaaga

SEQ ID NO: 2802594 - DNA, 23 bp, Homo sapiens
tggaatttttcattgatatgaaa

SEQ ID NO: 2802595 - DNA, 13 bp, Homo sapiens
tggacaagaagct

SEQ ID NO: 2802596 - DNA, 15 bp, Homo sapiens
tggacaagaagctgc

SEQ ID NO: 2802597 - DNA, 17 bp, Homo sapiens
tggacaagccaacttgt

SEQ ID NO: 2802598 - DNA, 17 bp, Homo sapiens
tggacacacaaggtgca

SEQ ID NO: 2802599 - DNA, 13 bp, Homo sapiens
tggacacagctct

SEQ ID NO: 2802600 - DNA, 10 bp, Homo sapiens
tggacacctg

SEQ ID NO: 2802601 - DNA, 11 bp, Homo sapiens
tggacacctgc

SEQ ID NO: 2802602 - DNA, 13 bp, Homo sapiens
tggacagcttgtg

SEQ ID NO: 2802603 - DNA, 15 bp, Homo sapiens
tggacattgtctgcg

SEQ ID NO: 2802604 - DNA, 16 bp, Homo sapiens
tggaccaccagcccca

SEQ ID NO: 2802605 - DNA, 14 bp, Homo sapiens
tggaccagaggaag

SEQ ID NO: 2802606 - DNA, 14 bp, Homo sapiens
tggaccaggacagg

SEQ ID NO: 2802607 - DNA, 18 bp, Homo sapiens
tggaccaggacaggacca

SEQ ID NO: 2802608 - DNA, 19 bp, Homo sapiens
tggaccaggacaggaccag

SEQ ID NO: 2802609 - DNA, 13 bp, Homo sapiens
tggacctctgctc

SEQ ID NO: 2802610 - DNA, 16 bp, Homo sapiens
tggacctctgctctga

SEQ ID NO: 2802611 - DNA, 13 bp, Homo sapiens
tggaccttcctgc

SEQ ID NO: 2802612 - DNA, 14 bp, Homo sapiens
tggaccttcctgcc

SEQ ID NO: 2802613 - DNA, 15 bp, Homo sapiens
tggacgcccagctga

SEQ ID NO: 2802614 - DNA, 22 bp, Homo sapiens
tggacgcccagctgaggctggg

SEQ ID NO: 2802615 - DNA, 13 bp, Homo sapiens
tggactcctccca

SEQ ID NO: 2802616 - DNA, 15 bp, Homo sapiens
tggactcctctgtcc

SEQ ID NO: 2802617 - DNA, 17 bp, Homo sapiens
tggactctgcacatgaa

SEQ ID NO: 2802618 - DNA, 15 bp, Homo sapiens
tggactgtcatagaa

SEQ ID NO: 2802619 - DNA, 15 bp, Homo sapiens
tggagaaaatgaaga

SEQ ID NO: 2802620 - DNA, 14 bp, Homo sapiens
tggagaaatattta

SEQ ID NO: 2802621 - DNA, 22 bp, Homo sapiens
tggagaactgggatttgaaccc

SEQ ID NO: 2802622 - DNA, 13 bp, Homo sapiens
tggagaagcagtg

SEQ ID NO: 2802623 - DNA, 18 bp, Homo sapiens
tggagactaagccctgtc

SEQ ID NO: 2802624 - DNA, 18 bp, Homo sapiens
tggagactcctgccctgt

SEQ ID NO: 2802625 - DNA, 23 bp, Homo sapiens
tggagagaagtttctggccctgg

SEQ ID NO: 2802626 - DNA, 16 bp, Homo sapiens
tggagagccctgggac

SEQ ID NO: 2802627 - DNA, 17 bp, Homo sapiens
tggagagctaggagcaa

SEQ ID NO: 2802628 - DNA, 18 bp, Homo sapiens
tggagagggacgaagaaa

SEQ ID NO: 2802629 - DNA, 23 bp, Homo sapiens
tggagatatttatggggggagaa

SEQ ID NO: 2802630 - DNA, 18 bp, Homo sapiens
tggagcagaaagccaggg

SEQ ID NO: 2802631 - DNA, 18 bp, Homo sapiens
tggagcctcggtggccat

SEQ ID NO: 2802632 - DNA, 21 bp, Homo sapiens
tggagcctcggtggccatgct

SEQ ID NO: 2802633 - DNA, 16 bp, Homo sapiens
tggagcgcacctgccc

SEQ ID NO: 2802634 - DNA, 22 bp, Homo sapiens
tggaggaacagctccctagtgg

SEQ ID NO: 2802635 - DNA, 13 bp, Homo sapiens
tggaggacctgag

SEQ ID NO: 2802636 - DNA, 16 bp, Homo sapiens
tggaggacctgagcct

SEQ ID NO: 2802637 - DNA, 22 bp, Homo sapiens
tggaggagctcaggacactaat

SEQ ID NO: 2802638 - DNA, 20 bp, Homo sapiens
tggaggatggagagagggga

SEQ ID NO: 2802639 - DNA, 17 bp, Homo sapiens
tggaggccaccgggaca

SEQ ID NO: 2802640 - DNA, 22 bp, Homo sapiens
tggaggccaccgggacagacct

SEQ ID NO: 2802641 - DNA, 20 bp, Homo sapiens
tggagggtgggagagcccag

SEQ ID NO: 2802642 - DNA, 21 bp, Homo sapiens
tggaggttgcagtgagctgag

SEQ ID NO: 2802643 - DNA, 22 bp, Homo sapiens
tggagtcatggtccggtgtcct

SEQ ID NO: 2802644 - DNA, 15 bp, Homo sapiens
tggagtgcagggagg

SEQ ID NO: 2802645 - DNA, 17 bp, Homo sapiens
tggagtgcagggaggag

SEQ ID NO: 2802646 - DNA, 19 bp, Homo sapiens
tggagtgcagggaggagag

SEQ ID NO: 2802647 - DNA, 20 bp, Homo sapiens
tggataataactagatctcc

SEQ ID NO: 2802648 - DNA, 18 bp, Homo sapiens
tggataatgctgttgcct

SEQ ID NO: 2802649 - DNA, 16 bp, Homo sapiens
tggatatgtaaaacat

SEQ ID NO: 2802650 - DNA, 20 bp, Homo sapiens
tggatatgttgttaaacacg

SEQ ID NO: 2802651 - DNA, 14 bp, Homo sapiens
tggatctccaagga

SEQ ID NO: 2802652 - DNA, 15 bp, Homo sapiens
tggatctccaaggac

SEQ ID NO: 2802653 - DNA, 18 bp, Homo sapiens
tggatctccaaggaccag

SEQ ID NO: 2802654 - DNA, 15 bp, Homo sapiens
tggatctccccactc

SEQ ID NO: 2802655 - DNA, 19 bp, Homo sapiens
tggatctccccactctagg

SEQ ID NO: 2802656 - DNA, 14 bp, Homo sapiens
tggcagccctgtag

SEQ ID NO: 2802657 - DNA, 19 bp, Homo sapiens
tggcagctgcggtccaccc

SEQ ID NO: 2802658 - DNA, 22 bp, Homo sapiens
tggcagctgcggtccacccagg

SEQ ID NO: 2802659 - DNA, 11 bp, Homo sapiens
tggcagctgga

SEQ ID NO: 2802660 - DNA, 14 bp, Homo sapiens
tggcagctgggcag

SEQ ID NO: 2802661 - DNA, 11 bp, Homo sapiens
tggcaggacca

SEQ ID NO: 2802662 - DNA, 16 bp, Homo sapiens
tggcaggaccaggact

SEQ ID NO: 2802663 - DNA, 17 bp, Homo sapiens
tggcaggaccaggacta

SEQ ID NO: 2802664 - DNA, 14 bp, Homo sapiens
tggcagtccagcca

SEQ ID NO: 2802665 - DNA, 19 bp, Homo sapiens
tggcagtccagccagctcc

SEQ ID NO: 2802666 - DNA, 13 bp, Homo sapiens
tggcagtgggagc

SEQ ID NO: 2802667 - DNA, 14 bp, Homo sapiens
tggcagtgggagct

SEQ ID NO: 2802668 - DNA, 15 bp, Homo sapiens
tggcagtgggagctg

SEQ ID NO: 2802669 - DNA, 19 bp, Homo sapiens
tggcagtgggagctgcctg

SEQ ID NO: 2802670 - DNA, 20 bp, Homo sapiens
tggcagtgggagctgcctgt

SEQ ID NO: 2802671 - DNA, 14 bp, Homo sapiens
tggcagtgtgtcac

SEQ ID NO: 2802672 - DNA, 24 bp, Homo sapiens
tggcagtgtgtcacactgagctgg

SEQ ID NO: 2802673 - DNA, 16 bp, Homo sapiens
tggcagtttatattta

SEQ ID NO: 2802674 - DNA, 20 bp, Homo sapiens
tggcatcacagggcagagcc

SEQ ID NO: 2802675 - DNA, 20 bp, Homo sapiens
tggcatgcttaaatattgaa

SEQ ID NO: 2802676 - DNA, 23 bp, Homo sapiens
tggccaagctgaggtgcccagga

SEQ ID NO: 2802677 - DNA, 22 bp, Homo sapiens
tggccaatgcacctaaagaaaa

SEQ ID NO: 2802678 - DNA, 19 bp, Homo sapiens
tggccacccgttctgctgg

SEQ ID NO: 2802679 - DNA, 19 bp, Homo sapiens
tggccagatgcaccagccc

SEQ ID NO: 2802680 - DNA, 21 bp, Homo sapiens
tggccaggcaccccctggaga

SEQ ID NO: 2802681 - DNA, 15 bp, Homo sapiens
tggccaggctggtct

SEQ ID NO: 2802682 - DNA, 13 bp, Homo sapiens
tggccagggtgag

SEQ ID NO: 2802683 - DNA, 18 bp, Homo sapiens
tggccagggtgagagctg

SEQ ID NO: 2802684 - DNA, 19 bp, Homo sapiens
tggccagggtgagagctgc

SEQ ID NO: 2802685 - DNA, 23 bp, Homo sapiens
tggccagtgtgacaaggattgct

SEQ ID NO: 2802686 - DNA, 14 bp, Homo sapiens
tggccatgcttctt

SEQ ID NO: 2802687 - DNA, 15 bp, Homo sapiens
tggccatgcttcttg

SEQ ID NO: 2802688 - DNA, 17 bp, Homo sapiens
tggccatgcttcttgcc

SEQ ID NO: 2802689 - DNA, 23 bp, Homo sapiens
tggccatgcttcttgccccttgg

SEQ ID NO: 2802690 - DNA, 14 bp, Homo sapiens
tggccccagccccc

SEQ ID NO: 2802691 - DNA, 21 bp, Homo sapiens
tggccccatgtctctcagaat

SEQ ID NO: 2802692 - DNA, 23 bp, Homo sapiens
tggccccatgtctctcagaattc

SEQ ID NO: 2802693 - DNA, 12 bp, Homo sapiens
tggcccccctcc

SEQ ID NO: 2802694 - DNA, 23 bp, Homo sapiens
tggcccccctccaggcatgctgg

SEQ ID NO: 2802695 - DNA, 14 bp, Homo sapiens
tggcccctgaacaa

SEQ ID NO: 2802696 - DNA, 21 bp, Homo sapiens
tggcccctgcccggctgcgga

SEQ ID NO: 2802697 - DNA, 15 bp, Homo sapiens
tggcccctgtgtgag

SEQ ID NO: 2802698 - DNA, 13 bp, Homo sapiens
tggcccttcctgg

SEQ ID NO: 2802699 - DNA, 16 bp, Homo sapiens
tggcccttcctggaca

SEQ ID NO: 2802700 - DNA, 18 bp, Homo sapiens
tggcccttcctggacagc

SEQ ID NO: 2802701 - DNA, 17 bp, Homo sapiens
tggccgactcagggacc

SEQ ID NO: 2802702 - DNA, 15 bp, Homo sapiens
tggccgcctccagga

SEQ ID NO: 2802703 - DNA, 24 bp, Homo sapiens
tggccggcaaccccagttctgctc

SEQ ID NO: 2802704 - DNA, 18 bp, Homo sapiens
tggccgggtgcggtggct

SEQ ID NO: 2802705 - DNA, 18 bp, Homo sapiens
tggccgtggtccagctct

SEQ ID NO: 2802706 - DNA, 20 bp, Homo sapiens
tggccgtggtccagctcttg

SEQ ID NO: 2802707 - DNA, 20 bp, Homo sapiens
tggcctagcaggcacaggac

SEQ ID NO: 2802708 - DNA, 18 bp, Homo sapiens
tggcctcacgcccagcct

SEQ ID NO: 2802709 - DNA, 14 bp, Homo sapiens
tggcctcctgcctc

SEQ ID NO: 2802710 - DNA, 15 bp, Homo sapiens
tggcctcctgcctct

SEQ ID NO: 2802711 - DNA, 21 bp, Homo sapiens
tggcctgctgggctctccacc

SEQ ID NO: 2802712 - DNA, 12 bp, Homo sapiens
tggcctggatct

SEQ ID NO: 2802713 - DNA, 16 bp, Homo sapiens
tggcctggctctcctg

SEQ ID NO: 2802714 - DNA, 11 bp, Homo sapiens
tggcctgggca

SEQ ID NO: 2802715 - DNA, 18 bp, Homo sapiens
tggcctgggtgggcagga

SEQ ID NO: 2802716 - DNA, 16 bp, Homo sapiens
tggcggctactcagca

SEQ ID NO: 2802717 - DNA, 17 bp, Homo sapiens
tggcggctactcagcag

SEQ ID NO: 2802718 - DNA, 22 bp, Homo sapiens
tggcggctactcagcagccctc

SEQ ID NO: 2802719 - DNA, 23 bp, Homo sapiens
tggcgggcagcccagcctctgtc

SEQ ID NO: 2802720 - DNA, 16 bp, Homo sapiens
tggctactctgtgcca

SEQ ID NO: 2802721 - DNA, 17 bp, Homo sapiens
tggctactctgtgccag

SEQ ID NO: 2802722 - DNA, 18 bp, Homo sapiens
tggctactctgtgccaga

SEQ ID NO: 2802723 - DNA, 14 bp, Homo sapiens
tggctatggccacc

SEQ ID NO: 2802724 - DNA, 17 bp, Homo sapiens
tggctatgtttttaatg

SEQ ID NO: 2802725 - DNA, 16 bp, Homo sapiens
tggctcaatcctctaa

SEQ ID NO: 2802726 - DNA, 12 bp, Homo sapiens
tggctcctccag

SEQ ID NO: 2802727 - DNA, 16 bp, Homo sapiens
tggctctcagaaggta

SEQ ID NO: 2802728 - DNA, 17 bp, Homo sapiens
tggctctgccagtcggt

SEQ ID NO: 2802729 - DNA, 12 bp, Homo sapiens
tggctgaaaatc

SEQ ID NO: 2802730 - DNA, 20 bp, Homo sapiens
tggctgacccagtccctggg

SEQ ID NO: 2802731 - DNA, 20 bp, Homo sapiens
tggctgaccccaaagagcct

SEQ ID NO: 2802732 - DNA, 22 bp, Homo sapiens
tggctgaccccaaagagcctgg

SEQ ID NO: 2802733 - DNA, 16 bp, Homo sapiens
tggctgactttgctct

SEQ ID NO: 2802734 - DNA, 14 bp, Homo sapiens
tggctgataatttt

SEQ ID NO: 2802735 - DNA, 16 bp, Homo sapiens
tggctgcagagacctt

SEQ ID NO: 2802736 - DNA, 14 bp, Homo sapiens
tggctggctgaggg

SEQ ID NO: 2802737 - DNA, 13 bp, Homo sapiens
tggctggctgcag

SEQ ID NO: 2802738 - DNA, 12 bp, Homo sapiens
tggctgggcatg

SEQ ID NO: 2802739 - DNA, 14 bp, Homo sapiens
tggctgggggcctc

SEQ ID NO: 2802740 - DNA, 17 bp, Homo sapiens
tggctgtatttttagag

SEQ ID NO: 2802741 - DNA, 18 bp, Homo sapiens
tggctgtatttttagaga

SEQ ID NO: 2802742 - DNA, 16 bp, Homo sapiens
tggctgtctctgtccc

SEQ ID NO: 2802743 - DNA, 19 bp, Homo sapiens
tggctgtgcctctgcctgt

SEQ ID NO: 2802744 - DNA, 17 bp, Homo sapiens
tggcttaaaacaacact

SEQ ID NO: 2802745 - DNA, 22 bp, Homo sapiens
tggcttccaggtatctccagga

SEQ ID NO: 2802746 - DNA, 13 bp, Homo sapiens
tgggcctgctgct

SEQ ID NO: 2802747 - DNA, 14 bp, Homo sapiens
tgggcctgctgctg

SEQ ID NO: 2802748 - DNA, 17 bp, Homo sapiens
tgggcctgctgctgaga

SEQ ID NO: 2802749 - DNA, 22 bp, Homo sapiens
tgggctaagtgatcctcccacc

SEQ ID NO: 2802750 - DNA, 17 bp, Homo sapiens
tgggctcctggaaccaa

SEQ ID NO: 2802751 - DNA, 15 bp, Homo sapiens
tgggctctccacctc

SEQ ID NO: 2802752 - DNA, 17 bp, Homo sapiens
tgggctctccacctcag

SEQ ID NO: 2802753 - DNA, 12 bp, Homo sapiens
tgggctctgccc

SEQ ID NO: 2802754 - DNA, 12 bp, Homo sapiens
tgggctgagccc

SEQ ID NO: 2802755 - DNA, 15 bp, Homo sapiens
tgggctgagccctgg

SEQ ID NO: 2802756 - DNA, 15 bp, Homo sapiens
tgggcttcagtggca

SEQ ID NO: 2802757 - DNA, 19 bp, Homo sapiens
tgggcttcagtggcagctg

SEQ ID NO: 2802758 - DNA, 14 bp, Homo sapiens
tgggcttgttttct

SEQ ID NO: 2802759 - DNA, 15 bp, Homo sapiens
tgggctttaacaaaa

SEQ ID NO: 2802760 - DNA, 16 bp, Homo sapiens
tgggctttaacaaaac

SEQ ID NO: 2802761 - DNA, 17 bp, Homo sapiens
tggggaagactgtggct

SEQ ID NO: 2802762 - DNA, 12 bp, Homo sapiens
tggggagaaagt

SEQ ID NO: 2802763 - DNA, 14 bp, Homo sapiens
tggggagacctggt

SEQ ID NO: 2802764 - DNA, 22 bp, Homo sapiens
tggggagccaacagaagcttcc

SEQ ID NO: 2802765 - DNA, 16 bp, Homo sapiens
tggggagggggaagag

SEQ ID NO: 2802766 - DNA, 22 bp, Homo sapiens
tggggagggggaagagaaattt

SEQ ID NO: 2802767 - DNA, 17 bp, Homo sapiens
tggggagttataaaaat

SEQ ID NO: 2802768 - DNA, 19 bp, Homo sapiens
tggggcaagtccctgactc

SEQ ID NO: 2802769 - DNA, 15 bp, Homo sapiens
tggggcagctcctct

SEQ ID NO: 2802770 - DNA, 22 bp, Homo sapiens
tggtctttcctatcatggagtg

SEQ ID NO: 2802771 - DNA, 11 bp, Homo sapiens
tggtctttgaa

SEQ ID NO: 2802772 - DNA, 17 bp, Homo sapiens
tggtctttgaataaagt

SEQ ID NO: 2802773 - DNA, 13 bp, Homo sapiens
tggtgataagtgg

SEQ ID NO: 2802774 - DNA, 18 bp, Homo sapiens
tggtgataagtggaaaaa

SEQ ID NO: 2802775 - DNA, 23 bp, Homo sapiens
tggtgcagaggtgagcagaggag

SEQ ID NO: 2802776 - DNA, 23 bp, Homo sapiens
tggtgcctggcctggcacacatc

SEQ ID NO: 2802777 - DNA, 24 bp, Homo sapiens
tggtgcctggcctggcacacatca

SEQ ID NO: 2802778 - DNA, 14 bp, Homo sapiens
tggtgccttcattt

SEQ ID NO: 2802779 - DNA, 23 bp, Homo sapiens
tggtgctataggctggagaagct

SEQ ID NO: 2802780 - DNA, 13 bp, Homo sapiens
tggtgctgtggcc

SEQ ID NO: 2802781 - DNA, 13 bp, Homo sapiens
tggtggcagctgc

SEQ ID NO: 2802782 - DNA, 14 bp, Homo sapiens
tggtggcagctgcg

SEQ ID NO: 2802783 - DNA, 18 bp, Homo sapiens
tggtggcagtgggagctg

SEQ ID NO: 2802784 - DNA, 16 bp, Homo sapiens
tggtggcgcaagcctg

SEQ ID NO: 2802785 - DNA, 15 bp, Homo sapiens
tggtggctgtctctg

SEQ ID NO: 2802786 - DNA, 18 bp, Homo sapiens
tggtgtaatgcacaattt

SEQ ID NO: 2802787 - DNA, 15 bp, Homo sapiens
tggtgtccacctggc

SEQ ID NO: 2802788 - DNA, 18 bp, Homo sapiens
tggtgtgaccctctgaat

SEQ ID NO: 2802789 - DNA, 23 bp, Homo sapiens
tggtgtggctgtattcagatcgt

SEQ ID NO: 2802790 - DNA, 13 bp, Homo sapiens
tggttaatgccat

SEQ ID NO: 2802791 - DNA, 13 bp, Homo sapiens
tggttagaaaagt

SEQ ID NO: 2802792 - DNA, 23 bp, Homo sapiens
tggttcagggttggcccctgccc

SEQ ID NO: 2802793 - DNA, 13 bp, Homo sapiens
tggttccatgcct

SEQ ID NO: 2802794 - DNA, 19 bp, Homo sapiens
tggttccatgcctgagggt

SEQ ID NO: 2802795 - DNA, 15 bp, Homo sapiens
tggttcccaataaaa

SEQ ID NO: 2802796 - DNA, 17 bp, Homo sapiens
tgtgaagacccagcagg

SEQ ID NO: 2802797 - DNA, 23 bp, Homo sapiens
tgtgaagacccagcaggaagcca

SEQ ID NO: 2802798 - DNA, 18 bp, Homo sapiens
tgtgaattctgtgaagaa

SEQ ID NO: 2802799 - DNA, 19 bp, Homo sapiens
tgtgaattctgtgaagaat

SEQ ID NO: 2802800 - DNA, 19 bp, Homo sapiens
tgtgacaacctttgtgtaa

SEQ ID NO: 2802801 - DNA, 22 bp, Homo sapiens
tgtgacaacctttgtgtaataa

SEQ ID NO: 2802802 - DNA, 22 bp, Homo sapiens
tgtgacaggaagcccaaggcag

SEQ ID NO: 2802803 - DNA, 18 bp, Homo sapiens
tgtgaccaaaagttacat

SEQ ID NO: 2802804 - DNA, 13 bp, Homo sapiens
tgtgaccaagtta

SEQ ID NO: 2802805 - DNA, 16 bp, Homo sapiens
tgtgaccctctgaatg

SEQ ID NO: 2802806 - DNA, 13 bp, Homo sapiens
tgtgactcgctta

SEQ ID NO: 2802807 - DNA, 20 bp, Homo sapiens
tgtgactcgcttagctgaaa

SEQ ID NO: 2802808 - DNA, 12 bp, Homo sapiens
tgtgactctctt

SEQ ID NO: 2802809 - DNA, 14 bp, Homo sapiens
tgtgagaatcaaaa

SEQ ID NO: 2802810 - DNA, 19 bp, Homo sapiens
tgtgagcaagcatttatgt

SEQ ID NO: 2802811 - DNA, 16 bp, Homo sapiens
tgtgagccaaagagaa

SEQ ID NO: 2802812 - DNA, 22 bp, Homo sapiens
tgtgagccaaagagaaaagatt

SEQ ID NO: 2802813 - DNA, 22 bp, Homo sapiens
tgtgaggattatgggtcctgca

SEQ ID NO: 2802814 - DNA, 13 bp, Homo sapiens
tgtgaggcagggg

SEQ ID NO: 2802815 - DNA, 18 bp, Homo sapiens
tgtgaggcctggccaggc

SEQ ID NO: 2802816 - DNA, 21 bp, Homo sapiens
tgtgagtcaccaagcccagtt

SEQ ID NO: 2802817 - DNA, 18 bp, Homo sapiens
tgtgataaggatcagaac

SEQ ID NO: 2802818 - DNA, 22 bp, Homo sapiens
tgtgatacccatagcttccatg

SEQ ID NO: 2802819 - DNA, 17 bp, Homo sapiens
tgtgatccttttatgtt

SEQ ID NO: 2802820 - DNA, 20 bp, Homo sapiens
tgtgatctatcaatagtcaa

SEQ ID NO: 2802821 - DNA, 23 bp, Homo sapiens
tgtgatggggtgggcagggctgg

SEQ ID NO: 2802822 - DNA, 13 bp, Homo sapiens
tgtgattgaatct

SEQ ID NO: 2802823 - DNA, 13 bp, Homo sapiens
tgtgattttgtac

SEQ ID NO: 2802824 - DNA, 14 bp, Homo sapiens
tgtgattttgtaca

SEQ ID NO: 2802825 - DNA, 15 bp, Homo sapiens
tgtgattttgtacag

SEQ ID NO: 2802826 - DNA, 18 bp, Homo sapiens
tgtgcaatgtaaatattt

SEQ ID NO: 2802827 - DNA, 18 bp, Homo sapiens
tgtgcagactcaataaaa

SEQ ID NO: 2802828 - DNA, 22 bp, Homo sapiens
tgtgcagactcaataaaatcat

SEQ ID NO: 2802829 - DNA, 13 bp, Homo sapiens
tgtgccagagcct

SEQ ID NO: 2802830 - DNA, 14 bp, Homo sapiens
tgtgccagagcctg

SEQ ID NO: 2802831 - DNA, 17 bp, Homo sapiens
tgtgccagagcctgggg

SEQ ID NO: 2802832 - DNA, 18 bp, Homo sapiens
tgtgccagagcctggggc

SEQ ID NO: 2802833 - DNA, 22 bp, Homo sapiens
tgtgccagagcctggggctcta

SEQ ID NO: 2802834 - DNA, 20 bp, Homo sapiens
tgtgccaggtttttggtctg

SEQ ID NO: 2802835 - DNA, 15 bp, Homo sapiens
tgtgcccacgtgtgc

SEQ ID NO: 2802836 - DNA, 21 bp, Homo sapiens
tgtgcccacgtgtgcagactg

SEQ ID NO: 2802837 - DNA, 11 bp, Homo sapiens
tgtgccctctg

SEQ ID NO: 2802838 - DNA, 21 bp, Homo sapiens
tgtgccgtgaactgcgtgcca

SEQ ID NO: 2802839 - DNA, 13 bp, Homo sapiens
tgtgcctgcagcc

SEQ ID NO: 2802840 - DNA, 19 bp, Homo sapiens
tgtgcgcctacaggagtga

SEQ ID NO: 2802841 - DNA, 18 bp, Homo sapiens
tgtgctctggacaggcat

SEQ ID NO: 2802842 - DNA, 14 bp, Homo sapiens
tgtgcttacagtga

SEQ ID NO: 2802843 - DNA, 15 bp, Homo sapiens
tgtgcttacagtgac

SEQ ID NO: 2802844 - DNA, 17 bp, Homo sapiens
tgtgcttacagtgactg

SEQ ID NO: 2802845 - DNA, 14 bp, Homo sapiens
tgtggaaaaatatt

SEQ ID NO: 2802846 - DNA, 15 bp, Homo sapiens
tgtggaaagcctctg

SEQ ID NO: 2802847 - DNA, 21 bp, Homo sapiens
tgtggaatggattatagagta

SEQ ID NO: 2802848 - DNA, 13 bp, Homo sapiens
tgtggacacagct

SEQ ID NO: 2802849 - DNA, 14 bp, Homo sapiens
tgtggacacagctc

SEQ ID NO: 2802850 - DNA, 15 bp, Homo sapiens
tgtggacacagctct

SEQ ID NO: 2802851 - DNA, 19 bp, Homo sapiens
tgtggacacagctcttctc

SEQ ID NO: 2802852 - DNA, 16 bp, Homo sapiens
tgtggagagtgagaat

SEQ ID NO: 2802853 - DNA, 21 bp, Homo sapiens
tgtggagagtgagaataattg

SEQ ID NO: 2802854 - DNA, 19 bp, Homo sapiens
tgtggatgtgtaaatggag

SEQ ID NO: 2802855 - DNA, 15 bp, Homo sapiens
tgtggcaagtgaatt

SEQ ID NO: 2802856 - DNA, 14 bp, Homo sapiens
tgtggccccagccc

SEQ ID NO: 2802857 - DNA, 17 bp, Homo sapiens
tgtggcccctgaacaag

SEQ ID NO: 2802858 - DNA, 22 bp, Homo sapiens
tgtggcccctgaacaagaattg

SEQ ID NO: 2802859 - DNA, 16 bp, Homo sapiens
tgtggcgggcagtggg

SEQ ID NO: 2802860 - DNA, 13 bp, Homo sapiens
tgtggcggtgcct

SEQ ID NO: 2802861 - DNA, 23 bp, Homo sapiens
tgtggcgttctgctgcccctgca

SEQ ID NO: 2802862 - DNA, 21 bp, Homo sapiens
tgtggctcctgggggttcttt

SEQ ID NO: 2802863 - DNA, 14 bp, Homo sapiens
tgtggctgctagca

SEQ ID NO: 2802864 - DNA, 22 bp, Homo sapiens
tgtgggctagttgggcttcctc

SEQ ID NO: 2802865 - DNA, 15 bp, Homo sapiens
tgtgggtcaaggaat

SEQ ID NO: 2802866 - DNA, 13 bp, Homo sapiens
tgtgggtgggaga

SEQ ID NO: 2802867 - DNA, 14 bp, Homo sapiens
tgtgggtgttaatt

SEQ ID NO: 2802868 - DNA, 16 bp, Homo sapiens
tgtggtacaatctcaa

SEQ ID NO: 2802869 - DNA, 15 bp, Homo sapiens
tgtggttaatgccat

SEQ ID NO: 2802870 - DNA, 20 bp, Homo sapiens
tgtgtaaatggagcttgtac

SEQ ID NO: 2802871 - DNA, 12 bp, Homo sapiens
tgtgtaataaaa

SEQ ID NO: 2802872 - DNA, 20 bp, Homo sapiens
tgtgtacaaagtagagaagt

SEQ ID NO: 2802873 - DNA, 22 bp, Homo sapiens
tgtgtacaaagtagagaagtat

SEQ ID NO: 2802874 - DNA, 18 bp, Homo sapiens
tgtgtagctctgtccact

SEQ ID NO: 2802875 - DNA, 22 bp, Homo sapiens
tgtgtagctgtgacctgctgag

SEQ ID NO: 2802876 - DNA, 17 bp, Homo sapiens
tgtgtagctttgctctt

SEQ ID NO: 2802877 - DNA, 14 bp, Homo sapiens
tgtgtagggaaagt

SEQ ID NO: 2802878 - DNA, 21 bp, Homo sapiens
tgtgtatagatgcaagatatt

SEQ ID NO: 2802879 - DNA, 15 bp, Homo sapiens
tgtgtcacactgagc

SEQ ID NO: 2802880 - DNA, 17 bp, Homo sapiens
tgtgtcaggtggggcag

SEQ ID NO: 2802881 - DNA, 12 bp, Homo sapiens
tgtgtcatatta

SEQ ID NO: 2802882 - DNA, 17 bp, Homo sapiens
tgtgtctctcgatgcca

SEQ ID NO: 2802883 - DNA, 13 bp, Homo sapiens
tgtgtcttctatt

SEQ ID NO: 2802884 - DNA, 15 bp, Homo sapiens
tgtgtcttttataaa

SEQ ID NO: 2802885 - DNA, 20 bp, Homo sapiens
tgtgtgaaataccagtgtgg

SEQ ID NO: 2802886 - DNA, 19 bp, Homo sapiens
tgtcatgatttcaatgatt

SEQ ID NO: 2802887 - DNA, 23 bp, Homo sapiens
tgtcattaaatggggctcacaaa

SEQ ID NO: 2802888 - DNA, 22 bp, Homo sapiens
tgtcattactgcctttggaaga

SEQ ID NO: 2802889 - DNA, 23 bp, Homo sapiens
tgtcattactgcctttggaagaa

SEQ ID NO: 2802890 - DNA, 16 bp, Homo sapiens
tgtcattcaagcctgt

SEQ ID NO: 2802891 - DNA, 20 bp, Homo sapiens
tgtcattcaagcctgtgaat

SEQ ID NO: 2802892 - DNA, 23 bp, Homo sapiens
tgtcattcaggaccccaacccct

SEQ ID NO: 2802893 - DNA, 16 bp, Homo sapiens
tgtcatttcatttcct

SEQ ID NO: 2802894 - DNA, 21 bp, Homo sapiens
tgtcatttgagcagggctcag

SEQ ID NO: 2802895 - DNA, 22 bp, Homo sapiens
tgtcatttgagcagggctcagc

SEQ ID NO: 2802896 - DNA, 20 bp, Homo sapiens
tgtccaacaactccaggaaa

SEQ ID NO: 2802897 - DNA, 21 bp, Homo sapiens
tgtccaacaactccaggaaaa

SEQ ID NO: 2802898 - DNA, 22 bp, Homo sapiens
tgtccaacctaacccctttcct

SEQ ID NO: 2802899 - DNA, 11 bp, Homo sapiens
tgtccacctgg

SEQ ID NO: 2802900 - DNA, 14 bp, Homo sapiens
tgtccacctggccc

SEQ ID NO: 2802901 - DNA, 15 bp, Homo sapiens
tgtccagaagaatat

SEQ ID NO: 2802902 - DNA, 16 bp, Homo sapiens
tgtccagaagaatatt

SEQ ID NO: 2802903 - DNA, 16 bp, Homo sapiens
tgtccagcacagaagg

SEQ ID NO: 2802904 - DNA, 21 bp, Homo sapiens
tgtccagcacagaaggaatct

SEQ ID NO: 2802905 - DNA, 21 bp, Homo sapiens
tgtccaggcactgctgcccag

SEQ ID NO: 2802906 - DNA, 13 bp, Homo sapiens
tgtccataaagta

SEQ ID NO: 2802907 - DNA, 23 bp, Homo sapiens
tgtccataaagtaattttgtgaa

SEQ ID NO: 2802908 - DNA, 20 bp, Homo sapiens
tgtccatatcagacctctga

SEQ ID NO: 2802909 - DNA, 23 bp, Homo sapiens
tgtccatatcagacctctgatcc

SEQ ID NO: 2802910 - DNA, 19 bp, Homo sapiens
tgtccatggcagctggtct

SEQ ID NO: 2802911 - DNA, 16 bp, Homo sapiens
tgtcccaacttgtaaa

SEQ ID NO: 2802912 - DNA, 23 bp, Homo sapiens
tgtcccacctcttctcttcctgt

SEQ ID NO: 2802913 - DNA, 13 bp, Homo sapiens
tgtcccatttcct

SEQ ID NO: 2802914 - DNA, 18 bp, Homo sapiens
tgtcccatttccttggag

SEQ ID NO: 2802915 - DNA, 21 bp, Homo sapiens
tgtccccctgagatcagagtc

SEQ ID NO: 2802916 - DNA, 23 bp, Homo sapiens
tgtccccctgagatcagagtcct

SEQ ID NO: 2802917 - DNA, 14 bp, Homo sapiens
tgtccctgcacttg

SEQ ID NO: 2802918 - DNA, 20 bp, Homo sapiens
tgtccctgcacttgcagact

SEQ ID NO: 2802919 - DNA, 22 bp, Homo sapiens
tgtccctgcacttgcagactct

SEQ ID NO: 2802920 - DNA, 23 bp, Homo sapiens
tgtccctgcacttgcagactcta

SEQ ID NO: 2802921 - DNA, 14 bp, Homo sapiens
tgtccctggtgcag

SEQ ID NO: 2802922 - DNA, 13 bp, Homo sapiens
tgtccctgtcacc

SEQ ID NO: 2802923 - DNA, 16 bp, Homo sapiens
tgtccctgtcaccaag

SEQ ID NO: 2802924 - DNA, 16 bp, Homo sapiens
tgtcccttgctgtttt

SEQ ID NO: 2802925 - DNA, 16 bp, Homo sapiens
tgtcctacccaccctc

SEQ ID NO: 2802926 - DNA, 23 bp, Homo sapiens
tgtcctaggggccgagggaaatg

SEQ ID NO: 2802927 - DNA, 15 bp, Homo sapiens
tgtcctccagcttcc

SEQ ID NO: 2802928 - DNA, 12 bp, Homo sapiens
tgtcctgctgtg

SEQ ID NO: 2802929 - DNA, 20 bp, Homo sapiens
tgtcctgggagtgagctggt

SEQ ID NO: 2802930 - DNA, 23 bp, Homo sapiens
tgtcctgttattttttatttcca

SEQ ID NO: 2802931 - DNA, 16 bp, Homo sapiens
tgtccttgcacctgca

SEQ ID NO: 2802932 - DNA, 15 bp, Homo sapiens
tgtccttgtgtgttt

SEQ ID NO: 2802933 - DNA, 17 bp, Homo sapiens
tgtcctttgagaaagaa

SEQ ID NO: 2802934 - DNA, 13 bp, Homo sapiens
tgtcgagacactt

SEQ ID NO: 2802935 - DNA, 18 bp, Homo sapiens
tgtcgattagactggaca

SEQ ID NO: 2802936 - DNA, 14 bp, Homo sapiens
tgtcgcctctgcat

SEQ ID NO: 2802937 - DNA, 13 bp, Homo sapiens
tgtcgcctgcccc

SEQ ID NO: 2802938 - DNA, 14 bp, Homo sapiens
tgtcgcctgccccc

SEQ ID NO: 2802939 - DNA, 16 bp, Homo sapiens
tgtcgcctgcccccag

SEQ ID NO: 2802940 - DNA, 17 bp, Homo sapiens
tgtcgctctgctggcct

SEQ ID NO: 2802941 - DNA, 15 bp, Homo sapiens
tgtcgctgcttcgtg

SEQ ID NO: 2802942 - DNA, 17 bp, Homo sapiens
tgtcggagtagaaattg

SEQ ID NO: 2802943 - DNA, 18 bp, Homo sapiens
tgtcggcacgtcccatgt

SEQ ID NO: 2802944 - DNA, 23 bp, Homo sapiens
tgtcgtagccaaggtgggctgag

SEQ ID NO: 2802945 - DNA, 17 bp, Homo sapiens
tgtcgtgtttacaaaag

SEQ ID NO: 2802946 - DNA, 21 bp, Homo sapiens
tgtctccactaaatgagctcc

SEQ ID NO: 2802947 - DNA, 18 bp, Homo sapiens
tgtctcgagcgccctgca

SEQ ID NO: 2802948 - DNA, 13 bp, Homo sapiens
tgtctctcagaat

SEQ ID NO: 2802949 - DNA, 14 bp, Homo sapiens
tgtctctgctcttg

SEQ ID NO: 2802950 - DNA, 12 bp, Homo sapiens
tgtctctgtccc

SEQ ID NO: 2802951 - DNA, 21 bp, Homo sapiens
tgtctgatcgttcaaagcatg

SEQ ID NO: 2802952 - DNA, 15 bp, Homo sapiens
tgtctgcacccaggg

SEQ ID NO: 2802953 - DNA, 16 bp, Homo sapiens
tgtctgcacccagggg

SEQ ID NO: 2802954 - DNA, 15 bp, Homo sapiens
tgtctgccagccagc

SEQ ID NO: 2802955 - DNA, 16 bp, Homo sapiens
tgtctgccagccagca

SEQ ID NO: 2802956 - DNA, 18 bp, Homo sapiens
tgtctgccagccagcagc

SEQ ID NO: 2802957 - DNA, 21 bp, Homo sapiens
tgtctgcgtggttcctttctc

SEQ ID NO: 2802958 - DNA, 19 bp, Homo sapiens
tgtctggctgaggatttca

SEQ ID NO: 2802959 - DNA, 23 bp, Homo sapiens
tgtctggctgaggatttcaagcc

SEQ ID NO: 2802960 - DNA, 18 bp, Homo sapiens
tgtctggggaccctgtag

SEQ ID NO: 2802961 - DNA, 13 bp, Homo sapiens
tgtctgtgcagct

SEQ ID NO: 2802962 - DNA, 22 bp, Homo sapiens
tgtctgtttcaatgacctgtat

SEQ ID NO: 2802963 - DNA, 16 bp, Homo sapiens
tgtctgtttgttctct

SEQ ID NO: 2802964 - DNA, 19 bp, Homo sapiens
tgtcttatggcgttgcagg

SEQ ID NO: 2802965 - DNA, 15 bp, Homo sapiens
tgtcttcatagcaga

SEQ ID NO: 2802966 - DNA, 12 bp, Homo sapiens
tgtcttccataa

SEQ ID NO: 2802967 - DNA, 17 bp, Homo sapiens
tgtcttccataatgtat

SEQ ID NO: 2802968 - DNA, 21 bp, Homo sapiens
tgtcttgcaatggcagccttg

SEQ ID NO: 2802969 - DNA, 16 bp, Homo sapiens
tgtcttgtacatgtgt

SEQ ID NO: 2802970 - DNA, 22 bp, Homo sapiens
tgtcttgtacatgtgtagcctg

SEQ ID NO: 2802971 - DNA, 19 bp, Homo sapiens
tgtctttctccaaagttat

SEQ ID NO: 2802972 - DNA, 19 bp, Homo sapiens
tgtctttgttggaaaagaa

SEQ ID NO: 2802973 - DNA, 15 bp, Homo sapiens
tgtgaaccaccacac

SEQ ID NO: 2802974 - DNA, 23 bp, Homo sapiens
tgtgaaccaccacacccagccca

SEQ ID NO: 2802975 - DNA, 16 bp, Homo sapiens
tgtgaacccaggacaa

SEQ ID NO: 2802976 - DNA, 22 bp, Homo sapiens
tgtactgagccttgtaattcta

SEQ ID NO: 2802977 - DNA, 12 bp, Homo sapiens
tgtactgcctgc

SEQ ID NO: 2802978 - DNA, 14 bp, Homo sapiens
tgtactgcctgctt

SEQ ID NO: 2802979 - DNA, 15 bp, Homo sapiens
tgtactgcctgcttg

SEQ ID NO: 2802980 - DNA, 17 bp, Homo sapiens
tgtacttattttccaat

SEQ ID NO: 2802981 - DNA, 21 bp, Homo sapiens
tgtacttattttccaataaaa

SEQ ID NO: 2802982 - DNA, 12 bp, Homo sapiens
tgtagaaatgta

SEQ ID NO: 2802983 - DNA, 17 bp, Homo sapiens
tgtagaacctaattcaa

SEQ ID NO: 2802984 - DNA, 15 bp, Homo sapiens
tgtagagccagggtc

SEQ ID NO: 2802985 - DNA, 15 bp, Homo sapiens
tgtagattgcgtgga

SEQ ID NO: 2802986 - DNA, 15 bp, Homo sapiens
tgtagcctgtgcatg

SEQ ID NO: 2802987 - DNA, 22 bp, Homo sapiens
tgtagcctgtgcatgtatgtct

SEQ ID NO: 2802988 - DNA, 16 bp, Homo sapiens
tgtagccttgcccgga

SEQ ID NO: 2802989 - DNA, 17 bp, Homo sapiens
tgtagccttgcccggat

SEQ ID NO: 2802990 - DNA, 13 bp, Homo sapiens
tgtagctgtgacc

SEQ ID NO: 2802991 - DNA, 15 bp, Homo sapiens
tgtagctgtgacctg

SEQ ID NO: 2802992 - DNA, 16 bp, Homo sapiens
tgtagctgtgacctgc

SEQ ID NO: 2802993 - DNA, 19 bp, Homo sapiens
tgtagctgtgacctgctga

SEQ ID NO: 2802994 - DNA, 21 bp, Homo sapiens
tgtagctgtgacctgctgagc

SEQ ID NO: 2802995 - DNA, 11 bp, Homo sapiens
tgtaggagaat

SEQ ID NO: 2802996 - DNA, 12 bp, Homo sapiens
tgtagggctgga

SEQ ID NO: 2802997 - DNA, 16 bp, Homo sapiens
tgtagggctggaccta

SEQ ID NO: 2802998 - DNA, 17 bp, Homo sapiens
tgtaggtatgaataagt

SEQ ID NO: 2802999 - DNA, 21 bp, Homo sapiens
tgtaggtcaatgaaatatttg

SEQ ID NO: 2803000 - DNA, 20 bp, Homo sapiens
tgtaggtgtctgcacccagg

SEQ ID NO: 2803001 - DNA, 13 bp, Homo sapiens
tgtaggttgctta

SEQ ID NO: 2803002 - DNA, 23 bp, Homo sapiens
tgtagtcctagccactcaggagg

SEQ ID NO: 2803003 - DNA, 23 bp, Homo sapiens
tgtagttaggaaataaaaccttt

SEQ ID NO: 2803004 - DNA, 19 bp, Homo sapiens
tgtagttcttgtctgattg

SEQ ID NO: 2803005 - DNA, 13 bp, Homo sapiens
tgtataaaaatag

SEQ ID NO: 2803006 - DNA, 15 bp, Homo sapiens
tgtataatattttta

SEQ ID NO: 2803007 - DNA, 15 bp, Homo sapiens
tgtatagtactggca

SEQ ID NO: 2803008 - DNA, 21 bp, Homo sapiens
tgtatagtactggcatggtac

SEQ ID NO: 2803009 - DNA, 20 bp, Homo sapiens
tgtatagtgagtgtggctta

SEQ ID NO: 2803010 - DNA, 22 bp, Homo sapiens
tgtatagttttataaaactcag

SEQ ID NO: 2803011 - DNA, 17 bp, Homo sapiens
tgtatatacaataacat

SEQ ID NO: 2803012 - DNA, 18 bp, Homo sapiens
tgtatatacaataacata

SEQ ID NO: 2803013 - DNA, 13 bp, Homo sapiens
tgtatatacatat

SEQ ID NO: 2803014 - DNA, 14 bp, Homo sapiens
tgtatatacatatt

SEQ ID NO: 2803015 - DNA, 19 bp, Homo sapiens
tgtatatacatattataaa

SEQ ID NO: 2803016 - DNA, 13 bp, Homo sapiens
tgtatatagtttg

SEQ ID NO: 2803017 - DNA, 15 bp, Homo sapiens
tgtatatatatatat

SEQ ID NO: 2803018 - DNA, 16 bp, Homo sapiens
tgtatattaaggtgtg

SEQ ID NO: 2803019 - DNA, 19 bp, Homo sapiens
tgtatattaaggtgtggct

SEQ ID NO: 2803020 - DNA, 21 bp, Homo sapiens
tgtatattatggaagatttta

SEQ ID NO: 2803021 - DNA, 19 bp, Homo sapiens
tgtatattatggtgtaatg

SEQ ID NO: 2803022 - DNA, 15 bp, Homo sapiens
tgtatattccaccat

SEQ ID NO: 2803023 - DNA, 16 bp, Homo sapiens
tgtatcatagaaatgt

SEQ ID NO: 2803024 - DNA, 19 bp, Homo sapiens
tgtatctatgcattttctg

SEQ ID NO: 2803025 - DNA, 19 bp, Homo sapiens
tgtatggaatacagtgtta

SEQ ID NO: 2803026 - DNA, 23 bp, Homo sapiens
tgtatgggtgtgtgtttgtgtga

SEQ ID NO: 2803027 - DNA, 14 bp, Homo sapiens
tgtatgtcttggac

SEQ ID NO: 2803028 - DNA, 22 bp, Homo sapiens
tgtattcagatcgtattaatta

SEQ ID NO: 2803029 - DNA, 20 bp, Homo sapiens
tgtatttgttaatggtttga

SEQ ID NO: 2803030 - DNA, 16 bp, Homo sapiens
tgtattttagcagaga

SEQ ID NO: 2803031 - DNA, 11 bp, Homo sapiens
tgtattttcca

SEQ ID NO: 2803032 - DNA, 14 bp, Homo sapiens
tgtattttccatac

SEQ ID NO: 2803033 - DNA, 20 bp, Homo sapiens
tgtattttcttcccatttgt

SEQ ID NO: 2803034 - DNA, 16 bp, Homo sapiens
tgtattttgagataat

SEQ ID NO: 2803035 - DNA, 16 bp, Homo sapiens
tgtatttttgaataaa

SEQ ID NO: 2803036 - DNA, 15 bp, Homo sapiens
tgtatttttgtttaa

SEQ ID NO: 2803037 - DNA, 23 bp, Homo sapiens
tgtcaaaaatgtcttgggtaggc

SEQ ID NO: 2803038 - DNA, 13 bp, Homo sapiens
tgtcaatattaaa

SEQ ID NO: 2803039 - DNA, 18 bp, Homo sapiens
tgtcaatattaaatacag

SEQ ID NO: 2803040 - DNA, 21 bp, Homo sapiens
tgtcaatattaaatacagaca

SEQ ID NO: 2803041 - DNA, 23 bp, Homo sapiens
tgtcaatattaaatacagacact

SEQ ID NO: 2803042 - DNA, 23 bp, Homo sapiens
tgtcaatttccctgactcctcta

SEQ ID NO: 2803043 - DNA, 18 bp, Homo sapiens
tgtcaatttgtatatcat

SEQ ID NO: 2803044 - DNA, 15 bp, Homo sapiens
tgtcacactgagctg

SEQ ID NO: 2803045 - DNA, 20 bp, Homo sapiens
tgtcacactgagctgggcac

SEQ ID NO: 2803046 - DNA, 13 bp, Homo sapiens
tgtcacaggcagg

SEQ ID NO: 2803047 - DNA, 21 bp, Homo sapiens
tgtcacaggcaggtccagggt

SEQ ID NO: 2803048 - DNA, 18 bp, Homo sapiens
tgtcaccaccttcccagc

SEQ ID NO: 2803049 - DNA, 19 bp, Homo sapiens
tgtcaccaccttcccagct

SEQ ID NO: 2803050 - DNA, 21 bp, Homo sapiens
tgtcaccaccttcccagctct

SEQ ID NO: 2803051 - DNA, 18 bp, Homo sapiens
tgtcaccagctgccaaaa

SEQ ID NO: 2803052 - DNA, 18 bp, Homo sapiens
tgtcaccgtggaccttcc

SEQ ID NO: 2803053 - DNA, 13 bp, Homo sapiens
tgtcacctgaaga

SEQ ID NO: 2803054 - DNA, 23 bp, Homo sapiens
tgtcacgtggtcaaggcccggcc

SEQ ID NO: 2803055 - DNA, 21 bp, Homo sapiens
tgtcactggtagaccaaaata

SEQ ID NO: 2803056 - DNA, 12 bp, Homo sapiens
tgtcagaaactc

SEQ ID NO: 2803057 - DNA, 20 bp, Homo sapiens
tgtcagacctatttgacata

SEQ ID NO: 2803058 - DNA, 20 bp, Homo sapiens
tgtcagatattttttcagaa

SEQ ID NO: 2803059 - DNA, 22 bp, Homo sapiens
tgtcagccgagccgggcctggg

SEQ ID NO: 2803060 - DNA, 20 bp, Homo sapiens
tgtcaggaacagaaggatga

SEQ ID NO: 2803061 - DNA, 14 bp, Homo sapiens
tgtcataagaatga

SEQ ID NO: 2803062 - DNA, 15 bp, Homo sapiens
tgtcatagaaattac

SEQ ID NO: 2803063 - DNA, 15 bp, Homo sapiens
tgtcatatattcatg

SEQ ID NO: 2803064 - DNA, 19 bp, Homo sapiens
tgtcatcaaatattaccaa

SEQ ID NO: 2803065 - DNA, 23 bp, Homo sapiens
tgtcatcccgctcctgctgaaac

SEQ ID NO: 2803066 - DNA, 14 bp, Homo sapiens
ttcagcctctccca

SEQ ID NO: 2803067 - DNA, 22 bp, Homo sapiens
ttcagctccagctcaccagccc

SEQ ID NO: 2803068 - DNA, 19 bp, Homo sapiens
ttcaggaaaaggcctgggg

SEQ ID NO: 2803069 - DNA, 13 bp, Homo sapiens
ttcaggaaaattg

SEQ ID NO: 2803070 - DNA, 18 bp, Homo sapiens
ttcaggaaaattgaatgc

SEQ ID NO: 2803071 - DNA, 17 bp, Homo sapiens
ttcaggatactctgtca

SEQ ID NO: 2803072 - DNA, 18 bp, Homo sapiens
ttcagggaatttcaggaa

SEQ ID NO: 2803073 - DNA, 21 bp, Homo sapiens
ttcaggggggttgtgaggcct

SEQ ID NO: 2803074 - DNA, 15 bp, Homo sapiens
ttcaggtaacaggca

SEQ ID NO: 2803075 - DNA, 21 bp, Homo sapiens
ttcagtaggtttgtgtggatg

SEQ ID NO: 2803076 - DNA, 13 bp, Homo sapiens
ttcagtcttggag

SEQ ID NO: 2803077 - DNA, 10 bp, Homo sapiens
ttcagtgccc

SEQ ID NO: 2803078 - DNA, 13 bp, Homo sapiens
ttcagtgctgtgg

SEQ ID NO: 2803079 - DNA, 21 bp, Homo sapiens
ttcagtgctgtggcctgggca

SEQ ID NO: 2803080 - DNA, 13 bp, Homo sapiens
ttcagtggcagct

SEQ ID NO: 2803081 - DNA, 15 bp, Homo sapiens
ttcataacctagcct

SEQ ID NO: 2803082 - DNA, 17 bp, Homo sapiens
ttcataactttcattaa

SEQ ID NO: 2803083 - DNA, 18 bp, Homo sapiens
ttcatatatgaggacttg

SEQ ID NO: 2803084 - DNA, 21 bp, Homo sapiens
ttcatatatgaggacttgtgt

SEQ ID NO: 2803085 - DNA, 12 bp, Homo sapiens
ttcatcaatttt

SEQ ID NO: 2803086 - DNA, 21 bp, Homo sapiens
ttcatcaatttttatacatat

SEQ ID NO: 2803087 - DNA, 22 bp, Homo sapiens
ttcatcaatttttatacatatc

SEQ ID NO: 2803088 - DNA, 22 bp, Homo sapiens
ttcatctatggcagtccagcca

SEQ ID NO: 2803089 - DNA, 18 bp, Homo sapiens
ttcatctatttctgagaa

SEQ ID NO: 2803090 - DNA, 12 bp, Homo sapiens
ttcatctcattt

SEQ ID NO: 2803091 - DNA, 16 bp, Homo sapiens
ttcatctcatttaagg

SEQ ID NO: 2803092 - DNA, 15 bp, Homo sapiens
ttcatgataatgaac

SEQ ID NO: 2803093 - DNA, 18 bp, Homo sapiens
ttcatgatgaattacttc

SEQ ID NO: 2803094 - DNA, 23 bp, Homo sapiens
ttcatgatttcatttcaactgtt

SEQ ID NO: 2803095 - DNA, 15 bp, Homo sapiens
ttcatgcaatgacat

SEQ ID NO: 2803096 - DNA, 14 bp, Homo sapiens
ttcatgctcagccc

SEQ ID NO: 2803097 - DNA, 14 bp, Homo sapiens
ttcattagctgtga

SEQ ID NO: 2803098 - DNA, 13 bp, Homo sapiens
ttcattcttgaaa

SEQ ID NO: 2803099 - DNA, 13 bp, Homo sapiens
ttcattgaccaag

SEQ ID NO: 2803100 - DNA, 16 bp, Homo sapiens
ttcatttaactacaaa

SEQ ID NO: 2803101 - DNA, 16 bp, Homo sapiens
ttcatttcactttaaa

SEQ ID NO: 2803102 - DNA, 16 bp, Homo sapiens
ttcatttcctccgtca

SEQ ID NO: 2803103 - DNA, 18 bp, Homo sapiens
ttcattttaacatctgag

SEQ ID NO: 2803104 - DNA, 21 bp, Homo sapiens
ttcattttaacatctgagaaa

SEQ ID NO: 2803105 - DNA, 14 bp, Homo sapiens
ttcattttcagagt

SEQ ID NO: 2803106 - DNA, 11 bp, Homo sapiens
ttcatttttgg

SEQ ID NO: 2803107 - DNA, 20 bp, Homo sapiens
ttccaaacttctaaatgttg

SEQ ID NO: 2803108 - DNA, 19 bp, Homo sapiens
ttccaaagcacattgaaag

SEQ ID NO: 2803109 - DNA, 11 bp, Homo sapiens
ttccaaagctc

SEQ ID NO: 2803110 - DNA, 19 bp, Homo sapiens
ttccaaagttttgaagtca

SEQ ID NO: 2803111 - DNA, 13 bp, Homo sapiens
ttccaacagacag

SEQ ID NO: 2803112 - DNA, 16 bp, Homo sapiens
ttccaacagacagggc

SEQ ID NO: 2803113 - DNA, 13 bp, Homo sapiens
ttccaagagctga

SEQ ID NO: 2803114 - DNA, 23 bp, Homo sapiens
ttccacaggagggagagaactta

SEQ ID NO: 2803115 - DNA, 13 bp, Homo sapiens
ttccacataaagg

SEQ ID NO: 2803116 - DNA, 14 bp, Homo sapiens
ttccacctgctttc

SEQ ID NO: 2803117 - DNA, 16 bp, Homo sapiens
ttccagacctgaagaa

SEQ ID NO: 2803118 - DNA, 23 bp, Homo sapiens
ttccagactgcttccaattttct

SEQ ID NO: 2803119 - DNA, 17 bp, Homo sapiens
ttccagagagtcctctg

SEQ ID NO: 2803120 - DNA, 20 bp, Homo sapiens
ttccagagagtcctctggat

SEQ ID NO: 2803121 - DNA, 23 bp, Homo sapiens
ttccagctagtgacccacatgcc

SEQ ID NO: 2803122 - DNA, 11 bp, Homo sapiens
ttattctgctc

SEQ ID NO: 2803123 - DNA, 14 bp, Homo sapiens
ttattgacaataat

SEQ ID NO: 2803124 - DNA, 22 bp, Homo sapiens
ttattgacaataatttcaggtt

SEQ ID NO: 2803125 - DNA, 13 bp, Homo sapiens
ttattgagaattt

SEQ ID NO: 2803126 - DNA, 14 bp, Homo sapiens
ttattgcttaatcc

SEQ ID NO: 2803127 - DNA, 15 bp, Homo sapiens
ttattgcttaatccc

SEQ ID NO: 2803128 - DNA, 19 bp, Homo sapiens
ttattgggcaagtgattga

SEQ ID NO: 2803129 - DNA, 12 bp, Homo sapiens
ttatttaaatga

SEQ ID NO: 2803130 - DNA, 17 bp, Homo sapiens
ttatttacaatgcagaa

SEQ ID NO: 2803131 - DNA, 14 bp, Homo sapiens
ttatttatgcctct

SEQ ID NO: 2803132 - DNA, 13 bp, Homo sapiens
ttatttattcact

SEQ ID NO: 2803133 - DNA, 22 bp, Homo sapiens
ttatttcaaccgcttgccatat

SEQ ID NO: 2803134 - DNA, 18 bp, Homo sapiens
ttatttgcagagacagga

SEQ ID NO: 2803135 - DNA, 18 bp, Homo sapiens
ttatttgtaatagatgtt

SEQ ID NO: 2803136 - DNA, 13 bp, Homo sapiens
ttatttgtataat

SEQ ID NO: 2803137 - DNA, 18 bp, Homo sapiens
ttattttaggagacagtc

SEQ ID NO: 2803138 - DNA, 20 bp, Homo sapiens
ttattttagtctgtcatcca

SEQ ID NO: 2803139 - DNA, 12 bp, Homo sapiens
ttattttcactg

SEQ ID NO: 2803140 - DNA, 15 bp, Homo sapiens
ttattttgacataaa

SEQ ID NO: 2803141 - DNA, 21 bp, Homo sapiens
ttattttgttgtgattttgta

SEQ ID NO: 2803142 - DNA, 20 bp, Homo sapiens
ttatttttatatcagcctga

SEQ ID NO: 2803143 - DNA, 23 bp, Homo sapiens
ttatttttgtttcttccaaagca

SEQ ID NO: 2803144 - DNA, 16 bp, Homo sapiens
ttattttttaattatt

SEQ ID NO: 2803145 - DNA, 14 bp, Homo sapiens
ttattttttctaca

SEQ ID NO: 2803146 - DNA, 21 bp, Homo sapiens
ttcaaaaagtctacgctctcc

SEQ ID NO: 2803147 - DNA, 16 bp, Homo sapiens
ttcaaaccaggatttt

SEQ ID NO: 2803148 - DNA, 19 bp, Homo sapiens
ttcaaaccatttaattcat

SEQ ID NO: 2803149 - DNA, 20 bp, Homo sapiens
ttcaaagctgtgtgtttgga

SEQ ID NO: 2803150 - DNA, 16 bp, Homo sapiens
ttcaaagcttgaagat

SEQ ID NO: 2803151 - DNA, 18 bp, Homo sapiens
ttcaacaattctaaaatg

SEQ ID NO: 2803152 - DNA, 21 bp, Homo sapiens
ttcaacacattacttgcacaa

SEQ ID NO: 2803153 - DNA, 17 bp, Homo sapiens
ttcaacatgttatttgt

SEQ ID NO: 2803154 - DNA, 15 bp, Homo sapiens
ttcaaccagcatttt

SEQ ID NO: 2803155 - DNA, 18 bp, Homo sapiens
ttcaaccagcattttact

SEQ ID NO: 2803156 - DNA, 23 bp, Homo sapiens
ttcaaccagcattttactacttg

SEQ ID NO: 2803157 - DNA, 14 bp, Homo sapiens
ttcaactgaaaaga

SEQ ID NO: 2803158 - DNA, 17 bp, Homo sapiens
ttcaacttaaatcactg

SEQ ID NO: 2803159 - DNA, 18 bp, Homo sapiens
ttcaacttaaatcactga

SEQ ID NO: 2803160 - DNA, 16 bp, Homo sapiens
ttcaagaaaactggaa

SEQ ID NO: 2803161 - DNA, 13 bp, Homo sapiens
ttcaagaaactga

SEQ ID NO: 2803162 - DNA, 23 bp, Homo sapiens
ttcaagaaactgaggaattttct

SEQ ID NO: 2803163 - DNA, 21 bp, Homo sapiens
ttcaagacaccaaattccaaa

SEQ ID NO: 2803164 - DNA, 18 bp, Homo sapiens
ttcaagaccttctcccca

SEQ ID NO: 2803165 - DNA, 20 bp, Homo sapiens
ttcaagagaagaaaaaatta

SEQ ID NO: 2803166 - DNA, 17 bp, Homo sapiens
ttcaagtgaatctaaaa

SEQ ID NO: 2803167 - DNA, 22 bp, Homo sapiens
ttcaagtgcatgctctctgcag

SEQ ID NO: 2803168 - DNA, 19 bp, Homo sapiens
ttcaataaatgtctgttga

SEQ ID NO: 2803169 - DNA, 11 bp, Homo sapiens
ttcaatattta

SEQ ID NO: 2803170 - DNA, 17 bp, Homo sapiens
ttcaatgacctgtattt

SEQ ID NO: 2803171 - DNA, 16 bp, Homo sapiens
ttcaattcctctggga

SEQ ID NO: 2803172 - DNA, 18 bp, Homo sapiens
ttcaattctcatttgtca

SEQ ID NO: 2803173 - DNA, 17 bp, Homo sapiens
ttcaatttccaagagct

SEQ ID NO: 2803174 - DNA, 19 bp, Homo sapiens
ttcaatttccaagagctga

SEQ ID NO: 2803175 - DNA, 20 bp, Homo sapiens
ttcacaaccagccacacaga

SEQ ID NO: 2803176 - DNA, 13 bp, Homo sapiens
ttcacaatagaaa

SEQ ID NO: 2803177 - DNA, 23 bp, Homo sapiens
ttcacaattccatttccagttca

SEQ ID NO: 2803178 - DNA, 13 bp, Homo sapiens
ttactacagttgt

SEQ ID NO: 2803179 - DNA, 14 bp, Homo sapiens
ttactacatgcact

SEQ ID NO: 2803180 - DNA, 22 bp, Homo sapiens
ttactactattctgttaaaatc

SEQ ID NO: 2803181 - DNA, 16 bp, Homo sapiens
ttactacttgttacct

SEQ ID NO: 2803182 - DNA, 16 bp, Homo sapiens
ttactatgcacaattt

SEQ ID NO: 2803183 - DNA, 13 bp, Homo sapiens
ttactcagccctg

SEQ ID NO: 2803184 - DNA, 21 bp, Homo sapiens
ttactccacagcggaggagac

SEQ ID NO: 2803185 - DNA, 16 bp, Homo sapiens
ttactgagcttctctg

SEQ ID NO: 2803186 - DNA, 19 bp, Homo sapiens
ttactgagcttctctgtga

SEQ ID NO: 2803187 - DNA, 12 bp, Homo sapiens
ttactggtttca

SEQ ID NO: 2803188 - DNA, 24 bp, Homo sapiens
ttactgtaattggtgacaatgtca

SEQ ID NO: 2803189 - DNA, 14 bp, Homo sapiens
ttactgtctgtaag

SEQ ID NO: 2803190 - DNA, 18 bp, Homo sapiens
ttactgttagtcatttgc

SEQ ID NO: 2803191 - DNA, 16 bp, Homo sapiens
ttacttaaagcttgtt

SEQ ID NO: 2803192 - DNA, 15 bp, Homo sapiens
ttacttcctatcaag

SEQ ID NO: 2803193 - DNA, 13 bp, Homo sapiens
ttacttgcacaag

SEQ ID NO: 2803194 - DNA, 19 bp, Homo sapiens
ttacttggtgtaattaata

SEQ ID NO: 2803195 - DNA, 17 bp, Homo sapiens
ttactttaaaaggagcc

SEQ ID NO: 2803196 - DNA, 18 bp, Homo sapiens
ttactttaaaaggagcca

SEQ ID NO: 2803197 - DNA, 11 bp, Homo sapiens
ttactttctgt

SEQ ID NO: 2803198 - DNA, 21 bp, Homo sapiens
ttactttggaatgactataaa

SEQ ID NO: 2803199 - DNA, 21 bp, Homo sapiens
ttactttttagtcttttactc

SEQ ID NO: 2803200 - DNA, 14 bp, Homo sapiens
ttagaaaacattca

SEQ ID NO: 2803201 - DNA, 13 bp, Homo sapiens
ttagaaatagaca

SEQ ID NO: 2803202 - DNA, 15 bp, Homo sapiens
ttagaaatagacagt

SEQ ID NO: 2803203 - DNA, 13 bp, Homo sapiens
ttagaaatcattt

SEQ ID NO: 2803204 - DNA, 16 bp, Homo sapiens
ttagaaatgcagaatc

SEQ ID NO: 2803205 - DNA, 18 bp, Homo sapiens
ttagaacaggcaagtgaa

SEQ ID NO: 2803206 - DNA, 20 bp, Homo sapiens
ttagaacaggcaagtgaaga

SEQ ID NO: 2803207 - DNA, 17 bp, Homo sapiens
ttagaagagcctgactg

SEQ ID NO: 2803208 - DNA, 16 bp, Homo sapiens
ttagaagtcacacagt

SEQ ID NO: 2803209 - DNA, 13 bp, Homo sapiens
ttagaatgaaaat

SEQ ID NO: 2803210 - DNA, 20 bp, Homo sapiens
ttagacagagtctcactgtt

SEQ ID NO: 2803211 - DNA, 11 bp, Homo sapiens
ttagacctcag

SEQ ID NO: 2803212 - DNA, 21 bp, Homo sapiens
ttagactagttgaacatctca

SEQ ID NO: 2803213 - DNA, 15 bp, Homo sapiens
ttagactggacagct

SEQ ID NO: 2803214 - DNA, 17 bp, Homo sapiens
ttagaggaaaaaaatga

SEQ ID NO: 2803215 - DNA, 20 bp, Homo sapiens
ttagagtgcccttaaaataa

SEQ ID NO: 2803216 - DNA, 22 bp, Homo sapiens
ttagagtgcccttaaaataatg

SEQ ID NO: 2803217 - DNA, 14 bp, Homo sapiens
ttagattagctctg

SEQ ID NO: 2803218 - DNA, 16 bp, Homo sapiens
ttagattagctctgga

SEQ ID NO: 2803219 - DNA, 13 bp, Homo sapiens
ttagattttatga

SEQ ID NO: 2803220 - DNA, 13 bp, Homo sapiens
ttagcaaagagtt

SEQ ID NO: 2803221 - DNA, 23 bp, Homo sapiens
ttagcagctcttcccctttcctg

SEQ ID NO: 2803222 - DNA, 22 bp, Homo sapiens
ttagcaggaaatagtgttcttt

SEQ ID NO: 2803223 - DNA, 20 bp, Homo sapiens
ttagcctcaatttctgaaca

SEQ ID NO: 2803224 - DNA, 12 bp, Homo sapiens
ttagccttctct

SEQ ID NO: 2803225 - DNA, 15 bp, Homo sapiens
ttagccttctctgtt

SEQ ID NO: 2803226 - DNA, 20 bp, Homo sapiens
ttagctgtaaatacatgtgt

SEQ ID NO: 2803227 - DNA, 17 bp, Homo sapiens
ttagctgtctgctcaga

SEQ ID NO: 2803228 - DNA, 15 bp, Homo sapiens
ttagctgtgtgaaat

SEQ ID NO: 2803229 - DNA, 16 bp, Homo sapiens
ttagctgtgtgaaata

SEQ ID NO: 2803230 - DNA, 16 bp, Homo sapiens
ttagctgttatttcta

SEQ ID NO: 2803231 - DNA, 21 bp, Homo sapiens
ttagctgttatttctattttt

SEQ ID NO: 2803232 - DNA, 12 bp, Homo sapiens
ttaggaaataaa

SEQ ID NO: 2803233 - DNA, 15 bp, Homo sapiens
ttaggaaataaaacc

SEQ ID NO: 2803234 - DNA, 17 bp, Homo sapiens
ttaggaaataaaacctt

SEQ ID NO: 2803235 - DNA, 15 bp, Homo sapiens
ttaggaagagaaacc

SEQ ID NO: 2803236 - DNA, 21 bp, Homo sapiens
ttaggagttcgagaccagcct

SEQ ID NO: 2803237 - DNA, 13 bp, Homo sapiens
ttaggcagcagct

SEQ ID NO: 2803238 - DNA, 23 bp, Homo sapiens
ttaggcagcagcttttaatacag

SEQ ID NO: 2803239 - DNA, 17 bp, Homo sapiens
ttaggggaaaatagtag

SEQ ID NO: 2803240 - DNA, 14 bp, Homo sapiens
ttaggttataagaa

SEQ ID NO: 2803241 - DNA, 14 bp, Homo sapiens
ttaggttttgtaca

SEQ ID NO: 2803242 - DNA, 18 bp, Homo sapiens
ttagtacagtagcttaaa

SEQ ID NO: 2803243 - DNA, 23 bp, Homo sapiens
ttagtacagtagcttaaataaat

SEQ ID NO: 2803244 - DNA, 13 bp, Homo sapiens
ttagtagagacag

SEQ ID NO: 2803245 - DNA, 18 bp, Homo sapiens
ttagtcttttactccttt

SEQ ID NO: 2803246 - DNA, 14 bp, Homo sapiens
ttagtgagatttgt

SEQ ID NO: 2803247 - DNA, 17 bp, Homo sapiens
ttagtgagatttgtatt

SEQ ID NO: 2803248 - DNA, 23 bp, Homo sapiens
ttagtgtcacttacctagattta

SEQ ID NO: 2803249 - DNA, 15 bp, Homo sapiens
ttagttctttgttat

SEQ ID NO: 2803250 - DNA, 14 bp, Homo sapiens
ttagtttctttggg

SEQ ID NO: 2803251 - DNA, 15 bp, Homo sapiens
ttagttttagttgca

SEQ ID NO: 2803252 - DNA, 17 bp, Homo sapiens
ttataaataaatgccaa

SEQ ID NO: 2803253 - DNA, 18 bp, Homo sapiens
ttataaataaatgccaac

SEQ ID NO: 2803254 - DNA, 18 bp, Homo sapiens
ttataactgaaggagaag

SEQ ID NO: 2803255 - DNA, 13 bp, Homo sapiens
ttataacttaaaa

SEQ ID NO: 2803256 - DNA, 12 bp, Homo sapiens
ttataagaaaca

SEQ ID NO: 2803257 - DNA, 17 bp, Homo sapiens
ttataagcccaaatggc

SEQ ID NO: 2803258 - DNA, 21 bp, Homo sapiens
ttataagcccaaatggctctg

SEQ ID NO: 2803259 - DNA, 18 bp, Homo sapiens
ttataagtagcaggccaa

SEQ ID NO: 2803260 - DNA, 22 bp, Homo sapiens
ttataatgtggatttcctattt

SEQ ID NO: 2803261 - DNA, 13 bp, Homo sapiens
ttatacaaaataa

SEQ ID NO: 2803262 - DNA, 14 bp, Homo sapiens
ttatacaaaataat

SEQ ID NO: 2803263 - DNA, 19 bp, Homo sapiens
ttatacatagtcacaaaaa

SEQ ID NO: 2803264 - DNA, 15 bp, Homo sapiens
ttatacatatcagaa

SEQ ID NO: 2803265 - DNA, 16 bp, Homo sapiens
ttatacatatcagaaa

SEQ ID NO: 2803266 - DNA, 21 bp, Homo sapiens
ttatacatatcagaaaagtag

SEQ ID NO: 2803267 - DNA, 17 bp, Homo sapiens
ttatagcaatgtaacat

SEQ ID NO: 2803268 - DNA, 16 bp, Homo sapiens
ttatagctcagtttat

SEQ ID NO: 2803269 - DNA, 15 bp, Homo sapiens
ttcttcccatttgta

SEQ ID NO: 2803270 - DNA, 20 bp, Homo sapiens
ttcttcggggaactcctgga

SEQ ID NO: 2803271 - DNA, 14 bp, Homo sapiens
ttcttctaaaattg

SEQ ID NO: 2803272 - DNA, 15 bp, Homo sapiens
ttcttctgcttcagc

SEQ ID NO: 2803273 - DNA, 13 bp, Homo sapiens
ttcttcttcagaa

SEQ ID NO: 2803274 - DNA, 13 bp, Homo sapiens
ttcttgaaagctg

SEQ ID NO: 2803275 - DNA, 16 bp, Homo sapiens
ttcttgatgttgctta

SEQ ID NO: 2803276 - DNA, 21 bp, Homo sapiens
ttcttgcctactatgccagat

SEQ ID NO: 2803277 - DNA, 12 bp, Homo sapiens
ttcttgcctcat

SEQ ID NO: 2803278 - DNA, 14 bp, Homo sapiens
ttcttggagaactt

SEQ ID NO: 2803279 - DNA, 15 bp, Homo sapiens
ttcttggagaacttt

SEQ ID NO: 2803280 - DNA, 12 bp, Homo sapiens
ttctttaaatca

SEQ ID NO: 2803281 - DNA, 14 bp, Homo sapiens
ttctttaaatcaaa

SEQ ID NO: 2803282 - DNA, 15 bp, Homo sapiens
ttctttaaatcaaaa

SEQ ID NO: 2803283 - DNA, 17 bp, Homo sapiens
ttctttaaatcaaaagc

SEQ ID NO: 2803284 - DNA, 20 bp, Homo sapiens
ttctttaaatcaaaagctgc

SEQ ID NO: 2803285 - DNA, 14 bp, Homo sapiens
ttctttacctgaga

SEQ ID NO: 2803286 - DNA, 20 bp, Homo sapiens
ttctttacctgagaccagtt

SEQ ID NO: 2803287 - DNA, 20 bp, Homo sapiens
ttctttcaagtgaatctaaa

SEQ ID NO: 2803288 - DNA, 15 bp, Homo sapiens
ttctttctcactaaa

SEQ ID NO: 2803289 - DNA, 13 bp, Homo sapiens
ttctttcttcctc

SEQ ID NO: 2803290 - DNA, 15 bp, Homo sapiens
ttctttgaaattgtt

SEQ ID NO: 2803291 - DNA, 22 bp, Homo sapiens
ttctttggtttcccaagagcta

SEQ ID NO: 2803292 - DNA, 12 bp, Homo sapiens
ttctttgtgtag

SEQ ID NO: 2803293 - DNA, 15 bp, Homo sapiens
ttcttttactgtaat

SEQ ID NO: 2803294 - DNA, 12 bp, Homo sapiens
ttcttttatcac

SEQ ID NO: 2803295 - DNA, 21 bp, Homo sapiens
ttcttttgcccttcacagtgt

SEQ ID NO: 2803296 - DNA, 12 bp, Homo sapiens
ttcttttgtaaa

SEQ ID NO: 2803297 - DNA, 22 bp, Homo sapiens
ttctttttaaaaagttgcacat

SEQ ID NO: 2803298 - DNA, 13 bp, Homo sapiens
ttgaaaaagcgaa

SEQ ID NO: 2803299 - DNA, 11 bp, Homo sapiens
ttgaaaatgag

SEQ ID NO: 2803300 - DNA, 13 bp, Homo sapiens
ttgaaagaccttc

SEQ ID NO: 2803301 - DNA, 14 bp, Homo sapiens
ttgaaagagatggc

SEQ ID NO: 2803302 - DNA, 18 bp, Homo sapiens
ttgaaagtgaataaactt

SEQ ID NO: 2803303 - DNA, 22 bp, Homo sapiens
ttgaaagtgaataaacttcagc

SEQ ID NO: 2803304 - DNA, 19 bp, Homo sapiens
ttgaaatataatgcaaacc

SEQ ID NO: 2803305 - DNA, 14 bp, Homo sapiens
ttgaaattatatct

SEQ ID NO: 2803306 - DNA, 19 bp, Homo sapiens
ttgaaattatatctgtggt

SEQ ID NO: 2803307 - DNA, 20 bp, Homo sapiens
ttgaacaagttgtttcattg

SEQ ID NO: 2803308 - DNA, 14 bp, Homo sapiens
ttgaacccctgtgt

SEQ ID NO: 2803309 - DNA, 15 bp, Homo sapiens
ttgaactcctggcct

SEQ ID NO: 2803310 - DNA, 15 bp, Homo sapiens
ttgaactgccaagaa

SEQ ID NO: 2803311 - DNA, 18 bp, Homo sapiens
ttgaagagagatatatct

SEQ ID NO: 2803312 - DNA, 20 bp, Homo sapiens
ttgaagagagatatatctga

SEQ ID NO: 2803313 - DNA, 20 bp, Homo sapiens
ttgaagatcgttagtatcta

SEQ ID NO: 2803314 - DNA, 21 bp, Homo sapiens
ttgaagccactgaagctggga

SEQ ID NO: 2803315 - DNA, 15 bp, Homo sapiens
ttgaaggatctgttt

SEQ ID NO: 2803316 - DNA, 23 bp, Homo sapiens
ttgaaggcccaggtcaacatcta

SEQ ID NO: 2803317 - DNA, 18 bp, Homo sapiens
ttgaagggtaaagaagtt

SEQ ID NO: 2803318 - DNA, 19 bp, Homo sapiens
ttgaagttagctttaactt

SEQ ID NO: 2803319 - DNA, 23 bp, Homo sapiens
ttgaataaaaaacatttgtacat

SEQ ID NO: 2803320 - DNA, 15 bp, Homo sapiens
ttgaataaagtctga

SEQ ID NO: 2803321 - DNA, 17 bp, Homo sapiens
ttgaataaagtctgagt

SEQ ID NO: 2803322 - DNA, 19 bp, Homo sapiens
ttgaataaagttgaagcta

SEQ ID NO: 2803323 - DNA, 19 bp, Homo sapiens
ttgaatatattataatctt

SEQ ID NO: 2803324 - DNA, 21 bp, Homo sapiens
ttctacccagcgagccctggt

SEQ ID NO: 2803325 - DNA, 15 bp, Homo sapiens
ttctacgtataaata

SEQ ID NO: 2803326 - DNA, 22 bp, Homo sapiens
ttctagagaagaggctggtgct

SEQ ID NO: 2803327 - DNA, 21 bp, Homo sapiens
ttctagctgttgagctgtttt

SEQ ID NO: 2803328 - DNA, 21 bp, Homo sapiens
ttctagtctcctttgcactga

SEQ ID NO: 2803329 - DNA, 18 bp, Homo sapiens
ttctagtctggtgttctg

SEQ ID NO: 2803330 - DNA, 21 bp, Homo sapiens
ttctagtgtaacactgcaaga

SEQ ID NO: 2803331 - DNA, 19 bp, Homo sapiens
ttctagttagcaggaaata

SEQ ID NO: 2803332 - DNA, 22 bp, Homo sapiens
ttctatagctcttctatttaaa

SEQ ID NO: 2803333 - DNA, 17 bp, Homo sapiens
ttctatcacatatttga

SEQ ID NO: 2803334 - DNA, 17 bp, Homo sapiens
ttctatttaaaaaataa

SEQ ID NO: 2803335 - DNA, 20 bp, Homo sapiens
ttctatttaaaaaataaaaa

SEQ ID NO: 2803336 - DNA, 13 bp, Homo sapiens
ttctattttgtaa

SEQ ID NO: 2803337 - DNA, 16 bp, Homo sapiens
ttctattttgtaaact

SEQ ID NO: 2803338 - DNA, 16 bp, Homo sapiens
ttctatttttcttcta

SEQ ID NO: 2803339 - DNA, 19 bp, Homo sapiens
ttctatttttcttctaaaa

SEQ ID NO: 2803340 - DNA, 15 bp, Homo sapiens
ttctcactaaatctt

SEQ ID NO: 2803341 - DNA, 20 bp, Homo sapiens
ttctcagaatccaaagatca

SEQ ID NO: 2803342 - DNA, 16 bp, Homo sapiens
ttctcaggacacaggc

SEQ ID NO: 2803343 - DNA, 18 bp, Homo sapiens
ttctcaggacacaggcct

SEQ ID NO: 2803344 - DNA, 22 bp, Homo sapiens
ttctcaggacacaggcctgtgt

SEQ ID NO: 2803345 - DNA, 18 bp, Homo sapiens
ttctcagtcggtgtgtaa

SEQ ID NO: 2803346 - DNA, 15 bp, Homo sapiens
ttctcatcatattgt

SEQ ID NO: 2803347 - DNA, 20 bp, Homo sapiens
ttctcatcatattgtatgta

SEQ ID NO: 2803348 - DNA, 21 bp, Homo sapiens
ttctcatcatattgtatgtaa

SEQ ID NO: 2803349 - DNA, 16 bp, Homo sapiens
ttctccaccctgctct

SEQ ID NO: 2803350 - DNA, 14 bp, Homo sapiens
ttctccagccagca

SEQ ID NO: 2803351 - DNA, 18 bp, Homo sapiens
ttctccaggattccaaag

SEQ ID NO: 2803352 - DNA, 18 bp, Homo sapiens
ttctccaggctctttggg

SEQ ID NO: 2803353 - DNA, 23 bp, Homo sapiens
ttctccgactgctagggagtggt

SEQ ID NO: 2803354 - DNA, 22 bp, Homo sapiens
ttctcctgggcccgctttgcct

SEQ ID NO: 2803355 - DNA, 17 bp, Homo sapiens
ttctctacccatctccc

SEQ ID NO: 2803356 - DNA, 20 bp, Homo sapiens
ttctctacccatctccccca

SEQ ID NO: 2803357 - DNA, 20 bp, Homo sapiens
ttctctagctgatcagaatt

SEQ ID NO: 2803358 - DNA, 21 bp, Homo sapiens
ttctctagctgatcagaattt

SEQ ID NO: 2803359 - DNA, 23 bp, Homo sapiens
ttctctctaaaaataaaatgatg

SEQ ID NO: 2803360 - DNA, 12 bp, Homo sapiens
ttctctctctgg

SEQ ID NO: 2803361 - DNA, 22 bp, Homo sapiens
ttctcttacgctctctgtctgg

SEQ ID NO: 2803362 - DNA, 22 bp, Homo sapiens
ttctctttcttattttgtaata

SEQ ID NO: 2803363 - DNA, 14 bp, Homo sapiens
ttctctttgcctca

SEQ ID NO: 2803364 - DNA, 17 bp, Homo sapiens
ttctgaaaactgtttat

SEQ ID NO: 2803365 - DNA, 19 bp, Homo sapiens
ttctgaactcaagctgcgt

SEQ ID NO: 2803366 - DNA, 18 bp, Homo sapiens
ttctgagaaggtccttaa

SEQ ID NO: 2803367 - DNA, 18 bp, Homo sapiens
ttctgatgacataataaa

SEQ ID NO: 2803368 - DNA, 21 bp, Homo sapiens
ttctgattcgaatgacactgt

SEQ ID NO: 2803369 - DNA, 15 bp, Homo sapiens
ttctgccatattctg

SEQ ID NO: 2803370 - DNA, 17 bp, Homo sapiens
ttctgcctgcccaggcc

SEQ ID NO: 2803371 - DNA, 21 bp, Homo sapiens
ttctgctacctcactggggtc

SEQ ID NO: 2803372 - DNA, 13 bp, Homo sapiens
ttctgctcctctc

SEQ ID NO: 2803373 - DNA, 16 bp, Homo sapiens
ttctgctcctctccag

SEQ ID NO: 2803374 - DNA, 18 bp, Homo sapiens
ttctgctcctctccaggc

SEQ ID NO: 2803375 - DNA, 18 bp, Homo sapiens
ttctgctcttccaaagct

SEQ ID NO: 2803376 - DNA, 21 bp, Homo sapiens
ttctgctcttccaaagctcct

SEQ ID NO: 2803377 - DNA, 12 bp, Homo sapiens
ttctgctggcct

SEQ ID NO: 2803378 - DNA, 19 bp, Homo sapiens
ttctgcttcagcctcccga

SEQ ID NO: 2803379 - DNA, 10 bp, Homo sapiens
ttctggagcc

SEQ ID NO: 2803380 - DNA, 13 bp, Homo sapiens
ttctggagccctt

SEQ ID NO: 2803381 - DNA, 15 bp, Homo sapiens
ttctggagctgctgt

SEQ ID NO: 2803382 - DNA, 12 bp, Homo sapiens
ttctggcctcag

SEQ ID NO: 2803383 - DNA, 22 bp, Homo sapiens
ttctggtatgaacttgaggaca

SEQ ID NO: 2803384 - DNA, 17 bp, Homo sapiens
ttctgtaaaatgtctgt

SEQ ID NO: 2803385 - DNA, 17 bp, Homo sapiens
ttctgtcacgtgaaata

SEQ ID NO: 2803386 - DNA, 22 bp, Homo sapiens
ttctgtcatcccgctcctgctg

SEQ ID NO: 2803387 - DNA, 16 bp, Homo sapiens
ttctgtccagtttcca

SEQ ID NO: 2803388 - DNA, 17 bp, Homo sapiens
ttctgtcctactctgtg

SEQ ID NO: 2803389 - DNA, 23 bp, Homo sapiens
ttctgtccttttggcactgagat

SEQ ID NO: 2803390 - DNA, 12 bp, Homo sapiens
ttctgtgtattt

SEQ ID NO: 2803391 - DNA, 18 bp, Homo sapiens
ttctgtgtattttgagat

SEQ ID NO: 2803392 - DNA, 17 bp, Homo sapiens
ttcttaaacaaatgtat

SEQ ID NO: 2803393 - DNA, 13 bp, Homo sapiens
ttcttaaagagtt

SEQ ID NO: 2803394 - DNA, 18 bp, Homo sapiens
ttcttaaataagaaactt

SEQ ID NO: 2803395 - DNA, 22 bp, Homo sapiens
ttcttaataggctttatcgttt

SEQ ID NO: 2803396 - DNA, 20 bp, Homo sapiens
ttcttaatgctttcctccct

SEQ ID NO: 2803397 - DNA, 15 bp, Homo sapiens
ttcttactaaacatt

SEQ ID NO: 2803398 - DNA, 18 bp, Homo sapiens
ttcttactaaacattttg

SEQ ID NO: 2803399 - DNA, 13 bp, Homo sapiens
ttcttagtgtcac

SEQ ID NO: 2803400 - DNA, 16 bp, Homo sapiens
ttcttatcttctgcaa

SEQ ID NO: 2803401 - DNA, 13 bp, Homo sapiens
ttcttatttgcaa

SEQ ID NO: 2803402 - DNA, 15 bp, Homo sapiens
ttcttatttgcaata

SEQ ID NO: 2803403 - DNA, 17 bp, Homo sapiens
ttcttatttgcaataaa

SEQ ID NO: 2803404 - DNA, 13 bp, Homo sapiens
ttcttatttgttt

SEQ ID NO: 2803405 - DNA, 15 bp, Homo sapiens
ttcttattttgtaat

SEQ ID NO: 2803406 - DNA, 17 bp, Homo sapiens
ttcttattttgtaataa

SEQ ID NO: 2803407 - DNA, 19 bp, Homo sapiens
ttcttattttgtaataaac

SEQ ID NO: 2803408 - DNA, 21 bp, Homo sapiens
ttcttattttgtaataaactc

SEQ ID NO: 2803409 - DNA, 17 bp, Homo sapiens
ttcttcagaagacactg

SEQ ID NO: 2803410 - DNA, 21 bp, Homo sapiens
ttcttcataacaattttagga

SEQ ID NO: 2803411 - DNA, 18 bp, Homo sapiens
ttcttcatgcaatgacat

SEQ ID NO: 2803412 - DNA, 21 bp, Homo sapiens
ttcttcattcaatacaagtgt

SEQ ID NO: 2803413 - DNA, 19 bp, Homo sapiens
ttcttcccatcactggagc

SEQ ID NO: 2803414 - DNA, 21 bp, Homo sapiens
ttgatgtttccagaaaatata

SEQ ID NO: 2803415 - DNA, 14 bp, Homo sapiens
ttgatttaatatct

SEQ ID NO: 2803416 - DNA, 22 bp, Homo sapiens
ttgatttctacgttatgaaaac

SEQ ID NO: 2803417 - DNA, 15 bp, Homo sapiens
ttgatttgagaaatt

SEQ ID NO: 2803418 - DNA, 11 bp, Homo sapiens
ttgcaaaattt

SEQ ID NO: 2803419 - DNA, 23 bp, Homo sapiens
ttgcaaaatttccagtacctttg

SEQ ID NO: 2803420 - DNA, 22 bp, Homo sapiens
ttgcaaatgtagtatggcctgt

SEQ ID NO: 2803421 - DNA, 17 bp, Homo sapiens
ttgcaacaggctgggct

SEQ ID NO: 2803422 - DNA, 12 bp, Homo sapiens
ttgcaaccactg

SEQ ID NO: 2803423 - DNA, 14 bp, Homo sapiens
ttgcaaggccgctg

SEQ ID NO: 2803424 - DNA, 17 bp, Homo sapiens
ttgcaaggccgctgttc

SEQ ID NO: 2803425 - DNA, 14 bp, Homo sapiens
ttgcaataaaatag

SEQ ID NO: 2803426 - DNA, 16 bp, Homo sapiens
ttgcaataaaatagta

SEQ ID NO: 2803427 - DNA, 20 bp, Homo sapiens
ttgcaatggtgttgccctga

SEQ ID NO: 2803428 - DNA, 17 bp, Homo sapiens
ttgcaattattctaatt

SEQ ID NO: 2803429 - DNA, 21 bp, Homo sapiens
ttgcacaagcttgtatataca

SEQ ID NO: 2803430 - DNA, 11 bp, Homo sapiens
ttgcacaattt

SEQ ID NO: 2803431 - DNA, 13 bp, Homo sapiens
ttgcacattagga

SEQ ID NO: 2803432 - DNA, 15 bp, Homo sapiens
ttgcacctttctagt

SEQ ID NO: 2803433 - DNA, 22 bp, Homo sapiens
ttgcagacaggcaagcacctcc

SEQ ID NO: 2803434 - DNA, 14 bp, Homo sapiens
ttgcagagacagga

SEQ ID NO: 2803435 - DNA, 20 bp, Homo sapiens
ttgcaggccaggttatgcct

SEQ ID NO: 2803436 - DNA, 22 bp, Homo sapiens
ttgcaggccaggttatgcctca

SEQ ID NO: 2803437 - DNA, 22 bp, Homo sapiens
ttgcatagtaccaatcatttta

SEQ ID NO: 2803438 - DNA, 23 bp, Homo sapiens
ttgcatagtaccaatcattttaa

SEQ ID NO: 2803439 - DNA, 15 bp, Homo sapiens
ttgcatgatgtattt

SEQ ID NO: 2803440 - DNA, 13 bp, Homo sapiens
ttgcatgtaaaat

SEQ ID NO: 2803441 - DNA, 14 bp, Homo sapiens
ttgcatgtaaaatg

SEQ ID NO: 2803442 - DNA, 19 bp, Homo sapiens
ttgcatgtaaaatgcagtc

SEQ ID NO: 2803443 - DNA, 12 bp, Homo sapiens
ttgcattagaaa

SEQ ID NO: 2803444 - DNA, 17 bp, Homo sapiens
ttgcattgaatatatta

SEQ ID NO: 2803445 - DNA, 14 bp, Homo sapiens
ttgcatttctgctc

SEQ ID NO: 2803446 - DNA, 23 bp, Homo sapiens
ttgccaccaccagatgagaagtt

SEQ ID NO: 2803447 - DNA, 14 bp, Homo sapiens
ttgccactgcctct

SEQ ID NO: 2803448 - DNA, 18 bp, Homo sapiens
ttgccagccagaagcctc

SEQ ID NO: 2803449 - DNA, 22 bp, Homo sapiens
ttgccatgaggcctttccccag

SEQ ID NO: 2803450 - DNA, 16 bp, Homo sapiens
ttgccatgtagacccc

SEQ ID NO: 2803451 - DNA, 18 bp, Homo sapiens
ttgcccagagatgcctcc

SEQ ID NO: 2803452 - DNA, 19 bp, Homo sapiens
ttgcccagagatgcctcca

SEQ ID NO: 2803453 - DNA, 22 bp, Homo sapiens
ttgcccagagatgcctccaccg

SEQ ID NO: 2803454 - DNA, 18 bp, Homo sapiens
ttgcccaggcaggtcttg

SEQ ID NO: 2803455 - DNA, 17 bp, Homo sapiens
ttgcccagggctcagcc

SEQ ID NO: 2803456 - DNA, 19 bp, Homo sapiens
ttgccccttgggcctcccc

SEQ ID NO: 2803457 - DNA, 21 bp, Homo sapiens
ttgccccttgggcctcccccc

SEQ ID NO: 2803458 - DNA, 13 bp, Homo sapiens
ttgccctgacctc

SEQ ID NO: 2803459 - DNA, 18 bp, Homo sapiens
ttgccctgacctcccagc

SEQ ID NO: 2803460 - DNA, 10 bp, Homo sapiens
ttgccctggt

SEQ ID NO: 2803461 - DNA, 14 bp, Homo sapiens
ttgcccttgccctg

SEQ ID NO: 2803462 - DNA, 15 bp, Homo sapiens
ttgcccttgccctga

SEQ ID NO: 2803463 - DNA, 16 bp, Homo sapiens
ttgcccttgccctgac

SEQ ID NO: 2803464 - DNA, 17 bp, Homo sapiens
ttgcctaaatccaaaga

SEQ ID NO: 2803465 - DNA, 17 bp, Homo sapiens
ttgcctactatgccaga

SEQ ID NO: 2803466 - DNA, 23 bp, Homo sapiens
ttgcctcaaataaaaagtgcttt

SEQ ID NO: 2803467 - DNA, 14 bp, Homo sapiens
ttgcctctgcctct

SEQ ID NO: 2803468 - DNA, 18 bp, Homo sapiens
ttgtacagacgtatgctt

SEQ ID NO: 2803469 - DNA, 15 bp, Homo sapiens
ttgtacatatggaaa

SEQ ID NO: 2803470 - DNA, 20 bp, Homo sapiens
ttgtacatgtgtagcctgtg

SEQ ID NO: 2803471 - DNA, 21 bp, Homo sapiens
ttgtacatgtgtagcctgtgc

SEQ ID NO: 2803472 - DNA, 13 bp, Homo sapiens
ttgtacattcctg

SEQ ID NO: 2803473 - DNA, 19 bp, Homo sapiens
ttgtacattcctgatactg

SEQ ID NO: 2803474 - DNA, 14 bp, Homo sapiens
ttgtaccagtgtga

SEQ ID NO: 2803475 - DNA, 13 bp, Homo sapiens
ttgtactatgtta

SEQ ID NO: 2803476 - DNA, 14 bp, Homo sapiens
ttgtagagccaggg

SEQ ID NO: 2803477 - DNA, 15 bp, Homo sapiens
ttgtagccagccggg

SEQ ID NO: 2803478 - DNA, 16 bp, Homo sapiens
ttgtagggatgccttt

SEQ ID NO: 2803479 - DNA, 12 bp, Homo sapiens
ttgtataaaaat

SEQ ID NO: 2803480 - DNA, 20 bp, Homo sapiens
ttgtataaaaatagaagaat

SEQ ID NO: 2803481 - DNA, 13 bp, Homo sapiens
ttgtatatacata

SEQ ID NO: 2803482 - DNA, 14 bp, Homo sapiens
ttgtatatacatat

SEQ ID NO: 2803483 - DNA, 16 bp, Homo sapiens
ttgtatatacatatta

SEQ ID NO: 2803484 - DNA, 23 bp, Homo sapiens
ttgtatatacatattataaataa

SEQ ID NO: 2803485 - DNA, 15 bp, Homo sapiens
ttgtatatcatgaaa

SEQ ID NO: 2803486 - DNA, 18 bp, Homo sapiens
ttgtatattatggaagat

SEQ ID NO: 2803487 - DNA, 19 bp, Homo sapiens
ttgtatattgtcagatatt

SEQ ID NO: 2803488 - DNA, 13 bp, Homo sapiens
ttgtatctctttt

SEQ ID NO: 2803489 - DNA, 20 bp, Homo sapiens
ttgtatctcttttgaatcca

SEQ ID NO: 2803490 - DNA, 12 bp, Homo sapiens
ttgtatgtaagt

SEQ ID NO: 2803491 - DNA, 13 bp, Homo sapiens
ttgtattttccat

SEQ ID NO: 2803492 - DNA, 12 bp, Homo sapiens
ttgtcagacttt

SEQ ID NO: 2803493 - DNA, 14 bp, Homo sapiens
ttgtcagactttaa

SEQ ID NO: 2803494 - DNA, 15 bp, Homo sapiens
ttgtcatatattcat

SEQ ID NO: 2803495 - DNA, 19 bp, Homo sapiens
ttgtcatctttcttctatt

SEQ ID NO: 2803496 - DNA, 20 bp, Homo sapiens
ttgtccaacaactccaggaa

SEQ ID NO: 2803497 - DNA, 20 bp, Homo sapiens
ttgtccatgcctacagataa

SEQ ID NO: 2803498 - DNA, 14 bp, Homo sapiens
ttgtcccatttcct

SEQ ID NO: 2803499 - DNA, 11 bp, Homo sapiens
ttgtccccagt

SEQ ID NO: 2803500 - DNA, 18 bp, Homo sapiens
ttgtccctggtgcagagg

SEQ ID NO: 2803501 - DNA, 15 bp, Homo sapiens
ttgtcctatgtcaat

SEQ ID NO: 2803502 - DNA, 15 bp, Homo sapiens
ttgtcctttgagaaa

SEQ ID NO: 2803503 - DNA, 14 bp, Homo sapiens
ttgtctgtgcagct

SEQ ID NO: 2803504 - DNA, 12 bp, Homo sapiens
ttgtcttaatat

SEQ ID NO: 2803505 - DNA, 13 bp, Homo sapiens
ttccccacagaac

SEQ ID NO: 2803506 - DNA, 17 bp, Homo sapiens
ttccccagactcagctc

SEQ ID NO: 2803507 - DNA, 22 bp, Homo sapiens
ttccccagtgtggccccagccc

SEQ ID NO: 2803508 - DNA, 20 bp, Homo sapiens
ttcccccatcccctttcctc

SEQ ID NO: 2803509 - DNA, 19 bp, Homo sapiens
ttcccccgctggcagccac

SEQ ID NO: 2803510 - DNA, 16 bp, Homo sapiens
ttccccgggggaggaa

SEQ ID NO: 2803511 - DNA, 13 bp, Homo sapiens
ttccccttgccct

SEQ ID NO: 2803512 - DNA, 21 bp, Homo sapiens
ttccccttgcccttgccctga

SEQ ID NO: 2803513 - DNA, 17 bp, Homo sapiens
ttccctacttcctgtga

SEQ ID NO: 2803514 - DNA, 20 bp, Homo sapiens
ttccctagaggcaaacattt

SEQ ID NO: 2803515 - DNA, 13 bp, Homo sapiens
ttccctcaccccc

SEQ ID NO: 2803516 - DNA, 23 bp, Homo sapiens
ttccctcccgggagaggagatca

SEQ ID NO: 2803517 - DNA, 16 bp, Homo sapiens
ttccctctcccaggcc

SEQ ID NO: 2803518 - DNA, 17 bp, Homo sapiens
ttccctctcccaggccc

SEQ ID NO: 2803519 - DNA, 16 bp, Homo sapiens
ttccctgaacatctgt

SEQ ID NO: 2803520 - DNA, 17 bp, Homo sapiens
ttccctgaacatctgtg

SEQ ID NO: 2803521 - DNA, 20 bp, Homo sapiens
ttccctgaacatctgtgtgt

SEQ ID NO: 2803522 - DNA, 16 bp, Homo sapiens
ttccctgagtcaccag

SEQ ID NO: 2803523 - DNA, 12 bp, Homo sapiens
ttccctgctttg

SEQ ID NO: 2803524 - DNA, 23 bp, Homo sapiens
ttccgtctccctaaaataaaaac

SEQ ID NO: 2803525 - DNA, 14 bp, Homo sapiens
ttcctaaatgcagt

SEQ ID NO: 2803526 - DNA, 16 bp, Homo sapiens
ttcctaaatgcagtga

SEQ ID NO: 2803527 - DNA, 17 bp, Homo sapiens
ttcctacccaaccactc

SEQ ID NO: 2803528 - DNA, 15 bp, Homo sapiens
ttcctagttttctcc

SEQ ID NO: 2803529 - DNA, 18 bp, Homo sapiens
ttcctagttttctcctcc

SEQ ID NO: 2803530 - DNA, 20 bp, Homo sapiens
ttcctattttaaaaccatgc

SEQ ID NO: 2803531 - DNA, 22 bp, Homo sapiens
ttcctattttaaaaccatgcag

SEQ ID NO: 2803532 - DNA, 23 bp, Homo sapiens
ttcctattttaaaaccatgcagc

SEQ ID NO: 2803533 - DNA, 13 bp, Homo sapiens
ttcctcaccaata

SEQ ID NO: 2803534 - DNA, 20 bp, Homo sapiens
ttcctcaccaataacttcag

SEQ ID NO: 2803535 - DNA, 21 bp, Homo sapiens
ttcctcaccaataacttcaga

SEQ ID NO: 2803536 - DNA, 23 bp, Homo sapiens
ttcctcatagtatggtggctggg

SEQ ID NO: 2803537 - DNA, 23 bp, Homo sapiens
ttcctccccaccttccccagact

SEQ ID NO: 2803538 - DNA, 24 bp, Homo sapiens
ttcctccctggcatgaccatcctg

SEQ ID NO: 2803539 - DNA, 19 bp, Homo sapiens
ttcctctagtgccctccac

SEQ ID NO: 2803540 - DNA, 13 bp, Homo sapiens
ttcctctccagcc

SEQ ID NO: 2803541 - DNA, 14 bp, Homo sapiens
ttcctctccagcct

SEQ ID NO: 2803542 - DNA, 19 bp, Homo sapiens
ttcctctccagccttctct

SEQ ID NO: 2803543 - DNA, 21 bp, Homo sapiens
ttcctctccagccttctctct

SEQ ID NO: 2803544 - DNA, 22 bp, Homo sapiens
ttcctctccagccttctctctc

SEQ ID NO: 2803545 - DNA, 16 bp, Homo sapiens
ttcctctgcagcactt

SEQ ID NO: 2803546 - DNA, 16 bp, Homo sapiens
ttcctcttccccttgc

SEQ ID NO: 2803547 - DNA, 18 bp, Homo sapiens
ttcctcttccccttgccc

SEQ ID NO: 2803548 - DNA, 19 bp, Homo sapiens
ttcctcttccccttgccct

SEQ ID NO: 2803549 - DNA, 20 bp, Homo sapiens
ttcctcttctattttgtaaa

SEQ ID NO: 2803550 - DNA, 12 bp, Homo sapiens
ttcctgaaagaa

SEQ ID NO: 2803551 - DNA, 16 bp, Homo sapiens
ttcctgaatattaatc

SEQ ID NO: 2803552 - DNA, 22 bp, Homo sapiens
ttcctgacctcctcctgccctc

SEQ ID NO: 2803553 - DNA, 15 bp, Homo sapiens
ttcctgcatttgtga

SEQ ID NO: 2803554 - DNA, 17 bp, Homo sapiens
ttcctgccaccagtcac

SEQ ID NO: 2803555 - DNA, 21 bp, Homo sapiens
ttcctgcgggcttttccccgg

SEQ ID NO: 2803556 - DNA, 21 bp, Homo sapiens
ttcctggacagctgtgcctcg

SEQ ID NO: 2803557 - DNA, 23 bp, Homo sapiens
ttcctgggtggctactctgtgcc

SEQ ID NO: 2803558 - DNA, 11 bp, Homo sapiens
ttcctgtaaca

SEQ ID NO: 2803559 - DNA, 21 bp, Homo sapiens
ttcctgtaacacaagccacag

SEQ ID NO: 2803560 - DNA, 23 bp, Homo sapiens
ttcctgtaacacaagccacagaa

SEQ ID NO: 2803561 - DNA, 19 bp, Homo sapiens
tttaaccgtttttcaagaa

SEQ ID NO: 2803562 - DNA, 15 bp, Homo sapiens
tttaactaatttaaa

SEQ ID NO: 2803563 - DNA, 15 bp, Homo sapiens
tttaactagaattta

SEQ ID NO: 2803564 - DNA, 16 bp, Homo sapiens
tttaagcattcttaga

SEQ ID NO: 2803565 - DNA, 22 bp, Homo sapiens
tttaagcttatttaattaaaaa

SEQ ID NO: 2803566 - DNA, 17 bp, Homo sapiens
tttaagggtttgtggaa

SEQ ID NO: 2803567 - DNA, 12 bp, Homo sapiens
tttaagtattta

SEQ ID NO: 2803568 - DNA, 15 bp, Homo sapiens
tttaagtatttatat

SEQ ID NO: 2803569 - DNA, 18 bp, Homo sapiens
tttaagtgctttgtaatg

SEQ ID NO: 2803570 - DNA, 14 bp, Homo sapiens
tttaataaatttat

SEQ ID NO: 2803571 - DNA, 20 bp, Homo sapiens
tttaataattatgtgccatt

SEQ ID NO: 2803572 - DNA, 14 bp, Homo sapiens
tttaatatagctat

SEQ ID NO: 2803573 - DNA, 21 bp, Homo sapiens
tttaatatctgagaagtgtat

SEQ ID NO: 2803574 - DNA, 15 bp, Homo sapiens
tttaatgaacaaatg

SEQ ID NO: 2803575 - DNA, 15 bp, Homo sapiens
tttaatgacttttta

SEQ ID NO: 2803576 - DNA, 17 bp, Homo sapiens
tttaatgactttttata

SEQ ID NO: 2803577 - DNA, 20 bp, Homo sapiens
tttaatgactttttataatg

SEQ ID NO: 2803578 - DNA, 18 bp, Homo sapiens
tttaatgtatagtaaatc

SEQ ID NO: 2803579 - DNA, 13 bp, Homo sapiens
tttaattaaataa

SEQ ID NO: 2803580 - DNA, 16 bp, Homo sapiens
tttaattaatatgttc

SEQ ID NO: 2803581 - DNA, 13 bp, Homo sapiens
tttaattcataat

SEQ ID NO: 2803582 - DNA, 16 bp, Homo sapiens
tttaatttatgagttt

SEQ ID NO: 2803583 - DNA, 19 bp, Homo sapiens
tttacaataaatattctgc

SEQ ID NO: 2803584 - DNA, 16 bp, Homo sapiens
tttacagagaatctga

SEQ ID NO: 2803585 - DNA, 13 bp, Homo sapiens
tttacagctgcct

SEQ ID NO: 2803586 - DNA, 18 bp, Homo sapiens
tttacatgaattgcattt

SEQ ID NO: 2803587 - DNA, 18 bp, Homo sapiens
tttacattttatttatta

SEQ ID NO: 2803588 - DNA, 19 bp, Homo sapiens
tttacctaccacagtgtct

SEQ ID NO: 2803589 - DNA, 16 bp, Homo sapiens
tttacgactgaagaag

SEQ ID NO: 2803590 - DNA, 13 bp, Homo sapiens
tttactaaagcag

SEQ ID NO: 2803591 - DNA, 18 bp, Homo sapiens
tttactactattctgtta

SEQ ID NO: 2803592 - DNA, 14 bp, Homo sapiens
tttactacttgtta

SEQ ID NO: 2803593 - DNA, 19 bp, Homo sapiens
tttactcctttgcattcca

SEQ ID NO: 2803594 - DNA, 12 bp, Homo sapiens
tttactgctgtc

SEQ ID NO: 2803595 - DNA, 18 bp, Homo sapiens
tttacttttaaacagtga

SEQ ID NO: 2803596 - DNA, 13 bp, Homo sapiens
tttagaaaacttt

SEQ ID NO: 2803597 - DNA, 15 bp, Homo sapiens
tttagaaaactttaa

SEQ ID NO: 2803598 - DNA, 12 bp, Homo sapiens
tttagacagagt

SEQ ID NO: 2803599 - DNA, 21 bp, Homo sapiens
tttagagtatgcaagaagaat

SEQ ID NO: 2803600 - DNA, 15 bp, Homo sapiens
ttttcttcccatttg

SEQ ID NO: 2803601 - DNA, 14 bp, Homo sapiens
ttttcttctaaaat

SEQ ID NO: 2803602 - DNA, 19 bp, Homo sapiens
ttttcttctaaaatgcttt

SEQ ID NO: 2803603 - DNA, 13 bp, Homo sapiens
ttttcttgcagtt

SEQ ID NO: 2803604 - DNA, 16 bp, Homo sapiens
ttttctttgtgtagct

SEQ ID NO: 2803605 - DNA, 21 bp, Homo sapiens
ttttgaactaataaaagcata

SEQ ID NO: 2803606 - DNA, 22 bp, Homo sapiens
ttttgaagaagggaaattcaca

SEQ ID NO: 2803607 - DNA, 24 bp, Homo sapiens
ttttgacagtgttgaaaatgttca

SEQ ID NO: 2803608 - DNA, 13 bp, Homo sapiens
ttttgcaaaattt

SEQ ID NO: 2803609 - DNA, 18 bp, Homo sapiens
ttttgcaatcccttaata

SEQ ID NO: 2803610 - DNA, 18 bp, Homo sapiens
ttttgcccttcacagtgt

SEQ ID NO: 2803611 - DNA, 18 bp, Homo sapiens
ttttgctgtttcctttta

SEQ ID NO: 2803612 - DNA, 15 bp, Homo sapiens
ttttgcttaaaattt

SEQ ID NO: 2803613 - DNA, 18 bp, Homo sapiens
ttttgcttaaaattttac

SEQ ID NO: 2803614 - DNA, 19 bp, Homo sapiens
ttttggcactgagatattt

SEQ ID NO: 2803615 - DNA, 17 bp, Homo sapiens
ttttggccaaagtgtta

SEQ ID NO: 2803616 - DNA, 21 bp, Homo sapiens
ttttggtccaagttgtgctta

SEQ ID NO: 2803617 - DNA, 15 bp, Homo sapiens
ttttggtctgtgtga

SEQ ID NO: 2803618 - DNA, 18 bp, Homo sapiens
ttttgtaaactcaaaata

SEQ ID NO: 2803619 - DNA, 14 bp, Homo sapiens
ttttgtaagacaaa

SEQ ID NO: 2803620 - DNA, 16 bp, Homo sapiens
ttttgtaataaactct

SEQ ID NO: 2803621 - DNA, 12 bp, Homo sapiens
ttttgtacagaa

SEQ ID NO: 2803622 - DNA, 18 bp, Homo sapiens
ttttgtatagtaaagtga

SEQ ID NO: 2803623 - DNA, 17 bp, Homo sapiens
ttttgtcccatttcctt

SEQ ID NO: 2803624 - DNA, 18 bp, Homo sapiens
ttttgtcgagtttacttc

SEQ ID NO: 2803625 - DNA, 13 bp, Homo sapiens
ttttgtgagatgt

SEQ ID NO: 2803626 - DNA, 21 bp, Homo sapiens
ttttgtgatgtcccaacttgt

SEQ ID NO: 2803627 - DNA, 11 bp, Homo sapiens
ttttgtggatt

SEQ ID NO: 2803628 - DNA, 18 bp, Homo sapiens
ttttgtggattgacagta

SEQ ID NO: 2803629 - DNA, 18 bp, Homo sapiens
ttttgttaataataagat

SEQ ID NO: 2803630 - DNA, 22 bp, Homo sapiens
ttttgttaataataagataatg

SEQ ID NO: 2803631 - DNA, 14 bp, Homo sapiens
ttttgttgattaaa

SEQ ID NO: 2803632 - DNA, 19 bp, Homo sapiens
ttttgttgtttcttaaata

SEQ ID NO: 2803633 - DNA, 19 bp, Homo sapiens
ttttgtttttgtaaaaaag

SEQ ID NO: 2803634 - DNA, 17 bp, Homo sapiens
tttttaaaaaagcttaa

SEQ ID NO: 2803635 - DNA, 22 bp, Homo sapiens
tttttaaaaaagcttaaaactt

SEQ ID NO: 2803636 - DNA, 16 bp, Homo sapiens
tttttaaataaaagca

SEQ ID NO: 2803637 - DNA, 15 bp, Homo sapiens
tttttaacctgttta

SEQ ID NO: 2803638 - DNA, 22 bp, Homo sapiens
tttttaactcaatattttccat

SEQ ID NO: 2803639 - DNA, 19 bp, Homo sapiens
tttttaatgactttttata

SEQ ID NO: 2803640 - DNA, 12 bp, Homo sapiens
tttttacaaaat

SEQ ID NO: 2803641 - DNA, 18 bp, Homo sapiens
tttttacaaataaagatg

SEQ ID NO: 2803642 - DNA, 13 bp, Homo sapiens
tttttagtctttt

SEQ ID NO: 2803643 - DNA, 12 bp, Homo sapiens
tttttatacata

SEQ ID NO: 2803644 - DNA, 19 bp, Homo sapiens
tttttatacatatcagaaa

SEQ ID NO: 2803645 - DNA, 22 bp, Homo sapiens
tttttatacatatcagaaaagt

SEQ ID NO: 2803646 - DNA, 17 bp, Homo sapiens
tttttatactccataca

SEQ ID NO: 2803647 - DNA, 21 bp, Homo sapiens
tttttcaaaacgccatgtcct

SEQ ID NO: 2803648 - DNA, 19 bp, Homo sapiens
tttttcaaagatgtgttgc

SEQ ID NO: 2803649 - DNA, 15 bp, Homo sapiens
tttttcaagaaaact

SEQ ID NO: 2803650 - DNA, 16 bp, Homo sapiens
tttttcatgataatga

SEQ ID NO: 2803651 - DNA, 21 bp, Homo sapiens
tttttcattgatatgaaaaat

SEQ ID NO: 2803652 - DNA, 15 bp, Homo sapiens
tttttccccaaagtc

SEQ ID NO: 2803653 - DNA, 18 bp, Homo sapiens
tttttcctagccctctca

SEQ ID NO: 2803654 - DNA, 22 bp, Homo sapiens
tttttccttcaaagtttaataa

SEQ ID NO: 2803655 - DNA, 11 bp, Homo sapiens
tttttcctttt

SEQ ID NO: 2803656 - DNA, 22 bp, Homo sapiens
tttttcttgagtactagaattt

SEQ ID NO: 2803657 - DNA, 13 bp, Homo sapiens
tttttgaaaacat

SEQ ID NO: 2803658 - DNA, 21 bp, Homo sapiens
tttttgaagaagggaaattca

SEQ ID NO: 2803659 - DNA, 12 bp, Homo sapiens
tttttgaataaa

SEQ ID NO: 2803660 - DNA, 14 bp, Homo sapiens
tttttgatagcttt

SEQ ID NO: 2803661 - DNA, 22 bp, Homo sapiens
tttttgcctaaatccaaagaaa

SEQ ID NO: 2803662 - DNA, 15 bp, Homo sapiens
tttttgtgtatttgt

SEQ ID NO: 2803663 - DNA, 13 bp, Homo sapiens
ttttttaaaaaag

SEQ ID NO: 2803664 - DNA, 17 bp, Homo sapiens
ttttttaagtatttata

SEQ ID NO: 2803665 - DNA, 18 bp, Homo sapiens
tttaggaagcaagcttaa

SEQ ID NO: 2803666 - DNA, 13 bp, Homo sapiens
tttaggagcagtg

SEQ ID NO: 2803667 - DNA, 13 bp, Homo sapiens
tttaggtgcctcc

SEQ ID NO: 2803668 - DNA, 17 bp, Homo sapiens
tttaggtgcctcctgtc

SEQ ID NO: 2803669 - DNA, 18 bp, Homo sapiens
tttaggtgcctcctgtct

SEQ ID NO: 2803670 - DNA, 21 bp, Homo sapiens
tttagtagcagtgattgtctt

SEQ ID NO: 2803671 - DNA, 22 bp, Homo sapiens
tttagtagcagtgattgtctta

SEQ ID NO: 2803672 - DNA, 20 bp, Homo sapiens
tttagttgtatctcttttga

SEQ ID NO: 2803673 - DNA, 14 bp, Homo sapiens
tttataaacttaat

SEQ ID NO: 2803674 - DNA, 19 bp, Homo sapiens
tttataactagtcctttac

SEQ ID NO: 2803675 - DNA, 16 bp, Homo sapiens
tttataactcatcata

SEQ ID NO: 2803676 - DNA, 20 bp, Homo sapiens
tttataatgtggatttccta

SEQ ID NO: 2803677 - DNA, 23 bp, Homo sapiens
tttatactctagaacatgcacat

SEQ ID NO: 2803678 - DNA, 16 bp, Homo sapiens
tttatagctcagttta

SEQ ID NO: 2803679 - DNA, 15 bp, Homo sapiens
tttatataattttgc

SEQ ID NO: 2803680 - DNA, 20 bp, Homo sapiens
tttatatatatatgtatatg

SEQ ID NO: 2803681 - DNA, 13 bp, Homo sapiens
tttatatatgtat

SEQ ID NO: 2803682 - DNA, 15 bp, Homo sapiens
tttatatatttataa

SEQ ID NO: 2803683 - DNA, 16 bp, Homo sapiens
tttatatatttataac

SEQ ID NO: 2803684 - DNA, 14 bp, Homo sapiens
tttatatctatagt

SEQ ID NO: 2803685 - DNA, 14 bp, Homo sapiens
tttatattgtaaat

SEQ ID NO: 2803686 - DNA, 16 bp, Homo sapiens
tttatatttggaaaga

SEQ ID NO: 2803687 - DNA, 18 bp, Homo sapiens
tttatcagtgacagagtt

SEQ ID NO: 2803688 - DNA, 21 bp, Homo sapiens
tttatcagtgacagagttcac

SEQ ID NO: 2803689 - DNA, 18 bp, Homo sapiens
tttatcgtttattgctta

SEQ ID NO: 2803690 - DNA, 21 bp, Homo sapiens
tttatcttggactgacattta

SEQ ID NO: 2803691 - DNA, 14 bp, Homo sapiens
tttatcttgtctct

SEQ ID NO: 2803692 - DNA, 21 bp, Homo sapiens
tttatgaaaaactcttctact

SEQ ID NO: 2803693 - DNA, 19 bp, Homo sapiens
tttatgaaaaagaagaatc

SEQ ID NO: 2803694 - DNA, 13 bp, Homo sapiens
tttatgaaaagag

SEQ ID NO: 2803695 - DNA, 19 bp, Homo sapiens
tttatgatttaaaaaataa

SEQ ID NO: 2803696 - DNA, 22 bp, Homo sapiens
tttatggtgtgttcctaacata

SEQ ID NO: 2803697 - DNA, 21 bp, Homo sapiens
tttatgtgctctcatcagaaa

SEQ ID NO: 2803698 - DNA, 18 bp, Homo sapiens
tttattaaaaactgagtg

SEQ ID NO: 2803699 - DNA, 16 bp, Homo sapiens
tttattagctgtaaat

SEQ ID NO: 2803700 - DNA, 24 bp, Homo sapiens
tttattagctgtaaatacatgtgt

SEQ ID NO: 2803701 - DNA, 17 bp, Homo sapiens
tttattattttcacctg

SEQ ID NO: 2803702 - DNA, 16 bp, Homo sapiens
tttattcattagctgt

SEQ ID NO: 2803703 - DNA, 22 bp, Homo sapiens
tttattcctatatagtttattg

SEQ ID NO: 2803704 - DNA, 12 bp, Homo sapiens
tttattgacaat

SEQ ID NO: 2803705 - DNA, 14 bp, Homo sapiens
tttattgagaattt

SEQ ID NO: 2803706 - DNA, 19 bp, Homo sapiens
tttattgtcattactgcct

SEQ ID NO: 2803707 - DNA, 16 bp, Homo sapiens
tttatttattcactgt

SEQ ID NO: 2803708 - DNA, 18 bp, Homo sapiens
tttatttccacataaagg

SEQ ID NO: 2803709 - DNA, 20 bp, Homo sapiens
tttatttgtttgtgcatttg

SEQ ID NO: 2803710 - DNA, 14 bp, Homo sapiens
tttattttgacata

SEQ ID NO: 2803711 - DNA, 18 bp, Homo sapiens
tttattttgtatttttga

SEQ ID NO: 2803712 - DNA, 14 bp, Homo sapiens
tttattttttaagt

SEQ ID NO: 2803713 - DNA, 17 bp, Homo sapiens
tttattttttaatcatt

SEQ ID NO: 2803714 - DNA, 18 bp, Homo sapiens
tttattttttctacacag

SEQ ID NO: 2803715 - DNA, 16 bp, Homo sapiens
tttgatacatatgtga

SEQ ID NO: 2803716 - DNA, 16 bp, Homo sapiens
tttgatactaagcatt

SEQ ID NO: 2803717 - DNA, 18 bp, Homo sapiens
tttgatactaagcattga

SEQ ID NO: 2803718 - DNA, 14 bp, Homo sapiens
tttgatgtacatgt

SEQ ID NO: 2803719 - DNA, 14 bp, Homo sapiens
tttgcaaggaagcc

SEQ ID NO: 2803720 - DNA, 23 bp, Homo sapiens
tttgcacatgtaacatagattta

SEQ ID NO: 2803721 - DNA, 14 bp, Homo sapiens
tttgcactgagggc

SEQ ID NO: 2803722 - DNA, 16 bp, Homo sapiens
tttgcactgagggcca

SEQ ID NO: 2803723 - DNA, 17 bp, Homo sapiens
tttgcactgagggccac

SEQ ID NO: 2803724 - DNA, 17 bp, Homo sapiens
tttgcactgtatgctgg

SEQ ID NO: 2803725 - DNA, 14 bp, Homo sapiens
tttgcactgttact

SEQ ID NO: 2803726 - DNA, 22 bp, Homo sapiens
tttgcagaaaagcacctgccga

SEQ ID NO: 2803727 - DNA, 19 bp, Homo sapiens
tttgcagattattttagtc

SEQ ID NO: 2803728 - DNA, 16 bp, Homo sapiens
tttgcattagacagat

SEQ ID NO: 2803729 - DNA, 13 bp, Homo sapiens
tttgcattccatg

SEQ ID NO: 2803730 - DNA, 19 bp, Homo sapiens
tttgcattccatgatttta

SEQ ID NO: 2803731 - DNA, 23 bp, Homo sapiens
tttgccccaaggctgctcagagg

SEQ ID NO: 2803732 - DNA, 15 bp, Homo sapiens
tttgccccagttaca

SEQ ID NO: 2803733 - DNA, 22 bp, Homo sapiens
tttgcctaaatccaaagaaaaa

SEQ ID NO: 2803734 - DNA, 14 bp, Homo sapiens
tttgcctcaaataa

SEQ ID NO: 2803735 - DNA, 13 bp, Homo sapiens
tttgcctctgaaa

SEQ ID NO: 2803736 - DNA, 20 bp, Homo sapiens
tttgcctcttttctctgtgc

SEQ ID NO: 2803737 - DNA, 21 bp, Homo sapiens
tttgcctgtaacaagccagat

SEQ ID NO: 2803738 - DNA, 14 bp, Homo sapiens
tttgctaattaaaa

SEQ ID NO: 2803739 - DNA, 13 bp, Homo sapiens
tttgctattgaca

SEQ ID NO: 2803740 - DNA, 18 bp, Homo sapiens
tttgcttatttatattca

SEQ ID NO: 2803741 - DNA, 22 bp, Homo sapiens
tttggaggaacagctccctagt

SEQ ID NO: 2803742 - DNA, 23 bp, Homo sapiens
tttggcaggagaatcaataaaaa

SEQ ID NO: 2803743 - DNA, 19 bp, Homo sapiens
tttggcatgcttaaatatt

SEQ ID NO: 2803744 - DNA, 23 bp, Homo sapiens
tttggccaatgcacctaaagaaa

SEQ ID NO: 2803745 - DNA, 20 bp, Homo sapiens
tttgggcagaagggagaagg

SEQ ID NO: 2803746 - DNA, 18 bp, Homo sapiens
tttgggccactgcactct

SEQ ID NO: 2803747 - DNA, 23 bp, Homo sapiens
tttgggccactgcactctagcct

SEQ ID NO: 2803748 - DNA, 20 bp, Homo sapiens
tttggggagggggaagagaa

SEQ ID NO: 2803749 - DNA, 22 bp, Homo sapiens
tttggtgtggctgtattcagat

SEQ ID NO: 2803750 - DNA, 15 bp, Homo sapiens
tttggtttttatatt

SEQ ID NO: 2803751 - DNA, 16 bp, Homo sapiens
tttgtaagttgaagca

SEQ ID NO: 2803752 - DNA, 13 bp, Homo sapiens
tttgtaataaact

SEQ ID NO: 2803753 - DNA, 14 bp, Homo sapiens
tttgtaataaactc

SEQ ID NO: 2803754 - DNA, 17 bp, Homo sapiens
tttgtaataaactctct

SEQ ID NO: 2803755 - DNA, 21 bp, Homo sapiens
tttgtaatcgttatgtgtgta

SEQ ID NO: 2803756 - DNA, 12 bp, Homo sapiens
tttgtacagaat

SEQ ID NO: 2803757 - DNA, 12 bp, Homo sapiens
ttttacaaagcc

SEQ ID NO: 2803758 - DNA, 21 bp, Homo sapiens
ttttacaaataaagatggcta

SEQ ID NO: 2803759 - DNA, 20 bp, Homo sapiens
ttttacctaccacagtgtct

SEQ ID NO: 2803760 - DNA, 14 bp, Homo sapiens
ttttactaaagcag

SEQ ID NO: 2803761 - DNA, 16 bp, Homo sapiens
ttttactaaagcagtg

SEQ ID NO: 2803762 - DNA, 17 bp, Homo sapiens
ttttactaaagcagtgt

SEQ ID NO: 2803763 - DNA, 15 bp, Homo sapiens
ttttactactgtgga

SEQ ID NO: 2803764 - DNA, 22 bp, Homo sapiens
ttttactcctttgcattccatg

SEQ ID NO: 2803765 - DNA, 13 bp, Homo sapiens
ttttactgtctgt

SEQ ID NO: 2803766 - DNA, 18 bp, Homo sapiens
ttttagagattaatttgt

SEQ ID NO: 2803767 - DNA, 23 bp, Homo sapiens
ttttagccttctctgttcatttc

SEQ ID NO: 2803768 - DNA, 19 bp, Homo sapiens
ttttagctccttgactcct

SEQ ID NO: 2803769 - DNA, 16 bp, Homo sapiens
ttttagctctgttctt

SEQ ID NO: 2803770 - DNA, 22 bp, Homo sapiens
ttttataatgtggatttcctat

SEQ ID NO: 2803771 - DNA, 17 bp, Homo sapiens
ttttatacatatcagaa

SEQ ID NO: 2803772 - DNA, 19 bp, Homo sapiens
ttttatacatatcagaaaa

SEQ ID NO: 2803773 - DNA, 23 bp, Homo sapiens
ttttatctgaatttttaaacaag

SEQ ID NO: 2803774 - DNA, 12 bp, Homo sapiens
ttttatgactgt

SEQ ID NO: 2803775 - DNA, 19 bp, Homo sapiens
ttttatgatttaaaaaata

SEQ ID NO: 2803776 - DNA, 18 bp, Homo sapiens
ttttatgtgcctttttgt

SEQ ID NO: 2803777 - DNA, 21 bp, Homo sapiens
ttttatgtgctctcatcagaa

SEQ ID NO: 2803778 - DNA, 20 bp, Homo sapiens
ttttatttccacataaaggt

SEQ ID NO: 2803779 - DNA, 12 bp, Homo sapiens
ttttatttttga

SEQ ID NO: 2803780 - DNA, 18 bp, Homo sapiens
ttttcaaaaattgtgttt

SEQ ID NO: 2803781 - DNA, 14 bp, Homo sapiens
ttttcaaaatggag

SEQ ID NO: 2803782 - DNA, 14 bp, Homo sapiens
ttttcaaccagcat

SEQ ID NO: 2803783 - DNA, 16 bp, Homo sapiens
ttttcaaccagcattt

SEQ ID NO: 2803784 - DNA, 18 bp, Homo sapiens
ttttcaagaaaactggaa

SEQ ID NO: 2803785 - DNA, 21 bp, Homo sapiens
ttttcaagagaagaaaaaatt

SEQ ID NO: 2803786 - DNA, 22 bp, Homo sapiens
ttttcaagagaagaaaaaatta

SEQ ID NO: 2803787 - DNA, 16 bp, Homo sapiens
ttttcaatatttatta

SEQ ID NO: 2803788 - DNA, 14 bp, Homo sapiens
ttttcaattttgca

SEQ ID NO: 2803789 - DNA, 18 bp, Homo sapiens
ttttcaattttgcatgct

SEQ ID NO: 2803790 - DNA, 23 bp, Homo sapiens
ttttcagtagggctacaaaacct

SEQ ID NO: 2803791 - DNA, 17 bp, Homo sapiens
ttttccaataaaatttt

SEQ ID NO: 2803792 - DNA, 19 bp, Homo sapiens
ttttccccggtcccttgag

SEQ ID NO: 2803793 - DNA, 14 bp, Homo sapiens
ttttccctctggca

SEQ ID NO: 2803794 - DNA, 18 bp, Homo sapiens
ttttcctcttctattttg

SEQ ID NO: 2803795 - DNA, 16 bp, Homo sapiens
ttttccttcaaagttt

SEQ ID NO: 2803796 - DNA, 13 bp, Homo sapiens
ttttctacagtta

SEQ ID NO: 2803797 - DNA, 24 bp, Homo sapiens
ttttctagcaactgttggataata

SEQ ID NO: 2803798 - DNA, 18 bp, Homo sapiens
ttttctggaatgtaatca

SEQ ID NO: 2803799 - DNA, 15 bp, Homo sapiens
aaccatttaattcat

SEQ ID NO: 2803800 - DNA, 23 bp, Homo sapiens
aaccatttaattcataattagaa

SEQ ID NO: 2803801 - DNA, 19 bp, Homo sapiens
aacccaccagcctaagaag

SEQ ID NO: 2803802 - DNA, 22 bp, Homo sapiens
aacctgggaggcggagagtaca

SEQ ID NO: 2803803 - DNA, 15 bp, Homo sapiens
aacctgtacttcaag

SEQ ID NO: 2803804 - DNA, 23 bp, Homo sapiens
aacctgtacttcaagttaaagtg

SEQ ID NO: 2803805 - DNA, 17 bp, Homo sapiens
aacctgtccataaagta

SEQ ID NO: 2803806 - DNA, 21 bp, Homo sapiens
aacctgtccataaagtaattt

SEQ ID NO: 2803807 - DNA, 15 bp, Homo sapiens
aaccttacttaaagc

SEQ ID NO: 2803808 - DNA, 18 bp, Homo sapiens
aaccttattgtacctctc

SEQ ID NO: 2803809 - DNA, 19 bp, Homo sapiens
aaccttattgtacctctct

SEQ ID NO: 2803810 - DNA, 23 bp, Homo sapiens
aaccttgtctctatgccagctca

SEQ ID NO: 2803811 - DNA, 18 bp, Homo sapiens
aacctttcaaatttcaca

SEQ ID NO: 2803812 - DNA, 13 bp, Homo sapiens
aacctttccctca

SEQ ID NO: 2803813 - DNA, 14 bp, Homo sapiens
aacctttccctcac

SEQ ID NO: 2803814 - DNA, 18 bp, Homo sapiens
aacctttccctcaccccc

SEQ ID NO: 2803815 - DNA, 20 bp, Homo sapiens
aacctttccctcaccccctc

SEQ ID NO: 2803816 - DNA, 16 bp, Homo sapiens
aacgaacccactgtgc

SEQ ID NO: 2803817 - DNA, 21 bp, Homo sapiens
aacgaacccactgtgcttaca

SEQ ID NO: 2803818 - DNA, 11 bp, Homo sapiens
aacgcctgagc

SEQ ID NO: 2803819 - DNA, 18 bp, Homo sapiens
aacgcctgagcccaggga

SEQ ID NO: 2803820 - DNA, 14 bp, Homo sapiens
aacggctccaggat

SEQ ID NO: 2803821 - DNA, 15 bp, Homo sapiens
aacgggctgccctgc

SEQ ID NO: 2803822 - DNA, 18 bp, Homo sapiens
aacggtcccccctcactc

SEQ ID NO: 2803823 - DNA, 13 bp, Homo sapiens
aacgtcatctcag

SEQ ID NO: 2803824 - DNA, 14 bp, Homo sapiens
aacgtcatctcagg

SEQ ID NO: 2803825 - DNA, 15 bp, Homo sapiens
aacgtgatgatcagc

SEQ ID NO: 2803826 - DNA, 16 bp, Homo sapiens
aacgttaaaagacagt

SEQ ID NO: 2803827 - DNA, 17 bp, Homo sapiens
aacgttaaaagacagtg

SEQ ID NO: 2803828 - DNA, 14 bp, Homo sapiens
aacgttgctcccca

SEQ ID NO: 2803829 - DNA, 20 bp, Homo sapiens
aacgtttaagccaaaacaat

SEQ ID NO: 2803830 - DNA, 15 bp, Homo sapiens
aacgttttgaactaa

SEQ ID NO: 2803831 - DNA, 20 bp, Homo sapiens
aacgttttgaactaataaaa

SEQ ID NO: 2803832 - DNA, 23 bp, Homo sapiens
aactaagaaatatgcacaatagc

SEQ ID NO: 2803833 - DNA, 16 bp, Homo sapiens
aactaatcaagagtga

SEQ ID NO: 2803834 - DNA, 15 bp, Homo sapiens
aactactttttatac

SEQ ID NO: 2803835 - DNA, 20 bp, Homo sapiens
aactagagatgactgagtcc

SEQ ID NO: 2803836 - DNA, 21 bp, Homo sapiens
aactagaggtgagaaatttaa

SEQ ID NO: 2803837 - DNA, 22 bp, Homo sapiens
aactagaggtgagaaatttaaa

SEQ ID NO: 2803838 - DNA, 23 bp, Homo sapiens
aactagatctcctatttttcaga

SEQ ID NO: 2803839 - DNA, 15 bp, Homo sapiens
aactagatctcctgt

SEQ ID NO: 2803840 - DNA, 19 bp, Homo sapiens
aactagatctcctgtaatt

SEQ ID NO: 2803841 - DNA, 22 bp, Homo sapiens
aactagtaatgggccaattaaa

SEQ ID NO: 2803842 - DNA, 15 bp, Homo sapiens
aactagtcctttact

SEQ ID NO: 2803843 - DNA, 17 bp, Homo sapiens
aactatgaactacaaag

SEQ ID NO: 2803844 - DNA, 18 bp, Homo sapiens
aactatgatatggtaaaa

SEQ ID NO: 2803845 - DNA, 20 bp, Homo sapiens
aactatggttcccaataaaa

SEQ ID NO: 2803846 - DNA, 22 bp, Homo sapiens
aactatggttcccaataaaagt

SEQ ID NO: 2803847 - DNA, 13 bp, Homo sapiens
aactcaatatttt

SEQ ID NO: 2803848 - DNA, 14 bp, Homo sapiens
aactcaatattttc

SEQ ID NO: 2803849 - DNA, 21 bp, Homo sapiens
aactcaatattttccatgaaa

SEQ ID NO: 2803850 - DNA, 15 bp, Homo sapiens
aactcaccatgtaaa

SEQ ID NO: 2803851 - DNA, 14 bp, Homo sapiens
aactcactgctcaa

SEQ ID NO: 2803852 - DNA, 17 bp, Homo sapiens
aactcacttcaatgaac

SEQ ID NO: 2803853 - DNA, 13 bp, Homo sapiens
aactccaggaaaa

SEQ ID NO: 2803854 - DNA, 22 bp, Homo sapiens
aactcccagcaacacaagctgg

SEQ ID NO: 2803855 - DNA, 15 bp, Homo sapiens
aactcgttttttaca

SEQ ID NO: 2803856 - DNA, 21 bp, Homo sapiens
aactctaattcccattttgca

SEQ ID NO: 2803857 - DNA, 19 bp, Homo sapiens
aactctaccctggtaggaa

SEQ ID NO: 2803858 - DNA, 22 bp, Homo sapiens
aactctaccctggtaggaaagc

SEQ ID NO: 2803859 - DNA, 12 bp, Homo sapiens
aactctctccac

SEQ ID NO: 2803860 - DNA, 16 bp, Homo sapiens
aactctgcattctagt

SEQ ID NO: 2803861 - DNA, 14 bp, Homo sapiens
aactctgccagcca

SEQ ID NO: 2803862 - DNA, 18 bp, Homo sapiens
aactctggcttccaggta

SEQ ID NO: 2803863 - DNA, 16 bp, Homo sapiens
aactcttccatttatt

SEQ ID NO: 2803864 - DNA, 20 bp, Homo sapiens
aactcttccatttattgcac

SEQ ID NO: 2803865 - DNA, 17 bp, Homo sapiens
aactgaaaactgtaaat

SEQ ID NO: 2803866 - DNA, 17 bp, Homo sapiens
aactgaaaattatttaa

SEQ ID NO: 2803867 - DNA, 15 bp, Homo sapiens
aactgaacgtcctgc

SEQ ID NO: 2803868 - DNA, 22 bp, Homo sapiens
aactgaatggaaggtttgtata

SEQ ID NO: 2803869 - DNA, 12 bp, Homo sapiens
aactgagcctag

SEQ ID NO: 2803870 - DNA, 16 bp, Homo sapiens
aactgagcctagctac

SEQ ID NO: 2803871 - DNA, 12 bp, Homo sapiens
aactgaggaatt

SEQ ID NO: 2803872 - DNA, 16 bp, Homo sapiens
aactgaggaattttct

SEQ ID NO: 2803873 - DNA, 18 bp, Homo sapiens
aactgaggaattttcttt

SEQ ID NO: 2803874 - DNA, 20 bp, Homo sapiens
aactgaggaattttctttgt

SEQ ID NO: 2803875 - DNA, 12 bp, Homo sapiens
aactgaggcaga

SEQ ID NO: 2803876 - DNA, 19 bp, Homo sapiens
aactgattcacatctcatt

SEQ ID NO: 2803877 - DNA, 14 bp, Homo sapiens
aactgcgtgccagt

SEQ ID NO: 2803878 - DNA, 22 bp, Homo sapiens
aactgcgtgccagtgtccccac

SEQ ID NO: 2803879 - DNA, 20 bp, Homo sapiens
aactgctgttaattgattaa

SEQ ID NO: 2803880 - DNA, 14 bp, Homo sapiens
aactggaaatctgg

SEQ ID NO: 2803881 - DNA, 16 bp, Homo sapiens
aactggaaatctggat

SEQ ID NO: 2803882 - DNA, 18 bp, Homo sapiens
aactggaaatctggattt

SEQ ID NO: 2803883 - DNA, 19 bp, Homo sapiens
aactggccaagctgaggtg

SEQ ID NO: 2803884 - DNA, 23 bp, Homo sapiens
aactggggagttataaaaataca

SEQ ID NO: 2803885 - DNA, 23 bp, Homo sapiens
aactggtttagcacaatttatat

SEQ ID NO: 2803886 - DNA, 13 bp, Homo sapiens
aactgtaaataca

SEQ ID NO: 2803887 - DNA, 23 bp, Homo sapiens
aactgtaaatacaaaataaaatt

SEQ ID NO: 2803888 - DNA, 16 bp, Homo sapiens
aactgtgacaggaagc

SEQ ID NO: 2803889 - DNA, 23 bp, Homo sapiens
aactgtgatggggtgggcagggc

SEQ ID NO: 2803890 - DNA, 16 bp, Homo sapiens
aactgtgtgaagaaat

SEQ ID NO: 2803891 - DNA, 17 bp, Homo sapiens
aactgtgtgaagaaatg

SEQ ID NO: 2803892 - DNA, 22 bp, Homo sapiens
aaggttgacaataaatgtgctt

SEQ ID NO: 2803893 - DNA, 21 bp, Homo sapiens
aaggttgactcaagtttttac

SEQ ID NO: 2803894 - DNA, 13 bp, Homo sapiens
aaggtttggtgtg

SEQ ID NO: 2803895 - DNA, 14 bp, Homo sapiens
aaggttttctccac

SEQ ID NO: 2803896 - DNA, 13 bp, Homo sapiens
aagtaaaagcaaa

SEQ ID NO: 2803897 - DNA, 13 bp, Homo sapiens
aagtaaaccaaaa

SEQ ID NO: 2803898 - DNA, 15 bp, Homo sapiens
aagtaacttttacaa

SEQ ID NO: 2803899 - DNA, 18 bp, Homo sapiens
aagtaagtaccactcagg

SEQ ID NO: 2803900 - DNA, 13 bp, Homo sapiens
aagtaattatcgg

SEQ ID NO: 2803901 - DNA, 22 bp, Homo sapiens
aagtaattatcgggaacagtgt

SEQ ID NO: 2803902 - DNA, 23 bp, Homo sapiens
aagtaattatcgggaacagtgtt

SEQ ID NO: 2803903 - DNA, 18 bp, Homo sapiens
aagtaattgcatttctgc

SEQ ID NO: 2803904 - DNA, 18 bp, Homo sapiens
aagtacttctccaccctg

SEQ ID NO: 2803905 - DNA, 16 bp, Homo sapiens
aagtagagaacagtca

SEQ ID NO: 2803906 - DNA, 23 bp, Homo sapiens
aagtaggactttcctaaatgttt

SEQ ID NO: 2803907 - DNA, 22 bp, Homo sapiens
aagtatatagtatatttatact

SEQ ID NO: 2803908 - DNA, 13 bp, Homo sapiens
aagtatatattta

SEQ ID NO: 2803909 - DNA, 19 bp, Homo sapiens
aagtatcatcagtgtagaa

SEQ ID NO: 2803910 - DNA, 13 bp, Homo sapiens
aagtatccaatta

SEQ ID NO: 2803911 - DNA, 17 bp, Homo sapiens
aagtatgagggaaaatg

SEQ ID NO: 2803912 - DNA, 13 bp, Homo sapiens
aagtattcttcat

SEQ ID NO: 2803913 - DNA, 14 bp, Homo sapiens
aagtatttatatat

SEQ ID NO: 2803914 - DNA, 15 bp, Homo sapiens
aagtatttatatatt

SEQ ID NO: 2803915 - DNA, 20 bp, Homo sapiens
aagtatttgttaatttagaa

SEQ ID NO: 2803916 - DNA, 18 bp, Homo sapiens
aagtattttatctgtgtt

SEQ ID NO: 2803917 - DNA, 20 bp, Homo sapiens
aagtattttatctgtgttgt

SEQ ID NO: 2803918 - DNA, 16 bp, Homo sapiens
aagtcaaaaggtgcct

SEQ ID NO: 2803919 - DNA, 22 bp, Homo sapiens
aagtcaaagtaaaacttgctgc

SEQ ID NO: 2803920 - DNA, 13 bp, Homo sapiens
aagtcaaggagaa

SEQ ID NO: 2803921 - DNA, 12 bp, Homo sapiens
aagtcacacaga

SEQ ID NO: 2803922 - DNA, 14 bp, Homo sapiens
aagtcacacagaca

SEQ ID NO: 2803923 - DNA, 24 bp, Homo sapiens
aagtcacacagtattacttctgct

SEQ ID NO: 2803924 - DNA, 13 bp, Homo sapiens
aagtcacacagtg

SEQ ID NO: 2803925 - DNA, 16 bp, Homo sapiens
aagtcacatcacagga

SEQ ID NO: 2803926 - DNA, 18 bp, Homo sapiens
aagtcagaacagcagact

SEQ ID NO: 2803927 - DNA, 17 bp, Homo sapiens
aagtcaggacctggctt

SEQ ID NO: 2803928 - DNA, 18 bp, Homo sapiens
aagtcaggacctggcttg

SEQ ID NO: 2803929 - DNA, 18 bp, Homo sapiens
aagtcagtgggaacgtga

SEQ ID NO: 2803930 - DNA, 12 bp, Homo sapiens
aagtcatccaca

SEQ ID NO: 2803931 - DNA, 23 bp, Homo sapiens
aagtcatcttagctttccacagg

SEQ ID NO: 2803932 - DNA, 15 bp, Homo sapiens
aagtcatgaagccca

SEQ ID NO: 2803933 - DNA, 14 bp, Homo sapiens
aagtcatggcccaa

SEQ ID NO: 2803934 - DNA, 16 bp, Homo sapiens
aagtcattttaacttt

SEQ ID NO: 2803935 - DNA, 13 bp, Homo sapiens
aagtccaggtcct

SEQ ID NO: 2803936 - DNA, 15 bp, Homo sapiens
aagtccaggtcctgg

SEQ ID NO: 2803937 - DNA, 18 bp, Homo sapiens
aagtcctcttttctgaga

SEQ ID NO: 2803938 - DNA, 22 bp, Homo sapiens
aagtcctcttttctgagaggac

SEQ ID NO: 2803939 - DNA, 21 bp, Homo sapiens
aagtctccaagaatacagaaa

SEQ ID NO: 2803940 - DNA, 18 bp, Homo sapiens
aagtctggatctgggacc

SEQ ID NO: 2803941 - DNA, 17 bp, Homo sapiens
aagtcttaaaataactt

SEQ ID NO: 2803942 - DNA, 16 bp, Homo sapiens
aagtgaaatcaaaggt

SEQ ID NO: 2803943 - DNA, 12 bp, Homo sapiens
aagtgaataaac

SEQ ID NO: 2803944 - DNA, 14 bp, Homo sapiens
aagtgaataaactt

SEQ ID NO: 2803945 - DNA, 15 bp, Homo sapiens
aagtgaataaacttc

SEQ ID NO: 2803946 - DNA, 15 bp, Homo sapiens
aagtgagagctgggt

SEQ ID NO: 2803947 - DNA, 17 bp, Homo sapiens
aagtgatatatgtattt

SEQ ID NO: 2803948 - DNA, 19 bp, Homo sapiens
aagtgatcctcccacctca

SEQ ID NO: 2803949 - DNA, 20 bp, Homo sapiens
aagtgatcctcccacctcag

SEQ ID NO: 2803950 - DNA, 15 bp, Homo sapiens
aagtgattctcctgc

SEQ ID NO: 2803951 - DNA, 17 bp, Homo sapiens
aagtgattctcctgcct

SEQ ID NO: 2803952 - DNA, 19 bp, Homo sapiens
aagtgattctcctgcctca

SEQ ID NO: 2803953 - DNA, 13 bp, Homo sapiens
aagtgcttagaaa

SEQ ID NO: 2803954 - DNA, 18 bp, Homo sapiens
aagtgcttagaaagttat

SEQ ID NO: 2803955 - DNA, 11 bp, Homo sapiens
aagtggaaaaa

SEQ ID NO: 2803956 - DNA, 14 bp, Homo sapiens
aagtggaaaaaaga

SEQ ID NO: 2803957 - DNA, 17 bp, Homo sapiens
aagtggaaaaaagagaa

SEQ ID NO: 2803958 - DNA, 19 bp, Homo sapiens
aagtggaaaaaagagaaaa

SEQ ID NO: 2803959 - DNA, 19 bp, Homo sapiens
aagtggaccaggacaggac

SEQ ID NO: 2803960 - DNA, 19 bp, Homo sapiens
aagtggctaattcaattta

SEQ ID NO: 2803961 - DNA, 14 bp, Homo sapiens
aagtggctgctgac

SEQ ID NO: 2803962 - DNA, 21 bp, Homo sapiens
aagtgggccaggacaggcccg

SEQ ID NO: 2803963 - DNA, 23 bp, Homo sapiens
aagtgtatttttgtttaatcaaa

SEQ ID NO: 2803964 - DNA, 22 bp, Homo sapiens
aagtgtgttgggaattgcatgc

SEQ ID NO: 2803965 - DNA, 22 bp, Homo sapiens
aagtgttgaagaagagtttgca

SEQ ID NO: 2803966 - DNA, 23 bp, Homo sapiens
aagtgttggctaatgaagggaaa

SEQ ID NO: 2803967 - DNA, 17 bp, Homo sapiens
aagtgttgtaaatattt

SEQ ID NO: 2803968 - DNA, 22 bp, Homo sapiens
aagtgttgtaaatatttatgta

SEQ ID NO: 2803969 - DNA, 19 bp, Homo sapiens
aagttacatgtttgcacct

SEQ ID NO: 2803970 - DNA, 16 bp, Homo sapiens
aagttacttattctag

SEQ ID NO: 2803971 - DNA, 20 bp, Homo sapiens
aagttaggttataagaaaca

SEQ ID NO: 2803972 - DNA, 22 bp, Homo sapiens
aagttagtgtgttgtctgtgca

SEQ ID NO: 2803973 - DNA, 19 bp, Homo sapiens
aagttataaatcaatgtca

SEQ ID NO: 2803974 - DNA, 23 bp, Homo sapiens
aagttattccccatcttccaagg

SEQ ID NO: 2803975 - DNA, 17 bp, Homo sapiens
aagttattgtgttgcct

SEQ ID NO: 2803976 - DNA, 22 bp, Homo sapiens
aagttcctgttcaccttatgta

SEQ ID NO: 2803977 - DNA, 22 bp, Homo sapiens
aagttggaaccgtgtccagcac

SEQ ID NO: 2803978 - DNA, 13 bp, Homo sapiens
aagtttaaaaaat

SEQ ID NO: 2803979 - DNA, 14 bp, Homo sapiens
aagtttaataaatt

SEQ ID NO: 2803980 - DNA, 12 bp, Homo sapiens
aagtttataagc

SEQ ID NO: 2803981 - DNA, 22 bp, Homo sapiens
aagtttattttttctacacagt

SEQ ID NO: 2803982 - DNA, 18 bp, Homo sapiens
aagtttcttggtctcagc

SEQ ID NO: 2803983 - DNA, 18 bp, Homo sapiens
aatgttaaaatattgatt

SEQ ID NO: 2803984 - DNA, 16 bp, Homo sapiens
aatgttacattattat

SEQ ID NO: 2803985 - DNA, 17 bp, Homo sapiens
aatgttagcctcaattt

SEQ ID NO: 2803986 - DNA, 20 bp, Homo sapiens
aatgttattttttaattatt

SEQ ID NO: 2803987 - DNA, 18 bp, Homo sapiens
aatgttggaattttcaaa

SEQ ID NO: 2803988 - DNA, 18 bp, Homo sapiens
aatgttgggatttatatc

SEQ ID NO: 2803989 - DNA, 23 bp, Homo sapiens
aatgtttacactctttgtaagag

SEQ ID NO: 2803990 - DNA, 21 bp, Homo sapiens
aatgtttcattttcattaaaa

SEQ ID NO: 2803991 - DNA, 18 bp, Homo sapiens
aatgtttgcctctgcctc

SEQ ID NO: 2803992 - DNA, 12 bp, Homo sapiens
aatgtttgctat

SEQ ID NO: 2803993 - DNA, 23 bp, Homo sapiens
aatgtttgggcagaagggagaag

SEQ ID NO: 2803994 - DNA, 15 bp, Homo sapiens
aattaaagctgttat

SEQ ID NO: 2803995 - DNA, 19 bp, Homo sapiens
aattaatcgaaatgaattt

SEQ ID NO: 2803996 - DNA, 14 bp, Homo sapiens
aattacacccaaag

SEQ ID NO: 2803997 - DNA, 17 bp, Homo sapiens
aattacactacaagttt

SEQ ID NO: 2803998 - DNA, 16 bp, Homo sapiens
aattactacaaaattt

SEQ ID NO: 2803999 - DNA, 13 bp, Homo sapiens
aattagaacaata

SEQ ID NO: 2804000 - DNA, 12 bp, Homo sapiens
aattagcaattg

SEQ ID NO: 2804001 - DNA, 18 bp, Homo sapiens
aattaggatctatgcaat

SEQ ID NO: 2804002 - DNA, 16 bp, Homo sapiens
aattaggttttgtaca

SEQ ID NO: 2804003 - DNA, 17 bp, Homo sapiens
aattaggttttgtacaa

SEQ ID NO: 2804004 - DNA, 13 bp, Homo sapiens
aattagtacagta

SEQ ID NO: 2804005 - DNA, 19 bp, Homo sapiens
aattagtacagtagcttaa

SEQ ID NO: 2804006 - DNA, 17 bp, Homo sapiens
aattagtatttatttaa

SEQ ID NO: 2804007 - DNA, 16 bp, Homo sapiens
aattagtgagatttgt

SEQ ID NO: 2804008 - DNA, 16 bp, Homo sapiens
aattataatatactat

SEQ ID NO: 2804009 - DNA, 18 bp, Homo sapiens
aattatatctaatttata

SEQ ID NO: 2804010 - DNA, 12 bp, Homo sapiens
aattatatctgt

SEQ ID NO: 2804011 - DNA, 13 bp, Homo sapiens
aattatccaggaa

SEQ ID NO: 2804012 - DNA, 17 bp, Homo sapiens
aattatcggaagcagtg

SEQ ID NO: 2804013 - DNA, 20 bp, Homo sapiens
aattatcggaagcagtgcct

SEQ ID NO: 2804014 - DNA, 17 bp, Homo sapiens
aattatcgggaacagtg

SEQ ID NO: 2804015 - DNA, 18 bp, Homo sapiens
aattatggaaatatagtt

SEQ ID NO: 2804016 - DNA, 20 bp, Homo sapiens
aattattatgtctcaaaata

SEQ ID NO: 2804017 - DNA, 16 bp, Homo sapiens
aattattatttatata

SEQ ID NO: 2804018 - DNA, 18 bp, Homo sapiens
aattattatttatatatg

SEQ ID NO: 2804019 - DNA, 22 bp, Homo sapiens
aattattatttatatatgtatt

SEQ ID NO: 2804020 - DNA, 22 bp, Homo sapiens
aattatttaaaccgctaaaaga

SEQ ID NO: 2804021 - DNA, 17 bp, Homo sapiens
aattcaaaccatttaat

SEQ ID NO: 2804022 - DNA, 13 bp, Homo sapiens
aattcaacacatt

SEQ ID NO: 2804023 - DNA, 15 bp, Homo sapiens
aattcaacacattac

SEQ ID NO: 2804024 - DNA, 16 bp, Homo sapiens
aattcaacacattact

SEQ ID NO: 2804025 - DNA, 19 bp, Homo sapiens
aattcaacacattacttgc

SEQ ID NO: 2804026 - DNA, 21 bp, Homo sapiens
aattcaaccactgtaaaatga

SEQ ID NO: 2804027 - DNA, 19 bp, Homo sapiens
aattcaaggagatataaaa

SEQ ID NO: 2804028 - DNA, 16 bp, Homo sapiens
aattcagtgctgtact

SEQ ID NO: 2804029 - DNA, 13 bp, Homo sapiens
aattcataattag

SEQ ID NO: 2804030 - DNA, 23 bp, Homo sapiens
aattcataattagaacaatagct

SEQ ID NO: 2804031 - DNA, 18 bp, Homo sapiens
aattcatgtacagcatgc

SEQ ID NO: 2804032 - DNA, 16 bp, Homo sapiens
aattcatttcacttta

SEQ ID NO: 2804033 - DNA, 20 bp, Homo sapiens
aattcatttcactttaaagt

SEQ ID NO: 2804034 - DNA, 21 bp, Homo sapiens
aattcatttcactttaaagtc

SEQ ID NO: 2804035 - DNA, 21 bp, Homo sapiens
aattcccagctgtctgtgtca

SEQ ID NO: 2804036 - DNA, 16 bp, Homo sapiens
aattcccattttgcaa

SEQ ID NO: 2804037 - DNA, 21 bp, Homo sapiens
aattcccattttgcaaaattt

SEQ ID NO: 2804038 - DNA, 22 bp, Homo sapiens
aattcccattttgcaaaatttc

SEQ ID NO: 2804039 - DNA, 10 bp, Homo sapiens
aattccctat

SEQ ID NO: 2804040 - DNA, 23 bp, Homo sapiens
aattccctatcttttagttttag

SEQ ID NO: 2804041 - DNA, 11 bp, Homo sapiens
aattcctgggc

SEQ ID NO: 2804042 - DNA, 14 bp, Homo sapiens
aattctacagtttc

SEQ ID NO: 2804043 - DNA, 14 bp, Homo sapiens
aattctctctaaaa

SEQ ID NO: 2804044 - DNA, 22 bp, Homo sapiens
aattctctctaaaaataaaatg

SEQ ID NO: 2804045 - DNA, 16 bp, Homo sapiens
aattctgctacctcac

SEQ ID NO: 2804046 - DNA, 16 bp, Homo sapiens
aattctgctcagatag

SEQ ID NO: 2804047 - DNA, 17 bp, Homo sapiens
aattctggaggaagaag

SEQ ID NO: 2804048 - DNA, 18 bp, Homo sapiens
aattcttcaggtggaaaa

SEQ ID NO: 2804049 - DNA, 15 bp, Homo sapiens
aattcttgtatatta

SEQ ID NO: 2804050 - DNA, 16 bp, Homo sapiens
aattcttgtatattat

SEQ ID NO: 2804051 - DNA, 20 bp, Homo sapiens
aattcttgtatattatggaa

SEQ ID NO: 2804052 - DNA, 22 bp, Homo sapiens
aattgaacttaaataaatgtca

SEQ ID NO: 2804053 - DNA, 20 bp, Homo sapiens
aattgaagagatttcaacat

SEQ ID NO: 2804054 - DNA, 14 bp, Homo sapiens
aattgaagatgtaa

SEQ ID NO: 2804055 - DNA, 18 bp, Homo sapiens
aattgaatgcaaaccata

SEQ ID NO: 2804056 - DNA, 23 bp, Homo sapiens
aattgagataatatctgtgaggt

SEQ ID NO: 2804057 - DNA, 19 bp, Homo sapiens
aattgcacaatttgagcaa

SEQ ID NO: 2804058 - DNA, 14 bp, Homo sapiens
aattgccaaagctg

SEQ ID NO: 2804059 - DNA, 18 bp, Homo sapiens
aattggaccatcctattt

SEQ ID NO: 2804060 - DNA, 22 bp, Homo sapiens
aattggttagaacctcctattt

SEQ ID NO: 2804061 - DNA, 18 bp, Homo sapiens
aattgtagatggaaatca

SEQ ID NO: 2804062 - DNA, 12 bp, Homo sapiens
aattgtatgtta

SEQ ID NO: 2804063 - DNA, 21 bp, Homo sapiens
aattgtgcgacttcacaaaat

SEQ ID NO: 2804064 - DNA, 21 bp, Homo sapiens
aattgtgtacaaagtagagaa

SEQ ID NO: 2804065 - DNA, 17 bp, Homo sapiens
aattgtgtttagatttt

SEQ ID NO: 2804066 - DNA, 23 bp, Homo sapiens
aattgttgctaatcttcttatgc

SEQ ID NO: 2804067 - DNA, 20 bp, Homo sapiens
aattgtttaagtgttgtaaa

SEQ ID NO: 2804068 - DNA, 16 bp, Homo sapiens
aatttaaaccagcaga

SEQ ID NO: 2804069 - DNA, 20 bp, Homo sapiens
aatttaaaccagcagaaaag

SEQ ID NO: 2804070 - DNA, 20 bp, Homo sapiens
aatttaaattctttttcaaa

SEQ ID NO: 2804071 - DNA, 21 bp, Homo sapiens
aatttaactaatttaaaccag

SEQ ID NO: 2804072 - DNA, 12 bp, Homo sapiens
aatttagaaaac

SEQ ID NO: 2804073 - DNA, 12 bp, Homo sapiens
acagtctctggg

SEQ ID NO: 2804074 - DNA, 20 bp, Homo sapiens
acagtctctttaatcttcag

SEQ ID NO: 2804075 - DNA, 20 bp, Homo sapiens
acagtgactgtcgtgtttac

SEQ ID NO: 2804076 - DNA, 22 bp, Homo sapiens
acagtgagtcgaggacagggag

SEQ ID NO: 2804077 - DNA, 19 bp, Homo sapiens
acagtgatctccatatgtt

SEQ ID NO: 2804078 - DNA, 17 bp, Homo sapiens
acagtgcccagctaatt

SEQ ID NO: 2804079 - DNA, 18 bp, Homo sapiens
acagtgcccagctaattt

SEQ ID NO: 2804080 - DNA, 19 bp, Homo sapiens
acagtgctctaggctgccc

SEQ ID NO: 2804081 - DNA, 15 bp, Homo sapiens
acagtgctgttctgg

SEQ ID NO: 2804082 - DNA, 21 bp, Homo sapiens
acagtgctgttctggagctgc

SEQ ID NO: 2804083 - DNA, 15 bp, Homo sapiens
acagtggagaaatat

SEQ ID NO: 2804084 - DNA, 16 bp, Homo sapiens
acagtggatcatgaaa

SEQ ID NO: 2804085 - DNA, 17 bp, Homo sapiens
acagtgggaactggagg

SEQ ID NO: 2804086 - DNA, 21 bp, Homo sapiens
acagtgttgaaaatgttcaga

SEQ ID NO: 2804087 - DNA, 15 bp, Homo sapiens
acagtgtttcccata

SEQ ID NO: 2804088 - DNA, 23 bp, Homo sapiens
acagtgtttcccataattttctt

SEQ ID NO: 2804089 - DNA, 17 bp, Homo sapiens
acagtgtttgcaatggt

SEQ ID NO: 2804090 - DNA, 16 bp, Homo sapiens
acagttactcttcagt

SEQ ID NO: 2804091 - DNA, 13 bp, Homo sapiens
acagttatacata

SEQ ID NO: 2804092 - DNA, 23 bp, Homo sapiens
acagttatctaagttaatttaaa

SEQ ID NO: 2804093 - DNA, 13 bp, Homo sapiens
acagttcaaagaa

SEQ ID NO: 2804094 - DNA, 20 bp, Homo sapiens
acagttcaagaaagcttcaa

SEQ ID NO: 2804095 - DNA, 20 bp, Homo sapiens
acagttcaattctcatttgt

SEQ ID NO: 2804096 - DNA, 15 bp, Homo sapiens
acagttcatatgtac

SEQ ID NO: 2804097 - DNA, 14 bp, Homo sapiens
acagttcctcgccc

SEQ ID NO: 2804098 - DNA, 19 bp, Homo sapiens
acataaaatatacaaacat

SEQ ID NO: 2804099 - DNA, 15 bp, Homo sapiens
acataatgaatgcta

SEQ ID NO: 2804100 - DNA, 20 bp, Homo sapiens
acatacaatttgcactgtta

SEQ ID NO: 2804101 - DNA, 18 bp, Homo sapiens
acatacccttctttaaat

SEQ ID NO: 2804102 - DNA, 14 bp, Homo sapiens
acatactcattttt

SEQ ID NO: 2804103 - DNA, 16 bp, Homo sapiens
acatactcatttttca

SEQ ID NO: 2804104 - DNA, 12 bp, Homo sapiens
acatagtcacaa

SEQ ID NO: 2804105 - DNA, 14 bp, Homo sapiens
acatagtcacaaaa

SEQ ID NO: 2804106 - DNA, 16 bp, Homo sapiens
acatagtcacaaaaat

SEQ ID NO: 2804107 - DNA, 17 bp, Homo sapiens
acatatatgtatatgta

SEQ ID NO: 2804108 - DNA, 12 bp, Homo sapiens
acatatcaattc

SEQ ID NO: 2804109 - DNA, 18 bp, Homo sapiens
acatatgaaatttaatat

SEQ ID NO: 2804110 - DNA, 15 bp, Homo sapiens
acatatgcaccttgt

SEQ ID NO: 2804111 - DNA, 20 bp, Homo sapiens
acatatgcaccttgtgtctg

SEQ ID NO: 2804112 - DNA, 18 bp, Homo sapiens
acatatggaaatcctgtt

SEQ ID NO: 2804113 - DNA, 13 bp, Homo sapiens
acatatgtgaata

SEQ ID NO: 2804114 - DNA, 14 bp, Homo sapiens
acatattataaata

SEQ ID NO: 2804115 - DNA, 17 bp, Homo sapiens
acatattggaaaggtca

SEQ ID NO: 2804116 - DNA, 19 bp, Homo sapiens
acatatttgttaaatattt

SEQ ID NO: 2804117 - DNA, 13 bp, Homo sapiens
acatcaacattcc

SEQ ID NO: 2804118 - DNA, 16 bp, Homo sapiens
acatcacttgtacaaa

SEQ ID NO: 2804119 - DNA, 15 bp, Homo sapiens
acatcattcattttt

SEQ ID NO: 2804120 - DNA, 22 bp, Homo sapiens
acatccaaggagaaacagagac

SEQ ID NO: 2804121 - DNA, 23 bp, Homo sapiens
acatccaaggagaaacagagaca

SEQ ID NO: 2804122 - DNA, 17 bp, Homo sapiens
acatcccattgccctgg

SEQ ID NO: 2804123 - DNA, 15 bp, Homo sapiens
acatccccaggtctc

SEQ ID NO: 2804124 - DNA, 13 bp, Homo sapiens
acatccctgggcc

SEQ ID NO: 2804125 - DNA, 14 bp, Homo sapiens
acatccctgggcct

SEQ ID NO: 2804126 - DNA, 15 bp, Homo sapiens
acatccctgggcctg

SEQ ID NO: 2804127 - DNA, 20 bp, Homo sapiens
acatccctgggcctgctgct

SEQ ID NO: 2804128 - DNA, 21 bp, Homo sapiens
acatccctgggcctgctgctg

SEQ ID NO: 2804129 - DNA, 19 bp, Homo sapiens
acatctattataaaaccat

SEQ ID NO: 2804130 - DNA, 13 bp, Homo sapiens
acatctgaaagcc

SEQ ID NO: 2804131 - DNA, 21 bp, Homo sapiens
acatctgggaggctggtctcc

SEQ ID NO: 2804132 - DNA, 17 bp, Homo sapiens
acatctgttttaaattt

SEQ ID NO: 2804133 - DNA, 13 bp, Homo sapiens
acatcttgctctg

SEQ ID NO: 2804134 - DNA, 15 bp, Homo sapiens
acatcttgctctgct

SEQ ID NO: 2804135 - DNA, 13 bp, Homo sapiens
acatctttaagta

SEQ ID NO: 2804136 - DNA, 15 bp, Homo sapiens
acatctttaagtatt

SEQ ID NO: 2804137 - DNA, 21 bp, Homo sapiens
acatgaatcccacccacatgt

SEQ ID NO: 2804138 - DNA, 15 bp, Homo sapiens
acatgaatgcacact

SEQ ID NO: 2804139 - DNA, 15 bp, Homo sapiens
acatgcacatttata

SEQ ID NO: 2804140 - DNA, 16 bp, Homo sapiens
acatgcacatttatat

SEQ ID NO: 2804141 - DNA, 13 bp, Homo sapiens
acatgcacgtgtg

SEQ ID NO: 2804142 - DNA, 16 bp, Homo sapiens
acatgcagctctgatg

SEQ ID NO: 2804143 - DNA, 17 bp, Homo sapiens
acatgccatttgtactg

SEQ ID NO: 2804144 - DNA, 18 bp, Homo sapiens
acatgccatttgtactga

SEQ ID NO: 2804145 - DNA, 18 bp, Homo sapiens
acatgcctgattttaaaa

SEQ ID NO: 2804146 - DNA, 19 bp, Homo sapiens
acatgctaagagaagtaga

SEQ ID NO: 2804147 - DNA, 13 bp, Homo sapiens
acatgctttgttt

SEQ ID NO: 2804148 - DNA, 15 bp, Homo sapiens
acatggagactcctg

SEQ ID NO: 2804149 - DNA, 17 bp, Homo sapiens
acatggcctatgcacat

SEQ ID NO: 2804150 - DNA, 18 bp, Homo sapiens
acatggggttttcaattt

SEQ ID NO: 2804151 - DNA, 22 bp, Homo sapiens
acatggggttttcaattttgca

SEQ ID NO: 2804152 - DNA, 13 bp, Homo sapiens
acatgtatagtga

SEQ ID NO: 2804153 - DNA, 23 bp, Homo sapiens
acatgtcaccgtggaccttcctg

SEQ ID NO: 2804154 - DNA, 21 bp, Homo sapiens
acatgtccagtgggaggtgag

SEQ ID NO: 2804155 - DNA, 16 bp, Homo sapiens
acatgtcctatccaaa

SEQ ID NO: 2804156 - DNA, 15 bp, Homo sapiens
acatgtggtgggaca

SEQ ID NO: 2804157 - DNA, 18 bp, Homo sapiens
acatgtgtagcctgtgca

SEQ ID NO: 2804158 - DNA, 21 bp, Homo sapiens
acatgtttgcacctttctagt

SEQ ID NO: 2804159 - DNA, 20 bp, Homo sapiens
acattaaaagaagactggaa

SEQ ID NO: 2804160 - DNA, 13 bp, Homo sapiens
acattaacatcta

SEQ ID NO: 2804161 - DNA, 16 bp, Homo sapiens
acattaacatctatta

SEQ ID NO: 2804162 - DNA, 13 bp, Homo sapiens
acattaactcatt

SEQ ID NO: 2804163 - DNA, 22 bp, Homo sapiens
acattaactcattagactggaa

SEQ ID NO: 2804164 - DNA, 21 bp, Homo sapiens
tgcccagagggcccaggcagg

SEQ ID NO: 2804165 - DNA, 19 bp, Homo sapiens
tgcccagccctaaacatca

SEQ ID NO: 2804166 - DNA, 12 bp, Homo sapiens
tgcccaggagaa

SEQ ID NO: 2804167 - DNA, 16 bp, Homo sapiens
tgcccaggagagccag

SEQ ID NO: 2804168 - DNA, 17 bp, Homo sapiens
tgcccaggagagccagc

SEQ ID NO: 2804169 - DNA, 12 bp, Homo sapiens
tgcccaggcagg

SEQ ID NO: 2804170 - DNA, 16 bp, Homo sapiens
tgcccaggcaggtctt

SEQ ID NO: 2804171 - DNA, 22 bp, Homo sapiens
tgcccaggcccctgccaccctg

SEQ ID NO: 2804172 - DNA, 11 bp, Homo sapiens
tgcccaggctg

SEQ ID NO: 2804173 - DNA, 20 bp, Homo sapiens
tgcccaggctggagtgcagt

SEQ ID NO: 2804174 - DNA, 13 bp, Homo sapiens
tgcccaggctggc

SEQ ID NO: 2804175 - DNA, 23 bp, Homo sapiens
tgcccaggctggcgtgcagtggt

SEQ ID NO: 2804176 - DNA, 15 bp, Homo sapiens
tgcccagggctcagc

SEQ ID NO: 2804177 - DNA, 20 bp, Homo sapiens
tgcccaggggcccacaggga

SEQ ID NO: 2804178 - DNA, 15 bp, Homo sapiens
tgccccaactcctgg

SEQ ID NO: 2804179 - DNA, 22 bp, Homo sapiens
tgccccaactccttccagctag

SEQ ID NO: 2804180 - DNA, 15 bp, Homo sapiens
tgccccaaggctgct

SEQ ID NO: 2804181 - DNA, 15 bp, Homo sapiens
tgccccaccagccac

SEQ ID NO: 2804182 - DNA, 13 bp, Homo sapiens
tgccccagccccg

SEQ ID NO: 2804183 - DNA, 13 bp, Homo sapiens
tgccccagctctg

SEQ ID NO: 2804184 - DNA, 20 bp, Homo sapiens
tgcccccagcactcctctgt

SEQ ID NO: 2804185 - DNA, 18 bp, Homo sapiens
tgccccccttgccagaca

SEQ ID NO: 2804186 - DNA, 13 bp, Homo sapiens
tgccccctggtgg

SEQ ID NO: 2804187 - DNA, 15 bp, Homo sapiens
tgccccgcctccccg

SEQ ID NO: 2804188 - DNA, 18 bp, Homo sapiens
tgccccgcttccccacag

SEQ ID NO: 2804189 - DNA, 21 bp, Homo sapiens
tgccccgcttccccacagaac

SEQ ID NO: 2804190 - DNA, 19 bp, Homo sapiens
tgccccgggtccccagctc

SEQ ID NO: 2804191 - DNA, 23 bp, Homo sapiens
tgcccctgcagttggcagaaagg

SEQ ID NO: 2804192 - DNA, 21 bp, Homo sapiens
tgcccctgtaggttgcttaaa

SEQ ID NO: 2804193 - DNA, 16 bp, Homo sapiens
tgcccggattctggga

SEQ ID NO: 2804194 - DNA, 14 bp, Homo sapiens
tgcccggctgcgga

SEQ ID NO: 2804195 - DNA, 19 bp, Homo sapiens
tgcccgtcttcagcctagc

SEQ ID NO: 2804196 - DNA, 17 bp, Homo sapiens
tgccctagagcacactg

SEQ ID NO: 2804197 - DNA, 23 bp, Homo sapiens
tgccctagagcacactgtagcat

SEQ ID NO: 2804198 - DNA, 18 bp, Homo sapiens
tgccctcattttatgtca

SEQ ID NO: 2804199 - DNA, 15 bp, Homo sapiens
tgccctccctggcct

SEQ ID NO: 2804200 - DNA, 14 bp, Homo sapiens
tgccctgacctccc

SEQ ID NO: 2804201 - DNA, 16 bp, Homo sapiens
tgccctgacctcccag

SEQ ID NO: 2804202 - DNA, 14 bp, Homo sapiens
tgccctgccacctg

SEQ ID NO: 2804203 - DNA, 14 bp, Homo sapiens
tgccctgccctgcc

SEQ ID NO: 2804204 - DNA, 21 bp, Homo sapiens
tgccctgctgccgcctcccag

SEQ ID NO: 2804205 - DNA, 14 bp, Homo sapiens
tgccctgtcctcca

SEQ ID NO: 2804206 - DNA, 19 bp, Homo sapiens
tgccctgttgtgtatagat

SEQ ID NO: 2804207 - DNA, 13 bp, Homo sapiens
tgcccttctttct

SEQ ID NO: 2804208 - DNA, 16 bp, Homo sapiens
tgcccttctttctacc

SEQ ID NO: 2804209 - DNA, 17 bp, Homo sapiens
tgcccttgccctgacct

SEQ ID NO: 2804210 - DNA, 18 bp, Homo sapiens
tgcccttgccctgacctc

SEQ ID NO: 2804211 - DNA, 21 bp, Homo sapiens
tgccgaccagagccccacacg

SEQ ID NO: 2804212 - DNA, 14 bp, Homo sapiens
tgccgacctcgtcc

SEQ ID NO: 2804213 - DNA, 21 bp, Homo sapiens
tgccgacctcgtcctccccct

SEQ ID NO: 2804214 - DNA, 20 bp, Homo sapiens
tgccgagcaaccgtggccct

SEQ ID NO: 2804215 - DNA, 20 bp, Homo sapiens
tgccgcaagtctgcagcccg

SEQ ID NO: 2804216 - DNA, 12 bp, Homo sapiens
tgccgcacccca

SEQ ID NO: 2804217 - DNA, 16 bp, Homo sapiens
tgccgcctcaatgtgg

SEQ ID NO: 2804218 - DNA, 13 bp, Homo sapiens
tgccgcctcccag

SEQ ID NO: 2804219 - DNA, 14 bp, Homo sapiens
tgccgcctcccagc

SEQ ID NO: 2804220 - DNA, 18 bp, Homo sapiens
tgccgcctcccagcctgg

SEQ ID NO: 2804221 - DNA, 14 bp, Homo sapiens
tgccgcctgtgccc

SEQ ID NO: 2804222 - DNA, 21 bp, Homo sapiens
tgccgctcttctgtcatcccg

SEQ ID NO: 2804223 - DNA, 16 bp, Homo sapiens
tgccgttactctccaa

SEQ ID NO: 2804224 - DNA, 18 bp, Homo sapiens
tgcctaaatccaaagaaa

SEQ ID NO: 2804225 - DNA, 21 bp, Homo sapiens
tgcctaataaacatccttcaa

SEQ ID NO: 2804226 - DNA, 14 bp, Homo sapiens
tgcctacattccct

SEQ ID NO: 2804227 - DNA, 20 bp, Homo sapiens
tgcctacattccctggcctg

SEQ ID NO: 2804228 - DNA, 17 bp, Homo sapiens
tgcctacttgtaatttc

SEQ ID NO: 2804229 - DNA, 17 bp, Homo sapiens
tgcctaggaattcccag

SEQ ID NO: 2804230 - DNA, 18 bp, Homo sapiens
tgcctaggaggccttctc

SEQ ID NO: 2804231 - DNA, 16 bp, Homo sapiens
tgcctatccatcctgc

SEQ ID NO: 2804232 - DNA, 24 bp, Homo sapiens
tgcctcaatgtgaatcagacccta

SEQ ID NO: 2804233 - DNA, 14 bp, Homo sapiens
tgcctcagcctccc

SEQ ID NO: 2804234 - DNA, 23 bp, Homo sapiens
tgcctcatgaccctcctgtccag

SEQ ID NO: 2804235 - DNA, 16 bp, Homo sapiens
tgcctcatttttttcc

SEQ ID NO: 2804236 - DNA, 21 bp, Homo sapiens
tgcctcatttttttccttgca

SEQ ID NO: 2804237 - DNA, 20 bp, Homo sapiens
tgcctccaccgctgcctaag

SEQ ID NO: 2804238 - DNA, 19 bp, Homo sapiens
tgcctcctcacccccagct

SEQ ID NO: 2804239 - DNA, 16 bp, Homo sapiens
tgcctcctcttcaact

SEQ ID NO: 2804240 - DNA, 21 bp, Homo sapiens
tgcctcgctccccactctgct

SEQ ID NO: 2804241 - DNA, 16 bp, Homo sapiens
tgcctctactgggaag

SEQ ID NO: 2804242 - DNA, 19 bp, Homo sapiens
tgcctctcccgcaccaggc

SEQ ID NO: 2804243 - DNA, 13 bp, Homo sapiens
tgcctctgaaact

SEQ ID NO: 2804244 - DNA, 20 bp, Homo sapiens
tgcctctgacacacagctct

SEQ ID NO: 2804245 - DNA, 15 bp, Homo sapiens
tgcctctgaggccag

SEQ ID NO: 2804246 - DNA, 12 bp, Homo sapiens
tgcctctgcctg

SEQ ID NO: 2804247 - DNA, 18 bp, Homo sapiens
tgcctctttcctgttgtt

SEQ ID NO: 2804248 - DNA, 22 bp, Homo sapiens
tgcctgaagtcacacagtgagt

SEQ ID NO: 2804249 - DNA, 23 bp, Homo sapiens
tgcctgaccctacttcttttgct

SEQ ID NO: 2804250 - DNA, 11 bp, Homo sapiens
tgcctgagggt

SEQ ID NO: 2804251 - DNA, 14 bp, Homo sapiens
tgcctgagggtgga

SEQ ID NO: 2804252 - DNA, 15 bp, Homo sapiens
tgcctgattttaaaa

SEQ ID NO: 2804253 - DNA, 20 bp, Homo sapiens
tgcctgcacccttcctcctc

SEQ ID NO: 2804254 - DNA, 15 bp, Homo sapiens
tgcctgcagagagaa

SEQ ID NO: 2804255 - DNA, 19 bp, Homo sapiens
aaatattttaaagaattgt

SEQ ID NO: 2804256 - DNA, 14 bp, Homo sapiens
aaatcaaaagctgc

SEQ ID NO: 2804257 - DNA, 21 bp, Homo sapiens
aaatcaaaagctgcttgacta

SEQ ID NO: 2804258 - DNA, 17 bp, Homo sapiens
aaatcaactccagctcc

SEQ ID NO: 2804259 - DNA, 13 bp, Homo sapiens
aaatcaatgtcac

SEQ ID NO: 2804260 - DNA, 14 bp, Homo sapiens
aaatcacaagcaat

SEQ ID NO: 2804261 - DNA, 22 bp, Homo sapiens
aaatcaccacaccaaacctctc

SEQ ID NO: 2804262 - DNA, 14 bp, Homo sapiens
aaatcataaactgt

SEQ ID NO: 2804263 - DNA, 16 bp, Homo sapiens
aaatcataaactgtgt

SEQ ID NO: 2804264 - DNA, 15 bp, Homo sapiens
aaatcatgaatattt

SEQ ID NO: 2804265 - DNA, 14 bp, Homo sapiens
aaatccaaagaaaa

SEQ ID NO: 2804266 - DNA, 20 bp, Homo sapiens
aaatccagtgtgcacccctc

SEQ ID NO: 2804267 - DNA, 17 bp, Homo sapiens
aaatccagtttcccacc

SEQ ID NO: 2804268 - DNA, 16 bp, Homo sapiens
aaatcctttactgtta

SEQ ID NO: 2804269 - DNA, 14 bp, Homo sapiens
aaatcgattggctt

SEQ ID NO: 2804270 - DNA, 15 bp, Homo sapiens
aaatcgattggcttt

SEQ ID NO: 2804271 - DNA, 21 bp, Homo sapiens
aaatctaatcaggttgttaat

SEQ ID NO: 2804272 - DNA, 23 bp, Homo sapiens
aaatctaatcaggttgttaatgt

SEQ ID NO: 2804273 - DNA, 23 bp, Homo sapiens
aaatctagatcaattaattctta

SEQ ID NO: 2804274 - DNA, 13 bp, Homo sapiens
aaatctattcaga

SEQ ID NO: 2804275 - DNA, 19 bp, Homo sapiens
aaatctattcagacaagca

SEQ ID NO: 2804276 - DNA, 22 bp, Homo sapiens
aaatctgagcctaaatctaatc

SEQ ID NO: 2804277 - DNA, 22 bp, Homo sapiens
aaatctggcaaagttatattta

SEQ ID NO: 2804278 - DNA, 18 bp, Homo sapiens
aaatctgtttgatccctg

SEQ ID NO: 2804279 - DNA, 19 bp, Homo sapiens
aaatcttatattccatata

SEQ ID NO: 2804280 - DNA, 13 bp, Homo sapiens
aaatcttccttgt

SEQ ID NO: 2804281 - DNA, 15 bp, Homo sapiens
aaatcttccttgtga

SEQ ID NO: 2804282 - DNA, 22 bp, Homo sapiens
aaatcttggttgatgccaaaaa

SEQ ID NO: 2804283 - DNA, 11 bp, Homo sapiens
aaatgaagaaa

SEQ ID NO: 2804284 - DNA, 14 bp, Homo sapiens
aaatgacagatgtt

SEQ ID NO: 2804285 - DNA, 16 bp, Homo sapiens
aaatgacccaaagacc

SEQ ID NO: 2804286 - DNA, 15 bp, Homo sapiens
aaatgagcattagct

SEQ ID NO: 2804287 - DNA, 13 bp, Homo sapiens
aaatgaggaaact

SEQ ID NO: 2804288 - DNA, 15 bp, Homo sapiens
aaatgataaagatgt

SEQ ID NO: 2804289 - DNA, 15 bp, Homo sapiens
aaatgcaaacactgt

SEQ ID NO: 2804290 - DNA, 18 bp, Homo sapiens
aaatgcagtccagaataa

SEQ ID NO: 2804291 - DNA, 20 bp, Homo sapiens
aaatgcatccattcctcagg

SEQ ID NO: 2804292 - DNA, 12 bp, Homo sapiens
aaatgcatgatt

SEQ ID NO: 2804293 - DNA, 16 bp, Homo sapiens
aaatgcatgattttat

SEQ ID NO: 2804294 - DNA, 19 bp, Homo sapiens
aaatgcatgattttataca

SEQ ID NO: 2804295 - DNA, 21 bp, Homo sapiens
aaatgcatgattttatacata

SEQ ID NO: 2804296 - DNA, 22 bp, Homo sapiens
aaatgcatgattttatacatag

SEQ ID NO: 2804297 - DNA, 20 bp, Homo sapiens
aaatgcattataggatcatt

SEQ ID NO: 2804298 - DNA, 16 bp, Homo sapiens
aaatgccttttcccaa

SEQ ID NO: 2804299 - DNA, 15 bp, Homo sapiens
aaatgctaaatgcaa

SEQ ID NO: 2804300 - DNA, 18 bp, Homo sapiens
aaatgctttatgcaaacc

SEQ ID NO: 2804301 - DNA, 19 bp, Homo sapiens
aaatgctttgtgtgattga

SEQ ID NO: 2804302 - DNA, 15 bp, Homo sapiens
aaatggagaagctct

SEQ ID NO: 2804303 - DNA, 19 bp, Homo sapiens
aaatggagaagctctgttt

SEQ ID NO: 2804304 - DNA, 23 bp, Homo sapiens
aaatggccatttgctttttcacc

SEQ ID NO: 2804305 - DNA, 17 bp, Homo sapiens
aaatggctctgtgaaat

SEQ ID NO: 2804306 - DNA, 17 bp, Homo sapiens
aaatggtcgcccaggag

SEQ ID NO: 2804307 - DNA, 16 bp, Homo sapiens
aaatggtggtttgtca

SEQ ID NO: 2804308 - DNA, 21 bp, Homo sapiens
aaatggtggtttgtcatatat

SEQ ID NO: 2804309 - DNA, 19 bp, Homo sapiens
aaatggtttttgcaagatt

SEQ ID NO: 2804310 - DNA, 18 bp, Homo sapiens
aaatgtaacttttgtaag

SEQ ID NO: 2804311 - DNA, 20 bp, Homo sapiens
aaatgtatcctgataaacat

SEQ ID NO: 2804312 - DNA, 14 bp, Homo sapiens
aaatgtatcttatt

SEQ ID NO: 2804313 - DNA, 17 bp, Homo sapiens
aaatgtatcttattcac

SEQ ID NO: 2804314 - DNA, 21 bp, Homo sapiens
aaatgtcacaatcctgtccct

SEQ ID NO: 2804315 - DNA, 16 bp, Homo sapiens
aaatgtcatcaaatat

SEQ ID NO: 2804316 - DNA, 18 bp, Homo sapiens
aaatgtctatagagaaaa

SEQ ID NO: 2804317 - DNA, 13 bp, Homo sapiens
aaatgtctgtttc

SEQ ID NO: 2804318 - DNA, 18 bp, Homo sapiens
aaatgttggaattttcaa

SEQ ID NO: 2804319 - DNA, 17 bp, Homo sapiens
aaatgtttcattttcat

SEQ ID NO: 2804320 - DNA, 12 bp, Homo sapiens
aaattaacactg

SEQ ID NO: 2804321 - DNA, 21 bp, Homo sapiens
aaattaactgggtaatgaaac

SEQ ID NO: 2804322 - DNA, 20 bp, Homo sapiens
aaattaagagatacattccc

SEQ ID NO: 2804323 - DNA, 17 bp, Homo sapiens
aaattagctgtgtgaaa

SEQ ID NO: 2804324 - DNA, 18 bp, Homo sapiens
aaattagctgtgtgaaat

SEQ ID NO: 2804325 - DNA, 19 bp, Homo sapiens
aaattagctgtgtgaaata

SEQ ID NO: 2804326 - DNA, 18 bp, Homo sapiens
aaattaggatttcatgat

SEQ ID NO: 2804327 - DNA, 19 bp, Homo sapiens
aaattaggatttcatgatt

SEQ ID NO: 2804328 - DNA, 19 bp, Homo sapiens
aaattaggttttgtacaat

SEQ ID NO: 2804329 - DNA, 13 bp, Homo sapiens
aaattagtgagat

SEQ ID NO: 2804330 - DNA, 15 bp, Homo sapiens
aaattagtgagattt

SEQ ID NO: 2804331 - DNA, 19 bp, Homo sapiens
aaattagtgagatttgtat

SEQ ID NO: 2804332 - DNA, 14 bp, Homo sapiens
aaattatggtgaaa

SEQ ID NO: 2804333 - DNA, 19 bp, Homo sapiens
aaattcaaaccatttaatt

SEQ ID NO: 2804334 - DNA, 21 bp, Homo sapiens
aaattcaaaccatttaattca

SEQ ID NO: 2804335 - DNA, 20 bp, Homo sapiens
aaattcctaataagtttgat

SEQ ID NO: 2804336 - DNA, 14 bp, Homo sapiens
aaattcctgtagca

SEQ ID NO: 2804337 - DNA, 17 bp, Homo sapiens
aaattgaagagagatat

SEQ ID NO: 2804338 - DNA, 23 bp, Homo sapiens
aaattgaagagatttcaacatat

SEQ ID NO: 2804339 - DNA, 13 bp, Homo sapiens
aaattgaatgcaa

SEQ ID NO: 2804340 - DNA, 14 bp, Homo sapiens
aaattgaatgcaaa

SEQ ID NO: 2804341 - DNA, 18 bp, Homo sapiens
aaattgacaacattttat

SEQ ID NO: 2804342 - DNA, 13 bp, Homo sapiens
aaattgacttctt

SEQ ID NO: 2804343 - DNA, 13 bp, Homo sapiens
aaattgcacaatt

SEQ ID NO: 2804344 - DNA, 16 bp, Homo sapiens
aaattgcacaatttga

SEQ ID NO: 2804345 - DNA, 22 bp, Homo sapiens
aaattgcacaatttgagcaatt

SEQ ID NO: 2804346 - DNA, 12 bp, Homo sapiens
aagagaataaag

SEQ ID NO: 2804347 - DNA, 22 bp, Homo sapiens
aagagacaggagggcaagggcc

SEQ ID NO: 2804348 - DNA, 13 bp, Homo sapiens
aagagaccagcac

SEQ ID NO: 2804349 - DNA, 21 bp, Homo sapiens
aagagagaaagaagtaggcat

SEQ ID NO: 2804350 - DNA, 17 bp, Homo sapiens
aagagagatatatctga

SEQ ID NO: 2804351 - DNA, 20 bp, Homo sapiens
aagagagatatatctgaaaa

SEQ ID NO: 2804352 - DNA, 20 bp, Homo sapiens
aagagatgggcttgttttct

SEQ ID NO: 2804353 - DNA, 15 bp, Homo sapiens
aagagatttcaacat

SEQ ID NO: 2804354 - DNA, 16 bp, Homo sapiens
aagagatttcaacata

SEQ ID NO: 2804355 - DNA, 15 bp, Homo sapiens
aagagcaagtctgga

SEQ ID NO: 2804356 - DNA, 23 bp, Homo sapiens
aagagcaggcacatggaggagct

SEQ ID NO: 2804357 - DNA, 15 bp, Homo sapiens
aagagcatcatgcct

SEQ ID NO: 2804358 - DNA, 17 bp, Homo sapiens
aagagcatcatgcctct

SEQ ID NO: 2804359 - DNA, 19 bp, Homo sapiens
aagagcatcatgcctctga

SEQ ID NO: 2804360 - DNA, 21 bp, Homo sapiens
aagagcatcatgcctctgagg

SEQ ID NO: 2804361 - DNA, 24 bp, Homo sapiens
aagagcatcatgcctctgaggcca

SEQ ID NO: 2804362 - DNA, 15 bp, Homo sapiens
aagagcctgactgtg

SEQ ID NO: 2804363 - DNA, 16 bp, Homo sapiens
aagagcctggagaagc

SEQ ID NO: 2804364 - DNA, 16 bp, Homo sapiens
aagagctagcgctgcc

SEQ ID NO: 2804365 - DNA, 19 bp, Homo sapiens
aagagctagcgctgccgca

SEQ ID NO: 2804366 - DNA, 20 bp, Homo sapiens
aagagctagcgctgccgcac

SEQ ID NO: 2804367 - DNA, 11 bp, Homo sapiens
aagagctgagg

SEQ ID NO: 2804368 - DNA, 21 bp, Homo sapiens
aagagctgatgtgagtgtgtg

SEQ ID NO: 2804369 - DNA, 21 bp, Homo sapiens
aagaggagtttcgaggtagag

SEQ ID NO: 2804370 - DNA, 14 bp, Homo sapiens
aagaggctgaggca

SEQ ID NO: 2804371 - DNA, 19 bp, Homo sapiens
aagaggggaggggcctagg

SEQ ID NO: 2804372 - DNA, 21 bp, Homo sapiens
aagaggggaggggcctaggga

SEQ ID NO: 2804373 - DNA, 17 bp, Homo sapiens
aagaggtgaccccaggg

SEQ ID NO: 2804374 - DNA, 20 bp, Homo sapiens
aagaggtgaccccagggcac

SEQ ID NO: 2804375 - DNA, 23 bp, Homo sapiens
aagagtagcaagttctagagaag

SEQ ID NO: 2804376 - DNA, 15 bp, Homo sapiens
aagagtattccattt

SEQ ID NO: 2804377 - DNA, 14 bp, Homo sapiens
aagagttcaagaaa

SEQ ID NO: 2804378 - DNA, 23 bp, Homo sapiens
aagagttcttaaggattgtgata

SEQ ID NO: 2804379 - DNA, 22 bp, Homo sapiens
aagagttctttaggtgcctcct

SEQ ID NO: 2804380 - DNA, 20 bp, Homo sapiens
aagagtttgcaaatgcaaca

SEQ ID NO: 2804381 - DNA, 22 bp, Homo sapiens
aagataacaagatctttcagga

SEQ ID NO: 2804382 - DNA, 21 bp, Homo sapiens
aagatatatacacaggatcct

SEQ ID NO: 2804383 - DNA, 22 bp, Homo sapiens
aagatatatatttactaaaaga

SEQ ID NO: 2804384 - DNA, 13 bp, Homo sapiens
aagatatttatat

SEQ ID NO: 2804385 - DNA, 15 bp, Homo sapiens
aagatatttatatat

SEQ ID NO: 2804386 - DNA, 14 bp, Homo sapiens
aagatcgttagtat

SEQ ID NO: 2804387 - DNA, 18 bp, Homo sapiens
aagatctcagataaagtg

SEQ ID NO: 2804388 - DNA, 24 bp, Homo sapiens
aagatcttgtctccactaaatgag

SEQ ID NO: 2804389 - DNA, 13 bp, Homo sapiens
aagatctttcagg

SEQ ID NO: 2804390 - DNA, 13 bp, Homo sapiens
aagatgacacaag

SEQ ID NO: 2804391 - DNA, 19 bp, Homo sapiens
aagatggctattataatgg

SEQ ID NO: 2804392 - DNA, 17 bp, Homo sapiens
aagatggctgactttgc

SEQ ID NO: 2804393 - DNA, 16 bp, Homo sapiens
aagatggctgtgcctc

SEQ ID NO: 2804394 - DNA, 20 bp, Homo sapiens
aagatggctgtgcctctgcc

SEQ ID NO: 2804395 - DNA, 23 bp, Homo sapiens
aagatggctgtgcctctgcctgt

SEQ ID NO: 2804396 - DNA, 13 bp, Homo sapiens
aagatgtaaggaa

SEQ ID NO: 2804397 - DNA, 18 bp, Homo sapiens
aagatgtcaaatatctca

SEQ ID NO: 2804398 - DNA, 21 bp, Homo sapiens
aagatgtcaaatatctcagag

SEQ ID NO: 2804399 - DNA, 16 bp, Homo sapiens
aagatgtcagactggc

SEQ ID NO: 2804400 - DNA, 20 bp, Homo sapiens
aagatgtcctccttgttcta

SEQ ID NO: 2804401 - DNA, 13 bp, Homo sapiens
aagattagaatga

SEQ ID NO: 2804402 - DNA, 18 bp, Homo sapiens
aagattcccagagacagg

SEQ ID NO: 2804403 - DNA, 19 bp, Homo sapiens
aagattcccagagacagga

SEQ ID NO: 2804404 - DNA, 20 bp, Homo sapiens
aagattcccagagacaggaa

SEQ ID NO: 2804405 - DNA, 14 bp, Homo sapiens
aagatttaacacta

SEQ ID NO: 2804406 - DNA, 17 bp, Homo sapiens
aagatttaagtaatttt

SEQ ID NO: 2804407 - DNA, 17 bp, Homo sapiens
aagattttttaataatt

SEQ ID NO: 2804408 - DNA, 15 bp, Homo sapiens
aagcaaaaaagaaaa

SEQ ID NO: 2804409 - DNA, 11 bp, Homo sapiens
aagcaaaggtg

SEQ ID NO: 2804410 - DNA, 17 bp, Homo sapiens
aagcaaaggtgaagaga

SEQ ID NO: 2804411 - DNA, 13 bp, Homo sapiens
aagcaaataaata

SEQ ID NO: 2804412 - DNA, 14 bp, Homo sapiens
aagcaaataaatat

SEQ ID NO: 2804413 - DNA, 18 bp, Homo sapiens
aagcaaatcgaatgaaat

SEQ ID NO: 2804414 - DNA, 19 bp, Homo sapiens
aagcaacataaaacaatga

SEQ ID NO: 2804415 - DNA, 19 bp, Homo sapiens
aagcaacctcagtaattta

SEQ ID NO: 2804416 - DNA, 22 bp, Homo sapiens
aagcaacctcagtaatttagaa

SEQ ID NO: 2804417 - DNA, 19 bp, Homo sapiens
aagcaagcattcagaagaa

SEQ ID NO: 2804418 - DNA, 12 bp, Homo sapiens
aagcaataatta

SEQ ID NO: 2804419 - DNA, 16 bp, Homo sapiens
aagcacaaagctcaag

SEQ ID NO: 2804420 - DNA, 13 bp, Homo sapiens
aagcaccaaattc

SEQ ID NO: 2804421 - DNA, 12 bp, Homo sapiens
aagcacccttga

SEQ ID NO: 2804422 - DNA, 18 bp, Homo sapiens
aagcaccgcagcatgtgg

SEQ ID NO: 2804423 - DNA, 14 bp, Homo sapiens
aagcacctcctgcc

SEQ ID NO: 2804424 - DNA, 15 bp, Homo sapiens
aagcacctcctgcct

SEQ ID NO: 2804425 - DNA, 15 bp, Homo sapiens
aagcacgaaatgtta

SEQ ID NO: 2804426 - DNA, 23 bp, Homo sapiens
aagcactgctaggcgagtgccag

SEQ ID NO: 2804427 - DNA, 20 bp, Homo sapiens
aagcactgctgtgtccgctt

SEQ ID NO: 2804428 - DNA, 16 bp, Homo sapiens
aagcagagaggtggag

SEQ ID NO: 2804429 - DNA, 19 bp, Homo sapiens
aagcagcctttctgtggag

SEQ ID NO: 2804430 - DNA, 15 bp, Homo sapiens
aagcagtgccttcca

SEQ ID NO: 2804431 - DNA, 17 bp, Homo sapiens
aagcagtgccttccata

SEQ ID NO: 2804432 - DNA, 18 bp, Homo sapiens
aagcagtgccttccataa

SEQ ID NO: 2804433 - DNA, 16 bp, Homo sapiens
aagcatcacctcaggc

SEQ ID NO: 2804434 - DNA, 22 bp, Homo sapiens
aagcatcattatttgcagagac

SEQ ID NO: 2804435 - DNA, 13 bp, Homo sapiens
aagcatctgtgta

SEQ ID NO: 2804436 - DNA, 13 bp, Homo sapiens
aataaatgtcatt

SEQ ID NO: 2804437 - DNA, 13 bp, Homo sapiens
aataaatgtgtaa

SEQ ID NO: 2804438 - DNA, 16 bp, Homo sapiens
aataaattgctccttg

SEQ ID NO: 2804439 - DNA, 21 bp, Homo sapiens
aataaattggtgataagtgga

SEQ ID NO: 2804440 - DNA, 20 bp, Homo sapiens
aataaatttattttcttgga

SEQ ID NO: 2804441 - DNA, 18 bp, Homo sapiens
aataaatttggttctaat

SEQ ID NO: 2804442 - DNA, 13 bp, Homo sapiens
aataacaatgtgc

SEQ ID NO: 2804443 - DNA, 22 bp, Homo sapiens
aataaccacttaaaaaatgtcc

SEQ ID NO: 2804444 - DNA, 15 bp, Homo sapiens
aataacttcagagaa

SEQ ID NO: 2804445 - DNA, 18 bp, Homo sapiens
aataacttcagagaagtc

SEQ ID NO: 2804446 - DNA, 19 bp, Homo sapiens
aataaggtacaagaagcat

SEQ ID NO: 2804447 - DNA, 16 bp, Homo sapiens
aataaggtcaatgcca

SEQ ID NO: 2804448 - DNA, 14 bp, Homo sapiens
aataagtattcttc

SEQ ID NO: 2804449 - DNA, 13 bp, Homo sapiens
aataagtgctgtt

SEQ ID NO: 2804450 - DNA, 16 bp, Homo sapiens
aataagtgctgtttga

SEQ ID NO: 2804451 - DNA, 18 bp, Homo sapiens
aataagtgctgtttgaga

SEQ ID NO: 2804452 - DNA, 22 bp, Homo sapiens
aataagtgctgtttgagatgtg

SEQ ID NO: 2804453 - DNA, 20 bp, Homo sapiens
aataagtttttgtttcacag

SEQ ID NO: 2804454 - DNA, 11 bp, Homo sapiens
aataataatta

SEQ ID NO: 2804455 - DNA, 14 bp, Homo sapiens
aataatgatttaag

SEQ ID NO: 2804456 - DNA, 16 bp, Homo sapiens
aataattaggatctat

SEQ ID NO: 2804457 - DNA, 23 bp, Homo sapiens
aataattaggatctatgcaattt

SEQ ID NO: 2804458 - DNA, 20 bp, Homo sapiens
aataattgatttcaagacct

SEQ ID NO: 2804459 - DNA, 13 bp, Homo sapiens
aataattgtgtac

SEQ ID NO: 2804460 - DNA, 20 bp, Homo sapiens
aataattgtgtacaaagtag

SEQ ID NO: 2804461 - DNA, 10 bp, Homo sapiens
aataatttaa

SEQ ID NO: 2804462 - DNA, 16 bp, Homo sapiens
aataatttaactaatt

SEQ ID NO: 2804463 - DNA, 22 bp, Homo sapiens
aataatttaactaatttaaacc

SEQ ID NO: 2804464 - DNA, 23 bp, Homo sapiens
aatacaaaaatgagctaggcatg

SEQ ID NO: 2804465 - DNA, 20 bp, Homo sapiens
aatacaaaaattagccgggc

SEQ ID NO: 2804466 - DNA, 17 bp, Homo sapiens
aatacaaaataaaatta

SEQ ID NO: 2804467 - DNA, 17 bp, Homo sapiens
aatacaaacatatttgt

SEQ ID NO: 2804468 - DNA, 21 bp, Homo sapiens
aatacaccacctcactcctgt

SEQ ID NO: 2804469 - DNA, 21 bp, Homo sapiens
aatacaccaggtagaacacaa

SEQ ID NO: 2804470 - DNA, 15 bp, Homo sapiens
aatacagacactaag

SEQ ID NO: 2804471 - DNA, 23 bp, Homo sapiens
aatacagggcatgcattttgcag

SEQ ID NO: 2804472 - DNA, 20 bp, Homo sapiens
aatacagtaaagtttaaaaa

SEQ ID NO: 2804473 - DNA, 21 bp, Homo sapiens
aatacagtaagctgctctatt

SEQ ID NO: 2804474 - DNA, 23 bp, Homo sapiens
aatacatgctaagagaagtagaa

SEQ ID NO: 2804475 - DNA, 12 bp, Homo sapiens
aatacattttat

SEQ ID NO: 2804476 - DNA, 13 bp, Homo sapiens
aatacctctgtgt

SEQ ID NO: 2804477 - DNA, 16 bp, Homo sapiens
aatactccaagcttca

SEQ ID NO: 2804478 - DNA, 23 bp, Homo sapiens
aatactccaagcttcaagtgata

SEQ ID NO: 2804479 - DNA, 23 bp, Homo sapiens
aatactcttaggaagagaaacca

SEQ ID NO: 2804480 - DNA, 14 bp, Homo sapiens
aatacttctcattt

SEQ ID NO: 2804481 - DNA, 16 bp, Homo sapiens
aatacttctcattttt

SEQ ID NO: 2804482 - DNA, 16 bp, Homo sapiens
aatactttttcttaaa

SEQ ID NO: 2804483 - DNA, 15 bp, Homo sapiens
aatagacagtatatt

SEQ ID NO: 2804484 - DNA, 15 bp, Homo sapiens
aatagattatagttg

SEQ ID NO: 2804485 - DNA, 13 bp, Homo sapiens
aatagcaaaagaa

SEQ ID NO: 2804486 - DNA, 19 bp, Homo sapiens
aatagcaaaagaagaagtt

SEQ ID NO: 2804487 - DNA, 20 bp, Homo sapiens
aatagcaaaagaagaagttt

SEQ ID NO: 2804488 - DNA, 15 bp, Homo sapiens
aatagcatctgctct

SEQ ID NO: 2804489 - DNA, 22 bp, Homo sapiens
aatagccacttaccttcaataa

SEQ ID NO: 2804490 - DNA, 21 bp, Homo sapiens
aatagctaaatacctcaatca

SEQ ID NO: 2804491 - DNA, 13 bp, Homo sapiens
aatagctattgca

SEQ ID NO: 2804492 - DNA, 23 bp, Homo sapiens
aatagctattgcatgtaaaatgc

SEQ ID NO: 2804493 - DNA, 19 bp, Homo sapiens
aatagctctttcagggggg

SEQ ID NO: 2804494 - DNA, 13 bp, Homo sapiens
aatagtatttatg

SEQ ID NO: 2804495 - DNA, 15 bp, Homo sapiens
aatagtatttcccat

SEQ ID NO: 2804496 - DNA, 16 bp, Homo sapiens
aatagtcaagaaaaat

SEQ ID NO: 2804497 - DNA, 17 bp, Homo sapiens
aatagtcaagaaaaatt

SEQ ID NO: 2804498 - DNA, 21 bp, Homo sapiens
aatagttcaggtaacaggcag

SEQ ID NO: 2804499 - DNA, 17 bp, Homo sapiens
aatagttttaaatatga

SEQ ID NO: 2804500 - DNA, 19 bp, Homo sapiens
aatagttttaaatatgaac

SEQ ID NO: 2804501 - DNA, 13 bp, Homo sapiens
aatataaacacta

SEQ ID NO: 2804502 - DNA, 21 bp, Homo sapiens
aatataaagatggctgacttt

SEQ ID NO: 2804503 - DNA, 12 bp, Homo sapiens
aatataaatgca

SEQ ID NO: 2804504 - DNA, 16 bp, Homo sapiens
aatataaatgcatgat

SEQ ID NO: 2804505 - DNA, 15 bp, Homo sapiens
aatataattgggatt

SEQ ID NO: 2804506 - DNA, 21 bp, Homo sapiens
aatatagatcagttataagta

SEQ ID NO: 2804507 - DNA, 14 bp, Homo sapiens
aatatataatggtt

SEQ ID NO: 2804508 - DNA, 13 bp, Homo sapiens
aatatatataaat

SEQ ID NO: 2804509 - DNA, 20 bp, Homo sapiens
aatatatataaatatatatt

SEQ ID NO: 2804510 - DNA, 20 bp, Homo sapiens
aatatatatctatctatttg

SEQ ID NO: 2804511 - DNA, 16 bp, Homo sapiens
aatatatatttttcaa

SEQ ID NO: 2804512 - DNA, 15 bp, Homo sapiens
aatatatttaagata

SEQ ID NO: 2804513 - DNA, 19 bp, Homo sapiens
aatatatttaagataatta

SEQ ID NO: 2804514 - DNA, 14 bp, Homo sapiens
aatatcctaaacat

SEQ ID NO: 2804515 - DNA, 16 bp, Homo sapiens
aatatcctaaacatca

SEQ ID NO: 2804516 - DNA, 18 bp, Homo sapiens
aatatcctaaacatcatt

SEQ ID NO: 2804517 - DNA, 18 bp, Homo sapiens
aatatctaataaaaagtc

SEQ ID NO: 2804518 - DNA, 18 bp, Homo sapiens
aatatctgagaagtgtat

SEQ ID NO: 2804519 - DNA, 20 bp, Homo sapiens
aatatctgagaagtgtatat

SEQ ID NO: 2804520 - DNA, 21 bp, Homo sapiens
aatatctgagaagtgtatata

SEQ ID NO: 2804521 - DNA, 23 bp, Homo sapiens
aatatctgagaagtgtatatagt

SEQ ID NO: 2804522 - DNA, 14 bp, Homo sapiens
aatatctgctttaa

SEQ ID NO: 2804523 - DNA, 21 bp, Homo sapiens
aatatctgtgaggtgctgatg

SEQ ID NO: 2804524 - DNA, 13 bp, Homo sapiens
aatatcttgaaga

SEQ ID NO: 2804525 - DNA, 13 bp, Homo sapiens
aatatgaacaaag

SEQ ID NO: 2804526 - DNA, 14 bp, Homo sapiens
aatatgaacaaaga

SEQ ID NO: 2804527 - DNA, 22 bp, Homo sapiens
aattggcttattttttaaaata

SEQ ID NO: 2804528 - DNA, 16 bp, Homo sapiens
aattgggaagctgggg

SEQ ID NO: 2804529 - DNA, 21 bp, Homo sapiens
aattgggagcttgggaatgga

SEQ ID NO: 2804530 - DNA, 23 bp, Homo sapiens
aattgggattttaaaaacatgag

SEQ ID NO: 2804531 - DNA, 21 bp, Homo sapiens
aattggtgacaatgtcacata

SEQ ID NO: 2804532 - DNA, 17 bp, Homo sapiens
aattggtgataagtgga

SEQ ID NO: 2804533 - DNA, 19 bp, Homo sapiens
aattggtgataagtggaaa

SEQ ID NO: 2804534 - DNA, 18 bp, Homo sapiens
aattgtatcatttgaaca

SEQ ID NO: 2804535 - DNA, 22 bp, Homo sapiens
aattgtatgttaagttacttca

SEQ ID NO: 2804536 - DNA, 20 bp, Homo sapiens
aattgtcttttgtcatgtgg

SEQ ID NO: 2804537 - DNA, 15 bp, Homo sapiens
aattgtgtacaaagt

SEQ ID NO: 2804538 - DNA, 17 bp, Homo sapiens
aattgtgtgtcttctat

SEQ ID NO: 2804539 - DNA, 19 bp, Homo sapiens
aattgttcctgatgtgcca

SEQ ID NO: 2804540 - DNA, 19 bp, Homo sapiens
aattgttttatctgaattt

SEQ ID NO: 2804541 - DNA, 22 bp, Homo sapiens
aatttaaaatcattcaatatct

SEQ ID NO: 2804542 - DNA, 17 bp, Homo sapiens
aatttaaaccagcagaa

SEQ ID NO: 2804543 - DNA, 18 bp, Homo sapiens
aatttaaaccagcagaaa

SEQ ID NO: 2804544 - DNA, 19 bp, Homo sapiens
aatttaaaccagcagaaaa

SEQ ID NO: 2804545 - DNA, 21 bp, Homo sapiens
aatttaaaccagcagaaaagt

SEQ ID NO: 2804546 - DNA, 15 bp, Homo sapiens
aatttaactaattta

SEQ ID NO: 2804547 - DNA, 20 bp, Homo sapiens
aatttaaggagggacaagaa

SEQ ID NO: 2804548 - DNA, 11 bp, Homo sapiens
aatttaattaa

SEQ ID NO: 2804549 - DNA, 21 bp, Homo sapiens
aatttaattaggggttgctaa

SEQ ID NO: 2804550 - DNA, 16 bp, Homo sapiens
aatttagaaaacttta

SEQ ID NO: 2804551 - DNA, 15 bp, Homo sapiens
aatttagaaatcatt

SEQ ID NO: 2804552 - DNA, 17 bp, Homo sapiens
aatttagaaatcatttt

SEQ ID NO: 2804553 - DNA, 20 bp, Homo sapiens
aatttagaaatcattttgca

SEQ ID NO: 2804554 - DNA, 17 bp, Homo sapiens
aatttagacttcaagca

SEQ ID NO: 2804555 - DNA, 18 bp, Homo sapiens
aatttagcagtccaaaga

SEQ ID NO: 2804556 - DNA, 18 bp, Homo sapiens
aatttatacaaaataatt

SEQ ID NO: 2804557 - DNA, 20 bp, Homo sapiens
aatttatacaaaataattta

SEQ ID NO: 2804558 - DNA, 16 bp, Homo sapiens
aatttatattgtaaat

SEQ ID NO: 2804559 - DNA, 18 bp, Homo sapiens
aatttatcctgaaatttc

SEQ ID NO: 2804560 - DNA, 19 bp, Homo sapiens
aatttatcctgaaatttca

SEQ ID NO: 2804561 - DNA, 19 bp, Homo sapiens
aatttatcttgtctctggg

SEQ ID NO: 2804562 - DNA, 12 bp, Homo sapiens
aatttattttgt

SEQ ID NO: 2804563 - DNA, 17 bp, Homo sapiens
aatttccagtacctttg

SEQ ID NO: 2804564 - DNA, 24 bp, Homo sapiens
aatttccagtgagcttatcatgct

SEQ ID NO: 2804565 - DNA, 21 bp, Homo sapiens
aatttcgccgttgaagaggaa

SEQ ID NO: 2804566 - DNA, 20 bp, Homo sapiens
aatttcttactaaacatttt

SEQ ID NO: 2804567 - DNA, 15 bp, Homo sapiens
aatttgagcaattca

SEQ ID NO: 2804568 - DNA, 16 bp, Homo sapiens
aatttgagcaattcat

SEQ ID NO: 2804569 - DNA, 18 bp, Homo sapiens
aatttgagcaattcattt

SEQ ID NO: 2804570 - DNA, 21 bp, Homo sapiens
aatttgagcaattcatttcac

SEQ ID NO: 2804571 - DNA, 14 bp, Homo sapiens
aatttgaggacaac

SEQ ID NO: 2804572 - DNA, 21 bp, Homo sapiens
aatttgatacatatgtgaata

SEQ ID NO: 2804573 - DNA, 16 bp, Homo sapiens
aatttgcctgtaacaa

SEQ ID NO: 2804574 - DNA, 19 bp, Homo sapiens
aatttggtgtggctgtatt

SEQ ID NO: 2804575 - DNA, 16 bp, Homo sapiens
aatttggttctaatag

SEQ ID NO: 2804576 - DNA, 22 bp, Homo sapiens
aatttggttctaatagaactca

SEQ ID NO: 2804577 - DNA, 13 bp, Homo sapiens
aatttgtatatca

SEQ ID NO: 2804578 - DNA, 12 bp, Homo sapiens
aattttaaatta

SEQ ID NO: 2804579 - DNA, 19 bp, Homo sapiens
aattttaagtgctttgtaa

SEQ ID NO: 2804580 - DNA, 19 bp, Homo sapiens
aattttacaattatggaaa

SEQ ID NO: 2804581 - DNA, 19 bp, Homo sapiens
aattttactgacagaaatg

SEQ ID NO: 2804582 - DNA, 22 bp, Homo sapiens
aattttctggaatacatgaaat

SEQ ID NO: 2804583 - DNA, 20 bp, Homo sapiens
aattttcttacccatatatc

SEQ ID NO: 2804584 - DNA, 21 bp, Homo sapiens
aattttgaataaataaatgta

SEQ ID NO: 2804585 - DNA, 17 bp, Homo sapiens
aattttggccaaagtgt

SEQ ID NO: 2804586 - DNA, 13 bp, Homo sapiens
aattttgttgctg

SEQ ID NO: 2804587 - DNA, 14 bp, Homo sapiens
aattttgtttgtaa

SEQ ID NO: 2804588 - DNA, 19 bp, Homo sapiens
aatttttaaacaagtattt

SEQ ID NO: 2804589 - DNA, 13 bp, Homo sapiens
aatttttaaacta

SEQ ID NO: 2804590 - DNA, 19 bp, Homo sapiens
aatttttaatgacttttta

SEQ ID NO: 2804591 - DNA, 23 bp, Homo sapiens
aatttttatacatatcagaaaag

SEQ ID NO: 2804592 - DNA, 17 bp, Homo sapiens
aatttttatttttgaac

SEQ ID NO: 2804593 - DNA, 19 bp, Homo sapiens
aattttttgagtaattcta

SEQ ID NO: 2804594 - DNA, 17 bp, Homo sapiens
aatttttttgagacaga

SEQ ID NO: 2804595 - DNA, 15 bp, Homo sapiens
acaaaaaacttttaa

SEQ ID NO: 2804596 - DNA, 15 bp, Homo sapiens
acaaaaacagcctca

SEQ ID NO: 2804597 - DNA, 12 bp, Homo sapiens
acaaaaccagct

SEQ ID NO: 2804598 - DNA, 17 bp, Homo sapiens
acaaaaggcagcccttt

SEQ ID NO: 2804599 - DNA, 12 bp, Homo sapiens
acaaaataaaca

SEQ ID NO: 2804600 - DNA, 14 bp, Homo sapiens
acaaaataaacaaa

SEQ ID NO: 2804601 - DNA, 12 bp, Homo sapiens
acaaaataacat

SEQ ID NO: 2804602 - DNA, 15 bp, Homo sapiens
acaaaataacatttg

SEQ ID NO: 2804603 - DNA, 10 bp, Homo sapiens
acaaaataat

SEQ ID NO: 2804604 - DNA, 15 bp, Homo sapiens
acaaaataatttaac

SEQ ID NO: 2804605 - DNA, 14 bp, Homo sapiens
acaaaccatgcaaa

SEQ ID NO: 2804606 - DNA, 23 bp, Homo sapiens
acaaacccaggagtttgtgtgtc

SEQ ID NO: 2804607 - DNA, 20 bp, Homo sapiens
acaaactcgttttttacaaa

SEQ ID NO: 2804608 - DNA, 21 bp, Homo sapiens
acaaactcgttttttacaaag

SEQ ID NO: 2804609 - DNA, 17 bp, Homo sapiens
acaaagaaaaaaatata

SEQ ID NO: 2804610 - DNA, 16 bp, Homo sapiens
acaaagaaggcacagg

SEQ ID NO: 2804611 - DNA, 16 bp, Homo sapiens
acaaagagaataaaga

SEQ ID NO: 2804612 - DNA, 18 bp, Homo sapiens
acaaagagttcaagaaat

SEQ ID NO: 2804613 - DNA, 21 bp, Homo sapiens
acaaagatgtttgtcagatat

SEQ ID NO: 2804614 - DNA, 23 bp, Homo sapiens
acaaagatgtttgtcagatatga

SEQ ID NO: 2804615 - DNA, 16 bp, Homo sapiens
acaaagcccttttata

SEQ ID NO: 2804616 - DNA, 21 bp, Homo sapiens
acaaagcttctatcccaggag

SEQ ID NO: 2804617 - DNA, 21 bp, Homo sapiens
acaggctgggcttcagtggca

SEQ ID NO: 2804618 - DNA, 23 bp, Homo sapiens
acaggctgggcttcagtggcagc

SEQ ID NO: 2804619 - DNA, 23 bp, Homo sapiens
acagggaaccctgcttgcacttt

SEQ ID NO: 2804620 - DNA, 15 bp, Homo sapiens
acagggaaggcaggc

SEQ ID NO: 2804621 - DNA, 20 bp, Homo sapiens
acagggagactgcatctcaa

SEQ ID NO: 2804622 - DNA, 20 bp, Homo sapiens
acagggcacaccgggcactc

SEQ ID NO: 2804623 - DNA, 16 bp, Homo sapiens
acagggcagagccggg

SEQ ID NO: 2804624 - DNA, 22 bp, Homo sapiens
acagggtcgggggggtccccat

SEQ ID NO: 2804625 - DNA, 17 bp, Homo sapiens
acaggtctagactttct

SEQ ID NO: 2804626 - DNA, 19 bp, Homo sapiens
acaggtctcctcttaaaaa

SEQ ID NO: 2804627 - DNA, 20 bp, Homo sapiens
acaggtgtgaaccaccacac

SEQ ID NO: 2804628 - DNA, 23 bp, Homo sapiens
acaggtgtgaaccaccacaccca

SEQ ID NO: 2804629 - DNA, 20 bp, Homo sapiens
acagtaaaaacttgtactat

SEQ ID NO: 2804630 - DNA, 23 bp, Homo sapiens
acagtaaaaacttgtactatgtt

SEQ ID NO: 2804631 - DNA, 12 bp, Homo sapiens
acagtaaacatt

SEQ ID NO: 2804632 - DNA, 12 bp, Homo sapiens
acagtagcttaa

SEQ ID NO: 2804633 - DNA, 15 bp, Homo sapiens
acagtagcttaaata

SEQ ID NO: 2804634 - DNA, 17 bp, Homo sapiens
acagtattacttctgct

SEQ ID NO: 2804635 - DNA, 19 bp, Homo sapiens
acagtattacttctgctac

SEQ ID NO: 2804636 - DNA, 17 bp, Homo sapiens
acagtattctcagtgct

SEQ ID NO: 2804637 - DNA, 16 bp, Homo sapiens
acagtcaaaacagaga

SEQ ID NO: 2804638 - DNA, 18 bp, Homo sapiens
acagtcaaaacagagatg

SEQ ID NO: 2804639 - DNA, 17 bp, Homo sapiens
acagtccgtcaaaacag

SEQ ID NO: 2804640 - DNA, 21 bp, Homo sapiens
acagtccgtcaaaacagattg

SEQ ID NO: 2804641 - DNA, 22 bp, Homo sapiens
acagtcctgggagaacctcagg

SEQ ID NO: 2804642 - DNA, 14 bp, Homo sapiens
acagtctaaagctg

SEQ ID NO: 2804643 - DNA, 14 bp, Homo sapiens
acagtctctttaat

SEQ ID NO: 2804644 - DNA, 19 bp, Homo sapiens
acagtctctttaatcttca

SEQ ID NO: 2804645 - DNA, 22 bp, Homo sapiens
acagtgactgtcgtgtttacaa

SEQ ID NO: 2804646 - DNA, 13 bp, Homo sapiens
acagtgagccaag

SEQ ID NO: 2804647 - DNA, 23 bp, Homo sapiens
acagtgagtcgaggacagggagg

SEQ ID NO: 2804648 - DNA, 15 bp, Homo sapiens
acagtgatctccata

SEQ ID NO: 2804649 - DNA, 18 bp, Homo sapiens
acagtgatctccatatgt

SEQ ID NO: 2804650 - DNA, 11 bp, Homo sapiens
acagtgcctgc

SEQ ID NO: 2804651 - DNA, 15 bp, Homo sapiens
acagtgcttcagcct

SEQ ID NO: 2804652 - DNA, 21 bp, Homo sapiens
acagtgcttcagcctgaggct

SEQ ID NO: 2804653 - DNA, 22 bp, Homo sapiens
acagtgcttcagcctgaggctg

SEQ ID NO: 2804654 - DNA, 17 bp, Homo sapiens
acagtggagaaatattt

SEQ ID NO: 2804655 - DNA, 15 bp, Homo sapiens
acagtgggtggtgga

SEQ ID NO: 2804656 - DNA, 20 bp, Homo sapiens
acagtgttattttctttgaa

SEQ ID NO: 2804657 - DNA, 22 bp, Homo sapiens
acagtgttattttctttgaaat

SEQ ID NO: 2804658 - DNA, 19 bp, Homo sapiens
acagtgttgaaaatgttca

SEQ ID NO: 2804659 - DNA, 22 bp, Homo sapiens
acagtgtttcccataattttct

SEQ ID NO: 2804660 - DNA, 13 bp, Homo sapiens
acagttaactttc

SEQ ID NO: 2804661 - DNA, 14 bp, Homo sapiens
acagttaactttca

SEQ ID NO: 2804662 - DNA, 16 bp, Homo sapiens
acagttaactttcaga

SEQ ID NO: 2804663 - DNA, 22 bp, Homo sapiens
acagttagggttgagttacttc

SEQ ID NO: 2804664 - DNA, 16 bp, Homo sapiens
acagttcctcgccctg

SEQ ID NO: 2804665 - DNA, 19 bp, Homo sapiens
acagttcctcgccctgggt

SEQ ID NO: 2804666 - DNA, 22 bp, Homo sapiens
acagttgctgtcataagaatga

SEQ ID NO: 2804667 - DNA, 15 bp, Homo sapiens
acagtttatttgttg

SEQ ID NO: 2804668 - DNA, 16 bp, Homo sapiens
acagttttaagagttg

SEQ ID NO: 2804669 - DNA, 20 bp, Homo sapiens
acataaaatatacaaacatg

SEQ ID NO: 2804670 - DNA, 12 bp, Homo sapiens
acataaaggtat

SEQ ID NO: 2804671 - DNA, 21 bp, Homo sapiens
acataaaggtggtatgtgtgt

SEQ ID NO: 2804672 - DNA, 15 bp, Homo sapiens
acataaagttgataa

SEQ ID NO: 2804673 - DNA, 18 bp, Homo sapiens
acataacttgatatagaa

SEQ ID NO: 2804674 - DNA, 22 bp, Homo sapiens
acataacttgatatagaaagct

SEQ ID NO: 2804675 - DNA, 14 bp, Homo sapiens
acataagaccataa

SEQ ID NO: 2804676 - DNA, 20 bp, Homo sapiens
acatacctctctctatatat

SEQ ID NO: 2804677 - DNA, 22 bp, Homo sapiens
acatacctctctctatatatac

SEQ ID NO: 2804678 - DNA, 14 bp, Homo sapiens
acatactagaaagc

SEQ ID NO: 2804679 - DNA, 17 bp, Homo sapiens
acatactcatttttcat

SEQ ID NO: 2804680 - DNA, 15 bp, Homo sapiens
acatagttatttatt

SEQ ID NO: 2804681 - DNA, 12 bp, Homo sapiens
acatataaaagt

SEQ ID NO: 2804682 - DNA, 23 bp, Homo sapiens
acatatatgtatatgtatatcta

SEQ ID NO: 2804683 - DNA, 15 bp, Homo sapiens
acatatcaattcaac

SEQ ID NO: 2804684 - DNA, 17 bp, Homo sapiens
acatatcaattcaacac

SEQ ID NO: 2804685 - DNA, 19 bp, Homo sapiens
acatatcaattcaacacat

SEQ ID NO: 2804686 - DNA, 12 bp, Homo sapiens
acatatcagaaa

SEQ ID NO: 2804687 - DNA, 14 bp, Homo sapiens
acatatcagaaaag

SEQ ID NO: 2804688 - DNA, 15 bp, Homo sapiens
acatatcagaaaagt

SEQ ID NO: 2804689 - DNA, 20 bp, Homo sapiens
acatatcagaaaagtagaat

SEQ ID NO: 2804690 - DNA, 18 bp, Homo sapiens
acatatgcaccttgtgtc

SEQ ID NO: 2804691 - DNA, 19 bp, Homo sapiens
acatatggaaatcctgtta

SEQ ID NO: 2804692 - DNA, 13 bp, Homo sapiens
acatattataaat

SEQ ID NO: 2804693 - DNA, 17 bp, Homo sapiens
acatattataaataaat

SEQ ID NO: 2804694 - DNA, 22 bp, Homo sapiens
acatattataaataaatgccaa

SEQ ID NO: 2804695 - DNA, 16 bp, Homo sapiens
acatattcttggagaa

SEQ ID NO: 2804696 - DNA, 20 bp, Homo sapiens
acatatttgttaaatattta

SEQ ID NO: 2804697 - DNA, 13 bp, Homo sapiens
acatcatgtaaac

SEQ ID NO: 2804698 - DNA, 15 bp, Homo sapiens
acatcattcttgaga

SEQ ID NO: 2804699 - DNA, 18 bp, Homo sapiens
acatcccatcatggctgc

SEQ ID NO: 2804700 - DNA, 16 bp, Homo sapiens
acatccctgggcctgc

SEQ ID NO: 2804701 - DNA, 17 bp, Homo sapiens
acatccctgggcctgct

SEQ ID NO: 2804702 - DNA, 18 bp, Homo sapiens
acatccctgggcctgctg

SEQ ID NO: 2804703 - DNA, 21 bp, Homo sapiens
acatcctttctattgaaaaat

SEQ ID NO: 2804704 - DNA, 17 bp, Homo sapiens
acatcttgctctgctga

SEQ ID NO: 2804705 - DNA, 22 bp, Homo sapiens
acatcttgctctgctgacagac

SEQ ID NO: 2804706 - DNA, 23 bp, Homo sapiens
acatgaaaagataggtttgagtt

SEQ ID NO: 2804707 - DNA, 14 bp, Homo sapiens
acctctgctctgag

SEQ ID NO: 2804708 - DNA, 11 bp, Homo sapiens
acctctgtgtg

SEQ ID NO: 2804709 - DNA, 16 bp, Homo sapiens
acctcttctcttcctg

SEQ ID NO: 2804710 - DNA, 22 bp, Homo sapiens
acctcttgggcatgctcagccc

SEQ ID NO: 2804711 - DNA, 23 bp, Homo sapiens
acctcttgggcatgctcagccct

SEQ ID NO: 2804712 - DNA, 14 bp, Homo sapiens
acctgacacatctt

SEQ ID NO: 2804713 - DNA, 15 bp, Homo sapiens
acctgacacatcttg

SEQ ID NO: 2804714 - DNA, 22 bp, Homo sapiens
acctgacagatgtcagccgagc

SEQ ID NO: 2804715 - DNA, 19 bp, Homo sapiens
acctgaccaacatggagaa

SEQ ID NO: 2804716 - DNA, 10 bp, Homo sapiens
acctgagcct

SEQ ID NO: 2804717 - DNA, 14 bp, Homo sapiens
acctgagcctgccg

SEQ ID NO: 2804718 - DNA, 16 bp, Homo sapiens
acctgagcctgccgag

SEQ ID NO: 2804719 - DNA, 22 bp, Homo sapiens
acctgagtcaccctacctgtgc

SEQ ID NO: 2804720 - DNA, 13 bp, Homo sapiens
acctgcaaaaaat

SEQ ID NO: 2804721 - DNA, 22 bp, Homo sapiens
acctgcacctccccccactgca

SEQ ID NO: 2804722 - DNA, 15 bp, Homo sapiens
acctgcaggccaaga

SEQ ID NO: 2804723 - DNA, 21 bp, Homo sapiens
acctgcatccgtagttccctg

SEQ ID NO: 2804724 - DNA, 15 bp, Homo sapiens
acctgccatttgcac

SEQ ID NO: 2804725 - DNA, 18 bp, Homo sapiens
acctgccatttgcaccct

SEQ ID NO: 2804726 - DNA, 20 bp, Homo sapiens
acctgccctgccctgccacc

SEQ ID NO: 2804727 - DNA, 23 bp, Homo sapiens
acctgccctgccctgccacctgt

SEQ ID NO: 2804728 - DNA, 20 bp, Homo sapiens
acctgccgacctcgtcctcc

SEQ ID NO: 2804729 - DNA, 17 bp, Homo sapiens
acctgcctatccatcct

SEQ ID NO: 2804730 - DNA, 21 bp, Homo sapiens
acctgcctatccatcctgcga

SEQ ID NO: 2804731 - DNA, 12 bp, Homo sapiens
acctgctctcct

SEQ ID NO: 2804732 - DNA, 17 bp, Homo sapiens
acctgctctcctcttgc

SEQ ID NO: 2804733 - DNA, 16 bp, Homo sapiens
acctgctgagagaccc

SEQ ID NO: 2804734 - DNA, 18 bp, Homo sapiens
acctgctgagctctgaga

SEQ ID NO: 2804735 - DNA, 19 bp, Homo sapiens
acctgctgagctctgagag

SEQ ID NO: 2804736 - DNA, 20 bp, Homo sapiens
acctgctgagctctgagagg

SEQ ID NO: 2804737 - DNA, 15 bp, Homo sapiens
acctgcttctgaact

SEQ ID NO: 2804738 - DNA, 23 bp, Homo sapiens
acctgcttctgaactcaagctgc

SEQ ID NO: 2804739 - DNA, 16 bp, Homo sapiens
acctgctttctcctgg

SEQ ID NO: 2804740 - DNA, 20 bp, Homo sapiens
acctgggaaccatgaagctg

SEQ ID NO: 2804741 - DNA, 13 bp, Homo sapiens
acctgggccctgg

SEQ ID NO: 2804742 - DNA, 15 bp, Homo sapiens
acctgggccctgggg

SEQ ID NO: 2804743 - DNA, 16 bp, Homo sapiens
acctgggccctggggc

SEQ ID NO: 2804744 - DNA, 20 bp, Homo sapiens
acctgggccctggggcctgt

SEQ ID NO: 2804745 - DNA, 21 bp, Homo sapiens
acctgggccctggggcctgta

SEQ ID NO: 2804746 - DNA, 23 bp, Homo sapiens
acctggtcacaggactctgcctc

SEQ ID NO: 2804747 - DNA, 14 bp, Homo sapiens
acctggtctctcct

SEQ ID NO: 2804748 - DNA, 11 bp, Homo sapiens
acctgtaatca

SEQ ID NO: 2804749 - DNA, 15 bp, Homo sapiens
acctgtccataaagt

SEQ ID NO: 2804750 - DNA, 16 bp, Homo sapiens
acctgtccataaagta

SEQ ID NO: 2804751 - DNA, 15 bp, Homo sapiens
acctgtctccctggg

SEQ ID NO: 2804752 - DNA, 13 bp, Homo sapiens
acctgtgcacccc

SEQ ID NO: 2804753 - DNA, 14 bp, Homo sapiens
acctgtgcacccca

SEQ ID NO: 2804754 - DNA, 14 bp, Homo sapiens
acctgttcaggagc

SEQ ID NO: 2804755 - DNA, 18 bp, Homo sapiens
acctgttcaggagctgaa

SEQ ID NO: 2804756 - DNA, 18 bp, Homo sapiens
acctgtttttaagctgtt

SEQ ID NO: 2804757 - DNA, 17 bp, Homo sapiens
accttagattagctctg

SEQ ID NO: 2804758 - DNA, 22 bp, Homo sapiens
accttagctggcattacagctg

SEQ ID NO: 2804759 - DNA, 12 bp, Homo sapiens
accttatgtatt

SEQ ID NO: 2804760 - DNA, 20 bp, Homo sapiens
accttattgtacctctctta

SEQ ID NO: 2804761 - DNA, 13 bp, Homo sapiens
accttcaataaag

SEQ ID NO: 2804762 - DNA, 15 bp, Homo sapiens
accttcaataaagta

SEQ ID NO: 2804763 - DNA, 20 bp, Homo sapiens
accttcaataaagtatctac

SEQ ID NO: 2804764 - DNA, 23 bp, Homo sapiens
accttcaataaagtatctacatg

SEQ ID NO: 2804765 - DNA, 16 bp, Homo sapiens
accttcaattcctggg

SEQ ID NO: 2804766 - DNA, 13 bp, Homo sapiens
accttcccagctc

SEQ ID NO: 2804767 - DNA, 9 bp, Homo sapiens
accttcccc

SEQ ID NO: 2804768 - DNA, 16 bp, Homo sapiens
accttccccagactca

SEQ ID NO: 2804769 - DNA, 17 bp, Homo sapiens
accttctgaagatctca

SEQ ID NO: 2804770 - DNA, 20 bp, Homo sapiens
accttcttcagccacctctc

SEQ ID NO: 2804771 - DNA, 18 bp, Homo sapiens
accttgaacactggggga

SEQ ID NO: 2804772 - DNA, 20 bp, Homo sapiens
accttgaactgggtacttgt

SEQ ID NO: 2804773 - DNA, 19 bp, Homo sapiens
accttgccaagctttcttc

SEQ ID NO: 2804774 - DNA, 20 bp, Homo sapiens
accttgccaagctttcttct

SEQ ID NO: 2804775 - DNA, 13 bp, Homo sapiens
accttggactcct

SEQ ID NO: 2804776 - DNA, 18 bp, Homo sapiens
accttggactcctcccac

SEQ ID NO: 2804777 - DNA, 12 bp, Homo sapiens
accttgtgtctg

SEQ ID NO: 2804778 - DNA, 18 bp, Homo sapiens
accttgtgtctgtacacg

SEQ ID NO: 2804779 - DNA, 22 bp, Homo sapiens
acctttattaatgaactgtgac

SEQ ID NO: 2804780 - DNA, 17 bp, Homo sapiens
acctttcccatgctgaa

SEQ ID NO: 2804781 - DNA, 23 bp, Homo sapiens
acctttcccatgctgaattattt

SEQ ID NO: 2804782 - DNA, 20 bp, Homo sapiens
acctttcttcaccaaatctt

SEQ ID NO: 2804783 - DNA, 16 bp, Homo sapiens
acctttgtgtaataaa

SEQ ID NO: 2804784 - DNA, 23 bp, Homo sapiens
acgaaatgttattttttaattat

SEQ ID NO: 2804785 - DNA, 16 bp, Homo sapiens
acgaacccacctgctg

SEQ ID NO: 2804786 - DNA, 17 bp, Homo sapiens
acgaacccactgtgctt

SEQ ID NO: 2804787 - DNA, 22 bp, Homo sapiens
acgaatttggtgtggctgtatt

SEQ ID NO: 2804788 - DNA, 12 bp, Homo sapiens
acgactgaagaa

SEQ ID NO: 2804789 - DNA, 19 bp, Homo sapiens
acgagaccctacaggagag

SEQ ID NO: 2804790 - DNA, 18 bp, Homo sapiens
acgaggagcttccagtgc

SEQ ID NO: 2804791 - DNA, 20 bp, Homo sapiens
acgagggatgggatttcatg

SEQ ID NO: 2804792 - DNA, 17 bp, Homo sapiens
acgatgtggccctggcc

SEQ ID NO: 2804793 - DNA, 22 bp, Homo sapiens
acgatgtggccctggcctgctg

SEQ ID NO: 2804794 - DNA, 21 bp, Homo sapiens
acgcaaagggctgaaagccat

SEQ ID NO: 2804795 - DNA, 13 bp, Homo sapiens
acgcacctccatc

SEQ ID NO: 2804796 - DNA, 16 bp, Homo sapiens
acgcaggaactcccag

SEQ ID NO: 2804797 - DNA, 17 bp, Homo sapiens
acgcaggaactcccagc

SEQ ID NO: 2804798 - DNA, 21 bp, Homo sapiens
actccggtgtgcctgcagccc

SEQ ID NO: 2804799 - DNA, 21 bp, Homo sapiens
actcctcaaaagcaaatgaga

SEQ ID NO: 2804800 - DNA, 15 bp, Homo sapiens
actcctgcaaaattt

SEQ ID NO: 2804801 - DNA, 18 bp, Homo sapiens
actcctgcaaaattttat

SEQ ID NO: 2804802 - DNA, 22 bp, Homo sapiens
actcctgccctgttgtgtatag

SEQ ID NO: 2804803 - DNA, 11 bp, Homo sapiens
actcctggcct

SEQ ID NO: 2804804 - DNA, 16 bp, Homo sapiens
actcctgtgggagcct

SEQ ID NO: 2804805 - DNA, 18 bp, Homo sapiens
actcctgtgggagcctcg

SEQ ID NO: 2804806 - DNA, 13 bp, Homo sapiens
actccttccagct

SEQ ID NO: 2804807 - DNA, 18 bp, Homo sapiens
actccttgtggtttatgt

SEQ ID NO: 2804808 - DNA, 20 bp, Homo sapiens
actccttgtggtttatgtca

SEQ ID NO: 2804809 - DNA, 22 bp, Homo sapiens
actcctttgcattccatgattt

SEQ ID NO: 2804810 - DNA, 18 bp, Homo sapiens
actcgaagcccttccagt

SEQ ID NO: 2804811 - DNA, 20 bp, Homo sapiens
actcgaagcccttccagtgg

SEQ ID NO: 2804812 - DNA, 19 bp, Homo sapiens
actcgcttagctgaaacct

SEQ ID NO: 2804813 - DNA, 15 bp, Homo sapiens
actctacagaggcca

SEQ ID NO: 2804814 - DNA, 21 bp, Homo sapiens
actctaggggtcaggctccat

SEQ ID NO: 2804815 - DNA, 22 bp, Homo sapiens
actctatatagctgatcagttt

SEQ ID NO: 2804816 - DNA, 19 bp, Homo sapiens
actctccaacctggacaac

SEQ ID NO: 2804817 - DNA, 13 bp, Homo sapiens
actctccatctta

SEQ ID NO: 2804818 - DNA, 12 bp, Homo sapiens
actctcccctcc

SEQ ID NO: 2804819 - DNA, 14 bp, Homo sapiens
actctcccctccct

SEQ ID NO: 2804820 - DNA, 20 bp, Homo sapiens
actctcccctccctcttcct

SEQ ID NO: 2804821 - DNA, 19 bp, Homo sapiens
actctcctcggccccctcc

SEQ ID NO: 2804822 - DNA, 18 bp, Homo sapiens
actctctaaatcttcctt

SEQ ID NO: 2804823 - DNA, 13 bp, Homo sapiens
actctgcacatgt

SEQ ID NO: 2804824 - DNA, 17 bp, Homo sapiens
actctgcacatgtcttg

SEQ ID NO: 2804825 - DNA, 13 bp, Homo sapiens
actctgccagcca

SEQ ID NO: 2804826 - DNA, 16 bp, Homo sapiens
actctgccagccacat

SEQ ID NO: 2804827 - DNA, 12 bp, Homo sapiens
actctgctctga

SEQ ID NO: 2804828 - DNA, 14 bp, Homo sapiens
actctgctctgatg

SEQ ID NO: 2804829 - DNA, 14 bp, Homo sapiens
actctggcacccag

SEQ ID NO: 2804830 - DNA, 15 bp, Homo sapiens
actctggcagccaca

SEQ ID NO: 2804831 - DNA, 17 bp, Homo sapiens
actctggcttccaggta

SEQ ID NO: 2804832 - DNA, 14 bp, Homo sapiens
actctgtgccagag

SEQ ID NO: 2804833 - DNA, 20 bp, Homo sapiens
actctgtgccagagcctggg

SEQ ID NO: 2804834 - DNA, 23 bp, Homo sapiens
actctgtgccagagcctggggct

SEQ ID NO: 2804835 - DNA, 20 bp, Homo sapiens
actcttaggaagagaaacca

SEQ ID NO: 2804836 - DNA, 15 bp, Homo sapiens
actcttatgaaatgg

SEQ ID NO: 2804837 - DNA, 16 bp, Homo sapiens
actcttattgcccacg

SEQ ID NO: 2804838 - DNA, 16 bp, Homo sapiens
actcttcctgcaagga

SEQ ID NO: 2804839 - DNA, 16 bp, Homo sapiens
actcttctactttcat

SEQ ID NO: 2804840 - DNA, 14 bp, Homo sapiens
actcttgacctcag

SEQ ID NO: 2804841 - DNA, 15 bp, Homo sapiens
actcttgacctcagg

SEQ ID NO: 2804842 - DNA, 17 bp, Homo sapiens
actcttgcctttccacc

SEQ ID NO: 2804843 - DNA, 16 bp, Homo sapiens
actgaaaactgtaaat

SEQ ID NO: 2804844 - DNA, 17 bp, Homo sapiens
actgaaaattatttaaa

SEQ ID NO: 2804845 - DNA, 10 bp, Homo sapiens
actgaaagaa

SEQ ID NO: 2804846 - DNA, 13 bp, Homo sapiens
actgaaaggttac

SEQ ID NO: 2804847 - DNA, 13 bp, Homo sapiens
actgaaagtggtt

SEQ ID NO: 2804848 - DNA, 20 bp, Homo sapiens
actgaacatttgctttgttt

SEQ ID NO: 2804849 - DNA, 21 bp, Homo sapiens
actgaaccgacttttctaaag

SEQ ID NO: 2804850 - DNA, 17 bp, Homo sapiens
actgaacgtcctgcagc

SEQ ID NO: 2804851 - DNA, 11 bp, Homo sapiens
actgaaggaga

SEQ ID NO: 2804852 - DNA, 17 bp, Homo sapiens
actgaagttaacagaga

SEQ ID NO: 2804853 - DNA, 21 bp, Homo sapiens
actgaagttaacagagacaga

SEQ ID NO: 2804854 - DNA, 19 bp, Homo sapiens
actgacacctcactgagga

SEQ ID NO: 2804855 - DNA, 17 bp, Homo sapiens
actgacattgttggcca

SEQ ID NO: 2804856 - DNA, 23 bp, Homo sapiens
actgaccagcctccatgctgcct

SEQ ID NO: 2804857 - DNA, 20 bp, Homo sapiens
actgacccacagcctctgcc

SEQ ID NO: 2804858 - DNA, 13 bp, Homo sapiens
actgagcaagatc

SEQ ID NO: 2804859 - DNA, 16 bp, Homo sapiens
actgaggaattttctt

SEQ ID NO: 2804860 - DNA, 15 bp, Homo sapiens
actgaggaccagcca

SEQ ID NO: 2804861 - DNA, 15 bp, Homo sapiens
actgaggccattatt

SEQ ID NO: 2804862 - DNA, 12 bp, Homo sapiens
actgagggccac

SEQ ID NO: 2804863 - DNA, 23 bp, Homo sapiens
actgagtgactctatatagctga

SEQ ID NO: 2804864 - DNA, 22 bp, Homo sapiens
actgatgggcaacccccagcct

SEQ ID NO: 2804865 - DNA, 22 bp, Homo sapiens
actgatgttacatcacagtgtt

SEQ ID NO: 2804866 - DNA, 19 bp, Homo sapiens
actgattcacatctcattt

SEQ ID NO: 2804867 - DNA, 13 bp, Homo sapiens
actgcaacctccg

SEQ ID NO: 2804868 - DNA, 22 bp, Homo sapiens
actgcaacctccgcctcttggg

SEQ ID NO: 2804869 - DNA, 19 bp, Homo sapiens
actgcaacttctacctccg

SEQ ID NO: 2804870 - DNA, 17 bp, Homo sapiens
actgcaagacttaaata

SEQ ID NO: 2804871 - DNA, 22 bp, Homo sapiens
actgcaagacttaaatagttca

SEQ ID NO: 2804872 - DNA, 15 bp, Homo sapiens
actgcaagagccttg

SEQ ID NO: 2804873 - DNA, 18 bp, Homo sapiens
actgcaagaggctcctgt

SEQ ID NO: 2804874 - DNA, 16 bp, Homo sapiens
actgcaccgggccaca

SEQ ID NO: 2804875 - DNA, 15 bp, Homo sapiens
actgcactccagcct

SEQ ID NO: 2804876 - DNA, 20 bp, Homo sapiens
actgcactccagcctgggca

SEQ ID NO: 2804877 - DNA, 21 bp, Homo sapiens
actgcagcctcaacctcctgg

SEQ ID NO: 2804878 - DNA, 15 bp, Homo sapiens
actgcatctcaaaaa

SEQ ID NO: 2804879 - DNA, 14 bp, Homo sapiens
actgcatgcacttc

SEQ ID NO: 2804880 - DNA, 15 bp, Homo sapiens
actgccacaccctcc

SEQ ID NO: 2804881 - DNA, 15 bp, Homo sapiens
actgccaggagggac

SEQ ID NO: 2804882 - DNA, 21 bp, Homo sapiens
actgccaggagggacaaagga

SEQ ID NO: 2804883 - DNA, 17 bp, Homo sapiens
actgccccaactcctgg

SEQ ID NO: 2804884 - DNA, 20 bp, Homo sapiens
actgcgggatggtcctgggg

SEQ ID NO: 2804885 - DNA, 19 bp, Homo sapiens
actgctaggcgagtgccag

SEQ ID NO: 2804886 - DNA, 20 bp, Homo sapiens
actgctaggcgagtgccagg

SEQ ID NO: 2804887 - DNA, 21 bp, Homo sapiens
actgctaggcgagtgccagga

SEQ ID NO: 2804888 - DNA, 12 bp, Homo sapiens
actgctccaagt

SEQ ID NO: 2804889 - DNA, 18 bp, Homo sapiens
acttcattttcagagtga

SEQ ID NO: 2804890 - DNA, 19 bp, Homo sapiens
acttcattttcagagtgac

SEQ ID NO: 2804891 - DNA, 17 bp, Homo sapiens
acttccataatctggac

SEQ ID NO: 2804892 - DNA, 24 bp, Homo sapiens
acttcccagttcaggagtcccaag

SEQ ID NO: 2804893 - DNA, 18 bp, Homo sapiens
acttcctcgcctctccca

SEQ ID NO: 2804894 - DNA, 15 bp, Homo sapiens
acttcctctccagcc

SEQ ID NO: 2804895 - DNA, 17 bp, Homo sapiens
acttcggggctgggaag

SEQ ID NO: 2804896 - DNA, 20 bp, Homo sapiens
acttctcaggacacaggcct

SEQ ID NO: 2804897 - DNA, 22 bp, Homo sapiens
acttctcaggacacaggcctgt

SEQ ID NO: 2804898 - DNA, 20 bp, Homo sapiens
acttctcattttttaaaaaa

SEQ ID NO: 2804899 - DNA, 15 bp, Homo sapiens
acttctccaccctgc

SEQ ID NO: 2804900 - DNA, 11 bp, Homo sapiens
acttctctaga

SEQ ID NO: 2804901 - DNA, 12 bp, Homo sapiens
acttctctccag

SEQ ID NO: 2804902 - DNA, 15 bp, Homo sapiens
acttctctttgcctc

SEQ ID NO: 2804903 - DNA, 17 bp, Homo sapiens
acttctctttgcctcaa

SEQ ID NO: 2804904 - DNA, 21 bp, Homo sapiens
acttctctttgcctcaaataa

SEQ ID NO: 2804905 - DNA, 17 bp, Homo sapiens
acttgaacccgggaggc

SEQ ID NO: 2804906 - DNA, 23 bp, Homo sapiens
acttgaaggcccaggtcaacatc

SEQ ID NO: 2804907 - DNA, 16 bp, Homo sapiens
acttgaatcaaagcag

SEQ ID NO: 2804908 - DNA, 14 bp, Homo sapiens
acttgacagtggaa

SEQ ID NO: 2804909 - DNA, 16 bp, Homo sapiens
acttgaggacacatgt

SEQ ID NO: 2804910 - DNA, 18 bp, Homo sapiens
acttgaggctggcactcc

SEQ ID NO: 2804911 - DNA, 19 bp, Homo sapiens
acttgatatagaaagctgt

SEQ ID NO: 2804912 - DNA, 14 bp, Homo sapiens
acttgcacaagctt

SEQ ID NO: 2804913 - DNA, 16 bp, Homo sapiens
acttgcacaagcttgt

SEQ ID NO: 2804914 - DNA, 19 bp, Homo sapiens
acttgcagactctacagag

SEQ ID NO: 2804915 - DNA, 23 bp, Homo sapiens
acttggagagggacgaagaaagg

SEQ ID NO: 2804916 - DNA, 11 bp, Homo sapiens
acttggagcca

SEQ ID NO: 2804917 - DNA, 14 bp, Homo sapiens
acttggagccaagg

SEQ ID NO: 2804918 - DNA, 19 bp, Homo sapiens
acttggagccaagggttca

SEQ ID NO: 2804919 - DNA, 23 bp, Homo sapiens
acttgggcacccccagcctgggc

SEQ ID NO: 2804920 - DNA, 20 bp, Homo sapiens
acttggggagatggagttct

SEQ ID NO: 2804921 - DNA, 15 bp, Homo sapiens
acttgggtcttccct

SEQ ID NO: 2804922 - DNA, 14 bp, Homo sapiens
acttgtaaatacac

SEQ ID NO: 2804923 - DNA, 14 bp, Homo sapiens
acttgtaaatgctg

SEQ ID NO: 2804924 - DNA, 14 bp, Homo sapiens
acttgtacaaaata

SEQ ID NO: 2804925 - DNA, 18 bp, Homo sapiens
acttgtacaaaataaaca

SEQ ID NO: 2804926 - DNA, 14 bp, Homo sapiens
acttgtatattcca

SEQ ID NO: 2804927 - DNA, 15 bp, Homo sapiens
acttgtatctgaaga

SEQ ID NO: 2804928 - DNA, 23 bp, Homo sapiens
acttgtccttttgtaccatggtg

SEQ ID NO: 2804929 - DNA, 16 bp, Homo sapiens
acttgtctattacctg

SEQ ID NO: 2804930 - DNA, 16 bp, Homo sapiens
acttgtggacacagct

SEQ ID NO: 2804931 - DNA, 18 bp, Homo sapiens
acttgtggacacagctct

SEQ ID NO: 2804932 - DNA, 14 bp, Homo sapiens
acttgtgtctctgt

SEQ ID NO: 2804933 - DNA, 16 bp, Homo sapiens
acttgtgtctctgtgc

SEQ ID NO: 2804934 - DNA, 17 bp, Homo sapiens
acttgttacctttccca

SEQ ID NO: 2804935 - DNA, 16 bp, Homo sapiens
actttaaaaggagcca

SEQ ID NO: 2804936 - DNA, 12 bp, Homo sapiens
actttaaagcgt

SEQ ID NO: 2804937 - DNA, 21 bp, Homo sapiens
actttaaagtctttccgtctc

SEQ ID NO: 2804938 - DNA, 19 bp, Homo sapiens
actttaaccctctcttccc

SEQ ID NO: 2804939 - DNA, 20 bp, Homo sapiens
actttaaccctctcttccct

SEQ ID NO: 2804940 - DNA, 14 bp, Homo sapiens
actttaattgtgtg

SEQ ID NO: 2804941 - DNA, 21 bp, Homo sapiens
actttagagtagcatgagaga

SEQ ID NO: 2804942 - DNA, 22 bp, Homo sapiens
actttagccactggtttctcag

SEQ ID NO: 2804943 - DNA, 23 bp, Homo sapiens
actttatctaatacctctgtgtg

SEQ ID NO: 2804944 - DNA, 19 bp, Homo sapiens
actttcattaaagcattta

SEQ ID NO: 2804945 - DNA, 13 bp, Homo sapiens
actttctttctca

SEQ ID NO: 2804946 - DNA, 14 bp, Homo sapiens
actttgaagttagc

SEQ ID NO: 2804947 - DNA, 17 bp, Homo sapiens
actttgctctttcttga

SEQ ID NO: 2804948 - DNA, 17 bp, Homo sapiens
actttggaatgactata

SEQ ID NO: 2804949 - DNA, 14 bp, Homo sapiens
actttgggaggcca

SEQ ID NO: 2804950 - DNA, 19 bp, Homo sapiens
actttggtacatggccagt

SEQ ID NO: 2804951 - DNA, 20 bp, Homo sapiens
actttgtacagtggagaaat

SEQ ID NO: 2804952 - DNA, 17 bp, Homo sapiens
actttgttaaaaatatt

SEQ ID NO: 2804953 - DNA, 21 bp, Homo sapiens
acttttcagaattgaaggaga

SEQ ID NO: 2804954 - DNA, 20 bp, Homo sapiens
acttttcataacctagcctt

SEQ ID NO: 2804955 - DNA, 11 bp, Homo sapiens
acttttctgta

SEQ ID NO: 2804956 - DNA, 14 bp, Homo sapiens
acttttctttgtgg

SEQ ID NO: 2804957 - DNA, 14 bp, Homo sapiens
actttttataatgt

SEQ ID NO: 2804958 - DNA, 19 bp, Homo sapiens
actttttataatgtggatt

SEQ ID NO: 2804959 - DNA, 12 bp, Homo sapiens
actttttatact

SEQ ID NO: 2804960 - DNA, 23 bp, Homo sapiens
acttttttatttaaaaaactaaa

SEQ ID NO: 2804961 - DNA, 23 bp, Homo sapiens
acttttttgctatccagctattt

SEQ ID NO: 2804962 - DNA, 12 bp, Homo sapiens
agaaaaaaatat

SEQ ID NO: 2804963 - DNA, 14 bp, Homo sapiens
agaaaaaaatatat

SEQ ID NO: 2804964 - DNA, 19 bp, Homo sapiens
agaaaaaaatatattttat

SEQ ID NO: 2804965 - DNA, 14 bp, Homo sapiens
agaaaaaatacatt

SEQ ID NO: 2804966 - DNA, 14 bp, Homo sapiens
agaaaaaccaatga

SEQ ID NO: 2804967 - DNA, 15 bp, Homo sapiens
agaaaaagggctgcc

SEQ ID NO: 2804968 - DNA, 16 bp, Homo sapiens
agaaaaagggctgccg

SEQ ID NO: 2804969 - DNA, 16 bp, Homo sapiens
agaaaacctccagtag

SEQ ID NO: 2804970 - DNA, 20 bp, Homo sapiens
agaaaacggagagtgcttgg

SEQ ID NO: 2804971 - DNA, 12 bp, Homo sapiens
agaaaactggaa

SEQ ID NO: 2804972 - DNA, 15 bp, Homo sapiens
agaaaactggaaatc

SEQ ID NO: 2804973 - DNA, 18 bp, Homo sapiens
agaaaagcacctgccgac

SEQ ID NO: 2804974 - DNA, 13 bp, Homo sapiens
agaaaagctataa

SEQ ID NO: 2804975 - DNA, 14 bp, Homo sapiens
agaaaagtagaatt

SEQ ID NO: 2804976 - DNA, 16 bp, Homo sapiens
agaaaagtagaattat

SEQ ID NO: 2804977 - DNA, 18 bp, Homo sapiens
agaaaagtagaattatat

SEQ ID NO: 2804978 - DNA, 12 bp, Homo sapiens
agaaaatataaa

SEQ ID NO: 2804979 - DNA, 14 bp, Homo sapiens
agaaaatataaatg

SEQ ID NO: 2804980 - DNA, 13 bp, Homo sapiens
agagccctgggac

SEQ ID NO: 2804981 - DNA, 16 bp, Homo sapiens
agagccgggaagcgat

SEQ ID NO: 2804982 - DNA, 21 bp, Homo sapiens
agagcctgactgtgttcagtg

SEQ ID NO: 2804983 - DNA, 13 bp, Homo sapiens
agagcctgctccc

SEQ ID NO: 2804984 - DNA, 16 bp, Homo sapiens
agagcctgctccccca

SEQ ID NO: 2804985 - DNA, 17 bp, Homo sapiens
agagcctggagaagctg

SEQ ID NO: 2804986 - DNA, 13 bp, Homo sapiens
agagcctgtcttt

SEQ ID NO: 2804987 - DNA, 20 bp, Homo sapiens
agagcctgtctttcagcatt

SEQ ID NO: 2804988 - DNA, 22 bp, Homo sapiens
agagcctgtctttcagcattca

SEQ ID NO: 2804989 - DNA, 16 bp, Homo sapiens
agagctacgtatttaa

SEQ ID NO: 2804990 - DNA, 13 bp, Homo sapiens
agagctagcgctg

SEQ ID NO: 2804991 - DNA, 13 bp, Homo sapiens
agagctaggagca

SEQ ID NO: 2804992 - DNA, 18 bp, Homo sapiens
agagctaggagcaaagcc

SEQ ID NO: 2804993 - DNA, 19 bp, Homo sapiens
agagctaggagcaaagcct

SEQ ID NO: 2804994 - DNA, 14 bp, Homo sapiens
agagctgctctgga

SEQ ID NO: 2804995 - DNA, 22 bp, Homo sapiens
agagctttctgtccttttggca

SEQ ID NO: 2804996 - DNA, 16 bp, Homo sapiens
agaggaaaaaaatgac

SEQ ID NO: 2804997 - DNA, 22 bp, Homo sapiens
agaggaaaggacatgggtagca

SEQ ID NO: 2804998 - DNA, 13 bp, Homo sapiens
agaggaagagaga

SEQ ID NO: 2804999 - DNA, 13 bp, Homo sapiens
agaggaagggtgg

SEQ ID NO: 2805000 - DNA, 23 bp, Homo sapiens
agaggaatcagacttcacactgc

SEQ ID NO: 2805001 - DNA, 24 bp, Homo sapiens
agaggaatcagacttcacactgca

SEQ ID NO: 2805002 - DNA, 23 bp, Homo sapiens
agaggacttttctttgtggcttc

SEQ ID NO: 2805003 - DNA, 15 bp, Homo sapiens
agaggagatcagggc

SEQ ID NO: 2805004 - DNA, 17 bp, Homo sapiens
agaggagggatgctgcc

SEQ ID NO: 2805005 - DNA, 14 bp, Homo sapiens
agaggcaaacattt

SEQ ID NO: 2805006 - DNA, 18 bp, Homo sapiens
agaggcacctgtcccaga

SEQ ID NO: 2805007 - DNA, 17 bp, Homo sapiens
agaggcagagaaagaag

SEQ ID NO: 2805008 - DNA, 13 bp, Homo sapiens
agaggcagcccca

SEQ ID NO: 2805009 - DNA, 24 bp, Homo sapiens
agaggcagccccattctgcctgcc

SEQ ID NO: 2805010 - DNA, 15 bp, Homo sapiens
agaggccatggcaga

SEQ ID NO: 2805011 - DNA, 20 bp, Homo sapiens
agaggccatggcagaataat

SEQ ID NO: 2805012 - DNA, 13 bp, Homo sapiens
agaggccctggat

SEQ ID NO: 2805013 - DNA, 21 bp, Homo sapiens
agaggccctggatcagcgtgg

SEQ ID NO: 2805014 - DNA, 19 bp, Homo sapiens
agaggctattattttcact

SEQ ID NO: 2805015 - DNA, 20 bp, Homo sapiens
agaggctggaggcagggcct

SEQ ID NO: 2805016 - DNA, 14 bp, Homo sapiens
agaggctggtgctg

SEQ ID NO: 2805017 - DNA, 16 bp, Homo sapiens
agaggctggtgctgtg

SEQ ID NO: 2805018 - DNA, 17 bp, Homo sapiens
agaggctgtggtggctg

SEQ ID NO: 2805019 - DNA, 23 bp, Homo sapiens
agaggctgtggtggctgtctctg

SEQ ID NO: 2805020 - DNA, 14 bp, Homo sapiens
agaggcttcttcag

SEQ ID NO: 2805021 - DNA, 18 bp, Homo sapiens
agagggcaaacccaaaac

SEQ ID NO: 2805022 - DNA, 16 bp, Homo sapiens
agagggcccaggcagg

SEQ ID NO: 2805023 - DNA, 16 bp, Homo sapiens
agagggcctgtgggag

SEQ ID NO: 2805024 - DNA, 22 bp, Homo sapiens
agaggggaaaccagtgtagcct

SEQ ID NO: 2805025 - DNA, 16 bp, Homo sapiens
agaggggacatttccc

SEQ ID NO: 2805026 - DNA, 14 bp, Homo sapiens
agaggggaggggcc

SEQ ID NO: 2805027 - DNA, 18 bp, Homo sapiens
agaggggaggggcctagg

SEQ ID NO: 2805028 - DNA, 20 bp, Homo sapiens
agaggggaggggcctaggga

SEQ ID NO: 2805029 - DNA, 18 bp, Homo sapiens
agagggtctggagaagca

SEQ ID NO: 2805030 - DNA, 22 bp, Homo sapiens
agagggtctggagaagcagtga

SEQ ID NO: 2805031 - DNA, 23 bp, Homo sapiens
agagggtggtgacctctgcctga

SEQ ID NO: 2805032 - DNA, 16 bp, Homo sapiens
agaggtaaaagtgtga

SEQ ID NO: 2805033 - DNA, 19 bp, Homo sapiens
agaggtaaaagtgtgagca

SEQ ID NO: 2805034 - DNA, 22 bp, Homo sapiens
agaggtaaaagtgtgagcagtg

SEQ ID NO: 2805035 - DNA, 17 bp, Homo sapiens
agaggtgaccccagggc

SEQ ID NO: 2805036 - DNA, 23 bp, Homo sapiens
agaggtgaccccagggcacagga

SEQ ID NO: 2805037 - DNA, 24 bp, Homo sapiens
agaggtgaccccagggcacaggag

SEQ ID NO: 2805038 - DNA, 16 bp, Homo sapiens
agaggtgctgcaggca

SEQ ID NO: 2805039 - DNA, 13 bp, Homo sapiens
agaggtgggcagc

SEQ ID NO: 2805040 - DNA, 18 bp, Homo sapiens
agaggtgggcagcagctc

SEQ ID NO: 2805041 - DNA, 12 bp, Homo sapiens
agagtagcaagt

SEQ ID NO: 2805042 - DNA, 22 bp, Homo sapiens
agagtagcaagttctagagaag

SEQ ID NO: 2805043 - DNA, 22 bp, Homo sapiens
agagtagccgagagcctgctcc

SEQ ID NO: 2805044 - DNA, 14 bp, Homo sapiens
agagtagtttttca

SEQ ID NO: 2805045 - DNA, 17 bp, Homo sapiens
agagtatatatgtacag

SEQ ID NO: 2805046 - DNA, 17 bp, Homo sapiens
agagtatgcaagaagaa

SEQ ID NO: 2805047 - DNA, 18 bp, Homo sapiens
agagtcagccttccccct

SEQ ID NO: 2805048 - DNA, 14 bp, Homo sapiens
agagtcctctggat

SEQ ID NO: 2805049 - DNA, 12 bp, Homo sapiens
agagtctgtctc

SEQ ID NO: 2805050 - DNA, 20 bp, Homo sapiens
agagtgaaataattaaaaac

SEQ ID NO: 2805051 - DNA, 21 bp, Homo sapiens
agagtgacacccaagagggct

SEQ ID NO: 2805052 - DNA, 23 bp, Homo sapiens
agagtgacacccaagagggctgc

SEQ ID NO: 2805053 - DNA, 19 bp, Homo sapiens
agagtgagaataattgtgt

SEQ ID NO: 2805054 - DNA, 15 bp, Homo sapiens
agagtgagaccctgt

SEQ ID NO: 2805055 - DNA, 16 bp, Homo sapiens
agagtgagactctgtc

SEQ ID NO: 2805056 - DNA, 11 bp, Homo sapiens
agagtgtgacc

SEQ ID NO: 2805057 - DNA, 14 bp, Homo sapiens
agagtgtgaccaaa

SEQ ID NO: 2805058 - DNA, 20 bp, Homo sapiens
agagttaatatatagaaggg

SEQ ID NO: 2805059 - DNA, 22 bp, Homo sapiens
agagttctttaggtgcctcctg

SEQ ID NO: 2805060 - DNA, 13 bp, Homo sapiens
agataaattataa

SEQ ID NO: 2805061 - DNA, 18 bp, Homo sapiens
agataacaagatctttca

SEQ ID NO: 2805062 - DNA, 15 bp, Homo sapiens
agataatatctgtga

SEQ ID NO: 2805063 - DNA, 18 bp, Homo sapiens
agataatatctgtgaggt

SEQ ID NO: 2805064 - DNA, 16 bp, Homo sapiens
agataatcagcctctt

SEQ ID NO: 2805065 - DNA, 19 bp, Homo sapiens
agataatttattttgtatt

SEQ ID NO: 2805066 - DNA, 19 bp, Homo sapiens
agatacattccctatcaaa

SEQ ID NO: 2805067 - DNA, 19 bp, Homo sapiens
agatactggaagttttgca

SEQ ID NO: 2805068 - DNA, 23 bp, Homo sapiens
agatagggaagagagaaacattt

SEQ ID NO: 2805069 - DNA, 22 bp, Homo sapiens
agataggtttgagttcaaattt

SEQ ID NO: 2805070 - DNA, 21 bp, Homo sapiens
agccagcgcctccctccaccc

SEQ ID NO: 2805071 - DNA, 13 bp, Homo sapiens
agccagctcctgg

SEQ ID NO: 2805072 - DNA, 20 bp, Homo sapiens
agccagctcctgggcagctt

SEQ ID NO: 2805073 - DNA, 15 bp, Homo sapiens
agccagctctcagcc

SEQ ID NO: 2805074 - DNA, 20 bp, Homo sapiens
agccagctgccgaccagagc

SEQ ID NO: 2805075 - DNA, 13 bp, Homo sapiens
agccaggagcaaa

SEQ ID NO: 2805076 - DNA, 22 bp, Homo sapiens
agccaggagcaaatgtttctgc

SEQ ID NO: 2805077 - DNA, 16 bp, Homo sapiens
agccaggaggagagga

SEQ ID NO: 2805078 - DNA, 15 bp, Homo sapiens
agccaggctgagtga

SEQ ID NO: 2805079 - DNA, 11 bp, Homo sapiens
agccagggcca

SEQ ID NO: 2805080 - DNA, 12 bp, Homo sapiens
agccagggccag

SEQ ID NO: 2805081 - DNA, 17 bp, Homo sapiens
agccagggccaggggtc

SEQ ID NO: 2805082 - DNA, 15 bp, Homo sapiens
agccagggtcctgag

SEQ ID NO: 2805083 - DNA, 18 bp, Homo sapiens
agccaggtaatgagggac

SEQ ID NO: 2805084 - DNA, 18 bp, Homo sapiens
agccatcatgtgcctgga

SEQ ID NO: 2805085 - DNA, 19 bp, Homo sapiens
agccatgaggagttgctgt

SEQ ID NO: 2805086 - DNA, 23 bp, Homo sapiens
agccatgtaccagtgtactgctt

SEQ ID NO: 2805087 - DNA, 17 bp, Homo sapiens
agccatttgttggggca

SEQ ID NO: 2805088 - DNA, 22 bp, Homo sapiens
agccatttgttggggcagtggt

SEQ ID NO: 2805089 - DNA, 22 bp, Homo sapiens
agcccaaatggctctgtgaaat

SEQ ID NO: 2805090 - DNA, 22 bp, Homo sapiens
agcccaagggcggggctatgcc

SEQ ID NO: 2805091 - DNA, 16 bp, Homo sapiens
agcccaataaacctct

SEQ ID NO: 2805092 - DNA, 16 bp, Homo sapiens
agcccaatattataat

SEQ ID NO: 2805093 - DNA, 16 bp, Homo sapiens
agcccaccttggctca

SEQ ID NO: 2805094 - DNA, 13 bp, Homo sapiens
agcccagcactgt

SEQ ID NO: 2805095 - DNA, 14 bp, Homo sapiens
agcccagcactgtg

SEQ ID NO: 2805096 - DNA, 17 bp, Homo sapiens
agcccagcactgtgaag

SEQ ID NO: 2805097 - DNA, 15 bp, Homo sapiens
agcccagcccagctg

SEQ ID NO: 2805098 - DNA, 16 bp, Homo sapiens
agcccagcccagctgg

SEQ ID NO: 2805099 - DNA, 11 bp, Homo sapiens
agcccagcctc

SEQ ID NO: 2805100 - DNA, 11 bp, Homo sapiens
agcccaggagt

SEQ ID NO: 2805101 - DNA, 23 bp, Homo sapiens
agcccaggtcctctgatacccag

SEQ ID NO: 2805102 - DNA, 14 bp, Homo sapiens
agcccatggagcag

SEQ ID NO: 2805103 - DNA, 17 bp, Homo sapiens
agcccattctctctcct

SEQ ID NO: 2805104 - DNA, 22 bp, Homo sapiens
agcccattctctctcctgtcca

SEQ ID NO: 2805105 - DNA, 15 bp, Homo sapiens
agccccagtgcccac

SEQ ID NO: 2805106 - DNA, 20 bp, Homo sapiens
agccccattctgcctgccca

SEQ ID NO: 2805107 - DNA, 17 bp, Homo sapiens
agcccccaccccacgga

SEQ ID NO: 2805108 - DNA, 20 bp, Homo sapiens
agcccccacctccgccccag

SEQ ID NO: 2805109 - DNA, 21 bp, Homo sapiens
agcccccacctccgccccaga

SEQ ID NO: 2805110 - DNA, 14 bp, Homo sapiens
agccccgactccag

SEQ ID NO: 2805111 - DNA, 14 bp, Homo sapiens
agccccgaggcctt

SEQ ID NO: 2805112 - DNA, 17 bp, Homo sapiens
agccccgaggccttctc

SEQ ID NO: 2805113 - DNA, 13 bp, Homo sapiens
agcccctcctccc

SEQ ID NO: 2805114 - DNA, 13 bp, Homo sapiens
agcccctcctctg

SEQ ID NO: 2805115 - DNA, 18 bp, Homo sapiens
agcccctcctctgccacc

SEQ ID NO: 2805116 - DNA, 21 bp, Homo sapiens
agcccctcctctgccacctcc

SEQ ID NO: 2805117 - DNA, 23 bp, Homo sapiens
agccccttgctctcccctgccct

SEQ ID NO: 2805118 - DNA, 20 bp, Homo sapiens
agcccggcctgctcccagca

SEQ ID NO: 2805119 - DNA, 22 bp, Homo sapiens
agcccggcctgctcccagcagc

SEQ ID NO: 2805120 - DNA, 21 bp, Homo sapiens
agcccggcgccaccatcctgc

SEQ ID NO: 2805121 - DNA, 13 bp, Homo sapiens
agccctaaacatc

SEQ ID NO: 2805122 - DNA, 16 bp, Homo sapiens
agccctaaggatctct

SEQ ID NO: 2805123 - DNA, 14 bp, Homo sapiens
agccctccctgtcc

SEQ ID NO: 2805124 - DNA, 20 bp, Homo sapiens
agccctccctgtcctcctcg

SEQ ID NO: 2805125 - DNA, 22 bp, Homo sapiens
agccctccctgtcctcctcgga

SEQ ID NO: 2805126 - DNA, 13 bp, Homo sapiens
agccctcctcacc

SEQ ID NO: 2805127 - DNA, 13 bp, Homo sapiens
agccctccttcca

SEQ ID NO: 2805128 - DNA, 17 bp, Homo sapiens
agccctgcggagccggc

SEQ ID NO: 2805129 - DNA, 20 bp, Homo sapiens
agccctgcggagccggcacc

SEQ ID NO: 2805130 - DNA, 23 bp, Homo sapiens
agccctggatttcagaaagagca

SEQ ID NO: 2805131 - DNA, 14 bp, Homo sapiens
agccctgggaccgc

SEQ ID NO: 2805132 - DNA, 21 bp, Homo sapiens
agccctgggccccaccaccta

SEQ ID NO: 2805133 - DNA, 16 bp, Homo sapiens
agccctggtggcagtg

SEQ ID NO: 2805134 - DNA, 22 bp, Homo sapiens
agccctggtggcagtgggagct

SEQ ID NO: 2805135 - DNA, 14 bp, Homo sapiens
agcccttcatttgg

SEQ ID NO: 2805136 - DNA, 22 bp, Homo sapiens
agcccttccagtggtaccagct

SEQ ID NO: 2805137 - DNA, 23 bp, Homo sapiens
agcccttccatgtcgcctctgca

SEQ ID NO: 2805138 - DNA, 17 bp, Homo sapiens
agcccttgagctcccca

SEQ ID NO: 2805139 - DNA, 12 bp, Homo sapiens
agcccttgggtt

SEQ ID NO: 2805140 - DNA, 16 bp, Homo sapiens
agccgacctcagcctt

SEQ ID NO: 2805141 - DNA, 17 bp, Homo sapiens
agccgagagcctgctcc

SEQ ID NO: 2805142 - DNA, 19 bp, Homo sapiens
agccgagatcacgccactg

SEQ ID NO: 2805143 - DNA, 21 bp, Homo sapiens
agccgagatcacgccactgca

SEQ ID NO: 2805144 - DNA, 16 bp, Homo sapiens
agccgcatcttctcca

SEQ ID NO: 2805145 - DNA, 14 bp, Homo sapiens
agccgctcctgtct

SEQ ID NO: 2805146 - DNA, 22 bp, Homo sapiens
agccgggcgtggtggcgggcac

SEQ ID NO: 2805147 - DNA, 17 bp, Homo sapiens
agccgggtacctcagtt

SEQ ID NO: 2805148 - DNA, 12 bp, Homo sapiens
agccggtgcctg

SEQ ID NO: 2805149 - DNA, 13 bp, Homo sapiens
agccggtgcctgg

SEQ ID NO: 2805150 - DNA, 22 bp, Homo sapiens
agccggtgcctggcgcccctgc

SEQ ID NO: 2805151 - DNA, 17 bp, Homo sapiens
agccgtgatgctcaggc

SEQ ID NO: 2805152 - DNA, 16 bp, Homo sapiens
agcctaaatctaatca

SEQ ID NO: 2805153 - DNA, 19 bp, Homo sapiens
agcctagccgacctcagcc

SEQ ID NO: 2805154 - DNA, 15 bp, Homo sapiens
agcctaggtgacaga

SEQ ID NO: 2805155 - DNA, 17 bp, Homo sapiens
agcctaggtgacagagt

SEQ ID NO: 2805156 - DNA, 20 bp, Homo sapiens
agcctattagatgttttaca

SEQ ID NO: 2805157 - DNA, 22 bp, Homo sapiens
agcctcacttttaatgaacaaa

SEQ ID NO: 2805158 - DNA, 15 bp, Homo sapiens
agcctcagcatcctg

SEQ ID NO: 2805159 - DNA, 16 bp, Homo sapiens
agcctcagcatcctgg

SEQ ID NO: 2805160 - DNA, 17 bp, Homo sapiens
agcctcagcatcctggc

SEQ ID NO: 2805161 - DNA, 22 bp, Homo sapiens
agctttcatcacacccttttaa

SEQ ID NO: 2805162 - DNA, 20 bp, Homo sapiens
agctttcttctacaaccaga

SEQ ID NO: 2805163 - DNA, 23 bp, Homo sapiens
agctttcttctacaaccagagcc

SEQ ID NO: 2805164 - DNA, 18 bp, Homo sapiens
agctttgctctttggtag

SEQ ID NO: 2805165 - DNA, 16 bp, Homo sapiens
agcttttaataaaatt

SEQ ID NO: 2805166 - DNA, 19 bp, Homo sapiens
agcttttaataaaattgac

SEQ ID NO: 2805167 - DNA, 13 bp, Homo sapiens
agcttttgctttt

SEQ ID NO: 2805168 - DNA, 17 bp, Homo sapiens
agctttttgtcttttct

SEQ ID NO: 2805169 - DNA, 14 bp, Homo sapiens
aggaaaagctgctg

SEQ ID NO: 2805170 - DNA, 14 bp, Homo sapiens
aggaaaattgaatg

SEQ ID NO: 2805171 - DNA, 16 bp, Homo sapiens
aggaaaattgaatgca

SEQ ID NO: 2805172 - DNA, 22 bp, Homo sapiens
aggaaagcaccgcagcatgtgg

SEQ ID NO: 2805173 - DNA, 16 bp, Homo sapiens
aggaaataaaaccttt

SEQ ID NO: 2805174 - DNA, 17 bp, Homo sapiens
aggaaataaaacctttc

SEQ ID NO: 2805175 - DNA, 19 bp, Homo sapiens
aggaaataaaacctttcaa

SEQ ID NO: 2805176 - DNA, 22 bp, Homo sapiens
aggaaataaaacctttcaaatt

SEQ ID NO: 2805177 - DNA, 16 bp, Homo sapiens
aggaacacccggaaag

SEQ ID NO: 2805178 - DNA, 18 bp, Homo sapiens
aggaacacccggaaagac

SEQ ID NO: 2805179 - DNA, 13 bp, Homo sapiens
aggaacagaagga

SEQ ID NO: 2805180 - DNA, 13 bp, Homo sapiens
aggaactcccagc

SEQ ID NO: 2805181 - DNA, 19 bp, Homo sapiens
aggaactctggcttccagg

SEQ ID NO: 2805182 - DNA, 12 bp, Homo sapiens
aggaactggaac

SEQ ID NO: 2805183 - DNA, 15 bp, Homo sapiens
aggaactggaacaca

SEQ ID NO: 2805184 - DNA, 11 bp, Homo sapiens
aggaagaagac

SEQ ID NO: 2805185 - DNA, 13 bp, Homo sapiens
aggaagagagaga

SEQ ID NO: 2805186 - DNA, 23 bp, Homo sapiens
aggaagagcaggcacatggagga

SEQ ID NO: 2805187 - DNA, 17 bp, Homo sapiens
aggaagcaagcttaatg

SEQ ID NO: 2805188 - DNA, 16 bp, Homo sapiens
aggaagccaggctgag

SEQ ID NO: 2805189 - DNA, 16 bp, Homo sapiens
aggaagcccaaggcag

SEQ ID NO: 2805190 - DNA, 17 bp, Homo sapiens
aggaagcccaaggcagt

SEQ ID NO: 2805191 - DNA, 21 bp, Homo sapiens
aggaaggagactcacctctgc

SEQ ID NO: 2805192 - DNA, 23 bp, Homo sapiens
aggaaggagactcacctctgcct

SEQ ID NO: 2805193 - DNA, 16 bp, Homo sapiens
aggaaggtagcccagc

SEQ ID NO: 2805194 - DNA, 15 bp, Homo sapiens
aggaatcagacttca

SEQ ID NO: 2805195 - DNA, 15 bp, Homo sapiens
aggaatcagctgcag

SEQ ID NO: 2805196 - DNA, 20 bp, Homo sapiens
aggaatccagacccggctgc

SEQ ID NO: 2805197 - DNA, 14 bp, Homo sapiens
aggaatctcagaga

SEQ ID NO: 2805198 - DNA, 17 bp, Homo sapiens
aggaatctcagagacag

SEQ ID NO: 2805199 - DNA, 18 bp, Homo sapiens
aggaatctcagagacagg

SEQ ID NO: 2805200 - DNA, 23 bp, Homo sapiens
aggaattaagttagggaatggca

SEQ ID NO: 2805201 - DNA, 20 bp, Homo sapiens
aggaattgaagatgtaagga

SEQ ID NO: 2805202 - DNA, 14 bp, Homo sapiens
aggaattttctttg

SEQ ID NO: 2805203 - DNA, 16 bp, Homo sapiens
aggaattttctttgtg

SEQ ID NO: 2805204 - DNA, 23 bp, Homo sapiens
aggacacaagcacagttttaaga

SEQ ID NO: 2805205 - DNA, 23 bp, Homo sapiens
aggacacactaatcgaactatga

SEQ ID NO: 2805206 - DNA, 11 bp, Homo sapiens
aggacacaggc

SEQ ID NO: 2805207 - DNA, 13 bp, Homo sapiens
aggacacaggcct

SEQ ID NO: 2805208 - DNA, 18 bp, Homo sapiens
aggacactaaccacgctg

SEQ ID NO: 2805209 - DNA, 19 bp, Homo sapiens
aggacactaaccacgctgg

SEQ ID NO: 2805210 - DNA, 23 bp, Homo sapiens
aggacagcctgtggcggtgcctg

SEQ ID NO: 2805211 - DNA, 12 bp, Homo sapiens
aggacaggcccg

SEQ ID NO: 2805212 - DNA, 16 bp, Homo sapiens
aggacagtgcttcagc

SEQ ID NO: 2805213 - DNA, 20 bp, Homo sapiens
aggacataaattagaggtct

SEQ ID NO: 2805214 - DNA, 14 bp, Homo sapiens
aggaccaatgttgt

SEQ ID NO: 2805215 - DNA, 12 bp, Homo sapiens
aggaccaggact

SEQ ID NO: 2805216 - DNA, 22 bp, Homo sapiens
aggaccaggactatagcccagg

SEQ ID NO: 2805217 - DNA, 23 bp, Homo sapiens
aggaccaggactatagcccaggt

SEQ ID NO: 2805218 - DNA, 14 bp, Homo sapiens
aggaccctggctct

SEQ ID NO: 2805219 - DNA, 16 bp, Homo sapiens
aggacctgagcctgcc

SEQ ID NO: 2805220 - DNA, 21 bp, Homo sapiens
aggacctgagcctgccgagca

SEQ ID NO: 2805221 - DNA, 20 bp, Homo sapiens
aggacctggcttggctttaa

SEQ ID NO: 2805222 - DNA, 23 bp, Homo sapiens
aggacgagggatgggatttcatg

SEQ ID NO: 2805223 - DNA, 16 bp, Homo sapiens
aggacgccactcattt

SEQ ID NO: 2805224 - DNA, 20 bp, Homo sapiens
aggactaacactcagaagcc

SEQ ID NO: 2805225 - DNA, 22 bp, Homo sapiens
aggactaacactcagaagcctg

SEQ ID NO: 2805226 - DNA, 20 bp, Homo sapiens
aggactacgttaagggaagg

SEQ ID NO: 2805227 - DNA, 18 bp, Homo sapiens
aggactatagcccaggtc

SEQ ID NO: 2805228 - DNA, 19 bp, Homo sapiens
aggactatagcccaggtcc

SEQ ID NO: 2805229 - DNA, 20 bp, Homo sapiens
aggactatagcccaggtcct

SEQ ID NO: 2805230 - DNA, 13 bp, Homo sapiens
aggactccccagg

SEQ ID NO: 2805231 - DNA, 16 bp, Homo sapiens
aggactccccaggcca

SEQ ID NO: 2805232 - DNA, 17 bp, Homo sapiens
aggactccttaaatttg

SEQ ID NO: 2805233 - DNA, 12 bp, Homo sapiens
aggactctgcct

SEQ ID NO: 2805234 - DNA, 13 bp, Homo sapiens
aggactctgcctc

SEQ ID NO: 2805235 - DNA, 19 bp, Homo sapiens
aggactctgcctcctcttc

SEQ ID NO: 2805236 - DNA, 20 bp, Homo sapiens
aggactgaattgtccccagt

SEQ ID NO: 2805237 - DNA, 14 bp, Homo sapiens
aggacttctgcctg

SEQ ID NO: 2805238 - DNA, 16 bp, Homo sapiens
aggacttggtctgatt

SEQ ID NO: 2805239 - DNA, 23 bp, Homo sapiens
aggacttggtctgatttcaggat

SEQ ID NO: 2805240 - DNA, 21 bp, Homo sapiens
aggactttcctaaatgtttaa

SEQ ID NO: 2805241 - DNA, 17 bp, Homo sapiens
aggacttttctttgtgg

SEQ ID NO: 2805242 - DNA, 19 bp, Homo sapiens
aggacttttctttgtggct

SEQ ID NO: 2805243 - DNA, 18 bp, Homo sapiens
aggagaaacagagacagg

SEQ ID NO: 2805244 - DNA, 18 bp, Homo sapiens
aggagaatcaataaaaat

SEQ ID NO: 2805245 - DNA, 16 bp, Homo sapiens
aggagaatccaagcga

SEQ ID NO: 2805246 - DNA, 18 bp, Homo sapiens
aggagacagttcaagaaa

SEQ ID NO: 2805247 - DNA, 11 bp, Homo sapiens
aggagactcac

SEQ ID NO: 2805248 - DNA, 17 bp, Homo sapiens
aggagactcacctctgc

SEQ ID NO: 2805249 - DNA, 18 bp, Homo sapiens
aggagactcacctctgcc

SEQ ID NO: 2805250 - DNA, 19 bp, Homo sapiens
aggagactcacctctgcct

SEQ ID NO: 2805251 - DNA, 14 bp, Homo sapiens
aggagagagttgaa

SEQ ID NO: 2805252 - DNA, 16 bp, Homo sapiens
agggctctcctggctt

SEQ ID NO: 2805253 - DNA, 11 bp, Homo sapiens
agggctctgag

SEQ ID NO: 2805254 - DNA, 14 bp, Homo sapiens
agggctctgaggcg

SEQ ID NO: 2805255 - DNA, 21 bp, Homo sapiens
agggctggaaaagtcacacag

SEQ ID NO: 2805256 - DNA, 12 bp, Homo sapiens
agggctggacct

SEQ ID NO: 2805257 - DNA, 14 bp, Homo sapiens
aggggaaaatagta

SEQ ID NO: 2805258 - DNA, 14 bp, Homo sapiens
aggggaacagactg

SEQ ID NO: 2805259 - DNA, 17 bp, Homo sapiens
aggggaataatagaaga

SEQ ID NO: 2805260 - DNA, 18 bp, Homo sapiens
aggggaataatagaagaa

SEQ ID NO: 2805261 - DNA, 21 bp, Homo sapiens
aggggaatgtttgcctctgcc

SEQ ID NO: 2805262 - DNA, 19 bp, Homo sapiens
aggggacatttccctcctg

SEQ ID NO: 2805263 - DNA, 21 bp, Homo sapiens
aggggactaattcactggcga

SEQ ID NO: 2805264 - DNA, 10 bp, Homo sapiens
aggggagagg

SEQ ID NO: 2805265 - DNA, 19 bp, Homo sapiens
aggggaggatcactggagc

SEQ ID NO: 2805266 - DNA, 12 bp, Homo sapiens
aggggaggggcc

SEQ ID NO: 2805267 - DNA, 16 bp, Homo sapiens
aggggaggggcctagg

SEQ ID NO: 2805268 - DNA, 16 bp, Homo sapiens
aggggatagagagaga

SEQ ID NO: 2805269 - DNA, 20 bp, Homo sapiens
aggggatcaaagttcctgtt

SEQ ID NO: 2805270 - DNA, 16 bp, Homo sapiens
aggggcacgcctgccc

SEQ ID NO: 2805271 - DNA, 14 bp, Homo sapiens
aggggcccacaggg

SEQ ID NO: 2805272 - DNA, 19 bp, Homo sapiens
aggggcccacagggaaccc

SEQ ID NO: 2805273 - DNA, 14 bp, Homo sapiens
aggggcctgcccag

SEQ ID NO: 2805274 - DNA, 23 bp, Homo sapiens
aggggctcctggaaaggctcagt

SEQ ID NO: 2805275 - DNA, 14 bp, Homo sapiens
aggggctttctgga

SEQ ID NO: 2805276 - DNA, 12 bp, Homo sapiens
agggggcggcct

SEQ ID NO: 2805277 - DNA, 15 bp, Homo sapiens
agggggcggcctatg

SEQ ID NO: 2805278 - DNA, 16 bp, Homo sapiens
agggggtcgtggagag

SEQ ID NO: 2805279 - DNA, 23 bp, Homo sapiens
agggggtcgtggagagctaggag

SEQ ID NO: 2805280 - DNA, 23 bp, Homo sapiens
agggggtgattagagggaggaga

SEQ ID NO: 2805281 - DNA, 16 bp, Homo sapiens
aggggtcaggctccat

SEQ ID NO: 2805282 - DNA, 16 bp, Homo sapiens
aggggtccttggtgtg

SEQ ID NO: 2805283 - DNA, 17 bp, Homo sapiens
aggggtctccctggagt

SEQ ID NO: 2805284 - DNA, 19 bp, Homo sapiens
aggggtctccctggagtgc

SEQ ID NO: 2805285 - DNA, 15 bp, Homo sapiens
aggggtgggagagcc

SEQ ID NO: 2805286 - DNA, 22 bp, Homo sapiens
aggggttgtcaagagagagtca

SEQ ID NO: 2805287 - DNA, 14 bp, Homo sapiens
agggtaaggtgcct

SEQ ID NO: 2805288 - DNA, 15 bp, Homo sapiens
agggtaccagcagaa

SEQ ID NO: 2805289 - DNA, 21 bp, Homo sapiens
agggtaggaggtttggatggg

SEQ ID NO: 2805290 - DNA, 21 bp, Homo sapiens
agggtatcaggtgctgccatc

SEQ ID NO: 2805291 - DNA, 18 bp, Homo sapiens
agggtcaacggccctgtt

SEQ ID NO: 2805292 - DNA, 19 bp, Homo sapiens
agggtcgccacacccggct

SEQ ID NO: 2805293 - DNA, 20 bp, Homo sapiens
agggtctcactatgttgccc

SEQ ID NO: 2805294 - DNA, 21 bp, Homo sapiens
agggtctcactatgttgccca

SEQ ID NO: 2805295 - DNA, 15 bp, Homo sapiens
agggtctcactctgt

SEQ ID NO: 2805296 - DNA, 13 bp, Homo sapiens
agggtctggagaa

SEQ ID NO: 2805297 - DNA, 16 bp, Homo sapiens
agggtgggagagccca

SEQ ID NO: 2805298 - DNA, 18 bp, Homo sapiens
agggtgggagagcccagc

SEQ ID NO: 2805299 - DNA, 19 bp, Homo sapiens
agggtgggagagcccagcc

SEQ ID NO: 2805300 - DNA, 17 bp, Homo sapiens
agggtgggccactctcc

SEQ ID NO: 2805301 - DNA, 18 bp, Homo sapiens
agggtgggccactctccc

SEQ ID NO: 2805302 - DNA, 20 bp, Homo sapiens
agggtggtctgagcaccccc

SEQ ID NO: 2805303 - DNA, 16 bp, Homo sapiens
agggtggtgacctctg

SEQ ID NO: 2805304 - DNA, 13 bp, Homo sapiens
agggttagggagg

SEQ ID NO: 2805305 - DNA, 18 bp, Homo sapiens
agggttcagagactcagg

SEQ ID NO: 2805306 - DNA, 14 bp, Homo sapiens
agggttgatcacac

SEQ ID NO: 2805307 - DNA, 13 bp, Homo sapiens
agggttgggctgg

SEQ ID NO: 2805308 - DNA, 17 bp, Homo sapiens
agggttgggctggtgtc

SEQ ID NO: 2805309 - DNA, 19 bp, Homo sapiens
agggttgtgattttgtctg

SEQ ID NO: 2805310 - DNA, 19 bp, Homo sapiens
agggtttgaggattcctga

SEQ ID NO: 2805311 - DNA, 15 bp, Homo sapiens
agggttttccaccct

SEQ ID NO: 2805312 - DNA, 18 bp, Homo sapiens
agggttttccaccctgga

SEQ ID NO: 2805313 - DNA, 22 bp, Homo sapiens
agggttttgccatgttggccag

SEQ ID NO: 2805314 - DNA, 16 bp, Homo sapiens
aggtaaaaatataaga

SEQ ID NO: 2805315 - DNA, 14 bp, Homo sapiens
aggtaacaggcaga

SEQ ID NO: 2805316 - DNA, 16 bp, Homo sapiens
aggtaacaggcagata

SEQ ID NO: 2805317 - DNA, 14 bp, Homo sapiens
aggtaatgagggac

SEQ ID NO: 2805318 - DNA, 17 bp, Homo sapiens
aggtaatgagggactgg

SEQ ID NO: 2805319 - DNA, 15 bp, Homo sapiens
aggtactaaatacct

SEQ ID NO: 2805320 - DNA, 20 bp, Homo sapiens
aggtagagtttgaaggaggt

SEQ ID NO: 2805321 - DNA, 21 bp, Homo sapiens
aggtagagtttgaaggaggtg

SEQ ID NO: 2805322 - DNA, 12 bp, Homo sapiens
aggtagcccagc

SEQ ID NO: 2805323 - DNA, 16 bp, Homo sapiens
aggtagcccagcactg

SEQ ID NO: 2805324 - DNA, 17 bp, Homo sapiens
aggtagcccagcactgt

SEQ ID NO: 2805325 - DNA, 21 bp, Homo sapiens
aggtagcccagcactgtgaag

SEQ ID NO: 2805326 - DNA, 22 bp, Homo sapiens
aggtagcccagcactgtgaaga

SEQ ID NO: 2805327 - DNA, 14 bp, Homo sapiens
aggtagctcccagc

SEQ ID NO: 2805328 - DNA, 13 bp, Homo sapiens
aggtatctccagg

SEQ ID NO: 2805329 - DNA, 22 bp, Homo sapiens
aggtatgaccttctaggaagct

SEQ ID NO: 2805330 - DNA, 20 bp, Homo sapiens
aggtcaaaatagtgccacta

SEQ ID NO: 2805331 - DNA, 13 bp, Homo sapiens
aggtcaacatcta

SEQ ID NO: 2805332 - DNA, 18 bp, Homo sapiens
aggtcaacatctaagcct

SEQ ID NO: 2805333 - DNA, 15 bp, Homo sapiens
aggtcagagcctgca

SEQ ID NO: 2805334 - DNA, 17 bp, Homo sapiens
aggtcagagcctgcagt

SEQ ID NO: 2805335 - DNA, 18 bp, Homo sapiens
aggtcagagcctgcagtt

SEQ ID NO: 2805336 - DNA, 16 bp, Homo sapiens
aggtcaggagttccta

SEQ ID NO: 2805337 - DNA, 11 bp, Homo sapiens
aggtcccaggc

SEQ ID NO: 2805338 - DNA, 15 bp, Homo sapiens
aggtcctcagagaat

SEQ ID NO: 2805339 - DNA, 20 bp, Homo sapiens
aggtcctctgatacccagag

SEQ ID NO: 2805340 - DNA, 12 bp, Homo sapiens
aggtcctgagca

SEQ ID NO: 2805341 - DNA, 15 bp, Homo sapiens
aggtcctgagcactg

SEQ ID NO: 2805342 - DNA, 21 bp, Homo sapiens
aggtcgaccccaaagcccctt

SEQ ID NO: 2805343 - DNA, 13 bp, Homo sapiens
agtgtcttccata

SEQ ID NO: 2805344 - DNA, 15 bp, Homo sapiens
agtgtcttccataat

SEQ ID NO: 2805345 - DNA, 15 bp, Homo sapiens
agtgtgaaatagaca

SEQ ID NO: 2805346 - DNA, 17 bp, Homo sapiens
agtgtgaccaaaagtta

SEQ ID NO: 2805347 - DNA, 19 bp, Homo sapiens
agtgtgaccaaaagttaca

SEQ ID NO: 2805348 - DNA, 14 bp, Homo sapiens
agtgtgaccaggca

SEQ ID NO: 2805349 - DNA, 21 bp, Homo sapiens
agtgtggtagggacttaaaaa

SEQ ID NO: 2805350 - DNA, 19 bp, Homo sapiens
agtgtgtcacactgagctg

SEQ ID NO: 2805351 - DNA, 21 bp, Homo sapiens
agtgtgttgggaattgcatgc

SEQ ID NO: 2805352 - DNA, 16 bp, Homo sapiens
agtgttatcagtcata

SEQ ID NO: 2805353 - DNA, 17 bp, Homo sapiens
agtgttcctcaccaata

SEQ ID NO: 2805354 - DNA, 16 bp, Homo sapiens
agtgttgaaaatgttc

SEQ ID NO: 2805355 - DNA, 13 bp, Homo sapiens
agtgttgaagaag

SEQ ID NO: 2805356 - DNA, 20 bp, Homo sapiens
agtgtttagaagagcctgac

SEQ ID NO: 2805357 - DNA, 14 bp, Homo sapiens
agttaactttcaga

SEQ ID NO: 2805358 - DNA, 16 bp, Homo sapiens
agttaagcagcctttc

SEQ ID NO: 2805359 - DNA, 16 bp, Homo sapiens
agttacaaaaatagta

SEQ ID NO: 2805360 - DNA, 16 bp, Homo sapiens
agttacagatgcaccc

SEQ ID NO: 2805361 - DNA, 19 bp, Homo sapiens
agttactcttcagttttag

SEQ ID NO: 2805362 - DNA, 15 bp, Homo sapiens
agttacttcctatca

SEQ ID NO: 2805363 - DNA, 17 bp, Homo sapiens
agttagcaggaaatagt

SEQ ID NO: 2805364 - DNA, 18 bp, Homo sapiens
agttagcaggaaatagtg

SEQ ID NO: 2805365 - DNA, 22 bp, Homo sapiens
agttagctttaacttaaatagt

SEQ ID NO: 2805366 - DNA, 21 bp, Homo sapiens
agttaggaaataaaacctttc

SEQ ID NO: 2805367 - DNA, 22 bp, Homo sapiens
agttaggaaataaaacctttca

SEQ ID NO: 2805368 - DNA, 14 bp, Homo sapiens
agttaggtgtgcca

SEQ ID NO: 2805369 - DNA, 19 bp, Homo sapiens
agttaggttataagaaaca

SEQ ID NO: 2805370 - DNA, 21 bp, Homo sapiens
agttagtgtgttgtctgtgca

SEQ ID NO: 2805371 - DNA, 12 bp, Homo sapiens
agttataaaaat

SEQ ID NO: 2805372 - DNA, 14 bp, Homo sapiens
agttataaaaatac

SEQ ID NO: 2805373 - DNA, 15 bp, Homo sapiens
agttatctaagttaa

SEQ ID NO: 2805374 - DNA, 14 bp, Homo sapiens
agttatgtgaatga

SEQ ID NO: 2805375 - DNA, 12 bp, Homo sapiens
agttattttagg

SEQ ID NO: 2805376 - DNA, 15 bp, Homo sapiens
agttattttaggaga

SEQ ID NO: 2805377 - DNA, 14 bp, Homo sapiens
agttcaaattttgc

SEQ ID NO: 2805378 - DNA, 13 bp, Homo sapiens
agttcaacatgtt

SEQ ID NO: 2805379 - DNA, 18 bp, Homo sapiens
agttcaataaatgtctgt

SEQ ID NO: 2805380 - DNA, 19 bp, Homo sapiens
agttcaataaatgtctgtt

SEQ ID NO: 2805381 - DNA, 16 bp, Homo sapiens
agttcaattctcattt

SEQ ID NO: 2805382 - DNA, 16 bp, Homo sapiens
agttcactataaatgg

SEQ ID NO: 2805383 - DNA, 18 bp, Homo sapiens
agttcaggtaacaggcag

SEQ ID NO: 2805384 - DNA, 20 bp, Homo sapiens
agttcaggtaacaggcagat

SEQ ID NO: 2805385 - DNA, 21 bp, Homo sapiens
agttcatgagaatctatattt

SEQ ID NO: 2805386 - DNA, 14 bp, Homo sapiens
agttccctgaaaac

SEQ ID NO: 2805387 - DNA, 21 bp, Homo sapiens
agttccctgaaaacccagaga

SEQ ID NO: 2805388 - DNA, 16 bp, Homo sapiens
agttctctcgtaactg

SEQ ID NO: 2805389 - DNA, 13 bp, Homo sapiens
agttctgaaaact

SEQ ID NO: 2805390 - DNA, 19 bp, Homo sapiens
agttctgaaaactgtttat

SEQ ID NO: 2805391 - DNA, 15 bp, Homo sapiens
agttctgagtgtttt

SEQ ID NO: 2805392 - DNA, 22 bp, Homo sapiens
agttctgagtgtttttactaca

SEQ ID NO: 2805393 - DNA, 15 bp, Homo sapiens
agttctgctcctctc

SEQ ID NO: 2805394 - DNA, 17 bp, Homo sapiens
agttctgctcctctcca

SEQ ID NO: 2805395 - DNA, 22 bp, Homo sapiens
agttcttgtctgattggctcac

SEQ ID NO: 2805396 - DNA, 14 bp, Homo sapiens
agttcttgtgccat

SEQ ID NO: 2805397 - DNA, 20 bp, Homo sapiens
agttctttaggtgcctcctg

SEQ ID NO: 2805398 - DNA, 14 bp, Homo sapiens
agttgaacatctca

SEQ ID NO: 2805399 - DNA, 22 bp, Homo sapiens
agttgagtctcctctctgagac

SEQ ID NO: 2805400 - DNA, 23 bp, Homo sapiens
agttgagtctcctctctgagact

SEQ ID NO: 2805401 - DNA, 17 bp, Homo sapiens
agttgataaagattttt

SEQ ID NO: 2805402 - DNA, 21 bp, Homo sapiens
agttgataaagattttttaat

SEQ ID NO: 2805403 - DNA, 15 bp, Homo sapiens
agttgcaataaaata

SEQ ID NO: 2805404 - DNA, 16 bp, Homo sapiens
agttgcagactcagtt

SEQ ID NO: 2805405 - DNA, 20 bp, Homo sapiens
agttgccatgtagacccctt

SEQ ID NO: 2805406 - DNA, 21 bp, Homo sapiens
agttggaaccgtgtccagcac

SEQ ID NO: 2805407 - DNA, 19 bp, Homo sapiens
agttggagaaaatgaagaa

SEQ ID NO: 2805408 - DNA, 13 bp, Homo sapiens
agttgtgatcatc

SEQ ID NO: 2805409 - DNA, 19 bp, Homo sapiens
agttgttccttaagtcaga

SEQ ID NO: 2805410 - DNA, 19 bp, Homo sapiens
agttgttttcagactcaga

SEQ ID NO: 2805411 - DNA, 12 bp, Homo sapiens
agtttaaaaaat

SEQ ID NO: 2805412 - DNA, 22 bp, Homo sapiens
agtttaatggtgccttcatttg

SEQ ID NO: 2805413 - DNA, 14 bp, Homo sapiens
agtttactatttta

SEQ ID NO: 2805414 - DNA, 21 bp, Homo sapiens
agtttagaggaaaaaaatgac

SEQ ID NO: 2805415 - DNA, 16 bp, Homo sapiens
agtttaggcctatcaa

SEQ ID NO: 2805416 - DNA, 23 bp, Homo sapiens
agtttataagcccaaatggctct

SEQ ID NO: 2805417 - DNA, 16 bp, Homo sapiens
agtttatatttaactc

SEQ ID NO: 2805418 - DNA, 22 bp, Homo sapiens
agtttattgacaataatttcag

SEQ ID NO: 2805419 - DNA, 16 bp, Homo sapiens
agtttatttgttgaga

SEQ ID NO: 2805420 - DNA, 18 bp, Homo sapiens
agtttatttgttgagagt

SEQ ID NO: 2805421 - DNA, 20 bp, Homo sapiens
agtttatttgttgagagtgt

SEQ ID NO: 2805422 - DNA, 14 bp, Homo sapiens
agtttattttgtta

SEQ ID NO: 2805423 - DNA, 17 bp, Homo sapiens
agtttattttttctaca

SEQ ID NO: 2805424 - DNA, 18 bp, Homo sapiens
agtttattttttctacac

SEQ ID NO: 2805425 - DNA, 13 bp, Homo sapiens
agtttcaccattt

SEQ ID NO: 2805426 - DNA, 16 bp, Homo sapiens
agtttcatataaagta

SEQ ID NO: 2805427 - DNA, 15 bp, Homo sapiens
agtttctcagctccc

SEQ ID NO: 2805428 - DNA, 16 bp, Homo sapiens
agtttctcagctccca

SEQ ID NO: 2805429 - DNA, 17 bp, Homo sapiens
agtttctgggacctcag

SEQ ID NO: 2805430 - DNA, 18 bp, Homo sapiens
agtttcttggtctcagct

SEQ ID NO: 2805431 - DNA, 19 bp, Homo sapiens
agtttcttggtctcagctt

SEQ ID NO: 2805432 - DNA, 13 bp, Homo sapiens
agtttctttggga

SEQ ID NO: 2805433 - DNA, 16 bp, Homo sapiens
agtttgagaccagcct

SEQ ID NO: 2805434 - DNA, 15 bp, Homo sapiens
atatacatgtatagt

SEQ ID NO: 2805435 - DNA, 14 bp, Homo sapiens
atataggagcaata

SEQ ID NO: 2805436 - DNA, 20 bp, Homo sapiens
atatagtatatttatactct

SEQ ID NO: 2805437 - DNA, 21 bp, Homo sapiens
atatagtatatttatactcta

SEQ ID NO: 2805438 - DNA, 24 bp, Homo sapiens
atatagtttgtggtaaaaagatta

SEQ ID NO: 2805439 - DNA, 17 bp, Homo sapiens
atatatacatgtatagt

SEQ ID NO: 2805440 - DNA, 16 bp, Homo sapiens
atatatatatatatgt

SEQ ID NO: 2805441 - DNA, 14 bp, Homo sapiens
atatatatatatgt

SEQ ID NO: 2805442 - DNA, 13 bp, Homo sapiens
atatatatatgta

SEQ ID NO: 2805443 - DNA, 14 bp, Homo sapiens
atatatatatgtat

SEQ ID NO: 2805444 - DNA, 21 bp, Homo sapiens
atatatatctatctatttgag

SEQ ID NO: 2805445 - DNA, 15 bp, Homo sapiens
atatatatgtacagt

SEQ ID NO: 2805446 - DNA, 14 bp, Homo sapiens
atatatatgtatat

SEQ ID NO: 2805447 - DNA, 16 bp, Homo sapiens
atatatctatctattt

SEQ ID NO: 2805448 - DNA, 18 bp, Homo sapiens
atatatctatctatttga

SEQ ID NO: 2805449 - DNA, 20 bp, Homo sapiens
atatatctatctatttgagg

SEQ ID NO: 2805450 - DNA, 15 bp, Homo sapiens
atatatctatcttat

SEQ ID NO: 2805451 - DNA, 18 bp, Homo sapiens
atatatctgaaaactgga

SEQ ID NO: 2805452 - DNA, 13 bp, Homo sapiens
atatatgaggact

SEQ ID NO: 2805453 - DNA, 18 bp, Homo sapiens
atatatgctcaaccagaa

SEQ ID NO: 2805454 - DNA, 16 bp, Homo sapiens
atatatgtatatgtat

SEQ ID NO: 2805455 - DNA, 19 bp, Homo sapiens
atatatgtatatgtatata

SEQ ID NO: 2805456 - DNA, 23 bp, Homo sapiens
atatatgtatatgtatatctata

SEQ ID NO: 2805457 - DNA, 12 bp, Homo sapiens
atatatgtattt

SEQ ID NO: 2805458 - DNA, 21 bp, Homo sapiens
atatatgttttaagaggcagg

SEQ ID NO: 2805459 - DNA, 21 bp, Homo sapiens
atatattcatgtaataaatct

SEQ ID NO: 2805460 - DNA, 19 bp, Homo sapiens
atatattctacacatatat

SEQ ID NO: 2805461 - DNA, 23 bp, Homo sapiens
atatattctacacatatatgtat

SEQ ID NO: 2805462 - DNA, 21 bp, Homo sapiens
atatattggtaacatcctttc

SEQ ID NO: 2805463 - DNA, 17 bp, Homo sapiens
atatatttactaaaaga

SEQ ID NO: 2805464 - DNA, 19 bp, Homo sapiens
atatatttactaaaagaat

SEQ ID NO: 2805465 - DNA, 20 bp, Homo sapiens
atatatttttcaaccagcat

SEQ ID NO: 2805466 - DNA, 22 bp, Homo sapiens
atatatttttcaaccagcattt

SEQ ID NO: 2805467 - DNA, 21 bp, Homo sapiens
atatatttttcacagtttttc

SEQ ID NO: 2805468 - DNA, 15 bp, Homo sapiens
atatatttttggttg

SEQ ID NO: 2805469 - DNA, 14 bp, Homo sapiens
atatcaaggatgtt

SEQ ID NO: 2805470 - DNA, 17 bp, Homo sapiens
atatcaaggatgttctg

SEQ ID NO: 2805471 - DNA, 12 bp, Homo sapiens
atatcaattcaa

SEQ ID NO: 2805472 - DNA, 13 bp, Homo sapiens
atatcagaaaagt

SEQ ID NO: 2805473 - DNA, 14 bp, Homo sapiens
atatcagaaaagta

SEQ ID NO: 2805474 - DNA, 16 bp, Homo sapiens
atatcagacctctgat

SEQ ID NO: 2805475 - DNA, 14 bp, Homo sapiens
atatcagcctgagt

SEQ ID NO: 2805476 - DNA, 20 bp, Homo sapiens
atatcagcctgagtctcctg

SEQ ID NO: 2805477 - DNA, 22 bp, Homo sapiens
atatcagcctgagtctcctgtg

SEQ ID NO: 2805478 - DNA, 17 bp, Homo sapiens
atatcagttactcagcc

SEQ ID NO: 2805479 - DNA, 20 bp, Homo sapiens
atatcagttactcagccctg

SEQ ID NO: 2805480 - DNA, 13 bp, Homo sapiens
atatcataaagta

SEQ ID NO: 2805481 - DNA, 15 bp, Homo sapiens
atatcataaagtatg

SEQ ID NO: 2805482 - DNA, 18 bp, Homo sapiens
atatcatcagcatacctt

SEQ ID NO: 2805483 - DNA, 14 bp, Homo sapiens
atatcatgaaacac

SEQ ID NO: 2805484 - DNA, 23 bp, Homo sapiens
atatcattataactgaaggagaa

SEQ ID NO: 2805485 - DNA, 20 bp, Homo sapiens
atatccacatctttaagtat

SEQ ID NO: 2805486 - DNA, 14 bp, Homo sapiens
atatctaatttata

SEQ ID NO: 2805487 - DNA, 16 bp, Homo sapiens
atatctatctatttga

SEQ ID NO: 2805488 - DNA, 21 bp, Homo sapiens
atatctattattataaaaata

SEQ ID NO: 2805489 - DNA, 12 bp, Homo sapiens
atatctcatctc

SEQ ID NO: 2805490 - DNA, 22 bp, Homo sapiens
atatctcctgaaaaggtttatg

SEQ ID NO: 2805491 - DNA, 11 bp, Homo sapiens
atatctgaaaa

SEQ ID NO: 2805492 - DNA, 17 bp, Homo sapiens
atatctgaaaactggaa

SEQ ID NO: 2805493 - DNA, 23 bp, Homo sapiens
atatctgaaaactggaataagaa

SEQ ID NO: 2805494 - DNA, 14 bp, Homo sapiens
atatcttgaagaat

SEQ ID NO: 2805495 - DNA, 16 bp, Homo sapiens
atatcttgaagaatat

SEQ ID NO: 2805496 - DNA, 17 bp, Homo sapiens
atatgaaaaatatgata

SEQ ID NO: 2805497 - DNA, 18 bp, Homo sapiens
atatgaaaaatatgatat

SEQ ID NO: 2805498 - DNA, 17 bp, Homo sapiens
atatgaaatgtttcact

SEQ ID NO: 2805499 - DNA, 11 bp, Homo sapiens
atatgaacaaa

SEQ ID NO: 2805500 - DNA, 19 bp, Homo sapiens
atatgaagtaagttctgaa

SEQ ID NO: 2805501 - DNA, 15 bp, Homo sapiens
atatgatattgcata

SEQ ID NO: 2805502 - DNA, 16 bp, Homo sapiens
atatgatcatgtaaat

SEQ ID NO: 2805503 - DNA, 20 bp, Homo sapiens
atatgcaccttgtgtctgta

SEQ ID NO: 2805504 - DNA, 18 bp, Homo sapiens
atatgctgccaaattttg

SEQ ID NO: 2805505 - DNA, 22 bp, Homo sapiens
atatgctgccaaattttggcca

SEQ ID NO: 2805506 - DNA, 15 bp, Homo sapiens
atatggactctgcac

SEQ ID NO: 2805507 - DNA, 15 bp, Homo sapiens
atatgtaaaacattt

SEQ ID NO: 2805508 - DNA, 24 bp, Homo sapiens
atatgtaaaacatttattttgaca

SEQ ID NO: 2805509 - DNA, 12 bp, Homo sapiens
atatgtaaaata

SEQ ID NO: 2805510 - DNA, 15 bp, Homo sapiens
atatgtaaaataaaa

SEQ ID NO: 2805511 - DNA, 16 bp, Homo sapiens
atatgtaacaagccac

SEQ ID NO: 2805512 - DNA, 19 bp, Homo sapiens
atatgtacagttatacata

SEQ ID NO: 2805513 - DNA, 16 bp, Homo sapiens
atatgtacagttatct

SEQ ID NO: 2805514 - DNA, 22 bp, Homo sapiens
atatgtagccttgccttttaaa

SEQ ID NO: 2805515 - DNA, 14 bp, Homo sapiens
atatgtatatatat

SEQ ID NO: 2805516 - DNA, 14 bp, Homo sapiens
atatgtatatgtat

SEQ ID NO: 2805517 - DNA, 18 bp, Homo sapiens
atatgtatatgtatatat

SEQ ID NO: 2805518 - DNA, 16 bp, Homo sapiens
atatgtatgtgtgtat

SEQ ID NO: 2805519 - DNA, 16 bp, Homo sapiens
atatgtattaatattc

SEQ ID NO: 2805520 - DNA, 20 bp, Homo sapiens
atatgtatttattgtcatta

SEQ ID NO: 2805521 - DNA, 12 bp, Homo sapiens
atatgttcaact

SEQ ID NO: 2805522 - DNA, 14 bp, Homo sapiens
atatgttcattaaa

SEQ ID NO: 2805523 - DNA, 13 bp, Homo sapiens
atatgttgctgaa

SEQ ID NO: 2805524 - DNA, 17 bp, Homo sapiens
atattaaatacagacac

SEQ ID NO: 2805525 - DNA, 17 bp, Homo sapiens
atgactgtttttgtagt

SEQ ID NO: 2805526 - DNA, 23 bp, Homo sapiens
atgacttgggcacccccagcctg

SEQ ID NO: 2805527 - DNA, 13 bp, Homo sapiens
atgactttttata

SEQ ID NO: 2805528 - DNA, 12 bp, Homo sapiens
atgagaaatgtg

SEQ ID NO: 2805529 - DNA, 11 bp, Homo sapiens
atgagaagtta

SEQ ID NO: 2805530 - DNA, 11 bp, Homo sapiens
atgagaatcta

SEQ ID NO: 2805531 - DNA, 21 bp, Homo sapiens
atgagacccattcctatttct

SEQ ID NO: 2805532 - DNA, 13 bp, Homo sapiens
atgagatccttta

SEQ ID NO: 2805533 - DNA, 22 bp, Homo sapiens
atgagatctaagcctttccata

SEQ ID NO: 2805534 - DNA, 23 bp, Homo sapiens
atgagatctaagcctttccataa

SEQ ID NO: 2805535 - DNA, 20 bp, Homo sapiens
atgagattccctctcctccc

SEQ ID NO: 2805536 - DNA, 13 bp, Homo sapiens
atgagcagtcaca

SEQ ID NO: 2805537 - DNA, 16 bp, Homo sapiens
atgagcctcagcatcc

SEQ ID NO: 2805538 - DNA, 18 bp, Homo sapiens
atgagcctcagcatcctg

SEQ ID NO: 2805539 - DNA, 22 bp, Homo sapiens
atgagctcctcttcctggcttc

SEQ ID NO: 2805540 - DNA, 16 bp, Homo sapiens
atgagctcctgcggga

SEQ ID NO: 2805541 - DNA, 16 bp, Homo sapiens
atgagctcttcatgtt

SEQ ID NO: 2805542 - DNA, 22 bp, Homo sapiens
atgaggaacctcaaactgggta

SEQ ID NO: 2805543 - DNA, 22 bp, Homo sapiens
atgaggcctcttggacctctgc

SEQ ID NO: 2805544 - DNA, 20 bp, Homo sapiens
atgaggcctttccccagtgt

SEQ ID NO: 2805545 - DNA, 13 bp, Homo sapiens
atgagggactgga

SEQ ID NO: 2805546 - DNA, 16 bp, Homo sapiens
atgagggatcacaggg

SEQ ID NO: 2805547 - DNA, 14 bp, Homo sapiens
atgagggcagcagc

SEQ ID NO: 2805548 - DNA, 18 bp, Homo sapiens
atgagggcagcagccagc

SEQ ID NO: 2805549 - DNA, 16 bp, Homo sapiens
atgaggtcagagcctg

SEQ ID NO: 2805550 - DNA, 20 bp, Homo sapiens
atgaggtcagagcctgcagt

SEQ ID NO: 2805551 - DNA, 22 bp, Homo sapiens
atgaggtcagagcctgcagtta

SEQ ID NO: 2805552 - DNA, 17 bp, Homo sapiens
atgaggtctgaaatgga

SEQ ID NO: 2805553 - DNA, 20 bp, Homo sapiens
atgagtcagacatttggtat

SEQ ID NO: 2805554 - DNA, 23 bp, Homo sapiens
atgagtgattgacacacagcact

SEQ ID NO: 2805555 - DNA, 15 bp, Homo sapiens
atgagtttatgggaa

SEQ ID NO: 2805556 - DNA, 13 bp, Homo sapiens
atgagtttttgat

SEQ ID NO: 2805557 - DNA, 15 bp, Homo sapiens
atgataaagatgtca

SEQ ID NO: 2805558 - DNA, 13 bp, Homo sapiens
atgatatgtaaac

SEQ ID NO: 2805559 - DNA, 14 bp, Homo sapiens
atgatcacatggaa

SEQ ID NO: 2805560 - DNA, 18 bp, Homo sapiens
atgatcacggctcactgc

SEQ ID NO: 2805561 - DNA, 12 bp, Homo sapiens
atgatctcagga

SEQ ID NO: 2805562 - DNA, 15 bp, Homo sapiens
atgatctgactttaa

SEQ ID NO: 2805563 - DNA, 18 bp, Homo sapiens
atgatctttgcagacagg

SEQ ID NO: 2805564 - DNA, 19 bp, Homo sapiens
atgatctttgcagacaggc

SEQ ID NO: 2805565 - DNA, 14 bp, Homo sapiens
atgatgaccaagaa

SEQ ID NO: 2805566 - DNA, 20 bp, Homo sapiens
atgatgattaaacacctgac

SEQ ID NO: 2805567 - DNA, 13 bp, Homo sapiens
atgatgccaaaat

SEQ ID NO: 2805568 - DNA, 17 bp, Homo sapiens
atgatggatgagaaaaa

SEQ ID NO: 2805569 - DNA, 19 bp, Homo sapiens
atgatggcaattttgtaac

SEQ ID NO: 2805570 - DNA, 23 bp, Homo sapiens
atgatgtccagaagaatattcag

SEQ ID NO: 2805571 - DNA, 16 bp, Homo sapiens
atgattaaacacctga

SEQ ID NO: 2805572 - DNA, 18 bp, Homo sapiens
atgattaaacacctgaca

SEQ ID NO: 2805573 - DNA, 19 bp, Homo sapiens
atgattaaacacctgacac

SEQ ID NO: 2805574 - DNA, 21 bp, Homo sapiens
atgattaaacacctgacacat

SEQ ID NO: 2805575 - DNA, 15 bp, Homo sapiens
atgattcataacaat

SEQ ID NO: 2805576 - DNA, 17 bp, Homo sapiens
atgattgtttaattgta

SEQ ID NO: 2805577 - DNA, 22 bp, Homo sapiens
atgatttaaaaaataaatataa

SEQ ID NO: 2805578 - DNA, 23 bp, Homo sapiens
atgatttaaaaaataaatataat

SEQ ID NO: 2805579 - DNA, 20 bp, Homo sapiens
atgatttcaatgattgttta

SEQ ID NO: 2805580 - DNA, 14 bp, Homo sapiens
atgattttatacat

SEQ ID NO: 2805581 - DNA, 19 bp, Homo sapiens
atgattttatacatagtca

SEQ ID NO: 2805582 - DNA, 14 bp, Homo sapiens
atgattttctattt

SEQ ID NO: 2805583 - DNA, 14 bp, Homo sapiens
atgcaacaacatgt

SEQ ID NO: 2805584 - DNA, 15 bp, Homo sapiens
atgcaagaagaatat

SEQ ID NO: 2805585 - DNA, 13 bp, Homo sapiens
atgcaaggaagga

SEQ ID NO: 2805586 - DNA, 15 bp, Homo sapiens
atgcaaggaaggaaa

SEQ ID NO: 2805587 - DNA, 13 bp, Homo sapiens
atgcaatatgtat

SEQ ID NO: 2805588 - DNA, 14 bp, Homo sapiens
atgcaatatgtatt

SEQ ID NO: 2805589 - DNA, 12 bp, Homo sapiens
atgcacaattta

SEQ ID NO: 2805590 - DNA, 15 bp, Homo sapiens
atgcacaatttagaa

SEQ ID NO: 2805591 - DNA, 19 bp, Homo sapiens
atgcacatatggactctgc

SEQ ID NO: 2805592 - DNA, 13 bp, Homo sapiens
atgcacatttata

SEQ ID NO: 2805593 - DNA, 17 bp, Homo sapiens
atgcacatttatatata

SEQ ID NO: 2805594 - DNA, 21 bp, Homo sapiens
atgcacatttatatatatatg

SEQ ID NO: 2805595 - DNA, 14 bp, Homo sapiens
atgcaccagccctt

SEQ ID NO: 2805596 - DNA, 20 bp, Homo sapiens
atgcaccagtgccgcctgtg

SEQ ID NO: 2805597 - DNA, 22 bp, Homo sapiens
atgcaccagtgccgcctgtgcc

SEQ ID NO: 2805598 - DNA, 16 bp, Homo sapiens
atgcaccttgtgtctg

SEQ ID NO: 2805599 - DNA, 12 bp, Homo sapiens
atgcagcttcat

SEQ ID NO: 2805600 - DNA, 14 bp, Homo sapiens
atgcagcttcatca

SEQ ID NO: 2805601 - DNA, 18 bp, Homo sapiens
atgcagcttcatcaattt

SEQ ID NO: 2805602 - DNA, 20 bp, Homo sapiens
atgcagtccagaataagtgc

SEQ ID NO: 2805603 - DNA, 23 bp, Homo sapiens
atgcagtccagaataagtgctgt

SEQ ID NO: 2805604 - DNA, 23 bp, Homo sapiens
atgcagtggtatgatcacggctc

SEQ ID NO: 2805605 - DNA, 14 bp, Homo sapiens
atgcataaatgcat

SEQ ID NO: 2805606 - DNA, 18 bp, Homo sapiens
atgcatccattcctcagg

SEQ ID NO: 2805607 - DNA, 22 bp, Homo sapiens
atgcatccattcctcagggaca

SEQ ID NO: 2805608 - DNA, 15 bp, Homo sapiens
atgcatgattttata

SEQ ID NO: 2805609 - DNA, 17 bp, Homo sapiens
atgcatgattttataca

SEQ ID NO: 2805610 - DNA, 18 bp, Homo sapiens
atgcatgattttatacat

SEQ ID NO: 2805611 - DNA, 21 bp, Homo sapiens
atgcatgattttatacatagt

SEQ ID NO: 2805612 - DNA, 22 bp, Homo sapiens
atgcatgattttatacatagtc

SEQ ID NO: 2805613 - DNA, 19 bp, Homo sapiens
atgcattttgcagcagtga

SEQ ID NO: 2805614 - DNA, 18 bp, Homo sapiens
atgccaaaatattgctta

SEQ ID NO: 2805615 - DNA, 18 bp, Homo sapiens
atgccaaagcaaaagaag

SEQ ID NO: 2805616 - DNA, 15 bp, Homo sapiens
attcactgtaagttt

SEQ ID NO: 2805617 - DNA, 16 bp, Homo sapiens
attcagaagaaaaaga

SEQ ID NO: 2805618 - DNA, 20 bp, Homo sapiens
attcagagatgtaccatgtt

SEQ ID NO: 2805619 - DNA, 20 bp, Homo sapiens
attcaggaaaaggcctgggg

SEQ ID NO: 2805620 - DNA, 16 bp, Homo sapiens
attcaggaagatgaaa

SEQ ID NO: 2805621 - DNA, 18 bp, Homo sapiens
attcagtccgcctggccg

SEQ ID NO: 2805622 - DNA, 17 bp, Homo sapiens
attcagtgctgtggcct

SEQ ID NO: 2805623 - DNA, 17 bp, Homo sapiens
attcagtgcttcttaaa

SEQ ID NO: 2805624 - DNA, 14 bp, Homo sapiens
attcataacaatgt

SEQ ID NO: 2805625 - DNA, 15 bp, Homo sapiens
attcataattagaac

SEQ ID NO: 2805626 - DNA, 16 bp, Homo sapiens
attcataattagaaca

SEQ ID NO: 2805627 - DNA, 20 bp, Homo sapiens
attcatccagttgcaataaa

SEQ ID NO: 2805628 - DNA, 21 bp, Homo sapiens
attcatccagttgcaataaaa

SEQ ID NO: 2805629 - DNA, 21 bp, Homo sapiens
attcatgccaaagcaaaagaa

SEQ ID NO: 2805630 - DNA, 15 bp, Homo sapiens
attcatgtaataaat

SEQ ID NO: 2805631 - DNA, 18 bp, Homo sapiens
attcatgtaataaatctg

SEQ ID NO: 2805632 - DNA, 19 bp, Homo sapiens
attcatgtaataaatctga

SEQ ID NO: 2805633 - DNA, 17 bp, Homo sapiens
attcatttcactttaaa

SEQ ID NO: 2805634 - DNA, 18 bp, Homo sapiens
attcattttaacatctga

SEQ ID NO: 2805635 - DNA, 21 bp, Homo sapiens
attccaaacttctaaatgttg

SEQ ID NO: 2805636 - DNA, 14 bp, Homo sapiens
attccaacagctca

SEQ ID NO: 2805637 - DNA, 20 bp, Homo sapiens
attccaacagctcaagtctt

SEQ ID NO: 2805638 - DNA, 18 bp, Homo sapiens
attccacagtctctggga

SEQ ID NO: 2805639 - DNA, 18 bp, Homo sapiens
attccatccatatacttt

SEQ ID NO: 2805640 - DNA, 13 bp, Homo sapiens
attccatgatttt

SEQ ID NO: 2805641 - DNA, 15 bp, Homo sapiens
attccatgattttac

SEQ ID NO: 2805642 - DNA, 16 bp, Homo sapiens
attccatgattttaca

SEQ ID NO: 2805643 - DNA, 17 bp, Homo sapiens
attccatgattttacag

SEQ ID NO: 2805644 - DNA, 20 bp, Homo sapiens
attccatgattttacagaga

SEQ ID NO: 2805645 - DNA, 21 bp, Homo sapiens
attccatgattttacagagaa

SEQ ID NO: 2805646 - DNA, 15 bp, Homo sapiens
attcccaagctctgc

SEQ ID NO: 2805647 - DNA, 16 bp, Homo sapiens
attcccaagctctgct

SEQ ID NO: 2805648 - DNA, 18 bp, Homo sapiens
attcccaagctctgctcc

SEQ ID NO: 2805649 - DNA, 19 bp, Homo sapiens
attcccaagctctgctcct

SEQ ID NO: 2805650 - DNA, 12 bp, Homo sapiens
attcccagagac

SEQ ID NO: 2805651 - DNA, 16 bp, Homo sapiens
attcccagagacagga

SEQ ID NO: 2805652 - DNA, 19 bp, Homo sapiens
attcccagagcaaaataat

SEQ ID NO: 2805653 - DNA, 14 bp, Homo sapiens
attcccagctgtct

SEQ ID NO: 2805654 - DNA, 16 bp, Homo sapiens
attcccagctgtctgt

SEQ ID NO: 2805655 - DNA, 15 bp, Homo sapiens
attcccattttgcaa

SEQ ID NO: 2805656 - DNA, 20 bp, Homo sapiens
attcccattttgcaaaattt

SEQ ID NO: 2805657 - DNA, 23 bp, Homo sapiens
attcccattttgcaaaatttcca

SEQ ID NO: 2805658 - DNA, 19 bp, Homo sapiens
attccctatcaaaacatat

SEQ ID NO: 2805659 - DNA, 18 bp, Homo sapiens
attccctctcccaggccc

SEQ ID NO: 2805660 - DNA, 14 bp, Homo sapiens
attccctcttgcta

SEQ ID NO: 2805661 - DNA, 13 bp, Homo sapiens
attccctggcctg

SEQ ID NO: 2805662 - DNA, 19 bp, Homo sapiens
attccctggcctggctctc

SEQ ID NO: 2805663 - DNA, 20 bp, Homo sapiens
attccctggcctggctctcc

SEQ ID NO: 2805664 - DNA, 19 bp, Homo sapiens
attccctgtacaatattta

SEQ ID NO: 2805665 - DNA, 21 bp, Homo sapiens
attccctgtacaatatttaaa

SEQ ID NO: 2805666 - DNA, 14 bp, Homo sapiens
attcctaagcagtg

SEQ ID NO: 2805667 - DNA, 18 bp, Homo sapiens
attcctacaaagatgttt

SEQ ID NO: 2805668 - DNA, 24 bp, Homo sapiens
attcctggtattatttacaatgca

SEQ ID NO: 2805669 - DNA, 18 bp, Homo sapiens
attcctgtagcatcttct

SEQ ID NO: 2805670 - DNA, 23 bp, Homo sapiens
attccttagcttagacctcagcc

SEQ ID NO: 2805671 - DNA, 23 bp, Homo sapiens
attcgtggtgatcaattaaatgt

SEQ ID NO: 2805672 - DNA, 14 bp, Homo sapiens
attctaaaatgatt

SEQ ID NO: 2805673 - DNA, 18 bp, Homo sapiens
attctaaatgaatgttta

SEQ ID NO: 2805674 - DNA, 19 bp, Homo sapiens
attctaacttttttgctat

SEQ ID NO: 2805675 - DNA, 19 bp, Homo sapiens
attctacacatatatgtat

SEQ ID NO: 2805676 - DNA, 20 bp, Homo sapiens
attctacacatatatgtata

SEQ ID NO: 2805677 - DNA, 22 bp, Homo sapiens
attctacagtttcttactgttt

SEQ ID NO: 2805678 - DNA, 17 bp, Homo sapiens
attctactaaatatttt

SEQ ID NO: 2805679 - DNA, 16 bp, Homo sapiens
attctaggtctgtaat

SEQ ID NO: 2805680 - DNA, 21 bp, Homo sapiens
attctcaacctaccacccctt

SEQ ID NO: 2805681 - DNA, 14 bp, Homo sapiens
attctcaccaggaa

SEQ ID NO: 2805682 - DNA, 12 bp, Homo sapiens
attctcatgtga

SEQ ID NO: 2805683 - DNA, 17 bp, Homo sapiens
attctcatttgtcacac

SEQ ID NO: 2805684 - DNA, 15 bp, Homo sapiens
attctccaaatgatt

SEQ ID NO: 2805685 - DNA, 22 bp, Homo sapiens
attctctctaaaaataaaatga

SEQ ID NO: 2805686 - DNA, 12 bp, Homo sapiens
attctctctcct

SEQ ID NO: 2805687 - DNA, 21 bp, Homo sapiens
attctgattcgaatgacactg

SEQ ID NO: 2805688 - DNA, 17 bp, Homo sapiens
attctgcctgcccaggc

SEQ ID NO: 2805689 - DNA, 19 bp, Homo sapiens
attctgctacctcactggg

SEQ ID NO: 2805690 - DNA, 21 bp, Homo sapiens
attctgggctcctggaaccaa

SEQ ID NO: 2805691 - DNA, 23 bp, Homo sapiens
attctgggctcctggaaccaatc

SEQ ID NO: 2805692 - DNA, 17 bp, Homo sapiens
attctgtgaagaatgaa

SEQ ID NO: 2805693 - DNA, 21 bp, Homo sapiens
attctgttggccagtgtgaca

SEQ ID NO: 2805694 - DNA, 23 bp, Homo sapiens
attcttaaaatatatttcagata

SEQ ID NO: 2805695 - DNA, 17 bp, Homo sapiens
attcttacaaacatgtg

SEQ ID NO: 2805696 - DNA, 12 bp, Homo sapiens
attcttcctagt

SEQ ID NO: 2805697 - DNA, 19 bp, Homo sapiens
attcttcctagttttctcc

SEQ ID NO: 2805698 - DNA, 14 bp, Homo sapiens
attcttctgcttca

SEQ ID NO: 2805699 - DNA, 19 bp, Homo sapiens
attcttctgcttcagcctc

SEQ ID NO: 2805700 - DNA, 20 bp, Homo sapiens
attcttctgcttcagcctcc

SEQ ID NO: 2805701 - DNA, 22 bp, Homo sapiens
attcttctgtacgtctgacagg

SEQ ID NO: 2805702 - DNA, 12 bp, Homo sapiens
attcttgtatat

SEQ ID NO: 2805703 - DNA, 13 bp, Homo sapiens
attcttgtcctgg

SEQ ID NO: 2805704 - DNA, 19 bp, Homo sapiens
attctttcaagtgaatcta

SEQ ID NO: 2805705 - DNA, 22 bp, Homo sapiens
attctttgtaccatctgtcttg

SEQ ID NO: 2805706 - DNA, 13 bp, Homo sapiens
atttttatacata

SEQ ID NO: 2805707 - DNA, 15 bp, Homo sapiens
atttttatacatatc

SEQ ID NO: 2805708 - DNA, 17 bp, Homo sapiens
atttttatacatatcag

SEQ ID NO: 2805709 - DNA, 12 bp, Homo sapiens
atttttatggaa

SEQ ID NO: 2805710 - DNA, 15 bp, Homo sapiens
atttttatggaattt

SEQ ID NO: 2805711 - DNA, 23 bp, Homo sapiens
atttttcaaccagcattttacta

SEQ ID NO: 2805712 - DNA, 18 bp, Homo sapiens
atttttcatgataatgaa

SEQ ID NO: 2805713 - DNA, 15 bp, Homo sapiens
atttttcttctaaaa

SEQ ID NO: 2805714 - DNA, 13 bp, Homo sapiens
atttttgataaat

SEQ ID NO: 2805715 - DNA, 17 bp, Homo sapiens
atttttgcaattattct

SEQ ID NO: 2805716 - DNA, 23 bp, Homo sapiens
atttttggaagaggactccttaa

SEQ ID NO: 2805717 - DNA, 19 bp, Homo sapiens
atttttggttgtcaatatt

SEQ ID NO: 2805718 - DNA, 22 bp, Homo sapiens
atttttgtttcttccaaagcac

SEQ ID NO: 2805719 - DNA, 17 bp, Homo sapiens
attttttaaaataattt

SEQ ID NO: 2805720 - DNA, 11 bp, Homo sapiens
attttttaagt

SEQ ID NO: 2805721 - DNA, 22 bp, Homo sapiens
attttttcagaaatatgtggtt

SEQ ID NO: 2805722 - DNA, 14 bp, Homo sapiens
attttttctacaca

SEQ ID NO: 2805723 - DNA, 18 bp, Homo sapiens
atttttttaaagatgccc

SEQ ID NO: 2805724 - DNA, 22 bp, Homo sapiens
atttttttaagttagagaatat

SEQ ID NO: 2805725 - DNA, 15 bp, Homo sapiens
atttttttcaatatt

SEQ ID NO: 2805726 - DNA, 16 bp, Homo sapiens
atttttttccttgcaa

SEQ ID NO: 2805727 - DNA, 17 bp, Homo sapiens
atttttttttcctagcc

SEQ ID NO: 2805728 - DNA, 16 bp, Homo sapiens
caaaaaaacactagtt

SEQ ID NO: 2805729 - DNA, 15 bp, Homo sapiens
caaaaacagcctcac

SEQ ID NO: 2805730 - DNA, 16 bp, Homo sapiens
caaaaacagcctcaca

SEQ ID NO: 2805731 - DNA, 14 bp, Homo sapiens
caaaaatagctaaa

SEQ ID NO: 2805732 - DNA, 20 bp, Homo sapiens
caaaaattagccggacgtgg

SEQ ID NO: 2805733 - DNA, 19 bp, Homo sapiens
caaaacaagaaagaaacgt

SEQ ID NO: 2805734 - DNA, 11 bp, Homo sapiens
caaaacaatgc

SEQ ID NO: 2805735 - DNA, 14 bp, Homo sapiens
caaaacaatgttta

SEQ ID NO: 2805736 - DNA, 16 bp, Homo sapiens
caaaacaatgtttaaa

SEQ ID NO: 2805737 - DNA, 13 bp, Homo sapiens
caaaacagattgt

SEQ ID NO: 2805738 - DNA, 16 bp, Homo sapiens
caaaacatatcaattc

SEQ ID NO: 2805739 - DNA, 21 bp, Homo sapiens
caaaacctcatgacagccaga

SEQ ID NO: 2805740 - DNA, 21 bp, Homo sapiens
caaaagaaaaaaaaaagcacc

SEQ ID NO: 2805741 - DNA, 12 bp, Homo sapiens
caaaagaagtaa

SEQ ID NO: 2805742 - DNA, 15 bp, Homo sapiens
caaaagaagtaaaag

SEQ ID NO: 2805743 - DNA, 15 bp, Homo sapiens
caaaagaatcagaaa

SEQ ID NO: 2805744 - DNA, 11 bp, Homo sapiens
caaaagctgct

SEQ ID NO: 2805745 - DNA, 13 bp, Homo sapiens
caaaaggtgcctg

SEQ ID NO: 2805746 - DNA, 23 bp, Homo sapiens
caaaaggtgcctgtgaggcaggg

SEQ ID NO: 2805747 - DNA, 18 bp, Homo sapiens
caaaagttacatgtttgc

SEQ ID NO: 2805748 - DNA, 17 bp, Homo sapiens
caaaagttcgaaagaaa

SEQ ID NO: 2805749 - DNA, 19 bp, Homo sapiens
caaaatattgcttatgtct

SEQ ID NO: 2805750 - DNA, 21 bp, Homo sapiens
caaaatcacaagcaataatta

SEQ ID NO: 2805751 - DNA, 22 bp, Homo sapiens
caaaatcatgaatatttcaaaa

SEQ ID NO: 2805752 - DNA, 18 bp, Homo sapiens
caaaatcgattggcttta

SEQ ID NO: 2805753 - DNA, 11 bp, Homo sapiens
caaaatgcaag

SEQ ID NO: 2805754 - DNA, 22 bp, Homo sapiens
caaaatgttgaaatatgatgtt

SEQ ID NO: 2805755 - DNA, 23 bp, Homo sapiens
caaaattttatagctcagtttat

SEQ ID NO: 2805756 - DNA, 13 bp, Homo sapiens
caaaattttattc

SEQ ID NO: 2805757 - DNA, 16 bp, Homo sapiens
caaacaccaacataaa

SEQ ID NO: 2805758 - DNA, 15 bp, Homo sapiens
caaacacctcccagg

SEQ ID NO: 2805759 - DNA, 22 bp, Homo sapiens
caaacatgtggcaacctgttct

SEQ ID NO: 2805760 - DNA, 20 bp, Homo sapiens
caaacatttcttaaaatgtt

SEQ ID NO: 2805761 - DNA, 18 bp, Homo sapiens
caaaccatttaattcata

SEQ ID NO: 2805762 - DNA, 22 bp, Homo sapiens
caaaccatttaattcataatta

SEQ ID NO: 2805763 - DNA, 21 bp, Homo sapiens
caaaccccgaccacctgccca

SEQ ID NO: 2805764 - DNA, 16 bp, Homo sapiens
caaacctctatatgtt

SEQ ID NO: 2805765 - DNA, 18 bp, Homo sapiens
caaactcactgctcaaga

SEQ ID NO: 2805766 - DNA, 17 bp, Homo sapiens
caaactcttgacctcag

SEQ ID NO: 2805767 - DNA, 22 bp, Homo sapiens
caaagaaaaaaatatattttat

SEQ ID NO: 2805768 - DNA, 21 bp, Homo sapiens
caaagaacggcatgtgaattc

SEQ ID NO: 2805769 - DNA, 17 bp, Homo sapiens
caaagaaggaattctag

SEQ ID NO: 2805770 - DNA, 21 bp, Homo sapiens
caaagaaggcacaggtgtaaa

SEQ ID NO: 2805771 - DNA, 13 bp, Homo sapiens
caaagaagtcatg

SEQ ID NO: 2805772 - DNA, 19 bp, Homo sapiens
caaagacttagtatatttt

SEQ ID NO: 2805773 - DNA, 15 bp, Homo sapiens
caaagagcctggaga

SEQ ID NO: 2805774 - DNA, 16 bp, Homo sapiens
caaagagcctggagaa

SEQ ID NO: 2805775 - DNA, 13 bp, Homo sapiens
caaagaggtattt

SEQ ID NO: 2805776 - DNA, 20 bp, Homo sapiens
caaagagtgggctgcatctg

SEQ ID NO: 2805777 - DNA, 17 bp, Homo sapiens
caaagagttcaagaaat

SEQ ID NO: 2805778 - DNA, 23 bp, Homo sapiens
caaagatatatacacaggatcct

SEQ ID NO: 2805779 - DNA, 18 bp, Homo sapiens
caaagatgtttgtcagat

SEQ ID NO: 2805780 - DNA, 22 bp, Homo sapiens
caaagcaaaagaagtaaaagct

SEQ ID NO: 2805781 - DNA, 22 bp, Homo sapiens
caaagcaagcattcagaagaaa

SEQ ID NO: 2805782 - DNA, 18 bp, Homo sapiens
caaagcacattgaaagag

SEQ ID NO: 2805783 - DNA, 18 bp, Homo sapiens
caaagccaaactctgcca

SEQ ID NO: 2805784 - DNA, 22 bp, Homo sapiens
caaagccaaactctgccagcca

SEQ ID NO: 2805785 - DNA, 14 bp, Homo sapiens
caaagccacatttt

SEQ ID NO: 2805786 - DNA, 23 bp, Homo sapiens
caaagccccttgctctcccctgc

SEQ ID NO: 2805787 - DNA, 20 bp, Homo sapiens
caaagcctgttcatggcaga

SEQ ID NO: 2805788 - DNA, 13 bp, Homo sapiens
caaagctaggcct

SEQ ID NO: 2805789 - DNA, 17 bp, Homo sapiens
caaagctaggcctggcc

SEQ ID NO: 2805790 - DNA, 19 bp, Homo sapiens
caaagctaggcctggccag

SEQ ID NO: 2805791 - DNA, 22 bp, Homo sapiens
caaagctcaagatgacagctct

SEQ ID NO: 2805792 - DNA, 16 bp, Homo sapiens
caaagcttaaatgcct

SEQ ID NO: 2805793 - DNA, 19 bp, Homo sapiens
caaagcttctatcccagga

SEQ ID NO: 2805794 - DNA, 11 bp, Homo sapiens
caaaggagcct

SEQ ID NO: 2805795 - DNA, 16 bp, Homo sapiens
caaaggagcctgtgaa

SEQ ID NO: 2805796 - DNA, 23 bp, Homo sapiens
caaaggagcctgtgaacccagga

SEQ ID NO: 2805797 - DNA, 20 bp, Homo sapiens
cacacttgggcgctctgccc

SEQ ID NO: 2805798 - DNA, 23 bp, Homo sapiens
cacacttgggcgctctgccctcc

SEQ ID NO: 2805799 - DNA, 21 bp, Homo sapiens
cacagaaacacaatattttgt

SEQ ID NO: 2805800 - DNA, 23 bp, Homo sapiens
cacagaagccaggagcaaatgtt

SEQ ID NO: 2805801 - DNA, 19 bp, Homo sapiens
cacagaaggaatctgtgca

SEQ ID NO: 2805802 - DNA, 20 bp, Homo sapiens
cacagacagatcccatccat

SEQ ID NO: 2805803 - DNA, 20 bp, Homo sapiens
cacagaccacctgcttctga

SEQ ID NO: 2805804 - DNA, 19 bp, Homo sapiens
cacagagaaagtacttctc

SEQ ID NO: 2805805 - DNA, 15 bp, Homo sapiens
cacagagcctgcctc

SEQ ID NO: 2805806 - DNA, 22 bp, Homo sapiens
cacagagcctgcctcagctgct

SEQ ID NO: 2805807 - DNA, 17 bp, Homo sapiens
cacagaggaagagcagg

SEQ ID NO: 2805808 - DNA, 22 bp, Homo sapiens
cacagataactgaaaattattt

SEQ ID NO: 2805809 - DNA, 19 bp, Homo sapiens
cacagcagtatgaatgatg

SEQ ID NO: 2805810 - DNA, 20 bp, Homo sapiens
cacagcctgggaccagggca

SEQ ID NO: 2805811 - DNA, 21 bp, Homo sapiens
cacagcctgggaccagggcat

SEQ ID NO: 2805812 - DNA, 22 bp, Homo sapiens
cacagcggaggagaccagctca

SEQ ID NO: 2805813 - DNA, 16 bp, Homo sapiens
cacagctcccacccca

SEQ ID NO: 2805814 - DNA, 17 bp, Homo sapiens
cacagctcccaccccac

SEQ ID NO: 2805815 - DNA, 20 bp, Homo sapiens
cacagctctccggtctctct

SEQ ID NO: 2805816 - DNA, 21 bp, Homo sapiens
cacagctctccggtctctctc

SEQ ID NO: 2805817 - DNA, 16 bp, Homo sapiens
cacagctctgtcctgg

SEQ ID NO: 2805818 - DNA, 21 bp, Homo sapiens
cacagcttcatttcctgtgtc

SEQ ID NO: 2805819 - DNA, 23 bp, Homo sapiens
cacaggacacctggccgcctcca

SEQ ID NO: 2805820 - DNA, 15 bp, Homo sapiens
cacaggactctgcct

SEQ ID NO: 2805821 - DNA, 16 bp, Homo sapiens
cacaggagctacctgt

SEQ ID NO: 2805822 - DNA, 18 bp, Homo sapiens
cacaggagctacctgtgt

SEQ ID NO: 2805823 - DNA, 20 bp, Homo sapiens
cacaggagctacctgtgtgg

SEQ ID NO: 2805824 - DNA, 12 bp, Homo sapiens
cacaggaggggg

SEQ ID NO: 2805825 - DNA, 24 bp, Homo sapiens
cacaggatcctattctcaccagga

SEQ ID NO: 2805826 - DNA, 16 bp, Homo sapiens
cacaggcaaaatcctt

SEQ ID NO: 2805827 - DNA, 20 bp, Homo sapiens
cacaggcaaaatccttgctt

SEQ ID NO: 2805828 - DNA, 17 bp, Homo sapiens
cacaggcaactgaggca

SEQ ID NO: 2805829 - DNA, 23 bp, Homo sapiens
cacaggcaactgaggcagacagc

SEQ ID NO: 2805830 - DNA, 11 bp, Homo sapiens
cacaggcaggt

SEQ ID NO: 2805831 - DNA, 17 bp, Homo sapiens
cacaggcatctacacag

SEQ ID NO: 2805832 - DNA, 22 bp, Homo sapiens
cacaggcatctacacagcctgg

SEQ ID NO: 2805833 - DNA, 16 bp, Homo sapiens
cacaggcatttcctgg

SEQ ID NO: 2805834 - DNA, 18 bp, Homo sapiens
cacaggcatttcctgggt

SEQ ID NO: 2805835 - DNA, 19 bp, Homo sapiens
cacaggcatttcctgggtg

SEQ ID NO: 2805836 - DNA, 23 bp, Homo sapiens
cacaggcatttcctgggtggcta

SEQ ID NO: 2805837 - DNA, 19 bp, Homo sapiens
cacaggccccccgcagcac

SEQ ID NO: 2805838 - DNA, 14 bp, Homo sapiens
cacaggcccggctc

SEQ ID NO: 2805839 - DNA, 16 bp, Homo sapiens
cacaggcccggctcca

SEQ ID NO: 2805840 - DNA, 19 bp, Homo sapiens
cacaggcccggctccaggc

SEQ ID NO: 2805841 - DNA, 21 bp, Homo sapiens
cacaggctgcctcatgaccct

SEQ ID NO: 2805842 - DNA, 21 bp, Homo sapiens
cacaggtacagcaacaggaat

SEQ ID NO: 2805843 - DNA, 23 bp, Homo sapiens
cacaggtatgaccttctaggaag

SEQ ID NO: 2805844 - DNA, 16 bp, Homo sapiens
cacaggtgtaaatata

SEQ ID NO: 2805845 - DNA, 21 bp, Homo sapiens
cacagtattacttctgctaca

SEQ ID NO: 2805846 - DNA, 16 bp, Homo sapiens
cacagtctagattaga

SEQ ID NO: 2805847 - DNA, 20 bp, Homo sapiens
cacagtgagtcgaggacagg

SEQ ID NO: 2805848 - DNA, 21 bp, Homo sapiens
cacagtgagtcgaggacaggg

SEQ ID NO: 2805849 - DNA, 18 bp, Homo sapiens
cacagtgcccagctaatt

SEQ ID NO: 2805850 - DNA, 20 bp, Homo sapiens
cacataaaggtatttagaat

SEQ ID NO: 2805851 - DNA, 13 bp, Homo sapiens
cacataatgaatg

SEQ ID NO: 2805852 - DNA, 13 bp, Homo sapiens
cacataatttgaa

SEQ ID NO: 2805853 - DNA, 16 bp, Homo sapiens
cacatacaatttgcac

SEQ ID NO: 2805854 - DNA, 13 bp, Homo sapiens
cacataccctccc

SEQ ID NO: 2805855 - DNA, 15 bp, Homo sapiens
cacatactagaaagc

SEQ ID NO: 2805856 - DNA, 12 bp, Homo sapiens
cacatcccaggc

SEQ ID NO: 2805857 - DNA, 14 bp, Homo sapiens
cacatccctgggcc

SEQ ID NO: 2805858 - DNA, 18 bp, Homo sapiens
cacatctgtgtctctgga

SEQ ID NO: 2805859 - DNA, 23 bp, Homo sapiens
cacatctgtgtctctggaaccca

SEQ ID NO: 2805860 - DNA, 15 bp, Homo sapiens
cacatcttgctctgc

SEQ ID NO: 2805861 - DNA, 17 bp, Homo sapiens
cacatcttgctctgctg

SEQ ID NO: 2805862 - DNA, 18 bp, Homo sapiens
cacatcttgctctgctga

SEQ ID NO: 2805863 - DNA, 21 bp, Homo sapiens
cacatcttgctctgctgacag

SEQ ID NO: 2805864 - DNA, 22 bp, Homo sapiens
cacatgaaccatccttcccatg

SEQ ID NO: 2805865 - DNA, 17 bp, Homo sapiens
cacatgacgtaaaattt

SEQ ID NO: 2805866 - DNA, 19 bp, Homo sapiens
cacatgtaacatagattta

SEQ ID NO: 2805867 - DNA, 20 bp, Homo sapiens
cacatgtcaccgtggacctt

SEQ ID NO: 2805868 - DNA, 22 bp, Homo sapiens
cacatgtcaccgtggaccttcc

SEQ ID NO: 2805869 - DNA, 15 bp, Homo sapiens
cacatgtcttgtaca

SEQ ID NO: 2805870 - DNA, 20 bp, Homo sapiens
cacatgtcttgtacatgtgt

SEQ ID NO: 2805871 - DNA, 15 bp, Homo sapiens
cacatgtgacacata

SEQ ID NO: 2805872 - DNA, 14 bp, Homo sapiens
cacatgtgcacatg

SEQ ID NO: 2805873 - DNA, 19 bp, Homo sapiens
cacattaatatttgctgac

SEQ ID NO: 2805874 - DNA, 22 bp, Homo sapiens
cacattaattagattttcttgc

SEQ ID NO: 2805875 - DNA, 14 bp, Homo sapiens
cacattacttgcac

SEQ ID NO: 2805876 - DNA, 21 bp, Homo sapiens
cacattaggaacagagtatat

SEQ ID NO: 2805877 - DNA, 17 bp, Homo sapiens
cacattatcgggagcag

SEQ ID NO: 2805878 - DNA, 14 bp, Homo sapiens
cacattatttgcat

SEQ ID NO: 2805879 - DNA, 17 bp, Homo sapiens
cacattcaggaagatga

SEQ ID NO: 2805880 - DNA, 15 bp, Homo sapiens
cacatttatatatat

SEQ ID NO: 2805881 - DNA, 17 bp, Homo sapiens
cacatttgatgtacatg

SEQ ID NO: 2805882 - DNA, 19 bp, Homo sapiens
cacattttgtacaaagata

SEQ ID NO: 2805883 - DNA, 15 bp, Homo sapiens
caccaaaagaagtaa

SEQ ID NO: 2805884 - DNA, 22 bp, Homo sapiens
caccaaattcatgtacagcatg

SEQ ID NO: 2805885 - DNA, 17 bp, Homo sapiens
caccaacatcccattgc

SEQ ID NO: 2805886 - DNA, 22 bp, Homo sapiens
caccaacatcccattgccctgg

SEQ ID NO: 2805887 - DNA, 15 bp, Homo sapiens
cactgcaagagcctt

SEQ ID NO: 2805888 - DNA, 17 bp, Homo sapiens
cactgcaagagccttgg

SEQ ID NO: 2805889 - DNA, 19 bp, Homo sapiens
cactgcaagagccttggtg

SEQ ID NO: 2805890 - DNA, 20 bp, Homo sapiens
cactgcaagagccttggtgt

SEQ ID NO: 2805891 - DNA, 19 bp, Homo sapiens
cactgcaccgggccacaga

SEQ ID NO: 2805892 - DNA, 16 bp, Homo sapiens
cactgcactccagcct

SEQ ID NO: 2805893 - DNA, 19 bp, Homo sapiens
cactgcactctagcctggc

SEQ ID NO: 2805894 - DNA, 12 bp, Homo sapiens
cactgcagcctc

SEQ ID NO: 2805895 - DNA, 13 bp, Homo sapiens
cactgcagcctca

SEQ ID NO: 2805896 - DNA, 22 bp, Homo sapiens
cactgcagcctcaacctcctgg

SEQ ID NO: 2805897 - DNA, 16 bp, Homo sapiens
cactgccaggagggac

SEQ ID NO: 2805898 - DNA, 22 bp, Homo sapiens
cactgccccaccagccacctct

SEQ ID NO: 2805899 - DNA, 22 bp, Homo sapiens
cactgctaggcgagtgccagga

SEQ ID NO: 2805900 - DNA, 22 bp, Homo sapiens
cactgctcaagaagacatggag

SEQ ID NO: 2805901 - DNA, 13 bp, Homo sapiens
cactgctggggag

SEQ ID NO: 2805902 - DNA, 20 bp, Homo sapiens
cactgcttttggtctgtgtg

SEQ ID NO: 2805903 - DNA, 21 bp, Homo sapiens
cactgcttttggtctgtgtga

SEQ ID NO: 2805904 - DNA, 16 bp, Homo sapiens
cactggaccactgggc

SEQ ID NO: 2805905 - DNA, 14 bp, Homo sapiens
cactggagcccagg

SEQ ID NO: 2805906 - DNA, 17 bp, Homo sapiens
cactggagtgcagggag

SEQ ID NO: 2805907 - DNA, 13 bp, Homo sapiens
cactggccccacc

SEQ ID NO: 2805908 - DNA, 14 bp, Homo sapiens
cactggccccaccc

SEQ ID NO: 2805909 - DNA, 16 bp, Homo sapiens
cactggccccaccctc

SEQ ID NO: 2805910 - DNA, 19 bp, Homo sapiens
cactggcgaggtgcggcca

SEQ ID NO: 2805911 - DNA, 19 bp, Homo sapiens
cactggggtcctggggcct

SEQ ID NO: 2805912 - DNA, 20 bp, Homo sapiens
cactggtagaccaaaataaa

SEQ ID NO: 2805913 - DNA, 22 bp, Homo sapiens
cactggtgactgcgatcttcag

SEQ ID NO: 2805914 - DNA, 16 bp, Homo sapiens
cactggtttctcagaa

SEQ ID NO: 2805915 - DNA, 19 bp, Homo sapiens
cactggtttctcagaatcc

SEQ ID NO: 2805916 - DNA, 14 bp, Homo sapiens
cactgtaaaatgaa

SEQ ID NO: 2805917 - DNA, 18 bp, Homo sapiens
cactgtccctcaaatgac

SEQ ID NO: 2805918 - DNA, 12 bp, Homo sapiens
cactgtgcagga

SEQ ID NO: 2805919 - DNA, 16 bp, Homo sapiens
cactgtgccatgtgcc

SEQ ID NO: 2805920 - DNA, 19 bp, Homo sapiens
cactgtgcttacagtgact

SEQ ID NO: 2805921 - DNA, 20 bp, Homo sapiens
cactgtggcgttctgctgcc

SEQ ID NO: 2805922 - DNA, 16 bp, Homo sapiens
cactgttgcccaggct

SEQ ID NO: 2805923 - DNA, 19 bp, Homo sapiens
cactgtttaactgggagtg

SEQ ID NO: 2805924 - DNA, 18 bp, Homo sapiens
cacttacctagatttaca

SEQ ID NO: 2805925 - DNA, 15 bp, Homo sapiens
cacttaccttcaata

SEQ ID NO: 2805926 - DNA, 17 bp, Homo sapiens
cacttaccttcaataaa

SEQ ID NO: 2805927 - DNA, 18 bp, Homo sapiens
cacttaccttcaataaag

SEQ ID NO: 2805928 - DNA, 21 bp, Homo sapiens
cacttaccttcaataaagtat

SEQ ID NO: 2805929 - DNA, 21 bp, Homo sapiens
cacttataagtgggagctaaa

SEQ ID NO: 2805930 - DNA, 19 bp, Homo sapiens
cacttcagagtagagggct

SEQ ID NO: 2805931 - DNA, 22 bp, Homo sapiens
cacttcattcttgaaagctgtg

SEQ ID NO: 2805932 - DNA, 17 bp, Homo sapiens
cacttctaaatagcaat

SEQ ID NO: 2805933 - DNA, 21 bp, Homo sapiens
cacttctcacatcttatgcta

SEQ ID NO: 2805934 - DNA, 14 bp, Homo sapiens
cacttctcaggaca

SEQ ID NO: 2805935 - DNA, 21 bp, Homo sapiens
cacttctcaggacacaggcct

SEQ ID NO: 2805936 - DNA, 22 bp, Homo sapiens
cacttctcaggacacaggcctg

SEQ ID NO: 2805937 - DNA, 20 bp, Homo sapiens
cacttctctactctggaagt

SEQ ID NO: 2805938 - DNA, 22 bp, Homo sapiens
cacttctgccatattctgttgg

SEQ ID NO: 2805939 - DNA, 17 bp, Homo sapiens
cacttcttaatgctttc

SEQ ID NO: 2805940 - DNA, 18 bp, Homo sapiens
cacttgaacccgggaggc

SEQ ID NO: 2805941 - DNA, 19 bp, Homo sapiens
cacttgcagactctacaga

SEQ ID NO: 2805942 - DNA, 24 bp, Homo sapiens
cacttgcagactctacagaggcca

SEQ ID NO: 2805943 - DNA, 20 bp, Homo sapiens
cacttgggcgctctgccctc

SEQ ID NO: 2805944 - DNA, 16 bp, Homo sapiens
cacttgggtcttccct

SEQ ID NO: 2805945 - DNA, 18 bp, Homo sapiens
cacttgtgttatgaagca

SEQ ID NO: 2805946 - DNA, 18 bp, Homo sapiens
cactttaaccctctcttc

SEQ ID NO: 2805947 - DNA, 20 bp, Homo sapiens
cactttaattctcatgtgat

SEQ ID NO: 2805948 - DNA, 22 bp, Homo sapiens
cactttaattctcatgtgatcc

SEQ ID NO: 2805949 - DNA, 18 bp, Homo sapiens
cactttcagtgaaagcat

SEQ ID NO: 2805950 - DNA, 19 bp, Homo sapiens
cactttcagtgaaagcatc

SEQ ID NO: 2805951 - DNA, 12 bp, Homo sapiens
cactttgggagg

SEQ ID NO: 2805952 - DNA, 16 bp, Homo sapiens
cacttttcctccctca

SEQ ID NO: 2805953 - DNA, 21 bp, Homo sapiens
cagaaaacttagaaataagaa

SEQ ID NO: 2805954 - DNA, 16 bp, Homo sapiens
cagaaaagaaaaccat

SEQ ID NO: 2805955 - DNA, 17 bp, Homo sapiens
cagaaaagtgcaaagtt

SEQ ID NO: 2805956 - DNA, 13 bp, Homo sapiens
cagaaaagtgctt

SEQ ID NO: 2805957 - DNA, 23 bp, Homo sapiens
cagaaaagtgcttagaaagttat

SEQ ID NO: 2805958 - DNA, 16 bp, Homo sapiens
cagaaaatataaatgc

SEQ ID NO: 2805959 - DNA, 22 bp, Homo sapiens
cagaaaatgtgtcagcatgcat

SEQ ID NO: 2805960 - DNA, 20 bp, Homo sapiens
cagaaacaaaaacactaaaa

SEQ ID NO: 2805961 - DNA, 18 bp, Homo sapiens
cagaaacaggtgcatctg

SEQ ID NO: 2805962 - DNA, 18 bp, Homo sapiens
cagaaagcataaaattct

SEQ ID NO: 2805963 - DNA, 17 bp, Homo sapiens
cagaaagggagggctct

SEQ ID NO: 2805964 - DNA, 20 bp, Homo sapiens
cagaaagggagggctctgag

SEQ ID NO: 2805965 - DNA, 23 bp, Homo sapiens
cagaaagggagggctctgaggcg

SEQ ID NO: 2805966 - DNA, 22 bp, Homo sapiens
cagaaagtggccatgccaccct

SEQ ID NO: 2805967 - DNA, 23 bp, Homo sapiens
cagaaagtggccatgccaccctg

SEQ ID NO: 2805968 - DNA, 20 bp, Homo sapiens
cagaaataatctgacactac

SEQ ID NO: 2805969 - DNA, 15 bp, Homo sapiens
cagaaatatgtggtt

SEQ ID NO: 2805970 - DNA, 11 bp, Homo sapiens
cagaacactgt

SEQ ID NO: 2805971 - DNA, 21 bp, Homo sapiens
cagaacagcagaggttctttt

SEQ ID NO: 2805972 - DNA, 12 bp, Homo sapiens
cagaacagccgc

SEQ ID NO: 2805973 - DNA, 17 bp, Homo sapiens
cagaacagccgctcctg

SEQ ID NO: 2805974 - DNA, 16 bp, Homo sapiens
cagaacagtttgtaca

SEQ ID NO: 2805975 - DNA, 16 bp, Homo sapiens
cagaacatagacagaa

SEQ ID NO: 2805976 - DNA, 19 bp, Homo sapiens
cagaacatagacagaagaa

SEQ ID NO: 2805977 - DNA, 17 bp, Homo sapiens
cagatttcctgtgtggg

SEQ ID NO: 2805978 - DNA, 14 bp, Homo sapiens
cagatttgtgttat

SEQ ID NO: 2805979 - DNA, 19 bp, Homo sapiens
cagattttttacagctgcc

SEQ ID NO: 2805980 - DNA, 22 bp, Homo sapiens
cagattttttacagctgcctgc

SEQ ID NO: 2805981 - DNA, 15 bp, Homo sapiens
cagcaaaactccatc

SEQ ID NO: 2805982 - DNA, 19 bp, Homo sapiens
cagcaaagagtgggctgca

SEQ ID NO: 2805983 - DNA, 18 bp, Homo sapiens
cagcaaagtgtcagtgtt

SEQ ID NO: 2805984 - DNA, 16 bp, Homo sapiens
cagcaagagcacaaga

SEQ ID NO: 2805985 - DNA, 20 bp, Homo sapiens
cagcaaggcccgagcagctg

SEQ ID NO: 2805986 - DNA, 21 bp, Homo sapiens
cagcaaggcccgagcagctga

SEQ ID NO: 2805987 - DNA, 12 bp, Homo sapiens
cagcaagtgaga

SEQ ID NO: 2805988 - DNA, 18 bp, Homo sapiens
cagcaatgatgtccagaa

SEQ ID NO: 2805989 - DNA, 22 bp, Homo sapiens
cagcaatgatgtccagaagaat

SEQ ID NO: 2805990 - DNA, 21 bp, Homo sapiens
cagcacagaaggaatctgtgc

SEQ ID NO: 2805991 - DNA, 16 bp, Homo sapiens
cagcaccctgcagagc

SEQ ID NO: 2805992 - DNA, 14 bp, Homo sapiens
cagcactcctctgt

SEQ ID NO: 2805993 - DNA, 16 bp, Homo sapiens
cagcactcctctgtct

SEQ ID NO: 2805994 - DNA, 19 bp, Homo sapiens
cagcactcctctgtctctg

SEQ ID NO: 2805995 - DNA, 20 bp, Homo sapiens
cagcactcctctgtctctgc

SEQ ID NO: 2805996 - DNA, 21 bp, Homo sapiens
cagcactctctaaatcttcct

SEQ ID NO: 2805997 - DNA, 22 bp, Homo sapiens
cagcactctctaaatcttcctt

SEQ ID NO: 2805998 - DNA, 24 bp, Homo sapiens
cagcactttaaccctctcttccct

SEQ ID NO: 2805999 - DNA, 14 bp, Homo sapiens
cagcactttgggag

SEQ ID NO: 2806000 - DNA, 15 bp, Homo sapiens
cagcactttgggagg

SEQ ID NO: 2806001 - DNA, 16 bp, Homo sapiens
cagcactttgggaggc

SEQ ID NO: 2806002 - DNA, 23 bp, Homo sapiens
cagcactttgggaggctgaagtg

SEQ ID NO: 2806003 - DNA, 20 bp, Homo sapiens
cagcactttgggaggctgag

SEQ ID NO: 2806004 - DNA, 22 bp, Homo sapiens
cagcagaaaagtgcttagaaag

SEQ ID NO: 2806005 - DNA, 17 bp, Homo sapiens
cagcagactcagctctg

SEQ ID NO: 2806006 - DNA, 18 bp, Homo sapiens
cagcagactcagctctga

SEQ ID NO: 2806007 - DNA, 11 bp, Homo sapiens
cagcagccagc

SEQ ID NO: 2806008 - DNA, 17 bp, Homo sapiens
cagcagccagccctgcc

SEQ ID NO: 2806009 - DNA, 19 bp, Homo sapiens
cagcagccagccctgcctg

SEQ ID NO: 2806010 - DNA, 21 bp, Homo sapiens
cagcagccagccctgcctgga

SEQ ID NO: 2806011 - DNA, 19 bp, Homo sapiens
cagcagccagctctcagcc

SEQ ID NO: 2806012 - DNA, 14 bp, Homo sapiens
cagcagccctcctc

SEQ ID NO: 2806013 - DNA, 17 bp, Homo sapiens
cagcagccctcctcacc

SEQ ID NO: 2806014 - DNA, 18 bp, Homo sapiens
cagcagccctcctcaccc

SEQ ID NO: 2806015 - DNA, 16 bp, Homo sapiens
cagcagctcagcctcc

SEQ ID NO: 2806016 - DNA, 12 bp, Homo sapiens
cagcagctcagg

SEQ ID NO: 2806017 - DNA, 14 bp, Homo sapiens
cagcagctcaggca

SEQ ID NO: 2806018 - DNA, 20 bp, Homo sapiens
cagcagctgaacagccaaat

SEQ ID NO: 2806019 - DNA, 17 bp, Homo sapiens
cagcaggaggctagcaa

SEQ ID NO: 2806020 - DNA, 14 bp, Homo sapiens
cagcagggcctcaa

SEQ ID NO: 2806021 - DNA, 20 bp, Homo sapiens
cagcagggtagtctggtttc

SEQ ID NO: 2806022 - DNA, 21 bp, Homo sapiens
cagcagtgagtctcttcagaa

SEQ ID NO: 2806023 - DNA, 15 bp, Homo sapiens
cagcataattcggaa

SEQ ID NO: 2806024 - DNA, 19 bp, Homo sapiens
cagcatacctttattgtga

SEQ ID NO: 2806025 - DNA, 19 bp, Homo sapiens
cagcatagcaagacacatc

SEQ ID NO: 2806026 - DNA, 14 bp, Homo sapiens
cagcatatttatag

SEQ ID NO: 2806027 - DNA, 17 bp, Homo sapiens
cagcatcctggcacccg

SEQ ID NO: 2806028 - DNA, 14 bp, Homo sapiens
cagcattcctccat

SEQ ID NO: 2806029 - DNA, 12 bp, Homo sapiens
cagcattttact

SEQ ID NO: 2806030 - DNA, 23 bp, Homo sapiens
cagcattttactacttgttacct

SEQ ID NO: 2806031 - DNA, 22 bp, Homo sapiens
cagccaacaggtggcaggacca

SEQ ID NO: 2806032 - DNA, 21 bp, Homo sapiens
cagccaacgagtaatttattg

SEQ ID NO: 2806033 - DNA, 21 bp, Homo sapiens
cagccaataaatcaactccag

SEQ ID NO: 2806034 - DNA, 14 bp, Homo sapiens
cagccacacttctc

SEQ ID NO: 2806035 - DNA, 16 bp, Homo sapiens
cagccacacttctcag

SEQ ID NO: 2806036 - DNA, 17 bp, Homo sapiens
cagccacacttctcagg

SEQ ID NO: 2806037 - DNA, 21 bp, Homo sapiens
cagccacacttctcaggacac

SEQ ID NO: 2806038 - DNA, 17 bp, Homo sapiens
cagccaccccctccccc

SEQ ID NO: 2806039 - DNA, 21 bp, Homo sapiens
cagccaccctgaggagtctga

SEQ ID NO: 2806040 - DNA, 22 bp, Homo sapiens
cagccacctcttgggcatgctc

SEQ ID NO: 2806041 - DNA, 17 bp, Homo sapiens
cagccacggccaggcca

SEQ ID NO: 2806042 - DNA, 19 bp, Homo sapiens
cagccacggccaggccaga

SEQ ID NO: 2806043 - DNA, 14 bp, Homo sapiens
cagccactcgggag

SEQ ID NO: 2806044 - DNA, 21 bp, Homo sapiens
cagccactcgggaggctgaga

SEQ ID NO: 2806045 - DNA, 12 bp, Homo sapiens
cagccagaagcc

SEQ ID NO: 2806046 - DNA, 17 bp, Homo sapiens
cagccagaagcccatgg

SEQ ID NO: 2806047 - DNA, 12 bp, Homo sapiens
cagccagaagtt

SEQ ID NO: 2806048 - DNA, 20 bp, Homo sapiens
cagccagcaatgatgtccag

SEQ ID NO: 2806049 - DNA, 14 bp, Homo sapiens
cagccagcagccag

SEQ ID NO: 2806050 - DNA, 19 bp, Homo sapiens
cagccagcagccagctctc

SEQ ID NO: 2806051 - DNA, 14 bp, Homo sapiens
cagccagcccagcc

SEQ ID NO: 2806052 - DNA, 12 bp, Homo sapiens
cagccagccctg

SEQ ID NO: 2806053 - DNA, 16 bp, Homo sapiens
cagccagccctgcctg

SEQ ID NO: 2806054 - DNA, 16 bp, Homo sapiens
cagccagcgcctccct

SEQ ID NO: 2806055 - DNA, 20 bp, Homo sapiens
cagccagcgcctccctccac

SEQ ID NO: 2806056 - DNA, 21 bp, Homo sapiens
cagccagcgcctccctccacc

SEQ ID NO: 2806057 - DNA, 22 bp, Homo sapiens
cagccagcgcctccctccaccc

SEQ ID NO: 2806058 - DNA, 16 bp, Homo sapiens
cagccagctctcagcc

SEQ ID NO: 2806059 - DNA, 17 bp, Homo sapiens
cagccagctctcagcca

SEQ ID NO: 2806060 - DNA, 18 bp, Homo sapiens
cagccagctctcagccaa

SEQ ID NO: 2806061 - DNA, 20 bp, Homo sapiens
cagccagggaggacaagcag

SEQ ID NO: 2806062 - DNA, 21 bp, Homo sapiens
cagccatcaagagactgagtc

SEQ ID NO: 2806063 - DNA, 22 bp, Homo sapiens
cagccatgaggagttgctgttt

SEQ ID NO: 2806064 - DNA, 17 bp, Homo sapiens
cagcccaaagaaggaaa

SEQ ID NO: 2806065 - DNA, 15 bp, Homo sapiens
cagcccacttctgcc

SEQ ID NO: 2806066 - DNA, 14 bp, Homo sapiens
cagcccagcctctg

SEQ ID NO: 2806067 - DNA, 18 bp, Homo sapiens
caggcatgcaccagtgcc

SEQ ID NO: 2806068 - DNA, 15 bp, Homo sapiens
caggcatgctggcct

SEQ ID NO: 2806069 - DNA, 18 bp, Homo sapiens
caggcatttcctgggtgg

SEQ ID NO: 2806070 - DNA, 19 bp, Homo sapiens
caggcatttcctgggtggc

SEQ ID NO: 2806071 - DNA, 19 bp, Homo sapiens
caggccaagagcagaggca

SEQ ID NO: 2806072 - DNA, 19 bp, Homo sapiens
caggccagagggagtgaca

SEQ ID NO: 2806073 - DNA, 23 bp, Homo sapiens
caggccagagggagtgacagagg

SEQ ID NO: 2806074 - DNA, 16 bp, Homo sapiens
caggccaggtgcagtg

SEQ ID NO: 2806075 - DNA, 17 bp, Homo sapiens
caggccccatgacctcc

SEQ ID NO: 2806076 - DNA, 22 bp, Homo sapiens
caggccccgcttgtccagcgcc

SEQ ID NO: 2806077 - DNA, 23 bp, Homo sapiens
caggccccgcttgtccagcgcct

SEQ ID NO: 2806078 - DNA, 15 bp, Homo sapiens
caggcccctgccacc

SEQ ID NO: 2806079 - DNA, 17 bp, Homo sapiens
caggcccctgccaccct

SEQ ID NO: 2806080 - DNA, 19 bp, Homo sapiens
caggcccggcgcggtggct

SEQ ID NO: 2806081 - DNA, 19 bp, Homo sapiens
caggcccggctccaggctc

SEQ ID NO: 2806082 - DNA, 14 bp, Homo sapiens
caggcccggggctg

SEQ ID NO: 2806083 - DNA, 16 bp, Homo sapiens
caggccgaggcaggtg

SEQ ID NO: 2806084 - DNA, 18 bp, Homo sapiens
caggccgggcttgggccc

SEQ ID NO: 2806085 - DNA, 22 bp, Homo sapiens
caggccgggcttgggccctgca

SEQ ID NO: 2806086 - DNA, 22 bp, Homo sapiens
caggccggtgtgggctgtgtcg

SEQ ID NO: 2806087 - DNA, 17 bp, Homo sapiens
caggcctggcaagtggg

SEQ ID NO: 2806088 - DNA, 19 bp, Homo sapiens
caggcggggtgctgtggtg

SEQ ID NO: 2806089 - DNA, 22 bp, Homo sapiens
caggctaatttttttgtatttt

SEQ ID NO: 2806090 - DNA, 15 bp, Homo sapiens
caggctactctcctc

SEQ ID NO: 2806091 - DNA, 16 bp, Homo sapiens
caggctactctcctcg

SEQ ID NO: 2806092 - DNA, 23 bp, Homo sapiens
caggctctttggggtcagccagg

SEQ ID NO: 2806093 - DNA, 15 bp, Homo sapiens
caggctggcgtgcag

SEQ ID NO: 2806094 - DNA, 17 bp, Homo sapiens
caggctggcgtgcagtg

SEQ ID NO: 2806095 - DNA, 18 bp, Homo sapiens
caggctggcgtgcagtgg

SEQ ID NO: 2806096 - DNA, 19 bp, Homo sapiens
caggctgggcttcagtggc

SEQ ID NO: 2806097 - DNA, 20 bp, Homo sapiens
caggctgggcttcagtggca

SEQ ID NO: 2806098 - DNA, 23 bp, Homo sapiens
caggctgggcttcagtggcagct

SEQ ID NO: 2806099 - DNA, 22 bp, Homo sapiens
caggcttcaccctgaatggttc

SEQ ID NO: 2806100 - DNA, 21 bp, Homo sapiens
caggcttggaatgaattctct

SEQ ID NO: 2806101 - DNA, 12 bp, Homo sapiens
cagggaaggcag

SEQ ID NO: 2806102 - DNA, 21 bp, Homo sapiens
cagggaaggcaggcagggctc

SEQ ID NO: 2806103 - DNA, 14 bp, Homo sapiens
cagggacagagaca

SEQ ID NO: 2806104 - DNA, 20 bp, Homo sapiens
cagggacagagacacctgca

SEQ ID NO: 2806105 - DNA, 19 bp, Homo sapiens
cagggaggaggtggcagcc

SEQ ID NO: 2806106 - DNA, 21 bp, Homo sapiens
cagggaggggactatttatga

SEQ ID NO: 2806107 - DNA, 19 bp, Homo sapiens
cagggatcttgcattccca

SEQ ID NO: 2806108 - DNA, 17 bp, Homo sapiens
cagggcacaccgggcac

SEQ ID NO: 2806109 - DNA, 19 bp, Homo sapiens
cagggcacaccgggcactc

SEQ ID NO: 2806110 - DNA, 13 bp, Homo sapiens
cagggcacaggag

SEQ ID NO: 2806111 - DNA, 14 bp, Homo sapiens
cagggcacaggagc

SEQ ID NO: 2806112 - DNA, 19 bp, Homo sapiens
cagggcacaggagctacct

SEQ ID NO: 2806113 - DNA, 16 bp, Homo sapiens
cagggcagagccggga

SEQ ID NO: 2806114 - DNA, 19 bp, Homo sapiens
cagggcatgcattttgcag

SEQ ID NO: 2806115 - DNA, 20 bp, Homo sapiens
cagggccacgtgccaggccc

SEQ ID NO: 2806116 - DNA, 21 bp, Homo sapiens
cagggccacgtgccaggcccg

SEQ ID NO: 2806117 - DNA, 12 bp, Homo sapiens
cagggccagggc

SEQ ID NO: 2806118 - DNA, 15 bp, Homo sapiens
cagggccagggccct

SEQ ID NO: 2806119 - DNA, 19 bp, Homo sapiens
cagggccagggccctgcag

SEQ ID NO: 2806120 - DNA, 17 bp, Homo sapiens
cagggccccagaaggca

SEQ ID NO: 2806121 - DNA, 15 bp, Homo sapiens
cagggccccagcact

SEQ ID NO: 2806122 - DNA, 18 bp, Homo sapiens
cagggccctgcagagggg

SEQ ID NO: 2806123 - DNA, 22 bp, Homo sapiens
cagggccggggaactggccaag

SEQ ID NO: 2806124 - DNA, 24 bp, Homo sapiens
cagggccggggaactggccaagct

SEQ ID NO: 2806125 - DNA, 13 bp, Homo sapiens
cagggccttgccc

SEQ ID NO: 2806126 - DNA, 14 bp, Homo sapiens
cagggccttgccca

SEQ ID NO: 2806127 - DNA, 24 bp, Homo sapiens
cagggccttgcccagagatgcctc

SEQ ID NO: 2806128 - DNA, 15 bp, Homo sapiens
cagggctaccctccc

SEQ ID NO: 2806129 - DNA, 15 bp, Homo sapiens
cagggctcagcctgg

SEQ ID NO: 2806130 - DNA, 16 bp, Homo sapiens
cagggctcagcctggt

SEQ ID NO: 2806131 - DNA, 12 bp, Homo sapiens
cagggctcagcg

SEQ ID NO: 2806132 - DNA, 15 bp, Homo sapiens
cagggctgcccctgt

SEQ ID NO: 2806133 - DNA, 23 bp, Homo sapiens
cagggctgcccctgtaggttgct

SEQ ID NO: 2806134 - DNA, 22 bp, Homo sapiens
cagggctggaaaagtcacacag

SEQ ID NO: 2806135 - DNA, 17 bp, Homo sapiens
cagggctgggagaactt

SEQ ID NO: 2806136 - DNA, 19 bp, Homo sapiens
caggggctccacctgttca

SEQ ID NO: 2806137 - DNA, 15 bp, Homo sapiens
caggggctccccggg

SEQ ID NO: 2806138 - DNA, 18 bp, Homo sapiens
caggggtcgtcaccacct

SEQ ID NO: 2806139 - DNA, 21 bp, Homo sapiens
caggggtcgtcaccacctctc

SEQ ID NO: 2806140 - DNA, 13 bp, Homo sapiens
caggggtgggaga

SEQ ID NO: 2806141 - DNA, 16 bp, Homo sapiens
caggggtgggagagcc

SEQ ID NO: 2806142 - DNA, 21 bp, Homo sapiens
caggggtgggagagccagctc

SEQ ID NO: 2806143 - DNA, 22 bp, Homo sapiens
caggggtgggagagccagctct

SEQ ID NO: 2806144 - DNA, 23 bp, Homo sapiens
caggggtgggagagccagctctc

SEQ ID NO: 2806145 - DNA, 13 bp, Homo sapiens
cagggtagcaggt

SEQ ID NO: 2806146 - DNA, 16 bp, Homo sapiens
cagggtctcactctgt

SEQ ID NO: 2806147 - DNA, 21 bp, Homo sapiens
cagggtgagagctgctctgga

SEQ ID NO: 2806148 - DNA, 18 bp, Homo sapiens
cagggtgggatggaggag

SEQ ID NO: 2806149 - DNA, 18 bp, Homo sapiens
cagggtgggccactctcc

SEQ ID NO: 2806150 - DNA, 23 bp, Homo sapiens
cagggtgggccactctcccctcc

SEQ ID NO: 2806151 - DNA, 14 bp, Homo sapiens
cagggttggcccct

SEQ ID NO: 2806152 - DNA, 16 bp, Homo sapiens
cagggttggcccctgc

SEQ ID NO: 2806153 - DNA, 14 bp, Homo sapiens
caggtacagcaaca

SEQ ID NO: 2806154 - DNA, 14 bp, Homo sapiens
caggtatctccagg

SEQ ID NO: 2806155 - DNA, 15 bp, Homo sapiens
caggtatctccagga

SEQ ID NO: 2806156 - DNA, 18 bp, Homo sapiens
caggtatctccaggattg

SEQ ID NO: 2806157 - DNA, 20 bp, Homo sapiens
catctaagctgcagcttcct

SEQ ID NO: 2806158 - DNA, 21 bp, Homo sapiens
catctaagctgcagcttcctg

SEQ ID NO: 2806159 - DNA, 23 bp, Homo sapiens
catctaagctgcagcttcctgtc

SEQ ID NO: 2806160 - DNA, 15 bp, Homo sapiens
catctacacagcctg

SEQ ID NO: 2806161 - DNA, 20 bp, Homo sapiens
catctagaggcttccttcat

SEQ ID NO: 2806162 - DNA, 21 bp, Homo sapiens
catctagaggcttccttcatt

SEQ ID NO: 2806163 - DNA, 20 bp, Homo sapiens
catctatggcagtccagcca

SEQ ID NO: 2806164 - DNA, 18 bp, Homo sapiens
catctcaggcctccctca

SEQ ID NO: 2806165 - DNA, 21 bp, Homo sapiens
catctcagggtccagaccctg

SEQ ID NO: 2806166 - DNA, 20 bp, Homo sapiens
catctcatttaagggaaaaa

SEQ ID NO: 2806167 - DNA, 22 bp, Homo sapiens
catctcatttaagggaaaaata

SEQ ID NO: 2806168 - DNA, 16 bp, Homo sapiens
catctccaccctgagc

SEQ ID NO: 2806169 - DNA, 24 bp, Homo sapiens
catctcccccatcccccactgcca

SEQ ID NO: 2806170 - DNA, 23 bp, Homo sapiens
catctctctactcctacctcagc

SEQ ID NO: 2806171 - DNA, 20 bp, Homo sapiens
catctcttgaggccaggagt

SEQ ID NO: 2806172 - DNA, 14 bp, Homo sapiens
catctgaaagccac

SEQ ID NO: 2806173 - DNA, 23 bp, Homo sapiens
catctgcaccctcgatgaagccc

SEQ ID NO: 2806174 - DNA, 12 bp, Homo sapiens
catctgctaata

SEQ ID NO: 2806175 - DNA, 21 bp, Homo sapiens
catctgggaagatttctacct

SEQ ID NO: 2806176 - DNA, 18 bp, Homo sapiens
catctgtcttgccagcca

SEQ ID NO: 2806177 - DNA, 18 bp, Homo sapiens
catctgttatcctgctag

SEQ ID NO: 2806178 - DNA, 18 bp, Homo sapiens
catcttagctttccacag

SEQ ID NO: 2806179 - DNA, 21 bp, Homo sapiens
catcttatgctaactgtagat

SEQ ID NO: 2806180 - DNA, 20 bp, Homo sapiens
catcttattttcatgtatat

SEQ ID NO: 2806181 - DNA, 17 bp, Homo sapiens
catcttctccatctggc

SEQ ID NO: 2806182 - DNA, 22 bp, Homo sapiens
catcttctggagtctccagtgg

SEQ ID NO: 2806183 - DNA, 16 bp, Homo sapiens
catcttgctctgctga

SEQ ID NO: 2806184 - DNA, 16 bp, Homo sapiens
catctttcttctattt

SEQ ID NO: 2806185 - DNA, 21 bp, Homo sapiens
catctttcttctattttattc

SEQ ID NO: 2806186 - DNA, 14 bp, Homo sapiens
catcttttgtgaga

SEQ ID NO: 2806187 - DNA, 13 bp, Homo sapiens
catgaaacagaaa

SEQ ID NO: 2806188 - DNA, 15 bp, Homo sapiens
catgaaacagaaaca

SEQ ID NO: 2806189 - DNA, 22 bp, Homo sapiens
catgaaatatagatcagttata

SEQ ID NO: 2806190 - DNA, 24 bp, Homo sapiens
catgaaattgtctagcagagcagg

SEQ ID NO: 2806191 - DNA, 19 bp, Homo sapiens
catgaaccatccttcccat

SEQ ID NO: 2806192 - DNA, 15 bp, Homo sapiens
catgaagacaggaca

SEQ ID NO: 2806193 - DNA, 13 bp, Homo sapiens
catgaagaccaca

SEQ ID NO: 2806194 - DNA, 21 bp, Homo sapiens
catgaagctggaagcactgct

SEQ ID NO: 2806195 - DNA, 20 bp, Homo sapiens
catgaagtgtgtttccttca

SEQ ID NO: 2806196 - DNA, 14 bp, Homo sapiens
catgacagccagag

SEQ ID NO: 2806197 - DNA, 16 bp, Homo sapiens
catgacagccagagcc

SEQ ID NO: 2806198 - DNA, 16 bp, Homo sapiens
catgaccatcctgtcc

SEQ ID NO: 2806199 - DNA, 21 bp, Homo sapiens
catgacctccagctttcctgt

SEQ ID NO: 2806200 - DNA, 15 bp, Homo sapiens
catgacgtaaaattt

SEQ ID NO: 2806201 - DNA, 15 bp, Homo sapiens
catgagaaatgtgaa

SEQ ID NO: 2806202 - DNA, 17 bp, Homo sapiens
catgagaagagggcctg

SEQ ID NO: 2806203 - DNA, 18 bp, Homo sapiens
catgagaagagggcctgt

SEQ ID NO: 2806204 - DNA, 22 bp, Homo sapiens
catgagaagagggcctgtggga

SEQ ID NO: 2806205 - DNA, 15 bp, Homo sapiens
catgagcctcagcat

SEQ ID NO: 2806206 - DNA, 20 bp, Homo sapiens
catgagcctcagcatcctgg

SEQ ID NO: 2806207 - DNA, 16 bp, Homo sapiens
catgaggagttgctgt

SEQ ID NO: 2806208 - DNA, 22 bp, Homo sapiens
catgaggcaatgtcaggaacag

SEQ ID NO: 2806209 - DNA, 13 bp, Homo sapiens
catgaggcagctt

SEQ ID NO: 2806210 - DNA, 20 bp, Homo sapiens
catgaggcctttccccagtg

SEQ ID NO: 2806211 - DNA, 20 bp, Homo sapiens
catgagggatcacagggccc

SEQ ID NO: 2806212 - DNA, 13 bp, Homo sapiens
catgatcctgagt

SEQ ID NO: 2806213 - DNA, 13 bp, Homo sapiens
catgatctccctg

SEQ ID NO: 2806214 - DNA, 15 bp, Homo sapiens
catgatctccctgcc

SEQ ID NO: 2806215 - DNA, 19 bp, Homo sapiens
catgatctccctgccgcct

SEQ ID NO: 2806216 - DNA, 20 bp, Homo sapiens
catgatctgactttaattgt

SEQ ID NO: 2806217 - DNA, 21 bp, Homo sapiens
catgatctgactttaattgtg

SEQ ID NO: 2806218 - DNA, 23 bp, Homo sapiens
catgatctgactttaattgtgtg

SEQ ID NO: 2806219 - DNA, 15 bp, Homo sapiens
catgatgagctcctc

SEQ ID NO: 2806220 - DNA, 18 bp, Homo sapiens
catgatgagctcctcttc

SEQ ID NO: 2806221 - DNA, 19 bp, Homo sapiens
catgatgagctcctcttcc

SEQ ID NO: 2806222 - DNA, 20 bp, Homo sapiens
catgatgccgctcttctgtc

SEQ ID NO: 2806223 - DNA, 18 bp, Homo sapiens
catgatggagcgcacctg

SEQ ID NO: 2806224 - DNA, 19 bp, Homo sapiens
catgatggagcgcacctgc

SEQ ID NO: 2806225 - DNA, 22 bp, Homo sapiens
catgatgttaaccagaataaag

SEQ ID NO: 2806226 - DNA, 16 bp, Homo sapiens
catgattcatgccaat

SEQ ID NO: 2806227 - DNA, 18 bp, Homo sapiens
catgattcattttaacat

SEQ ID NO: 2806228 - DNA, 11 bp, Homo sapiens
catgattttat

SEQ ID NO: 2806229 - DNA, 16 bp, Homo sapiens
catgattttatacata

SEQ ID NO: 2806230 - DNA, 17 bp, Homo sapiens
catgattttatacatag

SEQ ID NO: 2806231 - DNA, 18 bp, Homo sapiens
catgattttatacatagt

SEQ ID NO: 2806232 - DNA, 18 bp, Homo sapiens
catgcagcttcatcaatt

SEQ ID NO: 2806233 - DNA, 20 bp, Homo sapiens
catgcagcttcatcaatttt

SEQ ID NO: 2806234 - DNA, 15 bp, Homo sapiens
catgcattactgcat

SEQ ID NO: 2806235 - DNA, 17 bp, Homo sapiens
catgcattactgcatgc

SEQ ID NO: 2806236 - DNA, 19 bp, Homo sapiens
catgcattttgcagcagtg

SEQ ID NO: 2806237 - DNA, 18 bp, Homo sapiens
catgccaaagcaaaagaa

SEQ ID NO: 2806238 - DNA, 18 bp, Homo sapiens
catgccaggctaattttt

SEQ ID NO: 2806239 - DNA, 23 bp, Homo sapiens
catgccatctccaccctgagcct

SEQ ID NO: 2806240 - DNA, 18 bp, Homo sapiens
catgccatttgtactgac

SEQ ID NO: 2806241 - DNA, 14 bp, Homo sapiens
catgcctctgaggc

SEQ ID NO: 2806242 - DNA, 18 bp, Homo sapiens
catgcctctgaggccagc

SEQ ID NO: 2806243 - DNA, 19 bp, Homo sapiens
catgcctctgaggccagcc

SEQ ID NO: 2806244 - DNA, 20 bp, Homo sapiens
catgcctgagggtggagact

SEQ ID NO: 2806245 - DNA, 17 bp, Homo sapiens
catgcctggcccccctc

SEQ ID NO: 2806246 - DNA, 18 bp, Homo sapiens
catgcctggcccccctcc

SEQ ID NO: 2806247 - DNA, 16 bp, Homo sapiens
ccacaaccaggaagaa

SEQ ID NO: 2806248 - DNA, 18 bp, Homo sapiens
ccacaagattcccagaga

SEQ ID NO: 2806249 - DNA, 21 bp, Homo sapiens
ccacaagattcccagagacag

SEQ ID NO: 2806250 - DNA, 21 bp, Homo sapiens
ccacaatgatgattaaacacc

SEQ ID NO: 2806251 - DNA, 23 bp, Homo sapiens
ccacaatgatgattaaacacctg

SEQ ID NO: 2806252 - DNA, 17 bp, Homo sapiens
ccacacacagaggaaga

SEQ ID NO: 2806253 - DNA, 18 bp, Homo sapiens
ccacacacagaggaagag

SEQ ID NO: 2806254 - DNA, 15 bp, Homo sapiens
ccacacacgcaggaa

SEQ ID NO: 2806255 - DNA, 22 bp, Homo sapiens
ccacacacgcaggaactcccag

SEQ ID NO: 2806256 - DNA, 23 bp, Homo sapiens
ccacacacgcaggaactcccagc

SEQ ID NO: 2806257 - DNA, 13 bp, Homo sapiens
ccacacccagccc

SEQ ID NO: 2806258 - DNA, 17 bp, Homo sapiens
ccacacccggctccccc

SEQ ID NO: 2806259 - DNA, 12 bp, Homo sapiens
ccacaccctccc

SEQ ID NO: 2806260 - DNA, 16 bp, Homo sapiens
ccacacctccctgaac

SEQ ID NO: 2806261 - DNA, 17 bp, Homo sapiens
ccacactattaccatga

SEQ ID NO: 2806262 - DNA, 16 bp, Homo sapiens
ccacactcccccagac

SEQ ID NO: 2806263 - DNA, 22 bp, Homo sapiens
ccacactggcacgtttgtgaga

SEQ ID NO: 2806264 - DNA, 14 bp, Homo sapiens
ccacacttctcagg

SEQ ID NO: 2806265 - DNA, 20 bp, Homo sapiens
ccacagaagccaggagcaaa

SEQ ID NO: 2806266 - DNA, 22 bp, Homo sapiens
ccacagaagccaggagcaaatg

SEQ ID NO: 2806267 - DNA, 15 bp, Homo sapiens
ccacagacagatccc

SEQ ID NO: 2806268 - DNA, 16 bp, Homo sapiens
ccacagacagatccca

SEQ ID NO: 2806269 - DNA, 17 bp, Homo sapiens
ccacagacagatcccat

SEQ ID NO: 2806270 - DNA, 15 bp, Homo sapiens
ccacagaccacctgc

SEQ ID NO: 2806271 - DNA, 21 bp, Homo sapiens
ccacagaccacctgcttctga

SEQ ID NO: 2806272 - DNA, 16 bp, Homo sapiens
ccacagataactgaaa

SEQ ID NO: 2806273 - DNA, 18 bp, Homo sapiens
ccacagataactgaaaat

SEQ ID NO: 2806274 - DNA, 19 bp, Homo sapiens
ccacagcattcctccatct

SEQ ID NO: 2806275 - DNA, 15 bp, Homo sapiens
ccacagcggaggaga

SEQ ID NO: 2806276 - DNA, 18 bp, Homo sapiens
ccacagcggaggagacca

SEQ ID NO: 2806277 - DNA, 15 bp, Homo sapiens
ccacagctcccaccc

SEQ ID NO: 2806278 - DNA, 17 bp, Homo sapiens
ccacagggctaagagct

SEQ ID NO: 2806279 - DNA, 13 bp, Homo sapiens
ccacagtctctgg

SEQ ID NO: 2806280 - DNA, 14 bp, Homo sapiens
ccacagtctctggg

SEQ ID NO: 2806281 - DNA, 15 bp, Homo sapiens
ccacagtctctggga

SEQ ID NO: 2806282 - DNA, 11 bp, Homo sapiens
ccacataaagg

SEQ ID NO: 2806283 - DNA, 15 bp, Homo sapiens
ccacatccacacacg

SEQ ID NO: 2806284 - DNA, 13 bp, Homo sapiens
ccacatcccaggc

SEQ ID NO: 2806285 - DNA, 14 bp, Homo sapiens
ccacatccctgggc

SEQ ID NO: 2806286 - DNA, 15 bp, Homo sapiens
ccacatccctgggcc

SEQ ID NO: 2806287 - DNA, 19 bp, Homo sapiens
ccacatccctgggcctgct

SEQ ID NO: 2806288 - DNA, 23 bp, Homo sapiens
ccacatccctgggcctgctgctg

SEQ ID NO: 2806289 - DNA, 16 bp, Homo sapiens
ccacatcttgctctgc

SEQ ID NO: 2806290 - DNA, 17 bp, Homo sapiens
ccacatcttgctctgct

SEQ ID NO: 2806291 - DNA, 23 bp, Homo sapiens
ccacatcttgctctgctgacaga

SEQ ID NO: 2806292 - DNA, 22 bp, Homo sapiens
ccacatgccatttgtactgacc

SEQ ID NO: 2806293 - DNA, 14 bp, Homo sapiens
ccaccaccctccca

SEQ ID NO: 2806294 - DNA, 15 bp, Homo sapiens
ccaccaccctcccac

SEQ ID NO: 2806295 - DNA, 22 bp, Homo sapiens
ccaccaccctcccaccatgcgc

SEQ ID NO: 2806296 - DNA, 18 bp, Homo sapiens
ccaccacctaggccactc

SEQ ID NO: 2806297 - DNA, 22 bp, Homo sapiens
ccaccaccttggactcctccca

SEQ ID NO: 2806298 - DNA, 16 bp, Homo sapiens
ccaccagatgagaagt

SEQ ID NO: 2806299 - DNA, 15 bp, Homo sapiens
ccacccacctcagcc

SEQ ID NO: 2806300 - DNA, 11 bp, Homo sapiens
ccacccagccc

SEQ ID NO: 2806301 - DNA, 22 bp, Homo sapiens
ccacccagcccattctctctcc

SEQ ID NO: 2806302 - DNA, 14 bp, Homo sapiens
ccacccaggagccc

SEQ ID NO: 2806303 - DNA, 15 bp, Homo sapiens
ccacccaggcaggcc

SEQ ID NO: 2806304 - DNA, 12 bp, Homo sapiens
ccaccccacgga

SEQ ID NO: 2806305 - DNA, 12 bp, Homo sapiens
ccacccccagcc

SEQ ID NO: 2806306 - DNA, 15 bp, Homo sapiens
ccacccccagccccg

SEQ ID NO: 2806307 - DNA, 18 bp, Homo sapiens
ccaccccctccccagggg

SEQ ID NO: 2806308 - DNA, 22 bp, Homo sapiens
ccacccccttcagtgcccacca

SEQ ID NO: 2806309 - DNA, 22 bp, Homo sapiens
ccacccgttctgctggcctgga

SEQ ID NO: 2806310 - DNA, 20 bp, Homo sapiens
ccaccctcccaccatgcgct

SEQ ID NO: 2806311 - DNA, 18 bp, Homo sapiens
ccaccctcgtggacacct

SEQ ID NO: 2806312 - DNA, 20 bp, Homo sapiens
ccaccctcgtggacacctgc

SEQ ID NO: 2806313 - DNA, 15 bp, Homo sapiens
ccaccctgaggagtc

SEQ ID NO: 2806314 - DNA, 11 bp, Homo sapiens
ccaccctgctc

SEQ ID NO: 2806315 - DNA, 13 bp, Homo sapiens
ccaccctgctctc

SEQ ID NO: 2806316 - DNA, 17 bp, Homo sapiens
ccaccgattgcaggaca

SEQ ID NO: 2806317 - DNA, 21 bp, Homo sapiens
ccaccgctgcctaagtggctg

SEQ ID NO: 2806318 - DNA, 17 bp, Homo sapiens
ccaccgggacagacctg

SEQ ID NO: 2806319 - DNA, 13 bp, Homo sapiens
ccaccgggccact

SEQ ID NO: 2806320 - DNA, 18 bp, Homo sapiens
ccaccgggccactccttc

SEQ ID NO: 2806321 - DNA, 23 bp, Homo sapiens
ccacctacttttctttcctcaga

SEQ ID NO: 2806322 - DNA, 16 bp, Homo sapiens
ccacctcagccttgga

SEQ ID NO: 2806323 - DNA, 17 bp, Homo sapiens
ccacctcccctatccac

SEQ ID NO: 2806324 - DNA, 13 bp, Homo sapiens
ccacctccctgcc

SEQ ID NO: 2806325 - DNA, 15 bp, Homo sapiens
ccacctccctgccct

SEQ ID NO: 2806326 - DNA, 19 bp, Homo sapiens
ccacctccgccccagacac

SEQ ID NO: 2806327 - DNA, 14 bp, Homo sapiens
ccacctctcaatat

SEQ ID NO: 2806328 - DNA, 23 bp, Homo sapiens
ccacctctcaatattcaataaag

SEQ ID NO: 2806329 - DNA, 14 bp, Homo sapiens
ccacctgcccaacc

SEQ ID NO: 2806330 - DNA, 14 bp, Homo sapiens
ccacctgcttctga

SEQ ID NO: 2806331 - DNA, 15 bp, Homo sapiens
ccacctgctttctcc

SEQ ID NO: 2806332 - DNA, 14 bp, Homo sapiens
ccacctgtctgtct

SEQ ID NO: 2806333 - DNA, 16 bp, Homo sapiens
ccaccttccagtgagc

SEQ ID NO: 2806334 - DNA, 12 bp, Homo sapiens
ccaccttcccag

SEQ ID NO: 2806335 - DNA, 14 bp, Homo sapiens
ccaccttcccagct

SEQ ID NO: 2806336 - DNA, 15 bp, Homo sapiens
ccaccttcccagctc

SEQ ID NO: 2806337 - DNA, 16 bp, Homo sapiens
ccaccttcccagctct

SEQ ID NO: 2806338 - DNA, 21 bp, Homo sapiens
ccagctactcgggaggctgag

SEQ ID NO: 2806339 - DNA, 15 bp, Homo sapiens
ccagctagggctgga

SEQ ID NO: 2806340 - DNA, 22 bp, Homo sapiens
ccagctcaccagccccagtgcc

SEQ ID NO: 2806341 - DNA, 14 bp, Homo sapiens
ccagctcagaggcc

SEQ ID NO: 2806342 - DNA, 17 bp, Homo sapiens
ccagctcagaggcccag

SEQ ID NO: 2806343 - DNA, 12 bp, Homo sapiens
ccagctccccag

SEQ ID NO: 2806344 - DNA, 14 bp, Homo sapiens
ccagctccctagga

SEQ ID NO: 2806345 - DNA, 13 bp, Homo sapiens
ccagctctcagcc

SEQ ID NO: 2806346 - DNA, 18 bp, Homo sapiens
ccagctctccctctggcc

SEQ ID NO: 2806347 - DNA, 16 bp, Homo sapiens
ccagctctctctaccc

SEQ ID NO: 2806348 - DNA, 12 bp, Homo sapiens
ccagctctggct

SEQ ID NO: 2806349 - DNA, 16 bp, Homo sapiens
ccagctcttggcccct

SEQ ID NO: 2806350 - DNA, 19 bp, Homo sapiens
ccagctcttggcccctgtg

SEQ ID NO: 2806351 - DNA, 20 bp, Homo sapiens
ccagctctttgttcagttga

SEQ ID NO: 2806352 - DNA, 14 bp, Homo sapiens
ccagctgaggctgg

SEQ ID NO: 2806353 - DNA, 20 bp, Homo sapiens
ccagctgcacctgccagcct

SEQ ID NO: 2806354 - DNA, 23 bp, Homo sapiens
ccagctgcacctgccagcctggc

SEQ ID NO: 2806355 - DNA, 20 bp, Homo sapiens
ccagctgccgaccagagccc

SEQ ID NO: 2806356 - DNA, 19 bp, Homo sapiens
ccagctggaattgctgctc

SEQ ID NO: 2806357 - DNA, 22 bp, Homo sapiens
ccagctgtctgtgtcagcctgt

SEQ ID NO: 2806358 - DNA, 21 bp, Homo sapiens
ccagcttcccctcgctgtcct

SEQ ID NO: 2806359 - DNA, 15 bp, Homo sapiens
ccagcttctccaggc

SEQ ID NO: 2806360 - DNA, 17 bp, Homo sapiens
ccagcttctccaggctc

SEQ ID NO: 2806361 - DNA, 18 bp, Homo sapiens
ccagcttctccaggctct

SEQ ID NO: 2806362 - DNA, 23 bp, Homo sapiens
ccagcttgctcttcagtgggaga

SEQ ID NO: 2806363 - DNA, 16 bp, Homo sapiens
ccaggaaaactgtttt

SEQ ID NO: 2806364 - DNA, 13 bp, Homo sapiens
ccaggacaggccc

SEQ ID NO: 2806365 - DNA, 21 bp, Homo sapiens
ccaggacgccactcatttcat

SEQ ID NO: 2806366 - DNA, 19 bp, Homo sapiens
ccaggactatagcccaggt

SEQ ID NO: 2806367 - DNA, 20 bp, Homo sapiens
ccaggactatagcccaggtc

SEQ ID NO: 2806368 - DNA, 22 bp, Homo sapiens
ccaggactatagcccaggtcct

SEQ ID NO: 2806369 - DNA, 21 bp, Homo sapiens
ccaggactccccaggccaggc

SEQ ID NO: 2806370 - DNA, 13 bp, Homo sapiens
ccaggagagccag

SEQ ID NO: 2806371 - DNA, 17 bp, Homo sapiens
ccaggagagccagccct

SEQ ID NO: 2806372 - DNA, 22 bp, Homo sapiens
ccaggaggtggctatggccacc

SEQ ID NO: 2806373 - DNA, 20 bp, Homo sapiens
ccaggagtttgaggctgcag

SEQ ID NO: 2806374 - DNA, 20 bp, Homo sapiens
ccaggatggcccttcccact

SEQ ID NO: 2806375 - DNA, 23 bp, Homo sapiens
ccaggatggcccttcccactgga

SEQ ID NO: 2806376 - DNA, 19 bp, Homo sapiens
ccaggcacgaacccacctg

SEQ ID NO: 2806377 - DNA, 21 bp, Homo sapiens
ccaggcacgaacccacctgct

SEQ ID NO: 2806378 - DNA, 18 bp, Homo sapiens
ccaggcaggccctgcctt

SEQ ID NO: 2806379 - DNA, 23 bp, Homo sapiens
ccaggcaggtcttgaactcctgg

SEQ ID NO: 2806380 - DNA, 16 bp, Homo sapiens
ccaggcatgctggcct

SEQ ID NO: 2806381 - DNA, 17 bp, Homo sapiens
ccaggcatgctggcctc

SEQ ID NO: 2806382 - DNA, 18 bp, Homo sapiens
ccaggcatgctggcctcc

SEQ ID NO: 2806383 - DNA, 12 bp, Homo sapiens
ccaggccaccag

SEQ ID NO: 2806384 - DNA, 15 bp, Homo sapiens
ccaggccaccaggat

SEQ ID NO: 2806385 - DNA, 11 bp, Homo sapiens
ccaggccaccg

SEQ ID NO: 2806386 - DNA, 12 bp, Homo sapiens
ccaggccagagg

SEQ ID NO: 2806387 - DNA, 13 bp, Homo sapiens
ccaggccccatga

SEQ ID NO: 2806388 - DNA, 16 bp, Homo sapiens
ccaggccccatgacct

SEQ ID NO: 2806389 - DNA, 17 bp, Homo sapiens
ccaggccccatgacctc

SEQ ID NO: 2806390 - DNA, 18 bp, Homo sapiens
ccaggccccatgacctcc

SEQ ID NO: 2806391 - DNA, 20 bp, Homo sapiens
ccaggccccatgacctccag

SEQ ID NO: 2806392 - DNA, 16 bp, Homo sapiens
ccaggcccctgccacc

SEQ ID NO: 2806393 - DNA, 15 bp, Homo sapiens
ccaggcccggggctg

SEQ ID NO: 2806394 - DNA, 20 bp, Homo sapiens
ccaggcccggggctggcggc

SEQ ID NO: 2806395 - DNA, 23 bp, Homo sapiens
ccaggccgggcttgggccctgca

SEQ ID NO: 2806396 - DNA, 22 bp, Homo sapiens
ccaggccggtgtgggctgtgtc

SEQ ID NO: 2806397 - DNA, 16 bp, Homo sapiens
ccaggctagactagga

SEQ ID NO: 2806398 - DNA, 21 bp, Homo sapiens
ccaggctagactaggaggttc

SEQ ID NO: 2806399 - DNA, 22 bp, Homo sapiens
ccaggctctttggggtcagcca

SEQ ID NO: 2806400 - DNA, 16 bp, Homo sapiens
ccaggctggcgtgcag

SEQ ID NO: 2806401 - DNA, 17 bp, Homo sapiens
ccaggctggcgtgcagt

SEQ ID NO: 2806402 - DNA, 18 bp, Homo sapiens
ccaggctggcgtgcagtg

SEQ ID NO: 2806403 - DNA, 14 bp, Homo sapiens
ccaggctggtctca

SEQ ID NO: 2806404 - DNA, 20 bp, Homo sapiens
ccaggctgtatcccatgagc

SEQ ID NO: 2806405 - DNA, 10 bp, Homo sapiens
ccagggcaca

SEQ ID NO: 2806406 - DNA, 13 bp, Homo sapiens
ccagggcacagga

SEQ ID NO: 2806407 - DNA, 14 bp, Homo sapiens
ccagggcacaggag

SEQ ID NO: 2806408 - DNA, 21 bp, Homo sapiens
ccagggccacgtgccaggccc

SEQ ID NO: 2806409 - DNA, 17 bp, Homo sapiens
ccagggccagggccctg

SEQ ID NO: 2806410 - DNA, 15 bp, Homo sapiens
ccagggcccccacag

SEQ ID NO: 2806411 - DNA, 18 bp, Homo sapiens
ccagggcccccacaggcc

SEQ ID NO: 2806412 - DNA, 16 bp, Homo sapiens
ccagggcccctgttcc

SEQ ID NO: 2806413 - DNA, 18 bp, Homo sapiens
ccagggccctgagctcgg

SEQ ID NO: 2806414 - DNA, 19 bp, Homo sapiens
ccagggcgggagtgggggc

SEQ ID NO: 2806415 - DNA, 12 bp, Homo sapiens
ccagggctcagc

SEQ ID NO: 2806416 - DNA, 16 bp, Homo sapiens
ccagggctgcccctgt

SEQ ID NO: 2806417 - DNA, 17 bp, Homo sapiens
ccaggggtctccctgga

SEQ ID NO: 2806418 - DNA, 19 bp, Homo sapiens
ccaggggtctccctggagt

SEQ ID NO: 2806419 - DNA, 16 bp, Homo sapiens
ccaggtatctccagga

SEQ ID NO: 2806420 - DNA, 14 bp, Homo sapiens
ccaggtcctctgat

SEQ ID NO: 2806421 - DNA, 14 bp, Homo sapiens
ccaggtcctggtgg

SEQ ID NO: 2806422 - DNA, 19 bp, Homo sapiens
ccaggtcctggtggggcag

SEQ ID NO: 2806423 - DNA, 16 bp, Homo sapiens
ccaggtggctgaccca

SEQ ID NO: 2806424 - DNA, 17 bp, Homo sapiens
ccaggtggctgacccag

SEQ ID NO: 2806425 - DNA, 20 bp, Homo sapiens
ccaggtggctgacccagtcc

SEQ ID NO: 2806426 - DNA, 15 bp, Homo sapiens
ccaggttcagcttgt

SEQ ID NO: 2806427 - DNA, 16 bp, Homo sapiens
ccaggttgaaagacct

SEQ ID NO: 2806428 - DNA, 17 bp, Homo sapiens
ccagtacctttgtcaca

SEQ ID NO: 2806429 - DNA, 19 bp, Homo sapiens
cccaggtggctgacccagt

SEQ ID NO: 2806430 - DNA, 12 bp, Homo sapiens
cccagtccctgg

SEQ ID NO: 2806431 - DNA, 14 bp, Homo sapiens
cccagtccctgggg

SEQ ID NO: 2806432 - DNA, 16 bp, Homo sapiens
cccagtccctggggga

SEQ ID NO: 2806433 - DNA, 16 bp, Homo sapiens
cccagtcgagccctgc

SEQ ID NO: 2806434 - DNA, 21 bp, Homo sapiens
cccagtcgagccctgcagcca

SEQ ID NO: 2806435 - DNA, 15 bp, Homo sapiens
cccagtgacagctag

SEQ ID NO: 2806436 - DNA, 14 bp, Homo sapiens
cccagtgccacaga

SEQ ID NO: 2806437 - DNA, 15 bp, Homo sapiens
cccagtgcccacagg

SEQ ID NO: 2806438 - DNA, 20 bp, Homo sapiens
cccagtgtaaagaataaatg

SEQ ID NO: 2806439 - DNA, 21 bp, Homo sapiens
cccagttctgctcctctccag

SEQ ID NO: 2806440 - DNA, 23 bp, Homo sapiens
cccataattttttttttcctttt

SEQ ID NO: 2806441 - DNA, 16 bp, Homo sapiens
cccatagatcttctga

SEQ ID NO: 2806442 - DNA, 14 bp, Homo sapiens
cccatcatcccagc

SEQ ID NO: 2806443 - DNA, 21 bp, Homo sapiens
cccatccagttcatgagaatc

SEQ ID NO: 2806444 - DNA, 18 bp, Homo sapiens
cccatccccagcgattcc

SEQ ID NO: 2806445 - DNA, 14 bp, Homo sapiens
cccatcccctttcc

SEQ ID NO: 2806446 - DNA, 18 bp, Homo sapiens
cccatctaagctgcagct

SEQ ID NO: 2806447 - DNA, 17 bp, Homo sapiens
cccatctgctcctccca

SEQ ID NO: 2806448 - DNA, 18 bp, Homo sapiens
cccatctgctcctcccat

SEQ ID NO: 2806449 - DNA, 16 bp, Homo sapiens
cccatgaatcaaagac

SEQ ID NO: 2806450 - DNA, 14 bp, Homo sapiens
cccatgagcctcag

SEQ ID NO: 2806451 - DNA, 22 bp, Homo sapiens
cccatgagcctcagcatcctgg

SEQ ID NO: 2806452 - DNA, 20 bp, Homo sapiens
cccatgctcaaccactgtgg

SEQ ID NO: 2806453 - DNA, 14 bp, Homo sapiens
cccatgctgaatta

SEQ ID NO: 2806454 - DNA, 23 bp, Homo sapiens
cccatgggggtgctgcagccagg

SEQ ID NO: 2806455 - DNA, 16 bp, Homo sapiens
cccatgtctctcagaa

SEQ ID NO: 2806456 - DNA, 13 bp, Homo sapiens
cccattcacagag

SEQ ID NO: 2806457 - DNA, 16 bp, Homo sapiens
cccattcacagagcct

SEQ ID NO: 2806458 - DNA, 13 bp, Homo sapiens
cccattcagacac

SEQ ID NO: 2806459 - DNA, 18 bp, Homo sapiens
cccattctctctcctgtc

SEQ ID NO: 2806460 - DNA, 12 bp, Homo sapiens
cccattcttcct

SEQ ID NO: 2806461 - DNA, 13 bp, Homo sapiens
cccatttccttgg

SEQ ID NO: 2806462 - DNA, 18 bp, Homo sapiens
cccatttgtaatgtatct

SEQ ID NO: 2806463 - DNA, 18 bp, Homo sapiens
cccattttgagtgactcg

SEQ ID NO: 2806464 - DNA, 19 bp, Homo sapiens
cccattttgcaaaatttcc

SEQ ID NO: 2806465 - DNA, 22 bp, Homo sapiens
cccatttttgagccaagcttca

SEQ ID NO: 2806466 - DNA, 20 bp, Homo sapiens
ccccaaaaacctcacccgag

SEQ ID NO: 2806467 - DNA, 15 bp, Homo sapiens
ccccaaagagcctgg

SEQ ID NO: 2806468 - DNA, 19 bp, Homo sapiens
ccccaaagagcctggagaa

SEQ ID NO: 2806469 - DNA, 20 bp, Homo sapiens
ccccaacccgtggaggctgc

SEQ ID NO: 2806470 - DNA, 15 bp, Homo sapiens
ccccaactcctggaa

SEQ ID NO: 2806471 - DNA, 14 bp, Homo sapiens
ccccaagctgtttt

SEQ ID NO: 2806472 - DNA, 16 bp, Homo sapiens
ccccaagctgttttct

SEQ ID NO: 2806473 - DNA, 22 bp, Homo sapiens
ccccaagtccacctgcctatcc

SEQ ID NO: 2806474 - DNA, 17 bp, Homo sapiens
ccccaccacttctttta

SEQ ID NO: 2806475 - DNA, 12 bp, Homo sapiens
ccccaccccacg

SEQ ID NO: 2806476 - DNA, 23 bp, Homo sapiens
ccccaccccctccccaggggaga

SEQ ID NO: 2806477 - DNA, 12 bp, Homo sapiens
ccccaccccctt

SEQ ID NO: 2806478 - DNA, 21 bp, Homo sapiens
ccccacccccttcagtgccca

SEQ ID NO: 2806479 - DNA, 21 bp, Homo sapiens
ccccaccctcgtggacacctg

SEQ ID NO: 2806480 - DNA, 23 bp, Homo sapiens
ccccaccctcgtggacacctgcc

SEQ ID NO: 2806481 - DNA, 12 bp, Homo sapiens
ccccacctgcca

SEQ ID NO: 2806482 - DNA, 20 bp, Homo sapiens
ccccactctcattccccagg

SEQ ID NO: 2806483 - DNA, 13 bp, Homo sapiens
ccccactctgctc

SEQ ID NO: 2806484 - DNA, 15 bp, Homo sapiens
ccccactctgctctg

SEQ ID NO: 2806485 - DNA, 16 bp, Homo sapiens
ccccactctgctctga

SEQ ID NO: 2806486 - DNA, 21 bp, Homo sapiens
ccccacttctctactctggaa

SEQ ID NO: 2806487 - DNA, 16 bp, Homo sapiens
ccccagaaggcaggga

SEQ ID NO: 2806488 - DNA, 21 bp, Homo sapiens
ccccagacacaccccccagtc

SEQ ID NO: 2806489 - DNA, 13 bp, Homo sapiens
ccccagacttctc

SEQ ID NO: 2806490 - DNA, 23 bp, Homo sapiens
ccccagattgcaacaggctgggc

SEQ ID NO: 2806491 - DNA, 21 bp, Homo sapiens
ccccagcaagtgagagctggg

SEQ ID NO: 2806492 - DNA, 16 bp, Homo sapiens
ccccagcactcctctg

SEQ ID NO: 2806493 - DNA, 22 bp, Homo sapiens
ccccagcactcctctgtctctg

SEQ ID NO: 2806494 - DNA, 13 bp, Homo sapiens
ccccagcccccac

SEQ ID NO: 2806495 - DNA, 19 bp, Homo sapiens
ccccagcccctcctcccct

SEQ ID NO: 2806496 - DNA, 21 bp, Homo sapiens
ccccagcccctcctccccttc

SEQ ID NO: 2806497 - DNA, 13 bp, Homo sapiens
ccccagcctgcta

SEQ ID NO: 2806498 - DNA, 11 bp, Homo sapiens
ccccagcctgg

SEQ ID NO: 2806499 - DNA, 16 bp, Homo sapiens
ccccagcctgggccta

SEQ ID NO: 2806500 - DNA, 20 bp, Homo sapiens
ccccagcctgggcctatgga

SEQ ID NO: 2806501 - DNA, 14 bp, Homo sapiens
ccccagctccccag

SEQ ID NO: 2806502 - DNA, 17 bp, Homo sapiens
ccccagctccccaggac

SEQ ID NO: 2806503 - DNA, 17 bp, Homo sapiens
ccccagctctggcttcc

SEQ ID NO: 2806504 - DNA, 22 bp, Homo sapiens
ccccagctgtcatcaattaaag

SEQ ID NO: 2806505 - DNA, 17 bp, Homo sapiens
ccccaggactcaccctc

SEQ ID NO: 2806506 - DNA, 20 bp, Homo sapiens
ccccagggcccccacaggcc

SEQ ID NO: 2806507 - DNA, 17 bp, Homo sapiens
ccccaggtctctccact

SEQ ID NO: 2806508 - DNA, 23 bp, Homo sapiens
ccccaggtggctgacccagtccc

SEQ ID NO: 2806509 - DNA, 15 bp, Homo sapiens
ccccagtgccacaga

SEQ ID NO: 2806510 - DNA, 20 bp, Homo sapiens
ccccagtgccacagagaaga

SEQ ID NO: 2806511 - DNA, 14 bp, Homo sapiens
ccccagtgcccaca

SEQ ID NO: 2806512 - DNA, 16 bp, Homo sapiens
ccccagtgcccacagg

SEQ ID NO: 2806513 - DNA, 17 bp, Homo sapiens
ccccagtgtggccccag

SEQ ID NO: 2806514 - DNA, 15 bp, Homo sapiens
ccccagttctgctcc

SEQ ID NO: 2806515 - DNA, 18 bp, Homo sapiens
ccccagttctgctcctct

SEQ ID NO: 2806516 - DNA, 19 bp, Homo sapiens
ccccagttctgctcctctc

SEQ ID NO: 2806517 - DNA, 22 bp, Homo sapiens
ccccataattttttttttcctt

SEQ ID NO: 2806518 - DNA, 17 bp, Homo sapiens
ccccatcagaggctggg

SEQ ID NO: 2806519 - DNA, 22 bp, Homo sapiens
ccccatcatatcctttgcccca

SEQ ID NO: 2806520 - DNA, 21 bp, Homo sapiens
ccgcagccagccggtgcctgg

SEQ ID NO: 2806521 - DNA, 16 bp, Homo sapiens
ccgcatcttctccatc

SEQ ID NO: 2806522 - DNA, 20 bp, Homo sapiens
ccgcatcttctccatctggc

SEQ ID NO: 2806523 - DNA, 13 bp, Homo sapiens
ccgcattccctga

SEQ ID NO: 2806524 - DNA, 14 bp, Homo sapiens
ccgcattccctgag

SEQ ID NO: 2806525 - DNA, 22 bp, Homo sapiens
ccgcccagctgcacctgccagc

SEQ ID NO: 2806526 - DNA, 14 bp, Homo sapiens
ccgccccagacaca

SEQ ID NO: 2806527 - DNA, 12 bp, Homo sapiens
ccgcctccagga

SEQ ID NO: 2806528 - DNA, 13 bp, Homo sapiens
ccgcctccaggag

SEQ ID NO: 2806529 - DNA, 18 bp, Homo sapiens
ccgcctggccggctccag

SEQ ID NO: 2806530 - DNA, 19 bp, Homo sapiens
ccgcctgtgcccacgtgtg

SEQ ID NO: 2806531 - DNA, 16 bp, Homo sapiens
ccgcgcctccttcctt

SEQ ID NO: 2806532 - DNA, 20 bp, Homo sapiens
ccgctacaccactctggcag

SEQ ID NO: 2806533 - DNA, 14 bp, Homo sapiens
ccgctcctgtctgc

SEQ ID NO: 2806534 - DNA, 17 bp, Homo sapiens
ccgctcctgtctgccag

SEQ ID NO: 2806535 - DNA, 20 bp, Homo sapiens
ccgctgcctaagtggctgct

SEQ ID NO: 2806536 - DNA, 20 bp, Homo sapiens
ccgctggctcctccaggcac

SEQ ID NO: 2806537 - DNA, 15 bp, Homo sapiens
ccgctgttcacccac

SEQ ID NO: 2806538 - DNA, 18 bp, Homo sapiens
ccgcttccccacagaact

SEQ ID NO: 2806539 - DNA, 12 bp, Homo sapiens
ccgctttctacc

SEQ ID NO: 2806540 - DNA, 23 bp, Homo sapiens
ccgctttctacccagcgagccct

SEQ ID NO: 2806541 - DNA, 21 bp, Homo sapiens
ccggacctgtggggccccaga

SEQ ID NO: 2806542 - DNA, 20 bp, Homo sapiens
ccggactcaagccccggact

SEQ ID NO: 2806543 - DNA, 20 bp, Homo sapiens
ccggcaaccccagttctgct

SEQ ID NO: 2806544 - DNA, 23 bp, Homo sapiens
ccggcaaccccagttctgctcct

SEQ ID NO: 2806545 - DNA, 14 bp, Homo sapiens
ccggcacacaaggc

SEQ ID NO: 2806546 - DNA, 14 bp, Homo sapiens
ccggcaccccctgc

SEQ ID NO: 2806547 - DNA, 19 bp, Homo sapiens
ccggcccagagaccccttc

SEQ ID NO: 2806548 - DNA, 14 bp, Homo sapiens
ccggcccctgctgg

SEQ ID NO: 2806549 - DNA, 20 bp, Homo sapiens
ccggcctgctcccagcagcc

SEQ ID NO: 2806550 - DNA, 12 bp, Homo sapiens
ccggctccccct

SEQ ID NO: 2806551 - DNA, 13 bp, Homo sapiens
ccggctccccctg

SEQ ID NO: 2806552 - DNA, 15 bp, Homo sapiens
ccggctccccctgct

SEQ ID NO: 2806553 - DNA, 15 bp, Homo sapiens
ccgggacagacctgg

SEQ ID NO: 2806554 - DNA, 12 bp, Homo sapiens
ccgggagaggag

SEQ ID NO: 2806555 - DNA, 13 bp, Homo sapiens
ccgggccactcct

SEQ ID NO: 2806556 - DNA, 19 bp, Homo sapiens
ccgggccactccttcctgc

SEQ ID NO: 2806557 - DNA, 17 bp, Homo sapiens
ccgggcttgggccctgc

SEQ ID NO: 2806558 - DNA, 20 bp, Homo sapiens
ccgggcttgggccctgcaca

SEQ ID NO: 2806559 - DNA, 18 bp, Homo sapiens
ccggggaactggccaagc

SEQ ID NO: 2806560 - DNA, 15 bp, Homo sapiens
ccgggggaggaaggg

SEQ ID NO: 2806561 - DNA, 15 bp, Homo sapiens
ccgggtacctcagtt

SEQ ID NO: 2806562 - DNA, 18 bp, Homo sapiens
ccgggtacctcagtttct

SEQ ID NO: 2806563 - DNA, 18 bp, Homo sapiens
ccgggtccccagctcccc

SEQ ID NO: 2806564 - DNA, 20 bp, Homo sapiens
ccgggtggaaaagaatccct

SEQ ID NO: 2806565 - DNA, 17 bp, Homo sapiens
ccgggttctagtctcct

SEQ ID NO: 2806566 - DNA, 20 bp, Homo sapiens
ccgggttctagtctcctttg

SEQ ID NO: 2806567 - DNA, 22 bp, Homo sapiens
ccggtcctggccccagccccca

SEQ ID NO: 2806568 - DNA, 11 bp, Homo sapiens
ccggtgtcctt

SEQ ID NO: 2806569 - DNA, 15 bp, Homo sapiens
ccggtgtgcctgcag

SEQ ID NO: 2806570 - DNA, 21 bp, Homo sapiens
ccggtgtggtggctcacgcct

SEQ ID NO: 2806571 - DNA, 20 bp, Homo sapiens
ccgtacccccgtggtctttg

SEQ ID NO: 2806572 - DNA, 15 bp, Homo sapiens
ccgtagttccctgaa

SEQ ID NO: 2806573 - DNA, 16 bp, Homo sapiens
ccgtagttccctgaaa

SEQ ID NO: 2806574 - DNA, 22 bp, Homo sapiens
ccgtcaaaacagattgtttgca

SEQ ID NO: 2806575 - DNA, 16 bp, Homo sapiens
ccgtccaggagcctgg

SEQ ID NO: 2806576 - DNA, 18 bp, Homo sapiens
ccgtccaggagcctgtgc

SEQ ID NO: 2806577 - DNA, 16 bp, Homo sapiens
ccgtctccctaaaata

SEQ ID NO: 2806578 - DNA, 18 bp, Homo sapiens
ccgtctccctaaaataaa

SEQ ID NO: 2806579 - DNA, 20 bp, Homo sapiens
ccgtctggggttcagcccct

SEQ ID NO: 2806580 - DNA, 22 bp, Homo sapiens
ccgtctggggttcagcccctcc

SEQ ID NO: 2806581 - DNA, 13 bp, Homo sapiens
ccgtctgtgaatt

SEQ ID NO: 2806582 - DNA, 15 bp, Homo sapiens
ccgtcttctctccat

SEQ ID NO: 2806583 - DNA, 14 bp, Homo sapiens
ccgtgaagggcacc

SEQ ID NO: 2806584 - DNA, 23 bp, Homo sapiens
ccgtgatgtagggtaaggtgcct

SEQ ID NO: 2806585 - DNA, 20 bp, Homo sapiens
ccgtgccaagtccaggtcct

SEQ ID NO: 2806586 - DNA, 17 bp, Homo sapiens
ccgtggaccttcctgcc

SEQ ID NO: 2806587 - DNA, 17 bp, Homo sapiens
ccgtggcccttcctgga

SEQ ID NO: 2806588 - DNA, 14 bp, Homo sapiens
ccgtggtccagctc

SEQ ID NO: 2806589 - DNA, 16 bp, Homo sapiens
ccgtggtccagctctt

SEQ ID NO: 2806590 - DNA, 12 bp, Homo sapiens
ccgtggtctttg

SEQ ID NO: 2806591 - DNA, 14 bp, Homo sapiens
ccgtggtctttgaa

SEQ ID NO: 2806592 - DNA, 23 bp, Homo sapiens
ccgtgtccagcacagaaggaatc

SEQ ID NO: 2806593 - DNA, 18 bp, Homo sapiens
ccgttctgctggcctgga

SEQ ID NO: 2806594 - DNA, 13 bp, Homo sapiens
cctaaaataaaaa

SEQ ID NO: 2806595 - DNA, 15 bp, Homo sapiens
cctaaaataaaaacc

SEQ ID NO: 2806596 - DNA, 23 bp, Homo sapiens
cctaaacagatataaatggctgg

SEQ ID NO: 2806597 - DNA, 16 bp, Homo sapiens
cctaaatccaaagaaa

SEQ ID NO: 2806598 - DNA, 12 bp, Homo sapiens
cctaaccccttt

SEQ ID NO: 2806599 - DNA, 14 bp, Homo sapiens
cctaagaagctctg

SEQ ID NO: 2806600 - DNA, 20 bp, Homo sapiens
cctaagaggcgacttcctct

SEQ ID NO: 2806601 - DNA, 24 bp, Homo sapiens
cctaagaggcgacttcctctccag

SEQ ID NO: 2806602 - DNA, 19 bp, Homo sapiens
cctaaggatctctcaggag

SEQ ID NO: 2806603 - DNA, 22 bp, Homo sapiens
cctaataaacatccttcaagaa

SEQ ID NO: 2806604 - DNA, 20 bp, Homo sapiens
cctaattcaattcaaagctg

SEQ ID NO: 2806605 - DNA, 21 bp, Homo sapiens
cctacagataatttattttgt

SEQ ID NO: 2806606 - DNA, 18 bp, Homo sapiens
cctacaggagtgagcact

SEQ ID NO: 2806607 - DNA, 14 bp, Homo sapiens
cctaccacagtgtc

SEQ ID NO: 2806608 - DNA, 16 bp, Homo sapiens
cctaccacagtgtctg

SEQ ID NO: 2806609 - DNA, 13 bp, Homo sapiens
cctacccaccctc

SEQ ID NO: 2806610 - DNA, 11 bp, Homo sapiens
cctaccccacc

SEQ ID NO: 2806611 - DNA, 22 bp, Homo sapiens
cctgcatccgtagttccctgaa

SEQ ID NO: 2806612 - DNA, 14 bp, Homo sapiens
cctgccaccagtca

SEQ ID NO: 2806613 - DNA, 12 bp, Homo sapiens
cctgccacctgt

SEQ ID NO: 2806614 - DNA, 14 bp, Homo sapiens
cctgccacctgtct

SEQ ID NO: 2806615 - DNA, 15 bp, Homo sapiens
cctgccacctgtctg

SEQ ID NO: 2806616 - DNA, 17 bp, Homo sapiens
cctgccacctgtctgtc

SEQ ID NO: 2806617 - DNA, 13 bp, Homo sapiens
cctgccagcctgg

SEQ ID NO: 2806618 - DNA, 14 bp, Homo sapiens
cctgccagcctggc

SEQ ID NO: 2806619 - DNA, 23 bp, Homo sapiens
cctgccagcgtcagaggccctgg

SEQ ID NO: 2806620 - DNA, 17 bp, Homo sapiens
cctgccagggcccctgt

SEQ ID NO: 2806621 - DNA, 17 bp, Homo sapiens
cctgccagtgccttacc

SEQ ID NO: 2806622 - DNA, 21 bp, Homo sapiens
cctgccagtgccttacctcct

SEQ ID NO: 2806623 - DNA, 22 bp, Homo sapiens
cctgccagtgccttacctcctg

SEQ ID NO: 2806624 - DNA, 17 bp, Homo sapiens
cctgccatttgcaccct

SEQ ID NO: 2806625 - DNA, 16 bp, Homo sapiens
cctgcccagcctcgca

SEQ ID NO: 2806626 - DNA, 14 bp, Homo sapiens
cctgcccaggcccc

SEQ ID NO: 2806627 - DNA, 19 bp, Homo sapiens
cctgcccaggcccctgcca

SEQ ID NO: 2806628 - DNA, 22 bp, Homo sapiens
cctgcccaggcccctgccaccc

SEQ ID NO: 2806629 - DNA, 14 bp, Homo sapiens
cctgccccaactcc

SEQ ID NO: 2806630 - DNA, 22 bp, Homo sapiens
cctgccccaactccttccagct

SEQ ID NO: 2806631 - DNA, 15 bp, Homo sapiens
cctgcccccagcact

SEQ ID NO: 2806632 - DNA, 13 bp, Homo sapiens
cctgccccctggt

SEQ ID NO: 2806633 - DNA, 15 bp, Homo sapiens
cctgccccctggtgg

SEQ ID NO: 2806634 - DNA, 22 bp, Homo sapiens
cctgccccgcccagctgcacct

SEQ ID NO: 2806635 - DNA, 23 bp, Homo sapiens
cctgcccctcacctgcctgccct

SEQ ID NO: 2806636 - DNA, 18 bp, Homo sapiens
cctgcccctcttcccggg

SEQ ID NO: 2806637 - DNA, 14 bp, Homo sapiens
cctgcccggctgcg

SEQ ID NO: 2806638 - DNA, 16 bp, Homo sapiens
cctgcccggctgcgga

SEQ ID NO: 2806639 - DNA, 21 bp, Homo sapiens
cctgccctgccacctgtctgt

SEQ ID NO: 2806640 - DNA, 21 bp, Homo sapiens
cctgcccttgtttggggcagg

SEQ ID NO: 2806641 - DNA, 22 bp, Homo sapiens
cctgcccttgtttggggcagga

SEQ ID NO: 2806642 - DNA, 19 bp, Homo sapiens
cctgcctacattccctggc

SEQ ID NO: 2806643 - DNA, 21 bp, Homo sapiens
cctgcctacattccctggcct

SEQ ID NO: 2806644 - DNA, 21 bp, Homo sapiens
cctgcctaggaattcccagcc

SEQ ID NO: 2806645 - DNA, 18 bp, Homo sapiens
cctgcctatccatcctgc

SEQ ID NO: 2806646 - DNA, 12 bp, Homo sapiens
cctgcctcagcc

SEQ ID NO: 2806647 - DNA, 13 bp, Homo sapiens
cctgcctcagcct

SEQ ID NO: 2806648 - DNA, 14 bp, Homo sapiens
cctgcctcagcctc

SEQ ID NO: 2806649 - DNA, 15 bp, Homo sapiens
cctgcctcagcctcc

SEQ ID NO: 2806650 - DNA, 21 bp, Homo sapiens
cctgcctcgaactggctgcaa

SEQ ID NO: 2806651 - DNA, 12 bp, Homo sapiens
cctgcctctact

SEQ ID NO: 2806652 - DNA, 12 bp, Homo sapiens
cctgcctggagg

SEQ ID NO: 2806653 - DNA, 17 bp, Homo sapiens
cctgcctggaggacctg

SEQ ID NO: 2806654 - DNA, 19 bp, Homo sapiens
cctgcctggaggacctgag

SEQ ID NO: 2806655 - DNA, 20 bp, Homo sapiens
cctgcctggaggacctgagc

SEQ ID NO: 2806656 - DNA, 21 bp, Homo sapiens
cctgcctggaggacctgagcc

SEQ ID NO: 2806657 - DNA, 22 bp, Homo sapiens
cctgcctgttcccattcttgca

SEQ ID NO: 2806658 - DNA, 21 bp, Homo sapiens
cctgccttgaagccactgaag

SEQ ID NO: 2806659 - DNA, 19 bp, Homo sapiens
cctgcgaaggggccctggt

SEQ ID NO: 2806660 - DNA, 20 bp, Homo sapiens
cctgcgaaggggccctggtc

SEQ ID NO: 2806661 - DNA, 16 bp, Homo sapiens
  misc_feature (6)..(6): n is a, c, g or t
cctgcnttgtccctgg

SEQ ID NO: 2806662 - DNA, 21 bp, Homo sapiens
cctgctaattccccagattgc

SEQ ID NO: 2806663 - DNA, 17 bp, Homo sapiens
cctgctagctgtagaaa

SEQ ID NO: 2806664 - DNA, 14 bp, Homo sapiens
cctgctcccagcag

SEQ ID NO: 2806665 - DNA, 16 bp, Homo sapiens
cctgctcccagcagcc

SEQ ID NO: 2806666 - DNA, 14 bp, Homo sapiens
cctgctcccccacc

SEQ ID NO: 2806667 - DNA, 18 bp, Homo sapiens
cctgctcccccaccccct

SEQ ID NO: 2806668 - DNA, 21 bp, Homo sapiens
cctgctctcctcttgccactg

SEQ ID NO: 2806669 - DNA, 19 bp, Homo sapiens
cctgctgaaacacctccca

SEQ ID NO: 2806670 - DNA, 22 bp, Homo sapiens
cctgctgaaacacctcccaggg

SEQ ID NO: 2806671 - DNA, 11 bp, Homo sapiens
cctgctgagct

SEQ ID NO: 2806672 - DNA, 14 bp, Homo sapiens
cctgctgagctctg

SEQ ID NO: 2806673 - DNA, 24 bp, Homo sapiens
cctgctgagctctgagaggccctg

SEQ ID NO: 2806674 - DNA, 15 bp, Homo sapiens
cctgctgccgcctcc

SEQ ID NO: 2806675 - DNA, 18 bp, Homo sapiens
cctgctgccgcctcccag

SEQ ID NO: 2806676 - DNA, 21 bp, Homo sapiens
cctgctgccgcctcccagcct

SEQ ID NO: 2806677 - DNA, 18 bp, Homo sapiens
cctgctgcggccagcctg

SEQ ID NO: 2806678 - DNA, 14 bp, Homo sapiens
cctgctgctgagaa

SEQ ID NO: 2806679 - DNA, 16 bp, Homo sapiens
cctgctgctgagaacc

SEQ ID NO: 2806680 - DNA, 19 bp, Homo sapiens
cctgctgctgagaacctgg

SEQ ID NO: 2806681 - DNA, 21 bp, Homo sapiens
cctgctgctgagaacctggcc

SEQ ID NO: 2806682 - DNA, 20 bp, Homo sapiens
cctgctgctgtgtttttgct

SEQ ID NO: 2806683 - DNA, 23 bp, Homo sapiens
cctgctgggctctccacctcagc

SEQ ID NO: 2806684 - DNA, 12 bp, Homo sapiens
cctgcttctctg

SEQ ID NO: 2806685 - DNA, 23 bp, Homo sapiens
cctgcttggggggtgatgagggc

SEQ ID NO: 2806686 - DNA, 15 bp, Homo sapiens
cctggaaaggctcag

SEQ ID NO: 2806687 - DNA, 13 bp, Homo sapiens
cctggaaccaatc

SEQ ID NO: 2806688 - DNA, 17 bp, Homo sapiens
cctggaagctgtgtcct

SEQ ID NO: 2806689 - DNA, 20 bp, Homo sapiens
cctggaagctgtgtccttgc

SEQ ID NO: 2806690 - DNA, 19 bp, Homo sapiens
cctggaatgaagcatgtag

SEQ ID NO: 2806691 - DNA, 13 bp, Homo sapiens
cctggacactagg

SEQ ID NO: 2806692 - DNA, 16 bp, Homo sapiens
cctggacagctgtgcc

SEQ ID NO: 2806693 - DNA, 17 bp, Homo sapiens
cctggacagctgtgcct

SEQ ID NO: 2806694 - DNA, 18 bp, Homo sapiens
cctggacagctgtgcctc

SEQ ID NO: 2806695 - DNA, 21 bp, Homo sapiens
cctggacagctgtgcctcgct

SEQ ID NO: 2806696 - DNA, 20 bp, Homo sapiens
cctggaccaccagccccagc

SEQ ID NO: 2806697 - DNA, 22 bp, Homo sapiens
cctggaccaccagccccagcaa

SEQ ID NO: 2806698 - DNA, 23 bp, Homo sapiens
cctggactttggttctctccagg

SEQ ID NO: 2806699 - DNA, 19 bp, Homo sapiens
cctggagcggctctcctga

SEQ ID NO: 2806700 - DNA, 12 bp, Homo sapiens
cctggaggacct

SEQ ID NO: 2806701 - DNA, 15 bp, Homo sapiens
ccttctcctgcctac

SEQ ID NO: 2806702 - DNA, 20 bp, Homo sapiens
ccttctgctggataaaatga

SEQ ID NO: 2806703 - DNA, 21 bp, Homo sapiens
ccttctgctggataaaatgag

SEQ ID NO: 2806704 - DNA, 21 bp, Homo sapiens
ccttctgtcctactctgtgtc

SEQ ID NO: 2806705 - DNA, 17 bp, Homo sapiens
ccttcttattctcactc

SEQ ID NO: 2806706 - DNA, 18 bp, Homo sapiens
ccttcttattctcactcc

SEQ ID NO: 2806707 - DNA, 14 bp, Homo sapiens
ccttcttcacccag

SEQ ID NO: 2806708 - DNA, 13 bp, Homo sapiens
ccttcttcgctgc

SEQ ID NO: 2806709 - DNA, 14 bp, Homo sapiens
ccttctttaaatca

SEQ ID NO: 2806710 - DNA, 13 bp, Homo sapiens
ccttctttcctct

SEQ ID NO: 2806711 - DNA, 17 bp, Homo sapiens
ccttctttcctcttccc

SEQ ID NO: 2806712 - DNA, 16 bp, Homo sapiens
ccttgaactgggtact

SEQ ID NO: 2806713 - DNA, 18 bp, Homo sapiens
ccttgaactgttctggcc

SEQ ID NO: 2806714 - DNA, 19 bp, Homo sapiens
ccttgagaaaccttattgt

SEQ ID NO: 2806715 - DNA, 19 bp, Homo sapiens
ccttgagacctcagccatg

SEQ ID NO: 2806716 - DNA, 17 bp, Homo sapiens
ccttgagctccccaaaa

SEQ ID NO: 2806717 - DNA, 14 bp, Homo sapiens
ccttgatctgtata

SEQ ID NO: 2806718 - DNA, 12 bp, Homo sapiens
ccttgcacctgc

SEQ ID NO: 2806719 - DNA, 14 bp, Homo sapiens
ccttgcacctgcat

SEQ ID NO: 2806720 - DNA, 19 bp, Homo sapiens
ccttgccaagctttcttct

SEQ ID NO: 2806721 - DNA, 19 bp, Homo sapiens
ccttgcccagagatgcctc

SEQ ID NO: 2806722 - DNA, 23 bp, Homo sapiens
ccttgcccagagatgcctccacc

SEQ ID NO: 2806723 - DNA, 13 bp, Homo sapiens
ccttgcccagggc

SEQ ID NO: 2806724 - DNA, 20 bp, Homo sapiens
ccttgcccagggctcagcct

SEQ ID NO: 2806725 - DNA, 16 bp, Homo sapiens
ccttgcccttgccctg

SEQ ID NO: 2806726 - DNA, 22 bp, Homo sapiens
ccttgctctcccctgccctgct

SEQ ID NO: 2806727 - DNA, 16 bp, Homo sapiens
ccttgctgtcctaggc

SEQ ID NO: 2806728 - DNA, 16 bp, Homo sapiens
ccttggactcctccca

SEQ ID NO: 2806729 - DNA, 18 bp, Homo sapiens
ccttggataatgctgttg

SEQ ID NO: 2806730 - DNA, 22 bp, Homo sapiens
ccttggataatgctgttgcctc

SEQ ID NO: 2806731 - DNA, 23 bp, Homo sapiens
ccttggataatgctgttgcctca

SEQ ID NO: 2806732 - DNA, 21 bp, Homo sapiens
ccttggcgggcagcccagcct

SEQ ID NO: 2806733 - DNA, 18 bp, Homo sapiens
ccttggctcaatcctcta

SEQ ID NO: 2806734 - DNA, 14 bp, Homo sapiens
ccttggctgcaggg

SEQ ID NO: 2806735 - DNA, 16 bp, Homo sapiens
ccttggctgcagggag

SEQ ID NO: 2806736 - DNA, 16 bp, Homo sapiens
ccttggtgtccacctg

SEQ ID NO: 2806737 - DNA, 18 bp, Homo sapiens
ccttggtgtccacctggc

SEQ ID NO: 2806738 - DNA, 19 bp, Homo sapiens
ccttggtgtccacctggcc

SEQ ID NO: 2806739 - DNA, 16 bp, Homo sapiens
ccttgtatttaaatat

SEQ ID NO: 2806740 - DNA, 18 bp, Homo sapiens
ccttgtgtgcatttctgt

SEQ ID NO: 2806741 - DNA, 11 bp, Homo sapiens
ccttgttctgt

SEQ ID NO: 2806742 - DNA, 19 bp, Homo sapiens
ccttgtttggggcaggagt

SEQ ID NO: 2806743 - DNA, 16 bp, Homo sapiens
cctttattaatgaact

SEQ ID NO: 2806744 - DNA, 17 bp, Homo sapiens
cctttattgctcctgta

SEQ ID NO: 2806745 - DNA, 16 bp, Homo sapiens
cctttcaaatttcaca

SEQ ID NO: 2806746 - DNA, 21 bp, Homo sapiens
cctttcacaaaattttattcc

SEQ ID NO: 2806747 - DNA, 17 bp, Homo sapiens
cctttcatccccacctt

SEQ ID NO: 2806748 - DNA, 16 bp, Homo sapiens
cctttccctcaccccc

SEQ ID NO: 2806749 - DNA, 13 bp, Homo sapiens
cctttcctcccca

SEQ ID NO: 2806750 - DNA, 16 bp, Homo sapiens
cctttcctccccacct

SEQ ID NO: 2806751 - DNA, 16 bp, Homo sapiens
cctttcctgggggatg

SEQ ID NO: 2806752 - DNA, 15 bp, Homo sapiens
cctttctagttgaaa

SEQ ID NO: 2806753 - DNA, 18 bp, Homo sapiens
cctttctccagccagcaa

SEQ ID NO: 2806754 - DNA, 23 bp, Homo sapiens
cctttctgagtgacatgggtgtg

SEQ ID NO: 2806755 - DNA, 14 bp, Homo sapiens
cctttgaatcctct

SEQ ID NO: 2806756 - DNA, 14 bp, Homo sapiens
cctttgagaaagaa

SEQ ID NO: 2806757 - DNA, 16 bp, Homo sapiens
cctttgagaaagaaat

SEQ ID NO: 2806758 - DNA, 16 bp, Homo sapiens
cctttgcactgagggc

SEQ ID NO: 2806759 - DNA, 21 bp, Homo sapiens
cctttgcattccatgatttta

SEQ ID NO: 2806760 - DNA, 14 bp, Homo sapiens
cctttgccccaagg

SEQ ID NO: 2806761 - DNA, 15 bp, Homo sapiens
cctttggccattcca

SEQ ID NO: 2806762 - DNA, 18 bp, Homo sapiens
cctttgtcatctttcttc

SEQ ID NO: 2806763 - DNA, 16 bp, Homo sapiens
cctttgtgtaataaaa

SEQ ID NO: 2806764 - DNA, 20 bp, Homo sapiens
cctttgttattatcctgcat

SEQ ID NO: 2806765 - DNA, 20 bp, Homo sapiens
cctttgtttttatgaagaaa

SEQ ID NO: 2806766 - DNA, 13 bp, Homo sapiens
ccttttaaaagaa

SEQ ID NO: 2806767 - DNA, 15 bp, Homo sapiens
ccttttcactacacc

SEQ ID NO: 2806768 - DNA, 23 bp, Homo sapiens
ccttttcccaaaatgttgaaata

SEQ ID NO: 2806769 - DNA, 14 bp, Homo sapiens
ccttttctttttcc

SEQ ID NO: 2806770 - DNA, 21 bp, Homo sapiens
cctttttccccaaagtcttaa

SEQ ID NO: 2806771 - DNA, 22 bp, Homo sapiens
cgaaagggacttggaagctccg

SEQ ID NO: 2806772 - DNA, 14 bp, Homo sapiens
cgaaccaatatttg

SEQ ID NO: 2806773 - DNA, 14 bp, Homo sapiens
cgaacccctcccct

SEQ ID NO: 2806774 - DNA, 14 bp, Homo sapiens
cgaaccctgccagg

SEQ ID NO: 2806775 - DNA, 14 bp, Homo sapiens
cgaactagaagaaa

SEQ ID NO: 2806776 - DNA, 14 bp, Homo sapiens
cgaactggctgcaa

SEQ ID NO: 2806777 - DNA, 14 bp, Homo sapiens
cgaagcccttccag

SEQ ID NO: 2806778 - DNA, 22 bp, Homo sapiens
cgaagcccttccagtggtacca

SEQ ID NO: 2806779 - DNA, 22 bp, Homo sapiens
cgaagctaacagggaaggcagg

SEQ ID NO: 2806780 - DNA, 15 bp, Homo sapiens
cgaattttattttac

SEQ ID NO: 2806781 - DNA, 16 bp, Homo sapiens
cgaattttattttaca

SEQ ID NO: 2806782 - DNA, 23 bp, Homo sapiens
cgaattttattttacagagcttg

SEQ ID NO: 2806783 - DNA, 12 bp, Homo sapiens
cgaccacctgcc

SEQ ID NO: 2806784 - DNA, 14 bp, Homo sapiens
cgaccacctgccca

SEQ ID NO: 2806785 - DNA, 23 bp, Homo sapiens
cgaccagacaccttgacagggca

SEQ ID NO: 2806786 - DNA, 15 bp, Homo sapiens
cgaccatgtgtagat

SEQ ID NO: 2806787 - DNA, 13 bp, Homo sapiens
cgacctcagcctt

SEQ ID NO: 2806788 - DNA, 19 bp, Homo sapiens
cgacctcgtcctccccctg

SEQ ID NO: 2806789 - DNA, 11 bp, Homo sapiens
cgactcaggat

SEQ ID NO: 2806790 - DNA, 14 bp, Homo sapiens
cgactcagggacct

SEQ ID NO: 2806791 - DNA, 15 bp, Homo sapiens
cgactccagccagcg

SEQ ID NO: 2806792 - DNA, 21 bp, Homo sapiens
ctacgtataaatatgaaatga

SEQ ID NO: 2806793 - DNA, 14 bp, Homo sapiens
ctacgtatttaata

SEQ ID NO: 2806794 - DNA, 16 bp, Homo sapiens
ctactaaaaatacaaa

SEQ ID NO: 2806795 - DNA, 20 bp, Homo sapiens
ctactcaagaggctgaggca

SEQ ID NO: 2806796 - DNA, 18 bp, Homo sapiens
ctactcacagtctcttta

SEQ ID NO: 2806797 - DNA, 19 bp, Homo sapiens
ctactcagaagcctgaggc

SEQ ID NO: 2806798 - DNA, 15 bp, Homo sapiens
ctactcagcagccct

SEQ ID NO: 2806799 - DNA, 16 bp, Homo sapiens
ctactcagcagccctc

SEQ ID NO: 2806800 - DNA, 21 bp, Homo sapiens
ctactcagcagccctcctcac

SEQ ID NO: 2806801 - DNA, 13 bp, Homo sapiens
ctactcaggaggc

SEQ ID NO: 2806802 - DNA, 21 bp, Homo sapiens
ctactcataagttggaccaga

SEQ ID NO: 2806803 - DNA, 16 bp, Homo sapiens
ctactcctacctcagc

SEQ ID NO: 2806804 - DNA, 18 bp, Homo sapiens
ctactcctacctcagcct

SEQ ID NO: 2806805 - DNA, 21 bp, Homo sapiens
ctactcgggaggctgaggcgg

SEQ ID NO: 2806806 - DNA, 17 bp, Homo sapiens
ctactctcctcggcccc

SEQ ID NO: 2806807 - DNA, 23 bp, Homo sapiens
ctactctggaagtccccgggagc

SEQ ID NO: 2806808 - DNA, 17 bp, Homo sapiens
ctactctgtgccagagc

SEQ ID NO: 2806809 - DNA, 18 bp, Homo sapiens
ctactctgtgccagagcc

SEQ ID NO: 2806810 - DNA, 19 bp, Homo sapiens
ctactctgtgccagagcct

SEQ ID NO: 2806811 - DNA, 21 bp, Homo sapiens
ctactctgtgccagagcctgg

SEQ ID NO: 2806812 - DNA, 22 bp, Homo sapiens
ctactctgtgccagagcctggg

SEQ ID NO: 2806813 - DNA, 22 bp, Homo sapiens
ctactgagcggacagaatgatg

SEQ ID NO: 2806814 - DNA, 19 bp, Homo sapiens
ctactgggaaattacttat

SEQ ID NO: 2806815 - DNA, 19 bp, Homo sapiens
ctactgtcctacccaccct

SEQ ID NO: 2806816 - DNA, 13 bp, Homo sapiens
ctactgtgactga

SEQ ID NO: 2806817 - DNA, 14 bp, Homo sapiens
ctactgtggaaaaa

SEQ ID NO: 2806818 - DNA, 15 bp, Homo sapiens
ctactgtggaaaaat

SEQ ID NO: 2806819 - DNA, 21 bp, Homo sapiens
ctactgtggaaaaatatttaa

SEQ ID NO: 2806820 - DNA, 17 bp, Homo sapiens
ctacttcggggctggga

SEQ ID NO: 2806821 - DNA, 20 bp, Homo sapiens
ctacttttgtaccagtgtga

SEQ ID NO: 2806822 - DNA, 21 bp, Homo sapiens
ctagaaagctctgcatgtgtg

SEQ ID NO: 2806823 - DNA, 15 bp, Homo sapiens
ctagaacatgcacat

SEQ ID NO: 2806824 - DNA, 20 bp, Homo sapiens
ctagaagtgggccaggacag

SEQ ID NO: 2806825 - DNA, 12 bp, Homo sapiens
ctagaatttatt

SEQ ID NO: 2806826 - DNA, 13 bp, Homo sapiens
ctagaatttattc

SEQ ID NO: 2806827 - DNA, 15 bp, Homo sapiens
ctagaatttattcaa

SEQ ID NO: 2806828 - DNA, 16 bp, Homo sapiens
ctagaatttgtatttt

SEQ ID NO: 2806829 - DNA, 22 bp, Homo sapiens
ctagactagtgctttaccttta

SEQ ID NO: 2806830 - DNA, 12 bp, Homo sapiens
ctagactttctc

SEQ ID NO: 2806831 - DNA, 17 bp, Homo sapiens
ctagagaagaggctggt

SEQ ID NO: 2806832 - DNA, 14 bp, Homo sapiens
ctagaggcagggag

SEQ ID NO: 2806833 - DNA, 18 bp, Homo sapiens
ctagaggcagggagggga

SEQ ID NO: 2806834 - DNA, 15 bp, Homo sapiens
ctagatcaaggagcc

SEQ ID NO: 2806835 - DNA, 20 bp, Homo sapiens
ctagatcaaggagcccagaa

SEQ ID NO: 2806836 - DNA, 13 bp, Homo sapiens
ctagatccacaca

SEQ ID NO: 2806837 - DNA, 14 bp, Homo sapiens
ctagatctcctgta

SEQ ID NO: 2806838 - DNA, 21 bp, Homo sapiens
ctagatctcctgtaattttgt

SEQ ID NO: 2806839 - DNA, 21 bp, Homo sapiens
ctagattaccccctcattgtt

SEQ ID NO: 2806840 - DNA, 17 bp, Homo sapiens
ctagattagaagtgttt

SEQ ID NO: 2806841 - DNA, 24 bp, Homo sapiens
ctagattgagagaagagacaaaca

SEQ ID NO: 2806842 - DNA, 14 bp, Homo sapiens
ctagcaactgttgg

SEQ ID NO: 2806843 - DNA, 19 bp, Homo sapiens
ctagcagagcaggggcagg

SEQ ID NO: 2806844 - DNA, 14 bp, Homo sapiens
ctagcagctgcagt

SEQ ID NO: 2806845 - DNA, 15 bp, Homo sapiens
ctagcaggcacagga

SEQ ID NO: 2806846 - DNA, 17 bp, Homo sapiens
ctagcaggcacaggaca

SEQ ID NO: 2806847 - DNA, 18 bp, Homo sapiens
ctagccctctcacattta

SEQ ID NO: 2806848 - DNA, 17 bp, Homo sapiens
ctagccgacctcagcct

SEQ ID NO: 2806849 - DNA, 22 bp, Homo sapiens
ctagcgctgccgcaccccagag

SEQ ID NO: 2806850 - DNA, 18 bp, Homo sapiens
ctagctgatcagaatttt

SEQ ID NO: 2806851 - DNA, 19 bp, Homo sapiens
ctagctgatcagaatttta

SEQ ID NO: 2806852 - DNA, 16 bp, Homo sapiens
ctaggaatgaaatcct

SEQ ID NO: 2806853 - DNA, 15 bp, Homo sapiens
ctaggaattcccagc

SEQ ID NO: 2806854 - DNA, 16 bp, Homo sapiens
ctaggagaccaaggcg

SEQ ID NO: 2806855 - DNA, 20 bp, Homo sapiens
ctaggagaccaaggcgggag

SEQ ID NO: 2806856 - DNA, 15 bp, Homo sapiens
ctaggagctgggagg

SEQ ID NO: 2806857 - DNA, 17 bp, Homo sapiens
ctaggaggaaaaagaaa

SEQ ID NO: 2806858 - DNA, 15 bp, Homo sapiens
ctaggaggccttctc

SEQ ID NO: 2806859 - DNA, 13 bp, Homo sapiens
ctaggaggttccg

SEQ ID NO: 2806860 - DNA, 20 bp, Homo sapiens
ctaggaggttccggtgtctg

SEQ ID NO: 2806861 - DNA, 14 bp, Homo sapiens
ctaggcatcccagg

SEQ ID NO: 2806862 - DNA, 15 bp, Homo sapiens
ctaggcatcccaggg

SEQ ID NO: 2806863 - DNA, 19 bp, Homo sapiens
ctaggccacaccatctcct

SEQ ID NO: 2806864 - DNA, 12 bp, Homo sapiens
ctaggccgggcg

SEQ ID NO: 2806865 - DNA, 18 bp, Homo sapiens
ctaggcctggccagatgc

SEQ ID NO: 2806866 - DNA, 23 bp, Homo sapiens
ctaggctgccccgggtccccagc

SEQ ID NO: 2806867 - DNA, 13 bp, Homo sapiens
ctaggctgttttc

SEQ ID NO: 2806868 - DNA, 23 bp, Homo sapiens
ctaggcttcagcatatttatagc

SEQ ID NO: 2806869 - DNA, 17 bp, Homo sapiens
ctaggtaggaaatgtgg

SEQ ID NO: 2806870 - DNA, 18 bp, Homo sapiens
ctaggtgacagagtgaga

SEQ ID NO: 2806871 - DNA, 22 bp, Homo sapiens
ctagtaatgggccaattaaaat

SEQ ID NO: 2806872 - DNA, 23 bp, Homo sapiens
ctagtattccagacctgaagaat

SEQ ID NO: 2806873 - DNA, 13 bp, Homo sapiens
ctagtcagagaga

SEQ ID NO: 2806874 - DNA, 16 bp, Homo sapiens
ctagtcagagagagtg

SEQ ID NO: 2806875 - DNA, 16 bp, Homo sapiens
ctagtgacccacatgc

SEQ ID NO: 2806876 - DNA, 19 bp, Homo sapiens
ctagtgacccacatgccat

SEQ ID NO: 2806877 - DNA, 19 bp, Homo sapiens
ctagtgccctccacagccg

SEQ ID NO: 2806878 - DNA, 18 bp, Homo sapiens
ctagttagctgctttaaa

SEQ ID NO: 2806879 - DNA, 23 bp, Homo sapiens
ctataaatggtgtttttttaata

SEQ ID NO: 2806880 - DNA, 20 bp, Homo sapiens
ctataatggaaacatttaca

SEQ ID NO: 2806881 - DNA, 20 bp, Homo sapiens
ctataattccctatctttta

SEQ ID NO: 2806882 - DNA, 15 bp, Homo sapiens
ctcctcttgccactg

SEQ ID NO: 2806883 - DNA, 16 bp, Homo sapiens
ctcctcttgccactgc

SEQ ID NO: 2806884 - DNA, 16 bp, Homo sapiens
ctcctgacccagtccc

SEQ ID NO: 2806885 - DNA, 15 bp, Homo sapiens
ctcctgcccaggaga

SEQ ID NO: 2806886 - DNA, 16 bp, Homo sapiens
ctcctgcccaggagag

SEQ ID NO: 2806887 - DNA, 17 bp, Homo sapiens
ctcctgcccaggagagc

SEQ ID NO: 2806888 - DNA, 20 bp, Homo sapiens
ctcctgcccaggagagccag

SEQ ID NO: 2806889 - DNA, 21 bp, Homo sapiens
ctcctgcctacattccctggc

SEQ ID NO: 2806890 - DNA, 12 bp, Homo sapiens
ctcctgcctcag

SEQ ID NO: 2806891 - DNA, 18 bp, Homo sapiens
ctcctgcctcgaactggc

SEQ ID NO: 2806892 - DNA, 20 bp, Homo sapiens
ctcctgcctcgaactggctg

SEQ ID NO: 2806893 - DNA, 23 bp, Homo sapiens
ctcctgctgaaacacctcccagg

SEQ ID NO: 2806894 - DNA, 18 bp, Homo sapiens
ctcctggaaaggctcagt

SEQ ID NO: 2806895 - DNA, 11 bp, Homo sapiens
ctcctggaaat

SEQ ID NO: 2806896 - DNA, 23 bp, Homo sapiens
ctcctggaagctgtgtccttgca

SEQ ID NO: 2806897 - DNA, 14 bp, Homo sapiens
ctcctggcttccca

SEQ ID NO: 2806898 - DNA, 15 bp, Homo sapiens
ctcctgggagagaag

SEQ ID NO: 2806899 - DNA, 16 bp, Homo sapiens
ctcctgggcagcttga

SEQ ID NO: 2806900 - DNA, 20 bp, Homo sapiens
ctcctgggggttctttcttc

SEQ ID NO: 2806901 - DNA, 22 bp, Homo sapiens
ctcctgggggttctttcttcct

SEQ ID NO: 2806902 - DNA, 14 bp, Homo sapiens
ctcctgtctgccag

SEQ ID NO: 2806903 - DNA, 17 bp, Homo sapiens
ctcctgtctgccagcca

SEQ ID NO: 2806904 - DNA, 19 bp, Homo sapiens
ctcctgtctgccagccagc

SEQ ID NO: 2806905 - DNA, 17 bp, Homo sapiens
ctcctgtgcaactttcc

SEQ ID NO: 2806906 - DNA, 14 bp, Homo sapiens
ctcctgtgtgtgcg

SEQ ID NO: 2806907 - DNA, 24 bp, Homo sapiens
ctcctgtgtgtgcgcctacaggag

SEQ ID NO: 2806908 - DNA, 20 bp, Homo sapiens
ctccttagagacatcaaaat

SEQ ID NO: 2806909 - DNA, 12 bp, Homo sapiens
ctccttatgttt

SEQ ID NO: 2806910 - DNA, 16 bp, Homo sapiens
ctccttccagctagtg

SEQ ID NO: 2806911 - DNA, 11 bp, Homo sapiens
ctccttcctgc

SEQ ID NO: 2806912 - DNA, 22 bp, Homo sapiens
ctccttccttgctgtcctaggc

SEQ ID NO: 2806913 - DNA, 17 bp, Homo sapiens
ctccttctctgccccca

SEQ ID NO: 2806914 - DNA, 15 bp, Homo sapiens
ctccttctgtcctac

SEQ ID NO: 2806915 - DNA, 19 bp, Homo sapiens
ctccttggaggacagtggg

SEQ ID NO: 2806916 - DNA, 19 bp, Homo sapiens
ctccttggtgcctggcctg

SEQ ID NO: 2806917 - DNA, 17 bp, Homo sapiens
ctcctttagcgcccagt

SEQ ID NO: 2806918 - DNA, 17 bp, Homo sapiens
ctcctttctccagccag

SEQ ID NO: 2806919 - DNA, 19 bp, Homo sapiens
ctcctttctccagccagca

SEQ ID NO: 2806920 - DNA, 21 bp, Homo sapiens
ctcctttctccagccagcaat

SEQ ID NO: 2806921 - DNA, 18 bp, Homo sapiens
ctcctttgcactgagggc

SEQ ID NO: 2806922 - DNA, 22 bp, Homo sapiens
ctcctttgcactgagggccaca

SEQ ID NO: 2806923 - DNA, 21 bp, Homo sapiens
ctcctttgcattccatgattt

SEQ ID NO: 2806924 - DNA, 11 bp, Homo sapiens
ctcctttgcct

SEQ ID NO: 2806925 - DNA, 13 bp, Homo sapiens
ctcgaactggctg

SEQ ID NO: 2806926 - DNA, 14 bp, Homo sapiens
ctcgaactggctgc

SEQ ID NO: 2806927 - DNA, 15 bp, Homo sapiens
ctcgaactggctgca

SEQ ID NO: 2806928 - DNA, 23 bp, Homo sapiens
ctcgaagaacaatgtcagaaact

SEQ ID NO: 2806929 - DNA, 15 bp, Homo sapiens
ctcgaagcccttcca

SEQ ID NO: 2806930 - DNA, 12 bp, Homo sapiens
ctcgagcgccct

SEQ ID NO: 2806931 - DNA, 23 bp, Homo sapiens
ctcgagggttgggttcatctgag

SEQ ID NO: 2806932 - DNA, 21 bp, Homo sapiens
ctcgcaacccgtgccaagtcc

SEQ ID NO: 2806933 - DNA, 22 bp, Homo sapiens
ctcgcaacccgtgccaagtcca

SEQ ID NO: 2806934 - DNA, 23 bp, Homo sapiens
ctcgcaacccgtgccaagtccag

SEQ ID NO: 2806935 - DNA, 17 bp, Homo sapiens
ctcgcatgccagagcct

SEQ ID NO: 2806936 - DNA, 13 bp, Homo sapiens
ctcgccctgggtc

SEQ ID NO: 2806937 - DNA, 15 bp, Homo sapiens
ctcgccctgggtcta

SEQ ID NO: 2806938 - DNA, 23 bp, Homo sapiens
ctcgctccccactctgctctgat

SEQ ID NO: 2806939 - DNA, 17 bp, Homo sapiens
ctcgctgtcctgctgtg

SEQ ID NO: 2806940 - DNA, 16 bp, Homo sapiens
ctcggagcctcatccg

SEQ ID NO: 2806941 - DNA, 17 bp, Homo sapiens
ctcggagggattcccct

SEQ ID NO: 2806942 - DNA, 17 bp, Homo sapiens
ctcggggtgcacaggag

SEQ ID NO: 2806943 - DNA, 16 bp, Homo sapiens
ctcggtggccatgctt

SEQ ID NO: 2806944 - DNA, 14 bp, Homo sapiens
ctcgtaactggttt

SEQ ID NO: 2806945 - DNA, 12 bp, Homo sapiens
ctcgtatttaat

SEQ ID NO: 2806946 - DNA, 18 bp, Homo sapiens
ctcgtccccaagtgacct

SEQ ID NO: 2806947 - DNA, 12 bp, Homo sapiens
ctcgtcctcccc

SEQ ID NO: 2806948 - DNA, 16 bp, Homo sapiens
ctcgtcctccccctgc

SEQ ID NO: 2806949 - DNA, 12 bp, Homo sapiens
ctcgtggacacc

SEQ ID NO: 2806950 - DNA, 15 bp, Homo sapiens
ctcgtggacacctgc

SEQ ID NO: 2806951 - DNA, 17 bp, Homo sapiens
ctcgtggacacctgccc

SEQ ID NO: 2806952 - DNA, 21 bp, Homo sapiens
ctcgtggacacctgccctgcc

SEQ ID NO: 2806953 - DNA, 16 bp, Homo sapiens
ctctaaaaataaaatg

SEQ ID NO: 2806954 - DNA, 20 bp, Homo sapiens
ctctaaaaataaaatgatgt

SEQ ID NO: 2806955 - DNA, 17 bp, Homo sapiens
ctctaaaatagccactt

SEQ ID NO: 2806956 - DNA, 20 bp, Homo sapiens
ctctaacccccagtgccaca

SEQ ID NO: 2806957 - DNA, 15 bp, Homo sapiens
ctctaacgcctgagc

SEQ ID NO: 2806958 - DNA, 17 bp, Homo sapiens
ctctaacgcctgagccc

SEQ ID NO: 2806959 - DNA, 22 bp, Homo sapiens
ctctaacgcctgagcccaggga

SEQ ID NO: 2806960 - DNA, 13 bp, Homo sapiens
ctctaagtctcca

SEQ ID NO: 2806961 - DNA, 16 bp, Homo sapiens
ctctacaaactcccac

SEQ ID NO: 2806962 - DNA, 13 bp, Homo sapiens
ctctacatggtat

SEQ ID NO: 2806963 - DNA, 19 bp, Homo sapiens
ctctacccggcccagagac

SEQ ID NO: 2806964 - DNA, 21 bp, Homo sapiens
ctctacccggcccagagaccc

SEQ ID NO: 2806965 - DNA, 23 bp, Homo sapiens
ctctaccctggtaggaaagcacc

SEQ ID NO: 2806966 - DNA, 22 bp, Homo sapiens
ctctactaaaaatacaaaaatt

SEQ ID NO: 2806967 - DNA, 19 bp, Homo sapiens
ctctactaaaaatacagaa

SEQ ID NO: 2806968 - DNA, 13 bp, Homo sapiens
ctctactctggaa

SEQ ID NO: 2806969 - DNA, 12 bp, Homo sapiens
ctctactgggaa

SEQ ID NO: 2806970 - DNA, 15 bp, Homo sapiens
ctctacttaatgaga

SEQ ID NO: 2806971 - DNA, 16 bp, Homo sapiens
ctctagacactgccac

SEQ ID NO: 2806972 - DNA, 14 bp, Homo sapiens
ctctagcctgggca

SEQ ID NO: 2806973 - DNA, 22 bp, Homo sapiens
ctgagcttcagtataaaagaca

SEQ ID NO: 2806974 - DNA, 16 bp, Homo sapiens
ctgagcttctctgtga

SEQ ID NO: 2806975 - DNA, 16 bp, Homo sapiens
ctgaggaattttcttt

SEQ ID NO: 2806976 - DNA, 22 bp, Homo sapiens
ctgaggacttaaaatattcctg

SEQ ID NO: 2806977 - DNA, 20 bp, Homo sapiens
ctgaggagtctgaggtcctg

SEQ ID NO: 2806978 - DNA, 14 bp, Homo sapiens
ctgaggatttcaag

SEQ ID NO: 2806979 - DNA, 18 bp, Homo sapiens
ctgaggatttcaagcctg

SEQ ID NO: 2806980 - DNA, 17 bp, Homo sapiens
ctgaggccagcctggcc

SEQ ID NO: 2806981 - DNA, 20 bp, Homo sapiens
ctgaggccagcctggcctcc

SEQ ID NO: 2806982 - DNA, 19 bp, Homo sapiens
ctgaggcctaaaagtaaac

SEQ ID NO: 2806983 - DNA, 16 bp, Homo sapiens
ctgaggctctttctgg

SEQ ID NO: 2806984 - DNA, 15 bp, Homo sapiens
ctgaggctgaggcag

SEQ ID NO: 2806985 - DNA, 18 bp, Homo sapiens
ctgaggcttccagagagt

SEQ ID NO: 2806986 - DNA, 12 bp, Homo sapiens
ctgagggcagtt

SEQ ID NO: 2806987 - DNA, 22 bp, Homo sapiens
ctgagggcagttcgcagccacc

SEQ ID NO: 2806988 - DNA, 15 bp, Homo sapiens
ctgagggccacacta

SEQ ID NO: 2806989 - DNA, 16 bp, Homo sapiens
ctgagggccacactat

SEQ ID NO: 2806990 - DNA, 23 bp, Homo sapiens
ctgaggggaggatcactggagcc

SEQ ID NO: 2806991 - DNA, 20 bp, Homo sapiens
ctgagggtggagactaagcc

SEQ ID NO: 2806992 - DNA, 14 bp, Homo sapiens
ctgaggtcctgagc

SEQ ID NO: 2806993 - DNA, 20 bp, Homo sapiens
ctgaggtcctgagcactgcc

SEQ ID NO: 2806994 - DNA, 21 bp, Homo sapiens
ctgaggtcctgagcactgcca

SEQ ID NO: 2806995 - DNA, 15 bp, Homo sapiens
ctgaggtgcccagga

SEQ ID NO: 2806996 - DNA, 18 bp, Homo sapiens
ctgaggtgcccaggagaa

SEQ ID NO: 2806997 - DNA, 19 bp, Homo sapiens
ctgaggtgcccaggagaag

SEQ ID NO: 2806998 - DNA, 23 bp, Homo sapiens
ctgagtcaccctacctgtgcctg

SEQ ID NO: 2806999 - DNA, 19 bp, Homo sapiens
ctgagtcatgatctccctg

SEQ ID NO: 2807000 - DNA, 21 bp, Homo sapiens
ctgagtcatgatctccctgcc

SEQ ID NO: 2807001 - DNA, 14 bp, Homo sapiens
ctgagtctcctgtg

SEQ ID NO: 2807002 - DNA, 15 bp, Homo sapiens
ctgagtctcctgtgc

SEQ ID NO: 2807003 - DNA, 19 bp, Homo sapiens
ctgataaacacagaggttt

SEQ ID NO: 2807004 - DNA, 15 bp, Homo sapiens
ctgataattttaaat

SEQ ID NO: 2807005 - DNA, 17 bp, Homo sapiens
ctgataattttaaattc

SEQ ID NO: 2807006 - DNA, 16 bp, Homo sapiens
ctgatatattttccag

SEQ ID NO: 2807007 - DNA, 18 bp, Homo sapiens
ctgatcaagtcaccggag

SEQ ID NO: 2807008 - DNA, 19 bp, Homo sapiens
ctgatcgggataacaaaat

SEQ ID NO: 2807009 - DNA, 15 bp, Homo sapiens
ctgatcgtgctaaat

SEQ ID NO: 2807010 - DNA, 21 bp, Homo sapiens
ctgatcgtgctaaattttcag

SEQ ID NO: 2807011 - DNA, 14 bp, Homo sapiens
ctgatgaaaatgaa

SEQ ID NO: 2807012 - DNA, 19 bp, Homo sapiens
ctgatgacctaacctaagc

SEQ ID NO: 2807013 - DNA, 22 bp, Homo sapiens
ctgatgctttgcttcaaatcca

SEQ ID NO: 2807014 - DNA, 18 bp, Homo sapiens
ctgatgggcaacccccag

SEQ ID NO: 2807015 - DNA, 20 bp, Homo sapiens
ctgatgttacatcacagtgt

SEQ ID NO: 2807016 - DNA, 20 bp, Homo sapiens
ctgattcccaagctctgctc

SEQ ID NO: 2807017 - DNA, 22 bp, Homo sapiens
ctgattcccaagctctgctcct

SEQ ID NO: 2807018 - DNA, 23 bp, Homo sapiens
ctgattttaaaaggttgactcaa

SEQ ID NO: 2807019 - DNA, 16 bp, Homo sapiens
ctgcaaactcactgct

SEQ ID NO: 2807020 - DNA, 21 bp, Homo sapiens
ctgcaaagggtatcaggtgct

SEQ ID NO: 2807021 - DNA, 20 bp, Homo sapiens
ctgcaacctccgcctcttgg

SEQ ID NO: 2807022 - DNA, 17 bp, Homo sapiens
ctgcaacggcttagact

SEQ ID NO: 2807023 - DNA, 17 bp, Homo sapiens
ctgcaagagccttggtg

SEQ ID NO: 2807024 - DNA, 15 bp, Homo sapiens
ctgcaagaggctcct

SEQ ID NO: 2807025 - DNA, 16 bp, Homo sapiens
ctgcaagaggctcctg

SEQ ID NO: 2807026 - DNA, 16 bp, Homo sapiens
ctgcaatctccagggc

SEQ ID NO: 2807027 - DNA, 22 bp, Homo sapiens
ctgcaatctccagggctgcccc

SEQ ID NO: 2807028 - DNA, 15 bp, Homo sapiens
ctgcaattgcttagg

SEQ ID NO: 2807029 - DNA, 16 bp, Homo sapiens
ctgcaattgcttagga

SEQ ID NO: 2807030 - DNA, 13 bp, Homo sapiens
ctgcacaaagccc

SEQ ID NO: 2807031 - DNA, 17 bp, Homo sapiens
ctgcacagatatttcca

SEQ ID NO: 2807032 - DNA, 22 bp, Homo sapiens
ctgcacatgaatcccacccaca

SEQ ID NO: 2807033 - DNA, 16 bp, Homo sapiens
ctgcacatgtcttgta

SEQ ID NO: 2807034 - DNA, 21 bp, Homo sapiens
ctgcacatgtcttgtacatgt

SEQ ID NO: 2807035 - DNA, 12 bp, Homo sapiens
ctgcacccaggg

SEQ ID NO: 2807036 - DNA, 13 bp, Homo sapiens
ctgcacccttcct

SEQ ID NO: 2807037 - DNA, 16 bp, Homo sapiens
ctgcacccttcctcct

SEQ ID NO: 2807038 - DNA, 17 bp, Homo sapiens
ctgcacccttcctcctc

SEQ ID NO: 2807039 - DNA, 12 bp, Homo sapiens
ctgcaccgggcc

SEQ ID NO: 2807040 - DNA, 15 bp, Homo sapiens
ctgcaccgggccaca

SEQ ID NO: 2807041 - DNA, 20 bp, Homo sapiens
ctgcaccgggccacagagaa

SEQ ID NO: 2807042 - DNA, 23 bp, Homo sapiens
ctgcaccgggccacagagaaagt

SEQ ID NO: 2807043 - DNA, 17 bp, Homo sapiens
ctgcacctccccccact

SEQ ID NO: 2807044 - DNA, 18 bp, Homo sapiens
ctgcacctccccccactg

SEQ ID NO: 2807045 - DNA, 19 bp, Homo sapiens
ctgcacctccccccactgc

SEQ ID NO: 2807046 - DNA, 13 bp, Homo sapiens
ctgcacctgccag

SEQ ID NO: 2807047 - DNA, 19 bp, Homo sapiens
ctgcacctgccagcctggc

SEQ ID NO: 2807048 - DNA, 18 bp, Homo sapiens
ctgcacgccgtggagcat

SEQ ID NO: 2807049 - DNA, 17 bp, Homo sapiens
ctgcactatagcctagg

SEQ ID NO: 2807050 - DNA, 14 bp, Homo sapiens
ctgcactccagcct

SEQ ID NO: 2807051 - DNA, 19 bp, Homo sapiens
ctgcactgacccacagcct

SEQ ID NO: 2807052 - DNA, 23 bp, Homo sapiens
ctgcagaacgtattggtccagct

SEQ ID NO: 2807053 - DNA, 13 bp, Homo sapiens
ctgcagaaggcca

SEQ ID NO: 2807054 - DNA, 15 bp, Homo sapiens
ctgcagaaggccaag

SEQ ID NO: 2807055 - DNA, 17 bp, Homo sapiens
ctgcagaccctgccctt

SEQ ID NO: 2807056 - DNA, 21 bp, Homo sapiens
ctgcagaccctgcccttgttt

SEQ ID NO: 2807057 - DNA, 21 bp, Homo sapiens
ctgcagaggggaaaccagtgt

SEQ ID NO: 2807058 - DNA, 20 bp, Homo sapiens
ctgcagaggggctttctgga

SEQ ID NO: 2807059 - DNA, 22 bp, Homo sapiens
ctgcagaggggctttctggaga

SEQ ID NO: 2807060 - DNA, 19 bp, Homo sapiens
ctgcagatttcctgtgtgg

SEQ ID NO: 2807061 - DNA, 18 bp, Homo sapiens
ctgcagccaaacagagcc

SEQ ID NO: 2807062 - DNA, 22 bp, Homo sapiens
ctgcagccaaacagagccttca

SEQ ID NO: 2807063 - DNA, 20 bp, Homo sapiens
ctggagcctcggtggccatg

SEQ ID NO: 2807064 - DNA, 17 bp, Homo sapiens
ctggagcggctctcctg

SEQ ID NO: 2807065 - DNA, 18 bp, Homo sapiens
ctggagcggctctcctga

SEQ ID NO: 2807066 - DNA, 21 bp, Homo sapiens
ctggaggacctgagcctgccg

SEQ ID NO: 2807067 - DNA, 16 bp, Homo sapiens
ctggaggcagggcctt

SEQ ID NO: 2807068 - DNA, 19 bp, Homo sapiens
ctggaggtcacattcagga

SEQ ID NO: 2807069 - DNA, 15 bp, Homo sapiens
ctggagtctccagtg

SEQ ID NO: 2807070 - DNA, 13 bp, Homo sapiens
ctggagtgcagtt

SEQ ID NO: 2807071 - DNA, 13 bp, Homo sapiens
ctggataaaatga

SEQ ID NO: 2807072 - DNA, 18 bp, Homo sapiens
ctggatacagaatgaatc

SEQ ID NO: 2807073 - DNA, 17 bp, Homo sapiens
ctggatcagcgtggcct

SEQ ID NO: 2807074 - DNA, 17 bp, Homo sapiens
ctggatccatcaggcca

SEQ ID NO: 2807075 - DNA, 19 bp, Homo sapiens
ctggatccatcaggccact

SEQ ID NO: 2807076 - DNA, 15 bp, Homo sapiens
ctggatctccccact

SEQ ID NO: 2807077 - DNA, 17 bp, Homo sapiens
ctggatgtgcccacagg

SEQ ID NO: 2807078 - DNA, 18 bp, Homo sapiens
ctggatgtgcccacaggg

SEQ ID NO: 2807079 - DNA, 22 bp, Homo sapiens
ctggcaatgaaaaattctcagt

SEQ ID NO: 2807080 - DNA, 16 bp, Homo sapiens
ctggcacccggcccct

SEQ ID NO: 2807081 - DNA, 22 bp, Homo sapiens
ctggcacccggcccctgctggt

SEQ ID NO: 2807082 - DNA, 21 bp, Homo sapiens
ctggcacggtggctcaggcct

SEQ ID NO: 2807083 - DNA, 18 bp, Homo sapiens
ctggcactccagaacaaa

SEQ ID NO: 2807084 - DNA, 15 bp, Homo sapiens
ctggcagagaaggct

SEQ ID NO: 2807085 - DNA, 12 bp, Homo sapiens
ctggcagccaca

SEQ ID NO: 2807086 - DNA, 14 bp, Homo sapiens
ctggcagccacact

SEQ ID NO: 2807087 - DNA, 23 bp, Homo sapiens
ctggcagccacacttctcaggac

SEQ ID NO: 2807088 - DNA, 13 bp, Homo sapiens
ctggccaacatgg

SEQ ID NO: 2807089 - DNA, 21 bp, Homo sapiens
ctggccaagctgaggtgccca

SEQ ID NO: 2807090 - DNA, 17 bp, Homo sapiens
ctggccagatgcaccag

SEQ ID NO: 2807091 - DNA, 20 bp, Homo sapiens
ctggccagatgcaccagccc

SEQ ID NO: 2807092 - DNA, 21 bp, Homo sapiens
ctggccagatgcaccagccct

SEQ ID NO: 2807093 - DNA, 15 bp, Homo sapiens
ctggccaggggtcct

SEQ ID NO: 2807094 - DNA, 19 bp, Homo sapiens
ctggccccatgtctctcag

SEQ ID NO: 2807095 - DNA, 18 bp, Homo sapiens
ctggcccgtcatgttcct

SEQ ID NO: 2807096 - DNA, 18 bp, Homo sapiens
ctggccgcctccaggagc

SEQ ID NO: 2807097 - DNA, 19 bp, Homo sapiens
ctggccggctccagtttcc

SEQ ID NO: 2807098 - DNA, 23 bp, Homo sapiens
ctggcctcacgcccagcctcctc

SEQ ID NO: 2807099 - DNA, 18 bp, Homo sapiens
ctggcctcccaataaagc

SEQ ID NO: 2807100 - DNA, 15 bp, Homo sapiens
ctggcctcctgcctc

SEQ ID NO: 2807101 - DNA, 12 bp, Homo sapiens
ctggcctggatc

SEQ ID NO: 2807102 - DNA, 17 bp, Homo sapiens
ctggcctggcacacatc

SEQ ID NO: 2807103 - DNA, 16 bp, Homo sapiens
ctggcctggctctcct

SEQ ID NO: 2807104 - DNA, 22 bp, Homo sapiens
ctggcgaggtgcggccaccacc

SEQ ID NO: 2807105 - DNA, 19 bp, Homo sapiens
ctggcgcaagagaacattt

SEQ ID NO: 2807106 - DNA, 20 bp, Homo sapiens
ctggcggctactcagcagcc

SEQ ID NO: 2807107 - DNA, 22 bp, Homo sapiens
ctggcggctactcagcagccct

SEQ ID NO: 2807108 - DNA, 15 bp, Homo sapiens
ctggcgtgcagtggt

SEQ ID NO: 2807109 - DNA, 23 bp, Homo sapiens
ctggctctcctgtagctctcctg

SEQ ID NO: 2807110 - DNA, 14 bp, Homo sapiens
ctggctcttctctc

SEQ ID NO: 2807111 - DNA, 19 bp, Homo sapiens
ctggctgaccccaaagagc

SEQ ID NO: 2807112 - DNA, 11 bp, Homo sapiens
ctggctggctg

SEQ ID NO: 2807113 - DNA, 16 bp, Homo sapiens
ctggctggctgagggc

SEQ ID NO: 2807114 - DNA, 18 bp, Homo sapiens
ctggcttcccatccccag

SEQ ID NO: 2807115 - DNA, 21 bp, Homo sapiens
ctggcttcccatccccagcga

SEQ ID NO: 2807116 - DNA, 20 bp, Homo sapiens
ctggcttctagtctggtgtt

SEQ ID NO: 2807117 - DNA, 23 bp, Homo sapiens
ctggcttctctgtgcccctgtaa

SEQ ID NO: 2807118 - DNA, 20 bp, Homo sapiens
ctggcttctggagcccttgg

SEQ ID NO: 2807119 - DNA, 18 bp, Homo sapiens
ctggctttacattttatt

SEQ ID NO: 2807120 - DNA, 22 bp, Homo sapiens
ctggctttctccgactgctagg

SEQ ID NO: 2807121 - DNA, 16 bp, Homo sapiens
ctgggaaataagagag

SEQ ID NO: 2807122 - DNA, 19 bp, Homo sapiens
ctgggaacccgactgtgaa

SEQ ID NO: 2807123 - DNA, 22 bp, Homo sapiens
ctgggaacccgactgtgaaagt

SEQ ID NO: 2807124 - DNA, 11 bp, Homo sapiens
ctgggacacag

SEQ ID NO: 2807125 - DNA, 12 bp, Homo sapiens
ctgggacacagt

SEQ ID NO: 2807126 - DNA, 13 bp, Homo sapiens
ctgggacacagtt

SEQ ID NO: 2807127 - DNA, 14 bp, Homo sapiens
ctgggaccagggca

SEQ ID NO: 2807128 - DNA, 15 bp, Homo sapiens
ctgggaccagggcat

SEQ ID NO: 2807129 - DNA, 23 bp, Homo sapiens
ctgggaccccagctagggctgga

SEQ ID NO: 2807130 - DNA, 20 bp, Homo sapiens
ctgggaccctttccttcctt

SEQ ID NO: 2807131 - DNA, 20 bp, Homo sapiens
ctgggaccgctacaccactc

SEQ ID NO: 2807132 - DNA, 13 bp, Homo sapiens
ctgggactacagg

SEQ ID NO: 2807133 - DNA, 15 bp, Homo sapiens
ctgggactacaggca

SEQ ID NO: 2807134 - DNA, 21 bp, Homo sapiens
ctgggactacaggcacccacc

SEQ ID NO: 2807135 - DNA, 14 bp, Homo sapiens
ctgggactggccag

SEQ ID NO: 2807136 - DNA, 18 bp, Homo sapiens
ctgggagaacctcaggct

SEQ ID NO: 2807137 - DNA, 15 bp, Homo sapiens
ctgggagagaaggag

SEQ ID NO: 2807138 - DNA, 13 bp, Homo sapiens
ctgggagctctgc

SEQ ID NO: 2807139 - DNA, 13 bp, Homo sapiens
ctgggaggaaaag

SEQ ID NO: 2807140 - DNA, 22 bp, Homo sapiens
ctgggaggaaaagaaaagaggg

SEQ ID NO: 2807141 - DNA, 14 bp, Homo sapiens
ctgggaggaagcag

SEQ ID NO: 2807142 - DNA, 21 bp, Homo sapiens
ctgggaggaagcaggttgagg

SEQ ID NO: 2807143 - DNA, 21 bp, Homo sapiens
ctgggattacaagcgtgagcc

SEQ ID NO: 2807144 - DNA, 20 bp, Homo sapiens
ctgggattacaggtgtgaac

SEQ ID NO: 2807145 - DNA, 18 bp, Homo sapiens
ctgggcaacagagcaaga

SEQ ID NO: 2807146 - DNA, 18 bp, Homo sapiens
ctgggcaccacaggctgc

SEQ ID NO: 2807147 - DNA, 17 bp, Homo sapiens
ctgggcagcatagcaag

SEQ ID NO: 2807148 - DNA, 18 bp, Homo sapiens
ctgggcagcatagcaaga

SEQ ID NO: 2807149 - DNA, 17 bp, Homo sapiens
ctgggcagcttgagagg

SEQ ID NO: 2807150 - DNA, 19 bp, Homo sapiens
ctgggccaactcacctgag

SEQ ID NO: 2807151 - DNA, 18 bp, Homo sapiens
ctgggccaagttcctcta

SEQ ID NO: 2807152 - DNA, 20 bp, Homo sapiens
ctgggccaagttcctctagt

SEQ ID NO: 2807153 - DNA, 19 bp, Homo sapiens
cttaaaataacttatatca

SEQ ID NO: 2807154 - DNA, 17 bp, Homo sapiens
cttaaaataatgattta

SEQ ID NO: 2807155 - DNA, 18 bp, Homo sapiens
cttaaaatattcctgcat

SEQ ID NO: 2807156 - DNA, 17 bp, Homo sapiens
cttaaataagaaacttt

SEQ ID NO: 2807157 - DNA, 22 bp, Homo sapiens
cttaaatagcatctgctcttct

SEQ ID NO: 2807158 - DNA, 22 bp, Homo sapiens
cttaaatattgaataagtattc

SEQ ID NO: 2807159 - DNA, 21 bp, Homo sapiens
cttaaatgaaagcatgtggca

SEQ ID NO: 2807160 - DNA, 16 bp, Homo sapiens
cttaacggctccagga

SEQ ID NO: 2807161 - DNA, 20 bp, Homo sapiens
cttaactgtgtgaagaaatg

SEQ ID NO: 2807162 - DNA, 21 bp, Homo sapiens
cttaaggatggagccagctct

SEQ ID NO: 2807163 - DNA, 17 bp, Homo sapiens
cttaataaattcagata

SEQ ID NO: 2807164 - DNA, 19 bp, Homo sapiens
cttaatatatatatccaga

SEQ ID NO: 2807165 - DNA, 20 bp, Homo sapiens
cttaatcaggtcctcagaga

SEQ ID NO: 2807166 - DNA, 20 bp, Homo sapiens
cttaatgctttcctccctgg

SEQ ID NO: 2807167 - DNA, 20 bp, Homo sapiens
cttaatgttctgaataattt

SEQ ID NO: 2807168 - DNA, 22 bp, Homo sapiens
cttaattctgagctggcccttt

SEQ ID NO: 2807169 - DNA, 18 bp, Homo sapiens
cttaattttcagtataat

SEQ ID NO: 2807170 - DNA, 18 bp, Homo sapiens
cttacatgcattactgca

SEQ ID NO: 2807171 - DNA, 20 bp, Homo sapiens
cttaccaggcaccaaaagaa

SEQ ID NO: 2807172 - DNA, 13 bp, Homo sapiens
cttacctcctgcc

SEQ ID NO: 2807173 - DNA, 20 bp, Homo sapiens
cttacctcctgcccaggaga

SEQ ID NO: 2807174 - DNA, 22 bp, Homo sapiens
cttactaaacattttgttattg

SEQ ID NO: 2807175 - DNA, 20 bp, Homo sapiens
cttactatgatctcaggagc

SEQ ID NO: 2807176 - DNA, 13 bp, Homo sapiens
cttactcctgtgg

SEQ ID NO: 2807177 - DNA, 20 bp, Homo sapiens
cttactcctgtgggagcctc

SEQ ID NO: 2807178 - DNA, 17 bp, Homo sapiens
cttactctttcactcag

SEQ ID NO: 2807179 - DNA, 20 bp, Homo sapiens
cttagaagtcacacagtatt

SEQ ID NO: 2807180 - DNA, 20 bp, Homo sapiens
cttagaagtggaccaggaca

SEQ ID NO: 2807181 - DNA, 23 bp, Homo sapiens
cttagaagtggaccaggacagga

SEQ ID NO: 2807182 - DNA, 17 bp, Homo sapiens
cttagacctcagcctgt

SEQ ID NO: 2807183 - DNA, 17 bp, Homo sapiens
cttagatagatggtact

SEQ ID NO: 2807184 - DNA, 11 bp, Homo sapiens
cttagcacttc

SEQ ID NO: 2807185 - DNA, 16 bp, Homo sapiens
cttagcacttctttcc

SEQ ID NO: 2807186 - DNA, 14 bp, Homo sapiens
cttagctgtctgct

SEQ ID NO: 2807187 - DNA, 15 bp, Homo sapiens
cttagcttagacctc

SEQ ID NO: 2807188 - DNA, 18 bp, Homo sapiens
cttagcttagacctcagc

SEQ ID NO: 2807189 - DNA, 19 bp, Homo sapiens
cttagtgcggacaagtttt

SEQ ID NO: 2807190 - DNA, 20 bp, Homo sapiens
cttagtgcggacaagtttta

SEQ ID NO: 2807191 - DNA, 22 bp, Homo sapiens
cttagtgcggacaagttttaat

SEQ ID NO: 2807192 - DNA, 21 bp, Homo sapiens
cttagttaagtcatccacagc

SEQ ID NO: 2807193 - DNA, 14 bp, Homo sapiens
cttatagaatattt

SEQ ID NO: 2807194 - DNA, 18 bp, Homo sapiens
cttatatagtttactatt

SEQ ID NO: 2807195 - DNA, 19 bp, Homo sapiens
cttatatagtttactattt

SEQ ID NO: 2807196 - DNA, 21 bp, Homo sapiens
cttatatcatcagcatacctt

SEQ ID NO: 2807197 - DNA, 13 bp, Homo sapiens
cttatccaggact

SEQ ID NO: 2807198 - DNA, 21 bp, Homo sapiens
cttatgacatcacttgtacaa

SEQ ID NO: 2807199 - DNA, 12 bp, Homo sapiens
cttattgcccac

SEQ ID NO: 2807200 - DNA, 23 bp, Homo sapiens
cttatttatattcagagatgtac

SEQ ID NO: 2807201 - DNA, 23 bp, Homo sapiens
cttattttaaaattttatctctt

SEQ ID NO: 2807202 - DNA, 14 bp, Homo sapiens
cttattttccaata

SEQ ID NO: 2807203 - DNA, 17 bp, Homo sapiens
cttattttccaataaaa

SEQ ID NO: 2807204 - DNA, 14 bp, Homo sapiens
cttattttgtaata

SEQ ID NO: 2807205 - DNA, 19 bp, Homo sapiens
cttattttgtaataaactc

SEQ ID NO: 2807206 - DNA, 16 bp, Homo sapiens
cttcaaagcttgaaga

SEQ ID NO: 2807207 - DNA, 15 bp, Homo sapiens
cttcaaagtttaata

SEQ ID NO: 2807208 - DNA, 20 bp, Homo sapiens
cttcaacaattctaaaatga

SEQ ID NO: 2807209 - DNA, 16 bp, Homo sapiens
cttcaaccctcagcct

SEQ ID NO: 2807210 - DNA, 19 bp, Homo sapiens
cttcaaccctcagccttga

SEQ ID NO: 2807211 - DNA, 18 bp, Homo sapiens
cttcaagaactctgggct

SEQ ID NO: 2807212 - DNA, 20 bp, Homo sapiens
cttcaagtgatatatgtatt

SEQ ID NO: 2807213 - DNA, 23 bp, Homo sapiens
cttcaagtgatatatgtatttat

SEQ ID NO: 2807214 - DNA, 22 bp, Homo sapiens
cttcaagtgcatgctctctgca

SEQ ID NO: 2807215 - DNA, 18 bp, Homo sapiens
cttcaagttaaagtgaat

SEQ ID NO: 2807216 - DNA, 12 bp, Homo sapiens
cttcaataaagt

SEQ ID NO: 2807217 - DNA, 14 bp, Homo sapiens
cttcaataaagtat

SEQ ID NO: 2807218 - DNA, 14 bp, Homo sapiens
cttcacaaaatgca

SEQ ID NO: 2807219 - DNA, 15 bp, Homo sapiens
cttcacaaccagcca

SEQ ID NO: 2807220 - DNA, 22 bp, Homo sapiens
cttcacacacaggcaactgagg

SEQ ID NO: 2807221 - DNA, 18 bp, Homo sapiens
cttcacactgcaagagcc

SEQ ID NO: 2807222 - DNA, 17 bp, Homo sapiens
cttcacataccctcccc

SEQ ID NO: 2807223 - DNA, 14 bp, Homo sapiens
cttcaccagagccc

SEQ ID NO: 2807224 - DNA, 16 bp, Homo sapiens
cttcaccagagcccat

SEQ ID NO: 2807225 - DNA, 16 bp, Homo sapiens
cttcactattcctagg

SEQ ID NO: 2807226 - DNA, 22 bp, Homo sapiens
cttcactccggtgtgcctgcag

SEQ ID NO: 2807227 - DNA, 23 bp, Homo sapiens
cttcactccggtgtgcctgcagc

SEQ ID NO: 2807228 - DNA, 19 bp, Homo sapiens
cttcagacacaaaagtcca

SEQ ID NO: 2807229 - DNA, 14 bp, Homo sapiens
cttcagagaagtca

SEQ ID NO: 2807230 - DNA, 12 bp, Homo sapiens
cttcagagcagg

SEQ ID NO: 2807231 - DNA, 15 bp, Homo sapiens
cttcagatcagtgct

SEQ ID NO: 2807232 - DNA, 20 bp, Homo sapiens
cttcagatcagtgcttgagt

SEQ ID NO: 2807233 - DNA, 18 bp, Homo sapiens
cttcagcatatttatagc

SEQ ID NO: 2807234 - DNA, 17 bp, Homo sapiens
cttcagccacctctctt

SEQ ID NO: 2807235 - DNA, 13 bp, Homo sapiens
cttcagcctagcc

SEQ ID NO: 2807236 - DNA, 20 bp, Homo sapiens
cttcagcctagccgacctca

SEQ ID NO: 2807237 - DNA, 22 bp, Homo sapiens
cttcagcctagccgacctcagc

SEQ ID NO: 2807238 - DNA, 14 bp, Homo sapiens
cttcagcctcccga

SEQ ID NO: 2807239 - DNA, 15 bp, Homo sapiens
cttcagcgagaccct

SEQ ID NO: 2807240 - DNA, 23 bp, Homo sapiens
cttcagcgagacccttgcattag

SEQ ID NO: 2807241 - DNA, 19 bp, Homo sapiens
cttcaggttcttagtgtca

SEQ ID NO: 2807242 - DNA, 14 bp, Homo sapiens
cttcagtcttggag

SEQ ID NO: 2807243 - DNA, 19 bp, Homo sapiens
cttggcatcacagggcaga

SEQ ID NO: 2807244 - DNA, 16 bp, Homo sapiens
cttggcccctgtgtga

SEQ ID NO: 2807245 - DNA, 15 bp, Homo sapiens
cttggccgactcagg

SEQ ID NO: 2807246 - DNA, 18 bp, Homo sapiens
cttggccgactcagggac

SEQ ID NO: 2807247 - DNA, 19 bp, Homo sapiens
cttggccgactcagggacc

SEQ ID NO: 2807248 - DNA, 19 bp, Homo sapiens
cttggcgggcagcccagcc

SEQ ID NO: 2807249 - DNA, 10 bp, Homo sapiens
cttgggaatg

SEQ ID NO: 2807250 - DNA, 17 bp, Homo sapiens
cttgggcacccccagcc

SEQ ID NO: 2807251 - DNA, 19 bp, Homo sapiens
cttgggcacccccagcctg

SEQ ID NO: 2807252 - DNA, 13 bp, Homo sapiens
cttgggccctgca

SEQ ID NO: 2807253 - DNA, 22 bp, Homo sapiens
cttgggcctccccccagcccct

SEQ ID NO: 2807254 - DNA, 16 bp, Homo sapiens
cttgggcgctctgccc

SEQ ID NO: 2807255 - DNA, 20 bp, Homo sapiens
cttggggggtgatgagggca

SEQ ID NO: 2807256 - DNA, 22 bp, Homo sapiens
cttggggggtttttactccagt

SEQ ID NO: 2807257 - DNA, 23 bp, Homo sapiens
cttggggggtttttactccagtg

SEQ ID NO: 2807258 - DNA, 17 bp, Homo sapiens
cttgggtcccagggaag

SEQ ID NO: 2807259 - DNA, 23 bp, Homo sapiens
cttgggtcctgcaatctccaggg

SEQ ID NO: 2807260 - DNA, 22 bp, Homo sapiens
cttgggtgtaacaggtctcctc

SEQ ID NO: 2807261 - DNA, 16 bp, Homo sapiens
cttggtgtccacctgg

SEQ ID NO: 2807262 - DNA, 17 bp, Homo sapiens
cttggtgtccacctggc

SEQ ID NO: 2807263 - DNA, 22 bp, Homo sapiens
cttggttgaagttgtgttaaca

SEQ ID NO: 2807264 - DNA, 21 bp, Homo sapiens
cttggttttgctacataatta

SEQ ID NO: 2807265 - DNA, 13 bp, Homo sapiens
cttgtaaatacac

SEQ ID NO: 2807266 - DNA, 16 bp, Homo sapiens
cttgtaaatagctcag

SEQ ID NO: 2807267 - DNA, 15 bp, Homo sapiens
cttgtaactccacca

SEQ ID NO: 2807268 - DNA, 17 bp, Homo sapiens
cttgtaactccaccaac

SEQ ID NO: 2807269 - DNA, 13 bp, Homo sapiens
cttgtaattctaa

SEQ ID NO: 2807270 - DNA, 15 bp, Homo sapiens
cttgtaattctaaat

SEQ ID NO: 2807271 - DNA, 23 bp, Homo sapiens
cttgtaattctaaatgaatgttt

SEQ ID NO: 2807272 - DNA, 12 bp, Homo sapiens
cttgtacatatt

SEQ ID NO: 2807273 - DNA, 13 bp, Homo sapiens
cttgtacatgtgt

SEQ ID NO: 2807274 - DNA, 14 bp, Homo sapiens
cttgtacatgtgta

SEQ ID NO: 2807275 - DNA, 19 bp, Homo sapiens
cttgtacatgtgtagcctg

SEQ ID NO: 2807276 - DNA, 20 bp, Homo sapiens
cttgtacatgtgtagcctgt

SEQ ID NO: 2807277 - DNA, 13 bp, Homo sapiens
cttgtagccagcc

SEQ ID NO: 2807278 - DNA, 14 bp, Homo sapiens
cttgtagccagccg

SEQ ID NO: 2807279 - DNA, 15 bp, Homo sapiens
cttgtagccagccgg

SEQ ID NO: 2807280 - DNA, 14 bp, Homo sapiens
cttgtatatacata

SEQ ID NO: 2807281 - DNA, 17 bp, Homo sapiens
cttgtatatacatatta

SEQ ID NO: 2807282 - DNA, 23 bp, Homo sapiens
cttgtatatacatattataaata

SEQ ID NO: 2807283 - DNA, 13 bp, Homo sapiens
cttgtatattcca

SEQ ID NO: 2807284 - DNA, 18 bp, Homo sapiens
cttgtatttaaatattaa

SEQ ID NO: 2807285 - DNA, 13 bp, Homo sapiens
cttgtattttcca

SEQ ID NO: 2807286 - DNA, 14 bp, Homo sapiens
cttgtattttccat

SEQ ID NO: 2807287 - DNA, 16 bp, Homo sapiens
cttgtcactagcagct

SEQ ID NO: 2807288 - DNA, 14 bp, Homo sapiens
cttgtcatgtgaca

SEQ ID NO: 2807289 - DNA, 18 bp, Homo sapiens
cttgtccagcgcctagtg

SEQ ID NO: 2807290 - DNA, 15 bp, Homo sapiens
cttgtccctgcccag

SEQ ID NO: 2807291 - DNA, 12 bp, Homo sapiens
cttgtctccact

SEQ ID NO: 2807292 - DNA, 23 bp, Homo sapiens
cttgtctccactaaatgagctcc

SEQ ID NO: 2807293 - DNA, 15 bp, Homo sapiens
cttgtgcagtgttga

SEQ ID NO: 2807294 - DNA, 11 bp, Homo sapiens
cttgtgccata

SEQ ID NO: 2807295 - DNA, 14 bp, Homo sapiens
cttgtggacacagc

SEQ ID NO: 2807296 - DNA, 17 bp, Homo sapiens
cttgtggacacagctct

SEQ ID NO: 2807297 - DNA, 21 bp, Homo sapiens
cttgtggacacagctcttctc

SEQ ID NO: 2807298 - DNA, 12 bp, Homo sapiens
cttgtgtctgta

SEQ ID NO: 2807299 - DNA, 23 bp, Homo sapiens
cttgttacctttcccatgctgaa

SEQ ID NO: 2807300 - DNA, 13 bp, Homo sapiens
cttgttatttata

SEQ ID NO: 2807301 - DNA, 13 bp, Homo sapiens
cttgttgtggagg

SEQ ID NO: 2807302 - DNA, 22 bp, Homo sapiens
cttgtttcaattccacctgcaa

SEQ ID NO: 2807303 - DNA, 17 bp, Homo sapiens
cttgtttggggcaggag

SEQ ID NO: 2807304 - DNA, 14 bp, Homo sapiens
cttgttttcttgcc

SEQ ID NO: 2807305 - DNA, 17 bp, Homo sapiens
cttgttttcttgccaat

SEQ ID NO: 2807306 - DNA, 12 bp, Homo sapiens
ctttaaagtctt

SEQ ID NO: 2807307 - DNA, 20 bp, Homo sapiens
ctttaaatcaaaagctgctt

SEQ ID NO: 2807308 - DNA, 17 bp, Homo sapiens
ctttaacaaaacaagaa

SEQ ID NO: 2807309 - DNA, 19 bp, Homo sapiens
ctttaacaaaacaagaaag

SEQ ID NO: 2807310 - DNA, 20 bp, Homo sapiens
ctttaacaaaacaagaaaga

SEQ ID NO: 2807311 - DNA, 17 bp, Homo sapiens
ctttaaccgtttttcaa

SEQ ID NO: 2807312 - DNA, 18 bp, Homo sapiens
ctttaaccgtttttcaag

SEQ ID NO: 2807313 - DNA, 19 bp, Homo sapiens
ctttaaccgtttttcaaga

SEQ ID NO: 2807314 - DNA, 15 bp, Homo sapiens
ctttaagactgagca

SEQ ID NO: 2807315 - DNA, 23 bp, Homo sapiens
ctttaatatagctatcatttctt

SEQ ID NO: 2807316 - DNA, 19 bp, Homo sapiens
ctttaatgtcacaggcagg

SEQ ID NO: 2807317 - DNA, 23 bp, Homo sapiens
ctttaatgtcacaggcaggtcca

SEQ ID NO: 2807318 - DNA, 20 bp, Homo sapiens
ctttaatgtgtattgaagaa

SEQ ID NO: 2807319 - DNA, 20 bp, Homo sapiens
ctttaattctcatgtgatcc

SEQ ID NO: 2807320 - DNA, 21 bp, Homo sapiens
ctttacatttgataaactaaa

SEQ ID NO: 2807321 - DNA, 22 bp, Homo sapiens
ctttagaatgagagtgtgaaat

SEQ ID NO: 2807322 - DNA, 22 bp, Homo sapiens
ctttagccactggtttctcaga

SEQ ID NO: 2807323 - DNA, 15 bp, Homo sapiens
ctttaggtgcctcct

SEQ ID NO: 2807324 - DNA, 18 bp, Homo sapiens
ctttaggtgcctcctgtc

SEQ ID NO: 2807325 - DNA, 22 bp, Homo sapiens
ctttagttcctactttagccac

SEQ ID NO: 2807326 - DNA, 13 bp, Homo sapiens
ctttataaacttt

SEQ ID NO: 2807327 - DNA, 14 bp, Homo sapiens
ctttattaaaaact

SEQ ID NO: 2807328 - DNA, 15 bp, Homo sapiens
ctttattaatgaact

SEQ ID NO: 2807329 - DNA, 16 bp, Homo sapiens
ctttattaatgaactg

SEQ ID NO: 2807330 - DNA, 23 bp, Homo sapiens
ctttattaatgaactgtgacagg

SEQ ID NO: 2807331 - DNA, 21 bp, Homo sapiens
ctttattttttaagtatttat

SEQ ID NO: 2807332 - DNA, 15 bp, Homo sapiens
ctttcaaagaaggaa

SEQ ID NO: 2807333 - DNA, 18 bp, Homo sapiens
ctttcaaagaaggaattc

SEQ ID NO: 2807334 - DNA, 14 bp, Homo sapiens
gaagaccacatcca

SEQ ID NO: 2807335 - DNA, 21 bp, Homo sapiens
gaagaccacatccacacacgc

SEQ ID NO: 2807336 - DNA, 22 bp, Homo sapiens
gaagaccacatccacacacgca

SEQ ID NO: 2807337 - DNA, 14 bp, Homo sapiens
gaagacccagcagg

SEQ ID NO: 2807338 - DNA, 18 bp, Homo sapiens
gaagacccagcaggaagc

SEQ ID NO: 2807339 - DNA, 23 bp, Homo sapiens
gaagacccagtgtaaagaataaa

SEQ ID NO: 2807340 - DNA, 16 bp, Homo sapiens
gaagaccttctgaaga

SEQ ID NO: 2807341 - DNA, 18 bp, Homo sapiens
gaagactcattcttctgt

SEQ ID NO: 2807342 - DNA, 12 bp, Homo sapiens
gaagactggaag

SEQ ID NO: 2807343 - DNA, 13 bp, Homo sapiens
gaagactgtggct

SEQ ID NO: 2807344 - DNA, 12 bp, Homo sapiens
gaagagaaacca

SEQ ID NO: 2807345 - DNA, 18 bp, Homo sapiens
gaagagagatatatctga

SEQ ID NO: 2807346 - DNA, 21 bp, Homo sapiens
gaagagagtccatatttcaat

SEQ ID NO: 2807347 - DNA, 23 bp, Homo sapiens
gaagagcaggcacatggaggagc

SEQ ID NO: 2807348 - DNA, 13 bp, Homo sapiens
gaagagggcctgt

SEQ ID NO: 2807349 - DNA, 21 bp, Homo sapiens
gaagaggggaggggcctaggg

SEQ ID NO: 2807350 - DNA, 23 bp, Homo sapiens
gaagaggggaggggcctagggag

SEQ ID NO: 2807351 - DNA, 14 bp, Homo sapiens
gaagagtgagaggg

SEQ ID NO: 2807352 - DNA, 14 bp, Homo sapiens
gaagagtttgcaaa

SEQ ID NO: 2807353 - DNA, 21 bp, Homo sapiens
gaagatcttttaaaaaggcag

SEQ ID NO: 2807354 - DNA, 14 bp, Homo sapiens
gaagcaaataaata

SEQ ID NO: 2807355 - DNA, 20 bp, Homo sapiens
gaagcaacctcagtaattta

SEQ ID NO: 2807356 - DNA, 23 bp, Homo sapiens
gaagcaagacgtcctggaatgaa

SEQ ID NO: 2807357 - DNA, 13 bp, Homo sapiens
gaagcacagcttc

SEQ ID NO: 2807358 - DNA, 14 bp, Homo sapiens
gaagcacagcttca

SEQ ID NO: 2807359 - DNA, 18 bp, Homo sapiens
gaagcaggttgaggggct

SEQ ID NO: 2807360 - DNA, 22 bp, Homo sapiens
gaagcaggttgaggggctcctg

SEQ ID NO: 2807361 - DNA, 23 bp, Homo sapiens
gaagcaggttgaggggctcctgg

SEQ ID NO: 2807362 - DNA, 19 bp, Homo sapiens
gaagcagtgccttccataa

SEQ ID NO: 2807363 - DNA, 17 bp, Homo sapiens
gaagcatgtaggagaat

SEQ ID NO: 2807364 - DNA, 18 bp, Homo sapiens
gaagccaggagcaaatgt

SEQ ID NO: 2807365 - DNA, 22 bp, Homo sapiens
gaagccaggagcaaatgtttct

SEQ ID NO: 2807366 - DNA, 16 bp, Homo sapiens
gaagcccaagtgaaat

SEQ ID NO: 2807367 - DNA, 18 bp, Homo sapiens
gaagcccaataaacctct

SEQ ID NO: 2807368 - DNA, 14 bp, Homo sapiens
gaagccctccttcc

SEQ ID NO: 2807369 - DNA, 18 bp, Homo sapiens
gaagccctggatttcaga

SEQ ID NO: 2807370 - DNA, 15 bp, Homo sapiens
gaagcccttccagtg

SEQ ID NO: 2807371 - DNA, 23 bp, Homo sapiens
gaagcccttccagtggtaccagc

SEQ ID NO: 2807372 - DNA, 19 bp, Homo sapiens
gaagcctctgcctccctag

SEQ ID NO: 2807373 - DNA, 21 bp, Homo sapiens
gaagcctgggggcctggctgg

SEQ ID NO: 2807374 - DNA, 22 bp, Homo sapiens
gaagcctgggggcctggctggc

SEQ ID NO: 2807375 - DNA, 16 bp, Homo sapiens
gaagcgagcactgacc

SEQ ID NO: 2807376 - DNA, 20 bp, Homo sapiens
gaagctaacagggaaggcag

SEQ ID NO: 2807377 - DNA, 21 bp, Homo sapiens
gaagctaacagggaaggcagg

SEQ ID NO: 2807378 - DNA, 17 bp, Homo sapiens
gaagctctggccccagg

SEQ ID NO: 2807379 - DNA, 21 bp, Homo sapiens
gaagctgatgctttgcttcaa

SEQ ID NO: 2807380 - DNA, 13 bp, Homo sapiens
gaagctgggggaa

SEQ ID NO: 2807381 - DNA, 17 bp, Homo sapiens
gaagctgggggaagggt

SEQ ID NO: 2807382 - DNA, 12 bp, Homo sapiens
gaagctgtgtcc

SEQ ID NO: 2807383 - DNA, 23 bp, Homo sapiens
gaagctgtgtccttgcacctgca

SEQ ID NO: 2807384 - DNA, 18 bp, Homo sapiens
gaaggaaaaggcagggag

SEQ ID NO: 2807385 - DNA, 15 bp, Homo sapiens
gaaggaactctggct

SEQ ID NO: 2807386 - DNA, 23 bp, Homo sapiens
gaaggaactctggcttccaggta

SEQ ID NO: 2807387 - DNA, 17 bp, Homo sapiens
gaaggaatctgtgcaga

SEQ ID NO: 2807388 - DNA, 16 bp, Homo sapiens
gaaggaccctggctct

SEQ ID NO: 2807389 - DNA, 16 bp, Homo sapiens
gaaggagaaggaagga

SEQ ID NO: 2807390 - DNA, 23 bp, Homo sapiens
gaaggagactcacctctgcctca

SEQ ID NO: 2807391 - DNA, 16 bp, Homo sapiens
gaaggagatcagggca

SEQ ID NO: 2807392 - DNA, 13 bp, Homo sapiens
gaaggaggtgagg

SEQ ID NO: 2807393 - DNA, 15 bp, Homo sapiens
gaaggcaaagcacga

SEQ ID NO: 2807394 - DNA, 16 bp, Homo sapiens
gaaggcaggcagggct

SEQ ID NO: 2807395 - DNA, 18 bp, Homo sapiens
gaaggcaggcagggctct

SEQ ID NO: 2807396 - DNA, 21 bp, Homo sapiens
gaaggcaggcagggctctcct

SEQ ID NO: 2807397 - DNA, 13 bp, Homo sapiens
gaaggcatggcgg

SEQ ID NO: 2807398 - DNA, 21 bp, Homo sapiens
gaaggctacttcggggctggg

SEQ ID NO: 2807399 - DNA, 20 bp, Homo sapiens
gaaggcttcctccagcggct

SEQ ID NO: 2807400 - DNA, 18 bp, Homo sapiens
gaagggaccttgaagggt

SEQ ID NO: 2807401 - DNA, 21 bp, Homo sapiens
gaagggagaaggatctagaat

SEQ ID NO: 2807402 - DNA, 11 bp, Homo sapiens
gaagggcaccg

SEQ ID NO: 2807403 - DNA, 14 bp, Homo sapiens
gaagggcaccgaga

SEQ ID NO: 2807404 - DNA, 19 bp, Homo sapiens
gaagggccagtctgggctg

SEQ ID NO: 2807405 - DNA, 23 bp, Homo sapiens
gaaggggccctggtccttccagg

SEQ ID NO: 2807406 - DNA, 18 bp, Homo sapiens
gaagggggtccacccagc

SEQ ID NO: 2807407 - DNA, 22 bp, Homo sapiens
gaagggtggtctgagcaccccc

SEQ ID NO: 2807408 - DNA, 22 bp, Homo sapiens
gaaggtagcccagcactgtgaa

SEQ ID NO: 2807409 - DNA, 15 bp, Homo sapiens
gaaggtttgtatatt

SEQ ID NO: 2807410 - DNA, 16 bp, Homo sapiens
gaagtaacttttacaa

SEQ ID NO: 2807411 - DNA, 18 bp, Homo sapiens
gaagtaacttttacaaaa

SEQ ID NO: 2807412 - DNA, 17 bp, Homo sapiens
gaagtaagtggggttgc

SEQ ID NO: 2807413 - DNA, 22 bp, Homo sapiens
gaagtaagttctgaaaactgtt

SEQ ID NO: 2807414 - DNA, 23 bp, Homo sapiens
gaagtaagttctgaaaactgttt

SEQ ID NO: 2807415 - DNA, 18 bp, Homo sapiens
gaagtcagttggagaaaa

SEQ ID NO: 2807416 - DNA, 20 bp, Homo sapiens
gaagtcagttggagaaaatg

SEQ ID NO: 2807417 - DNA, 15 bp, Homo sapiens
gaagtcatgaagccc

SEQ ID NO: 2807418 - DNA, 22 bp, Homo sapiens
gaagtcgtccttactcctgtgg

SEQ ID NO: 2807419 - DNA, 22 bp, Homo sapiens
gaagtggaccaggacaggacca

SEQ ID NO: 2807420 - DNA, 16 bp, Homo sapiens
gaagtgggccaggaca

SEQ ID NO: 2807421 - DNA, 15 bp, Homo sapiens
gaagtgtgtttcctt

SEQ ID NO: 2807422 - DNA, 16 bp, Homo sapiens
gaagttgccaagagtt

SEQ ID NO: 2807423 - DNA, 11 bp, Homo sapiens
gaagtttcatc

SEQ ID NO: 2807424 - DNA, 17 bp, Homo sapiens
gacataaagttgataaa

SEQ ID NO: 2807425 - DNA, 16 bp, Homo sapiens
gacatatatattaaaa

SEQ ID NO: 2807426 - DNA, 20 bp, Homo sapiens
gacatcttcaaagcttgaag

SEQ ID NO: 2807427 - DNA, 21 bp, Homo sapiens
gacatcttcaaagcttgaaga

SEQ ID NO: 2807428 - DNA, 17 bp, Homo sapiens
gacatggagactcctgc

SEQ ID NO: 2807429 - DNA, 20 bp, Homo sapiens
gacatggagactcctgccct

SEQ ID NO: 2807430 - DNA, 16 bp, Homo sapiens
gacatgtggtgggaca

SEQ ID NO: 2807431 - DNA, 22 bp, Homo sapiens
gacattaactcattagactgga

SEQ ID NO: 2807432 - DNA, 13 bp, Homo sapiens
gacattctgattc

SEQ ID NO: 2807433 - DNA, 22 bp, Homo sapiens
gacattctgattcgaatgacac

SEQ ID NO: 2807434 - DNA, 16 bp, Homo sapiens
gacatttccctcctgg

SEQ ID NO: 2807435 - DNA, 22 bp, Homo sapiens
gacatttccctcctgggagaga

SEQ ID NO: 2807436 - DNA, 24 bp, Homo sapiens
gacatttccctcctgggagagaag

SEQ ID NO: 2807437 - DNA, 17 bp, Homo sapiens
gacattttctctttaaa

SEQ ID NO: 2807438 - DNA, 21 bp, Homo sapiens
gacattttctctttaaaagaa

SEQ ID NO: 2807439 - DNA, 14 bp, Homo sapiens
gaccaaaagttaca

SEQ ID NO: 2807440 - DNA, 16 bp, Homo sapiens
gaccaacatggagaaa

SEQ ID NO: 2807441 - DNA, 21 bp, Homo sapiens
gaccaacatggagaaaccctg

SEQ ID NO: 2807442 - DNA, 22 bp, Homo sapiens
gaccaacatggagaaaccctgt

SEQ ID NO: 2807443 - DNA, 18 bp, Homo sapiens
gaccaagagagaaagaag

SEQ ID NO: 2807444 - DNA, 17 bp, Homo sapiens
gaccacacctccctgaa

SEQ ID NO: 2807445 - DNA, 20 bp, Homo sapiens
gaccacacctccctgaacca

SEQ ID NO: 2807446 - DNA, 13 bp, Homo sapiens
gaccaccagcccc

SEQ ID NO: 2807447 - DNA, 14 bp, Homo sapiens
gaccaccagcccca

SEQ ID NO: 2807448 - DNA, 16 bp, Homo sapiens
gaccaccagccccagc

SEQ ID NO: 2807449 - DNA, 20 bp, Homo sapiens
gaccaccagccccagcaaga

SEQ ID NO: 2807450 - DNA, 16 bp, Homo sapiens
gaccacctctcaatat

SEQ ID NO: 2807451 - DNA, 13 bp, Homo sapiens
gaccacctgccca

SEQ ID NO: 2807452 - DNA, 15 bp, Homo sapiens
gaccacctgcttctg

SEQ ID NO: 2807453 - DNA, 20 bp, Homo sapiens
gaccacctgcttctgaactc

SEQ ID NO: 2807454 - DNA, 21 bp, Homo sapiens
gaccacgctttctagctgttg

SEQ ID NO: 2807455 - DNA, 21 bp, Homo sapiens
gaccacggacgtttccatcag

SEQ ID NO: 2807456 - DNA, 12 bp, Homo sapiens
gaccagcctggc

SEQ ID NO: 2807457 - DNA, 13 bp, Homo sapiens
gaccagcctggcc

SEQ ID NO: 2807458 - DNA, 22 bp, Homo sapiens
gaccaggactatagcccaggtc

SEQ ID NO: 2807459 - DNA, 17 bp, Homo sapiens
gaccaggctcacaactg

SEQ ID NO: 2807460 - DNA, 22 bp, Homo sapiens
gaccaggggtgatttcagagag

SEQ ID NO: 2807461 - DNA, 17 bp, Homo sapiens
gaccagttgggagcact

SEQ ID NO: 2807462 - DNA, 16 bp, Homo sapiens
gaccataacagccaac

SEQ ID NO: 2807463 - DNA, 13 bp, Homo sapiens
gaccatcctattt

SEQ ID NO: 2807464 - DNA, 11 bp, Homo sapiens
gacccaaagac

SEQ ID NO: 2807465 - DNA, 14 bp, Homo sapiens
gacccaaggaggaa

SEQ ID NO: 2807466 - DNA, 14 bp, Homo sapiens
gacccacatgccat

SEQ ID NO: 2807467 - DNA, 11 bp, Homo sapiens
gacccactgct

SEQ ID NO: 2807468 - DNA, 12 bp, Homo sapiens
gacccactgctt

SEQ ID NO: 2807469 - DNA, 23 bp, Homo sapiens
gacccacttcacacacaggcaac

SEQ ID NO: 2807470 - DNA, 12 bp, Homo sapiens
gacccagcagga

SEQ ID NO: 2807471 - DNA, 16 bp, Homo sapiens
gacccagtccctgggg

SEQ ID NO: 2807472 - DNA, 16 bp, Homo sapiens
gaccccaaagagcctg

SEQ ID NO: 2807473 - DNA, 20 bp, Homo sapiens
gaccccaaagagcctggaga

SEQ ID NO: 2807474 - DNA, 21 bp, Homo sapiens
gaccccaaagagcctggagaa

SEQ ID NO: 2807475 - DNA, 18 bp, Homo sapiens
gaccccagcggctgagtc

SEQ ID NO: 2807476 - DNA, 19 bp, Homo sapiens
gaccccagcggctgagtca

SEQ ID NO: 2807477 - DNA, 16 bp, Homo sapiens
gaccccagctagggct

SEQ ID NO: 2807478 - DNA, 14 bp, Homo sapiens
gaccccagggcaca

SEQ ID NO: 2807479 - DNA, 18 bp, Homo sapiens
gaccccagggcacaggag

SEQ ID NO: 2807480 - DNA, 21 bp, Homo sapiens
gaccccagggcacaggagcta

SEQ ID NO: 2807481 - DNA, 19 bp, Homo sapiens
gaccccatcacctactcac

SEQ ID NO: 2807482 - DNA, 12 bp, Homo sapiens
gacccctcagtg

SEQ ID NO: 2807483 - DNA, 14 bp, Homo sapiens
gacccctccatgtg

SEQ ID NO: 2807484 - DNA, 23 bp, Homo sapiens
gacccctgcaccagcccttccct

SEQ ID NO: 2807485 - DNA, 16 bp, Homo sapiens
gaccccttcctttcct

SEQ ID NO: 2807486 - DNA, 22 bp, Homo sapiens
gaccccttcctttcctctgcag

SEQ ID NO: 2807487 - DNA, 13 bp, Homo sapiens
gacccgctctgga

SEQ ID NO: 2807488 - DNA, 10 bp, Homo sapiens
gaccctcact

SEQ ID NO: 2807489 - DNA, 20 bp, Homo sapiens
gaccctcctgtccagcaggt

SEQ ID NO: 2807490 - DNA, 11 bp, Homo sapiens
gaccctgccct

SEQ ID NO: 2807491 - DNA, 13 bp, Homo sapiens
gaccctgcccttg

SEQ ID NO: 2807492 - DNA, 23 bp, Homo sapiens
gaccctgcccttgtttggggcag

SEQ ID NO: 2807493 - DNA, 22 bp, Homo sapiens
gaccctgcgaaggggccctggt

SEQ ID NO: 2807494 - DNA, 19 bp, Homo sapiens
gaccctggagcggctctcc

SEQ ID NO: 2807495 - DNA, 23 bp, Homo sapiens
gaccctggctcttctctcggggc

SEQ ID NO: 2807496 - DNA, 23 bp, Homo sapiens
gaccctttccttccttccctggc

SEQ ID NO: 2807497 - DNA, 20 bp, Homo sapiens
gaccgctacaccactctggc

SEQ ID NO: 2807498 - DNA, 20 bp, Homo sapiens
gacctaccagggacaagcag

SEQ ID NO: 2807499 - DNA, 14 bp, Homo sapiens
gacctcagcctgtg

SEQ ID NO: 2807500 - DNA, 14 bp, Homo sapiens
gacctcagccttcc

SEQ ID NO: 2807501 - DNA, 20 bp, Homo sapiens
gacctcagccttccccttgc

SEQ ID NO: 2807502 - DNA, 19 bp, Homo sapiens
gacctcaggtgatccaccc

SEQ ID NO: 2807503 - DNA, 18 bp, Homo sapiens
gacctccagctttcctgt

SEQ ID NO: 2807504 - DNA, 15 bp, Homo sapiens
gacctcgtcctcccc

SEQ ID NO: 2807505 - DNA, 16 bp, Homo sapiens
gacctcgtcctccccc

SEQ ID NO: 2807506 - DNA, 15 bp, Homo sapiens
gacctctgctctgag

SEQ ID NO: 2807507 - DNA, 15 bp, Homo sapiens
gacctgactattgaa

SEQ ID NO: 2807508 - DNA, 12 bp, Homo sapiens
gacctgagcctg

SEQ ID NO: 2807509 - DNA, 14 bp, Homo sapiens
gacctgagcctgcc

SEQ ID NO: 2807510 - DNA, 15 bp, Homo sapiens
gacctgagcctgccg

SEQ ID NO: 2807511 - DNA, 17 bp, Homo sapiens
gacctgagcctgccgag

SEQ ID NO: 2807512 - DNA, 10 bp, Homo sapiens
gacctgctga

SEQ ID NO: 2807513 - DNA, 16 bp, Homo sapiens
gacctggacactaggg

SEQ ID NO: 2807514 - DNA, 12 bp, Homo sapiens
gacctggcttgg

SEQ ID NO: 2807515 - DNA, 16 bp, Homo sapiens
gaggcagacagcagct

SEQ ID NO: 2807516 - DNA, 20 bp, Homo sapiens
gaggcagacagcagctcagg

SEQ ID NO: 2807517 - DNA, 16 bp, Homo sapiens
gaggcagagaaagaag

SEQ ID NO: 2807518 - DNA, 19 bp, Homo sapiens
gaggcagagaaagaagaga

SEQ ID NO: 2807519 - DNA, 19 bp, Homo sapiens
gaggcagccccattctgcc

SEQ ID NO: 2807520 - DNA, 22 bp, Homo sapiens
gaggcagccccattctgcctgc

SEQ ID NO: 2807521 - DNA, 15 bp, Homo sapiens
gaggcagggagggga

SEQ ID NO: 2807522 - DNA, 17 bp, Homo sapiens
gaggcagggaggggact

SEQ ID NO: 2807523 - DNA, 20 bp, Homo sapiens
gaggcagggccttgcccaga

SEQ ID NO: 2807524 - DNA, 14 bp, Homo sapiens
gaggcagggtctca

SEQ ID NO: 2807525 - DNA, 22 bp, Homo sapiens
gaggcagggtctcactctgtcg

SEQ ID NO: 2807526 - DNA, 21 bp, Homo sapiens
gaggccaccgggacagacctg

SEQ ID NO: 2807527 - DNA, 22 bp, Homo sapiens
gaggccaccgggacagacctgg

SEQ ID NO: 2807528 - DNA, 23 bp, Homo sapiens
gaggccaccgggacagacctgga

SEQ ID NO: 2807529 - DNA, 13 bp, Homo sapiens
gaggccagcctgg

SEQ ID NO: 2807530 - DNA, 18 bp, Homo sapiens
gaggccagcctggcctcc

SEQ ID NO: 2807531 - DNA, 19 bp, Homo sapiens
gaggccagcctggcctcct

SEQ ID NO: 2807532 - DNA, 20 bp, Homo sapiens
gaggccagcctggcctcctg

SEQ ID NO: 2807533 - DNA, 12 bp, Homo sapiens
gaggccaggagt

SEQ ID NO: 2807534 - DNA, 18 bp, Homo sapiens
gaggccatgggcctcctg

SEQ ID NO: 2807535 - DNA, 21 bp, Homo sapiens
gaggccatgggcctcctgtgt

SEQ ID NO: 2807536 - DNA, 18 bp, Homo sapiens
gaggccgaagctaacagg

SEQ ID NO: 2807537 - DNA, 14 bp, Homo sapiens
gaggccgcccggca

SEQ ID NO: 2807538 - DNA, 23 bp, Homo sapiens
gaggcctgccctcagggatcttg

SEQ ID NO: 2807539 - DNA, 15 bp, Homo sapiens
gaggcctggccaggc

SEQ ID NO: 2807540 - DNA, 20 bp, Homo sapiens
gaggcggcacattggcagtg

SEQ ID NO: 2807541 - DNA, 19 bp, Homo sapiens
gaggcggtttccaggaaga

SEQ ID NO: 2807542 - DNA, 13 bp, Homo sapiens
gaggcgtcttgta

SEQ ID NO: 2807543 - DNA, 16 bp, Homo sapiens
gaggcgtcttgtattt

SEQ ID NO: 2807544 - DNA, 16 bp, Homo sapiens
gaggctatagctggga

SEQ ID NO: 2807545 - DNA, 13 bp, Homo sapiens
gaggctgaggcag

SEQ ID NO: 2807546 - DNA, 16 bp, Homo sapiens
gaggctgaggcaggag

SEQ ID NO: 2807547 - DNA, 18 bp, Homo sapiens
gaggctgaggcaggagaa

SEQ ID NO: 2807548 - DNA, 23 bp, Homo sapiens
gaggctgctcggggtgcacagga

SEQ ID NO: 2807549 - DNA, 24 bp, Homo sapiens
gaggctgctcggggtgcacaggag

SEQ ID NO: 2807550 - DNA, 16 bp, Homo sapiens
gaggctggaggcaggg

SEQ ID NO: 2807551 - DNA, 18 bp, Homo sapiens
gaggctggaggcagggcc

SEQ ID NO: 2807552 - DNA, 23 bp, Homo sapiens
gaggctggtctccctccagctgg

SEQ ID NO: 2807553 - DNA, 16 bp, Homo sapiens
gaggcttccagagagt

SEQ ID NO: 2807554 - DNA, 22 bp, Homo sapiens
gaggcttccagagagtcctctg

SEQ ID NO: 2807555 - DNA, 16 bp, Homo sapiens
gaggcttcttcagatc

SEQ ID NO: 2807556 - DNA, 22 bp, Homo sapiens
gaggcttcttcagatcagtgct

SEQ ID NO: 2807557 - DNA, 19 bp, Homo sapiens
gagggaacagacaggagaa

SEQ ID NO: 2807558 - DNA, 22 bp, Homo sapiens
gagggacaaaggagcctgtgaa

SEQ ID NO: 2807559 - DNA, 13 bp, Homo sapiens
gagggagaaggga

SEQ ID NO: 2807560 - DNA, 16 bp, Homo sapiens
gagggagtgacagagg

SEQ ID NO: 2807561 - DNA, 21 bp, Homo sapiens
gagggagtgacagaggcagcc

SEQ ID NO: 2807562 - DNA, 15 bp, Homo sapiens
gagggatgctgcctg

SEQ ID NO: 2807563 - DNA, 17 bp, Homo sapiens
gagggatgctgcctgag

SEQ ID NO: 2807564 - DNA, 20 bp, Homo sapiens
gagggatgctgcctgagtca

SEQ ID NO: 2807565 - DNA, 15 bp, Homo sapiens
gagggcagcagccag

SEQ ID NO: 2807566 - DNA, 20 bp, Homo sapiens
gagggcagcagccagccctg

SEQ ID NO: 2807567 - DNA, 19 bp, Homo sapiens
gagggcagttcgcagccac

SEQ ID NO: 2807568 - DNA, 18 bp, Homo sapiens
gagggcatgcgcacaagg

SEQ ID NO: 2807569 - DNA, 16 bp, Homo sapiens
gagggcccaggcaggc

SEQ ID NO: 2807570 - DNA, 12 bp, Homo sapiens
gagggcgtgtct

SEQ ID NO: 2807571 - DNA, 13 bp, Homo sapiens
gagggctctgagg

SEQ ID NO: 2807572 - DNA, 13 bp, Homo sapiens
gagggctgccctg

SEQ ID NO: 2807573 - DNA, 13 bp, Homo sapiens
gagggctgcctga

SEQ ID NO: 2807574 - DNA, 18 bp, Homo sapiens
gaggggaataatagaaga

SEQ ID NO: 2807575 - DNA, 20 bp, Homo sapiens
gaggggacatttccctcctg

SEQ ID NO: 2807576 - DNA, 22 bp, Homo sapiens
gaggggacatttccctcctggg

SEQ ID NO: 2807577 - DNA, 12 bp, Homo sapiens
gaggggagaagc

SEQ ID NO: 2807578 - DNA, 21 bp, Homo sapiens
gaggggaggatcactggagcc

SEQ ID NO: 2807579 - DNA, 12 bp, Homo sapiens
gaggggcctagg

SEQ ID NO: 2807580 - DNA, 13 bp, Homo sapiens
gaggggcctaggg

SEQ ID NO: 2807581 - DNA, 15 bp, Homo sapiens
gaggggcctagggag

SEQ ID NO: 2807582 - DNA, 12 bp, Homo sapiens
gaggggctcctg

SEQ ID NO: 2807583 - DNA, 15 bp, Homo sapiens
gaggggctcctggaa

SEQ ID NO: 2807584 - DNA, 17 bp, Homo sapiens
gagggggtcgtggagag

SEQ ID NO: 2807585 - DNA, 21 bp, Homo sapiens
gagggggtcgtggagagctag

SEQ ID NO: 2807586 - DNA, 21 bp, Homo sapiens
gagggtccccgggagcacacg

SEQ ID NO: 2807587 - DNA, 19 bp, Homo sapiens
gagggtcgccacacccggc

SEQ ID NO: 2807588 - DNA, 20 bp, Homo sapiens
gagggtggagactaagccct

SEQ ID NO: 2807589 - DNA, 18 bp, Homo sapiens
gagggtgggagagcccag

SEQ ID NO: 2807590 - DNA, 19 bp, Homo sapiens
gagggtgggagagcccagc

SEQ ID NO: 2807591 - DNA, 20 bp, Homo sapiens
gagggttgggttcatctgag

SEQ ID NO: 2807592 - DNA, 15 bp, Homo sapiens
gaggtcaacagagaa

SEQ ID NO: 2807593 - DNA, 22 bp, Homo sapiens
gaggtcaacagagaaggcagga

SEQ ID NO: 2807594 - DNA, 23 bp, Homo sapiens
gaggtcaacagagaaggcaggaa

SEQ ID NO: 2807595 - DNA, 17 bp, Homo sapiens
gaggtcagagcctgcag

SEQ ID NO: 2807596 - DNA, 12 bp, Homo sapiens
gaggtcccaggc

SEQ ID NO: 2807597 - DNA, 14 bp, Homo sapiens
gaggtcccaggcag

SEQ ID NO: 2807598 - DNA, 14 bp, Homo sapiens
gaggtccctgccag

SEQ ID NO: 2807599 - DNA, 12 bp, Homo sapiens
gaggtcctgagc

SEQ ID NO: 2807600 - DNA, 16 bp, Homo sapiens
gaggtcctgagcactg

SEQ ID NO: 2807601 - DNA, 17 bp, Homo sapiens
gaggtcctgagcactgc

SEQ ID NO: 2807602 - DNA, 22 bp, Homo sapiens
gaggtcctgagcactgccagga

SEQ ID NO: 2807603 - DNA, 23 bp, Homo sapiens
gaggtcttggccgactcagggac

SEQ ID NO: 2807604 - DNA, 16 bp, Homo sapiens
gaggtgaccccagggc

SEQ ID NO: 2807605 - DNA, 13 bp, Homo sapiens
gcaagtgagagct

SEQ ID NO: 2807606 - DNA, 14 bp, Homo sapiens
gcaataaaatagta

SEQ ID NO: 2807607 - DNA, 17 bp, Homo sapiens
gcaataaaatagtattg

SEQ ID NO: 2807608 - DNA, 20 bp, Homo sapiens
gcaatccatgttagttttta

SEQ ID NO: 2807609 - DNA, 13 bp, Homo sapiens
gcaatctccaggg

SEQ ID NO: 2807610 - DNA, 15 bp, Homo sapiens
gcaatgaaaaattct

SEQ ID NO: 2807611 - DNA, 15 bp, Homo sapiens
gcaatgatgtccaga

SEQ ID NO: 2807612 - DNA, 14 bp, Homo sapiens
gcaatgctggctgt

SEQ ID NO: 2807613 - DNA, 22 bp, Homo sapiens
gcaatgctggctgttggctggg

SEQ ID NO: 2807614 - DNA, 19 bp, Homo sapiens
gcaatgtaaatattttaaa

SEQ ID NO: 2807615 - DNA, 22 bp, Homo sapiens
gcaatgtcaggaacagaaggat

SEQ ID NO: 2807616 - DNA, 15 bp, Homo sapiens
gcaattgcttaggat

SEQ ID NO: 2807617 - DNA, 18 bp, Homo sapiens
gcaatttccttttttgtt

SEQ ID NO: 2807618 - DNA, 20 bp, Homo sapiens
gcaatttttaaactagtaat

SEQ ID NO: 2807619 - DNA, 13 bp, Homo sapiens
gcacaaagctcaa

SEQ ID NO: 2807620 - DNA, 17 bp, Homo sapiens
gcacaaagctcaagatg

SEQ ID NO: 2807621 - DNA, 14 bp, Homo sapiens
gcacaaatatttat

SEQ ID NO: 2807622 - DNA, 15 bp, Homo sapiens
gcacaaatatttatt

SEQ ID NO: 2807623 - DNA, 16 bp, Homo sapiens
gcacaaatatttattt

SEQ ID NO: 2807624 - DNA, 15 bp, Homo sapiens
gcacaatttagaaaa

SEQ ID NO: 2807625 - DNA, 18 bp, Homo sapiens
gcacaatttgagcaattc

SEQ ID NO: 2807626 - DNA, 22 bp, Homo sapiens
gcacaatttgagcaattcattt

SEQ ID NO: 2807627 - DNA, 14 bp, Homo sapiens
gcacacaccagagc

SEQ ID NO: 2807628 - DNA, 15 bp, Homo sapiens
gcacacaccagagcc

SEQ ID NO: 2807629 - DNA, 17 bp, Homo sapiens
gcacacaccagagccca

SEQ ID NO: 2807630 - DNA, 19 bp, Homo sapiens
gcacacaggtacagcaaca

SEQ ID NO: 2807631 - DNA, 18 bp, Homo sapiens
gcacacgcctgtaatccc

SEQ ID NO: 2807632 - DNA, 19 bp, Homo sapiens
gcacagaaggaatctgtgc

SEQ ID NO: 2807633 - DNA, 21 bp, Homo sapiens
gcacagaaggaatctgtgcag

SEQ ID NO: 2807634 - DNA, 18 bp, Homo sapiens
gcacagaggcagctgtgt

SEQ ID NO: 2807635 - DNA, 20 bp, Homo sapiens
gcacagaggcagctgtgtgg

SEQ ID NO: 2807636 - DNA, 23 bp, Homo sapiens
gcacagcttcatttcctgtgtct

SEQ ID NO: 2807637 - DNA, 12 bp, Homo sapiens
gcacaggcagct

SEQ ID NO: 2807638 - DNA, 15 bp, Homo sapiens
gcacaggctaatttt

SEQ ID NO: 2807639 - DNA, 16 bp, Homo sapiens
gcacaggctaattttt

SEQ ID NO: 2807640 - DNA, 13 bp, Homo sapiens
gcacatatggact

SEQ ID NO: 2807641 - DNA, 13 bp, Homo sapiens
gcacatgtcttgt

SEQ ID NO: 2807642 - DNA, 16 bp, Homo sapiens
gcacattggcagtgtg

SEQ ID NO: 2807643 - DNA, 20 bp, Homo sapiens
gcacatttatatatatatgt

SEQ ID NO: 2807644 - DNA, 15 bp, Homo sapiens
gcaccaaaagaagta

SEQ ID NO: 2807645 - DNA, 16 bp, Homo sapiens
gcaccaaaagaagtaa

SEQ ID NO: 2807646 - DNA, 18 bp, Homo sapiens
gcaccaaaagaagtaaaa

SEQ ID NO: 2807647 - DNA, 13 bp, Homo sapiens
gcaccacaggctg

SEQ ID NO: 2807648 - DNA, 17 bp, Homo sapiens
gcaccacaggctgcctc

SEQ ID NO: 2807649 - DNA, 23 bp, Homo sapiens
gcaccactgcactccagcctggg

SEQ ID NO: 2807650 - DNA, 15 bp, Homo sapiens
gcaccagaggctgca

SEQ ID NO: 2807651 - DNA, 19 bp, Homo sapiens
gcaccagcttctccaggct

SEQ ID NO: 2807652 - DNA, 15 bp, Homo sapiens
gcaccaggccgggct

SEQ ID NO: 2807653 - DNA, 18 bp, Homo sapiens
gcaccagtgccgcctgtg

SEQ ID NO: 2807654 - DNA, 20 bp, Homo sapiens
gcaccatctctgattttcaa

SEQ ID NO: 2807655 - DNA, 17 bp, Homo sapiens
gcaccccatgagtagtg

SEQ ID NO: 2807656 - DNA, 15 bp, Homo sapiens
gcacccccagcctgg

SEQ ID NO: 2807657 - DNA, 23 bp, Homo sapiens
gcacccccagcctgggcctatgg

SEQ ID NO: 2807658 - DNA, 13 bp, Homo sapiens
gcaccccctgcag

SEQ ID NO: 2807659 - DNA, 15 bp, Homo sapiens
gcaccccctgcagct

SEQ ID NO: 2807660 - DNA, 19 bp, Homo sapiens
gcaccccctgcagcttgta

SEQ ID NO: 2807661 - DNA, 17 bp, Homo sapiens
gcacccggcccctgctg

SEQ ID NO: 2807662 - DNA, 19 bp, Homo sapiens
gcacccggcccctgctggt

SEQ ID NO: 2807663 - DNA, 23 bp, Homo sapiens
gcacccgtacccccgtggtcttt

SEQ ID NO: 2807664 - DNA, 18 bp, Homo sapiens
gcacccgttcaccttctt

SEQ ID NO: 2807665 - DNA, 21 bp, Homo sapiens
gcaccctgcagagcacacagg

SEQ ID NO: 2807666 - DNA, 14 bp, Homo sapiens
gcaccgggccacag

SEQ ID NO: 2807667 - DNA, 23 bp, Homo sapiens
gcaccgggccacagagaaagtac

SEQ ID NO: 2807668 - DNA, 19 bp, Homo sapiens
gcacctacatccccaggtc

SEQ ID NO: 2807669 - DNA, 21 bp, Homo sapiens
gcacctacatccccaggtctc

SEQ ID NO: 2807670 - DNA, 21 bp, Homo sapiens
gcacctccccccactgcaggc

SEQ ID NO: 2807671 - DNA, 15 bp, Homo sapiens
gcacctcctgcctcg

SEQ ID NO: 2807672 - DNA, 22 bp, Homo sapiens
gcacctgcatccgtagttccct

SEQ ID NO: 2807673 - DNA, 13 bp, Homo sapiens
gcacctgccagcc

SEQ ID NO: 2807674 - DNA, 15 bp, Homo sapiens
gcacctgccccctgg

SEQ ID NO: 2807675 - DNA, 19 bp, Homo sapiens
gcacctgccgacctcgtcc

SEQ ID NO: 2807676 - DNA, 18 bp, Homo sapiens
  misc_feature (9)..(9): n is a, c, g or t
gcacctgcnttgtccctg

SEQ ID NO: 2807677 - DNA, 15 bp, Homo sapiens
gcacctgggccctgg

SEQ ID NO: 2807678 - DNA, 16 bp, Homo sapiens
gcacctgggccctggg

SEQ ID NO: 2807679 - DNA, 17 bp, Homo sapiens
gcacctgggccctgggg

SEQ ID NO: 2807680 - DNA, 23 bp, Homo sapiens
gcacctgggccctggggcctgta

SEQ ID NO: 2807681 - DNA, 21 bp, Homo sapiens
gcacctgtactcaggaggctg

SEQ ID NO: 2807682 - DNA, 15 bp, Homo sapiens
gcacctgtcccagaa

SEQ ID NO: 2807683 - DNA, 13 bp, Homo sapiens
gcacctttctagt

SEQ ID NO: 2807684 - DNA, 17 bp, Homo sapiens
gcacgaacccacctgct

SEQ ID NO: 2807685 - DNA, 14 bp, Homo sapiens
gcacgtgtgtgcac

SEQ ID NO: 2807686 - DNA, 14 bp, Homo sapiens
gcactaaagcagtg

SEQ ID NO: 2807687 - DNA, 20 bp, Homo sapiens
gcactaaagcagtggacacc

SEQ ID NO: 2807688 - DNA, 18 bp, Homo sapiens
gcactaaggtgtgctctg

SEQ ID NO: 2807689 - DNA, 19 bp, Homo sapiens
gcactaaggtgtgctctga

SEQ ID NO: 2807690 - DNA, 22 bp, Homo sapiens
gcactcaaccaacctccccgca

SEQ ID NO: 2807691 - DNA, 13 bp, Homo sapiens
gcactcagaagac

SEQ ID NO: 2807692 - DNA, 23 bp, Homo sapiens
gcactcagtgaggccgcccggca

SEQ ID NO: 2807693 - DNA, 21 bp, Homo sapiens
gcactccagcctgggcgacag

SEQ ID NO: 2807694 - DNA, 14 bp, Homo sapiens
gcactccggaggta

SEQ ID NO: 2807695 - DNA, 14 bp, Homo sapiens
gcactcctctgtct

SEQ ID NO: 2807696 - DNA, 20 bp, Homo sapiens
gcccaggagagccagccctc

SEQ ID NO: 2807697 - DNA, 14 bp, Homo sapiens
gcccaggcaggcca

SEQ ID NO: 2807698 - DNA, 13 bp, Homo sapiens
gcccaggcaggtc

SEQ ID NO: 2807699 - DNA, 15 bp, Homo sapiens
gcccaggcccctgcc

SEQ ID NO: 2807700 - DNA, 23 bp, Homo sapiens
gcccaggcccctgccaccctggg

SEQ ID NO: 2807701 - DNA, 19 bp, Homo sapiens
gcccaggctggagtgcagt

SEQ ID NO: 2807702 - DNA, 16 bp, Homo sapiens
gcccaggctggcgtgc

SEQ ID NO: 2807703 - DNA, 12 bp, Homo sapiens
gcccagggaggc

SEQ ID NO: 2807704 - DNA, 21 bp, Homo sapiens
gcccagggaggccgaagctaa

SEQ ID NO: 2807705 - DNA, 12 bp, Homo sapiens
gcccagggctca

SEQ ID NO: 2807706 - DNA, 14 bp, Homo sapiens
gcccagggctcagc

SEQ ID NO: 2807707 - DNA, 16 bp, Homo sapiens
gcccaggtcctctgat

SEQ ID NO: 2807708 - DNA, 19 bp, Homo sapiens
gcccagtctggaatgcagt

SEQ ID NO: 2807709 - DNA, 15 bp, Homo sapiens
gcccagttgggtgga

SEQ ID NO: 2807710 - DNA, 14 bp, Homo sapiens
gccccaactcctgg

SEQ ID NO: 2807711 - DNA, 17 bp, Homo sapiens
gccccaactccttccag

SEQ ID NO: 2807712 - DNA, 14 bp, Homo sapiens
gccccaaggctgct

SEQ ID NO: 2807713 - DNA, 16 bp, Homo sapiens
gccccaaggctgctca

SEQ ID NO: 2807714 - DNA, 18 bp, Homo sapiens
gccccaaggctgctcaga

SEQ ID NO: 2807715 - DNA, 18 bp, Homo sapiens
gccccaccacctaggcca

SEQ ID NO: 2807716 - DNA, 13 bp, Homo sapiens
gccccaccagcca

SEQ ID NO: 2807717 - DNA, 16 bp, Homo sapiens
gccccaccagccacct

SEQ ID NO: 2807718 - DNA, 18 bp, Homo sapiens
gccccaccagccacctct

SEQ ID NO: 2807719 - DNA, 23 bp, Homo sapiens
gccccaccagccacctcttgggc

SEQ ID NO: 2807720 - DNA, 21 bp, Homo sapiens
gccccaccctcgtggacacct

SEQ ID NO: 2807721 - DNA, 16 bp, Homo sapiens
gccccagagatgggca

SEQ ID NO: 2807722 - DNA, 19 bp, Homo sapiens
gccccagatcaccagcccg

SEQ ID NO: 2807723 - DNA, 23 bp, Homo sapiens
gccccagcactaaagcagtggac

SEQ ID NO: 2807724 - DNA, 13 bp, Homo sapiens
gccccagccccca

SEQ ID NO: 2807725 - DNA, 16 bp, Homo sapiens
gccccagcccccacct

SEQ ID NO: 2807726 - DNA, 20 bp, Homo sapiens
gccccagcccgacaggcatg

SEQ ID NO: 2807727 - DNA, 13 bp, Homo sapiens
gccccagctctgg

SEQ ID NO: 2807728 - DNA, 23 bp, Homo sapiens
gccccaggcttgtcactagcagc

SEQ ID NO: 2807729 - DNA, 18 bp, Homo sapiens
gccccagggctaccctcc

SEQ ID NO: 2807730 - DNA, 14 bp, Homo sapiens
gccccagtgacagc

SEQ ID NO: 2807731 - DNA, 12 bp, Homo sapiens
gccccagtgccc

SEQ ID NO: 2807732 - DNA, 13 bp, Homo sapiens
gccccagtgccca

SEQ ID NO: 2807733 - DNA, 15 bp, Homo sapiens
gccccagtgcccaca

SEQ ID NO: 2807734 - DNA, 18 bp, Homo sapiens
gccccatgtctctcagaa

SEQ ID NO: 2807735 - DNA, 21 bp, Homo sapiens
gccccattctgcctgcccagg

SEQ ID NO: 2807736 - DNA, 22 bp, Homo sapiens
gccccattctgcctgcccaggc

SEQ ID NO: 2807737 - DNA, 11 bp, Homo sapiens
gcccccacagg

SEQ ID NO: 2807738 - DNA, 16 bp, Homo sapiens
gcccccacctggctca

SEQ ID NO: 2807739 - DNA, 21 bp, Homo sapiens
gcccccacttctctccaggct

SEQ ID NO: 2807740 - DNA, 14 bp, Homo sapiens
gccccccgcagcac

SEQ ID NO: 2807741 - DNA, 12 bp, Homo sapiens
gcccccctccag

SEQ ID NO: 2807742 - DNA, 16 bp, Homo sapiens
gcccccgtcttctctc

SEQ ID NO: 2807743 - DNA, 22 bp, Homo sapiens
gccccctggtggacagtcctgg

SEQ ID NO: 2807744 - DNA, 13 bp, Homo sapiens
gccccgactccag

SEQ ID NO: 2807745 - DNA, 14 bp, Homo sapiens
gccccgactccagc

SEQ ID NO: 2807746 - DNA, 19 bp, Homo sapiens
gccccgactccagccagcg

SEQ ID NO: 2807747 - DNA, 21 bp, Homo sapiens
gccccgcttccccacagaact

SEQ ID NO: 2807748 - DNA, 18 bp, Homo sapiens
gccccgcttgtccagcgc

SEQ ID NO: 2807749 - DNA, 19 bp, Homo sapiens
gccccgcttgtccagcgcc

SEQ ID NO: 2807750 - DNA, 19 bp, Homo sapiens
gccccggtcctggccccag

SEQ ID NO: 2807751 - DNA, 21 bp, Homo sapiens
gccccggtcctggccccagcc

SEQ ID NO: 2807752 - DNA, 20 bp, Homo sapiens
gcccctcacctgcctgccct

SEQ ID NO: 2807753 - DNA, 15 bp, Homo sapiens
gcccctcctcccctt

SEQ ID NO: 2807754 - DNA, 20 bp, Homo sapiens
gcccctcctccccttcctgc

SEQ ID NO: 2807755 - DNA, 17 bp, Homo sapiens
gcccctcctctgccacc

SEQ ID NO: 2807756 - DNA, 18 bp, Homo sapiens
gcccctcctctgccacct

SEQ ID NO: 2807757 - DNA, 21 bp, Homo sapiens
gcccctcctctgccacctccc

SEQ ID NO: 2807758 - DNA, 22 bp, Homo sapiens
gcccctcctctgccacctcccc

SEQ ID NO: 2807759 - DNA, 13 bp, Homo sapiens
gcccctgcagttg

SEQ ID NO: 2807760 - DNA, 14 bp, Homo sapiens
gcccctgcagttgg

SEQ ID NO: 2807761 - DNA, 17 bp, Homo sapiens
gcccctgcagttggcag

SEQ ID NO: 2807762 - DNA, 13 bp, Homo sapiens
gcccctgccaccc

SEQ ID NO: 2807763 - DNA, 14 bp, Homo sapiens
gcccctgccaccct

SEQ ID NO: 2807764 - DNA, 15 bp, Homo sapiens
gcccctgctggttca

SEQ ID NO: 2807765 - DNA, 22 bp, Homo sapiens
gcccctgctggttcagggttgg

SEQ ID NO: 2807766 - DNA, 16 bp, Homo sapiens
gcccctggtctgccct

SEQ ID NO: 2807767 - DNA, 21 bp, Homo sapiens
gccccttactatgatctcagg

SEQ ID NO: 2807768 - DNA, 23 bp, Homo sapiens
gccccttactatgatctcaggag

SEQ ID NO: 2807769 - DNA, 13 bp, Homo sapiens
gccccttgggcct

SEQ ID NO: 2807770 - DNA, 16 bp, Homo sapiens
gcccgacaggcatgca

SEQ ID NO: 2807771 - DNA, 17 bp, Homo sapiens
gcccgagcagctgagca

SEQ ID NO: 2807772 - DNA, 18 bp, Homo sapiens
gcccgagcagctgagcag

SEQ ID NO: 2807773 - DNA, 15 bp, Homo sapiens
gcccgctttgcctgc

SEQ ID NO: 2807774 - DNA, 23 bp, Homo sapiens
gcccggccccatcagaggctggg

SEQ ID NO: 2807775 - DNA, 18 bp, Homo sapiens
gcccggctccaggctcct

SEQ ID NO: 2807776 - DNA, 15 bp, Homo sapiens
gccctaaggatctct

SEQ ID NO: 2807777 - DNA, 21 bp, Homo sapiens
gccctaagtgttgaagaagag

SEQ ID NO: 2807778 - DNA, 19 bp, Homo sapiens
gccctaccagagggaacac

SEQ ID NO: 2807779 - DNA, 13 bp, Homo sapiens
gccctagagcaca

SEQ ID NO: 2807780 - DNA, 17 bp, Homo sapiens
gccctagagcacactgt

SEQ ID NO: 2807781 - DNA, 19 bp, Homo sapiens
gccctagagcacactgtag

SEQ ID NO: 2807782 - DNA, 16 bp, Homo sapiens
gccctcccacctccgc

SEQ ID NO: 2807783 - DNA, 13 bp, Homo sapiens
gccctccctggcc

SEQ ID NO: 2807784 - DNA, 13 bp, Homo sapiens
gccctcctcaccc

SEQ ID NO: 2807785 - DNA, 10 bp, Homo sapiens
gccctccttc

SEQ ID NO: 2807786 - DNA, 11 bp, Homo sapiens
gccctctctga

SEQ ID NO: 2807787 - DNA, 23 bp, Homo sapiens
gctactctgtgccagagcctggg

SEQ ID NO: 2807788 - DNA, 20 bp, Homo sapiens
gctactgtcctacccaccct

SEQ ID NO: 2807789 - DNA, 18 bp, Homo sapiens
gctacttcggggctggga

SEQ ID NO: 2807790 - DNA, 19 bp, Homo sapiens
gctagcaaagcttaaatgc

SEQ ID NO: 2807791 - DNA, 17 bp, Homo sapiens
gctagcacttggagcca

SEQ ID NO: 2807792 - DNA, 12 bp, Homo sapiens
gctagcagaagt

SEQ ID NO: 2807793 - DNA, 14 bp, Homo sapiens
gctagcgctgccgc

SEQ ID NO: 2807794 - DNA, 20 bp, Homo sapiens
gctagcgctgccgcacccca

SEQ ID NO: 2807795 - DNA, 22 bp, Homo sapiens
gctagcgctgccgcaccccaga

SEQ ID NO: 2807796 - DNA, 17 bp, Homo sapiens
gctagctgtagaaatgt

SEQ ID NO: 2807797 - DNA, 17 bp, Homo sapiens
gctaggagcaaagcctg

SEQ ID NO: 2807798 - DNA, 15 bp, Homo sapiens
gctaggcctggccag

SEQ ID NO: 2807799 - DNA, 17 bp, Homo sapiens
gctaggcctggccagat

SEQ ID NO: 2807800 - DNA, 19 bp, Homo sapiens
gctaggcgagtgccaggac

SEQ ID NO: 2807801 - DNA, 20 bp, Homo sapiens
gctaggcgagtgccaggact

SEQ ID NO: 2807802 - DNA, 19 bp, Homo sapiens
gctataggctggagaagct

SEQ ID NO: 2807803 - DNA, 19 bp, Homo sapiens
gctatccagctatttttat

SEQ ID NO: 2807804 - DNA, 17 bp, Homo sapiens
gctatgatcgcgccact

SEQ ID NO: 2807805 - DNA, 18 bp, Homo sapiens
gctatgtttttaatgtat

SEQ ID NO: 2807806 - DNA, 18 bp, Homo sapiens
gctattaaaagaatccaa

SEQ ID NO: 2807807 - DNA, 17 bp, Homo sapiens
gctattattttcactgt

SEQ ID NO: 2807808 - DNA, 16 bp, Homo sapiens
gctattgacaagtcat

SEQ ID NO: 2807809 - DNA, 13 bp, Homo sapiens
gctattgatgttt

SEQ ID NO: 2807810 - DNA, 21 bp, Homo sapiens
gctattgatgtttccagaaaa

SEQ ID NO: 2807811 - DNA, 12 bp, Homo sapiens
gctattgcatgt

SEQ ID NO: 2807812 - DNA, 17 bp, Homo sapiens
gctattgcatgtaaaat

SEQ ID NO: 2807813 - DNA, 20 bp, Homo sapiens
gctatttgttgtttttaaca

SEQ ID NO: 2807814 - DNA, 18 bp, Homo sapiens
gctattttatattacact

SEQ ID NO: 2807815 - DNA, 23 bp, Homo sapiens
gctattttatattacactacaca

SEQ ID NO: 2807816 - DNA, 18 bp, Homo sapiens
gctcaaatctattcagac

SEQ ID NO: 2807817 - DNA, 22 bp, Homo sapiens
gctcaaatctattcagacaagc

SEQ ID NO: 2807818 - DNA, 23 bp, Homo sapiens
gctcaaatctattcagacaagca

SEQ ID NO: 2807819 - DNA, 14 bp, Homo sapiens
gctcaacctctctc

SEQ ID NO: 2807820 - DNA, 17 bp, Homo sapiens
gctcaagatgacagctc

SEQ ID NO: 2807821 - DNA, 22 bp, Homo sapiens
gctcaatattcctgaatgaaat

SEQ ID NO: 2807822 - DNA, 14 bp, Homo sapiens
gctcaatcctctaa

SEQ ID NO: 2807823 - DNA, 14 bp, Homo sapiens
gctcacaactgttt

SEQ ID NO: 2807824 - DNA, 13 bp, Homo sapiens
gctcacaaggcag

SEQ ID NO: 2807825 - DNA, 19 bp, Homo sapiens
gctcacaaggcagcaaggc

SEQ ID NO: 2807826 - DNA, 16 bp, Homo sapiens
gctcacagttcctcgc

SEQ ID NO: 2807827 - DNA, 21 bp, Homo sapiens
gctcacagttcctcgccctgg

SEQ ID NO: 2807828 - DNA, 18 bp, Homo sapiens
gctcaccaagctgttcca

SEQ ID NO: 2807829 - DNA, 18 bp, Homo sapiens
gctcaccttgtgctgggg

SEQ ID NO: 2807830 - DNA, 23 bp, Homo sapiens
gctcacgcctataatcccagcac

SEQ ID NO: 2807831 - DNA, 23 bp, Homo sapiens
gctcacgcctgtaatcccagcac

SEQ ID NO: 2807832 - DNA, 14 bp, Homo sapiens
gctcactgcagcct

SEQ ID NO: 2807833 - DNA, 17 bp, Homo sapiens
gctcactgcagcctcaa

SEQ ID NO: 2807834 - DNA, 12 bp, Homo sapiens
gctcagaggccc

SEQ ID NO: 2807835 - DNA, 15 bp, Homo sapiens
gctcagatagaatga

SEQ ID NO: 2807836 - DNA, 19 bp, Homo sapiens
gctcagatagaatgacagt

SEQ ID NO: 2807837 - DNA, 20 bp, Homo sapiens
gctcagccctgactggtgct

SEQ ID NO: 2807838 - DNA, 18 bp, Homo sapiens
gctcagcctggtgggcct

SEQ ID NO: 2807839 - DNA, 16 bp, Homo sapiens
gctcagcggggacagc

SEQ ID NO: 2807840 - DNA, 18 bp, Homo sapiens
gctcagcggggacagctc

SEQ ID NO: 2807841 - DNA, 19 bp, Homo sapiens
gctcagcggggacagctcc

SEQ ID NO: 2807842 - DNA, 17 bp, Homo sapiens
gctcaggaggcttggaa

SEQ ID NO: 2807843 - DNA, 19 bp, Homo sapiens
gctcaggtgtccctgcact

SEQ ID NO: 2807844 - DNA, 21 bp, Homo sapiens
gctcagtaatttgaggacaac

SEQ ID NO: 2807845 - DNA, 21 bp, Homo sapiens
gctcagtctcaggagcatggg

SEQ ID NO: 2807846 - DNA, 12 bp, Homo sapiens
gctccacctgtt

SEQ ID NO: 2807847 - DNA, 14 bp, Homo sapiens
gctccacctgttca

SEQ ID NO: 2807848 - DNA, 13 bp, Homo sapiens
gctccagctcacc

SEQ ID NO: 2807849 - DNA, 21 bp, Homo sapiens
gctccagctcaccagccccag

SEQ ID NO: 2807850 - DNA, 12 bp, Homo sapiens
gctcccagcagc

SEQ ID NO: 2807851 - DNA, 19 bp, Homo sapiens
gctcccagcagccctaagg

SEQ ID NO: 2807852 - DNA, 20 bp, Homo sapiens
gctccccactctgctctgat

SEQ ID NO: 2807853 - DNA, 22 bp, Homo sapiens
gctccccactctgctctgatgc

SEQ ID NO: 2807854 - DNA, 13 bp, Homo sapiens
gctccccaggact

SEQ ID NO: 2807855 - DNA, 17 bp, Homo sapiens
gctccccctgcttctca

SEQ ID NO: 2807856 - DNA, 21 bp, Homo sapiens
gctccccctgcttctcagccc

SEQ ID NO: 2807857 - DNA, 20 bp, Homo sapiens
gctccctagtggcttcctcc

SEQ ID NO: 2807858 - DNA, 22 bp, Homo sapiens
gctccgctttctacccagcgag

SEQ ID NO: 2807859 - DNA, 23 bp, Homo sapiens
gctccgctttctacccagcgagc

SEQ ID NO: 2807860 - DNA, 24 bp, Homo sapiens
gctccgctttctacccagcgagcc

SEQ ID NO: 2807861 - DNA, 23 bp, Homo sapiens
gctccgtccaggagcctgtgcct

SEQ ID NO: 2807862 - DNA, 14 bp, Homo sapiens
gctcctccagggcc

SEQ ID NO: 2807863 - DNA, 18 bp, Homo sapiens
gctcctccagggccacgt

SEQ ID NO: 2807864 - DNA, 23 bp, Homo sapiens
gctcctccagggccacgtgccag

SEQ ID NO: 2807865 - DNA, 21 bp, Homo sapiens
gctcctcgctgcgtctccatc

SEQ ID NO: 2807866 - DNA, 16 bp, Homo sapiens
gctcctctccaggcac

SEQ ID NO: 2807867 - DNA, 17 bp, Homo sapiens
gctcctctccaggcacc

SEQ ID NO: 2807868 - DNA, 15 bp, Homo sapiens
gctcctctccccagc

SEQ ID NO: 2807869 - DNA, 16 bp, Homo sapiens
gctcctctccccagca

SEQ ID NO: 2807870 - DNA, 19 bp, Homo sapiens
gctcctctccccagcaagt

SEQ ID NO: 2807871 - DNA, 21 bp, Homo sapiens
gctcctctgtctcgagcgccc

SEQ ID NO: 2807872 - DNA, 23 bp, Homo sapiens
gctcctgctgaaacacctcccag

SEQ ID NO: 2807873 - DNA, 21 bp, Homo sapiens
gctcctggaaaggctcagtct

SEQ ID NO: 2807874 - DNA, 17 bp, Homo sapiens
gctcctgggcagcttga

SEQ ID NO: 2807875 - DNA, 23 bp, Homo sapiens
gctcctgggggttctttcttcct

SEQ ID NO: 2807876 - DNA, 19 bp, Homo sapiens
gctcctggtcttgagatgt

SEQ ID NO: 2807877 - DNA, 22 bp, Homo sapiens
gcttggggggtgatgagggcag

SEQ ID NO: 2807878 - DNA, 19 bp, Homo sapiens
gcttgggtgtaacaggtct

SEQ ID NO: 2807879 - DNA, 23 bp, Homo sapiens
gcttgggtgtaacaggtctcctc

SEQ ID NO: 2807880 - DNA, 17 bp, Homo sapiens
gcttgtaaatagctcag

SEQ ID NO: 2807881 - DNA, 16 bp, Homo sapiens
gcttgtaactccacca

SEQ ID NO: 2807882 - DNA, 22 bp, Homo sapiens
gcttgtaactccaccaacccat

SEQ ID NO: 2807883 - DNA, 18 bp, Homo sapiens
gcttgtacatattggaaa

SEQ ID NO: 2807884 - DNA, 15 bp, Homo sapiens
gcttgtagccagccg

SEQ ID NO: 2807885 - DNA, 17 bp, Homo sapiens
gcttgtagccagccggg

SEQ ID NO: 2807886 - DNA, 14 bp, Homo sapiens
gcttgtatatacat

SEQ ID NO: 2807887 - DNA, 21 bp, Homo sapiens
gcttgtcactagcagctgcag

SEQ ID NO: 2807888 - DNA, 15 bp, Homo sapiens
gcttgtccagcgcct

SEQ ID NO: 2807889 - DNA, 16 bp, Homo sapiens
gcttgtccagcgccta

SEQ ID NO: 2807890 - DNA, 15 bp, Homo sapiens
gcttgtccctgccca

SEQ ID NO: 2807891 - DNA, 17 bp, Homo sapiens
gctttaaatctatctat

SEQ ID NO: 2807892 - DNA, 20 bp, Homo sapiens
gctttaatatagctatcatt

SEQ ID NO: 2807893 - DNA, 15 bp, Homo sapiens
gctttacattttatt

SEQ ID NO: 2807894 - DNA, 23 bp, Homo sapiens
gctttacctttattaatgaactg

SEQ ID NO: 2807895 - DNA, 19 bp, Homo sapiens
gctttattttttaagtatt

SEQ ID NO: 2807896 - DNA, 16 bp, Homo sapiens
gctttcaacttaaatc

SEQ ID NO: 2807897 - DNA, 21 bp, Homo sapiens
gctttccccgggggaggaagg

SEQ ID NO: 2807898 - DNA, 11 bp, Homo sapiens
gctttcctccc

SEQ ID NO: 2807899 - DNA, 14 bp, Homo sapiens
gctttcctccctgg

SEQ ID NO: 2807900 - DNA, 13 bp, Homo sapiens
gctttctacccag

SEQ ID NO: 2807901 - DNA, 22 bp, Homo sapiens
gctttctggaaaagaggagttt

SEQ ID NO: 2807902 - DNA, 13 bp, Homo sapiens
gctttctggagag

SEQ ID NO: 2807903 - DNA, 18 bp, Homo sapiens
gctttcttctacaaccag

SEQ ID NO: 2807904 - DNA, 21 bp, Homo sapiens
gctttcttctacaaccagagc

SEQ ID NO: 2807905 - DNA, 20 bp, Homo sapiens
gctttgcattcctacaaaga

SEQ ID NO: 2807906 - DNA, 17 bp, Homo sapiens
gctttgcccttctttct

SEQ ID NO: 2807907 - DNA, 16 bp, Homo sapiens
gctttgctaccaaagc

SEQ ID NO: 2807908 - DNA, 23 bp, Homo sapiens
gctttgtactttgtgcaaaaggg

SEQ ID NO: 2807909 - DNA, 14 bp, Homo sapiens
gcttttaataaaat

SEQ ID NO: 2807910 - DNA, 16 bp, Homo sapiens
gcttttaataaaattg

SEQ ID NO: 2807911 - DNA, 14 bp, Homo sapiens
ggaaaaaaatgact

SEQ ID NO: 2807912 - DNA, 15 bp, Homo sapiens
ggaaaaatatttaag

SEQ ID NO: 2807913 - DNA, 15 bp, Homo sapiens
ggaaaaatccagaaa

SEQ ID NO: 2807914 - DNA, 16 bp, Homo sapiens
ggaaaactgacagagg

SEQ ID NO: 2807915 - DNA, 14 bp, Homo sapiens
ggaaaagaatacag

SEQ ID NO: 2807916 - DNA, 12 bp, Homo sapiens
ggaaaaggcctg

SEQ ID NO: 2807917 - DNA, 14 bp, Homo sapiens
ggaaaaggcctggg

SEQ ID NO: 2807918 - DNA, 17 bp, Homo sapiens
ggaaaaggcctggggtg

SEQ ID NO: 2807919 - DNA, 22 bp, Homo sapiens
ggaaaaggcctggggtgacccg

SEQ ID NO: 2807920 - DNA, 23 bp, Homo sapiens
ggaaacgaacccactgtgcttac

SEQ ID NO: 2807921 - DNA, 16 bp, Homo sapiens
ggaaagactgaaagaa

SEQ ID NO: 2807922 - DNA, 20 bp, Homo sapiens
ggaaagcaccgcagcatgtg

SEQ ID NO: 2807923 - DNA, 16 bp, Homo sapiens
ggaaaggatattttct

SEQ ID NO: 2807924 - DNA, 23 bp, Homo sapiens
ggaaaggctcagtctcaggagca

SEQ ID NO: 2807925 - DNA, 20 bp, Homo sapiens
ggaaaggctctgaaagccag

SEQ ID NO: 2807926 - DNA, 23 bp, Homo sapiens
ggaaaggtcattgtggctatctg

SEQ ID NO: 2807927 - DNA, 18 bp, Homo sapiens
ggaaataaaacctttcaa

SEQ ID NO: 2807928 - DNA, 22 bp, Homo sapiens
ggaaataaaacctttcaaattt

SEQ ID NO: 2807929 - DNA, 19 bp, Homo sapiens
ggaaatctggattttcagc

SEQ ID NO: 2807930 - DNA, 19 bp, Homo sapiens
ggaaatggtatgagctgag

SEQ ID NO: 2807931 - DNA, 13 bp, Homo sapiens
ggaacagaaggat

SEQ ID NO: 2807932 - DNA, 18 bp, Homo sapiens
ggaacagacaacagaagt

SEQ ID NO: 2807933 - DNA, 21 bp, Homo sapiens
ggaacagacaacagaagtcat

SEQ ID NO: 2807934 - DNA, 17 bp, Homo sapiens
ggaacagactggaagca

SEQ ID NO: 2807935 - DNA, 18 bp, Homo sapiens
ggaacagtgtttcccata

SEQ ID NO: 2807936 - DNA, 17 bp, Homo sapiens
ggaaccagggagaccga

SEQ ID NO: 2807937 - DNA, 18 bp, Homo sapiens
ggaacctcaaactgggta

SEQ ID NO: 2807938 - DNA, 17 bp, Homo sapiens
ggaacgtgactgcccca

SEQ ID NO: 2807939 - DNA, 21 bp, Homo sapiens
ggaactagagggatacactga

SEQ ID NO: 2807940 - DNA, 22 bp, Homo sapiens
ggaactagagggatacactgaa

SEQ ID NO: 2807941 - DNA, 13 bp, Homo sapiens
ggaactcccagca

SEQ ID NO: 2807942 - DNA, 18 bp, Homo sapiens
ggaactctaccctggtag

SEQ ID NO: 2807943 - DNA, 20 bp, Homo sapiens
ggaactgaagggggcggcct

SEQ ID NO: 2807944 - DNA, 21 bp, Homo sapiens
ggaactgaagggggcggccta

SEQ ID NO: 2807945 - DNA, 17 bp, Homo sapiens
ggaactggaatcctttc

SEQ ID NO: 2807946 - DNA, 14 bp, Homo sapiens
ggaactggccaagc

SEQ ID NO: 2807947 - DNA, 14 bp, Homo sapiens
ggaacttgaactga

SEQ ID NO: 2807948 - DNA, 13 bp, Homo sapiens
ggaagacaggtct

SEQ ID NO: 2807949 - DNA, 19 bp, Homo sapiens
ggaagacaggtctagactt

SEQ ID NO: 2807950 - DNA, 11 bp, Homo sapiens
ggaagagagag

SEQ ID NO: 2807951 - DNA, 22 bp, Homo sapiens
ggaagattccctcttcctgcca

SEQ ID NO: 2807952 - DNA, 18 bp, Homo sapiens
ggaagcaagacgtcctgg

SEQ ID NO: 2807953 - DNA, 19 bp, Homo sapiens
ggaagcagtgccttccata

SEQ ID NO: 2807954 - DNA, 20 bp, Homo sapiens
ggaagcagtgccttccataa

SEQ ID NO: 2807955 - DNA, 14 bp, Homo sapiens
ggaagccaggctga

SEQ ID NO: 2807956 - DNA, 18 bp, Homo sapiens
ggaagccaggctgagtga

SEQ ID NO: 2807957 - DNA, 19 bp, Homo sapiens
ggaagccccttactatgat

SEQ ID NO: 2807958 - DNA, 16 bp, Homo sapiens
ggaagccctccttcca

SEQ ID NO: 2807959 - DNA, 17 bp, Homo sapiens
ggaagccctccttccac

SEQ ID NO: 2807960 - DNA, 17 bp, Homo sapiens
ggaagctgccctgccca

SEQ ID NO: 2807961 - DNA, 16 bp, Homo sapiens
ggaagctgggggaagg

SEQ ID NO: 2807962 - DNA, 23 bp, Homo sapiens
ggaagctgtgtccttgcacctgc

SEQ ID NO: 2807963 - DNA, 17 bp, Homo sapiens
ggaaggaactctggctt

SEQ ID NO: 2807964 - DNA, 23 bp, Homo sapiens
ggaaggaactctggcttccaggt

SEQ ID NO: 2807965 - DNA, 11 bp, Homo sapiens
ggaaggcaggc

SEQ ID NO: 2807966 - DNA, 15 bp, Homo sapiens
ggaaggcaggcaggg

SEQ ID NO: 2807967 - DNA, 19 bp, Homo sapiens
ggccctgcccctcttcccg

SEQ ID NO: 2807968 - DNA, 17 bp, Homo sapiens
ggccctggatcagcgtg

SEQ ID NO: 2807969 - DNA, 12 bp, Homo sapiens
ggccctggcctg

SEQ ID NO: 2807970 - DNA, 14 bp, Homo sapiens
ggccctggcctgct

SEQ ID NO: 2807971 - DNA, 23 bp, Homo sapiens
ggccctggggcctgtactgcctg

SEQ ID NO: 2807972 - DNA, 13 bp, Homo sapiens
ggcccttcctgga

SEQ ID NO: 2807973 - DNA, 15 bp, Homo sapiens
ggcccttcctggaca

SEQ ID NO: 2807974 - DNA, 17 bp, Homo sapiens
ggcccttcctggacagc

SEQ ID NO: 2807975 - DNA, 20 bp, Homo sapiens
ggccgaagctaacagggaag

SEQ ID NO: 2807976 - DNA, 14 bp, Homo sapiens
ggccgagggaaatg

SEQ ID NO: 2807977 - DNA, 20 bp, Homo sapiens
ggccgctgctttgcgctggt

SEQ ID NO: 2807978 - DNA, 16 bp, Homo sapiens
ggccgctgttcaccca

SEQ ID NO: 2807979 - DNA, 18 bp, Homo sapiens
ggccggggaactggccaa

SEQ ID NO: 2807980 - DNA, 15 bp, Homo sapiens
ggccggtgtgggctg

SEQ ID NO: 2807981 - DNA, 22 bp, Homo sapiens
ggccgtggccatcagggtgggc

SEQ ID NO: 2807982 - DNA, 16 bp, Homo sapiens
ggcctaaaagtaaaca

SEQ ID NO: 2807983 - DNA, 18 bp, Homo sapiens
ggcctatggagagccctg

SEQ ID NO: 2807984 - DNA, 22 bp, Homo sapiens
ggcctatggagagccctgggac

SEQ ID NO: 2807985 - DNA, 22 bp, Homo sapiens
ggcctcaaagttggggcaggct

SEQ ID NO: 2807986 - DNA, 17 bp, Homo sapiens
ggcctcacgcccagcct

SEQ ID NO: 2807987 - DNA, 20 bp, Homo sapiens
ggcctcacgcccagcctcct

SEQ ID NO: 2807988 - DNA, 12 bp, Homo sapiens
ggcctcagacca

SEQ ID NO: 2807989 - DNA, 23 bp, Homo sapiens
ggcctcagaccaactctctcctg

SEQ ID NO: 2807990 - DNA, 19 bp, Homo sapiens
ggcctcaggggagccccca

SEQ ID NO: 2807991 - DNA, 21 bp, Homo sapiens
ggcctcccaataaagctggac

SEQ ID NO: 2807992 - DNA, 16 bp, Homo sapiens
ggcctccccccagccc

SEQ ID NO: 2807993 - DNA, 19 bp, Homo sapiens
ggcctccccccagcccctc

SEQ ID NO: 2807994 - DNA, 18 bp, Homo sapiens
ggcctcctctgtccaggg

SEQ ID NO: 2807995 - DNA, 20 bp, Homo sapiens
ggcctctttctgtgcttctc

SEQ ID NO: 2807996 - DNA, 11 bp, Homo sapiens
ggcctgcctgt

SEQ ID NO: 2807997 - DNA, 11 bp, Homo sapiens
ggcctgctgct

SEQ ID NO: 2807998 - DNA, 15 bp, Homo sapiens
ggcctgctgctgaga

SEQ ID NO: 2807999 - DNA, 16 bp, Homo sapiens
ggcctgctgctgagaa

SEQ ID NO: 2808000 - DNA, 18 bp, Homo sapiens
ggcctgctgctgagaacc

SEQ ID NO: 2808001 - DNA, 22 bp, Homo sapiens
ggcctgctgctgagaacctggc

SEQ ID NO: 2808002 - DNA, 15 bp, Homo sapiens
ggcctggctctcctg

SEQ ID NO: 2808003 - DNA, 14 bp, Homo sapiens
ggcctggggctcct

SEQ ID NO: 2808004 - DNA, 17 bp, Homo sapiens
ggcctgtactgcctgct

SEQ ID NO: 2808005 - DNA, 18 bp, Homo sapiens
ggcctgtactgcctgctt

SEQ ID NO: 2808006 - DNA, 17 bp, Homo sapiens
ggcctgtgggagcctgc

SEQ ID NO: 2808007 - DNA, 21 bp, Homo sapiens
ggcctgtgtagctgtgacctg

SEQ ID NO: 2808008 - DNA, 15 bp, Homo sapiens
ggccttgcccagaga

SEQ ID NO: 2808009 - DNA, 16 bp, Homo sapiens
ggccttgttctgtcac

SEQ ID NO: 2808010 - DNA, 18 bp, Homo sapiens
ggcgacccctcagtgctc

SEQ ID NO: 2808011 - DNA, 12 bp, Homo sapiens
ggcgacttcctc

SEQ ID NO: 2808012 - DNA, 14 bp, Homo sapiens
ggcgcaagcctgta

SEQ ID NO: 2808013 - DNA, 22 bp, Homo sapiens
ggcgcaagcctgtaatcccagc

SEQ ID NO: 2808014 - DNA, 11 bp, Homo sapiens
ggcgcaggagg

SEQ ID NO: 2808015 - DNA, 16 bp, Homo sapiens
ggcgccccaacccgtg

SEQ ID NO: 2808016 - DNA, 18 bp, Homo sapiens
ggcgccccaacccgtgga

SEQ ID NO: 2808017 - DNA, 18 bp, Homo sapiens
ggcgctattgcactccag

SEQ ID NO: 2808018 - DNA, 18 bp, Homo sapiens
ggcgctctgccctccctg

SEQ ID NO: 2808019 - DNA, 20 bp, Homo sapiens
ggcgctctgccctccctggc

SEQ ID NO: 2808020 - DNA, 21 bp, Homo sapiens
ggcgctctgccctccctggcc

SEQ ID NO: 2808021 - DNA, 23 bp, Homo sapiens
ggcgctctgccctccctggcctc

SEQ ID NO: 2808022 - DNA, 20 bp, Homo sapiens
ggcggaggttccagtgagcc

SEQ ID NO: 2808023 - DNA, 22 bp, Homo sapiens
ggcggcctatgacttgggcacc

SEQ ID NO: 2808024 - DNA, 22 bp, Homo sapiens
ggcggctactcagcagccctcc

SEQ ID NO: 2808025 - DNA, 15 bp, Homo sapiens
ggcgggagtgggggc

SEQ ID NO: 2808026 - DNA, 20 bp, Homo sapiens
ggcgtcgctggacaacccag

SEQ ID NO: 2808027 - DNA, 14 bp, Homo sapiens
ggcgtgcagtggtg

SEQ ID NO: 2808028 - DNA, 14 bp, Homo sapiens
ggctaactggaagc

SEQ ID NO: 2808029 - DNA, 20 bp, Homo sapiens
ggctaagtgatcctcccacc

SEQ ID NO: 2808030 - DNA, 15 bp, Homo sapiens
ggctaattaaataaa

SEQ ID NO: 2808031 - DNA, 23 bp, Homo sapiens
ggctaattcccagagtgtgaaac

SEQ ID NO: 2808032 - DNA, 18 bp, Homo sapiens
ggctactctgtgccagag

SEQ ID NO: 2808033 - DNA, 16 bp, Homo sapiens
ggctaggacccctcca

SEQ ID NO: 2808034 - DNA, 22 bp, Homo sapiens
ggctaggacccctccatgtggg

SEQ ID NO: 2808035 - DNA, 15 bp, Homo sapiens
ggctagtcagagaga

SEQ ID NO: 2808036 - DNA, 19 bp, Homo sapiens
ggctatgtatggaatacag

SEQ ID NO: 2808037 - DNA, 15 bp, Homo sapiens
ggctcaagtcctctt

SEQ ID NO: 2808038 - DNA, 23 bp, Homo sapiens
ggctcacgcctatgatcccagca

SEQ ID NO: 2808039 - DNA, 23 bp, Homo sapiens
ggctcacgcctgtaatcccagca

SEQ ID NO: 2808040 - DNA, 24 bp, Homo sapiens
ggctcacgcctgtaatcccagcag

SEQ ID NO: 2808041 - DNA, 10 bp, Homo sapiens
ggctcagcct

SEQ ID NO: 2808042 - DNA, 13 bp, Homo sapiens
ggctcagcctggt

SEQ ID NO: 2808043 - DNA, 20 bp, Homo sapiens
ggctcagcctggtgggcctc

SEQ ID NO: 2808044 - DNA, 20 bp, Homo sapiens
ggctcagcggggacagctcc

SEQ ID NO: 2808045 - DNA, 12 bp, Homo sapiens
ggctccaggctc

SEQ ID NO: 2808046 - DNA, 22 bp, Homo sapiens
ggctccagtttccccatggggc

SEQ ID NO: 2808047 - DNA, 18 bp, Homo sapiens
ggctccgaaaaactttgt

SEQ ID NO: 2808048 - DNA, 18 bp, Homo sapiens
ggctctaacgcctgagcc

SEQ ID NO: 2808049 - DNA, 22 bp, Homo sapiens
ggctctaacgcctgagcccagg

SEQ ID NO: 2808050 - DNA, 23 bp, Homo sapiens
ggctctaacgcctgagcccaggg

SEQ ID NO: 2808051 - DNA, 16 bp, Homo sapiens
ggctctccacctcagc

SEQ ID NO: 2808052 - DNA, 23 bp, Homo sapiens
ggctctgccccagctctggcttc

SEQ ID NO: 2808053 - DNA, 23 bp, Homo sapiens
ggctctgggatagctgacccagc

SEQ ID NO: 2808054 - DNA, 16 bp, Homo sapiens
ggctctgtgaaatcag

SEQ ID NO: 2808055 - DNA, 20 bp, Homo sapiens
ggctcttctccttggaggac

SEQ ID NO: 2808056 - DNA, 19 bp, Homo sapiens
ggctgaaataaaagcctct

SEQ ID NO: 2808057 - DNA, 12 bp, Homo sapiens
ggtttactgctg

SEQ ID NO: 2808058 - DNA, 19 bp, Homo sapiens
ggtttcaccatgttggcca

SEQ ID NO: 2808059 - DNA, 20 bp, Homo sapiens
ggtttctcagaatccaaaga

SEQ ID NO: 2808060 - DNA, 21 bp, Homo sapiens
ggtttctcagaatccaaagat

SEQ ID NO: 2808061 - DNA, 18 bp, Homo sapiens
ggtttgaatataaacact

SEQ ID NO: 2808062 - DNA, 14 bp, Homo sapiens
ggtttgcaaggaag

SEQ ID NO: 2808063 - DNA, 17 bp, Homo sapiens
ggtttgtcatatattca

SEQ ID NO: 2808064 - DNA, 14 bp, Homo sapiens
ggtttgtgtggatg

SEQ ID NO: 2808065 - DNA, 23 bp, Homo sapiens
ggttttgccatgttggccaggct

SEQ ID NO: 2808066 - DNA, 11 bp, Homo sapiens
ggttttgtaca

SEQ ID NO: 2808067 - DNA, 20 bp, Homo sapiens
gtaaaaagattatatatcat

SEQ ID NO: 2808068 - DNA, 15 bp, Homo sapiens
gtaaaaatgatttca

SEQ ID NO: 2808069 - DNA, 17 bp, Homo sapiens
gtaaaagataacaagat

SEQ ID NO: 2808070 - DNA, 17 bp, Homo sapiens
gtaaaaggtattaaatt

SEQ ID NO: 2808071 - DNA, 19 bp, Homo sapiens
gtaaaatgcagtccagaat

SEQ ID NO: 2808072 - DNA, 22 bp, Homo sapiens
gtaaacagtgcctgctgaatga

SEQ ID NO: 2808073 - DNA, 21 bp, Homo sapiens
gtaaacatagatagtgcttta

SEQ ID NO: 2808074 - DNA, 16 bp, Homo sapiens
gtaaactcaaaatatt

SEQ ID NO: 2808075 - DNA, 16 bp, Homo sapiens
gtaaagcttgtctgat

SEQ ID NO: 2808076 - DNA, 20 bp, Homo sapiens
gtaaagtttaaaaaatacac

SEQ ID NO: 2808077 - DNA, 15 bp, Homo sapiens
gtaaatacaaaataa

SEQ ID NO: 2808078 - DNA, 14 bp, Homo sapiens
gtaaatacatgtgt

SEQ ID NO: 2808079 - DNA, 17 bp, Homo sapiens
gtaaatacatgtgtgga

SEQ ID NO: 2808080 - DNA, 19 bp, Homo sapiens
gtaaatagttttaaatatg

SEQ ID NO: 2808081 - DNA, 13 bp, Homo sapiens
gtaaatatagtag

SEQ ID NO: 2808082 - DNA, 11 bp, Homo sapiens
gtaaatattta

SEQ ID NO: 2808083 - DNA, 13 bp, Homo sapiens
gtaaatattttaa

SEQ ID NO: 2808084 - DNA, 14 bp, Homo sapiens
gtaaatattttaaa

SEQ ID NO: 2808085 - DNA, 15 bp, Homo sapiens
gtaaatcctttttct

SEQ ID NO: 2808086 - DNA, 17 bp, Homo sapiens
gtaaatgtttaggtttt

SEQ ID NO: 2808087 - DNA, 14 bp, Homo sapiens
gtaaatttggattt

SEQ ID NO: 2808088 - DNA, 16 bp, Homo sapiens
gtaacaagccacccca

SEQ ID NO: 2808089 - DNA, 13 bp, Homo sapiens
gtaacaagccaga

SEQ ID NO: 2808090 - DNA, 23 bp, Homo sapiens
gtaacaagccagattttttaaaa

SEQ ID NO: 2808091 - DNA, 16 bp, Homo sapiens
gtaacactgcaagaag

SEQ ID NO: 2808092 - DNA, 18 bp, Homo sapiens
gtaacactgcaagaagtc

SEQ ID NO: 2808093 - DNA, 20 bp, Homo sapiens
gtaacaggtctcctcttaaa

SEQ ID NO: 2808094 - DNA, 20 bp, Homo sapiens
gtaaccaagagtattccatt

SEQ ID NO: 2808095 - DNA, 19 bp, Homo sapiens
gtaactctaattcccattt

SEQ ID NO: 2808096 - DNA, 15 bp, Homo sapiens
gtaagttctgaaaac

SEQ ID NO: 2808097 - DNA, 12 bp, Homo sapiens
gtaatcccagca

SEQ ID NO: 2808098 - DNA, 20 bp, Homo sapiens
gtaatcccagcactttggga

SEQ ID NO: 2808099 - DNA, 13 bp, Homo sapiens
gtaatcccagcta

SEQ ID NO: 2808100 - DNA, 14 bp, Homo sapiens
gtaatcccagctac

SEQ ID NO: 2808101 - DNA, 20 bp, Homo sapiens
gtaatcccagctacttggga

SEQ ID NO: 2808102 - DNA, 15 bp, Homo sapiens
gtaatgagggactgg

SEQ ID NO: 2808103 - DNA, 15 bp, Homo sapiens
gtaatgcacaattta

SEQ ID NO: 2808104 - DNA, 19 bp, Homo sapiens
gtaatgcacaatttagaaa

SEQ ID NO: 2808105 - DNA, 13 bp, Homo sapiens
gtaatgtatctta

SEQ ID NO: 2808106 - DNA, 14 bp, Homo sapiens
gtaatgtatcttat

SEQ ID NO: 2808107 - DNA, 12 bp, Homo sapiens
gtaatgtcacca

SEQ ID NO: 2808108 - DNA, 19 bp, Homo sapiens
gtaattaaaagaattttcc

SEQ ID NO: 2808109 - DNA, 21 bp, Homo sapiens
gtaattatcgggaacagtgtt

SEQ ID NO: 2808110 - DNA, 22 bp, Homo sapiens
gtaattatcgggaacagtgttt

SEQ ID NO: 2808111 - DNA, 15 bp, Homo sapiens
gtaattctaaatgaa

SEQ ID NO: 2808112 - DNA, 17 bp, Homo sapiens
gtaattgcatttctgct

SEQ ID NO: 2808113 - DNA, 17 bp, Homo sapiens
gtaattggtgacaatgt

SEQ ID NO: 2808114 - DNA, 20 bp, Homo sapiens
gtaatttctgtgtattttga

SEQ ID NO: 2808115 - DNA, 21 bp, Homo sapiens
gtaattttgtagtagttgatg

SEQ ID NO: 2808116 - DNA, 16 bp, Homo sapiens
gtaattttgtgaaaga

SEQ ID NO: 2808117 - DNA, 12 bp, Homo sapiens
gtacaaaataaa

SEQ ID NO: 2808118 - DNA, 15 bp, Homo sapiens
gtacaaagtagagaa

SEQ ID NO: 2808119 - DNA, 17 bp, Homo sapiens
gtacaaagtagagaagt

SEQ ID NO: 2808120 - DNA, 14 bp, Homo sapiens
gtacaatctcaaat

SEQ ID NO: 2808121 - DNA, 14 bp, Homo sapiens
gtacagaattttta

SEQ ID NO: 2808122 - DNA, 21 bp, Homo sapiens
gtacagaatttttaatgactt

SEQ ID NO: 2808123 - DNA, 22 bp, Homo sapiens
gtacagaatttttaatgacttt

SEQ ID NO: 2808124 - DNA, 16 bp, Homo sapiens
gtacagtggagaaata

SEQ ID NO: 2808125 - DNA, 20 bp, Homo sapiens
gtacagttatacatacctct

SEQ ID NO: 2808126 - DNA, 20 bp, Homo sapiens
gtacagttatctaagttaat

SEQ ID NO: 2808127 - DNA, 18 bp, Homo sapiens
gtacatagttatttattt

SEQ ID NO: 2808128 - DNA, 15 bp, Homo sapiens
gtacatatggaaatc

SEQ ID NO: 2808129 - DNA, 19 bp, Homo sapiens
gtacatgtgtagcctgtgc

SEQ ID NO: 2808130 - DNA, 18 bp, Homo sapiens
gtacattcaatgtttatg

SEQ ID NO: 2808131 - DNA, 14 bp, Homo sapiens
gtaccactcaggcc

SEQ ID NO: 2808132 - DNA, 12 bp, Homo sapiens
gtaccagctcac

SEQ ID NO: 2808133 - DNA, 16 bp, Homo sapiens
gtaccatgttaaagag

SEQ ID NO: 2808134 - DNA, 17 bp, Homo sapiens
gtaccatgttaaagagg

SEQ ID NO: 2808135 - DNA, 15 bp, Homo sapiens
gtacccactcctcac

SEQ ID NO: 2808136 - DNA, 20 bp, Homo sapiens
gtacccactcctcactgccc

SEQ ID NO: 2808137 - DNA, 12 bp, Homo sapiens
gtacccactgct

SEQ ID NO: 2808138 - DNA, 13 bp, Homo sapiens
gtacccactgctc

SEQ ID NO: 2808139 - DNA, 15 bp, Homo sapiens
gtacccactgctctg

SEQ ID NO: 2808140 - DNA, 16 bp, Homo sapiens
gtacccactgctctgg

SEQ ID NO: 2808141 - DNA, 16 bp, Homo sapiens
gtacccccgtggtctt

SEQ ID NO: 2808142 - DNA, 19 bp, Homo sapiens
gtacccccgtggtctttga

SEQ ID NO: 2808143 - DNA, 14 bp, Homo sapiens
gtacctcagtttct

SEQ ID NO: 2808144 - DNA, 17 bp, Homo sapiens
gtacctcagtttctcct

SEQ ID NO: 2808145 - DNA, 14 bp, Homo sapiens
gtaccttgaacact

SEQ ID NO: 2808146 - DNA, 18 bp, Homo sapiens
gtaccttgaacactgggg

SEQ ID NO: 2808147 - DNA, 23 bp, Homo sapiens
gtaccttgaacactgggggaggg

SEQ ID NO: 2808148 - DNA, 22 bp, Homo sapiens
gtgaccatctgtttgagaatat

SEQ ID NO: 2808149 - DNA, 14 bp, Homo sapiens
gtgacccacatgcc

SEQ ID NO: 2808150 - DNA, 21 bp, Homo sapiens
gtgaccccagggcacaggagc

SEQ ID NO: 2808151 - DNA, 12 bp, Homo sapiens
gtgaccccaggt

SEQ ID NO: 2808152 - DNA, 18 bp, Homo sapiens
gtgacccggcaccccctg

SEQ ID NO: 2808153 - DNA, 23 bp, Homo sapiens
gtgacccggcaccccctgcagct

SEQ ID NO: 2808154 - DNA, 18 bp, Homo sapiens
gtgacctatacctgtgtt

SEQ ID NO: 2808155 - DNA, 23 bp, Homo sapiens
gtgacctgccccgcccagctgca

SEQ ID NO: 2808156 - DNA, 12 bp, Homo sapiens
gtgacctgctga

SEQ ID NO: 2808157 - DNA, 16 bp, Homo sapiens
gtgacctgctgagctc

SEQ ID NO: 2808158 - DNA, 15 bp, Homo sapiens
gtgactcacccaagc

SEQ ID NO: 2808159 - DNA, 23 bp, Homo sapiens
gtgactgccccaactcctggaag

SEQ ID NO: 2808160 - DNA, 15 bp, Homo sapiens
gtgagaaatttaaac

SEQ ID NO: 2808161 - DNA, 19 bp, Homo sapiens
gtgagaatcgacctcactg

SEQ ID NO: 2808162 - DNA, 19 bp, Homo sapiens
gtgagagacattaactcat

SEQ ID NO: 2808163 - DNA, 12 bp, Homo sapiens
gtgagagctggg

SEQ ID NO: 2808164 - DNA, 13 bp, Homo sapiens
gtgagagctgggt

SEQ ID NO: 2808165 - DNA, 15 bp, Homo sapiens
gtgagaggaagggtg

SEQ ID NO: 2808166 - DNA, 16 bp, Homo sapiens
gtgagaggggaacaga

SEQ ID NO: 2808167 - DNA, 14 bp, Homo sapiens
gtgagatttgtatt

SEQ ID NO: 2808168 - DNA, 16 bp, Homo sapiens
gtgagatttgtattta

SEQ ID NO: 2808169 - DNA, 15 bp, Homo sapiens
gtgagcatctctgtg

SEQ ID NO: 2808170 - DNA, 21 bp, Homo sapiens
gtgagccacagaccacctgct

SEQ ID NO: 2808171 - DNA, 20 bp, Homo sapiens
gtgagccaggtaatgaggga

SEQ ID NO: 2808172 - DNA, 19 bp, Homo sapiens
gtgagccgagatcacgcca

SEQ ID NO: 2808173 - DNA, 21 bp, Homo sapiens
gtgagccgcatcttctccatc

SEQ ID NO: 2808174 - DNA, 20 bp, Homo sapiens
gtgaggattatgggtcctgc

SEQ ID NO: 2808175 - DNA, 21 bp, Homo sapiens
gtgaggattatgggtcctgca

SEQ ID NO: 2808176 - DNA, 17 bp, Homo sapiens
gtgaggcaggggcggag

SEQ ID NO: 2808177 - DNA, 13 bp, Homo sapiens
gtgaggcctggcc

SEQ ID NO: 2808178 - DNA, 19 bp, Homo sapiens
gtgagtcaccaagcccagt

SEQ ID NO: 2808179 - DNA, 19 bp, Homo sapiens
gtgataagtggaaaaaaga

SEQ ID NO: 2808180 - DNA, 16 bp, Homo sapiens
gtgatatatgtattta

SEQ ID NO: 2808181 - DNA, 20 bp, Homo sapiens
gtgatcagaccataatgtta

SEQ ID NO: 2808182 - DNA, 20 bp, Homo sapiens
gtgatcagtatgctgtttta

SEQ ID NO: 2808183 - DNA, 20 bp, Homo sapiens
gtgatccacccacctcagcc

SEQ ID NO: 2808184 - DNA, 23 bp, Homo sapiens
gtgatccacccacctcagcctcc

SEQ ID NO: 2808185 - DNA, 14 bp, Homo sapiens
gtgatccttttatg

SEQ ID NO: 2808186 - DNA, 12 bp, Homo sapiens
gtgatctccata

SEQ ID NO: 2808187 - DNA, 17 bp, Homo sapiens
gtgatgagggcagcagc

SEQ ID NO: 2808188 - DNA, 19 bp, Homo sapiens
gtgatgagggcagcagcca

SEQ ID NO: 2808189 - DNA, 18 bp, Homo sapiens
gtgatgatgaccaagaat

SEQ ID NO: 2808190 - DNA, 16 bp, Homo sapiens
gtgatgggatctgtaa

SEQ ID NO: 2808191 - DNA, 20 bp, Homo sapiens
gtgatggggtgggcagggct

SEQ ID NO: 2808192 - DNA, 15 bp, Homo sapiens
gtgatgtgagttgca

SEQ ID NO: 2808193 - DNA, 14 bp, Homo sapiens
gtgattctcctgcc

SEQ ID NO: 2808194 - DNA, 16 bp, Homo sapiens
gtgattctcctgcctc

SEQ ID NO: 2808195 - DNA, 22 bp, Homo sapiens
gtgattctcctgcctcagcctc

SEQ ID NO: 2808196 - DNA, 23 bp, Homo sapiens
gtgattctcctgcctcagcctcc

SEQ ID NO: 2808197 - DNA, 16 bp, Homo sapiens
gtgattgacacacagc

SEQ ID NO: 2808198 - DNA, 18 bp, Homo sapiens
gtgattgacacacagcac

SEQ ID NO: 2808199 - DNA, 20 bp, Homo sapiens
gtgattgacacacagcactc

SEQ ID NO: 2808200 - DNA, 17 bp, Homo sapiens
gtgattttgtacagaat

SEQ ID NO: 2808201 - DNA, 22 bp, Homo sapiens
gtgcaaatactccaagcttcaa

SEQ ID NO: 2808202 - DNA, 15 bp, Homo sapiens
gtgcaatgagccaga

SEQ ID NO: 2808203 - DNA, 13 bp, Homo sapiens
gtgcaatgtaaat

SEQ ID NO: 2808204 - DNA, 22 bp, Homo sapiens
gtgcaatgtaaatattttaaag

SEQ ID NO: 2808205 - DNA, 12 bp, Homo sapiens
gtgcacacacca

SEQ ID NO: 2808206 - DNA, 21 bp, Homo sapiens
gtgcacacaccagagcccacc

SEQ ID NO: 2808207 - DNA, 16 bp, Homo sapiens
gtgcacccctccccat

SEQ ID NO: 2808208 - DNA, 13 bp, Homo sapiens
gtgcacggcagct

SEQ ID NO: 2808209 - DNA, 16 bp, Homo sapiens
gtgcacggcagcttga

SEQ ID NO: 2808210 - DNA, 13 bp, Homo sapiens
gtgcactggcccc

SEQ ID NO: 2808211 - DNA, 17 bp, Homo sapiens
gtgcactggccccaccc

SEQ ID NO: 2808212 - DNA, 22 bp, Homo sapiens
gtgcagaaaaaaaaaaagaaac

SEQ ID NO: 2808213 - DNA, 20 bp, Homo sapiens
gtgcagtggtgcgatctggg

SEQ ID NO: 2808214 - DNA, 23 bp, Homo sapiens
gtgcagtggtgcgatctgggttc

SEQ ID NO: 2808215 - DNA, 22 bp, Homo sapiens
gtgcatgaaggtttctgaaaat

SEQ ID NO: 2808216 - DNA, 19 bp, Homo sapiens
gtgcatgctctctgcagcc

SEQ ID NO: 2808217 - DNA, 16 bp, Homo sapiens
gtgcatgtatgtcttg

SEQ ID NO: 2808218 - DNA, 14 bp, Homo sapiens
gtgcattctccagc

SEQ ID NO: 2808219 - DNA, 18 bp, Homo sapiens
gtgccaagtccaggtcct

SEQ ID NO: 2808220 - DNA, 20 bp, Homo sapiens
gtgccaagtccaggtcctgg

SEQ ID NO: 2808221 - DNA, 22 bp, Homo sapiens
gtgccaagtccaggtcctggtg

SEQ ID NO: 2808222 - DNA, 10 bp, Homo sapiens
gtgccacaga

SEQ ID NO: 2808223 - DNA, 13 bp, Homo sapiens
gtgccacagagaa

SEQ ID NO: 2808224 - DNA, 15 bp, Homo sapiens
gtgccacagagaaga

SEQ ID NO: 2808225 - DNA, 13 bp, Homo sapiens
gtgccagagcctg

SEQ ID NO: 2808226 - DNA, 22 bp, Homo sapiens
gtgccagccgtgatgctcaggc

SEQ ID NO: 2808227 - DNA, 18 bp, Homo sapiens
gtgccaggactccccagg

SEQ ID NO: 2808228 - DNA, 17 bp, Homo sapiens
gtgccatagtcacatgg

SEQ ID NO: 2808229 - DNA, 16 bp, Homo sapiens
gtgccattttaataaa

SEQ ID NO: 2808230 - DNA, 15 bp, Homo sapiens
gtgcccacatcccag

SEQ ID NO: 2808231 - DNA, 17 bp, Homo sapiens
gtgcccacgtgtgcaga

SEQ ID NO: 2808232 - DNA, 14 bp, Homo sapiens
gtgcccagctaatt

SEQ ID NO: 2808233 - DNA, 15 bp, Homo sapiens
gtgccgcctgtgccc

SEQ ID NO: 2808234 - DNA, 12 bp, Homo sapiens
gtgcctcctgtc

SEQ ID NO: 2808235 - DNA, 12 bp, Homo sapiens
gtgcctctgcct

SEQ ID NO: 2808236 - DNA, 11 bp, Homo sapiens
gtgcctgcagc

SEQ ID NO: 2808237 - DNA, 17 bp, Homo sapiens
gtgcctgggtggggctg

SEQ ID NO: 2808238 - DNA, 21 bp, Homo sapiens
gtgcctgggtggggctgctcc

SEQ ID NO: 2808239 - DNA, 21 bp, Homo sapiens
gtttttgaagaagggaaattc

SEQ ID NO: 2808240 - DNA, 15 bp, Homo sapiens
gttttttatgctaat

SEQ ID NO: 2808241 - DNA, 12 bp, Homo sapiens
gttttttgaaaa

SEQ ID NO: 2808242 - DNA, 22 bp, Homo sapiens
gttttttgcctaaatccaaaga

SEQ ID NO: 2808243 - DNA, 14 bp, Homo sapiens
taaaaaaagtatat

SEQ ID NO: 2808244 - DNA, 15 bp, Homo sapiens
taaaaaaataagaag

SEQ ID NO: 2808245 - DNA, 20 bp, Homo sapiens
taaaaaaatacagtaaagtt

SEQ ID NO: 2808246 - DNA, 13 bp, Homo sapiens
taaaaaaatgaca

SEQ ID NO: 2808247 - DNA, 18 bp, Homo sapiens
taaaaaagcttaaaactt

SEQ ID NO: 2808248 - DNA, 20 bp, Homo sapiens
taaaaaagcttaaaactttg

SEQ ID NO: 2808249 - DNA, 13 bp, Homo sapiens
taaaaaataaaaa

SEQ ID NO: 2808250 - DNA, 12 bp, Homo sapiens
taaaaaatacac

SEQ ID NO: 2808251 - DNA, 13 bp, Homo sapiens
taaaaacataaaa

SEQ ID NO: 2808252 - DNA, 18 bp, Homo sapiens
taaaaaccagaatcataa

SEQ ID NO: 2808253 - DNA, 19 bp, Homo sapiens
taaaaaccagaatcataat

SEQ ID NO: 2808254 - DNA, 21 bp, Homo sapiens
taaaaaccagaatcataattt

SEQ ID NO: 2808255 - DNA, 20 bp, Homo sapiens
taaaaactagaggtgagaaa

SEQ ID NO: 2808256 - DNA, 19 bp, Homo sapiens
taaaaataaaatgatgtat

SEQ ID NO: 2808257 - DNA, 16 bp, Homo sapiens
taaaaatattttctga

SEQ ID NO: 2808258 - DNA, 11 bp, Homo sapiens
taaaaatcata

SEQ ID NO: 2808259 - DNA, 17 bp, Homo sapiens
taaaaatcataaactgt

SEQ ID NO: 2808260 - DNA, 11 bp, Homo sapiens
taaaaatgcaa

SEQ ID NO: 2808261 - DNA, 23 bp, Homo sapiens
taaaaccttacttaaagcttgtt

SEQ ID NO: 2808262 - DNA, 10 bp, Homo sapiens
taaaaccttt

SEQ ID NO: 2808263 - DNA, 14 bp, Homo sapiens
taaaacctttcaaa

SEQ ID NO: 2808264 - DNA, 22 bp, Homo sapiens
taaaactatggttcccaataaa

SEQ ID NO: 2808265 - DNA, 20 bp, Homo sapiens
taaaactggtttagcacaat

SEQ ID NO: 2808266 - DNA, 23 bp, Homo sapiens
taaaagaaagttaggttataaga

SEQ ID NO: 2808267 - DNA, 12 bp, Homo sapiens
taaaagcaaaaa

SEQ ID NO: 2808268 - DNA, 16 bp, Homo sapiens
taaaagcaaaaaagaa

SEQ ID NO: 2808269 - DNA, 22 bp, Homo sapiens
taaaagcaaaaaagaaaacctt

SEQ ID NO: 2808270 - DNA, 11 bp, Homo sapiens
taaaagcagca

SEQ ID NO: 2808271 - DNA, 17 bp, Homo sapiens
taaaagcataaatgcaa

SEQ ID NO: 2808272 - DNA, 22 bp, Homo sapiens
taaaaggtattaaattgatgtt

SEQ ID NO: 2808273 - DNA, 22 bp, Homo sapiens
taaaaggtattgagccattttt

SEQ ID NO: 2808274 - DNA, 18 bp, Homo sapiens
taaaagtgtgagcagtga

SEQ ID NO: 2808275 - DNA, 22 bp, Homo sapiens
taaaagttaaactacttgtaaa

SEQ ID NO: 2808276 - DNA, 19 bp, Homo sapiens
taaaagttgggaaaagtgt

SEQ ID NO: 2808277 - DNA, 20 bp, Homo sapiens
taaaataaaaaccagaatca

SEQ ID NO: 2808278 - DNA, 13 bp, Homo sapiens
taaaataaataaa

SEQ ID NO: 2808279 - DNA, 16 bp, Homo sapiens
taaaatagcaaaagaa

SEQ ID NO: 2808280 - DNA, 17 bp, Homo sapiens
taaaatagcaaaagaag

SEQ ID NO: 2808281 - DNA, 21 bp, Homo sapiens
taaaatagcaaaagaagaagt

SEQ ID NO: 2808282 - DNA, 22 bp, Homo sapiens
taaaatagcaaaagaagaagtt

SEQ ID NO: 2808283 - DNA, 21 bp, Homo sapiens
taaaatagcaacactctatat

SEQ ID NO: 2808284 - DNA, 15 bp, Homo sapiens
taaaatagccactta

SEQ ID NO: 2808285 - DNA, 16 bp, Homo sapiens
taaaatagtattgaaa

SEQ ID NO: 2808286 - DNA, 15 bp, Homo sapiens
taaaatatatataaa

SEQ ID NO: 2808287 - DNA, 16 bp, Homo sapiens
taaaatatatataaat

SEQ ID NO: 2808288 - DNA, 18 bp, Homo sapiens
taaaatatatataaatat

SEQ ID NO: 2808289 - DNA, 15 bp, Homo sapiens
taaaatcattcaata

SEQ ID NO: 2808290 - DNA, 19 bp, Homo sapiens
taaaatctggcaaagttat

SEQ ID NO: 2808291 - DNA, 16 bp, Homo sapiens
taaaatcttgaaaatg

SEQ ID NO: 2808292 - DNA, 19 bp, Homo sapiens
taaaatcttggcacagaaa

SEQ ID NO: 2808293 - DNA, 16 bp, Homo sapiens
taaaatgaaagggtca

SEQ ID NO: 2808294 - DNA, 20 bp, Homo sapiens
taaaatgaggttcaactgtt

SEQ ID NO: 2808295 - DNA, 16 bp, Homo sapiens
taaaatgattgtagta

SEQ ID NO: 2808296 - DNA, 14 bp, Homo sapiens
taaaatgcagtcca

SEQ ID NO: 2808297 - DNA, 18 bp, Homo sapiens
taaaattatggtgaaatt

SEQ ID NO: 2808298 - DNA, 23 bp, Homo sapiens
taaacaagtatttgttaatttag

SEQ ID NO: 2808299 - DNA, 23 bp, Homo sapiens
taaacacccatgaatcaaagaca

SEQ ID NO: 2808300 - DNA, 15 bp, Homo sapiens
taaacacctgacaca

SEQ ID NO: 2808301 - DNA, 13 bp, Homo sapiens
taaacactgtaat

SEQ ID NO: 2808302 - DNA, 16 bp, Homo sapiens
taaacagatataaatg

SEQ ID NO: 2808303 - DNA, 13 bp, Homo sapiens
taaacagtgcctg

SEQ ID NO: 2808304 - DNA, 17 bp, Homo sapiens
taaacagtgcctgctga

SEQ ID NO: 2808305 - DNA, 18 bp, Homo sapiens
taaacagtgcctgctgaa

SEQ ID NO: 2808306 - DNA, 17 bp, Homo sapiens
taaacattaaacactgt

SEQ ID NO: 2808307 - DNA, 13 bp, Homo sapiens
taaaccagcagaa

SEQ ID NO: 2808308 - DNA, 15 bp, Homo sapiens
taaaccagcagaaaa

SEQ ID NO: 2808309 - DNA, 14 bp, Homo sapiens
taaacccaaataaa

SEQ ID NO: 2808310 - DNA, 17 bp, Homo sapiens
taaacccaaataaatgt

SEQ ID NO: 2808311 - DNA, 14 bp, Homo sapiens
taaacgaagataaa

SEQ ID NO: 2808312 - DNA, 14 bp, Homo sapiens
taaactagatctcc

SEQ ID NO: 2808313 - DNA, 22 bp, Homo sapiens
taaactagtaatgggccaatta

SEQ ID NO: 2808314 - DNA, 15 bp, Homo sapiens
taaactataagcaag

SEQ ID NO: 2808315 - DNA, 17 bp, Homo sapiens
taaactataagcaagaa

SEQ ID NO: 2808316 - DNA, 14 bp, Homo sapiens
taaactcaaaatat

SEQ ID NO: 2808317 - DNA, 16 bp, Homo sapiens
taaactcaaaatattt

SEQ ID NO: 2808318 - DNA, 23 bp, Homo sapiens
taaactcaaaatatttgtacata

SEQ ID NO: 2808319 - DNA, 12 bp, Homo sapiens
taaacttcagca

SEQ ID NO: 2808320 - DNA, 22 bp, Homo sapiens
taaagacagaaaaaaataaaaa

SEQ ID NO: 2808321 - DNA, 23 bp, Homo sapiens
taaagagcatggaaaaatactgc

SEQ ID NO: 2808322 - DNA, 12 bp, Homo sapiens
taaagagttctt

SEQ ID NO: 2808323 - DNA, 12 bp, Homo sapiens
taaagatttttt

SEQ ID NO: 2808324 - DNA, 16 bp, Homo sapiens
taaagattttttaata

SEQ ID NO: 2808325 - DNA, 16 bp, Homo sapiens
taaagcagtgttttca

SEQ ID NO: 2808326 - DNA, 22 bp, Homo sapiens
taaagcatgaatggtatggaac

SEQ ID NO: 2808327 - DNA, 18 bp, Homo sapiens
taaagctgcctgtagtta

SEQ ID NO: 2808328 - DNA, 21 bp, Homo sapiens
taaagctgcctgtagttagga

SEQ ID NO: 2808329 - DNA, 16 bp, Homo sapiens
taaagctggacaagaa

SEQ ID NO: 2808330 - DNA, 16 bp, Homo sapiens
tatttatatttggaaa

SEQ ID NO: 2808331 - DNA, 13 bp, Homo sapiens
tatttatcagtga

SEQ ID NO: 2808332 - DNA, 22 bp, Homo sapiens
tatttattgtttatttatcagt

SEQ ID NO: 2808333 - DNA, 13 bp, Homo sapiens
tatttatttatgg

SEQ ID NO: 2808334 - DNA, 14 bp, Homo sapiens
tatttatttatgga

SEQ ID NO: 2808335 - DNA, 13 bp, Homo sapiens
tatttcaaaataa

SEQ ID NO: 2808336 - DNA, 22 bp, Homo sapiens
tatttcaatttccaagagctga

SEQ ID NO: 2808337 - DNA, 20 bp, Homo sapiens
tatttcataaacaacttaat

SEQ ID NO: 2808338 - DNA, 20 bp, Homo sapiens
tatttcttaaacaaatgtat

SEQ ID NO: 2808339 - DNA, 16 bp, Homo sapiens
tatttgcttatttata

SEQ ID NO: 2808340 - DNA, 12 bp, Homo sapiens
tatttggaaaga

SEQ ID NO: 2808341 - DNA, 16 bp, Homo sapiens
tatttggaaagagacc

SEQ ID NO: 2808342 - DNA, 14 bp, Homo sapiens
tatttgtaatagat

SEQ ID NO: 2808343 - DNA, 15 bp, Homo sapiens
tatttgtaatagatg

SEQ ID NO: 2808344 - DNA, 17 bp, Homo sapiens
tatttgttaaatattta

SEQ ID NO: 2808345 - DNA, 17 bp, Homo sapiens
tatttgttcccaagagc

SEQ ID NO: 2808346 - DNA, 19 bp, Homo sapiens
tatttgttgtttttaacaa

SEQ ID NO: 2808347 - DNA, 15 bp, Homo sapiens
tattttaaaaccatg

SEQ ID NO: 2808348 - DNA, 20 bp, Homo sapiens
tattttaaaaccatgcagct

SEQ ID NO: 2808349 - DNA, 12 bp, Homo sapiens
tattttaaagaa

SEQ ID NO: 2808350 - DNA, 17 bp, Homo sapiens
tattttagtctgtcatc

SEQ ID NO: 2808351 - DNA, 20 bp, Homo sapiens
tattttcatttaactacaaa

SEQ ID NO: 2808352 - DNA, 13 bp, Homo sapiens
tattttcgtgcat

SEQ ID NO: 2808353 - DNA, 23 bp, Homo sapiens
tattttcgtgcatttgtgagcca

SEQ ID NO: 2808354 - DNA, 18 bp, Homo sapiens
tattttcttcccatttgt

SEQ ID NO: 2808355 - DNA, 22 bp, Homo sapiens
tattttcttcccatttgtaatg

SEQ ID NO: 2808356 - DNA, 16 bp, Homo sapiens
tattttcttttgtaaa

SEQ ID NO: 2808357 - DNA, 17 bp, Homo sapiens
tattttgacataaagtt

SEQ ID NO: 2808358 - DNA, 18 bp, Homo sapiens
tattttgacataaagttg

SEQ ID NO: 2808359 - DNA, 20 bp, Homo sapiens
tattttgtaaactcaaaata

SEQ ID NO: 2808360 - DNA, 13 bp, Homo sapiens
tatttttagagat

SEQ ID NO: 2808361 - DNA, 23 bp, Homo sapiens
tatttttagagattaatttgtgt

SEQ ID NO: 2808362 - DNA, 17 bp, Homo sapiens
tatttttatttgtttgt

SEQ ID NO: 2808363 - DNA, 19 bp, Homo sapiens
tatttttcaaccagcattt

SEQ ID NO: 2808364 - DNA, 20 bp, Homo sapiens
tatttttgaacccctgtgtc

SEQ ID NO: 2808365 - DNA, 13 bp, Homo sapiens
tatttttgaataa

SEQ ID NO: 2808366 - DNA, 18 bp, Homo sapiens
tattttttaaaataattt

SEQ ID NO: 2808367 - DNA, 21 bp, Homo sapiens
tattttttaagtatttatata

SEQ ID NO: 2808368 - DNA, 16 bp, Homo sapiens
tattttttaatcattt

SEQ ID NO: 2808369 - DNA, 18 bp, Homo sapiens
tattttttatttccacat

SEQ ID NO: 2808370 - DNA, 16 bp, Homo sapiens
tcaaaaaaagccttta

SEQ ID NO: 2808371 - DNA, 19 bp, Homo sapiens
tcaaaacagattgtttgca

SEQ ID NO: 2808372 - DNA, 15 bp, Homo sapiens
tcaaaacatatcaat

SEQ ID NO: 2808373 - DNA, 16 bp, Homo sapiens
tcaaaacatatcaatt

SEQ ID NO: 2808374 - DNA, 17 bp, Homo sapiens
tcaaaacatatcaattc

SEQ ID NO: 2808375 - DNA, 19 bp, Homo sapiens
tcaaaacatatcaattcaa

SEQ ID NO: 2808376 - DNA, 12 bp, Homo sapiens
tcaaaacattgt

SEQ ID NO: 2808377 - DNA, 18 bp, Homo sapiens
tcaaaagcaaatgagatc

SEQ ID NO: 2808378 - DNA, 15 bp, Homo sapiens
tcaaaagctgcttga

SEQ ID NO: 2808379 - DNA, 23 bp, Homo sapiens
tcaaaaggtgcctgtgaggcagg

SEQ ID NO: 2808380 - DNA, 14 bp, Homo sapiens
tcaaaataaattga

SEQ ID NO: 2808381 - DNA, 17 bp, Homo sapiens
tcaaaatagtgccacta

SEQ ID NO: 2808382 - DNA, 16 bp, Homo sapiens
tcaaaatatttgtaca

SEQ ID NO: 2808383 - DNA, 17 bp, Homo sapiens
tcaaaatatttgtacat

SEQ ID NO: 2808384 - DNA, 22 bp, Homo sapiens
tcaaaccatttaattcataatt

SEQ ID NO: 2808385 - DNA, 20 bp, Homo sapiens
tcaaaccccgaccacctgcc

SEQ ID NO: 2808386 - DNA, 23 bp, Homo sapiens
tcaaaccccgaccacctgcccaa

SEQ ID NO: 2808387 - DNA, 20 bp, Homo sapiens
tcaaaccgcactcacccatg

SEQ ID NO: 2808388 - DNA, 19 bp, Homo sapiens
tcaaactggggcctccctg

SEQ ID NO: 2808389 - DNA, 13 bp, Homo sapiens
tcaaactgggtat

SEQ ID NO: 2808390 - DNA, 15 bp, Homo sapiens
tcaaagcaagcattc

SEQ ID NO: 2808391 - DNA, 14 bp, Homo sapiens
tcaaagcttgaaga

SEQ ID NO: 2808392 - DNA, 16 bp, Homo sapiens
tcaaagctttttccag

SEQ ID NO: 2808393 - DNA, 15 bp, Homo sapiens
tcaaatccatccaga

SEQ ID NO: 2808394 - DNA, 16 bp, Homo sapiens
tcaaatctattcagac

SEQ ID NO: 2808395 - DNA, 18 bp, Homo sapiens
tcaaatctattcagacaa

SEQ ID NO: 2808396 - DNA, 15 bp, Homo sapiens
tcaaatgacccaaag

SEQ ID NO: 2808397 - DNA, 17 bp, Homo sapiens
tcaaatgacccaaagac

SEQ ID NO: 2808398 - DNA, 15 bp, Homo sapiens
tcaaatgctaaatgc

SEQ ID NO: 2808399 - DNA, 17 bp, Homo sapiens
tcaaatgctaaatgcaa

SEQ ID NO: 2808400 - DNA, 12 bp, Homo sapiens
tcaaatttcaca

SEQ ID NO: 2808401 - DNA, 21 bp, Homo sapiens
tcaacaaagaaatattatttg

SEQ ID NO: 2808402 - DNA, 14 bp, Homo sapiens
tcaacaattctaaa

SEQ ID NO: 2808403 - DNA, 17 bp, Homo sapiens
tcaacaattctaaaatg

SEQ ID NO: 2808404 - DNA, 17 bp, Homo sapiens
tcaacacattacttgca

SEQ ID NO: 2808405 - DNA, 22 bp, Homo sapiens
tcaacagagaaggcaggaatgt

SEQ ID NO: 2808406 - DNA, 16 bp, Homo sapiens
tcaacagttcaaagaa

SEQ ID NO: 2808407 - DNA, 23 bp, Homo sapiens
tcaaccactgtggcgttctgctg

SEQ ID NO: 2808408 - DNA, 14 bp, Homo sapiens
tcaaccagcatttt

SEQ ID NO: 2808409 - DNA, 18 bp, Homo sapiens
tcaaccagcattttacta

SEQ ID NO: 2808410 - DNA, 18 bp, Homo sapiens
tcaaccccttcgctcctg

SEQ ID NO: 2808411 - DNA, 20 bp, Homo sapiens
tcaaccccttcgctcctgtg

SEQ ID NO: 2808412 - DNA, 23 bp, Homo sapiens
tcaaccccttcgctcctgtgtct

SEQ ID NO: 2808413 - DNA, 16 bp, Homo sapiens
tcaaccgcttgccata

SEQ ID NO: 2808414 - DNA, 16 bp, Homo sapiens
tcaacctaagcaacag

SEQ ID NO: 2808415 - DNA, 22 bp, Homo sapiens
tcaacctaccaccccttcctgt

SEQ ID NO: 2808416 - DNA, 13 bp, Homo sapiens
tcaacctcctggg

SEQ ID NO: 2808417 - DNA, 15 bp, Homo sapiens
tcaacctcctgggct

SEQ ID NO: 2808418 - DNA, 15 bp, Homo sapiens
tcaactccagctccc

SEQ ID NO: 2808419 - DNA, 23 bp, Homo sapiens
tcaactgaaaagactcagtgttc

SEQ ID NO: 2808420 - DNA, 21 bp, Homo sapiens
tcaagaaaaattattgtataa

SEQ ID NO: 2808421 - DNA, 14 bp, Homo sapiens
tcatgatctccctg

SEQ ID NO: 2808422 - DNA, 18 bp, Homo sapiens
tcatgatctccctgccgc

SEQ ID NO: 2808423 - DNA, 22 bp, Homo sapiens
tcatgatctccctgccgcctca

SEQ ID NO: 2808424 - DNA, 17 bp, Homo sapiens
tcatgatttcatttcaa

SEQ ID NO: 2808425 - DNA, 22 bp, Homo sapiens
tcatgcctctgaggccagcctg

SEQ ID NO: 2808426 - DNA, 19 bp, Homo sapiens
tcatgcctggcccccctcc

SEQ ID NO: 2808427 - DNA, 21 bp, Homo sapiens
tcatgcctggcccccctccag

SEQ ID NO: 2808428 - DNA, 23 bp, Homo sapiens
tcatggagtgacggtcccacact

SEQ ID NO: 2808429 - DNA, 18 bp, Homo sapiens
tcatggcagatgtaggag

SEQ ID NO: 2808430 - DNA, 15 bp, Homo sapiens
tcatgtaataaatct

SEQ ID NO: 2808431 - DNA, 13 bp, Homo sapiens
tcatgtctggcta

SEQ ID NO: 2808432 - DNA, 15 bp, Homo sapiens
tcatgtgatcctttt

SEQ ID NO: 2808433 - DNA, 15 bp, Homo sapiens
tcatgtgcctggaaa

SEQ ID NO: 2808434 - DNA, 19 bp, Homo sapiens
tcatgtggaatataaagat

SEQ ID NO: 2808435 - DNA, 13 bp, Homo sapiens
tcatgttcctcaa

SEQ ID NO: 2808436 - DNA, 18 bp, Homo sapiens
tcattaaattggaatttt

SEQ ID NO: 2808437 - DNA, 17 bp, Homo sapiens
tcattagctgtgatttt

SEQ ID NO: 2808438 - DNA, 18 bp, Homo sapiens
tcattagctgtgattttt

SEQ ID NO: 2808439 - DNA, 13 bp, Homo sapiens
tcattataaacgt

SEQ ID NO: 2808440 - DNA, 23 bp, Homo sapiens
tcattataaacgtgatgatcagc

SEQ ID NO: 2808441 - DNA, 17 bp, Homo sapiens
tcattcaagcctgtgaa

SEQ ID NO: 2808442 - DNA, 16 bp, Homo sapiens
tcattcaatacaagtg

SEQ ID NO: 2808443 - DNA, 13 bp, Homo sapiens
tcattcaggaaaa

SEQ ID NO: 2808444 - DNA, 14 bp, Homo sapiens
tcattcatttttgt

SEQ ID NO: 2808445 - DNA, 21 bp, Homo sapiens
tcattccaacttcccagttca

SEQ ID NO: 2808446 - DNA, 23 bp, Homo sapiens
tcattccaccttcccatgccctg

SEQ ID NO: 2808447 - DNA, 12 bp, Homo sapiens
tcattccccagg

SEQ ID NO: 2808448 - DNA, 20 bp, Homo sapiens
tcattcctgaaagaaacagt

SEQ ID NO: 2808449 - DNA, 18 bp, Homo sapiens
tcattgagggaaaacata

SEQ ID NO: 2808450 - DNA, 16 bp, Homo sapiens
tcattgatatgaaaaa

SEQ ID NO: 2808451 - DNA, 18 bp, Homo sapiens
tcattgatatgaaaaata

SEQ ID NO: 2808452 - DNA, 19 bp, Homo sapiens
tcattgatatgaaaaatat

SEQ ID NO: 2808453 - DNA, 14 bp, Homo sapiens
tcattgtagaaaag

SEQ ID NO: 2808454 - DNA, 16 bp, Homo sapiens
tcattgtataaaaata

SEQ ID NO: 2808455 - DNA, 17 bp, Homo sapiens
tcattgtataaaaatag

SEQ ID NO: 2808456 - DNA, 20 bp, Homo sapiens
tcattgtccatgcctacaga

SEQ ID NO: 2808457 - DNA, 22 bp, Homo sapiens
tcattgtccatgcctacagata

SEQ ID NO: 2808458 - DNA, 23 bp, Homo sapiens
tcattgtccatgcctacagataa

SEQ ID NO: 2808459 - DNA, 23 bp, Homo sapiens
tcattgtttattaacaaattatg

SEQ ID NO: 2808460 - DNA, 15 bp, Homo sapiens
tcatttaagggaaaa

SEQ ID NO: 2808461 - DNA, 16 bp, Homo sapiens
tcatttaagggaaaaa

SEQ ID NO: 2808462 - DNA, 21 bp, Homo sapiens
tcatttataaaaccatcaaaa

SEQ ID NO: 2808463 - DNA, 15 bp, Homo sapiens
tcatttatgaaaaga

SEQ ID NO: 2808464 - DNA, 14 bp, Homo sapiens
tcatttcactttaa

SEQ ID NO: 2808465 - DNA, 16 bp, Homo sapiens
tcatttcctgtgtctt

SEQ ID NO: 2808466 - DNA, 21 bp, Homo sapiens
tcatttgagcagggctcagcg

SEQ ID NO: 2808467 - DNA, 18 bp, Homo sapiens
tcattttacccttggctc

SEQ ID NO: 2808468 - DNA, 13 bp, Homo sapiens
tcattttgcacgt

SEQ ID NO: 2808469 - DNA, 15 bp, Homo sapiens
tcatttttccgtaaa

SEQ ID NO: 2808470 - DNA, 15 bp, Homo sapiens
tcatttttttccttg

SEQ ID NO: 2808471 - DNA, 18 bp, Homo sapiens
tcatttttttccttgcaa

SEQ ID NO: 2808472 - DNA, 18 bp, Homo sapiens
tccaaaattacttctctc

SEQ ID NO: 2808473 - DNA, 23 bp, Homo sapiens
tccaaaggaatctccagttttca

SEQ ID NO: 2808474 - DNA, 19 bp, Homo sapiens
tccaaatgaatgaccttgt

SEQ ID NO: 2808475 - DNA, 19 bp, Homo sapiens
tccaaatgattttcatcaa

SEQ ID NO: 2808476 - DNA, 21 bp, Homo sapiens
tccaaatgattttcatcaatt

SEQ ID NO: 2808477 - DNA, 17 bp, Homo sapiens
tccaacaataaagagct

SEQ ID NO: 2808478 - DNA, 18 bp, Homo sapiens
tccaacagacagggccta

SEQ ID NO: 2808479 - DNA, 15 bp, Homo sapiens
tccaacccatgatga

SEQ ID NO: 2808480 - DNA, 18 bp, Homo sapiens
tccaacctaacccctttc

SEQ ID NO: 2808481 - DNA, 21 bp, Homo sapiens
tccaacctaacccctttcctg

SEQ ID NO: 2808482 - DNA, 17 bp, Homo sapiens
tccaacctggacaacaa

SEQ ID NO: 2808483 - DNA, 16 bp, Homo sapiens
tccaacgttaaaagac

SEQ ID NO: 2808484 - DNA, 19 bp, Homo sapiens
tccaacgttaaaagacagt

SEQ ID NO: 2808485 - DNA, 15 bp, Homo sapiens
tccaacttcatttga

SEQ ID NO: 2808486 - DNA, 22 bp, Homo sapiens
tccaagcgaggtcaacagagaa

SEQ ID NO: 2808487 - DNA, 16 bp, Homo sapiens
tccaaggagaaacaga

SEQ ID NO: 2808488 - DNA, 22 bp, Homo sapiens
tccaaggagaaacagagacagg

SEQ ID NO: 2808489 - DNA, 12 bp, Homo sapiens
tccaaggagttc

SEQ ID NO: 2808490 - DNA, 22 bp, Homo sapiens
tccaagtcttcagcgagaccct

SEQ ID NO: 2808491 - DNA, 22 bp, Homo sapiens
tccaagtggtgggaatcagatc

SEQ ID NO: 2808492 - DNA, 19 bp, Homo sapiens
tccaattatgtgacaacct

SEQ ID NO: 2808493 - DNA, 13 bp, Homo sapiens
tccaattgtaaaa

SEQ ID NO: 2808494 - DNA, 14 bp, Homo sapiens
tccaattttctgga

SEQ ID NO: 2808495 - DNA, 17 bp, Homo sapiens
tccacaagattcccaga

SEQ ID NO: 2808496 - DNA, 21 bp, Homo sapiens
tccacaagattcccagagaca

SEQ ID NO: 2808497 - DNA, 12 bp, Homo sapiens
tccacacacaga

SEQ ID NO: 2808498 - DNA, 14 bp, Homo sapiens
tccacacacagagg

SEQ ID NO: 2808499 - DNA, 23 bp, Homo sapiens
tccacacacagaggaagagcagg

SEQ ID NO: 2808500 - DNA, 19 bp, Homo sapiens
tccacacacgcaggaactc

SEQ ID NO: 2808501 - DNA, 16 bp, Homo sapiens
tccacagccgcagcct

SEQ ID NO: 2808502 - DNA, 23 bp, Homo sapiens
tccacagcggaggagaccagctc

SEQ ID NO: 2808503 - DNA, 21 bp, Homo sapiens
tccacagtagcatttcttatt

SEQ ID NO: 2808504 - DNA, 13 bp, Homo sapiens
tccacagtctctg

SEQ ID NO: 2808505 - DNA, 14 bp, Homo sapiens
tccacagtctctgg

SEQ ID NO: 2808506 - DNA, 20 bp, Homo sapiens
tccacagtgcccagctaatt

SEQ ID NO: 2808507 - DNA, 16 bp, Homo sapiens
tccaccaacccatcag

SEQ ID NO: 2808508 - DNA, 13 bp, Homo sapiens
tccaccacccaaa

SEQ ID NO: 2808509 - DNA, 17 bp, Homo sapiens
tccaccacccaaaagtc

SEQ ID NO: 2808510 - DNA, 13 bp, Homo sapiens
tccacccacctca

SEQ ID NO: 2808511 - DNA, 12 bp, Homo sapiens
tccccctgggct

SEQ ID NO: 2808512 - DNA, 20 bp, Homo sapiens
tccccctgggctctgcccca

SEQ ID NO: 2808513 - DNA, 23 bp, Homo sapiens
tccccctgggctctgccccagct

SEQ ID NO: 2808514 - DNA, 20 bp, Homo sapiens
tccccctggggcttctcctg

SEQ ID NO: 2808515 - DNA, 21 bp, Homo sapiens
tccccctggggcttctcctga

SEQ ID NO: 2808516 - DNA, 18 bp, Homo sapiens
tccccgcagagctccctt

SEQ ID NO: 2808517 - DNA, 18 bp, Homo sapiens
tcccctatccacccagcc

SEQ ID NO: 2808518 - DNA, 13 bp, Homo sapiens
tcccctcattcag

SEQ ID NO: 2808519 - DNA, 16 bp, Homo sapiens
tcccctcccccctgta

SEQ ID NO: 2808520 - DNA, 12 bp, Homo sapiens
tcccctccctct

SEQ ID NO: 2808521 - DNA, 23 bp, Homo sapiens
tcccctgcccccagaccttttat

SEQ ID NO: 2808522 - DNA, 12 bp, Homo sapiens
tcccctgccctg

SEQ ID NO: 2808523 - DNA, 18 bp, Homo sapiens
tcccctggaactgtctct

SEQ ID NO: 2808524 - DNA, 20 bp, Homo sapiens
tccccttgcccttgccctga

SEQ ID NO: 2808525 - DNA, 13 bp, Homo sapiens
tcccctttattaa

SEQ ID NO: 2808526 - DNA, 15 bp, Homo sapiens
tcccgagtagctggg

SEQ ID NO: 2808527 - DNA, 13 bp, Homo sapiens
tcccgcaccaggc

SEQ ID NO: 2808528 - DNA, 14 bp, Homo sapiens
tcccgggagaggag

SEQ ID NO: 2808529 - DNA, 23 bp, Homo sapiens
tcccgtgaaagaattatttttgt

SEQ ID NO: 2808530 - DNA, 20 bp, Homo sapiens
tccctaaaataaaaaccaga

SEQ ID NO: 2808531 - DNA, 18 bp, Homo sapiens
tccctagcctgcttttgt

SEQ ID NO: 2808532 - DNA, 13 bp, Homo sapiens
tccctatcaaaac

SEQ ID NO: 2808533 - DNA, 15 bp, Homo sapiens
tccctatcaaaacat

SEQ ID NO: 2808534 - DNA, 17 bp, Homo sapiens
tccctatcaaaacatat

SEQ ID NO: 2808535 - DNA, 22 bp, Homo sapiens
tccctatcaaaacatatcaatt

SEQ ID NO: 2808536 - DNA, 23 bp, Homo sapiens
tccctcaccccctcccaccccca

SEQ ID NO: 2808537 - DNA, 23 bp, Homo sapiens
tccctcattccaccttcccatgc

SEQ ID NO: 2808538 - DNA, 13 bp, Homo sapiens
tccctccacccca

SEQ ID NO: 2808539 - DNA, 14 bp, Homo sapiens
tccctccaccccag

SEQ ID NO: 2808540 - DNA, 15 bp, Homo sapiens
tccctccaccccagg

SEQ ID NO: 2808541 - DNA, 14 bp, Homo sapiens
tccctctcccaggc

SEQ ID NO: 2808542 - DNA, 16 bp, Homo sapiens
tccctctcccaggccc

SEQ ID NO: 2808543 - DNA, 21 bp, Homo sapiens
tccctctcccaggccccatga

SEQ ID NO: 2808544 - DNA, 13 bp, Homo sapiens
tccctctcctccc

SEQ ID NO: 2808545 - DNA, 15 bp, Homo sapiens
tccctctcctgccta

SEQ ID NO: 2808546 - DNA, 22 bp, Homo sapiens
tccctctcggaaggctggctgg

SEQ ID NO: 2808547 - DNA, 23 bp, Homo sapiens
tccctctcggaaggctggctggg

SEQ ID NO: 2808548 - DNA, 17 bp, Homo sapiens
tccctctgacctgcagg

SEQ ID NO: 2808549 - DNA, 21 bp, Homo sapiens
tccctctgagaattccaagga

SEQ ID NO: 2808550 - DNA, 16 bp, Homo sapiens
tccctctggccctgcc

SEQ ID NO: 2808551 - DNA, 19 bp, Homo sapiens
tccctctggccctgccttc

SEQ ID NO: 2808552 - DNA, 16 bp, Homo sapiens
tccctcttccttcccc

SEQ ID NO: 2808553 - DNA, 17 bp, Homo sapiens
tccctctttgcctgtgt

SEQ ID NO: 2808554 - DNA, 19 bp, Homo sapiens
tccctgaacatctgtgtgt

SEQ ID NO: 2808555 - DNA, 16 bp, Homo sapiens
tccctgacctccctct

SEQ ID NO: 2808556 - DNA, 19 bp, Homo sapiens
tccctgagaaacccaccag

SEQ ID NO: 2808557 - DNA, 22 bp, Homo sapiens
tccctgagaaacccaccagcct

SEQ ID NO: 2808558 - DNA, 17 bp, Homo sapiens
tccctgaggtcacctgg

SEQ ID NO: 2808559 - DNA, 20 bp, Homo sapiens
tccctgcacttgcagactct

SEQ ID NO: 2808560 - DNA, 18 bp, Homo sapiens
tccctgccctgtcctcca

SEQ ID NO: 2808561 - DNA, 14 bp, Homo sapiens
tccctggcctggct

SEQ ID NO: 2808562 - DNA, 19 bp, Homo sapiens
tccctggcttgtaactcca

SEQ ID NO: 2808563 - DNA, 12 bp, Homo sapiens
tccctgggcctg

SEQ ID NO: 2808564 - DNA, 16 bp, Homo sapiens
tccctgggcctgctgc

SEQ ID NO: 2808565 - DNA, 18 bp, Homo sapiens
tccctgggcctgctgctg

SEQ ID NO: 2808566 - DNA, 20 bp, Homo sapiens
tccctgggggaagccctgga

SEQ ID NO: 2808567 - DNA, 19 bp, Homo sapiens
tccctggtcccttggagac

SEQ ID NO: 2808568 - DNA, 13 bp, Homo sapiens
tccctggtgcaga

SEQ ID NO: 2808569 - DNA, 16 bp, Homo sapiens
tccctggtgcagaggt

SEQ ID NO: 2808570 - DNA, 14 bp, Homo sapiens
tccctgtcaccaag

SEQ ID NO: 2808571 - DNA, 15 bp, Homo sapiens
tccctgtcaccaagc

SEQ ID NO: 2808572 - DNA, 17 bp, Homo sapiens
tcccttaatatcctaaa

SEQ ID NO: 2808573 - DNA, 17 bp, Homo sapiens
tcccttcccccataagc

SEQ ID NO: 2808574 - DNA, 13 bp, Homo sapiens
tcccttgtgtgtg

SEQ ID NO: 2808575 - DNA, 15 bp, Homo sapiens
tcccttgtgtgtgtg

SEQ ID NO: 2808576 - DNA, 21 bp, Homo sapiens
tccctttcacaaaattttatt

SEQ ID NO: 2808577 - DNA, 20 bp, Homo sapiens
tcccttttgcataagattaa

SEQ ID NO: 2808578 - DNA, 22 bp, Homo sapiens
tccgaaagggacttggaagctc

SEQ ID NO: 2808579 - DNA, 17 bp, Homo sapiens
tccgaccagacaccttg

SEQ ID NO: 2808580 - DNA, 13 bp, Homo sapiens
tccgaggcagggt

SEQ ID NO: 2808581 - DNA, 16 bp, Homo sapiens
tccgccacgaggagct

SEQ ID NO: 2808582 - DNA, 20 bp, Homo sapiens
tccgctttctacccagcgag

SEQ ID NO: 2808583 - DNA, 14 bp, Homo sapiens
tccgtagttccctg

SEQ ID NO: 2808584 - DNA, 23 bp, Homo sapiens
tccgtcaaaacagattgtttgca

SEQ ID NO: 2808585 - DNA, 19 bp, Homo sapiens
tccgtctccctaaaataaa

SEQ ID NO: 2808586 - DNA, 20 bp, Homo sapiens
tccgtgagtgaaccatcatt

SEQ ID NO: 2808587 - DNA, 19 bp, Homo sapiens
tcctaagcagtgcttgtaa

SEQ ID NO: 2808588 - DNA, 16 bp, Homo sapiens
tcctacctatattaca

SEQ ID NO: 2808589 - DNA, 12 bp, Homo sapiens
tcctacctcagc

SEQ ID NO: 2808590 - DNA, 13 bp, Homo sapiens
tcctacctcagcc

SEQ ID NO: 2808591 - DNA, 20 bp, Homo sapiens
tcctactttagccactggtt

SEQ ID NO: 2808592 - DNA, 13 bp, Homo sapiens
tcctagccactca

SEQ ID NO: 2808593 - DNA, 22 bp, Homo sapiens
tcctaggctccaccccatccag

SEQ ID NO: 2808594 - DNA, 23 bp, Homo sapiens
tcctagtatattagtttgattta

SEQ ID NO: 2808595 - DNA, 15 bp, Homo sapiens
tcctatatagtttat

SEQ ID NO: 2808596 - DNA, 18 bp, Homo sapiens
tcctatgtcaatttgtat

SEQ ID NO: 2808597 - DNA, 24 bp, Homo sapiens
tcctatgtcaatttgtatatcatg

SEQ ID NO: 2808598 - DNA, 17 bp, Homo sapiens
tcctattaaaacacagc

SEQ ID NO: 2808599 - DNA, 16 bp, Homo sapiens
tcctattctcaccagg

SEQ ID NO: 2808600 - DNA, 18 bp, Homo sapiens
tcctattctcaccaggaa

SEQ ID NO: 2808601 - DNA, 12 bp, Homo sapiens
tcctattttaaa

SEQ ID NO: 2808602 - DNA, 21 bp, Homo sapiens
tctctactcctacctcagcct

SEQ ID NO: 2808603 - DNA, 14 bp, Homo sapiens
tctctactctggaa

SEQ ID NO: 2808604 - DNA, 13 bp, Homo sapiens
tctctagaatttt

SEQ ID NO: 2808605 - DNA, 17 bp, Homo sapiens
tctctcaggagcacagg

SEQ ID NO: 2808606 - DNA, 22 bp, Homo sapiens
tctctcaggagcacaggcagct

SEQ ID NO: 2808607 - DNA, 17 bp, Homo sapiens
tctctcatgaacctcaa

SEQ ID NO: 2808608 - DNA, 22 bp, Homo sapiens
tctctcatgaacctcaagctgc

SEQ ID NO: 2808609 - DNA, 22 bp, Homo sapiens
tctctcctgtataaccccacct

SEQ ID NO: 2808610 - DNA, 12 bp, Homo sapiens
tctctccttctg

SEQ ID NO: 2808611 - DNA, 19 bp, Homo sapiens
tctctccttgttctgataa

SEQ ID NO: 2808612 - DNA, 21 bp, Homo sapiens
tctctcggggcgacccctcag

SEQ ID NO: 2808613 - DNA, 23 bp, Homo sapiens
tctctcggggcgacccctcagtg

SEQ ID NO: 2808614 - DNA, 14 bp, Homo sapiens
tctctctaaaaata

SEQ ID NO: 2808615 - DNA, 20 bp, Homo sapiens
tctctctaaaaataaaatga

SEQ ID NO: 2808616 - DNA, 17 bp, Homo sapiens
tctctctatatatacat

SEQ ID NO: 2808617 - DNA, 21 bp, Homo sapiens
tctctctatatatacatgtat

SEQ ID NO: 2808618 - DNA, 13 bp, Homo sapiens
tctctctcctgtc

SEQ ID NO: 2808619 - DNA, 13 bp, Homo sapiens
tctctctctacaa

SEQ ID NO: 2808620 - DNA, 13 bp, Homo sapiens
tctctctctggtc

SEQ ID NO: 2808621 - DNA, 14 bp, Homo sapiens
tctctctctgtcct

SEQ ID NO: 2808622 - DNA, 16 bp, Homo sapiens
tctctgactcttgcct

SEQ ID NO: 2808623 - DNA, 20 bp, Homo sapiens
tctctgactcttgcctttcc

SEQ ID NO: 2808624 - DNA, 22 bp, Homo sapiens
tctctgagatgcccctctgcct

SEQ ID NO: 2808625 - DNA, 17 bp, Homo sapiens
tctctgagggagaggct

SEQ ID NO: 2808626 - DNA, 11 bp, Homo sapiens
tctctgcagcc

SEQ ID NO: 2808627 - DNA, 15 bp, Homo sapiens
tctctgcagccagcc

SEQ ID NO: 2808628 - DNA, 16 bp, Homo sapiens
tctctgcagccagccc

SEQ ID NO: 2808629 - DNA, 14 bp, Homo sapiens
tctctgctcttgcc

SEQ ID NO: 2808630 - DNA, 15 bp, Homo sapiens
tctctgctcttgcct

SEQ ID NO: 2808631 - DNA, 16 bp, Homo sapiens
tctctgctcttgcctg

SEQ ID NO: 2808632 - DNA, 15 bp, Homo sapiens
tctctgggagacttt

SEQ ID NO: 2808633 - DNA, 24 bp, Homo sapiens
tctctgggtaggtgttgaaaatga

SEQ ID NO: 2808634 - DNA, 18 bp, Homo sapiens
tctctgtccctcactgcc

SEQ ID NO: 2808635 - DNA, 19 bp, Homo sapiens
tctctgtccctcactgcct

SEQ ID NO: 2808636 - DNA, 16 bp, Homo sapiens
tctctgtgaacgattt

SEQ ID NO: 2808637 - DNA, 18 bp, Homo sapiens
tctctgtgacctgccccg

SEQ ID NO: 2808638 - DNA, 11 bp, Homo sapiens
tctctgtgctt

SEQ ID NO: 2808639 - DNA, 16 bp, Homo sapiens
tctctgtgctttgact

SEQ ID NO: 2808640 - DNA, 13 bp, Homo sapiens
tctctgttcattt

SEQ ID NO: 2808641 - DNA, 20 bp, Homo sapiens
tctcttatagaatatttatt

SEQ ID NO: 2808642 - DNA, 21 bp, Homo sapiens
tctcttatatagtattcattt

SEQ ID NO: 2808643 - DNA, 13 bp, Homo sapiens
tctcttcaggttc

SEQ ID NO: 2808644 - DNA, 12 bp, Homo sapiens
tctcttccctat

SEQ ID NO: 2808645 - DNA, 11 bp, Homo sapiens
tctcttcctac

SEQ ID NO: 2808646 - DNA, 12 bp, Homo sapiens
tctcttgccttt

SEQ ID NO: 2808647 - DNA, 19 bp, Homo sapiens
tctctttatgtctgtggat

SEQ ID NO: 2808648 - DNA, 15 bp, Homo sapiens
tctctttcttatttt

SEQ ID NO: 2808649 - DNA, 20 bp, Homo sapiens
tctctttcttattttgtaat

SEQ ID NO: 2808650 - DNA, 22 bp, Homo sapiens
tctctttcttattttgtaataa

SEQ ID NO: 2808651 - DNA, 22 bp, Homo sapiens
tctcttttgaatccatgcttgg

SEQ ID NO: 2808652 - DNA, 17 bp, Homo sapiens
tctgaaaattaacactg

SEQ ID NO: 2808653 - DNA, 16 bp, Homo sapiens
tctgaagctattgatg

SEQ ID NO: 2808654 - DNA, 23 bp, Homo sapiens
tctgaagtcacatcacaggacac

SEQ ID NO: 2808655 - DNA, 13 bp, Homo sapiens
tctgaatcctaag

SEQ ID NO: 2808656 - DNA, 15 bp, Homo sapiens
tctgaatttttaaac

SEQ ID NO: 2808657 - DNA, 14 bp, Homo sapiens
tctgacacacagct

SEQ ID NO: 2808658 - DNA, 17 bp, Homo sapiens
tctgacacacagctctg

SEQ ID NO: 2808659 - DNA, 12 bp, Homo sapiens
tctgacaggcaa

SEQ ID NO: 2808660 - DNA, 22 bp, Homo sapiens
tctgacagttactcttcagttt

SEQ ID NO: 2808661 - DNA, 15 bp, Homo sapiens
tctgacctgcaggcc

SEQ ID NO: 2808662 - DNA, 16 bp, Homo sapiens
tctgactcacaagaag

SEQ ID NO: 2808663 - DNA, 13 bp, Homo sapiens
tctgactcttgcc

SEQ ID NO: 2808664 - DNA, 14 bp, Homo sapiens
tctgactcttgcct

SEQ ID NO: 2808665 - DNA, 22 bp, Homo sapiens
tctgactttaattgtgtgtctt

SEQ ID NO: 2808666 - DNA, 18 bp, Homo sapiens
tctgagaattccaaggag

SEQ ID NO: 2808667 - DNA, 17 bp, Homo sapiens
tctgagaggccctggat

SEQ ID NO: 2808668 - DNA, 18 bp, Homo sapiens
tctgagaggccctggatc

SEQ ID NO: 2808669 - DNA, 22 bp, Homo sapiens
tctgagcaccccctcattcccc

SEQ ID NO: 2808670 - DNA, 23 bp, Homo sapiens
tctgaggacactaaccacgctgg

SEQ ID NO: 2808671 - DNA, 14 bp, Homo sapiens
tctgaggccagcct

SEQ ID NO: 2808672 - DNA, 17 bp, Homo sapiens
tctgaggccagcctggc

SEQ ID NO: 2808673 - DNA, 18 bp, Homo sapiens
tctgaggccagcctggcc

SEQ ID NO: 2808674 - DNA, 19 bp, Homo sapiens
tctgaggctctttctgggc

SEQ ID NO: 2808675 - DNA, 21 bp, Homo sapiens
tctgaggctctttctgggcca

SEQ ID NO: 2808676 - DNA, 14 bp, Homo sapiens
tctgaggcttccag

SEQ ID NO: 2808677 - DNA, 13 bp, Homo sapiens
tctgagggagagg

SEQ ID NO: 2808678 - DNA, 19 bp, Homo sapiens
tctgaggtcctgagcactg

SEQ ID NO: 2808679 - DNA, 21 bp, Homo sapiens
tctgaggtcctgagcactgcc

SEQ ID NO: 2808680 - DNA, 22 bp, Homo sapiens
tctgagtgacatgggtgtgcca

SEQ ID NO: 2808681 - DNA, 15 bp, Homo sapiens
tctgataatgaaaat

SEQ ID NO: 2808682 - DNA, 15 bp, Homo sapiens
tctgatccctcgccc

SEQ ID NO: 2808683 - DNA, 20 bp, Homo sapiens
tctgattcccaagctctgct

SEQ ID NO: 2808684 - DNA, 13 bp, Homo sapiens
tctgattggctca

SEQ ID NO: 2808685 - DNA, 13 bp, Homo sapiens
tctgatttcagga

SEQ ID NO: 2808686 - DNA, 12 bp, Homo sapiens
tctgcacatgaa

SEQ ID NO: 2808687 - DNA, 12 bp, Homo sapiens
tctgcacatgtc

SEQ ID NO: 2808688 - DNA, 16 bp, Homo sapiens
tctgcacatgtcttgt

SEQ ID NO: 2808689 - DNA, 21 bp, Homo sapiens
tctgcacatgtcttgtacatg

SEQ ID NO: 2808690 - DNA, 14 bp, Homo sapiens
tctgcagccagccc

SEQ ID NO: 2808691 - DNA, 15 bp, Homo sapiens
tctgcagccagccca

SEQ ID NO: 2808692 - DNA, 16 bp, Homo sapiens
tctgcagccagcccag

SEQ ID NO: 2808693 - DNA, 23 bp, Homo sapiens
tgacacacgtatttatatttgga

SEQ ID NO: 2808694 - DNA, 22 bp, Homo sapiens
tgacacatatgcaccttgtgtc

SEQ ID NO: 2808695 - DNA, 20 bp, Homo sapiens
tgacactaccttatcaggca

SEQ ID NO: 2808696 - DNA, 14 bp, Homo sapiens
tgacagaacactgt

SEQ ID NO: 2808697 - DNA, 16 bp, Homo sapiens
tgacagaacactgtct

SEQ ID NO: 2808698 - DNA, 16 bp, Homo sapiens
tgacagacacaggccc

SEQ ID NO: 2808699 - DNA, 14 bp, Homo sapiens
tgacagagacccag

SEQ ID NO: 2808700 - DNA, 18 bp, Homo sapiens
tgacagagcaagactctg

SEQ ID NO: 2808701 - DNA, 21 bp, Homo sapiens
tgacagagcaagactctgtct

SEQ ID NO: 2808702 - DNA, 17 bp, Homo sapiens
tgacagaggcagcccca

SEQ ID NO: 2808703 - DNA, 18 bp, Homo sapiens
tgacagaggcagccccat

SEQ ID NO: 2808704 - DNA, 17 bp, Homo sapiens
tgacagagtgagactct

SEQ ID NO: 2808705 - DNA, 22 bp, Homo sapiens
tgacagagtgagactctgtctc

SEQ ID NO: 2808706 - DNA, 14 bp, Homo sapiens
tgacagcaggtggg

SEQ ID NO: 2808707 - DNA, 11 bp, Homo sapiens
tgacagccaga

SEQ ID NO: 2808708 - DNA, 16 bp, Homo sapiens
tgacagctgtccctgt

SEQ ID NO: 2808709 - DNA, 18 bp, Homo sapiens
tgacagctgtccctgtca

SEQ ID NO: 2808710 - DNA, 20 bp, Homo sapiens
tgacagctgtccctgtcacc

SEQ ID NO: 2808711 - DNA, 23 bp, Homo sapiens
tgacaggaagcccaaggcagtgt

SEQ ID NO: 2808712 - DNA, 11 bp, Homo sapiens
tgacagggcac

SEQ ID NO: 2808713 - DNA, 15 bp, Homo sapiens
tgacaggtaaactat

SEQ ID NO: 2808714 - DNA, 22 bp, Homo sapiens
tgacagtccgtcaaaacagatt

SEQ ID NO: 2808715 - DNA, 18 bp, Homo sapiens
tgacagtggaactacatt

SEQ ID NO: 2808716 - DNA, 17 bp, Homo sapiens
tgacataacactataaa

SEQ ID NO: 2808717 - DNA, 15 bp, Homo sapiens
tgacataataaagac

SEQ ID NO: 2808718 - DNA, 13 bp, Homo sapiens
tgacatcacttgt

SEQ ID NO: 2808719 - DNA, 22 bp, Homo sapiens
tgaccaaaagttacatgtttgc

SEQ ID NO: 2808720 - DNA, 16 bp, Homo sapiens
tgaccaacatggagaa

SEQ ID NO: 2808721 - DNA, 15 bp, Homo sapiens
tgaccaagagagaaa

SEQ ID NO: 2808722 - DNA, 16 bp, Homo sapiens
tgaccaagagagaaag

SEQ ID NO: 2808723 - DNA, 17 bp, Homo sapiens
tgaccaagagagaaaga

SEQ ID NO: 2808724 - DNA, 18 bp, Homo sapiens
tgaccaagagagaaagaa

SEQ ID NO: 2808725 - DNA, 23 bp, Homo sapiens
tgaccacggacgtttccatcagg

SEQ ID NO: 2808726 - DNA, 16 bp, Homo sapiens
tgaccaggcatcctcc

SEQ ID NO: 2808727 - DNA, 20 bp, Homo sapiens
tgaccaggctcacaactgtt

SEQ ID NO: 2808728 - DNA, 22 bp, Homo sapiens
tgaccaggggtgatttcagaga

SEQ ID NO: 2808729 - DNA, 15 bp, Homo sapiens
tgaccatcctgtcct

SEQ ID NO: 2808730 - DNA, 18 bp, Homo sapiens
tgaccatctgtttgagaa

SEQ ID NO: 2808731 - DNA, 19 bp, Homo sapiens
tgacccacagcctctgcct

SEQ ID NO: 2808732 - DNA, 23 bp, Homo sapiens
tgacccagccccttgagaaacct

SEQ ID NO: 2808733 - DNA, 21 bp, Homo sapiens
tgacccagtccccgtgccccg

SEQ ID NO: 2808734 - DNA, 16 bp, Homo sapiens
tgacccagtccctggg

SEQ ID NO: 2808735 - DNA, 22 bp, Homo sapiens
tgaccccaaagagcctggagaa

SEQ ID NO: 2808736 - DNA, 19 bp, Homo sapiens
tgacccggcaccccctgca

SEQ ID NO: 2808737 - DNA, 20 bp, Homo sapiens
tgacccggcaccccctgcag

SEQ ID NO: 2808738 - DNA, 21 bp, Homo sapiens
tgaccctcctgtccagcaggt

SEQ ID NO: 2808739 - DNA, 22 bp, Homo sapiens
tgaccctctgaatggtccaggg

SEQ ID NO: 2808740 - DNA, 20 bp, Homo sapiens
tgaccctgcgaaggggccct

SEQ ID NO: 2808741 - DNA, 22 bp, Homo sapiens
tgaccctgcgaaggggccctgg

SEQ ID NO: 2808742 - DNA, 21 bp, Homo sapiens
tgacctcaagatgtcctcctt

SEQ ID NO: 2808743 - DNA, 15 bp, Homo sapiens
tgacctcccagccct

SEQ ID NO: 2808744 - DNA, 17 bp, Homo sapiens
tgacctcctcctgccct

SEQ ID NO: 2808745 - DNA, 18 bp, Homo sapiens
tgacctcctcctgccctc

SEQ ID NO: 2808746 - DNA, 18 bp, Homo sapiens
tgacctcgtgatccaccc

SEQ ID NO: 2808747 - DNA, 14 bp, Homo sapiens
tgacctctgcctga

SEQ ID NO: 2808748 - DNA, 11 bp, Homo sapiens
tgacctgctga

SEQ ID NO: 2808749 - DNA, 13 bp, Homo sapiens
tgacctgctgagc

SEQ ID NO: 2808750 - DNA, 16 bp, Homo sapiens
tgacctgctgagctct

SEQ ID NO: 2808751 - DNA, 22 bp, Homo sapiens
tgacctgctgagctctgagagg

SEQ ID NO: 2808752 - DNA, 20 bp, Homo sapiens
tgaccttttgacttaaagca

SEQ ID NO: 2808753 - DNA, 19 bp, Homo sapiens
tgacggtcccacactggtg

SEQ ID NO: 2808754 - DNA, 21 bp, Homo sapiens
tgacggtcccacactggtgac

SEQ ID NO: 2808755 - DNA, 18 bp, Homo sapiens
tgacgtgcacctgtactc

SEQ ID NO: 2808756 - DNA, 19 bp, Homo sapiens
tgacgtgcacctgtactca

SEQ ID NO: 2808757 - DNA, 22 bp, Homo sapiens
tgactaaaaatattataactta

SEQ ID NO: 2808758 - DNA, 17 bp, Homo sapiens
tgactagaccccaccct

SEQ ID NO: 2808759 - DNA, 21 bp, Homo sapiens
tgactataaacattaaaagaa

SEQ ID NO: 2808760 - DNA, 17 bp, Homo sapiens
tgactatcacatacaat

SEQ ID NO: 2808761 - DNA, 19 bp, Homo sapiens
tgactcaagtttttacaaa

SEQ ID NO: 2808762 - DNA, 19 bp, Homo sapiens
tgactcacaagaagaccag

SEQ ID NO: 2808763 - DNA, 11 bp, Homo sapiens
tgactcaccca

SEQ ID NO: 2808764 - DNA, 22 bp, Homo sapiens
tgactccttagagacatcaaaa

SEQ ID NO: 2808765 - DNA, 21 bp, Homo sapiens
tgactccttgtggtttatgtc

SEQ ID NO: 2808766 - DNA, 21 bp, Homo sapiens
tgactcgagggttgggttcat

SEQ ID NO: 2808767 - DNA, 21 bp, Homo sapiens
tgactcgtatatgtctcaggt

SEQ ID NO: 2808768 - DNA, 20 bp, Homo sapiens
tgactcttgcctttccacct

SEQ ID NO: 2808769 - DNA, 20 bp, Homo sapiens
tgactcttgttttcagtttc

SEQ ID NO: 2808770 - DNA, 17 bp, Homo sapiens
tgactgcgatcttcaga

SEQ ID NO: 2808771 - DNA, 15 bp, Homo sapiens
tgactgctgattctc

SEQ ID NO: 2808772 - DNA, 21 bp, Homo sapiens
tgactgtaaacatagatagtg

SEQ ID NO: 2808773 - DNA, 17 bp, Homo sapiens
tgactgtcactgttcct

SEQ ID NO: 2808774 - DNA, 18 bp, Homo sapiens
tgactgtgttcagtgcct

SEQ ID NO: 2808775 - DNA, 19 bp, Homo sapiens
tgactgtgttcagtgcctt

SEQ ID NO: 2808776 - DNA, 20 bp, Homo sapiens
tgactgtttttcggacagtt

SEQ ID NO: 2808777 - DNA, 21 bp, Homo sapiens
tgacttcctcgcctctcccac

SEQ ID NO: 2808778 - DNA, 19 bp, Homo sapiens
tgacttgacagaacactgt

SEQ ID NO: 2808779 - DNA, 17 bp, Homo sapiens
tgacttgggcaccccca

SEQ ID NO: 2808780 - DNA, 14 bp, Homo sapiens
tgactttagaaaca

SEQ ID NO: 2808781 - DNA, 13 bp, Homo sapiens
tgactttcaggta

SEQ ID NO: 2808782 - DNA, 16 bp, Homo sapiens
tgactttgctctttct

SEQ ID NO: 2808783 - DNA, 15 bp, Homo sapiens
tgatgtccagaagaa

SEQ ID NO: 2808784 - DNA, 17 bp, Homo sapiens
tgatgtgagtgtgtgtg

SEQ ID NO: 2808785 - DNA, 14 bp, Homo sapiens
tgatgttaaaaaaa

SEQ ID NO: 2808786 - DNA, 17 bp, Homo sapiens
tgatgttaaaattccat

SEQ ID NO: 2808787 - DNA, 14 bp, Homo sapiens
tgatgtttccagaa

SEQ ID NO: 2808788 - DNA, 15 bp, Homo sapiens
tgatgtttccagaaa

SEQ ID NO: 2808789 - DNA, 17 bp, Homo sapiens
tgatgtttccagaaaat

SEQ ID NO: 2808790 - DNA, 17 bp, Homo sapiens
tgattaaacacctgaca

SEQ ID NO: 2808791 - DNA, 21 bp, Homo sapiens
tgattaaacacctgacacatc

SEQ ID NO: 2808792 - DNA, 15 bp, Homo sapiens
tgattaaacagactt

SEQ ID NO: 2808793 - DNA, 13 bp, Homo sapiens
tgattacacagtt

SEQ ID NO: 2808794 - DNA, 18 bp, Homo sapiens
tgattacataatcaaagc

SEQ ID NO: 2808795 - DNA, 13 bp, Homo sapiens
tgattcataacaa

SEQ ID NO: 2808796 - DNA, 16 bp, Homo sapiens
tgattcccaagctctg

SEQ ID NO: 2808797 - DNA, 18 bp, Homo sapiens
tgattcccaagctctgct

SEQ ID NO: 2808798 - DNA, 21 bp, Homo sapiens
tgattcccaagctctgctcct

SEQ ID NO: 2808799 - DNA, 16 bp, Homo sapiens
tgattgacacacagca

SEQ ID NO: 2808800 - DNA, 12 bp, Homo sapiens
tgattggctcac

SEQ ID NO: 2808801 - DNA, 18 bp, Homo sapiens
tgattgtcttaatattgt

SEQ ID NO: 2808802 - DNA, 15 bp, Homo sapiens
tgattgtttaattgt

SEQ ID NO: 2808803 - DNA, 12 bp, Homo sapiens
tgatttaaaaaa

SEQ ID NO: 2808804 - DNA, 15 bp, Homo sapiens
tgatttaaaaaataa

SEQ ID NO: 2808805 - DNA, 17 bp, Homo sapiens
tgatttcaatgattgtt

SEQ ID NO: 2808806 - DNA, 11 bp, Homo sapiens
tgatttcagga

SEQ ID NO: 2808807 - DNA, 23 bp, Homo sapiens
tgatttcaggatactctgtcaga

SEQ ID NO: 2808808 - DNA, 13 bp, Homo sapiens
tgatttcatttca

SEQ ID NO: 2808809 - DNA, 14 bp, Homo sapiens
tgatttccaaagag

SEQ ID NO: 2808810 - DNA, 15 bp, Homo sapiens
tgattttaaaaggtt

SEQ ID NO: 2808811 - DNA, 16 bp, Homo sapiens
tgattttaaaaggttg

SEQ ID NO: 2808812 - DNA, 15 bp, Homo sapiens
tgattttagccttct

SEQ ID NO: 2808813 - DNA, 19 bp, Homo sapiens
tgattttagccttctctgt

SEQ ID NO: 2808814 - DNA, 18 bp, Homo sapiens
tgattttagctgcagaac

SEQ ID NO: 2808815 - DNA, 18 bp, Homo sapiens
tgattttatacatagtca

SEQ ID NO: 2808816 - DNA, 13 bp, Homo sapiens
tgattttcatcaa

SEQ ID NO: 2808817 - DNA, 12 bp, Homo sapiens
tgattttgtaca

SEQ ID NO: 2808818 - DNA, 14 bp, Homo sapiens
tgattttgtacaga

SEQ ID NO: 2808819 - DNA, 17 bp, Homo sapiens
tgattttgtacagaatt

SEQ ID NO: 2808820 - DNA, 14 bp, Homo sapiens
tgatttttgttgat

SEQ ID NO: 2808821 - DNA, 23 bp, Homo sapiens
tgcaaacacacaaaggtataatt

SEQ ID NO: 2808822 - DNA, 17 bp, Homo sapiens
tgcaaatactccaagct

SEQ ID NO: 2808823 - DNA, 13 bp, Homo sapiens
tgcaacaaaattc

SEQ ID NO: 2808824 - DNA, 13 bp, Homo sapiens
tgcaacaacatgt

SEQ ID NO: 2808825 - DNA, 15 bp, Homo sapiens
tgcaacaacatgtat

SEQ ID NO: 2808826 - DNA, 21 bp, Homo sapiens
tgcaacctccgcctcttgggt

SEQ ID NO: 2808827 - DNA, 17 bp, Homo sapiens
tgcaacttctttttatt

SEQ ID NO: 2808828 - DNA, 17 bp, Homo sapiens
tgcaagatttaacacta

SEQ ID NO: 2808829 - DNA, 18 bp, Homo sapiens
tgcaagatttaacactaa

SEQ ID NO: 2808830 - DNA, 15 bp, Homo sapiens
tgcaaggaaggaaag

SEQ ID NO: 2808831 - DNA, 22 bp, Homo sapiens
tgcaaggccctctatttctctc

SEQ ID NO: 2808832 - DNA, 24 bp, Homo sapiens
tgcaaggccgctgttcacccacag

SEQ ID NO: 2808833 - DNA, 15 bp, Homo sapiens
tgcaagtactgctgt

SEQ ID NO: 2808834 - DNA, 22 bp, Homo sapiens
tgcaatctccagggctgcccct

SEQ ID NO: 2808835 - DNA, 16 bp, Homo sapiens
tgcaatgacatcttca

SEQ ID NO: 2808836 - DNA, 17 bp, Homo sapiens
tgcaatgacatcttcaa

SEQ ID NO: 2808837 - DNA, 15 bp, Homo sapiens
tgcaatggcagcctt

SEQ ID NO: 2808838 - DNA, 23 bp, Homo sapiens
tgcaattattctaattttatata

SEQ ID NO: 2808839 - DNA, 19 bp, Homo sapiens
tgcaatttttaaactagta

SEQ ID NO: 2808840 - DNA, 22 bp, Homo sapiens
tgcaatttttaaactagtaatg

SEQ ID NO: 2808841 - DNA, 17 bp, Homo sapiens
tgcacaagcttgtatat

SEQ ID NO: 2808842 - DNA, 20 bp, Homo sapiens
tgcacaagcttgtatataca

SEQ ID NO: 2808843 - DNA, 21 bp, Homo sapiens
tgcacaagcttgtatatacat

SEQ ID NO: 2808844 - DNA, 23 bp, Homo sapiens
tgcacaagcttgtatatacatat

SEQ ID NO: 2808845 - DNA, 17 bp, Homo sapiens
tgcacaatttagaaaac

SEQ ID NO: 2808846 - DNA, 18 bp, Homo sapiens
tgcacaatttagaaaaca

SEQ ID NO: 2808847 - DNA, 20 bp, Homo sapiens
tgcacaatttagaaaacatt

SEQ ID NO: 2808848 - DNA, 11 bp, Homo sapiens
tgcacaatttg

SEQ ID NO: 2808849 - DNA, 14 bp, Homo sapiens
tgcacagcccacac

SEQ ID NO: 2808850 - DNA, 19 bp, Homo sapiens
tgcacatatggactctgca

SEQ ID NO: 2808851 - DNA, 23 bp, Homo sapiens
tgcacatgaatcccacccacatg

SEQ ID NO: 2808852 - DNA, 13 bp, Homo sapiens
tgcacatttatat

SEQ ID NO: 2808853 - DNA, 22 bp, Homo sapiens
tgcacatttatatatatatgta

SEQ ID NO: 2808854 - DNA, 19 bp, Homo sapiens
tgcaccagcccttccctgc

SEQ ID NO: 2808855 - DNA, 22 bp, Homo sapiens
tgcaccagcccttccctgcttt

SEQ ID NO: 2808856 - DNA, 22 bp, Homo sapiens
tgcacccgtacccccgtggtct

SEQ ID NO: 2808857 - DNA, 15 bp, Homo sapiens
tgcacctaaagaaaa

SEQ ID NO: 2808858 - DNA, 19 bp, Homo sapiens
tgcacctaaagaaaaacaa

SEQ ID NO: 2808859 - DNA, 20 bp, Homo sapiens
tgcacctgccagcctggctt

SEQ ID NO: 2808860 - DNA, 20 bp, Homo sapiens
  misc_feature (10)..(10): n is a, c, g or t
tgcacctgcnttgtccctgg

SEQ ID NO: 2808861 - DNA, 17 bp, Homo sapiens
tgcacctgtactcagga

SEQ ID NO: 2808862 - DNA, 19 bp, Homo sapiens
tgcacgtacacacacatac

SEQ ID NO: 2808863 - DNA, 15 bp, Homo sapiens
tgcactcagcttttt

SEQ ID NO: 2808864 - DNA, 20 bp, Homo sapiens
tgcactccagcctgggcaac

SEQ ID NO: 2808865 - DNA, 19 bp, Homo sapiens
tgcactccagcctgggcga

SEQ ID NO: 2808866 - DNA, 15 bp, Homo sapiens
tgcactctagcctgg

SEQ ID NO: 2808867 - DNA, 21 bp, Homo sapiens
tgcactgacattgttggccaa

SEQ ID NO: 2808868 - DNA, 12 bp, Homo sapiens
tgcactgagggc

SEQ ID NO: 2808869 - DNA, 16 bp, Homo sapiens
tgcactgagggccaca

SEQ ID NO: 2808870 - DNA, 17 bp, Homo sapiens
tgcactgagggccacac

SEQ ID NO: 2808871 - DNA, 19 bp, Homo sapiens
tgcactgagggccacacta

SEQ ID NO: 2808872 - DNA, 15 bp, Homo sapiens
tgcactggccccacc

SEQ ID NO: 2808873 - DNA, 19 bp, Homo sapiens
tgcactggtcccaagtagt

SEQ ID NO: 2808874 - DNA, 22 bp, Homo sapiens
tgccctgagtggatctccaagg

SEQ ID NO: 2808875 - DNA, 15 bp, Homo sapiens
tgccctgccacctgt

SEQ ID NO: 2808876 - DNA, 11 bp, Homo sapiens
tgccctgctgc

SEQ ID NO: 2808877 - DNA, 23 bp, Homo sapiens
tgccctgctgccgcctcccagcc

SEQ ID NO: 2808878 - DNA, 12 bp, Homo sapiens
tgccctgtcctc

SEQ ID NO: 2808879 - DNA, 13 bp, Homo sapiens
tgccctgtcctcc

SEQ ID NO: 2808880 - DNA, 17 bp, Homo sapiens
tgccctgtcctccagct

SEQ ID NO: 2808881 - DNA, 20 bp, Homo sapiens
tgccctgttgtgtatagatg

SEQ ID NO: 2808882 - DNA, 14 bp, Homo sapiens
tgcccttaaaataa

SEQ ID NO: 2808883 - DNA, 19 bp, Homo sapiens
tgcccttaaaataatgatt

SEQ ID NO: 2808884 - DNA, 17 bp, Homo sapiens
tgcccttcacagtgttt

SEQ ID NO: 2808885 - DNA, 14 bp, Homo sapiens
tgcccttctttcta

SEQ ID NO: 2808886 - DNA, 21 bp, Homo sapiens
tgcccttctttctaccctgct

SEQ ID NO: 2808887 - DNA, 14 bp, Homo sapiens
tgcccttgccctga

SEQ ID NO: 2808888 - DNA, 23 bp, Homo sapiens
tgcccttgtttggggcaggagta

SEQ ID NO: 2808889 - DNA, 24 bp, Homo sapiens
tgcccttgtttggggcaggagtag

SEQ ID NO: 2808890 - DNA, 15 bp, Homo sapiens
tgccgacctcgtcct

SEQ ID NO: 2808891 - DNA, 22 bp, Homo sapiens
tgccgacctcgtcctccccctg

SEQ ID NO: 2808892 - DNA, 19 bp, Homo sapiens
tgccgagcaaccgtggccc

SEQ ID NO: 2808893 - DNA, 16 bp, Homo sapiens
tgccgcctcccagcct

SEQ ID NO: 2808894 - DNA, 12 bp, Homo sapiens
tgccgctcttct

SEQ ID NO: 2808895 - DNA, 13 bp, Homo sapiens
tgccgctcttctg

SEQ ID NO: 2808896 - DNA, 14 bp, Homo sapiens
tgccgggttttata

SEQ ID NO: 2808897 - DNA, 18 bp, Homo sapiens
tgccgggttttatatttt

SEQ ID NO: 2808898 - DNA, 15 bp, Homo sapiens
tgcctaaatccaaag

SEQ ID NO: 2808899 - DNA, 16 bp, Homo sapiens
tgcctaaatccaaaga

SEQ ID NO: 2808900 - DNA, 17 bp, Homo sapiens
tgcctaaatccaaagaa

SEQ ID NO: 2808901 - DNA, 18 bp, Homo sapiens
tgcctaataaacatcctt

SEQ ID NO: 2808902 - DNA, 14 bp, Homo sapiens
tgcctacagataat

SEQ ID NO: 2808903 - DNA, 15 bp, Homo sapiens
tgcctatccatcctg

SEQ ID NO: 2808904 - DNA, 12 bp, Homo sapiens
tgcctcaaataa

SEQ ID NO: 2808905 - DNA, 21 bp, Homo sapiens
tgcctcaaataaaaagtgctt

SEQ ID NO: 2808906 - DNA, 22 bp, Homo sapiens
tgcctcaatgtgaatcagaccc

SEQ ID NO: 2808907 - DNA, 14 bp, Homo sapiens
tgcctcatgaccct

SEQ ID NO: 2808908 - DNA, 19 bp, Homo sapiens
tgcctcatgaccctcctgt

SEQ ID NO: 2808909 - DNA, 18 bp, Homo sapiens
tgcctcatgctgacttgc

SEQ ID NO: 2808910 - DNA, 11 bp, Homo sapiens
tgcctccaccg

SEQ ID NO: 2808911 - DNA, 18 bp, Homo sapiens
tgcctccaccgctgccta

SEQ ID NO: 2808912 - DNA, 12 bp, Homo sapiens
tgcctcctcacc

SEQ ID NO: 2808913 - DNA, 18 bp, Homo sapiens
tgcctcgaactggctgca

SEQ ID NO: 2808914 - DNA, 13 bp, Homo sapiens
tgcctctcccgca

SEQ ID NO: 2808915 - DNA, 21 bp, Homo sapiens
tgcctctgacacacagctctg

SEQ ID NO: 2808916 - DNA, 22 bp, Homo sapiens
tgcctctgacacacagctctgt

SEQ ID NO: 2808917 - DNA, 14 bp, Homo sapiens
tgcctctgactcac

SEQ ID NO: 2808918 - DNA, 11 bp, Homo sapiens
tgcctctgagg

SEQ ID NO: 2808919 - DNA, 13 bp, Homo sapiens
tgcctctgaggcc

SEQ ID NO: 2808920 - DNA, 16 bp, Homo sapiens
tgcctctgaggccagc

SEQ ID NO: 2808921 - DNA, 17 bp, Homo sapiens
tgcctctgaggccagcc

SEQ ID NO: 2808922 - DNA, 18 bp, Homo sapiens
tgcctctgaggccagcct

SEQ ID NO: 2808923 - DNA, 19 bp, Homo sapiens
tgcctctgaggccagcctg

SEQ ID NO: 2808924 - DNA, 23 bp, Homo sapiens
tgcctctgaggccagcctggcct

SEQ ID NO: 2808925 - DNA, 11 bp, Homo sapiens
tgcctctgcct

SEQ ID NO: 2808926 - DNA, 14 bp, Homo sapiens
tgcctctgcctctg

SEQ ID NO: 2808927 - DNA, 15 bp, Homo sapiens
tgcctctgcctctga

SEQ ID NO: 2808928 - DNA, 17 bp, Homo sapiens
tgcctctgcctctgaca

SEQ ID NO: 2808929 - DNA, 20 bp, Homo sapiens
tgcctctgcctctgacacac

SEQ ID NO: 2808930 - DNA, 14 bp, Homo sapiens
tgcctctgcctgtc

SEQ ID NO: 2808931 - DNA, 14 bp, Homo sapiens
tgcctctttcctgt

SEQ ID NO: 2808932 - DNA, 22 bp, Homo sapiens
tgcctgaatccatcaggacttg

SEQ ID NO: 2808933 - DNA, 18 bp, Homo sapiens
tgcctgagggtggagact

SEQ ID NO: 2808934 - DNA, 17 bp, Homo sapiens
tgcctgcacccttcctc

SEQ ID NO: 2808935 - DNA, 19 bp, Homo sapiens
tgcctgcacccttcctcct

SEQ ID NO: 2808936 - DNA, 18 bp, Homo sapiens
tgcctgcagagagaagcc

SEQ ID NO: 2808937 - DNA, 14 bp, Homo sapiens
tgcctgcccaggcc

SEQ ID NO: 2808938 - DNA, 15 bp, Homo sapiens
tgcctgcccaggccc

SEQ ID NO: 2808939 - DNA, 16 bp, Homo sapiens
tgcctgcccaggcccc

SEQ ID NO: 2808940 - DNA, 18 bp, Homo sapiens
tgcctgcccaggcccctg

SEQ ID NO: 2808941 - DNA, 10 bp, Homo sapiens
tgcctgctga

SEQ ID NO: 2808942 - DNA, 20 bp, Homo sapiens
tgcctggaggacctgagcct

SEQ ID NO: 2808943 - DNA, 19 bp, Homo sapiens
tgcctggcccccctccagg

SEQ ID NO: 2808944 - DNA, 21 bp, Homo sapiens
tgcctggcccccctccaggca

SEQ ID NO: 2808945 - DNA, 16 bp, Homo sapiens
tgcctgggtggggctg

SEQ ID NO: 2808946 - DNA, 17 bp, Homo sapiens
tgcctgggtggggctgc

SEQ ID NO: 2808947 - DNA, 23 bp, Homo sapiens
tgcctgggtggggctgctcctcc

SEQ ID NO: 2808948 - DNA, 24 bp, Homo sapiens
tgcctgggtggggctgctcctcca

SEQ ID NO: 2808949 - DNA, 21 bp, Homo sapiens
tgcctgtagccccagtgacag

SEQ ID NO: 2808950 - DNA, 22 bp, Homo sapiens
tgcctgtagccccagtgacagc

SEQ ID NO: 2808951 - DNA, 15 bp, Homo sapiens
tgcctgtagttagga

SEQ ID NO: 2808952 - DNA, 19 bp, Homo sapiens
tgcctgtagttaggaaata

SEQ ID NO: 2808953 - DNA, 21 bp, Homo sapiens
tgcctgtagttaggaaataaa

SEQ ID NO: 2808954 - DNA, 14 bp, Homo sapiens
tgcctgtgaggcag

SEQ ID NO: 2808955 - DNA, 16 bp, Homo sapiens
tgcctgtgaggcaggg

SEQ ID NO: 2808956 - DNA, 17 bp, Homo sapiens
tgcctgtgaggcagggg

SEQ ID NO: 2808957 - DNA, 17 bp, Homo sapiens
tgcctgtgtgagcatct

SEQ ID NO: 2808958 - DNA, 23 bp, Homo sapiens
tgcctgtgtgagcatctctgtgt

SEQ ID NO: 2808959 - DNA, 20 bp, Homo sapiens
tgcctgttcagctccagctc

SEQ ID NO: 2808960 - DNA, 21 bp, Homo sapiens
tgcctgttcagctccagctca

SEQ ID NO: 2808961 - DNA, 17 bp, Homo sapiens
tgccttacctcctgccc

SEQ ID NO: 2808962 - DNA, 17 bp, Homo sapiens
tgccttagcacttcttt

SEQ ID NO: 2808963 - DNA, 13 bp, Homo sapiens
tgccttccataat

SEQ ID NO: 2808964 - DNA, 21 bp, Homo sapiens
tgccttccataattatgacag

SEQ ID NO: 2808965 - DNA, 19 bp, Homo sapiens
tggcagaataatctttggg

SEQ ID NO: 2808966 - DNA, 20 bp, Homo sapiens
tggcagaataatctttgggt

SEQ ID NO: 2808967 - DNA, 22 bp, Homo sapiens
tggcagaatggggtgcatgaag

SEQ ID NO: 2808968 - DNA, 19 bp, Homo sapiens
tggcagataatcagcctct

SEQ ID NO: 2808969 - DNA, 15 bp, Homo sapiens
tggcagatgtaggag

SEQ ID NO: 2808970 - DNA, 18 bp, Homo sapiens
tggcagatgtaggaggga

SEQ ID NO: 2808971 - DNA, 22 bp, Homo sapiens
tggcagatttagtgaaagctag

SEQ ID NO: 2808972 - DNA, 11 bp, Homo sapiens
tggcagccctg

SEQ ID NO: 2808973 - DNA, 12 bp, Homo sapiens
tggcagccctgt

SEQ ID NO: 2808974 - DNA, 13 bp, Homo sapiens
tggcagccttggc

SEQ ID NO: 2808975 - DNA, 14 bp, Homo sapiens
tggcaggaccagga

SEQ ID NO: 2808976 - DNA, 22 bp, Homo sapiens
tggcaggatgaccctgcgaagg

SEQ ID NO: 2808977 - DNA, 20 bp, Homo sapiens
tggcagtccagccagctcct

SEQ ID NO: 2808978 - DNA, 16 bp, Homo sapiens
tggcagtgggagctgc

SEQ ID NO: 2808979 - DNA, 22 bp, Homo sapiens
tggcagtgtgtcacactgagct

SEQ ID NO: 2808980 - DNA, 18 bp, Homo sapiens
tggcatgcttaaatattg

SEQ ID NO: 2808981 - DNA, 12 bp, Homo sapiens
tggcatgtgttt

SEQ ID NO: 2808982 - DNA, 19 bp, Homo sapiens
tggcattacagctggagaa

SEQ ID NO: 2808983 - DNA, 21 bp, Homo sapiens
tggccaaagccaaagctaggc

SEQ ID NO: 2808984 - DNA, 23 bp, Homo sapiens
tggccaaagccaaagctaggcct

SEQ ID NO: 2808985 - DNA, 13 bp, Homo sapiens
tggccaagctgag

SEQ ID NO: 2808986 - DNA, 21 bp, Homo sapiens
tggccaagctgaggtgcccag

SEQ ID NO: 2808987 - DNA, 21 bp, Homo sapiens
tggccacttgggtcttccctg

SEQ ID NO: 2808988 - DNA, 15 bp, Homo sapiens
tggccagagagtggg

SEQ ID NO: 2808989 - DNA, 18 bp, Homo sapiens
tggccagatgcaccagcc

SEQ ID NO: 2808990 - DNA, 20 bp, Homo sapiens
tggccagatgcaccagccct

SEQ ID NO: 2808991 - DNA, 21 bp, Homo sapiens
tggccagatgcaccagccctt

SEQ ID NO: 2808992 - DNA, 13 bp, Homo sapiens
tggccaggctggt

SEQ ID NO: 2808993 - DNA, 16 bp, Homo sapiens
tggccagtgtgatccc

SEQ ID NO: 2808994 - DNA, 18 bp, Homo sapiens
tggccatgcttcttgccc

SEQ ID NO: 2808995 - DNA, 21 bp, Homo sapiens
tggccatgcttcttgcccctt

SEQ ID NO: 2808996 - DNA, 14 bp, Homo sapiens
tggcccaaatccag

SEQ ID NO: 2808997 - DNA, 19 bp, Homo sapiens
tggccccatgtctctcaga

SEQ ID NO: 2808998 - DNA, 14 bp, Homo sapiens
tggcccccctccag

SEQ ID NO: 2808999 - DNA, 16 bp, Homo sapiens
tggcccccctccaggc

SEQ ID NO: 2809000 - DNA, 16 bp, Homo sapiens
tggcccctgcccggct

SEQ ID NO: 2809001 - DNA, 11 bp, Homo sapiens
tggccctgcct

SEQ ID NO: 2809002 - DNA, 17 bp, Homo sapiens
tggccctggcctgctgg

SEQ ID NO: 2809003 - DNA, 19 bp, Homo sapiens
tggcccttcccactggagg

SEQ ID NO: 2809004 - DNA, 15 bp, Homo sapiens
tggcccttcctggac

SEQ ID NO: 2809005 - DNA, 18 bp, Homo sapiens
tggccgactcagggacct

SEQ ID NO: 2809006 - DNA, 17 bp, Homo sapiens
tggccgcctccaggagc

SEQ ID NO: 2809007 - DNA, 17 bp, Homo sapiens
tggccgtggtccagctc

SEQ ID NO: 2809008 - DNA, 19 bp, Homo sapiens
tggccgtggtccagctctt

SEQ ID NO: 2809009 - DNA, 23 bp, Homo sapiens
tggccgtggtccagctcttggcc

SEQ ID NO: 2809010 - DNA, 15 bp, Homo sapiens
tggcctatgcacata

SEQ ID NO: 2809011 - DNA, 23 bp, Homo sapiens
tggcctcaagtgattctcctgcc

SEQ ID NO: 2809012 - DNA, 16 bp, Homo sapiens
tggcctcagaccaact

SEQ ID NO: 2809013 - DNA, 17 bp, Homo sapiens
tggcctcccaataaagc

SEQ ID NO: 2809014 - DNA, 22 bp, Homo sapiens
tggcctcccaataaagctggac

SEQ ID NO: 2809015 - DNA, 16 bp, Homo sapiens
tggcctcctgcctcta

SEQ ID NO: 2809016 - DNA, 21 bp, Homo sapiens
tggcctcctgcctctactggg

SEQ ID NO: 2809017 - DNA, 14 bp, Homo sapiens
tggcctgcactaat

SEQ ID NO: 2809018 - DNA, 21 bp, Homo sapiens
tggcctggatctccccactct

SEQ ID NO: 2809019 - DNA, 15 bp, Homo sapiens
tggcctggctctcct

SEQ ID NO: 2809020 - DNA, 23 bp, Homo sapiens
tggcctggtggccatgtcgcctg

SEQ ID NO: 2809021 - DNA, 23 bp, Homo sapiens
tggcggctactcagcagccctcc

SEQ ID NO: 2809022 - DNA, 19 bp, Homo sapiens
tggcgttctgctgcccctg

SEQ ID NO: 2809023 - DNA, 17 bp, Homo sapiens
tggctaattcaatttat

SEQ ID NO: 2809024 - DNA, 15 bp, Homo sapiens
tggctaattcccaga

SEQ ID NO: 2809025 - DNA, 13 bp, Homo sapiens
tggctatgttttt

SEQ ID NO: 2809026 - DNA, 18 bp, Homo sapiens
tggctcaagtcctctttt

SEQ ID NO: 2809027 - DNA, 23 bp, Homo sapiens
tggctcacgcctataatcccagc

SEQ ID NO: 2809028 - DNA, 13 bp, Homo sapiens
tggctcacgcctg

SEQ ID NO: 2809029 - DNA, 16 bp, Homo sapiens
tggctcacgcctgtaa

SEQ ID NO: 2809030 - DNA, 13 bp, Homo sapiens
tggctcctccagg

SEQ ID NO: 2809031 - DNA, 13 bp, Homo sapiens
tggctctgtgaaa

SEQ ID NO: 2809032 - DNA, 13 bp, Homo sapiens
tggctgagggcag

SEQ ID NO: 2809033 - DNA, 14 bp, Homo sapiens
tggctgagggcagt

SEQ ID NO: 2809034 - DNA, 23 bp, Homo sapiens
tggctgagggcagttcgcagcca

SEQ ID NO: 2809035 - DNA, 13 bp, Homo sapiens
tggctgcagggag

SEQ ID NO: 2809036 - DNA, 15 bp, Homo sapiens
tggctgcagggagtc

SEQ ID NO: 2809037 - DNA, 19 bp, Homo sapiens
tggctgcataaatgtggta

SEQ ID NO: 2809038 - DNA, 14 bp, Homo sapiens
tggctgctagcact

SEQ ID NO: 2809039 - DNA, 15 bp, Homo sapiens
tggctgctagcactt

SEQ ID NO: 2809040 - DNA, 13 bp, Homo sapiens
tggctggctgagg

SEQ ID NO: 2809041 - DNA, 15 bp, Homo sapiens
tggctggctgagggc

SEQ ID NO: 2809042 - DNA, 17 bp, Homo sapiens
tggctggctgagggcag

SEQ ID NO: 2809043 - DNA, 18 bp, Homo sapiens
tggctggctgagggcagt

SEQ ID NO: 2809044 - DNA, 15 bp, Homo sapiens
tggctgggggcctca

SEQ ID NO: 2809045 - DNA, 21 bp, Homo sapiens
tggctggggtgggggtgggga

SEQ ID NO: 2809046 - DNA, 14 bp, Homo sapiens
tggctgtattcaga

SEQ ID NO: 2809047 - DNA, 22 bp, Homo sapiens
tggctgtctctgtccctcactg

SEQ ID NO: 2809048 - DNA, 22 bp, Homo sapiens
tggctgtgcctctgcctgtctc

SEQ ID NO: 2809049 - DNA, 13 bp, Homo sapiens
tggctgttggctg

SEQ ID NO: 2809050 - DNA, 16 bp, Homo sapiens
tggctgttggctgggg

SEQ ID NO: 2809051 - DNA, 23 bp, Homo sapiens
tggctgttggctgggggcctcag

SEQ ID NO: 2809052 - DNA, 19 bp, Homo sapiens
tggcttattttttaaaata

SEQ ID NO: 2809053 - DNA, 18 bp, Homo sapiens
tggcttcccatccccagc

SEQ ID NO: 2809054 - DNA, 17 bp, Homo sapiens
tggcttcccatgtcttt

SEQ ID NO: 2809055 - DNA, 17 bp, Homo sapiens
tgggaaataagagagaa

SEQ ID NO: 2809056 - DNA, 14 bp, Homo sapiens
tgtagcctgtgcat

SEQ ID NO: 2809057 - DNA, 20 bp, Homo sapiens
tgtagcctgtgcatgtatgt

SEQ ID NO: 2809058 - DNA, 23 bp, Homo sapiens
tgtagccttgccttttaaaagaa

SEQ ID NO: 2809059 - DNA, 14 bp, Homo sapiens
tgtagctgtgacct

SEQ ID NO: 2809060 - DNA, 18 bp, Homo sapiens
tgtagctgtgacctgctg

SEQ ID NO: 2809061 - DNA, 20 bp, Homo sapiens
tgtagctgtgacctgctgag

SEQ ID NO: 2809062 - DNA, 12 bp, Homo sapiens
tgtagctttgct

SEQ ID NO: 2809063 - DNA, 13 bp, Homo sapiens
tgtagctttgctc

SEQ ID NO: 2809064 - DNA, 19 bp, Homo sapiens
tgtaggagggactgtcgct

SEQ ID NO: 2809065 - DNA, 15 bp, Homo sapiens
tgtagggctggacct

SEQ ID NO: 2809066 - DNA, 18 bp, Homo sapiens
tgtagggtaaggtgcctt

SEQ ID NO: 2809067 - DNA, 15 bp, Homo sapiens
tgtagtagttgatga

SEQ ID NO: 2809068 - DNA, 16 bp, Homo sapiens
tgtagtgagaaactga

SEQ ID NO: 2809069 - DNA, 13 bp, Homo sapiens
tgtagttaggaaa

SEQ ID NO: 2809070 - DNA, 14 bp, Homo sapiens
tgtagttaggaaat

SEQ ID NO: 2809071 - DNA, 13 bp, Homo sapiens
tgtataaagaaca

SEQ ID NO: 2809072 - DNA, 17 bp, Homo sapiens
tgtatacagattctagc

SEQ ID NO: 2809073 - DNA, 18 bp, Homo sapiens
tgtatagatgcaagatat

SEQ ID NO: 2809074 - DNA, 19 bp, Homo sapiens
tgtatagtgagtgtggctt

SEQ ID NO: 2809075 - DNA, 12 bp, Homo sapiens
tgtatatacata

SEQ ID NO: 2809076 - DNA, 20 bp, Homo sapiens
tgtatatacatattataaat

SEQ ID NO: 2809077 - DNA, 14 bp, Homo sapiens
tgtatatgtatata

SEQ ID NO: 2809078 - DNA, 22 bp, Homo sapiens
tgtatattccaccattcacatt

SEQ ID NO: 2809079 - DNA, 15 bp, Homo sapiens
tgtatcggagacagt

SEQ ID NO: 2809080 - DNA, 17 bp, Homo sapiens
tgtatcggagacagtga

SEQ ID NO: 2809081 - DNA, 18 bp, Homo sapiens
tgtatcttatttatatat

SEQ ID NO: 2809082 - DNA, 22 bp, Homo sapiens
tgtatgaaagatggctgtgcct

SEQ ID NO: 2809083 - DNA, 17 bp, Homo sapiens
tgtatggaatacagtgt

SEQ ID NO: 2809084 - DNA, 19 bp, Homo sapiens
tgtatgtaagtaattgcat

SEQ ID NO: 2809085 - DNA, 12 bp, Homo sapiens
tgtatgtgaaag

SEQ ID NO: 2809086 - DNA, 14 bp, Homo sapiens
tgtatgtgtgtatg

SEQ ID NO: 2809087 - DNA, 16 bp, Homo sapiens
tgtattattttctata

SEQ ID NO: 2809088 - DNA, 17 bp, Homo sapiens
tgtattcacacacccct

SEQ ID NO: 2809089 - DNA, 21 bp, Homo sapiens
tgtattcagatcgtattaatt

SEQ ID NO: 2809090 - DNA, 19 bp, Homo sapiens
tgtatttattgtcattact

SEQ ID NO: 2809091 - DNA, 18 bp, Homo sapiens
tgtatttgttaatggttt

SEQ ID NO: 2809092 - DNA, 22 bp, Homo sapiens
tgtattttcatttaactacaaa

SEQ ID NO: 2809093 - DNA, 21 bp, Homo sapiens
tgtattttcttcccatttgta

SEQ ID NO: 2809094 - DNA, 14 bp, Homo sapiens
tgtatttttagaga

SEQ ID NO: 2809095 - DNA, 23 bp, Homo sapiens
tgtatttttagagattaatttgt

SEQ ID NO: 2809096 - DNA, 17 bp, Homo sapiens
tgtatttttgaataaaa

SEQ ID NO: 2809097 - DNA, 23 bp, Homo sapiens
tgtcaaaatcatgaatatttcaa

SEQ ID NO: 2809098 - DNA, 21 bp, Homo sapiens
tgtcaaacaaatagtctatca

SEQ ID NO: 2809099 - DNA, 15 bp, Homo sapiens
tgtcaagagagagtc

SEQ ID NO: 2809100 - DNA, 19 bp, Homo sapiens
tgtcaagagggtctgagga

SEQ ID NO: 2809101 - DNA, 15 bp, Homo sapiens
tgtcaatttgtatat

SEQ ID NO: 2809102 - DNA, 22 bp, Homo sapiens
tgtcaatttgtatatcatgaaa

SEQ ID NO: 2809103 - DNA, 14 bp, Homo sapiens
tgtcacaatcctaa

SEQ ID NO: 2809104 - DNA, 13 bp, Homo sapiens
tgtcacacacttt

SEQ ID NO: 2809105 - DNA, 15 bp, Homo sapiens
tgtcacaggcaggtc

SEQ ID NO: 2809106 - DNA, 17 bp, Homo sapiens
tgtcaccagctgccaaa

SEQ ID NO: 2809107 - DNA, 19 bp, Homo sapiens
tgtcaccgtggaccttcct

SEQ ID NO: 2809108 - DNA, 21 bp, Homo sapiens
tgtcaccgtggaccttcctgc

SEQ ID NO: 2809109 - DNA, 16 bp, Homo sapiens
tgtcactactcacagt

SEQ ID NO: 2809110 - DNA, 17 bp, Homo sapiens
tgtcactagcagctgca

SEQ ID NO: 2809111 - DNA, 13 bp, Homo sapiens
tgtcactcccaga

SEQ ID NO: 2809112 - DNA, 21 bp, Homo sapiens
tgtcactcccagaccacctcc

SEQ ID NO: 2809113 - DNA, 17 bp, Homo sapiens
tgtcagaatttctttgt

SEQ ID NO: 2809114 - DNA, 23 bp, Homo sapiens
tgtcagactttaaagaataatat

SEQ ID NO: 2809115 - DNA, 19 bp, Homo sapiens
tgtcagcatgcatagtgct

SEQ ID NO: 2809116 - DNA, 18 bp, Homo sapiens
tgtcagcccaagcagagt

SEQ ID NO: 2809117 - DNA, 20 bp, Homo sapiens
tgtcagcccaagcagagtga

SEQ ID NO: 2809118 - DNA, 19 bp, Homo sapiens
tgtcagcgtttctccacct

SEQ ID NO: 2809119 - DNA, 20 bp, Homo sapiens
tgtcaggtggggcagcttga

SEQ ID NO: 2809120 - DNA, 16 bp, Homo sapiens
tgtcataagaatgaat

SEQ ID NO: 2809121 - DNA, 16 bp, Homo sapiens
tgtcatatattcatgt

SEQ ID NO: 2809122 - DNA, 18 bp, Homo sapiens
tgtcatatattcatgtaa

SEQ ID NO: 2809123 - DNA, 19 bp, Homo sapiens
tgtcatatattcatgtaat

SEQ ID NO: 2809124 - DNA, 14 bp, Homo sapiens
tgtcatcaattaaa

SEQ ID NO: 2809125 - DNA, 16 bp, Homo sapiens
tgtcatcccgctcctg

SEQ ID NO: 2809126 - DNA, 23 bp, Homo sapiens
tgtcatctttcttctattttatt

SEQ ID NO: 2809127 - DNA, 15 bp, Homo sapiens
tgtcatgtaccatca

SEQ ID NO: 2809128 - DNA, 19 bp, Homo sapiens
tgtcattaaaataaataaa

SEQ ID NO: 2809129 - DNA, 19 bp, Homo sapiens
tgtcattcaagcctgtgaa

SEQ ID NO: 2809130 - DNA, 18 bp, Homo sapiens
tgtcattgtccatgccta

SEQ ID NO: 2809131 - DNA, 20 bp, Homo sapiens
tgtcattgtccatgcctaca

SEQ ID NO: 2809132 - DNA, 20 bp, Homo sapiens
tgtcatttgagcagggctca

SEQ ID NO: 2809133 - DNA, 13 bp, Homo sapiens
tgtcattttggta

SEQ ID NO: 2809134 - DNA, 15 bp, Homo sapiens
tgtccacctggcccc

SEQ ID NO: 2809135 - DNA, 14 bp, Homo sapiens
tgtccagcgcctag

SEQ ID NO: 2809136 - DNA, 19 bp, Homo sapiens
tgtccaggcactgctgccc

SEQ ID NO: 2809137 - DNA, 13 bp, Homo sapiens
tgtccagtttcca

SEQ ID NO: 2809138 - DNA, 21 bp, Homo sapiens
tgtccatatcagacctctgat

SEQ ID NO: 2809139 - DNA, 18 bp, Homo sapiens
tgtccatgcctacagata

SEQ ID NO: 2809140 - DNA, 23 bp, Homo sapiens
tgtcccaaaaagaaaggagggga

SEQ ID NO: 2809141 - DNA, 13 bp, Homo sapiens
tgtcccaccagct

SEQ ID NO: 2809142 - DNA, 14 bp, Homo sapiens
tgtcccaggtcctc

SEQ ID NO: 2809143 - DNA, 17 bp, Homo sapiens
tgtcccaggtcctcact

SEQ ID NO: 2809144 - DNA, 20 bp, Homo sapiens
tgtcccatttccttggaggc

SEQ ID NO: 2809145 - DNA, 22 bp, Homo sapiens
tgtcccccttggaggagggctg

SEQ ID NO: 2809146 - DNA, 17 bp, Homo sapiens
tgtgattttgtacagaa

SEQ ID NO: 2809147 - DNA, 18 bp, Homo sapiens
tgtgattttgtacagaat

SEQ ID NO: 2809148 - DNA, 16 bp, Homo sapiens
tgtgcacatgcacgtg

SEQ ID NO: 2809149 - DNA, 16 bp, Homo sapiens
tgtgcacggcagcttg

SEQ ID NO: 2809150 - DNA, 21 bp, Homo sapiens
tgtgcacggcagcttgagcct

SEQ ID NO: 2809151 - DNA, 16 bp, Homo sapiens
tgtgcagactgtggct

SEQ ID NO: 2809152 - DNA, 23 bp, Homo sapiens
tgtgcatgtatgtcttggacact

SEQ ID NO: 2809153 - DNA, 12 bp, Homo sapiens
tgtgccaaacta

SEQ ID NO: 2809154 - DNA, 15 bp, Homo sapiens
tgtgccagagcctgg

SEQ ID NO: 2809155 - DNA, 16 bp, Homo sapiens
tgtgccagagcctggg

SEQ ID NO: 2809156 - DNA, 16 bp, Homo sapiens
tgtgccatagtcacat

SEQ ID NO: 2809157 - DNA, 18 bp, Homo sapiens
tgtgccatagtcacatgg

SEQ ID NO: 2809158 - DNA, 16 bp, Homo sapiens
tgtgccatgtcaaaca

SEQ ID NO: 2809159 - DNA, 17 bp, Homo sapiens
tgtgcccacatcccagg

SEQ ID NO: 2809160 - DNA, 20 bp, Homo sapiens
tgtgcccacatcccaggctt

SEQ ID NO: 2809161 - DNA, 20 bp, Homo sapiens
tgtgcccacgtgtgcagact

SEQ ID NO: 2809162 - DNA, 21 bp, Homo sapiens
tgtgcctcgctccccactctg

SEQ ID NO: 2809163 - DNA, 12 bp, Homo sapiens
tgtgcctctgcc

SEQ ID NO: 2809164 - DNA, 12 bp, Homo sapiens
tgtgcctgcagc

SEQ ID NO: 2809165 - DNA, 17 bp, Homo sapiens
tgtgctcccctttgcct

SEQ ID NO: 2809166 - DNA, 16 bp, Homo sapiens
tgtgctcctccttggt

SEQ ID NO: 2809167 - DNA, 15 bp, Homo sapiens
tgtgctctggacagg

SEQ ID NO: 2809168 - DNA, 19 bp, Homo sapiens
tgtgctctggacaggcatg

SEQ ID NO: 2809169 - DNA, 20 bp, Homo sapiens
tgtgctgcccgtcttcagcc

SEQ ID NO: 2809170 - DNA, 20 bp, Homo sapiens
tgtgcttgtcatctgccact

SEQ ID NO: 2809171 - DNA, 20 bp, Homo sapiens
tgtgctttgactcacctgtt

SEQ ID NO: 2809172 - DNA, 17 bp, Homo sapiens
tgtgctttgcattccta

SEQ ID NO: 2809173 - DNA, 16 bp, Homo sapiens
tgtggaaaaatattta

SEQ ID NO: 2809174 - DNA, 12 bp, Homo sapiens
tgtggaaagcct

SEQ ID NO: 2809175 - DNA, 20 bp, Homo sapiens
tgtggaaagcctctgctgcc

SEQ ID NO: 2809176 - DNA, 22 bp, Homo sapiens
tgtggaatggattatagagtat

SEQ ID NO: 2809177 - DNA, 18 bp, Homo sapiens
tgtggacacagctcttct

SEQ ID NO: 2809178 - DNA, 14 bp, Homo sapiens
tgtggacaggacta

SEQ ID NO: 2809179 - DNA, 18 bp, Homo sapiens
tgtggagagtgagaataa

SEQ ID NO: 2809180 - DNA, 18 bp, Homo sapiens
tgtggatttcctatttta

SEQ ID NO: 2809181 - DNA, 22 bp, Homo sapiens
tgtggattttttccttcaaagt

SEQ ID NO: 2809182 - DNA, 19 bp, Homo sapiens
tgtggccagggtgagagct

SEQ ID NO: 2809183 - DNA, 20 bp, Homo sapiens
tgtggccagggtgagagctg

SEQ ID NO: 2809184 - DNA, 14 bp, Homo sapiens
tgtggccctggcct

SEQ ID NO: 2809185 - DNA, 22 bp, Homo sapiens
tgtggcgttctgctgcccctgc

SEQ ID NO: 2809186 - DNA, 14 bp, Homo sapiens
tgtggctgcagaga

SEQ ID NO: 2809187 - DNA, 14 bp, Homo sapiens
tgtggctgtattca

SEQ ID NO: 2809188 - DNA, 14 bp, Homo sapiens
tgtgggagcctcgc

SEQ ID NO: 2809189 - DNA, 22 bp, Homo sapiens
tgtgggtgttaatttttgatac

SEQ ID NO: 2809190 - DNA, 14 bp, Homo sapiens
tgtggttaatgcca

SEQ ID NO: 2809191 - DNA, 14 bp, Homo sapiens
tgtggtttatgtca

SEQ ID NO: 2809192 - DNA, 21 bp, Homo sapiens
tgtgtaaagtgtaaatccttt

SEQ ID NO: 2809193 - DNA, 10 bp, Homo sapiens
tgtgtaaatg

SEQ ID NO: 2809194 - DNA, 16 bp, Homo sapiens
tgtgtagctgtgacct

SEQ ID NO: 2809195 - DNA, 12 bp, Homo sapiens
tgtgtagggcgg

SEQ ID NO: 2809196 - DNA, 22 bp, Homo sapiens
tgtgtcatattaaacttctgat

SEQ ID NO: 2809197 - DNA, 14 bp, Homo sapiens
tgtgtccttgcacc

SEQ ID NO: 2809198 - DNA, 19 bp, Homo sapiens
tgtgtctgcgtctgtgttg

SEQ ID NO: 2809199 - DNA, 20 bp, Homo sapiens
tgtgtcttgcaatggcagcc

SEQ ID NO: 2809200 - DNA, 21 bp, Homo sapiens
tgtgtcttttataaaaagttt

SEQ ID NO: 2809201 - DNA, 19 bp, Homo sapiens
tgtgtgagcatctctgtgt

SEQ ID NO: 2809202 - DNA, 14 bp, Homo sapiens
tgtgtgcgcgtgca

SEQ ID NO: 2809203 - DNA, 15 bp, Homo sapiens
tgtgtggatgtgtaa

SEQ ID NO: 2809204 - DNA, 13 bp, Homo sapiens
tgtgttatttaaa

SEQ ID NO: 2809205 - DNA, 14 bp, Homo sapiens
tgtgttatttaaat

SEQ ID NO: 2809206 - DNA, 15 bp, Homo sapiens
tgtgttcagtgcctt

SEQ ID NO: 2809207 - DNA, 13 bp, Homo sapiens
tgtgttgtctgtg

SEQ ID NO: 2809208 - DNA, 20 bp, Homo sapiens
tgtgtttactttatgttact

SEQ ID NO: 2809209 - DNA, 14 bp, Homo sapiens
tgtgtttagatttt

SEQ ID NO: 2809210 - DNA, 17 bp, Homo sapiens
tgtgtttggaagactat

SEQ ID NO: 2809211 - DNA, 23 bp, Homo sapiens
tgtgttttctgaataacatttgt

SEQ ID NO: 2809212 - DNA, 21 bp, Homo sapiens
tgtgtttttgctatcacacag

SEQ ID NO: 2809213 - DNA, 20 bp, Homo sapiens
tgttaaaaaaataagaagaa

SEQ ID NO: 2809214 - DNA, 23 bp, Homo sapiens
tgttaaaaaaataagaagaatgc

SEQ ID NO: 2809215 - DNA, 12 bp, Homo sapiens
tgttaaaataac

SEQ ID NO: 2809216 - DNA, 17 bp, Homo sapiens
tgttaaaatagacaact

SEQ ID NO: 2809217 - DNA, 17 bp, Homo sapiens
tgttaaaatgtacactg

SEQ ID NO: 2809218 - DNA, 18 bp, Homo sapiens
tgttaaacacgtgtctat

SEQ ID NO: 2809219 - DNA, 17 bp, Homo sapiens
tgttaacctcagtgtca

SEQ ID NO: 2809220 - DNA, 19 bp, Homo sapiens
tgttaacctcagtgtcatt

SEQ ID NO: 2809221 - DNA, 16 bp, Homo sapiens
tgttaataataagata

SEQ ID NO: 2809222 - DNA, 14 bp, Homo sapiens
tgttaattgattaa

SEQ ID NO: 2809223 - DNA, 22 bp, Homo sapiens
tgttaatttagaaaactttaaa

SEQ ID NO: 2809224 - DNA, 13 bp, Homo sapiens
tgttaatttttga

SEQ ID NO: 2809225 - DNA, 17 bp, Homo sapiens
tgttacaggtgtactat

SEQ ID NO: 2809226 - DNA, 21 bp, Homo sapiens
tgttacccagtaactcatctg

SEQ ID NO: 2809227 - DNA, 13 bp, Homo sapiens
tgttactaaagtc

SEQ ID NO: 2809228 - DNA, 16 bp, Homo sapiens
tgttacttaaatagca

SEQ ID NO: 2809229 - DNA, 12 bp, Homo sapiens
tgttacttacct

SEQ ID NO: 2809230 - DNA, 13 bp, Homo sapiens
tgttactttggaa

SEQ ID NO: 2809231 - DNA, 16 bp, Homo sapiens
tgttactttggaatga

SEQ ID NO: 2809232 - DNA, 17 bp, Homo sapiens
tgttactttttagtctt

SEQ ID NO: 2809233 - DNA, 19 bp, Homo sapiens
tgttagcctcaatttctga

SEQ ID NO: 2809234 - DNA, 21 bp, Homo sapiens
tgttagttattttaggagaca

SEQ ID NO: 2809235 - DNA, 22 bp, Homo sapiens
tgttatcaaacaccaacataaa

SEQ ID NO: 2809236 - DNA, 22 bp, Homo sapiens
tgttattgggcaagtgattgaa

SEQ ID NO: 2809237 - DNA, 12 bp, Homo sapiens
ttagaatatatt

SEQ ID NO: 2809238 - DNA, 11 bp, Homo sapiens
ttagacagagt

SEQ ID NO: 2809239 - DNA, 16 bp, Homo sapiens
ttagactggacagctt

SEQ ID NO: 2809240 - DNA, 19 bp, Homo sapiens
ttagactggacagcttgtg

SEQ ID NO: 2809241 - DNA, 21 bp, Homo sapiens
ttagacttcgactcaggatcc

SEQ ID NO: 2809242 - DNA, 16 bp, Homo sapiens
ttagagaatatatttt

SEQ ID NO: 2809243 - DNA, 19 bp, Homo sapiens
ttagagaatatatttttga

SEQ ID NO: 2809244 - DNA, 14 bp, Homo sapiens
ttagagtcagcctt

SEQ ID NO: 2809245 - DNA, 21 bp, Homo sapiens
ttagcagctcttcccctttcc

SEQ ID NO: 2809246 - DNA, 22 bp, Homo sapiens
ttagcatttagtccaatgtctt

SEQ ID NO: 2809247 - DNA, 14 bp, Homo sapiens
ttagccccataatt

SEQ ID NO: 2809248 - DNA, 14 bp, Homo sapiens
ttagccttctctgt

SEQ ID NO: 2809249 - DNA, 17 bp, Homo sapiens
ttagccttctctgttca

SEQ ID NO: 2809250 - DNA, 14 bp, Homo sapiens
ttagcggagacgga

SEQ ID NO: 2809251 - DNA, 13 bp, Homo sapiens
ttagctgtaaata

SEQ ID NO: 2809252 - DNA, 16 bp, Homo sapiens
ttagcttagacctcag

SEQ ID NO: 2809253 - DNA, 17 bp, Homo sapiens
ttagcttagacctcagc

SEQ ID NO: 2809254 - DNA, 18 bp, Homo sapiens
ttagcttagacctcagcc

SEQ ID NO: 2809255 - DNA, 21 bp, Homo sapiens
ttagcttgaaggatctgtttt

SEQ ID NO: 2809256 - DNA, 11 bp, Homo sapiens
ttaggaaataa

SEQ ID NO: 2809257 - DNA, 18 bp, Homo sapiens
ttaggaaataaaaccttt

SEQ ID NO: 2809258 - DNA, 21 bp, Homo sapiens
ttaggaacagagtatatatgt

SEQ ID NO: 2809259 - DNA, 16 bp, Homo sapiens
ttaggatctatgcaat

SEQ ID NO: 2809260 - DNA, 17 bp, Homo sapiens
ttaggatctatgcaatt

SEQ ID NO: 2809261 - DNA, 12 bp, Homo sapiens
ttagggaggggt

SEQ ID NO: 2809262 - DNA, 12 bp, Homo sapiens
ttaggttataag

SEQ ID NO: 2809263 - DNA, 22 bp, Homo sapiens
ttaggttttgtacaattgaact

SEQ ID NO: 2809264 - DNA, 18 bp, Homo sapiens
ttagtaaagtcaaggaga

SEQ ID NO: 2809265 - DNA, 12 bp, Homo sapiens
ttagtaatagat

SEQ ID NO: 2809266 - DNA, 14 bp, Homo sapiens
ttagtacagtagct

SEQ ID NO: 2809267 - DNA, 18 bp, Homo sapiens
ttagtatctaacatgtat

SEQ ID NO: 2809268 - DNA, 14 bp, Homo sapiens
ttagtctgtcatcc

SEQ ID NO: 2809269 - DNA, 13 bp, Homo sapiens
ttagtgagatttg

SEQ ID NO: 2809270 - DNA, 19 bp, Homo sapiens
ttagtttgatttaatatct

SEQ ID NO: 2809271 - DNA, 17 bp, Homo sapiens
ttataaaaacaaaaaca

SEQ ID NO: 2809272 - DNA, 12 bp, Homo sapiens
ttataaaaatac

SEQ ID NO: 2809273 - DNA, 15 bp, Homo sapiens
ttataaatatattta

SEQ ID NO: 2809274 - DNA, 17 bp, Homo sapiens
ttataactcatcataaa

SEQ ID NO: 2809275 - DNA, 19 bp, Homo sapiens
ttataactcatcataaaat

SEQ ID NO: 2809276 - DNA, 20 bp, Homo sapiens
ttataactcatcataaaata

SEQ ID NO: 2809277 - DNA, 21 bp, Homo sapiens
ttataactcatcataaaataa

SEQ ID NO: 2809278 - DNA, 17 bp, Homo sapiens
ttataacttaaaatatt

SEQ ID NO: 2809279 - DNA, 14 bp, Homo sapiens
ttataagcagattt

SEQ ID NO: 2809280 - DNA, 18 bp, Homo sapiens
ttataatgtggatttcct

SEQ ID NO: 2809281 - DNA, 20 bp, Homo sapiens
ttataatgtggatttcctat

SEQ ID NO: 2809282 - DNA, 23 bp, Homo sapiens
ttataatgtggatttcctatttt

SEQ ID NO: 2809283 - DNA, 21 bp, Homo sapiens
ttataatttttttattactga

SEQ ID NO: 2809284 - DNA, 15 bp, Homo sapiens
ttatacaaaataatt

SEQ ID NO: 2809285 - DNA, 20 bp, Homo sapiens
ttatacaaaataatttaact

SEQ ID NO: 2809286 - DNA, 12 bp, Homo sapiens
ttatacatagtc

SEQ ID NO: 2809287 - DNA, 21 bp, Homo sapiens
ttatacatagtcacaaaaatg

SEQ ID NO: 2809288 - DNA, 20 bp, Homo sapiens
ttatacatatcagaaaagta

SEQ ID NO: 2809289 - DNA, 22 bp, Homo sapiens
ttatacatatcagaaaagtaga

SEQ ID NO: 2809290 - DNA, 17 bp, Homo sapiens
ttatactccatacataa

SEQ ID NO: 2809291 - DNA, 22 bp, Homo sapiens
ttatactgtacttaataaattc

SEQ ID NO: 2809292 - DNA, 23 bp, Homo sapiens
ttatagaatatttattacctctg

SEQ ID NO: 2809293 - DNA, 16 bp, Homo sapiens
ttatagccgaaatgat

SEQ ID NO: 2809294 - DNA, 24 bp, Homo sapiens
ttataggatttatttaaaatagca

SEQ ID NO: 2809295 - DNA, 15 bp, Homo sapiens
ttatagtatatctgg

SEQ ID NO: 2809296 - DNA, 20 bp, Homo sapiens
ttatagttgtgggtgggaga

SEQ ID NO: 2809297 - DNA, 20 bp, Homo sapiens
ttatagtttgctttgctttt

SEQ ID NO: 2809298 - DNA, 18 bp, Homo sapiens
ttatatatatatgtatat

SEQ ID NO: 2809299 - DNA, 13 bp, Homo sapiens
ttatatatcataa

SEQ ID NO: 2809300 - DNA, 16 bp, Homo sapiens
ttatatatcataaagt

SEQ ID NO: 2809301 - DNA, 13 bp, Homo sapiens
ttatatatttata

SEQ ID NO: 2809302 - DNA, 13 bp, Homo sapiens
ttatatctaattt

SEQ ID NO: 2809303 - DNA, 14 bp, Homo sapiens
ttatatctaattta

SEQ ID NO: 2809304 - DNA, 18 bp, Homo sapiens
ttatatctaatttataca

SEQ ID NO: 2809305 - DNA, 21 bp, Homo sapiens
ttatatctaatttatacaaaa

SEQ ID NO: 2809306 - DNA, 22 bp, Homo sapiens
ttatatctaatttatacaaaat

SEQ ID NO: 2809307 - DNA, 15 bp, Homo sapiens
ttatatctatagtag

SEQ ID NO: 2809308 - DNA, 14 bp, Homo sapiens
ttatattatgtagt

SEQ ID NO: 2809309 - DNA, 14 bp, Homo sapiens
ttatattccatata

SEQ ID NO: 2809310 - DNA, 19 bp, Homo sapiens
ttatattttactactgtgg

SEQ ID NO: 2809311 - DNA, 12 bp, Homo sapiens
ttatcaaaatct

SEQ ID NO: 2809312 - DNA, 21 bp, Homo sapiens
ttatcagtcataactaaataa

SEQ ID NO: 2809313 - DNA, 23 bp, Homo sapiens
ttatcagtcataactaaataaag

SEQ ID NO: 2809314 - DNA, 16 bp, Homo sapiens
ttatcagtgacagagt

SEQ ID NO: 2809315 - DNA, 17 bp, Homo sapiens
ttatcagtgacagagtt

SEQ ID NO: 2809316 - DNA, 18 bp, Homo sapiens
ttatcattgggagaagcc

SEQ ID NO: 2809317 - DNA, 22 bp, Homo sapiens
ttatccaaggtgtaactctaat

SEQ ID NO: 2809318 - DNA, 16 bp, Homo sapiens
ttatcctgaaatttca

SEQ ID NO: 2809319 - DNA, 17 bp, Homo sapiens
ttatcctgaaatttcag

SEQ ID NO: 2809320 - DNA, 15 bp, Homo sapiens
ttatcggaagcagtg

SEQ ID NO: 2809321 - DNA, 19 bp, Homo sapiens
ttatcgggagcagtgtctt

SEQ ID NO: 2809322 - DNA, 21 bp, Homo sapiens
ttatctaagttaatttaaagt

SEQ ID NO: 2809323 - DNA, 20 bp, Homo sapiens
ttatctgaatttttaaacaa

SEQ ID NO: 2809324 - DNA, 22 bp, Homo sapiens
ttatctgatcgggataacaaaa

SEQ ID NO: 2809325 - DNA, 20 bp, Homo sapiens
ttatcttatttaatttttgc

SEQ ID NO: 2809326 - DNA, 17 bp, Homo sapiens
ttatcttggactgacat

SEQ ID NO: 2809327 - DNA, 18 bp, Homo sapiens
ttatgaagaaaaaataca

SEQ ID NO: 2809328 - DNA, 19 bp, Homo sapiens
ttctatagctcttctattt

SEQ ID NO: 2809329 - DNA, 20 bp, Homo sapiens
ttctatagctcttctattta

SEQ ID NO: 2809330 - DNA, 17 bp, Homo sapiens
ttctattctctcctcag

SEQ ID NO: 2809331 - DNA, 15 bp, Homo sapiens
ttctatttttgtaga

SEQ ID NO: 2809332 - DNA, 14 bp, Homo sapiens
ttctcaacctacca

SEQ ID NO: 2809333 - DNA, 13 bp, Homo sapiens
ttctcaccaggaa

SEQ ID NO: 2809334 - DNA, 17 bp, Homo sapiens
ttctcagaatccaaaga

SEQ ID NO: 2809335 - DNA, 18 bp, Homo sapiens
ttctcagccccgggcctg

SEQ ID NO: 2809336 - DNA, 20 bp, Homo sapiens
ttctcaggacacaggcctgt

SEQ ID NO: 2809337 - DNA, 16 bp, Homo sapiens
ttctcatcatattgta

SEQ ID NO: 2809338 - DNA, 17 bp, Homo sapiens
ttctcatgtgatccttt

SEQ ID NO: 2809339 - DNA, 16 bp, Homo sapiens
ttctccaagagctaca

SEQ ID NO: 2809340 - DNA, 17 bp, Homo sapiens
ttctccaggattccaaa

SEQ ID NO: 2809341 - DNA, 18 bp, Homo sapiens
ttctccccctgggctctg

SEQ ID NO: 2809342 - DNA, 13 bp, Homo sapiens
ttctcctcccagg

SEQ ID NO: 2809343 - DNA, 18 bp, Homo sapiens
ttctcctgacccagtccc

SEQ ID NO: 2809344 - DNA, 13 bp, Homo sapiens
ttctccttggagg

SEQ ID NO: 2809345 - DNA, 17 bp, Homo sapiens
ttctcctttattgctcc

SEQ ID NO: 2809346 - DNA, 21 bp, Homo sapiens
ttctctacccatctcccccat

SEQ ID NO: 2809347 - DNA, 20 bp, Homo sapiens
ttctctctatctggaattta

SEQ ID NO: 2809348 - DNA, 14 bp, Homo sapiens
ttctctgtatagta

SEQ ID NO: 2809349 - DNA, 19 bp, Homo sapiens
ttctctttcttattttgta

SEQ ID NO: 2809350 - DNA, 20 bp, Homo sapiens
ttctctttcttattttgtaa

SEQ ID NO: 2809351 - DNA, 21 bp, Homo sapiens
ttctctttcttattttgtaat

SEQ ID NO: 2809352 - DNA, 23 bp, Homo sapiens
ttctctttcttattttgtaataa

SEQ ID NO: 2809353 - DNA, 14 bp, Homo sapiens
ttctgaaaactgtt

SEQ ID NO: 2809354 - DNA, 15 bp, Homo sapiens
ttctgaaaactgttt

SEQ ID NO: 2809355 - DNA, 19 bp, Homo sapiens
ttctgaaaattaacactgc

SEQ ID NO: 2809356 - DNA, 17 bp, Homo sapiens
ttctgaaacttcataaa

SEQ ID NO: 2809357 - DNA, 13 bp, Homo sapiens
ttctgactgctga

SEQ ID NO: 2809358 - DNA, 22 bp, Homo sapiens
ttctgagtacttgatttcaggt

SEQ ID NO: 2809359 - DNA, 20 bp, Homo sapiens
ttctgagtgtttttactaca

SEQ ID NO: 2809360 - DNA, 15 bp, Homo sapiens
ttctgagttcctgca

SEQ ID NO: 2809361 - DNA, 16 bp, Homo sapiens
ttctgctacctcactg

SEQ ID NO: 2809362 - DNA, 14 bp, Homo sapiens
ttctgctcctctcc

SEQ ID NO: 2809363 - DNA, 15 bp, Homo sapiens
ttctgctcctctcca

SEQ ID NO: 2809364 - DNA, 14 bp, Homo sapiens
ttctgctgcccctg

SEQ ID NO: 2809365 - DNA, 17 bp, Homo sapiens
ttctgctgcccctgcag

SEQ ID NO: 2809366 - DNA, 13 bp, Homo sapiens
ttctgctggataa

SEQ ID NO: 2809367 - DNA, 21 bp, Homo sapiens
ttctgctggataaaatgaggt

SEQ ID NO: 2809368 - DNA, 14 bp, Homo sapiens
ttctgctggcctgg

SEQ ID NO: 2809369 - DNA, 18 bp, Homo sapiens
ttctgctggcctggatct

SEQ ID NO: 2809370 - DNA, 19 bp, Homo sapiens
ttctgctggcctggatctc

SEQ ID NO: 2809371 - DNA, 14 bp, Homo sapiens
ttctgcttcagcct

SEQ ID NO: 2809372 - DNA, 17 bp, Homo sapiens
ttctggaatacatgaaa

SEQ ID NO: 2809373 - DNA, 14 bp, Homo sapiens
ttctggagctgctg

SEQ ID NO: 2809374 - DNA, 15 bp, Homo sapiens
ttctggaggaagaag

SEQ ID NO: 2809375 - DNA, 17 bp, Homo sapiens
ttctggagtctccagtg

SEQ ID NO: 2809376 - DNA, 16 bp, Homo sapiens
ttctggctctcccatt

SEQ ID NO: 2809377 - DNA, 22 bp, Homo sapiens
ttctggctctcccatttcctga

SEQ ID NO: 2809378 - DNA, 19 bp, Homo sapiens
ttctggctgaacactggca

SEQ ID NO: 2809379 - DNA, 22 bp, Homo sapiens
ttctgggacacagttcaattct

SEQ ID NO: 2809380 - DNA, 11 bp, Homo sapiens
ttctgtatttt

SEQ ID NO: 2809381 - DNA, 12 bp, Homo sapiens
ttctgtattttc

SEQ ID NO: 2809382 - DNA, 12 bp, Homo sapiens
ttctgtcatccc

SEQ ID NO: 2809383 - DNA, 19 bp, Homo sapiens
ttctgtcatcccgctcctg

SEQ ID NO: 2809384 - DNA, 21 bp, Homo sapiens
ttctgtcatcccgctcctgct

SEQ ID NO: 2809385 - DNA, 20 bp, Homo sapiens
ttctgtttctattctctcct

SEQ ID NO: 2809386 - DNA, 22 bp, Homo sapiens
ttctgtttctattctctcctca

SEQ ID NO: 2809387 - DNA, 15 bp, Homo sapiens
ttcttaaaatatatt

SEQ ID NO: 2809388 - DNA, 20 bp, Homo sapiens
ttcttaaggattgtgatatt

SEQ ID NO: 2809389 - DNA, 15 bp, Homo sapiens
ttcttatcttctgca

SEQ ID NO: 2809390 - DNA, 16 bp, Homo sapiens
ttcttcaccaaatctt

SEQ ID NO: 2809391 - DNA, 14 bp, Homo sapiens
ttcttcagaagaca

SEQ ID NO: 2809392 - DNA, 14 bp, Homo sapiens
ttcttcagccacct

SEQ ID NO: 2809393 - DNA, 18 bp, Homo sapiens
ttcttcataacaatttta

SEQ ID NO: 2809394 - DNA, 16 bp, Homo sapiens
ttcttcctcactatga

SEQ ID NO: 2809395 - DNA, 12 bp, Homo sapiens
ttcttctaaaat

SEQ ID NO: 2809396 - DNA, 18 bp, Homo sapiens
ttcttctaaaatgctttt

SEQ ID NO: 2809397 - DNA, 17 bp, Homo sapiens
ttcttctaaaattgaag

SEQ ID NO: 2809398 - DNA, 17 bp, Homo sapiens
ttcttctacaaccagag

SEQ ID NO: 2809399 - DNA, 21 bp, Homo sapiens
ttcttctacaaccagagcccc

SEQ ID NO: 2809400 - DNA, 20 bp, Homo sapiens
ttcttctgcttcagcctccc

SEQ ID NO: 2809401 - DNA, 14 bp, Homo sapiens
ttcttgaaagctgt

SEQ ID NO: 2809402 - DNA, 18 bp, Homo sapiens
ttcttgcagtcatcagaa

SEQ ID NO: 2809403 - DNA, 22 bp, Homo sapiens
ttcttgtgccatagtcacatgg

SEQ ID NO: 2809404 - DNA, 21 bp, Homo sapiens
ttcttgtgctgactaactata

SEQ ID NO: 2809405 - DNA, 13 bp, Homo sapiens
ttctttataaact

SEQ ID NO: 2809406 - DNA, 21 bp, Homo sapiens
ttctttcctctccaattgtaa

SEQ ID NO: 2809407 - DNA, 19 bp, Homo sapiens
ttctttgtgtagctttgct

SEQ ID NO: 2809408 - DNA, 21 bp, Homo sapiens
ttcttttctggaatgtaatca

SEQ ID NO: 2809409 - DNA, 19 bp, Homo sapiens
ttcttttgtgttggatttg

SEQ ID NO: 2809410 - DNA, 12 bp, Homo sapiens
ttctttttcaaa

SEQ ID NO: 2809411 - DNA, 15 bp, Homo sapiens
ttctttttttatgac

SEQ ID NO: 2809412 - DNA, 12 bp, Homo sapiens
ttgaaagctgtg

SEQ ID NO: 2809413 - DNA, 22 bp, Homo sapiens
ttgaaagctgtggccagcttgt

SEQ ID NO: 2809414 - DNA, 21 bp, Homo sapiens
ttgaaaggggttgtgaagagg

SEQ ID NO: 2809415 - DNA, 21 bp, Homo sapiens
ttgaaagtgaataaacttcag

SEQ ID NO: 2809416 - DNA, 13 bp, Homo sapiens
ttgaacactgggg

SEQ ID NO: 2809417 - DNA, 12 bp, Homo sapiens
ttgaacccagga

SEQ ID NO: 2809418 - DNA, 15 bp, Homo sapiens
ttgaacccctgtgtc

SEQ ID NO: 2809419 - DNA, 14 bp, Homo sapiens
ttgtgtctgtacac

SEQ ID NO: 2809420 - DNA, 17 bp, Homo sapiens
ttgtgtgcatttctgtc

SEQ ID NO: 2809421 - DNA, 20 bp, Homo sapiens
ttgtgtgttatttaaatgag

SEQ ID NO: 2809422 - DNA, 22 bp, Homo sapiens
ttgtgttgccttagcacttctt

SEQ ID NO: 2809423 - DNA, 14 bp, Homo sapiens
ttgttaaatattta

SEQ ID NO: 2809424 - DNA, 23 bp, Homo sapiens
ttgttaataataagataatgatg

SEQ ID NO: 2809425 - DNA, 19 bp, Homo sapiens
ttgttaatggtttgaatat

SEQ ID NO: 2809426 - DNA, 21 bp, Homo sapiens
ttgttaatttagaaaacttta

SEQ ID NO: 2809427 - DNA, 22 bp, Homo sapiens
ttgttaatttagaaaactttaa

SEQ ID NO: 2809428 - DNA, 17 bp, Homo sapiens
ttgttacaggtgtacta

SEQ ID NO: 2809429 - DNA, 12 bp, Homo sapiens
ttgttaccttta

SEQ ID NO: 2809430 - DNA, 11 bp, Homo sapiens
ttgttcctgat

SEQ ID NO: 2809431 - DNA, 21 bp, Homo sapiens
ttgttgataaattccactgga

SEQ ID NO: 2809432 - DNA, 20 bp, Homo sapiens
ttgtttatttatcagtgaca

SEQ ID NO: 2809433 - DNA, 14 bp, Homo sapiens
ttgtttctactttg

SEQ ID NO: 2809434 - DNA, 23 bp, Homo sapiens
ttgtttctactttgatatgactg

SEQ ID NO: 2809435 - DNA, 16 bp, Homo sapiens
ttgtttctccccctgg

SEQ ID NO: 2809436 - DNA, 15 bp, Homo sapiens
ttgtttcttccaaag

SEQ ID NO: 2809437 - DNA, 19 bp, Homo sapiens
ttgtttcttccaaagcaca

SEQ ID NO: 2809438 - DNA, 16 bp, Homo sapiens
ttgtttggtcactgct

SEQ ID NO: 2809439 - DNA, 13 bp, Homo sapiens
ttgtttttccttg

SEQ ID NO: 2809440 - DNA, 21 bp, Homo sapiens
ttgtttttccttgtatttaaa

SEQ ID NO: 2809441 - DNA, 20 bp, Homo sapiens
tttaaaaaagcttaaaactt

SEQ ID NO: 2809442 - DNA, 19 bp, Homo sapiens
tttaaaaaataaaaaaata

SEQ ID NO: 2809443 - DNA, 14 bp, Homo sapiens
tttaaaaaataaat

SEQ ID NO: 2809444 - DNA, 17 bp, Homo sapiens
tttaaaaaataaatata

SEQ ID NO: 2809445 - DNA, 18 bp, Homo sapiens
tttaaaaaataaatataa

SEQ ID NO: 2809446 - DNA, 12 bp, Homo sapiens
tttaaaaaatac

SEQ ID NO: 2809447 - DNA, 18 bp, Homo sapiens
tttaaaaacatgagaaat

SEQ ID NO: 2809448 - DNA, 22 bp, Homo sapiens
tttaaaaacatgagaaatgtga

SEQ ID NO: 2809449 - DNA, 12 bp, Homo sapiens
tttaaaaatcat

SEQ ID NO: 2809450 - DNA, 16 bp, Homo sapiens
tttaaaaatcataaac

SEQ ID NO: 2809451 - DNA, 18 bp, Homo sapiens
tttaaaaggttgactcaa

SEQ ID NO: 2809452 - DNA, 16 bp, Homo sapiens
tttaaacatagaaagt

SEQ ID NO: 2809453 - DNA, 12 bp, Homo sapiens
tttaaaccagca

SEQ ID NO: 2809454 - DNA, 13 bp, Homo sapiens
tttaaaccagcag

SEQ ID NO: 2809455 - DNA, 21 bp, Homo sapiens
tttaaaccagcagaaaagtgc

SEQ ID NO: 2809456 - DNA, 22 bp, Homo sapiens
tttaaaccagcagaaaagtgct

SEQ ID NO: 2809457 - DNA, 21 bp, Homo sapiens
tttaaaccgctaaaagaaact

SEQ ID NO: 2809458 - DNA, 13 bp, Homo sapiens
tttaaagaattgt

SEQ ID NO: 2809459 - DNA, 17 bp, Homo sapiens
tttaaagcgtttgcaca

SEQ ID NO: 2809460 - DNA, 19 bp, Homo sapiens
tttaaagtctttccgtctc

SEQ ID NO: 2809461 - DNA, 18 bp, Homo sapiens
tttaaatattaatcaact

SEQ ID NO: 2809462 - DNA, 12 bp, Homo sapiens
tttaaatcaaaa

SEQ ID NO: 2809463 - DNA, 20 bp, Homo sapiens
tttaaatgatgattccttga

SEQ ID NO: 2809464 - DNA, 17 bp, Homo sapiens
tttaaattctttttcaa

SEQ ID NO: 2809465 - DNA, 16 bp, Homo sapiens
tttaacaaaagcaaga

SEQ ID NO: 2809466 - DNA, 14 bp, Homo sapiens
tttaacacataact

SEQ ID NO: 2809467 - DNA, 13 bp, Homo sapiens
tttaactaattta

SEQ ID NO: 2809468 - DNA, 24 bp, Homo sapiens
tttaactcaatattttccatgaaa

SEQ ID NO: 2809469 - DNA, 19 bp, Homo sapiens
tttaactttatcacattat

SEQ ID NO: 2809470 - DNA, 14 bp, Homo sapiens
tttaagataattat

SEQ ID NO: 2809471 - DNA, 20 bp, Homo sapiens
tttaagccaaaacaatgttt

SEQ ID NO: 2809472 - DNA, 12 bp, Homo sapiens
tttaagctgttt

SEQ ID NO: 2809473 - DNA, 21 bp, Homo sapiens
tttaaggagggacaagaatca

SEQ ID NO: 2809474 - DNA, 20 bp, Homo sapiens
tttaagggtttgtggaaaat

SEQ ID NO: 2809475 - DNA, 22 bp, Homo sapiens
tttaagggtttgtggaaaatga

SEQ ID NO: 2809476 - DNA, 13 bp, Homo sapiens
tttaagtatatag

SEQ ID NO: 2809477 - DNA, 13 bp, Homo sapiens
tttaagtatttat

SEQ ID NO: 2809478 - DNA, 21 bp, Homo sapiens
tttaatagaatataattatcg

SEQ ID NO: 2809479 - DNA, 17 bp, Homo sapiens
tttaatagcaaagaatt

SEQ ID NO: 2809480 - DNA, 18 bp, Homo sapiens
tttaatagcaaagaattg

SEQ ID NO: 2809481 - DNA, 12 bp, Homo sapiens
tttaatcattta

SEQ ID NO: 2809482 - DNA, 21 bp, Homo sapiens
tttaatccagaattgaccttt

SEQ ID NO: 2809483 - DNA, 16 bp, Homo sapiens
tttaatgaacaaatgg

SEQ ID NO: 2809484 - DNA, 13 bp, Homo sapiens
tttaatgccttcc

SEQ ID NO: 2809485 - DNA, 17 bp, Homo sapiens
tttaatgtgtattgaag

SEQ ID NO: 2809486 - DNA, 23 bp, Homo sapiens
tttaattattatttatatatgta

SEQ ID NO: 2809487 - DNA, 11 bp, Homo sapiens
tttaattcata

SEQ ID NO: 2809488 - DNA, 12 bp, Homo sapiens
tttaattcataa

SEQ ID NO: 2809489 - DNA, 14 bp, Homo sapiens
tttaattcataatt

SEQ ID NO: 2809490 - DNA, 18 bp, Homo sapiens
tttaattcataattagaa

SEQ ID NO: 2809491 - DNA, 13 bp, Homo sapiens
tttacaaaacata

SEQ ID NO: 2809492 - DNA, 15 bp, Homo sapiens
tttacaaataaagat

SEQ ID NO: 2809493 - DNA, 15 bp, Homo sapiens
tttacaataaatatt

SEQ ID NO: 2809494 - DNA, 17 bp, Homo sapiens
tttacaataaatattct

SEQ ID NO: 2809495 - DNA, 16 bp, Homo sapiens
tttacagctgcctgca

SEQ ID NO: 2809496 - DNA, 19 bp, Homo sapiens
tttacatggggttttcaat

SEQ ID NO: 2809497 - DNA, 18 bp, Homo sapiens
tttacctaccacagtgtc

SEQ ID NO: 2809498 - DNA, 16 bp, Homo sapiens
tttacctgagaccagt

SEQ ID NO: 2809499 - DNA, 16 bp, Homo sapiens
tttaccttcagcagtt

SEQ ID NO: 2809500 - DNA, 20 bp, Homo sapiens
tttacctttattaatgaact

SEQ ID NO: 2809501 - DNA, 14 bp, Homo sapiens
tttactaaagcagt

SEQ ID NO: 2809502 - DNA, 15 bp, Homo sapiens
tttactaaagcagtg

SEQ ID NO: 2809503 - DNA, 15 bp, Homo sapiens
tttactaagtaaaag

SEQ ID NO: 2809504 - DNA, 16 bp, Homo sapiens
tttactactattctgt

SEQ ID NO: 2809505 - DNA, 13 bp, Homo sapiens
tttactattttac

SEQ ID NO: 2809506 - DNA, 14 bp, Homo sapiens
tttactgtctgtaa

SEQ ID NO: 2809507 - DNA, 19 bp, Homo sapiens
tttactgtctgtaagagaa

SEQ ID NO: 2809508 - DNA, 21 bp, Homo sapiens
tttacttgcattgaatatatt

SEQ ID NO: 2809509 - DNA, 12 bp, Homo sapiens
tttagaaaactt

SEQ ID NO: 2809510 - DNA, 13 bp, Homo sapiens
tttgcctctgcct

SEQ ID NO: 2809511 - DNA, 14 bp, Homo sapiens
tttgcctgtaacaa

SEQ ID NO: 2809512 - DNA, 19 bp, Homo sapiens
tttgcctgtgtgagcatct

SEQ ID NO: 2809513 - DNA, 22 bp, Homo sapiens
tttgctaactagcttggaaact

SEQ ID NO: 2809514 - DNA, 13 bp, Homo sapiens
tttgctaattaaa

SEQ ID NO: 2809515 - DNA, 19 bp, Homo sapiens
tttgctaattaaaaagtta

SEQ ID NO: 2809516 - DNA, 21 bp, Homo sapiens
tttgcttaaaattttactttt

SEQ ID NO: 2809517 - DNA, 22 bp, Homo sapiens
tttgcttttcctttgtttttat

SEQ ID NO: 2809518 - DNA, 20 bp, Homo sapiens
tttggaataataattttcct

SEQ ID NO: 2809519 - DNA, 19 bp, Homo sapiens
tttggagactctgtggggc

SEQ ID NO: 2809520 - DNA, 19 bp, Homo sapiens
tttggatatgtaaaacatt

SEQ ID NO: 2809521 - DNA, 21 bp, Homo sapiens
tttggatgggagtgagacaga

SEQ ID NO: 2809522 - DNA, 20 bp, Homo sapiens
tttggatttacgactgaaga

SEQ ID NO: 2809523 - DNA, 23 bp, Homo sapiens
tttggctctcctcagaagaaaga

SEQ ID NO: 2809524 - DNA, 22 bp, Homo sapiens
tttggggagggggaagagaaat

SEQ ID NO: 2809525 - DNA, 22 bp, Homo sapiens
tttggggtacccactgctctgg

SEQ ID NO: 2809526 - DNA, 13 bp, Homo sapiens
tttggtatattac

SEQ ID NO: 2809527 - DNA, 18 bp, Homo sapiens
tttggtgtggctgtattc

SEQ ID NO: 2809528 - DNA, 19 bp, Homo sapiens
tttggtttcccaagagcta

SEQ ID NO: 2809529 - DNA, 21 bp, Homo sapiens
tttggtttcccaagagctacg

SEQ ID NO: 2809530 - DNA, 23 bp, Homo sapiens
tttgtaaaagaacagtaaacatt

SEQ ID NO: 2809531 - DNA, 17 bp, Homo sapiens
tttgtaaactcaaaata

SEQ ID NO: 2809532 - DNA, 22 bp, Homo sapiens
tttgtaaactcaaaatatttgt

SEQ ID NO: 2809533 - DNA, 20 bp, Homo sapiens
tttgtaagttgaagcaaatc

SEQ ID NO: 2809534 - DNA, 15 bp, Homo sapiens
tttgtaataaactct

SEQ ID NO: 2809535 - DNA, 19 bp, Homo sapiens
tttgtaataaactctctag

SEQ ID NO: 2809536 - DNA, 15 bp, Homo sapiens
tttgtaatgtatctt

SEQ ID NO: 2809537 - DNA, 18 bp, Homo sapiens
tttgtaatgtatcttatt

SEQ ID NO: 2809538 - DNA, 21 bp, Homo sapiens
tttgtaatgtatcttatttat

SEQ ID NO: 2809539 - DNA, 14 bp, Homo sapiens
tttgtacagaattt

SEQ ID NO: 2809540 - DNA, 19 bp, Homo sapiens
tttgtacagaatttttaat

SEQ ID NO: 2809541 - DNA, 18 bp, Homo sapiens
tttgtacagacgtatgct

SEQ ID NO: 2809542 - DNA, 19 bp, Homo sapiens
tttgtacagacgtatgctt

SEQ ID NO: 2809543 - DNA, 22 bp, Homo sapiens
tttgtacagacgtatgcttatt

SEQ ID NO: 2809544 - DNA, 19 bp, Homo sapiens
tttgtacatatgtaaaata

SEQ ID NO: 2809545 - DNA, 16 bp, Homo sapiens
tttgtacattcctgat

SEQ ID NO: 2809546 - DNA, 13 bp, Homo sapiens
tttgtatttatat

SEQ ID NO: 2809547 - DNA, 22 bp, Homo sapiens
tttgtcatatattcatgtaata

SEQ ID NO: 2809548 - DNA, 20 bp, Homo sapiens
tttgtcccatttccttggag

SEQ ID NO: 2809549 - DNA, 13 bp, Homo sapiens
tttgtgccagccg

SEQ ID NO: 2809550 - DNA, 23 bp, Homo sapiens
tttgtgtgtcttttataaaaagt

SEQ ID NO: 2809551 - DNA, 22 bp, Homo sapiens
tttgttaatttagaaaacttta

SEQ ID NO: 2809552 - DNA, 15 bp, Homo sapiens
tttgttcccaagagc

SEQ ID NO: 2809553 - DNA, 15 bp, Homo sapiens
ttttaaaaaagctta

SEQ ID NO: 2809554 - DNA, 22 bp, Homo sapiens
ttttaaaaaagcttaaaacttt

SEQ ID NO: 2809555 - DNA, 16 bp, Homo sapiens
ttttaaaacacttcca

SEQ ID NO: 2809556 - DNA, 13 bp, Homo sapiens
ttttaaacagtga

SEQ ID NO: 2809557 - DNA, 19 bp, Homo sapiens
ttttaaacagtgagcctga

SEQ ID NO: 2809558 - DNA, 13 bp, Homo sapiens
ttttaaagaattg

SEQ ID NO: 2809559 - DNA, 16 bp, Homo sapiens
ttttaaagtatatatt

SEQ ID NO: 2809560 - DNA, 15 bp, Homo sapiens
ttttaaatgacattt

SEQ ID NO: 2809561 - DNA, 19 bp, Homo sapiens
ttttaaatgcataaatgca

SEQ ID NO: 2809562 - DNA, 20 bp, Homo sapiens
ttttaacacataactagaaa

SEQ ID NO: 2809563 - DNA, 23 bp, Homo sapiens
ttttaacacataactagaaacct

SEQ ID NO: 2809564 - DNA, 19 bp, Homo sapiens
ttttaacatttatctaaaa

SEQ ID NO: 2809565 - DNA, 13 bp, Homo sapiens
ttttaataaaatt

SEQ ID NO: 2809566 - DNA, 21 bp, Homo sapiens
ttttaatagaatataattatc

SEQ ID NO: 2809567 - DNA, 14 bp, Homo sapiens
ttttaatgccttcc

SEQ ID NO: 2809568 - DNA, 14 bp, Homo sapiens
ttttaatttctaca

SEQ ID NO: 2809569 - DNA, 13 bp, Homo sapiens
ttttacaaaacat

SEQ ID NO: 2809570 - DNA, 14 bp, Homo sapiens
ttttactactgtgg

SEQ ID NO: 2809571 - DNA, 15 bp, Homo sapiens
ttttactacttgtta

SEQ ID NO: 2809572 - DNA, 18 bp, Homo sapiens
ttttactgacagaaatgc

SEQ ID NO: 2809573 - DNA, 18 bp, Homo sapiens
ttttacttttgttctgta

SEQ ID NO: 2809574 - DNA, 23 bp, Homo sapiens
ttttagagattaatttgtgtaga

SEQ ID NO: 2809575 - DNA, 15 bp, Homo sapiens
ttttagtcttttact

SEQ ID NO: 2809576 - DNA, 17 bp, Homo sapiens
ttttatacatagtcaca

SEQ ID NO: 2809577 - DNA, 16 bp, Homo sapiens
ttttatacatatcaga

SEQ ID NO: 2809578 - DNA, 20 bp, Homo sapiens
ttttatacatatcagaaaag

SEQ ID NO: 2809579 - DNA, 23 bp, Homo sapiens
ttttatacatatcagaaaagtag

SEQ ID NO: 2809580 - DNA, 17 bp, Homo sapiens
ttttatactccatacat

SEQ ID NO: 2809581 - DNA, 15 bp, Homo sapiens
ttttatactgtactt

SEQ ID NO: 2809582 - DNA, 19 bp, Homo sapiens
ttttatgactgtaaacata

SEQ ID NO: 2809583 - DNA, 19 bp, Homo sapiens
ttttattgagaattttaaa

SEQ ID NO: 2809584 - DNA, 18 bp, Homo sapiens
ttttatttttagacagag

SEQ ID NO: 2809585 - DNA, 22 bp, Homo sapiens
ttttatttttgaacccctgtgt

SEQ ID NO: 2809586 - DNA, 20 bp, Homo sapiens
ttttcaaccagcattttact

SEQ ID NO: 2809587 - DNA, 22 bp, Homo sapiens
ttttcaaccagcattttactac

SEQ ID NO: 2809588 - DNA, 15 bp, Homo sapiens
ttttcaagaaactga

SEQ ID NO: 2809589 - DNA, 12 bp, Homo sapiens
ttttcacctcat

SEQ ID NO: 2809590 - DNA, 23 bp, Homo sapiens
ttttcacctggaagcatttgttt

SEQ ID NO: 2809591 - DNA, 16 bp, Homo sapiens
ttttcagaatgctctt

SEQ ID NO: 2809592 - DNA, 24 bp, Homo sapiens
ttttcagaattgaaggagaaaatg

SEQ ID NO: 2809593 - DNA, 16 bp, Homo sapiens
ttttcagactcagact

SEQ ID NO: 2809594 - DNA, 20 bp, Homo sapiens
ttttcagctattagcaactg

SEQ ID NO: 2809595 - DNA, 19 bp, Homo sapiens
ttttcatcaatttaaaatc

SEQ ID NO: 2809596 - DNA, 12 bp, Homo sapiens
ttttccaataaa

SEQ ID NO: 2809597 - DNA, 13 bp, Homo sapiens
ttttccaataaaa

SEQ ID NO: 2809598 - DNA, 18 bp, Homo sapiens
ttttcccaaaatgttgaa

SEQ ID NO: 2809599 - DNA, 17 bp, Homo sapiens
ttttccctctcttgcct

SEQ ID NO: 2809600 - DNA, 21 bp, Homo sapiens
agggctaagagctagcgctgc

SEQ ID NO: 2809601 - DNA, 22 bp, Homo sapiens
agggctaagagctagcgctgcc

SEQ ID NO: 2809602 - DNA, 14 bp, Homo sapiens
agggctcagcctgg

SEQ ID NO: 2809603 - DNA, 23 bp, Homo sapiens
agggctcagcggggacagctcct

SEQ ID NO: 2809604 - DNA, 12 bp, Homo sapiens
agggctctcctg

SEQ ID NO: 2809605 - DNA, 14 bp, Homo sapiens
agggctctcctggc

SEQ ID NO: 2809606 - DNA, 12 bp, Homo sapiens
agggctctgagg

SEQ ID NO: 2809607 - DNA, 13 bp, Homo sapiens
agggctctgaggc

SEQ ID NO: 2809608 - DNA, 16 bp, Homo sapiens
agggctctgaggcgcc

SEQ ID NO: 2809609 - DNA, 14 bp, Homo sapiens
agggctgcccctgt

SEQ ID NO: 2809610 - DNA, 17 bp, Homo sapiens
agggctgccgggccagg

SEQ ID NO: 2809611 - DNA, 11 bp, Homo sapiens
agggctgcctg

SEQ ID NO: 2809612 - DNA, 13 bp, Homo sapiens
agggctggaccta

SEQ ID NO: 2809613 - DNA, 23 bp, Homo sapiens
aggggaaaccagtgtagccttgc

SEQ ID NO: 2809614 - DNA, 19 bp, Homo sapiens
aggggaataatagaagaac

SEQ ID NO: 2809615 - DNA, 16 bp, Homo sapiens
aggggacagcgccacc

SEQ ID NO: 2809616 - DNA, 14 bp, Homo sapiens
aggggacatttccc

SEQ ID NO: 2809617 - DNA, 15 bp, Homo sapiens
aggggacatttccct

SEQ ID NO: 2809618 - DNA, 14 bp, Homo sapiens
aggggaggggccta

SEQ ID NO: 2809619 - DNA, 15 bp, Homo sapiens
aggggaggggcctag

SEQ ID NO: 2809620 - DNA, 14 bp, Homo sapiens
aggggatcaaagtt

SEQ ID NO: 2809621 - DNA, 17 bp, Homo sapiens
aggggcacgcctgccca

SEQ ID NO: 2809622 - DNA, 17 bp, Homo sapiens
aggggcagaaaaactct

SEQ ID NO: 2809623 - DNA, 12 bp, Homo sapiens
aggggcctaggg

SEQ ID NO: 2809624 - DNA, 14 bp, Homo sapiens
aggggcctagggag

SEQ ID NO: 2809625 - DNA, 17 bp, Homo sapiens
aggggctttctggagag

SEQ ID NO: 2809626 - DNA, 20 bp, Homo sapiens
aggggctttctggagaggag

SEQ ID NO: 2809627 - DNA, 21 bp, Homo sapiens
aggggggttgtgaggcctggc

SEQ ID NO: 2809628 - DNA, 17 bp, Homo sapiens
agggggtcgtggagagc

SEQ ID NO: 2809629 - DNA, 13 bp, Homo sapiens
aggggtcaggctc

SEQ ID NO: 2809630 - DNA, 13 bp, Homo sapiens
aggggtgatttca

SEQ ID NO: 2809631 - DNA, 19 bp, Homo sapiens
aggggttggttgaggtgga

SEQ ID NO: 2809632 - DNA, 20 bp, Homo sapiens
aggggttggttgaggtggaa

SEQ ID NO: 2809633 - DNA, 16 bp, Homo sapiens
aggggttgtcaagaga

SEQ ID NO: 2809634 - DNA, 19 bp, Homo sapiens
agggtaccttgaacactgg

SEQ ID NO: 2809635 - DNA, 15 bp, Homo sapiens
agggtagcaggtacc

SEQ ID NO: 2809636 - DNA, 14 bp, Homo sapiens
agggtcaggagagg

SEQ ID NO: 2809637 - DNA, 15 bp, Homo sapiens
agggtcaggagaggg

SEQ ID NO: 2809638 - DNA, 15 bp, Homo sapiens
agggtcctccacaat

SEQ ID NO: 2809639 - DNA, 18 bp, Homo sapiens
agggtcgccacacccggc

SEQ ID NO: 2809640 - DNA, 15 bp, Homo sapiens
agggtctagggagag

SEQ ID NO: 2809641 - DNA, 14 bp, Homo sapiens
agggtctcactctg

SEQ ID NO: 2809642 - DNA, 21 bp, Homo sapiens
agggtctcactctgtcgccca

SEQ ID NO: 2809643 - DNA, 19 bp, Homo sapiens
agggtctggagaagcagtg

SEQ ID NO: 2809644 - DNA, 20 bp, Homo sapiens
agggtgctaacgtatctcta

SEQ ID NO: 2809645 - DNA, 17 bp, Homo sapiens
agggtgggagagcccag

SEQ ID NO: 2809646 - DNA, 19 bp, Homo sapiens
agggtggtgacctctgcct

SEQ ID NO: 2809647 - DNA, 15 bp, Homo sapiens
agggttagggagggg

SEQ ID NO: 2809648 - DNA, 13 bp, Homo sapiens
agggttggcccct

SEQ ID NO: 2809649 - DNA, 14 bp, Homo sapiens
agggttggcccctg

SEQ ID NO: 2809650 - DNA, 18 bp, Homo sapiens
agggttggcccctgcccg

SEQ ID NO: 2809651 - DNA, 23 bp, Homo sapiens
agggttggcccctgcccggctgc

SEQ ID NO: 2809652 - DNA, 14 bp, Homo sapiens
agggttgtgatttt

SEQ ID NO: 2809653 - DNA, 15 bp, Homo sapiens
agggttttctcttgg

SEQ ID NO: 2809654 - DNA, 16 bp, Homo sapiens
agtctacctcttcagt

SEQ ID NO: 2809655 - DNA, 15 bp, Homo sapiens
agtctacgctctcct

SEQ ID NO: 2809656 - DNA, 20 bp, Homo sapiens
agtctacgctctcctttctt

SEQ ID NO: 2809657 - DNA, 17 bp, Homo sapiens
agtctcactgttgccca

SEQ ID NO: 2809658 - DNA, 20 bp, Homo sapiens
agtctcactgttgcccaggc

SEQ ID NO: 2809659 - DNA, 19 bp, Homo sapiens
agtctcctttgcactgagg

SEQ ID NO: 2809660 - DNA, 22 bp, Homo sapiens
agtctcctttgcactgagggcc

SEQ ID NO: 2809661 - DNA, 18 bp, Homo sapiens
agtctctatgatcttggc

SEQ ID NO: 2809662 - DNA, 17 bp, Homo sapiens
agtctctgactcttgcc

SEQ ID NO: 2809663 - DNA, 19 bp, Homo sapiens
agtctctgactcttgcctt

SEQ ID NO: 2809664 - DNA, 11 bp, Homo sapiens
agtctctggga

SEQ ID NO: 2809665 - DNA, 16 bp, Homo sapiens
agtctctgtgctttga

SEQ ID NO: 2809666 - DNA, 15 bp, Homo sapiens
agtctctttaatctt

SEQ ID NO: 2809667 - DNA, 15 bp, Homo sapiens
agtctgaggtcctga

SEQ ID NO: 2809668 - DNA, 22 bp, Homo sapiens
agtctgaggtcctgagcactgc

SEQ ID NO: 2809669 - DNA, 18 bp, Homo sapiens
agtctgattcccaagctc

SEQ ID NO: 2809670 - DNA, 21 bp, Homo sapiens
agtctgattcccaagctctgc

SEQ ID NO: 2809671 - DNA, 18 bp, Homo sapiens
agtctggaatgcagtggt

SEQ ID NO: 2809672 - DNA, 17 bp, Homo sapiens
agtctggatctgggacc

SEQ ID NO: 2809673 - DNA, 13 bp, Homo sapiens
agtctgtcatcca

SEQ ID NO: 2809674 - DNA, 17 bp, Homo sapiens
agtcttaaaataactta

SEQ ID NO: 2809675 - DNA, 16 bp, Homo sapiens
agtgaaagctagagat

SEQ ID NO: 2809676 - DNA, 22 bp, Homo sapiens
agtgaaataattaaaaaccact

SEQ ID NO: 2809677 - DNA, 12 bp, Homo sapiens
agtgaagaatac

SEQ ID NO: 2809678 - DNA, 22 bp, Homo sapiens
agtgaagccagctgcaggaatc

SEQ ID NO: 2809679 - DNA, 23 bp, Homo sapiens
agtgaatctaaaagcttttgctt

SEQ ID NO: 2809680 - DNA, 19 bp, Homo sapiens
agtgacacccaagagggct

SEQ ID NO: 2809681 - DNA, 20 bp, Homo sapiens
agtgacacccaagagggctg

SEQ ID NO: 2809682 - DNA, 13 bp, Homo sapiens
agtgacagagacc

SEQ ID NO: 2809683 - DNA, 19 bp, Homo sapiens
agtgacagagttcactata

SEQ ID NO: 2809684 - DNA, 12 bp, Homo sapiens
agtgacagctag

SEQ ID NO: 2809685 - DNA, 23 bp, Homo sapiens
agtgaccaggctcacaactgttt

SEQ ID NO: 2809686 - DNA, 17 bp, Homo sapiens
agtgacccacatgccat

SEQ ID NO: 2809687 - DNA, 22 bp, Homo sapiens
agtgactgtcgtgtttacaaaa

SEQ ID NO: 2809688 - DNA, 18 bp, Homo sapiens
agtgagaataattgtgta

SEQ ID NO: 2809689 - DNA, 20 bp, Homo sapiens
agtgagaataattgtgtaca

SEQ ID NO: 2809690 - DNA, 12 bp, Homo sapiens
agtgagacagaa

SEQ ID NO: 2809691 - DNA, 16 bp, Homo sapiens
agtgagaccctgtctc

SEQ ID NO: 2809692 - DNA, 17 bp, Homo sapiens
agtgagactctgtctca

SEQ ID NO: 2809693 - DNA, 13 bp, Homo sapiens
agtgagagacatt

SEQ ID NO: 2809694 - DNA, 14 bp, Homo sapiens
agtgagagctgggt

SEQ ID NO: 2809695 - DNA, 13 bp, Homo sapiens
agtgagagggcat

SEQ ID NO: 2809696 - DNA, 20 bp, Homo sapiens
agtgagatttgtatttatat

SEQ ID NO: 2809697 - DNA, 23 bp, Homo sapiens
agtgagatttgtatttatattag

SEQ ID NO: 2809698 - DNA, 14 bp, Homo sapiens
agtgagcactaagg

SEQ ID NO: 2809699 - DNA, 16 bp, Homo sapiens
agtgagccacagacca

SEQ ID NO: 2809700 - DNA, 19 bp, Homo sapiens
agtgagccacagaccacct

SEQ ID NO: 2809701 - DNA, 20 bp, Homo sapiens
agtgagccacagaccacctg

SEQ ID NO: 2809702 - DNA, 21 bp, Homo sapiens
agtgagccacagaccacctgc

SEQ ID NO: 2809703 - DNA, 22 bp, Homo sapiens
agtgagccgcatcttctccatc

SEQ ID NO: 2809704 - DNA, 17 bp, Homo sapiens
agtgagctgtaggtgtg

SEQ ID NO: 2809705 - DNA, 15 bp, Homo sapiens
agtgagtcgaggaca

SEQ ID NO: 2809706 - DNA, 16 bp, Homo sapiens
agtgagtcgaggacag

SEQ ID NO: 2809707 - DNA, 22 bp, Homo sapiens
agtgagttacagcgagaggcag

SEQ ID NO: 2809708 - DNA, 16 bp, Homo sapiens
atagctcttctattta

SEQ ID NO: 2809709 - DNA, 22 bp, Homo sapiens
atagctcttctatttaaaaaat

SEQ ID NO: 2809710 - DNA, 23 bp, Homo sapiens
atagctcttctatttaaaaaata

SEQ ID NO: 2809711 - DNA, 17 bp, Homo sapiens
atagctgagattcctgg

SEQ ID NO: 2809712 - DNA, 17 bp, Homo sapiens
atagctgggactacagg

SEQ ID NO: 2809713 - DNA, 19 bp, Homo sapiens
atagctttattttttaagt

SEQ ID NO: 2809714 - DNA, 16 bp, Homo sapiens
ataggctggagaagct

SEQ ID NO: 2809715 - DNA, 20 bp, Homo sapiens
ataggtagaatgtaaagctt

SEQ ID NO: 2809716 - DNA, 23 bp, Homo sapiens
ataggtagaatgtaaagcttgtc

SEQ ID NO: 2809717 - DNA, 18 bp, Homo sapiens
atagtaaaagataacaag

SEQ ID NO: 2809718 - DNA, 21 bp, Homo sapiens
atagtaactactttttatact

SEQ ID NO: 2809719 - DNA, 17 bp, Homo sapiens
atagtaccaatcatttt

SEQ ID NO: 2809720 - DNA, 16 bp, Homo sapiens
atagtagcagagtcat

SEQ ID NO: 2809721 - DNA, 17 bp, Homo sapiens
atagtagcatacattta

SEQ ID NO: 2809722 - DNA, 18 bp, Homo sapiens
atagtaggaccaatgttg

SEQ ID NO: 2809723 - DNA, 19 bp, Homo sapiens
atagtagtcaattagtaca

SEQ ID NO: 2809724 - DNA, 21 bp, Homo sapiens
atagtagtcaattagtacagt

SEQ ID NO: 2809725 - DNA, 15 bp, Homo sapiens
atagtatatctggac

SEQ ID NO: 2809726 - DNA, 16 bp, Homo sapiens
atagtatatttatact

SEQ ID NO: 2809727 - DNA, 17 bp, Homo sapiens
atagtatatttatactc

SEQ ID NO: 2809728 - DNA, 19 bp, Homo sapiens
atagtcaaaccataaactt

SEQ ID NO: 2809729 - DNA, 15 bp, Homo sapiens
atagtcacaaaaatg

SEQ ID NO: 2809730 - DNA, 17 bp, Homo sapiens
atagtggcttaaaacaa

SEQ ID NO: 2809731 - DNA, 17 bp, Homo sapiens
atagttcccatgttaaa

SEQ ID NO: 2809732 - DNA, 18 bp, Homo sapiens
atagttgtgggtgggaga

SEQ ID NO: 2809733 - DNA, 16 bp, Homo sapiens
atagtttactatttta

SEQ ID NO: 2809734 - DNA, 22 bp, Homo sapiens
atagtttactattttacttcta

SEQ ID NO: 2809735 - DNA, 18 bp, Homo sapiens
atagtttggatatgtaaa

SEQ ID NO: 2809736 - DNA, 15 bp, Homo sapiens
atagttttaaatatg

SEQ ID NO: 2809737 - DNA, 16 bp, Homo sapiens
atataaacttgtgtat

SEQ ID NO: 2809738 - DNA, 21 bp, Homo sapiens
atataaatatatatttttcaa

SEQ ID NO: 2809739 - DNA, 11 bp, Homo sapiens
atataaatgca

SEQ ID NO: 2809740 - DNA, 18 bp, Homo sapiens
atataaatggctggtttt

SEQ ID NO: 2809741 - DNA, 23 bp, Homo sapiens
atataaatggctggtttttagaa

SEQ ID NO: 2809742 - DNA, 17 bp, Homo sapiens
atataagaacttgatat

SEQ ID NO: 2809743 - DNA, 16 bp, Homo sapiens
atataatggtttactg

SEQ ID NO: 2809744 - DNA, 17 bp, Homo sapiens
atataatggtttactgc

SEQ ID NO: 2809745 - DNA, 18 bp, Homo sapiens
atataatggtttactgct

SEQ ID NO: 2809746 - DNA, 22 bp, Homo sapiens
atataatgttgttatttaaaga

SEQ ID NO: 2809747 - DNA, 15 bp, Homo sapiens
atataattgggattt

SEQ ID NO: 2809748 - DNA, 18 bp, Homo sapiens
atataattgggattttaa

SEQ ID NO: 2809749 - DNA, 18 bp, Homo sapiens
atataattgttttatctg

SEQ ID NO: 2809750 - DNA, 15 bp, Homo sapiens
atatacaaacatgtg

SEQ ID NO: 2809751 - DNA, 22 bp, Homo sapiens
atatacaaatatatttaattgt

SEQ ID NO: 2809752 - DNA, 15 bp, Homo sapiens
atatacagctcagaa

SEQ ID NO: 2809753 - DNA, 15 bp, Homo sapiens
atatacatattataa

SEQ ID NO: 2809754 - DNA, 19 bp, Homo sapiens
atatacatattataaataa

SEQ ID NO: 2809755 - DNA, 23 bp, Homo sapiens
atatagatcagttataagtagca

SEQ ID NO: 2809756 - DNA, 18 bp, Homo sapiens
atatagctatcatttctt

SEQ ID NO: 2809757 - DNA, 13 bp, Homo sapiens
atataggaagcat

SEQ ID NO: 2809758 - DNA, 15 bp, Homo sapiens
atataggaagcatat

SEQ ID NO: 2809759 - DNA, 19 bp, Homo sapiens
atatagtatatttatactc

SEQ ID NO: 2809760 - DNA, 16 bp, Homo sapiens
atatagtttactattt

SEQ ID NO: 2809761 - DNA, 12 bp, Homo sapiens
atatataaatat

SEQ ID NO: 2809762 - DNA, 17 bp, Homo sapiens
atatataaatatatatt

SEQ ID NO: 2809763 - DNA, 22 bp, Homo sapiens
atatataatggtttactgctgt

SEQ ID NO: 2809764 - DNA, 14 bp, Homo sapiens
atatatacatatat

SEQ ID NO: 2809765 - DNA, 13 bp, Homo sapiens
atatatacatgta

SEQ ID NO: 2809766 - DNA, 14 bp, Homo sapiens
atatatacatgtat

SEQ ID NO: 2809767 - DNA, 13 bp, Homo sapiens
atatatagaatct

SEQ ID NO: 2809768 - DNA, 13 bp, Homo sapiens
atatatatatagt

SEQ ID NO: 2809769 - DNA, 16 bp, Homo sapiens
atatatatatgtatat

SEQ ID NO: 2809770 - DNA, 16 bp, Homo sapiens
atatatatgtatatgt

SEQ ID NO: 2809771 - DNA, 13 bp, Homo sapiens
atatatcataaag

SEQ ID NO: 2809772 - DNA, 14 bp, Homo sapiens
atatatcataaagt

SEQ ID NO: 2809773 - DNA, 15 bp, Homo sapiens
atatatcataaagta

SEQ ID NO: 2809774 - DNA, 15 bp, Homo sapiens
atatatctatctatt

SEQ ID NO: 2809775 - DNA, 17 bp, Homo sapiens
atatatgaagtaagttc

SEQ ID NO: 2809776 - DNA, 14 bp, Homo sapiens
atatatgtatatgt

SEQ ID NO: 2809777 - DNA, 21 bp, Homo sapiens
atatatgtatatgtatatcta

SEQ ID NO: 2809778 - DNA, 22 bp, Homo sapiens
atatatgttttaagaggcaggg

SEQ ID NO: 2809779 - DNA, 12 bp, Homo sapiens
atatattcatgt

SEQ ID NO: 2809780 - DNA, 14 bp, Homo sapiens
atatattcatgtaa

SEQ ID NO: 2809781 - DNA, 19 bp, Homo sapiens
atatattggtaacatcctt

SEQ ID NO: 2809782 - DNA, 18 bp, Homo sapiens
atatatttactaaaagaa

SEQ ID NO: 2809783 - DNA, 10 bp, Homo sapiens
atatatttat

SEQ ID NO: 2809784 - DNA, 13 bp, Homo sapiens
atatatttataac

SEQ ID NO: 2809785 - DNA, 15 bp, Homo sapiens
atatatttataactc

SEQ ID NO: 2809786 - DNA, 14 bp, Homo sapiens
atatatttcagata

SEQ ID NO: 2809787 - DNA, 14 bp, Homo sapiens
atatatttcattct

SEQ ID NO: 2809788 - DNA, 14 bp, Homo sapiens
atatatttttcaac

SEQ ID NO: 2809789 - DNA, 19 bp, Homo sapiens
atatatttttcaaccagca

SEQ ID NO: 2809790 - DNA, 15 bp, Homo sapiens
atatatttttcacag

SEQ ID NO: 2809791 - DNA, 14 bp, Homo sapiens
atatcaattcaaca

SEQ ID NO: 2809792 - DNA, 17 bp, Homo sapiens
atatcagaaaagtagaa

SEQ ID NO: 2809793 - DNA, 19 bp, Homo sapiens
atatcagaaaagtagaatt

SEQ ID NO: 2809794 - DNA, 20 bp, Homo sapiens
atatcagaaaagtagaatta

SEQ ID NO: 2809795 - DNA, 21 bp, Homo sapiens
atatcagaaaagtagaattat

SEQ ID NO: 2809796 - DNA, 18 bp, Homo sapiens
atatcagaatcgctaata

SEQ ID NO: 2809797 - DNA, 18 bp, Homo sapiens
atatcagacctctgatcc

SEQ ID NO: 2809798 - DNA, 12 bp, Homo sapiens
atatcagcctga

SEQ ID NO: 2809799 - DNA, 20 bp, Homo sapiens
atatttttcaaccagcattt

SEQ ID NO: 2809800 - DNA, 21 bp, Homo sapiens
atatttttggttgtcaatatt

SEQ ID NO: 2809801 - DNA, 21 bp, Homo sapiens
atcaaaacctttcaaatatca

SEQ ID NO: 2809802 - DNA, 21 bp, Homo sapiens
atcaaaatccctatttaattt

SEQ ID NO: 2809803 - DNA, 11 bp, Homo sapiens
atcaaaatctt

SEQ ID NO: 2809804 - DNA, 23 bp, Homo sapiens
atcaaacaccaacataaaaatga

SEQ ID NO: 2809805 - DNA, 16 bp, Homo sapiens
atcaaactgaagccag

SEQ ID NO: 2809806 - DNA, 15 bp, Homo sapiens
atcaacaaagaaata

SEQ ID NO: 2809807 - DNA, 19 bp, Homo sapiens
atcaaccccagacactggt

SEQ ID NO: 2809808 - DNA, 22 bp, Homo sapiens
atcaatccttcttatgtttgct

SEQ ID NO: 2809809 - DNA, 19 bp, Homo sapiens
atcaatgtttcttctaggt

SEQ ID NO: 2809810 - DNA, 14 bp, Homo sapiens
atcaattaattctt

SEQ ID NO: 2809811 - DNA, 15 bp, Homo sapiens
atcaattcaacacat

SEQ ID NO: 2809812 - DNA, 14 bp, Homo sapiens
atcaatttttatac

SEQ ID NO: 2809813 - DNA, 16 bp, Homo sapiens
atcaatttttatacat

SEQ ID NO: 2809814 - DNA, 22 bp, Homo sapiens
atcaatttttatacatatcaga

SEQ ID NO: 2809815 - DNA, 13 bp, Homo sapiens
atcacaagcaata

SEQ ID NO: 2809816 - DNA, 18 bp, Homo sapiens
atcacaagcaataattag

SEQ ID NO: 2809817 - DNA, 22 bp, Homo sapiens
atcacagggccccagaaggcag

SEQ ID NO: 2809818 - DNA, 15 bp, Homo sapiens
atcacatacaatttg

SEQ ID NO: 2809819 - DNA, 18 bp, Homo sapiens
atcacatacaatttgcac

SEQ ID NO: 2809820 - DNA, 19 bp, Homo sapiens
atcacatacaatttgcact

SEQ ID NO: 2809821 - DNA, 15 bp, Homo sapiens
atcacatattctagt

SEQ ID NO: 2809822 - DNA, 15 bp, Homo sapiens
atcacattatttgca

SEQ ID NO: 2809823 - DNA, 16 bp, Homo sapiens
atcacattatttgcat

SEQ ID NO: 2809824 - DNA, 15 bp, Homo sapiens
atcaccagcccggcc

SEQ ID NO: 2809825 - DNA, 20 bp, Homo sapiens
atcaccgagagtagccgaga

SEQ ID NO: 2809826 - DNA, 12 bp, Homo sapiens
atcacctcaggc

SEQ ID NO: 2809827 - DNA, 17 bp, Homo sapiens
atcacggatcaatagac

SEQ ID NO: 2809828 - DNA, 18 bp, Homo sapiens
atcacggctcactgcagc

SEQ ID NO: 2809829 - DNA, 22 bp, Homo sapiens
atcacggctcactgcagcctca

SEQ ID NO: 2809830 - DNA, 15 bp, Homo sapiens
atcactataaccatc

SEQ ID NO: 2809831 - DNA, 14 bp, Homo sapiens
atcacttaatgaac

SEQ ID NO: 2809832 - DNA, 19 bp, Homo sapiens
acctctttattttttgatt

SEQ ID NO: 2809833 - DNA, 14 bp, Homo sapiens
acctgaagaatcac

SEQ ID NO: 2809834 - DNA, 16 bp, Homo sapiens
acctgacaagcactgc

SEQ ID NO: 2809835 - DNA, 17 bp, Homo sapiens
acctgaccaacatggag

SEQ ID NO: 2809836 - DNA, 12 bp, Homo sapiens
acctgagcctgc

SEQ ID NO: 2809837 - DNA, 21 bp, Homo sapiens
acctgatgttaaaattccatc

SEQ ID NO: 2809838 - DNA, 15 bp, Homo sapiens
acctgcacctccccc

SEQ ID NO: 2809839 - DNA, 19 bp, Homo sapiens
acctgcacctccccccact

SEQ ID NO: 2809840 - DNA, 22 bp, Homo sapiens
acctgcatccgtagttccctga

SEQ ID NO: 2809841 - DNA, 16 bp, Homo sapiens
acctgccagcctggct

SEQ ID NO: 2809842 - DNA, 21 bp, Homo sapiens
acctgccagcctggcttctgg

SEQ ID NO: 2809843 - DNA, 21 bp, Homo sapiens
acctgcccaacctgctctcct

SEQ ID NO: 2809844 - DNA, 15 bp, Homo sapiens
acctgccccctggtg

SEQ ID NO: 2809845 - DNA, 16 bp, Homo sapiens
acctgccccgcccagc

SEQ ID NO: 2809846 - DNA, 13 bp, Homo sapiens
acctgccctgccc

SEQ ID NO: 2809847 - DNA, 17 bp, Homo sapiens
acctgccctgccctgcc

SEQ ID NO: 2809848 - DNA, 17 bp, Homo sapiens
acctgccgacctcgtcc

SEQ ID NO: 2809849 - DNA, 18 bp, Homo sapiens
acctgcctatccatcctg

SEQ ID NO: 2809850 - DNA, 18 bp, Homo sapiens
acctgctctcctcttgcc

SEQ ID NO: 2809851 - DNA, 22 bp, Homo sapiens
acctgctgagagacccaaggag

SEQ ID NO: 2809852 - DNA, 14 bp, Homo sapiens
acctgctgagctct

SEQ ID NO: 2809853 - DNA, 16 bp, Homo sapiens
acctgctgagctctga

SEQ ID NO: 2809854 - DNA, 21 bp, Homo sapiens
acctgctgagctctgagaggc

SEQ ID NO: 2809855 - DNA, 21 bp, Homo sapiens
acctgcttctgaactcaagct

SEQ ID NO: 2809856 - DNA, 20 bp, Homo sapiens
acctggaatcagattattaa

SEQ ID NO: 2809857 - DNA, 19 bp, Homo sapiens
acctggccgcctccaggag

SEQ ID NO: 2809858 - DNA, 21 bp, Homo sapiens
acctggccgcctccaggagcc

SEQ ID NO: 2809859 - DNA, 16 bp, Homo sapiens
acctgggaaccatgaa

SEQ ID NO: 2809860 - DNA, 14 bp, Homo sapiens
acctgggccctggg

SEQ ID NO: 2809861 - DNA, 19 bp, Homo sapiens
acctgggccctggggcctg

SEQ ID NO: 2809862 - DNA, 19 bp, Homo sapiens
acctggtactgcacatttt

SEQ ID NO: 2809863 - DNA, 21 bp, Homo sapiens
acctggtcacaggactctgcc

SEQ ID NO: 2809864 - DNA, 22 bp, Homo sapiens
acctggtcacaggactctgcct

SEQ ID NO: 2809865 - DNA, 16 bp, Homo sapiens
acctgtagtgagaaac

SEQ ID NO: 2809866 - DNA, 17 bp, Homo sapiens
acctgtatgtctccagt

SEQ ID NO: 2809867 - DNA, 19 bp, Homo sapiens
acctgtcaccgtgagcagc

SEQ ID NO: 2809868 - DNA, 18 bp, Homo sapiens
acctgtcagcccaagcag

SEQ ID NO: 2809869 - DNA, 14 bp, Homo sapiens
acctgtctgtctgt

SEQ ID NO: 2809870 - DNA, 20 bp, Homo sapiens
acctgtctgtctgtctgtcc

SEQ ID NO: 2809871 - DNA, 18 bp, Homo sapiens
acctgtgcaccccatgag

SEQ ID NO: 2809872 - DNA, 16 bp, Homo sapiens
acctgtgtggacagga

SEQ ID NO: 2809873 - DNA, 20 bp, Homo sapiens
acctgtgtttcttgcctcat

SEQ ID NO: 2809874 - DNA, 18 bp, Homo sapiens
acctgttaaaatgtacac

SEQ ID NO: 2809875 - DNA, 14 bp, Homo sapiens
actgtgtgaagaaa

SEQ ID NO: 2809876 - DNA, 19 bp, Homo sapiens
actgtgtgcagactcaata

SEQ ID NO: 2809877 - DNA, 16 bp, Homo sapiens
actgtgttcagtgcct

SEQ ID NO: 2809878 - DNA, 17 bp, Homo sapiens
actgttaatagttcagg

SEQ ID NO: 2809879 - DNA, 20 bp, Homo sapiens
actgttactttttagtcttt

SEQ ID NO: 2809880 - DNA, 22 bp, Homo sapiens
actgttactttttagtctttta

SEQ ID NO: 2809881 - DNA, 20 bp, Homo sapiens
actgttctggcctcagacca

SEQ ID NO: 2809882 - DNA, 17 bp, Homo sapiens
actgttgcccaggctgg

SEQ ID NO: 2809883 - DNA, 12 bp, Homo sapiens
actgttgctcaa

SEQ ID NO: 2809884 - DNA, 21 bp, Homo sapiens
actgttgctcaaatctattca

SEQ ID NO: 2809885 - DNA, 21 bp, Homo sapiens
actgtttgccttctactttta

SEQ ID NO: 2809886 - DNA, 18 bp, Homo sapiens
actgtttttcggacagtt

SEQ ID NO: 2809887 - DNA, 19 bp, Homo sapiens
actgtttttcggacagttt

SEQ ID NO: 2809888 - DNA, 16 bp, Homo sapiens
actgtttttgaagaag

SEQ ID NO: 2809889 - DNA, 15 bp, Homo sapiens
acttaaaaaaatgac

SEQ ID NO: 2809890 - DNA, 16 bp, Homo sapiens
acttaaaaaaatgaca

SEQ ID NO: 2809891 - DNA, 14 bp, Homo sapiens
acttaaaagattca

SEQ ID NO: 2809892 - DNA, 15 bp, Homo sapiens
acttaaagcttgttt

SEQ ID NO: 2809893 - DNA, 20 bp, Homo sapiens
acttaaatagcatctgctct

SEQ ID NO: 2809894 - DNA, 14 bp, Homo sapiens
acttaaatcactga

SEQ ID NO: 2809895 - DNA, 19 bp, Homo sapiens
acttaactgtgtgaagaaa

SEQ ID NO: 2809896 - DNA, 13 bp, Homo sapiens
acttaataaattc

SEQ ID NO: 2809897 - DNA, 13 bp, Homo sapiens
acttaatgaacca

SEQ ID NO: 2809898 - DNA, 19 bp, Homo sapiens
acttacatgattcatttta

SEQ ID NO: 2809899 - DNA, 21 bp, Homo sapiens
acttaccaggcaccaaaagaa

SEQ ID NO: 2809900 - DNA, 17 bp, Homo sapiens
acttacctagatttaca

SEQ ID NO: 2809901 - DNA, 20 bp, Homo sapiens
acttaccttcaataaagtat

SEQ ID NO: 2809902 - DNA, 20 bp, Homo sapiens
acttagtgcggacaagtttt

SEQ ID NO: 2809903 - DNA, 17 bp, Homo sapiens
acttatatcatcagcat

SEQ ID NO: 2809904 - DNA, 19 bp, Homo sapiens
acttatttttgacagtgtt

SEQ ID NO: 2809905 - DNA, 14 bp, Homo sapiens
acttcacactgcaa

SEQ ID NO: 2809906 - DNA, 14 bp, Homo sapiens
acttcagagaagtc

SEQ ID NO: 2809907 - DNA, 11 bp, Homo sapiens
acttcagcacc

SEQ ID NO: 2809908 - DNA, 19 bp, Homo sapiens
acttcataaatgttcagct

SEQ ID NO: 2809909 - DNA, 13 bp, Homo sapiens
acttcatggacca

SEQ ID NO: 2809910 - DNA, 18 bp, Homo sapiens
acttcatggaccaagaat

SEQ ID NO: 2809911 - DNA, 15 bp, Homo sapiens
acttcattcttgaaa

SEQ ID NO: 2809912 - DNA, 16 bp, Homo sapiens
acttcattttcagagt

SEQ ID NO: 2809913 - DNA, 17 bp, Homo sapiens
acttccatgaggccaaa

SEQ ID NO: 2809914 - DNA, 19 bp, Homo sapiens
acttcccattttggaagtt

SEQ ID NO: 2809915 - DNA, 15 bp, Homo sapiens
acttcctgtgacttc

SEQ ID NO: 2809916 - DNA, 14 bp, Homo sapiens
acttctaaatgttg

SEQ ID NO: 2809917 - DNA, 17 bp, Homo sapiens
acttctcaggacacagg

SEQ ID NO: 2809918 - DNA, 14 bp, Homo sapiens
acttctccaccctg

SEQ ID NO: 2809919 - DNA, 16 bp, Homo sapiens
acttctccaccctgct

SEQ ID NO: 2809920 - DNA, 18 bp, Homo sapiens
acttctccaccctgctct

SEQ ID NO: 2809921 - DNA, 17 bp, Homo sapiens
acttctctactctggaa

SEQ ID NO: 2809922 - DNA, 11 bp, Homo sapiens
acttctctcca

SEQ ID NO: 2809923 - DNA, 14 bp, Homo sapiens
acttctctttctta

SEQ ID NO: 2809924 - DNA, 16 bp, Homo sapiens
acttctctttgcctca

SEQ ID NO: 2809925 - DNA, 19 bp, Homo sapiens
acttctgccatattctgtt

SEQ ID NO: 2809926 - DNA, 22 bp, Homo sapiens
acttcttaatgctttcctccct

SEQ ID NO: 2809927 - DNA, 15 bp, Homo sapiens
acttcttttataact

SEQ ID NO: 2809928 - DNA, 22 bp, Homo sapiens
acttcttttataactagtcctt

SEQ ID NO: 2809929 - DNA, 19 bp, Homo sapiens
acttcttttgctcttagct

SEQ ID NO: 2809930 - DNA, 20 bp, Homo sapiens
acttcttttgctcttagctg

SEQ ID NO: 2809931 - DNA, 19 bp, Homo sapiens
acttgaaataccagtgaac

SEQ ID NO: 2809932 - DNA, 16 bp, Homo sapiens
acttgaaattatatct

SEQ ID NO: 2809933 - DNA, 20 bp, Homo sapiens
acttgacagaacactgtctt

SEQ ID NO: 2809934 - DNA, 19 bp, Homo sapiens
acttgagcctccatttctg

SEQ ID NO: 2809935 - DNA, 17 bp, Homo sapiens
acttgaggacacatgtc

SEQ ID NO: 2809936 - DNA, 19 bp, Homo sapiens
acttgaggacacatgtcca

SEQ ID NO: 2809937 - DNA, 23 bp, Homo sapiens
acttgcagactctacagaggcca

SEQ ID NO: 2809938 - DNA, 19 bp, Homo sapiens
acttgcattgaatatatta

SEQ ID NO: 2809939 - DNA, 17 bp, Homo sapiens
acttgggcacccccagc

SEQ ID NO: 2809940 - DNA, 20 bp, Homo sapiens
acttgggcacccccagcctg

SEQ ID NO: 2809941 - DNA, 19 bp, Homo sapiens
acttgggcgctctgccctc

SEQ ID NO: 2809942 - DNA, 18 bp, Homo sapiens
acttggtgtaattaataa

SEQ ID NO: 2809943 - DNA, 14 bp, Homo sapiens
acttggttttgcta

SEQ ID NO: 2809944 - DNA, 13 bp, Homo sapiens
acttgtaaataca

SEQ ID NO: 2809945 - DNA, 16 bp, Homo sapiens
acttgtaaatacacca

SEQ ID NO: 2809946 - DNA, 16 bp, Homo sapiens
acttgtatctgaagac

SEQ ID NO: 2809947 - DNA, 14 bp, Homo sapiens
acttgtatgaaaga

SEQ ID NO: 2809948 - DNA, 15 bp, Homo sapiens
acttgtcctatgtca

SEQ ID NO: 2809949 - DNA, 22 bp, Homo sapiens
acttgtgctgatcgtgctaaat

SEQ ID NO: 2809950 - DNA, 14 bp, Homo sapiens
acttgtggacacag

SEQ ID NO: 2809951 - DNA, 19 bp, Homo sapiens
acttgtggacacagctctt

SEQ ID NO: 2809952 - DNA, 17 bp, Homo sapiens
acttgtgtatgatccaa

SEQ ID NO: 2809953 - DNA, 21 bp, Homo sapiens
acttgtgtctctgtgctttta

SEQ ID NO: 2809954 - DNA, 12 bp, Homo sapiens
actttaaagtct

SEQ ID NO: 2809955 - DNA, 15 bp, Homo sapiens
actttaaccctctct

SEQ ID NO: 2809956 - DNA, 23 bp, Homo sapiens
actttaattctcatgtgatcctt

SEQ ID NO: 2809957 - DNA, 13 bp, Homo sapiens
actttaattgtgt

SEQ ID NO: 2809958 - DNA, 13 bp, Homo sapiens
actttactctaag

SEQ ID NO: 2809959 - DNA, 15 bp, Homo sapiens
actttagaatgagag

SEQ ID NO: 2809960 - DNA, 14 bp, Homo sapiens
actttatcacatta

SEQ ID NO: 2809961 - DNA, 12 bp, Homo sapiens
actttcattttt

SEQ ID NO: 2809962 - DNA, 14 bp, Homo sapiens
actttcgggagggt

SEQ ID NO: 2809963 - DNA, 16 bp, Homo sapiens
actttctttctcacta

SEQ ID NO: 2809964 - DNA, 22 bp, Homo sapiens
actttctttctcactaaatctt

SEQ ID NO: 2809965 - DNA, 15 bp, Homo sapiens
actttcttttctgga

SEQ ID NO: 2809966 - DNA, 21 bp, Homo sapiens
agaatttctttgtcattcaag

SEQ ID NO: 2809967 - DNA, 19 bp, Homo sapiens
agaatttgtattttgctta

SEQ ID NO: 2809968 - DNA, 14 bp, Homo sapiens
agaattttaccaaa

SEQ ID NO: 2809969 - DNA, 17 bp, Homo sapiens
agaattttaccaaaatt

SEQ ID NO: 2809970 - DNA, 20 bp, Homo sapiens
agaattttcagaccccagcg

SEQ ID NO: 2809971 - DNA, 16 bp, Homo sapiens
agacaaaaacagcctc

SEQ ID NO: 2809972 - DNA, 19 bp, Homo sapiens
agacaaacacctcccagga

SEQ ID NO: 2809973 - DNA, 17 bp, Homo sapiens
agacaactcttccattt

SEQ ID NO: 2809974 - DNA, 15 bp, Homo sapiens
agacaataaaacatt

SEQ ID NO: 2809975 - DNA, 13 bp, Homo sapiens
agacacaggcccg

SEQ ID NO: 2809976 - DNA, 16 bp, Homo sapiens
agacacaggcccggct

SEQ ID NO: 2809977 - DNA, 21 bp, Homo sapiens
agacacctgcacctcccccca

SEQ ID NO: 2809978 - DNA, 16 bp, Homo sapiens
agacacctgtgcaccc

SEQ ID NO: 2809979 - DNA, 19 bp, Homo sapiens
agacaccttgacagggcac

SEQ ID NO: 2809980 - DNA, 16 bp, Homo sapiens
agacacgctcttctat

SEQ ID NO: 2809981 - DNA, 21 bp, Homo sapiens
agacacttcatggaccaagaa

SEQ ID NO: 2809982 - DNA, 22 bp, Homo sapiens
agacacttcatggaccaagaat

SEQ ID NO: 2809983 - DNA, 13 bp, Homo sapiens
agacacttgcctt

SEQ ID NO: 2809984 - DNA, 21 bp, Homo sapiens
agacagaaaaaaataaaaaca

SEQ ID NO: 2809985 - DNA, 12 bp, Homo sapiens
agacagaagaaa

SEQ ID NO: 2809986 - DNA, 17 bp, Homo sapiens
agacagaagaaacaagg

SEQ ID NO: 2809987 - DNA, 21 bp, Homo sapiens
agacagagtctcactgttgcc

SEQ ID NO: 2809988 - DNA, 12 bp, Homo sapiens
agacagcagctc

SEQ ID NO: 2809989 - DNA, 19 bp, Homo sapiens
agacaggaaaatcctctgg

SEQ ID NO: 2809990 - DNA, 14 bp, Homo sapiens
agacaggagggcaa

SEQ ID NO: 2809991 - DNA, 19 bp, Homo sapiens
agacaggagggcaagggcc

SEQ ID NO: 2809992 - DNA, 23 bp, Homo sapiens
agacaggagggcaagggccatgc

SEQ ID NO: 2809993 - DNA, 20 bp, Homo sapiens
agacaggcaagcacctcctg

SEQ ID NO: 2809994 - DNA, 22 bp, Homo sapiens
agacaggcaagcacctcctgcc

SEQ ID NO: 2809995 - DNA, 23 bp, Homo sapiens
agacaggcaagcacctcctgcct

SEQ ID NO: 2809996 - DNA, 15 bp, Homo sapiens
agacaggcccaagag

SEQ ID NO: 2809997 - DNA, 22 bp, Homo sapiens
agacaggcccaagagatgaaga

SEQ ID NO: 2809998 - DNA, 15 bp, Homo sapiens
agacaggtggcctag

SEQ ID NO: 2809999 - DNA, 17 bp, Homo sapiens
agacagtatatttatag

SEQ ID NO: 2810000 - DNA, 14 bp, Homo sapiens
agacagttcaagaa

SEQ ID NO: 2810001 - DNA, 15 bp, Homo sapiens
agacagttcaagaaa

SEQ ID NO: 2810002 - DNA, 19 bp, Homo sapiens
agacatggagactcctgcc

SEQ ID NO: 2810003 - DNA, 13 bp, Homo sapiens
agaccaaaataaa

SEQ ID NO: 2810004 - DNA, 14 bp, Homo sapiens
agaccaaggcggga

SEQ ID NO: 2810005 - DNA, 17 bp, Homo sapiens
agaccaaggcgggagca

SEQ ID NO: 2810006 - DNA, 15 bp, Homo sapiens
agaccacctccctgc

SEQ ID NO: 2810007 - DNA, 17 bp, Homo sapiens
agaccacctgcttctga

SEQ ID NO: 2810008 - DNA, 21 bp, Homo sapiens
agaccacctgcttctgaactc

SEQ ID NO: 2810009 - DNA, 22 bp, Homo sapiens
agaccagactgtggagaaataa

SEQ ID NO: 2810010 - DNA, 13 bp, Homo sapiens
agaccagcctggc

SEQ ID NO: 2810011 - DNA, 15 bp, Homo sapiens
agaccagcctggcca

SEQ ID NO: 2810012 - DNA, 12 bp, Homo sapiens
agaccagctcag

SEQ ID NO: 2810013 - DNA, 15 bp, Homo sapiens
agaccagctcagagg

SEQ ID NO: 2810014 - DNA, 13 bp, Homo sapiens
agaccagttggga

SEQ ID NO: 2810015 - DNA, 19 bp, Homo sapiens
agaccagttgggagcactg

SEQ ID NO: 2810016 - DNA, 20 bp, Homo sapiens
agaccagttgggagcactgg

SEQ ID NO: 2810017 - DNA, 16 bp, Homo sapiens
agacccagatctcatg

SEQ ID NO: 2810018 - DNA, 17 bp, Homo sapiens
agacccagatctcatgg

SEQ ID NO: 2810019 - DNA, 15 bp, Homo sapiens
agacccattcctatt

SEQ ID NO: 2810020 - DNA, 16 bp, Homo sapiens
agacccattcctattt

SEQ ID NO: 2810021 - DNA, 19 bp, Homo sapiens
agaccccttcctttcctct

SEQ ID NO: 2810022 - DNA, 14 bp, Homo sapiens
agacccggctgcgt

SEQ ID NO: 2810023 - DNA, 13 bp, Homo sapiens
agaccctgtctct

SEQ ID NO: 2810024 - DNA, 17 bp, Homo sapiens
agacccttgcattagaa

SEQ ID NO: 2810025 - DNA, 11 bp, Homo sapiens
agacctcagcc

SEQ ID NO: 2810026 - DNA, 14 bp, Homo sapiens
agacctcagcctgt

SEQ ID NO: 2810027 - DNA, 16 bp, Homo sapiens
agacctcagcctgtgc

SEQ ID NO: 2810028 - DNA, 17 bp, Homo sapiens
agacctcagcctgtgct

SEQ ID NO: 2810029 - DNA, 13 bp, Homo sapiens
agacctctgatcc

SEQ ID NO: 2810030 - DNA, 17 bp, Homo sapiens
agacctgacaagcactg

SEQ ID NO: 2810031 - DNA, 13 bp, Homo sapiens
agacctgtaatca

SEQ ID NO: 2810032 - DNA, 19 bp, Homo sapiens
agaccttctccaaatgaga

SEQ ID NO: 2810033 - DNA, 14 bp, Homo sapiens
agacggattgcatt

SEQ ID NO: 2810034 - DNA, 16 bp, Homo sapiens
agacgtatgcttattt

SEQ ID NO: 2810035 - DNA, 18 bp, Homo sapiens
agacgtatgcttatttta

SEQ ID NO: 2810036 - DNA, 14 bp, Homo sapiens
agacgtcctggaat

SEQ ID NO: 2810037 - DNA, 17 bp, Homo sapiens
agacgtcctggaatgaa

SEQ ID NO: 2810038 - DNA, 23 bp, Homo sapiens
agactagttgaacatctcacttt

SEQ ID NO: 2810039 - DNA, 20 bp, Homo sapiens
agactatgtgtcatgatttc

SEQ ID NO: 2810040 - DNA, 18 bp, Homo sapiens
agactcacctctgcctca

SEQ ID NO: 2810041 - DNA, 15 bp, Homo sapiens
agactcagctccaga

SEQ ID NO: 2810042 - DNA, 20 bp, Homo sapiens
agactcagggccccagcact

SEQ ID NO: 2810043 - DNA, 21 bp, Homo sapiens
agactcagggccccagcacta

SEQ ID NO: 2810044 - DNA, 15 bp, Homo sapiens
agactcattcttctg

SEQ ID NO: 2810045 - DNA, 17 bp, Homo sapiens
agactccttcaacaatt

SEQ ID NO: 2810046 - DNA, 21 bp, Homo sapiens
agactccttcaacaattctaa

SEQ ID NO: 2810047 - DNA, 19 bp, Homo sapiens
agactctacagaggccatg

SEQ ID NO: 2810048 - DNA, 21 bp, Homo sapiens
agactctaggacataaattag

SEQ ID NO: 2810049 - DNA, 17 bp, Homo sapiens
agactgacacctcactg

SEQ ID NO: 2810050 - DNA, 23 bp, Homo sapiens
agactgcgatttgtcccaggtcc

SEQ ID NO: 2810051 - DNA, 13 bp, Homo sapiens
agactggaacttg

SEQ ID NO: 2810052 - DNA, 23 bp, Homo sapiens
agactggaacttgaactgattca

SEQ ID NO: 2810053 - DNA, 17 bp, Homo sapiens
agactggaagcacagct

SEQ ID NO: 2810054 - DNA, 11 bp, Homo sapiens
agactggacag

SEQ ID NO: 2810055 - DNA, 14 bp, Homo sapiens
agactggacagctt

SEQ ID NO: 2810056 - DNA, 16 bp, Homo sapiens
agactggacagcttgt

SEQ ID NO: 2810057 - DNA, 22 bp, Homo sapiens
agcaatccatgttagtttttac

SEQ ID NO: 2810058 - DNA, 18 bp, Homo sapiens
agcaatgatgtccagaag

SEQ ID NO: 2810059 - DNA, 17 bp, Homo sapiens
agcaattcatttcactt

SEQ ID NO: 2810060 - DNA, 20 bp, Homo sapiens
agcaattcatttcactttaa

SEQ ID NO: 2810061 - DNA, 17 bp, Homo sapiens
agcacaagttatttaaa

SEQ ID NO: 2810062 - DNA, 18 bp, Homo sapiens
agcacaagttatttaaat

SEQ ID NO: 2810063 - DNA, 21 bp, Homo sapiens
agcacaagttatttaaatctg

SEQ ID NO: 2810064 - DNA, 14 bp, Homo sapiens
agcacaatttatat

SEQ ID NO: 2810065 - DNA, 14 bp, Homo sapiens
agcacactgtagca

SEQ ID NO: 2810066 - DNA, 23 bp, Homo sapiens
agcacagaaggaatctgtgcaga

SEQ ID NO: 2810067 - DNA, 12 bp, Homo sapiens
agcacaggctaa

SEQ ID NO: 2810068 - DNA, 16 bp, Homo sapiens
agcacaggctaatttt

SEQ ID NO: 2810069 - DNA, 13 bp, Homo sapiens
agcacatctggga

SEQ ID NO: 2810070 - DNA, 18 bp, Homo sapiens
agcacatttctcctgttt

SEQ ID NO: 2810071 - DNA, 17 bp, Homo sapiens
agcaccagcttctccag

SEQ ID NO: 2810072 - DNA, 20 bp, Homo sapiens
agcaccagcttctccaggct

SEQ ID NO: 2810073 - DNA, 12 bp, Homo sapiens
agcaccccctca

SEQ ID NO: 2810074 - DNA, 20 bp, Homo sapiens
agcaccccctcattcccctc

SEQ ID NO: 2810075 - DNA, 14 bp, Homo sapiens
agcacctcctgcct

SEQ ID NO: 2810076 - DNA, 16 bp, Homo sapiens
agcacctgccgacctc

SEQ ID NO: 2810077 - DNA, 18 bp, Homo sapiens
agcacgaaatgttatttt

SEQ ID NO: 2810078 - DNA, 13 bp, Homo sapiens
agcactaaagcag

SEQ ID NO: 2810079 - DNA, 16 bp, Homo sapiens
agcactaacgtaaata

SEQ ID NO: 2810080 - DNA, 20 bp, Homo sapiens
agcactcaaccaacctcccc

SEQ ID NO: 2810081 - DNA, 17 bp, Homo sapiens
agcactcagaaaagaaa

SEQ ID NO: 2810082 - DNA, 15 bp, Homo sapiens
agcactcctctgtct

SEQ ID NO: 2810083 - DNA, 17 bp, Homo sapiens
agcactcctctgtctct

SEQ ID NO: 2810084 - DNA, 18 bp, Homo sapiens
agcactcctctgtctctg

SEQ ID NO: 2810085 - DNA, 16 bp, Homo sapiens
agcactgccaggaggg

SEQ ID NO: 2810086 - DNA, 20 bp, Homo sapiens
agcactggagtgcagggagg

SEQ ID NO: 2810087 - DNA, 20 bp, Homo sapiens
agcactgtgaagacccagca

SEQ ID NO: 2810088 - DNA, 23 bp, Homo sapiens
agcacttggagccaagggttcag

SEQ ID NO: 2810089 - DNA, 17 bp, Homo sapiens
agcactttaaccctctc

SEQ ID NO: 2810090 - DNA, 20 bp, Homo sapiens
agcactttaaccctctcttc

SEQ ID NO: 2810091 - DNA, 21 bp, Homo sapiens
agcactttaaccctctcttcc

SEQ ID NO: 2810092 - DNA, 12 bp, Homo sapiens
agcactttggga

SEQ ID NO: 2810093 - DNA, 14 bp, Homo sapiens
agcactttgggagg

SEQ ID NO: 2810094 - DNA, 22 bp, Homo sapiens
agcactttgggaggccaaggtg

SEQ ID NO: 2810095 - DNA, 22 bp, Homo sapiens
agcactttgggaggctgaggcg

SEQ ID NO: 2810096 - DNA, 12 bp, Homo sapiens
agcagaaaagtg

SEQ ID NO: 2810097 - DNA, 14 bp, Homo sapiens
agcagaaaagtgct

SEQ ID NO: 2810098 - DNA, 17 bp, Homo sapiens
agcagaaaagtgcttag

SEQ ID NO: 2810099 - DNA, 21 bp, Homo sapiens
agcagaaagccagggtcctga

SEQ ID NO: 2810100 - DNA, 15 bp, Homo sapiens
agcagagcaggggca

SEQ ID NO: 2810101 - DNA, 19 bp, Homo sapiens
agcagaggagtccagggcg

SEQ ID NO: 2810102 - DNA, 17 bp, Homo sapiens
agcagatggaaagaaag

SEQ ID NO: 2810103 - DNA, 12 bp, Homo sapiens
agcagccagccc

SEQ ID NO: 2810104 - DNA, 13 bp, Homo sapiens
agcagccagccct

SEQ ID NO: 2810105 - DNA, 16 bp, Homo sapiens
agcagccagccctgcc

SEQ ID NO: 2810106 - DNA, 19 bp, Homo sapiens
agcagccagccctgcctgg

SEQ ID NO: 2810107 - DNA, 20 bp, Homo sapiens
agcagccagccctgcctgga

SEQ ID NO: 2810108 - DNA, 14 bp, Homo sapiens
agcagccagctctc

SEQ ID NO: 2810109 - DNA, 23 bp, Homo sapiens
agcagccctcctcaccccgtctg

SEQ ID NO: 2810110 - DNA, 15 bp, Homo sapiens
agcagcctttctgtg

SEQ ID NO: 2810111 - DNA, 15 bp, Homo sapiens
agcagctcagcctcc

SEQ ID NO: 2810112 - DNA, 13 bp, Homo sapiens
agcagctcaggca

SEQ ID NO: 2810113 - DNA, 14 bp, Homo sapiens
agcagctcaggcac

SEQ ID NO: 2810114 - DNA, 13 bp, Homo sapiens
agcaggcacagga

SEQ ID NO: 2810115 - DNA, 15 bp, Homo sapiens
agcaggcacaggaca

SEQ ID NO: 2810116 - DNA, 14 bp, Homo sapiens
agcaggcacatgga

SEQ ID NO: 2810117 - DNA, 15 bp, Homo sapiens
agcagggaaacagct

SEQ ID NO: 2810118 - DNA, 22 bp, Homo sapiens
agcagggccggggaactggcca

SEQ ID NO: 2810119 - DNA, 20 bp, Homo sapiens
agcaggtagtgggtgaatgt

SEQ ID NO: 2810120 - DNA, 23 bp, Homo sapiens
agcaggtagtgggtgaatgtgtg

SEQ ID NO: 2810121 - DNA, 13 bp, Homo sapiens
agcaggtggtcct

SEQ ID NO: 2810122 - DNA, 22 bp, Homo sapiens
agcaggttgaggggctcctgga

SEQ ID NO: 2810123 - DNA, 14 bp, Homo sapiens
agcagtatgaatga

SEQ ID NO: 2810124 - DNA, 14 bp, Homo sapiens
agcagtcacactgt

SEQ ID NO: 2810125 - DNA, 20 bp, Homo sapiens
agcagtcacactgttactcc

SEQ ID NO: 2810126 - DNA, 16 bp, Homo sapiens
agcagtgagtctcttc

SEQ ID NO: 2810127 - DNA, 17 bp, Homo sapiens
agcagtgccttccataa

SEQ ID NO: 2810128 - DNA, 15 bp, Homo sapiens
agcagtgtcttccat

SEQ ID NO: 2810129 - DNA, 17 bp, Homo sapiens
agcagtgtcttccataa

SEQ ID NO: 2810130 - DNA, 22 bp, Homo sapiens
agcagttaactttaagactgag

SEQ ID NO: 2810131 - DNA, 19 bp, Homo sapiens
agcagttaccgaggagcta

SEQ ID NO: 2810132 - DNA, 23 bp, Homo sapiens
agcataagtttctgggacctcag

SEQ ID NO: 2810133 - DNA, 13 bp, Homo sapiens
agcatacatttat

SEQ ID NO: 2810134 - DNA, 14 bp, Homo sapiens
agcatacatttata

SEQ ID NO: 2810135 - DNA, 14 bp, Homo sapiens
agcatcacctcagg

SEQ ID NO: 2810136 - DNA, 17 bp, Homo sapiens
agcatcacttgggatta

SEQ ID NO: 2810137 - DNA, 13 bp, Homo sapiens
agcatcatgcctc

SEQ ID NO: 2810138 - DNA, 18 bp, Homo sapiens
agcatcatgcctctgagg

SEQ ID NO: 2810139 - DNA, 14 bp, Homo sapiens
agcatcctggcacc

SEQ ID NO: 2810140 - DNA, 19 bp, Homo sapiens
agcatccttttctgcagag

SEQ ID NO: 2810141 - DNA, 20 bp, Homo sapiens
agcatctcagcctaccatga

SEQ ID NO: 2810142 - DNA, 14 bp, Homo sapiens
agcatctcatgagt

SEQ ID NO: 2810143 - DNA, 15 bp, Homo sapiens
agcatctctgtgtac

SEQ ID NO: 2810144 - DNA, 22 bp, Homo sapiens
agcatgaatggtatggaactct

SEQ ID NO: 2810145 - DNA, 19 bp, Homo sapiens
agcatgagagaattgtatc

SEQ ID NO: 2810146 - DNA, 21 bp, Homo sapiens
agcatggtcacaagcacaaag

SEQ ID NO: 2810147 - DNA, 17 bp, Homo sapiens
agcatgtggggaagcaa

SEQ ID NO: 2810148 - DNA, 14 bp, Homo sapiens
agctgtgtgaaata

SEQ ID NO: 2810149 - DNA, 23 bp, Homo sapiens
agctgtgtgaaataccagtgtgg

SEQ ID NO: 2810150 - DNA, 19 bp, Homo sapiens
agctgttatttctattttt

SEQ ID NO: 2810151 - DNA, 13 bp, Homo sapiens
agctgttgagctg

SEQ ID NO: 2810152 - DNA, 17 bp, Homo sapiens
agctgttgagctgtttt

SEQ ID NO: 2810153 - DNA, 19 bp, Homo sapiens
agctgtttatttattcact

SEQ ID NO: 2810154 - DNA, 15 bp, Homo sapiens
agcttatcatgctgt

SEQ ID NO: 2810155 - DNA, 19 bp, Homo sapiens
agcttatcatgctgtcttt

SEQ ID NO: 2810156 - DNA, 22 bp, Homo sapiens
agcttattcatctgtttttctt

SEQ ID NO: 2810157 - DNA, 21 bp, Homo sapiens
agcttcaaccctcagccttga

SEQ ID NO: 2810158 - DNA, 13 bp, Homo sapiens
agcttcaagtgat

SEQ ID NO: 2810159 - DNA, 15 bp, Homo sapiens
agcttcaagtgatat

SEQ ID NO: 2810160 - DNA, 19 bp, Homo sapiens
agcttcatttcctgtgtct

SEQ ID NO: 2810161 - DNA, 23 bp, Homo sapiens
agcttccattccaagcctgacca

SEQ ID NO: 2810162 - DNA, 20 bp, Homo sapiens
agcttcccctcgctgtcctg

SEQ ID NO: 2810163 - DNA, 22 bp, Homo sapiens
agcttcccctcgctgtcctgct

SEQ ID NO: 2810164 - DNA, 17 bp, Homo sapiens
agcttcggggcaagtga

SEQ ID NO: 2810165 - DNA, 23 bp, Homo sapiens
agcttctattatagccacatccc

SEQ ID NO: 2810166 - DNA, 17 bp, Homo sapiens
agcttgaaaactcactt

SEQ ID NO: 2810167 - DNA, 19 bp, Homo sapiens
agcttgaaggatctgtttt

SEQ ID NO: 2810168 - DNA, 14 bp, Homo sapiens
agcttgagcctgtc

SEQ ID NO: 2810169 - DNA, 22 bp, Homo sapiens
agcttgatgttggatctcaaga

SEQ ID NO: 2810170 - DNA, 13 bp, Homo sapiens
agcttgcaagaag

SEQ ID NO: 2810171 - DNA, 22 bp, Homo sapiens
agcttgctcttcagtgggagaa

SEQ ID NO: 2810172 - DNA, 12 bp, Homo sapiens
agcttgggaatg

SEQ ID NO: 2810173 - DNA, 20 bp, Homo sapiens
agcttgtaaatagctcaggt

SEQ ID NO: 2810174 - DNA, 21 bp, Homo sapiens
agcttgtaaatagctcaggtg

SEQ ID NO: 2810175 - DNA, 14 bp, Homo sapiens
agcttgtatataca

SEQ ID NO: 2810176 - DNA, 21 bp, Homo sapiens
agcttgtatatacatattata

SEQ ID NO: 2810177 - DNA, 23 bp, Homo sapiens
agcttgtatatacatattataaa

SEQ ID NO: 2810178 - DNA, 17 bp, Homo sapiens
agcttgtttgttctagt

SEQ ID NO: 2810179 - DNA, 17 bp, Homo sapiens
agctttacaacttccat

SEQ ID NO: 2810180 - DNA, 17 bp, Homo sapiens
agctttcaaagaaggaa

SEQ ID NO: 2810181 - DNA, 16 bp, Homo sapiens
agctttcatttgacac

SEQ ID NO: 2810182 - DNA, 13 bp, Homo sapiens
agctttccacagg

SEQ ID NO: 2810183 - DNA, 20 bp, Homo sapiens
agctttctgtccttttggca

SEQ ID NO: 2810184 - DNA, 22 bp, Homo sapiens
agctttctgtccttttggcact

SEQ ID NO: 2810185 - DNA, 11 bp, Homo sapiens
agctttcttct

SEQ ID NO: 2810186 - DNA, 15 bp, Homo sapiens
agctttcttctacaa

SEQ ID NO: 2810187 - DNA, 17 bp, Homo sapiens
agctttcttctacaacc

SEQ ID NO: 2810188 - DNA, 22 bp, Homo sapiens
agctttcttctacaaccagagc

SEQ ID NO: 2810189 - DNA, 10 bp, Homo sapiens
agctttgcta

SEQ ID NO: 2810190 - DNA, 16 bp, Homo sapiens
agctttgctaccaaag

SEQ ID NO: 2810191 - DNA, 21 bp, Homo sapiens
agctttgctaccaaagcacct

SEQ ID NO: 2810192 - DNA, 18 bp, Homo sapiens
agcttttaataaaattga

SEQ ID NO: 2810193 - DNA, 13 bp, Homo sapiens
agcttttcccttc

SEQ ID NO: 2810194 - DNA, 15 bp, Homo sapiens
aggaaaaaaatgact

SEQ ID NO: 2810195 - DNA, 18 bp, Homo sapiens
aggaaaaggcctggggtg

SEQ ID NO: 2810196 - DNA, 16 bp, Homo sapiens
aggaaagcctcactga

SEQ ID NO: 2810197 - DNA, 20 bp, Homo sapiens
aggaaagcctcactgatata

SEQ ID NO: 2810198 - DNA, 21 bp, Homo sapiens
aggaaataaaacctttcaaat

SEQ ID NO: 2810199 - DNA, 16 bp, Homo sapiens
aggaaatagtgttctt

SEQ ID NO: 2810200 - DNA, 18 bp, Homo sapiens
aggaaatagtgttctttt

SEQ ID NO: 2810201 - DNA, 19 bp, Homo sapiens
aggaacacccggaaagact

SEQ ID NO: 2810202 - DNA, 14 bp, Homo sapiens
aggaacatgtaact

SEQ ID NO: 2810203 - DNA, 15 bp, Homo sapiens
aggaagatgaaagag

SEQ ID NO: 2810204 - DNA, 15 bp, Homo sapiens
aggaagcaagcttaa

SEQ ID NO: 2810205 - DNA, 16 bp, Homo sapiens
aggaagccacagctgg

SEQ ID NO: 2810206 - DNA, 15 bp, Homo sapiens
aggaagccaggctga

SEQ ID NO: 2810207 - DNA, 19 bp, Homo sapiens
aggaagccaggctgagtga

SEQ ID NO: 2810208 - DNA, 11 bp, Homo sapiens
aggaaggaaaa

SEQ ID NO: 2810209 - DNA, 18 bp, Homo sapiens
aggaaggttttctccact

SEQ ID NO: 2810210 - DNA, 18 bp, Homo sapiens
aggaagtctaggagctgg

SEQ ID NO: 2810211 - DNA, 19 bp, Homo sapiens
aggaataaattgctccttg

SEQ ID NO: 2810212 - DNA, 20 bp, Homo sapiens
aggaataaattgctccttga

SEQ ID NO: 2810213 - DNA, 15 bp, Homo sapiens
aggaatctcagagac

SEQ ID NO: 2810214 - DNA, 22 bp, Homo sapiens
aggaattcccagcccaaagctg

SEQ ID NO: 2810215 - DNA, 13 bp, Homo sapiens
aggaattgaagat

SEQ ID NO: 2810216 - DNA, 14 bp, Homo sapiens
aggaattgaagatg

SEQ ID NO: 2810217 - DNA, 22 bp, Homo sapiens
aggaattgaagatgtaaggaat

SEQ ID NO: 2810218 - DNA, 18 bp, Homo sapiens
aggacaaagagaataaag

SEQ ID NO: 2810219 - DNA, 14 bp, Homo sapiens
aggacaaccattcc

SEQ ID NO: 2810220 - DNA, 16 bp, Homo sapiens
aggacacaggcctgtg

SEQ ID NO: 2810221 - DNA, 11 bp, Homo sapiens
aggacacatgt

SEQ ID NO: 2810222 - DNA, 17 bp, Homo sapiens
aggacacctggccgcct

SEQ ID NO: 2810223 - DNA, 15 bp, Homo sapiens
aggacagtgcttcag

SEQ ID NO: 2810224 - DNA, 17 bp, Homo sapiens
aggacagtgcttcagcc

SEQ ID NO: 2810225 - DNA, 19 bp, Homo sapiens
aggacagtgcttcagcctg

SEQ ID NO: 2810226 - DNA, 20 bp, Homo sapiens
aggacagtgcttcagcctga

SEQ ID NO: 2810227 - DNA, 21 bp, Homo sapiens
aggacatgatggagcgcacct

SEQ ID NO: 2810228 - DNA, 19 bp, Homo sapiens
aggacattgcggacagcca

SEQ ID NO: 2810229 - DNA, 23 bp, Homo sapiens
aggacattgcggacagccacggc

SEQ ID NO: 2810230 - DNA, 21 bp, Homo sapiens
aggacattttctctttaaaag

SEQ ID NO: 2810231 - DNA, 14 bp, Homo sapiens
aggacctgagcctg

SEQ ID NO: 2810232 - DNA, 19 bp, Homo sapiens
aggacctgagcctgccgag

SEQ ID NO: 2810233 - DNA, 12 bp, Homo sapiens
aggacgccactc

SEQ ID NO: 2810234 - DNA, 18 bp, Homo sapiens
aggacgccactcatttca

SEQ ID NO: 2810235 - DNA, 23 bp, Homo sapiens
aggacgccactcatttcatctca

SEQ ID NO: 2810236 - DNA, 18 bp, Homo sapiens
aggactaacactcagaag

SEQ ID NO: 2810237 - DNA, 19 bp, Homo sapiens
aggactacgttaagggaag

SEQ ID NO: 2810238 - DNA, 21 bp, Homo sapiens
caggagggggtcgtggagagc

SEQ ID NO: 2810239 - DNA, 19 bp, Homo sapiens
caggaggtggaggttgcag

SEQ ID NO: 2810240 - DNA, 20 bp, Homo sapiens
caggaggtggaggttgcagt

SEQ ID NO: 2810241 - DNA, 18 bp, Homo sapiens
caggagtagctgagctca

SEQ ID NO: 2810242 - DNA, 20 bp, Homo sapiens
caggagtagctgagctcaca

SEQ ID NO: 2810243 - DNA, 15 bp, Homo sapiens
caggagtcccaagga

SEQ ID NO: 2810244 - DNA, 17 bp, Homo sapiens
caggagtcccaaggaaa

SEQ ID NO: 2810245 - DNA, 13 bp, Homo sapiens
caggagtccctgg

SEQ ID NO: 2810246 - DNA, 12 bp, Homo sapiens
caggagtgagca

SEQ ID NO: 2810247 - DNA, 19 bp, Homo sapiens
caggagtggccggggaagc

SEQ ID NO: 2810248 - DNA, 21 bp, Homo sapiens
caggagttcaataaatgtctg

SEQ ID NO: 2810249 - DNA, 22 bp, Homo sapiens
caggagtttgaggctgcagcga

SEQ ID NO: 2810250 - DNA, 22 bp, Homo sapiens
caggatcctattctcaccagga

SEQ ID NO: 2810251 - DNA, 15 bp, Homo sapiens
caggatgaccctgcg

SEQ ID NO: 2810252 - DNA, 21 bp, Homo sapiens
caggatgaggaacctcaaact

SEQ ID NO: 2810253 - DNA, 23 bp, Homo sapiens
caggatgaggaacctcaaactgg

SEQ ID NO: 2810254 - DNA, 20 bp, Homo sapiens
caggattccaaagttttgaa

SEQ ID NO: 2810255 - DNA, 13 bp, Homo sapiens
caggattgaagag

SEQ ID NO: 2810256 - DNA, 17 bp, Homo sapiens
caggattttgtgttttt

SEQ ID NO: 2810257 - DNA, 15 bp, Homo sapiens
caggcaactgaggca

SEQ ID NO: 2810258 - DNA, 14 bp, Homo sapiens
caggcaagcacctc

SEQ ID NO: 2810259 - DNA, 21 bp, Homo sapiens
caggcaagcacctcctgcctc

SEQ ID NO: 2810260 - DNA, 16 bp, Homo sapiens
caggcaatgctggctg

SEQ ID NO: 2810261 - DNA, 19 bp, Homo sapiens
caggcaatgctggctgttg

SEQ ID NO: 2810262 - DNA, 13 bp, Homo sapiens
caggcacaggaca

SEQ ID NO: 2810263 - DNA, 14 bp, Homo sapiens
caggcacaggacac

SEQ ID NO: 2810264 - DNA, 16 bp, Homo sapiens
caggcaccaaaagaag

SEQ ID NO: 2810265 - DNA, 18 bp, Homo sapiens
caggcacccaccatcatg

SEQ ID NO: 2810266 - DNA, 22 bp, Homo sapiens
caggcacccaccatcatgtctg

SEQ ID NO: 2810267 - DNA, 23 bp, Homo sapiens
caggcacccaccatcatgtctgg

SEQ ID NO: 2810268 - DNA, 16 bp, Homo sapiens
caggcacccttctttc

SEQ ID NO: 2810269 - DNA, 23 bp, Homo sapiens
caggcacccttctttcctcttcc

SEQ ID NO: 2810270 - DNA, 18 bp, Homo sapiens
caggcagatacaggaaaa

SEQ ID NO: 2810271 - DNA, 15 bp, Homo sapiens
caggcagctggatga

SEQ ID NO: 2810272 - DNA, 18 bp, Homo sapiens
caggcagctggatgagac

SEQ ID NO: 2810273 - DNA, 11 bp, Homo sapiens
caggcagggct

SEQ ID NO: 2810274 - DNA, 12 bp, Homo sapiens
caggcagggctc

SEQ ID NO: 2810275 - DNA, 20 bp, Homo sapiens
caggcagggctctcctggct

SEQ ID NO: 2810276 - DNA, 21 bp, Homo sapiens
caggcagggctctcctggctt

SEQ ID NO: 2810277 - DNA, 18 bp, Homo sapiens
caggcaggggtgggagag

SEQ ID NO: 2810278 - DNA, 20 bp, Homo sapiens
caggcaggggtgggagagcc

SEQ ID NO: 2810279 - DNA, 13 bp, Homo sapiens
caggcaggtccag

SEQ ID NO: 2810280 - DNA, 15 bp, Homo sapiens
caggcaggtccaggg

SEQ ID NO: 2810281 - DNA, 12 bp, Homo sapiens
caggcatcctcc

SEQ ID NO: 2810282 - DNA, 15 bp, Homo sapiens
caggcatctacacag

SEQ ID NO: 2810283 - DNA, 21 bp, Homo sapiens
caggcatctacacagcctgga

SEQ ID NO: 2810284 - DNA, 17 bp, Homo sapiens
caggcatgcaccagtgc

SEQ ID NO: 2810285 - DNA, 23 bp, Homo sapiens
caggcatgcaccagtgccgcctg

SEQ ID NO: 2810286 - DNA, 11 bp, Homo sapiens
caggcatgctg

SEQ ID NO: 2810287 - DNA, 19 bp, Homo sapiens
caggcatgctggcctccca

SEQ ID NO: 2810288 - DNA, 15 bp, Homo sapiens
caggcatgttctctg

SEQ ID NO: 2810289 - DNA, 20 bp, Homo sapiens
caggcatgttctctgaggac

SEQ ID NO: 2810290 - DNA, 15 bp, Homo sapiens
caggcatttcctggg

SEQ ID NO: 2810291 - DNA, 17 bp, Homo sapiens
caggcatttcctgggtg

SEQ ID NO: 2810292 - DNA, 13 bp, Homo sapiens
caggccaccagga

SEQ ID NO: 2810293 - DNA, 16 bp, Homo sapiens
caggccaccaggatgg

SEQ ID NO: 2810294 - DNA, 13 bp, Homo sapiens
caggccagaggga

SEQ ID NO: 2810295 - DNA, 15 bp, Homo sapiens
caggccagagggagt

SEQ ID NO: 2810296 - DNA, 21 bp, Homo sapiens
caggccagagggagtgacaga

SEQ ID NO: 2810297 - DNA, 19 bp, Homo sapiens
caggcccaagagatgaaga

SEQ ID NO: 2810298 - DNA, 16 bp, Homo sapiens
caggccccatgacctc

SEQ ID NO: 2810299 - DNA, 18 bp, Homo sapiens
caggccccatgacctcca

SEQ ID NO: 2810300 - DNA, 22 bp, Homo sapiens
caggccccatgacctccagctt

SEQ ID NO: 2810301 - DNA, 15 bp, Homo sapiens
caggcccccaccact

SEQ ID NO: 2810302 - DNA, 17 bp, Homo sapiens
caggcccccacctggct

SEQ ID NO: 2810303 - DNA, 19 bp, Homo sapiens
caggcccccacctggctca

SEQ ID NO: 2810304 - DNA, 17 bp, Homo sapiens
caggccccgcttgtcca

SEQ ID NO: 2810305 - DNA, 19 bp, Homo sapiens
caggccccgcttgtccagc

SEQ ID NO: 2810306 - DNA, 13 bp, Homo sapiens
caggcccggctcc

SEQ ID NO: 2810307 - DNA, 15 bp, Homo sapiens
caggcccggctccag

SEQ ID NO: 2810308 - DNA, 18 bp, Homo sapiens
catacctgctggtgcaga

SEQ ID NO: 2810309 - DNA, 23 bp, Homo sapiens
catagaaatgtaacttttgtaag

SEQ ID NO: 2810310 - DNA, 20 bp, Homo sapiens
catagacagaagaaacaagg

SEQ ID NO: 2810311 - DNA, 14 bp, Homo sapiens
catagcaagacaca

SEQ ID NO: 2810312 - DNA, 20 bp, Homo sapiens
catagcaagacacatcccta

SEQ ID NO: 2810313 - DNA, 22 bp, Homo sapiens
catagcagagaatgaaagggcc

SEQ ID NO: 2810314 - DNA, 17 bp, Homo sapiens
catagcagattttaatt

SEQ ID NO: 2810315 - DNA, 18 bp, Homo sapiens
catagcagattttaattt

SEQ ID NO: 2810316 - DNA, 21 bp, Homo sapiens
catagcatagctagagattgg

SEQ ID NO: 2810317 - DNA, 15 bp, Homo sapiens
catagccaggaaact

SEQ ID NO: 2810318 - DNA, 23 bp, Homo sapiens
cataggtagaatgtaaagcttgt

SEQ ID NO: 2810319 - DNA, 18 bp, Homo sapiens
catagtaccaatcatttt

SEQ ID NO: 2810320 - DNA, 16 bp, Homo sapiens
catagtatggtggctg

SEQ ID NO: 2810321 - DNA, 15 bp, Homo sapiens
catataatgttgtta

SEQ ID NO: 2810322 - DNA, 22 bp, Homo sapiens
catatatatgttttaagaggca

SEQ ID NO: 2810323 - DNA, 16 bp, Homo sapiens
catatatcttatgtta

SEQ ID NO: 2810324 - DNA, 20 bp, Homo sapiens
catatatgtatatgtatatc

SEQ ID NO: 2810325 - DNA, 21 bp, Homo sapiens
catatatgtatatgtatatct

SEQ ID NO: 2810326 - DNA, 17 bp, Homo sapiens
catatattcatgtaata

SEQ ID NO: 2810327 - DNA, 20 bp, Homo sapiens
catatattcatgtaataaat

SEQ ID NO: 2810328 - DNA, 15 bp, Homo sapiens
catatcagaaaagta

SEQ ID NO: 2810329 - DNA, 16 bp, Homo sapiens
catatcagaaaagtag

SEQ ID NO: 2810330 - DNA, 12 bp, Homo sapiens
catatcattttt

SEQ ID NO: 2810331 - DNA, 18 bp, Homo sapiens
catatcctttgccccaag

SEQ ID NO: 2810332 - DNA, 17 bp, Homo sapiens
catatgaaatttaatat

SEQ ID NO: 2810333 - DNA, 17 bp, Homo sapiens
catatgcaccttgtgtc

SEQ ID NO: 2810334 - DNA, 13 bp, Homo sapiens
catatgctatgtt

SEQ ID NO: 2810335 - DNA, 18 bp, Homo sapiens
catatggactctgcacat

SEQ ID NO: 2810336 - DNA, 21 bp, Homo sapiens
catatgtaccatgtacatgaa

SEQ ID NO: 2810337 - DNA, 17 bp, Homo sapiens
catatgtgaatatggac

SEQ ID NO: 2810338 - DNA, 15 bp, Homo sapiens
catattataaataaa

SEQ ID NO: 2810339 - DNA, 21 bp, Homo sapiens
catattataaataaatgccaa

SEQ ID NO: 2810340 - DNA, 21 bp, Homo sapiens
catattctagtgtaacactgc

SEQ ID NO: 2810341 - DNA, 22 bp, Homo sapiens
catattctgttggccagtgtga

SEQ ID NO: 2810342 - DNA, 19 bp, Homo sapiens
catattcttggagaacttt

SEQ ID NO: 2810343 - DNA, 22 bp, Homo sapiens
catatttatagcaatccatgtt

SEQ ID NO: 2810344 - DNA, 12 bp, Homo sapiens
catatttcaatt

SEQ ID NO: 2810345 - DNA, 20 bp, Homo sapiens
catatttgttaaatatttac

SEQ ID NO: 2810346 - DNA, 23 bp, Homo sapiens
catattttcacatgacgtaaaat

SEQ ID NO: 2810347 - DNA, 17 bp, Homo sapiens
catcaagagactgagtc

SEQ ID NO: 2810348 - DNA, 15 bp, Homo sapiens
catcaatttttatac

SEQ ID NO: 2810349 - DNA, 22 bp, Homo sapiens
catcacaggacacggggcagtg

SEQ ID NO: 2810350 - DNA, 20 bp, Homo sapiens
catcacagggcagagccggg

SEQ ID NO: 2810351 - DNA, 21 bp, Homo sapiens
catcacctactcacacaggca

SEQ ID NO: 2810352 - DNA, 15 bp, Homo sapiens
catcacctcaggcca

SEQ ID NO: 2810353 - DNA, 20 bp, Homo sapiens
catcagaaagggagggctct

SEQ ID NO: 2810354 - DNA, 22 bp, Homo sapiens
catcagaaagggagggctctga

SEQ ID NO: 2810355 - DNA, 24 bp, Homo sapiens
catcagaaagggagggctctgagg

SEQ ID NO: 2810356 - DNA, 14 bp, Homo sapiens
catcagaaggagaa

SEQ ID NO: 2810357 - DNA, 14 bp, Homo sapiens
catcagaagtggta

SEQ ID NO: 2810358 - DNA, 17 bp, Homo sapiens
catcaggcttggaatga

SEQ ID NO: 2810359 - DNA, 20 bp, Homo sapiens
catcagggtgggccactctc

SEQ ID NO: 2810360 - DNA, 14 bp, Homo sapiens
catcataaaataaa

SEQ ID NO: 2810361 - DNA, 20 bp, Homo sapiens
catcataaaataaagtatat

SEQ ID NO: 2810362 - DNA, 20 bp, Homo sapiens
catcatattgtatgtaagta

SEQ ID NO: 2810363 - DNA, 22 bp, Homo sapiens
catcatcaggcttggaatgaat

SEQ ID NO: 2810364 - DNA, 13 bp, Homo sapiens
catcatcccagct

SEQ ID NO: 2810365 - DNA, 23 bp, Homo sapiens
catcatgcctctgaggccagcct

SEQ ID NO: 2810366 - DNA, 13 bp, Homo sapiens
catcatgtctggc

SEQ ID NO: 2810367 - DNA, 19 bp, Homo sapiens
catccaaccccccacctgc

SEQ ID NO: 2810368 - DNA, 21 bp, Homo sapiens
catccaaggagaaacagagac

SEQ ID NO: 2810369 - DNA, 14 bp, Homo sapiens
catccactgtgcca

SEQ ID NO: 2810370 - DNA, 23 bp, Homo sapiens
catccactgtgccatgtgccagg

SEQ ID NO: 2810371 - DNA, 15 bp, Homo sapiens
catccaggttcagct

SEQ ID NO: 2810372 - DNA, 16 bp, Homo sapiens
catccatcagctccct

SEQ ID NO: 2810373 - DNA, 19 bp, Homo sapiens
catccattcctcagggaca

SEQ ID NO: 2810374 - DNA, 16 bp, Homo sapiens
catcccatcatggctg

SEQ ID NO: 2810375 - DNA, 15 bp, Homo sapiens
catcccattgccctg

SEQ ID NO: 2810376 - DNA, 12 bp, Homo sapiens
catccccacctt

SEQ ID NO: 2810377 - DNA, 21 bp, Homo sapiens
catccccaggtctctccactg

SEQ ID NO: 2810378 - DNA, 19 bp, Homo sapiens
catcccccactgccacacc

SEQ ID NO: 2810379 - DNA, 15 bp, Homo sapiens
catcccctttcctcc

SEQ ID NO: 2810380 - DNA, 17 bp, Homo sapiens
catccctgggcctgctg

SEQ ID NO: 2810381 - DNA, 20 bp, Homo sapiens
catccctgggcctgctgctg

SEQ ID NO: 2810382 - DNA, 22 bp, Homo sapiens
catccctgggcctgctgctgag

SEQ ID NO: 2810383 - DNA, 23 bp, Homo sapiens
catccctgggcctgctgctgaga

SEQ ID NO: 2810384 - DNA, 19 bp, Homo sapiens
catccctttgaaacaagat

SEQ ID NO: 2810385 - DNA, 16 bp, Homo sapiens
catccgtagttccctg

SEQ ID NO: 2810386 - DNA, 21 bp, Homo sapiens
catccgtagttccctgaaaac

SEQ ID NO: 2810387 - DNA, 16 bp, Homo sapiens
catcctgccttcatgg

SEQ ID NO: 2810388 - DNA, 22 bp, Homo sapiens
catcctggcacccggcccctgc

SEQ ID NO: 2810389 - DNA, 23 bp, Homo sapiens
catccttcaagaactctgggctg

SEQ ID NO: 2810390 - DNA, 14 bp, Homo sapiens
catccttcaccaga

SEQ ID NO: 2810391 - DNA, 20 bp, Homo sapiens
catccttcaccagagcccat

SEQ ID NO: 2810392 - DNA, 19 bp, Homo sapiens
catccttttctgcagaggg

SEQ ID NO: 2810393 - DNA, 21 bp, Homo sapiens
catcgtataacacaatatgaa

SEQ ID NO: 2810394 - DNA, 16 bp, Homo sapiens
catctaagctgcagct

SEQ ID NO: 2810395 - DNA, 16 bp, Homo sapiens
catctacacagcctgg

SEQ ID NO: 2810396 - DNA, 22 bp, Homo sapiens
catctatggcagtccagccagc

SEQ ID NO: 2810397 - DNA, 13 bp, Homo sapiens
catctcagggtcc

SEQ ID NO: 2810398 - DNA, 17 bp, Homo sapiens
catgtaccagtgtactg

SEQ ID NO: 2810399 - DNA, 15 bp, Homo sapiens
catgtataatatttt

SEQ ID NO: 2810400 - DNA, 15 bp, Homo sapiens
catgtatagtgagtg

SEQ ID NO: 2810401 - DNA, 21 bp, Homo sapiens
catgtatagtgagtgtggctt

SEQ ID NO: 2810402 - DNA, 23 bp, Homo sapiens
catgtatctatgcattttctgga

SEQ ID NO: 2810403 - DNA, 21 bp, Homo sapiens
catgtatgtcttggacactgt

SEQ ID NO: 2810404 - DNA, 14 bp, Homo sapiens
catgtcactcccag

SEQ ID NO: 2810405 - DNA, 22 bp, Homo sapiens
catgtccttgtgtgttttgaga

SEQ ID NO: 2810406 - DNA, 14 bp, Homo sapiens
catgtcgcctctgc

SEQ ID NO: 2810407 - DNA, 15 bp, Homo sapiens
catgtcgcctctgca

SEQ ID NO: 2810408 - DNA, 18 bp, Homo sapiens
catgtcgcctctgcattc

SEQ ID NO: 2810409 - DNA, 20 bp, Homo sapiens
catgtcgcctctgcattcag

SEQ ID NO: 2810410 - DNA, 18 bp, Homo sapiens
catgtcgcctgcccccag

SEQ ID NO: 2810411 - DNA, 17 bp, Homo sapiens
catgtcggagtagaaat

SEQ ID NO: 2810412 - DNA, 17 bp, Homo sapiens
catgtctctcagaattc

SEQ ID NO: 2810413 - DNA, 13 bp, Homo sapiens
catgtcttgtaca

SEQ ID NO: 2810414 - DNA, 23 bp, Homo sapiens
catgtcttgtacatgtgtagcct

SEQ ID NO: 2810415 - DNA, 20 bp, Homo sapiens
catgtctttctccaaagtta

SEQ ID NO: 2810416 - DNA, 21 bp, Homo sapiens
catgtctttctccaaagttat

SEQ ID NO: 2810417 - DNA, 16 bp, Homo sapiens
catgtgacacatatgc

SEQ ID NO: 2810418 - DNA, 22 bp, Homo sapiens
catgtgagcatggtcacaagca

SEQ ID NO: 2810419 - DNA, 19 bp, Homo sapiens
catgtgatccttttatgtt

SEQ ID NO: 2810420 - DNA, 15 bp, Homo sapiens
catgtgcacatgcac

SEQ ID NO: 2810421 - DNA, 13 bp, Homo sapiens
catgtgcctggaa

SEQ ID NO: 2810422 - DNA, 14 bp, Homo sapiens
catgtgcctggaaa

SEQ ID NO: 2810423 - DNA, 15 bp, Homo sapiens
catgtggcaacctgt

SEQ ID NO: 2810424 - DNA, 14 bp, Homo sapiens
catgtggggaagca

SEQ ID NO: 2810425 - DNA, 21 bp, Homo sapiens
catgtggtgggacagggaccc

SEQ ID NO: 2810426 - DNA, 22 bp, Homo sapiens
catgtggttaatgccatggaca

SEQ ID NO: 2810427 - DNA, 14 bp, Homo sapiens
catgtgtagcctgt

SEQ ID NO: 2810428 - DNA, 18 bp, Homo sapiens
catgtgtagcctgtgcat

SEQ ID NO: 2810429 - DNA, 17 bp, Homo sapiens
catgtgtggatgtgtaa

SEQ ID NO: 2810430 - DNA, 18 bp, Homo sapiens
catgtgtttactttatgt

SEQ ID NO: 2810431 - DNA, 18 bp, Homo sapiens
catgttaggaaaatttca

SEQ ID NO: 2810432 - DNA, 12 bp, Homo sapiens
catgttggccag

SEQ ID NO: 2810433 - DNA, 14 bp, Homo sapiens
catgttggccaggc

SEQ ID NO: 2810434 - DNA, 21 bp, Homo sapiens
catgtttgcacctttctagtt

SEQ ID NO: 2810435 - DNA, 16 bp, Homo sapiens
cattaaacactgtaat

SEQ ID NO: 2810436 - DNA, 18 bp, Homo sapiens
cattaaacactgtaatct

SEQ ID NO: 2810437 - DNA, 22 bp, Homo sapiens
cattaaagcatttactttgaat

SEQ ID NO: 2810438 - DNA, 20 bp, Homo sapiens
cattaaattttctatgctta

SEQ ID NO: 2810439 - DNA, 13 bp, Homo sapiens
cattaattctact

SEQ ID NO: 2810440 - DNA, 17 bp, Homo sapiens
cattaattctactaaat

SEQ ID NO: 2810441 - DNA, 16 bp, Homo sapiens
cattacgtgagccagg

SEQ ID NO: 2810442 - DNA, 16 bp, Homo sapiens
cattactgcatgcact

SEQ ID NO: 2810443 - DNA, 14 bp, Homo sapiens
cattacttgcacaa

SEQ ID NO: 2810444 - DNA, 20 bp, Homo sapiens
cattacttgcacaagcttgt

SEQ ID NO: 2810445 - DNA, 23 bp, Homo sapiens
cattacttgcacaagcttgtata

SEQ ID NO: 2810446 - DNA, 13 bp, Homo sapiens
cattataaacgtg

SEQ ID NO: 2810447 - DNA, 20 bp, Homo sapiens
cattatcgggagcagtgtct

SEQ ID NO: 2810448 - DNA, 22 bp, Homo sapiens
cattatgatgtgggtcaaggaa

SEQ ID NO: 2810449 - DNA, 19 bp, Homo sapiens
cattatttgcatgttacct

SEQ ID NO: 2810450 - DNA, 17 bp, Homo sapiens
cattcaagcctgtgaat

SEQ ID NO: 2810451 - DNA, 17 bp, Homo sapiens
cattcagaagaaaaaga

SEQ ID NO: 2810452 - DNA, 20 bp, Homo sapiens
cattcaggaaaactgacaga

SEQ ID NO: 2810453 - DNA, 20 bp, Homo sapiens
cattcaggaccccaacccct

SEQ ID NO: 2810454 - DNA, 22 bp, Homo sapiens
cattcatgccaaagcaaaagaa

SEQ ID NO: 2810455 - DNA, 17 bp, Homo sapiens
cattcatttttgttgtt

SEQ ID NO: 2810456 - DNA, 14 bp, Homo sapiens
cattccaagcctga

SEQ ID NO: 2810457 - DNA, 17 bp, Homo sapiens
cattccaccttcccatg

SEQ ID NO: 2810458 - DNA, 22 bp, Homo sapiens
cattccaccttcccatgccctg

SEQ ID NO: 2810459 - DNA, 16 bp, Homo sapiens
cattccatgattttac

SEQ ID NO: 2810460 - DNA, 13 bp, Homo sapiens
cattccccaggtg

SEQ ID NO: 2810461 - DNA, 17 bp, Homo sapiens
cattccccaggtggctg

SEQ ID NO: 2810462 - DNA, 16 bp, Homo sapiens
cattccctatcaaaac

SEQ ID NO: 2810463 - DNA, 20 bp, Homo sapiens
cattcccttggatgtagtct

SEQ ID NO: 2810464 - DNA, 13 bp, Homo sapiens
cattcctatttct

SEQ ID NO: 2810465 - DNA, 15 bp, Homo sapiens
cattctctctcctgt

SEQ ID NO: 2810466 - DNA, 20 bp, Homo sapiens
cattctctctcctgtccaac

SEQ ID NO: 2810467 - DNA, 16 bp, Homo sapiens
cattctcttatatagt

SEQ ID NO: 2810468 - DNA, 22 bp, Homo sapiens
cattctgattcgaatgacactg

SEQ ID NO: 2810469 - DNA, 12 bp, Homo sapiens
cattctgcctgc

SEQ ID NO: 2810470 - DNA, 13 bp, Homo sapiens
cattctgcctgcc

SEQ ID NO: 2810471 - DNA, 18 bp, Homo sapiens
cattctgcctgcccaggc

SEQ ID NO: 2810472 - DNA, 19 bp, Homo sapiens
cattctgcctgcccaggcc

SEQ ID NO: 2810473 - DNA, 21 bp, Homo sapiens
cattcttcctagttttctcct

SEQ ID NO: 2810474 - DNA, 21 bp, Homo sapiens
cattgaccaagatgatcacat

SEQ ID NO: 2810475 - DNA, 22 bp, Homo sapiens
cattgactatcaaactgaagcc

SEQ ID NO: 2810476 - DNA, 22 bp, Homo sapiens
cattgagatgtgtttttaatgt

SEQ ID NO: 2810477 - DNA, 19 bp, Homo sapiens
cattgagtttaagtctctg

SEQ ID NO: 2810478 - DNA, 17 bp, Homo sapiens
cattgatatgaaaaata

SEQ ID NO: 2810479 - DNA, 12 bp, Homo sapiens
cattgccctggt

SEQ ID NO: 2810480 - DNA, 18 bp, Homo sapiens
cattggacccacatgagg

SEQ ID NO: 2810481 - DNA, 22 bp, Homo sapiens
cattggatgtggagctcctgct

SEQ ID NO: 2810482 - DNA, 13 bp, Homo sapiens
cattgggagaagc

SEQ ID NO: 2810483 - DNA, 19 bp, Homo sapiens
cattgggtgggtaaattca

SEQ ID NO: 2810484 - DNA, 19 bp, Homo sapiens
cattgtagagcttctggca

SEQ ID NO: 2810485 - DNA, 15 bp, Homo sapiens
cattgtataaaaata

SEQ ID NO: 2810486 - DNA, 19 bp, Homo sapiens
cattgtccatgcctacaga

SEQ ID NO: 2810487 - DNA, 19 bp, Homo sapiens
cattgttacaggtgtacta

SEQ ID NO: 2810488 - DNA, 21 bp, Homo sapiens
ccaagctgttccacttctcta

SEQ ID NO: 2810489 - DNA, 17 bp, Homo sapiens
ccaagctgttttcttct

SEQ ID NO: 2810490 - DNA, 18 bp, Homo sapiens
ccaagcttcaaccctcag

SEQ ID NO: 2810491 - DNA, 15 bp, Homo sapiens
ccaaggagaaacaga

SEQ ID NO: 2810492 - DNA, 19 bp, Homo sapiens
ccaaggagaaacagagaca

SEQ ID NO: 2810493 - DNA, 17 bp, Homo sapiens
ccaaggtcttcagccat

SEQ ID NO: 2810494 - DNA, 20 bp, Homo sapiens
ccaaggtgggctgagccctg

SEQ ID NO: 2810495 - DNA, 17 bp, Homo sapiens
ccaagtccaggtcctgg

SEQ ID NO: 2810496 - DNA, 18 bp, Homo sapiens
ccaagtccaggtcctggt

SEQ ID NO: 2810497 - DNA, 16 bp, Homo sapiens
ccaagtgggggcagag

SEQ ID NO: 2810498 - DNA, 13 bp, Homo sapiens
ccaagtgtgttgg

SEQ ID NO: 2810499 - DNA, 21 bp, Homo sapiens
ccaagtgtgttgggaattgca

SEQ ID NO: 2810500 - DNA, 20 bp, Homo sapiens
ccaagttataaatcaatgtc

SEQ ID NO: 2810501 - DNA, 20 bp, Homo sapiens
ccaataaatcaactccagct

SEQ ID NO: 2810502 - DNA, 14 bp, Homo sapiens
ccaatcattttaat

SEQ ID NO: 2810503 - DNA, 14 bp, Homo sapiens
ccaatcccgtgaaa

SEQ ID NO: 2810504 - DNA, 11 bp, Homo sapiens
ccaatctctgt

SEQ ID NO: 2810505 - DNA, 16 bp, Homo sapiens
ccaatctctgtgactc

SEQ ID NO: 2810506 - DNA, 19 bp, Homo sapiens
ccaatgaggtctgaaatgg

SEQ ID NO: 2810507 - DNA, 20 bp, Homo sapiens
ccaattaaaatatatataaa

SEQ ID NO: 2810508 - DNA, 22 bp, Homo sapiens
ccaattaaaatatatataaata

SEQ ID NO: 2810509 - DNA, 15 bp, Homo sapiens
ccaattatgtgacaa

SEQ ID NO: 2810510 - DNA, 18 bp, Homo sapiens
ccaattcttacaaacatg

SEQ ID NO: 2810511 - DNA, 19 bp, Homo sapiens
ccaattcttacaaacatgt

SEQ ID NO: 2810512 - DNA, 18 bp, Homo sapiens
ccacaaccctgttttata

SEQ ID NO: 2810513 - DNA, 15 bp, Homo sapiens
ccacaagattcccag

SEQ ID NO: 2810514 - DNA, 19 bp, Homo sapiens
ccacaagattcccagagac

SEQ ID NO: 2810515 - DNA, 12 bp, Homo sapiens
ccacacacagag

SEQ ID NO: 2810516 - DNA, 15 bp, Homo sapiens
ccacaccaaacctct

SEQ ID NO: 2810517 - DNA, 12 bp, Homo sapiens
ccacacccagcc

SEQ ID NO: 2810518 - DNA, 15 bp, Homo sapiens
ccacacccagcccac

SEQ ID NO: 2810519 - DNA, 20 bp, Homo sapiens
ccacacccggctccccctgc

SEQ ID NO: 2810520 - DNA, 13 bp, Homo sapiens
ccacaccctcccc

SEQ ID NO: 2810521 - DNA, 14 bp, Homo sapiens
ccacaccgcagaag

SEQ ID NO: 2810522 - DNA, 15 bp, Homo sapiens
ccacaccgcagaagc

SEQ ID NO: 2810523 - DNA, 17 bp, Homo sapiens
ccacacctccctgaacc

SEQ ID NO: 2810524 - DNA, 14 bp, Homo sapiens
ccacactcagtccc

SEQ ID NO: 2810525 - DNA, 23 bp, Homo sapiens
ccacacttctcaggacacaggcc

SEQ ID NO: 2810526 - DNA, 24 bp, Homo sapiens
ccacacttctcaggacacaggcct

SEQ ID NO: 2810527 - DNA, 17 bp, Homo sapiens
ccacagaagccaggagc

SEQ ID NO: 2810528 - DNA, 13 bp, Homo sapiens
ccacagcaggtgc

SEQ ID NO: 2810529 - DNA, 15 bp, Homo sapiens
ccacagccgcagcct

SEQ ID NO: 2810530 - DNA, 18 bp, Homo sapiens
ccacagccgcagcctccc

SEQ ID NO: 2810531 - DNA, 22 bp, Homo sapiens
ccacagcggaggagaccagctc

SEQ ID NO: 2810532 - DNA, 16 bp, Homo sapiens
ccacagctcccacccc

SEQ ID NO: 2810533 - DNA, 17 bp, Homo sapiens
ccacagctcccacccca

SEQ ID NO: 2810534 - DNA, 22 bp, Homo sapiens
ccacaggcatctacacagcctg

SEQ ID NO: 2810535 - DNA, 21 bp, Homo sapiens
ccacaggccccccgcagcacc

SEQ ID NO: 2810536 - DNA, 23 bp, Homo sapiens
ccacaggccccccgcagcaccct

SEQ ID NO: 2810537 - DNA, 16 bp, Homo sapiens
ccacagggaaccctgc

SEQ ID NO: 2810538 - DNA, 20 bp, Homo sapiens
ccacatccacacacgcagga

SEQ ID NO: 2810539 - DNA, 16 bp, Homo sapiens
ccacatccctgggcct

SEQ ID NO: 2810540 - DNA, 18 bp, Homo sapiens
ccacatccctgggcctgc

SEQ ID NO: 2810541 - DNA, 20 bp, Homo sapiens
ccacatccctgggcctgctg

SEQ ID NO: 2810542 - DNA, 17 bp, Homo sapiens
ccacatctgtgtctctg

SEQ ID NO: 2810543 - DNA, 18 bp, Homo sapiens
ccacatcttgctctgctg

SEQ ID NO: 2810544 - DNA, 15 bp, Homo sapiens
ccacatgtgacacat

SEQ ID NO: 2810545 - DNA, 12 bp, Homo sapiens
ccaccaacccat

SEQ ID NO: 2810546 - DNA, 11 bp, Homo sapiens
ccaccaaggtc

SEQ ID NO: 2810547 - DNA, 17 bp, Homo sapiens
ccaccaaggtcttcagc

SEQ ID NO: 2810548 - DNA, 17 bp, Homo sapiens
ccaccacacccagccca

SEQ ID NO: 2810549 - DNA, 13 bp, Homo sapiens
ccaccacactgaa

SEQ ID NO: 2810550 - DNA, 20 bp, Homo sapiens
ccaccacctaggccactcct

SEQ ID NO: 2810551 - DNA, 19 bp, Homo sapiens
ccaccacgatgtggccctg

SEQ ID NO: 2810552 - DNA, 20 bp, Homo sapiens
ccaccacgatgtggccctgg

SEQ ID NO: 2810553 - DNA, 21 bp, Homo sapiens
ccaccacgatgtggccctggc

SEQ ID NO: 2810554 - DNA, 13 bp, Homo sapiens
ccaccagccacct

SEQ ID NO: 2810555 - DNA, 14 bp, Homo sapiens
ccaccagccacctc

SEQ ID NO: 2810556 - DNA, 15 bp, Homo sapiens
ccaccagccacctct

SEQ ID NO: 2810557 - DNA, 17 bp, Homo sapiens
ccaccagccacctcttg

SEQ ID NO: 2810558 - DNA, 19 bp, Homo sapiens
ccaccagcctaagaagctc

SEQ ID NO: 2810559 - DNA, 22 bp, Homo sapiens
ccaccatattcagtgctgtggc

SEQ ID NO: 2810560 - DNA, 14 bp, Homo sapiens
ccaccatcctgcag

SEQ ID NO: 2810561 - DNA, 15 bp, Homo sapiens
ccaccatgcgctgct

SEQ ID NO: 2810562 - DNA, 14 bp, Homo sapiens
ccacccaagtatac

SEQ ID NO: 2810563 - DNA, 12 bp, Homo sapiens
ccacccagccca

SEQ ID NO: 2810564 - DNA, 12 bp, Homo sapiens
ccacccaggagc

SEQ ID NO: 2810565 - DNA, 23 bp, Homo sapiens
ccacccaggagccccgaggcctt

SEQ ID NO: 2810566 - DNA, 14 bp, Homo sapiens
ccaccccaccccct

SEQ ID NO: 2810567 - DNA, 13 bp, Homo sapiens
ccacccccagccc

SEQ ID NO: 2810568 - DNA, 16 bp, Homo sapiens
ccaccccctccccagg

SEQ ID NO: 2810569 - DNA, 21 bp, Homo sapiens
ccacccgttctgctggcctgg

SEQ ID NO: 2810570 - DNA, 19 bp, Homo sapiens
ccaccctcgtggacacctg

SEQ ID NO: 2810571 - DNA, 14 bp, Homo sapiens
ccaccctgagcctg

SEQ ID NO: 2810572 - DNA, 22 bp, Homo sapiens
ccaccgggacagacctggacac

SEQ ID NO: 2810573 - DNA, 19 bp, Homo sapiens
ccaccgggccactccttcc

SEQ ID NO: 2810574 - DNA, 17 bp, Homo sapiens
ccacctaggccactcct

SEQ ID NO: 2810575 - DNA, 18 bp, Homo sapiens
ccacctaggccactcctc

SEQ ID NO: 2810576 - DNA, 18 bp, Homo sapiens
ccacctcactcctgttac

SEQ ID NO: 2810577 - DNA, 15 bp, Homo sapiens
ccacctcagccttgg

SEQ ID NO: 2810578 - DNA, 22 bp, Homo sapiens
ccacctcccctatccacccagc

SEQ ID NO: 2810579 - DNA, 16 bp, Homo sapiens
ccagcgagccctggtg

SEQ ID NO: 2810580 - DNA, 18 bp, Homo sapiens
ccagcgattccctctccc

SEQ ID NO: 2810581 - DNA, 19 bp, Homo sapiens
ccagcgattccctctccca

SEQ ID NO: 2810582 - DNA, 14 bp, Homo sapiens
ccagcgcctccctc

SEQ ID NO: 2810583 - DNA, 16 bp, Homo sapiens
ccagcgcctccctcca

SEQ ID NO: 2810584 - DNA, 13 bp, Homo sapiens
ccagcggctgagt

SEQ ID NO: 2810585 - DNA, 14 bp, Homo sapiens
ccagctactcagaa

SEQ ID NO: 2810586 - DNA, 20 bp, Homo sapiens
ccagctactcagaagcctga

SEQ ID NO: 2810587 - DNA, 23 bp, Homo sapiens
ccagctactcagaagcctgaggc

SEQ ID NO: 2810588 - DNA, 14 bp, Homo sapiens
ccagctagggctgg

SEQ ID NO: 2810589 - DNA, 14 bp, Homo sapiens
ccagctagtgaccc

SEQ ID NO: 2810590 - DNA, 18 bp, Homo sapiens
ccagctagtgacccacat

SEQ ID NO: 2810591 - DNA, 16 bp, Homo sapiens
ccagctcaccagcccc

SEQ ID NO: 2810592 - DNA, 15 bp, Homo sapiens
ccagctcagaggccc

SEQ ID NO: 2810593 - DNA, 22 bp, Homo sapiens
ccagctcagtcccatcagagag

SEQ ID NO: 2810594 - DNA, 13 bp, Homo sapiens
ccagctccccagg

SEQ ID NO: 2810595 - DNA, 14 bp, Homo sapiens
ccagctccccagga

SEQ ID NO: 2810596 - DNA, 17 bp, Homo sapiens
ccagctccccaggactc

SEQ ID NO: 2810597 - DNA, 18 bp, Homo sapiens
ccagctcctgggcagctt

SEQ ID NO: 2810598 - DNA, 21 bp, Homo sapiens
ccagctctccctctggccctg

SEQ ID NO: 2810599 - DNA, 23 bp, Homo sapiens
ccagctgcagatgccacacctgc

SEQ ID NO: 2810600 - DNA, 16 bp, Homo sapiens
ccagctgcaggaatca

SEQ ID NO: 2810601 - DNA, 18 bp, Homo sapiens
ccagctgccgaccagagc

SEQ ID NO: 2810602 - DNA, 9 bp, Homo sapiens
ccagctgct

SEQ ID NO: 2810603 - DNA, 15 bp, Homo sapiens
ccagctggaattgct

SEQ ID NO: 2810604 - DNA, 13 bp, Homo sapiens
ccagctgtctgtg

SEQ ID NO: 2810605 - DNA, 18 bp, Homo sapiens
ccagctgtgctctggaca

SEQ ID NO: 2810606 - DNA, 22 bp, Homo sapiens
ccagctgtgctctggacaggca

SEQ ID NO: 2810607 - DNA, 17 bp, Homo sapiens
ccaggaaggtagcccag

SEQ ID NO: 2810608 - DNA, 22 bp, Homo sapiens
ccaggaaggtagcccagcactg

SEQ ID NO: 2810609 - DNA, 15 bp, Homo sapiens
ccaggacaagcatgg

SEQ ID NO: 2810610 - DNA, 20 bp, Homo sapiens
ccaggacaagcatggtccca

SEQ ID NO: 2810611 - DNA, 23 bp, Homo sapiens
ccaggacaagcatggtcccacat

SEQ ID NO: 2810612 - DNA, 13 bp, Homo sapiens
ccaggacaggacc

SEQ ID NO: 2810613 - DNA, 14 bp, Homo sapiens
ccaggacaggcccg

SEQ ID NO: 2810614 - DNA, 17 bp, Homo sapiens
ccaggacaggcccggcg

SEQ ID NO: 2810615 - DNA, 22 bp, Homo sapiens
ccaggacgccactcatttcatc

SEQ ID NO: 2810616 - DNA, 16 bp, Homo sapiens
ccaggactcaccctca

SEQ ID NO: 2810617 - DNA, 15 bp, Homo sapiens
ccaggactccccagg

SEQ ID NO: 2810618 - DNA, 18 bp, Homo sapiens
ccaggagagccagccctc

SEQ ID NO: 2810619 - DNA, 23 bp, Homo sapiens
ccaggagagccagccctccctgt

SEQ ID NO: 2810620 - DNA, 12 bp, Homo sapiens
ccaggagcaaat

SEQ ID NO: 2810621 - DNA, 19 bp, Homo sapiens
ccaggagcaaatgtttctg

SEQ ID NO: 2810622 - DNA, 19 bp, Homo sapiens
ccaggagccccgaggcctt

SEQ ID NO: 2810623 - DNA, 12 bp, Homo sapiens
ccaggagcctac

SEQ ID NO: 2810624 - DNA, 18 bp, Homo sapiens
ccaggagcctaccccctg

SEQ ID NO: 2810625 - DNA, 20 bp, Homo sapiens
ccaggagcctaccccctgaa

SEQ ID NO: 2810626 - DNA, 16 bp, Homo sapiens
ccaggagcctgtgcct

SEQ ID NO: 2810627 - DNA, 19 bp, Homo sapiens
ccaggaggagaggaaagga

SEQ ID NO: 2810628 - DNA, 21 bp, Homo sapiens
ccaggagggacaaaggagcct

SEQ ID NO: 2810629 - DNA, 22 bp, Homo sapiens
ccaggagggacaaaggagcctg

SEQ ID NO: 2810630 - DNA, 18 bp, Homo sapiens
ccaggaggtcgaccccaa

SEQ ID NO: 2810631 - DNA, 20 bp, Homo sapiens
ccaggagttcgaggctgcag

SEQ ID NO: 2810632 - DNA, 16 bp, Homo sapiens
ccaggattgaagagca

SEQ ID NO: 2810633 - DNA, 18 bp, Homo sapiens
ccaggattgaagagcatt

SEQ ID NO: 2810634 - DNA, 20 bp, Homo sapiens
ccaggattttaacaaaagca

SEQ ID NO: 2810635 - DNA, 16 bp, Homo sapiens
ccaggcaccccctgga

SEQ ID NO: 2810636 - DNA, 17 bp, Homo sapiens
ccaggcaccccctggag

SEQ ID NO: 2810637 - DNA, 19 bp, Homo sapiens
ccaggcaccccctggagag

SEQ ID NO: 2810638 - DNA, 21 bp, Homo sapiens
ccaggcaccccctggagagaa

SEQ ID NO: 2810639 - DNA, 13 bp, Homo sapiens
ccaggcacccttc

SEQ ID NO: 2810640 - DNA, 14 bp, Homo sapiens
ccaggcacccttct

SEQ ID NO: 2810641 - DNA, 20 bp, Homo sapiens
ccaggcacgaacccacctgc

SEQ ID NO: 2810642 - DNA, 14 bp, Homo sapiens
ccaggcaggtcttg

SEQ ID NO: 2810643 - DNA, 14 bp, Homo sapiens
ccaggccaccagga

SEQ ID NO: 2810644 - DNA, 14 bp, Homo sapiens
ccaggccagaggga

SEQ ID NO: 2810645 - DNA, 15 bp, Homo sapiens
ccaggcccccgctgg

SEQ ID NO: 2810646 - DNA, 20 bp, Homo sapiens
ccaggccgggcttgggccct

SEQ ID NO: 2810647 - DNA, 24 bp, Homo sapiens
ccaggctaatttttttgtatttta

SEQ ID NO: 2810648 - DNA, 23 bp, Homo sapiens
ccaggctctttggggtcagccag

SEQ ID NO: 2810649 - DNA, 12 bp, Homo sapiens
ccaggctggcgt

SEQ ID NO: 2810650 - DNA, 14 bp, Homo sapiens
ccaggctgtttctt

SEQ ID NO: 2810651 - DNA, 16 bp, Homo sapiens
ccaggcttcaccctga

SEQ ID NO: 2810652 - DNA, 18 bp, Homo sapiens
ccaggcttcaccctgaat

SEQ ID NO: 2810653 - DNA, 13 bp, Homo sapiens
ccagggagaccga

SEQ ID NO: 2810654 - DNA, 16 bp, Homo sapiens
ccagggcacaggagct

SEQ ID NO: 2810655 - DNA, 22 bp, Homo sapiens
ccagggcacaggagctacctgt

SEQ ID NO: 2810656 - DNA, 13 bp, Homo sapiens
ccagggccacgtg

SEQ ID NO: 2810657 - DNA, 17 bp, Homo sapiens
ccagggccacgtgccag

SEQ ID NO: 2810658 - DNA, 19 bp, Homo sapiens
ccagggccacgtgccaggc

SEQ ID NO: 2810659 - DNA, 12 bp, Homo sapiens
ccagggccaggg

SEQ ID NO: 2810660 - DNA, 14 bp, Homo sapiens
ccagggccagggcc

SEQ ID NO: 2810661 - DNA, 16 bp, Homo sapiens
ccagggccagggccct

SEQ ID NO: 2810662 - DNA, 15 bp, Homo sapiens
ccagggccctgcaga

SEQ ID NO: 2810663 - DNA, 11 bp, Homo sapiens
ccagggctcag

SEQ ID NO: 2810664 - DNA, 14 bp, Homo sapiens
ccagggctcagcct

SEQ ID NO: 2810665 - DNA, 15 bp, Homo sapiens
ccagggctcagcctg

SEQ ID NO: 2810666 - DNA, 16 bp, Homo sapiens
ccagggctcagcctgg

SEQ ID NO: 2810667 - DNA, 18 bp, Homo sapiens
ccaggggcccacagggaa

SEQ ID NO: 2810668 - DNA, 16 bp, Homo sapiens
ccaggggtctccctgg

SEQ ID NO: 2810669 - DNA, 15 bp, Homo sapiens
ccagggtcctgagtg

SEQ ID NO: 2810670 - DNA, 14 bp, Homo sapiens
cccacagcctctgc

SEQ ID NO: 2810671 - DNA, 21 bp, Homo sapiens
cccacaggccccccgcagcac

SEQ ID NO: 2810672 - DNA, 13 bp, Homo sapiens
cccacatccctgg

SEQ ID NO: 2810673 - DNA, 14 bp, Homo sapiens
cccacatccctggg

SEQ ID NO: 2810674 - DNA, 19 bp, Homo sapiens
cccacatccctgggcctgc

SEQ ID NO: 2810675 - DNA, 24 bp, Homo sapiens
cccacatccctgggcctgctgctg

SEQ ID NO: 2810676 - DNA, 18 bp, Homo sapiens
cccacatgaggacatgat

SEQ ID NO: 2810677 - DNA, 21 bp, Homo sapiens
cccaccaacatcccattgccc

SEQ ID NO: 2810678 - DNA, 20 bp, Homo sapiens
cccaccaccctcccaccatg

SEQ ID NO: 2810679 - DNA, 16 bp, Homo sapiens
cccaccacctaggcca

SEQ ID NO: 2810680 - DNA, 23 bp, Homo sapiens
cccaccactaggactctgaggct

SEQ ID NO: 2810681 - DNA, 17 bp, Homo sapiens
cccaccagcatgtcact

SEQ ID NO: 2810682 - DNA, 21 bp, Homo sapiens
cccaccagcatgtcactccca

SEQ ID NO: 2810683 - DNA, 12 bp, Homo sapiens
cccaccagccac

SEQ ID NO: 2810684 - DNA, 15 bp, Homo sapiens
cccaccagccacctc

SEQ ID NO: 2810685 - DNA, 19 bp, Homo sapiens
cccaccatgcgctgctcaa

SEQ ID NO: 2810686 - DNA, 18 bp, Homo sapiens
cccacccccagccccgac

SEQ ID NO: 2810687 - DNA, 19 bp, Homo sapiens
cccacccccttcagtgccc

SEQ ID NO: 2810688 - DNA, 23 bp, Homo sapiens
cccacccccttcagtgcccacca

SEQ ID NO: 2810689 - DNA, 22 bp, Homo sapiens
cccaccctcgtggacacctgcc

SEQ ID NO: 2810690 - DNA, 17 bp, Homo sapiens
cccaccgggccactcct

SEQ ID NO: 2810691 - DNA, 23 bp, Homo sapiens
cccaccgggccactccttcctgc

SEQ ID NO: 2810692 - DNA, 17 bp, Homo sapiens
cccacctcagcctcccg

SEQ ID NO: 2810693 - DNA, 19 bp, Homo sapiens
cccacctccgccccagaca

SEQ ID NO: 2810694 - DNA, 12 bp, Homo sapiens
cccacctcttct

SEQ ID NO: 2810695 - DNA, 13 bp, Homo sapiens
cccacctgctgag

SEQ ID NO: 2810696 - DNA, 22 bp, Homo sapiens
cccaccttcaattcctgggccc

SEQ ID NO: 2810697 - DNA, 13 bp, Homo sapiens
cccaccttcccca

SEQ ID NO: 2810698 - DNA, 18 bp, Homo sapiens
cccaccttccccagactc

SEQ ID NO: 2810699 - DNA, 12 bp, Homo sapiens
cccaccttggct

SEQ ID NO: 2810700 - DNA, 22 bp, Homo sapiens
cccaccttggctcaagtcctct

SEQ ID NO: 2810701 - DNA, 15 bp, Homo sapiens
cccaccttggctgca

SEQ ID NO: 2810702 - DNA, 23 bp, Homo sapiens
cccacgagggagttgggacagga

SEQ ID NO: 2810703 - DNA, 14 bp, Homo sapiens
cccacgctggagtg

SEQ ID NO: 2810704 - DNA, 21 bp, Homo sapiens
cccacgctggagtgcagtgag

SEQ ID NO: 2810705 - DNA, 16 bp, Homo sapiens
cccacgtgtgcagact

SEQ ID NO: 2810706 - DNA, 17 bp, Homo sapiens
cccactccccaccttca

SEQ ID NO: 2810707 - DNA, 21 bp, Homo sapiens
cccactctaggggtcaggctc

SEQ ID NO: 2810708 - DNA, 13 bp, Homo sapiens
cccactctcattc

SEQ ID NO: 2810709 - DNA, 18 bp, Homo sapiens
cccactctgctctgatgc

SEQ ID NO: 2810710 - DNA, 18 bp, Homo sapiens
cccactgccacaccctcc

SEQ ID NO: 2810711 - DNA, 23 bp, Homo sapiens
cccactgcttttggtctgtgtga

SEQ ID NO: 2810712 - DNA, 19 bp, Homo sapiens
cccactgtgcttacagtga

SEQ ID NO: 2810713 - DNA, 12 bp, Homo sapiens
cccacttctgcc

SEQ ID NO: 2810714 - DNA, 22 bp, Homo sapiens
cccagaccacctccctgccctg

SEQ ID NO: 2810715 - DNA, 18 bp, Homo sapiens
cccagacttctctttctt

SEQ ID NO: 2810716 - DNA, 15 bp, Homo sapiens
cccagagacaggaaa

SEQ ID NO: 2810717 - DNA, 21 bp, Homo sapiens
cccagagaccccttcctttcc

SEQ ID NO: 2810718 - DNA, 21 bp, Homo sapiens
cccagagaggaatcagacttc

SEQ ID NO: 2810719 - DNA, 20 bp, Homo sapiens
cccagagatgcctccaccgc

SEQ ID NO: 2810720 - DNA, 21 bp, Homo sapiens
cccagagcattacgtgagcca

SEQ ID NO: 2810721 - DNA, 20 bp, Homo sapiens
cccagagccttctcctgcct

SEQ ID NO: 2810722 - DNA, 15 bp, Homo sapiens
cccagagggcccagg

SEQ ID NO: 2810723 - DNA, 16 bp, Homo sapiens
cccagagggcccaggc

SEQ ID NO: 2810724 - DNA, 18 bp, Homo sapiens
cccagagggcccaggcag

SEQ ID NO: 2810725 - DNA, 23 bp, Homo sapiens
cccagagtgtgggaagggagagc

SEQ ID NO: 2810726 - DNA, 20 bp, Homo sapiens
cccagattgcaacaggctgg

SEQ ID NO: 2810727 - DNA, 21 bp, Homo sapiens
cccagattgcaacaggctggg

SEQ ID NO: 2810728 - DNA, 20 bp, Homo sapiens
cccagcaacacaagctggaa

SEQ ID NO: 2810729 - DNA, 16 bp, Homo sapiens
cccagcactaaagcag

SEQ ID NO: 2810730 - DNA, 17 bp, Homo sapiens
cccagcactaaagcagt

SEQ ID NO: 2810731 - DNA, 12 bp, Homo sapiens
cccagcactcct

SEQ ID NO: 2810732 - DNA, 22 bp, Homo sapiens
cccagcactcctctgtctctgc

SEQ ID NO: 2810733 - DNA, 11 bp, Homo sapiens
cccagcactgt

SEQ ID NO: 2810734 - DNA, 20 bp, Homo sapiens
cccagcactttgggaggcca

SEQ ID NO: 2810735 - DNA, 19 bp, Homo sapiens
cccagcaggaagccaggct

SEQ ID NO: 2810736 - DNA, 13 bp, Homo sapiens
cccagcagggcct

SEQ ID NO: 2810737 - DNA, 19 bp, Homo sapiens
cccagcagggcctcaaagt

SEQ ID NO: 2810738 - DNA, 10 bp, Homo sapiens
cccagccatt

SEQ ID NO: 2810739 - DNA, 14 bp, Homo sapiens
cccagcccacttct

SEQ ID NO: 2810740 - DNA, 13 bp, Homo sapiens
cccagcccagctg

SEQ ID NO: 2810741 - DNA, 21 bp, Homo sapiens
cccagcccattctctctcctg

SEQ ID NO: 2810742 - DNA, 22 bp, Homo sapiens
cccagccccgactccagccagc

SEQ ID NO: 2810743 - DNA, 19 bp, Homo sapiens
cccagcccctcctcccctt

SEQ ID NO: 2810744 - DNA, 17 bp, Homo sapiens
cccagccctatggatgt

SEQ ID NO: 2810745 - DNA, 23 bp, Homo sapiens
cccagcctcgcatgccagagcct

SEQ ID NO: 2810746 - DNA, 17 bp, Homo sapiens
cccagcctctgtccctc

SEQ ID NO: 2810747 - DNA, 21 bp, Homo sapiens
cccagcgattccctctcccag

SEQ ID NO: 2810748 - DNA, 21 bp, Homo sapiens
cccagctactcaagaggctga

SEQ ID NO: 2810749 - DNA, 23 bp, Homo sapiens
cccagctactcagaagcctgagg

SEQ ID NO: 2810750 - DNA, 15 bp, Homo sapiens
cccagctacttggga

SEQ ID NO: 2810751 - DNA, 16 bp, Homo sapiens
cccagctccccaggac

SEQ ID NO: 2810752 - DNA, 12 bp, Homo sapiens
cccagctctccc

SEQ ID NO: 2810753 - DNA, 17 bp, Homo sapiens
cccagctctccctctgg

SEQ ID NO: 2810754 - DNA, 23 bp, Homo sapiens
cccagctctccctctggccctgc

SEQ ID NO: 2810755 - DNA, 13 bp, Homo sapiens
cccagctgaggct

SEQ ID NO: 2810756 - DNA, 21 bp, Homo sapiens
cccagctgcacctgccagcct

SEQ ID NO: 2810757 - DNA, 22 bp, Homo sapiens
cccagctgcacctgccagcctg

SEQ ID NO: 2810758 - DNA, 23 bp, Homo sapiens
cccagctgcacctgccagcctgg

SEQ ID NO: 2810759 - DNA, 23 bp, Homo sapiens
cccagctgtctgtgtcagcctgt

SEQ ID NO: 2810760 - DNA, 12 bp, Homo sapiens
cccctcctcccc

SEQ ID NO: 2810761 - DNA, 13 bp, Homo sapiens
cccctcgctgtcc

SEQ ID NO: 2810762 - DNA, 20 bp, Homo sapiens
cccctcgctgtcctgctgtg

SEQ ID NO: 2810763 - DNA, 22 bp, Homo sapiens
cccctgcagcttgtagccagcc

SEQ ID NO: 2810764 - DNA, 14 bp, Homo sapiens
cccctgccaccctg

SEQ ID NO: 2810765 - DNA, 14 bp, Homo sapiens
cccctgccctgctg

SEQ ID NO: 2810766 - DNA, 11 bp, Homo sapiens
cccctgggctc

SEQ ID NO: 2810767 - DNA, 15 bp, Homo sapiens
cccctgggctctgcc

SEQ ID NO: 2810768 - DNA, 21 bp, Homo sapiens
cccctgggctctgccccagct

SEQ ID NO: 2810769 - DNA, 20 bp, Homo sapiens
cccctggggcttctcctgac

SEQ ID NO: 2810770 - DNA, 16 bp, Homo sapiens
cccctggtctgccctg

SEQ ID NO: 2810771 - DNA, 17 bp, Homo sapiens
cccctggtctgccctgg

SEQ ID NO: 2810772 - DNA, 19 bp, Homo sapiens
cccctggtctgccctgggc

SEQ ID NO: 2810773 - DNA, 21 bp, Homo sapiens
cccctggtggacagtcctggg

SEQ ID NO: 2810774 - DNA, 14 bp, Homo sapiens
cccctgtactccag

SEQ ID NO: 2810775 - DNA, 22 bp, Homo sapiens
cccctgtgtgagttgagtctcc

SEQ ID NO: 2810776 - DNA, 15 bp, Homo sapiens
ccccttatccaggac

SEQ ID NO: 2810777 - DNA, 16 bp, Homo sapiens
ccccttatccaggact

SEQ ID NO: 2810778 - DNA, 13 bp, Homo sapiens
ccccttcctgcac

SEQ ID NO: 2810779 - DNA, 15 bp, Homo sapiens
ccccttcctgcaccc

SEQ ID NO: 2810780 - DNA, 16 bp, Homo sapiens
ccccttcctgcacccg

SEQ ID NO: 2810781 - DNA, 20 bp, Homo sapiens
ccccttcctgcacccgtacc

SEQ ID NO: 2810782 - DNA, 14 bp, Homo sapiens
ccccttcctttcct

SEQ ID NO: 2810783 - DNA, 21 bp, Homo sapiens
ccccttcctttcctctgcagc

SEQ ID NO: 2810784 - DNA, 15 bp, Homo sapiens
ccccttcgctcctgt

SEQ ID NO: 2810785 - DNA, 17 bp, Homo sapiens
ccccttcgctcctgtgt

SEQ ID NO: 2810786 - DNA, 17 bp, Homo sapiens
ccccttgcccagggctc

SEQ ID NO: 2810787 - DNA, 17 bp, Homo sapiens
ccccttggcgggcagcc

SEQ ID NO: 2810788 - DNA, 13 bp, Homo sapiens
ccccttgggcctc

SEQ ID NO: 2810789 - DNA, 15 bp, Homo sapiens
ccccttgggcctccc

SEQ ID NO: 2810790 - DNA, 15 bp, Homo sapiens
cccctttcctggggg

SEQ ID NO: 2810791 - DNA, 18 bp, Homo sapiens
cccgaatagctgggacta

SEQ ID NO: 2810792 - DNA, 13 bp, Homo sapiens
cccgagcagctga

SEQ ID NO: 2810793 - DNA, 22 bp, Homo sapiens
cccgagcagctgagcagggccg

SEQ ID NO: 2810794 - DNA, 11 bp, Homo sapiens
cccgctctgga

SEQ ID NO: 2810795 - DNA, 16 bp, Homo sapiens
cccgctggcagccacc

SEQ ID NO: 2810796 - DNA, 14 bp, Homo sapiens
cccgctggctcctc

SEQ ID NO: 2810797 - DNA, 18 bp, Homo sapiens
cccgcttccccacagaac

SEQ ID NO: 2810798 - DNA, 15 bp, Homo sapiens
cccgcttgtccagcg

SEQ ID NO: 2810799 - DNA, 16 bp, Homo sapiens
cccgctttgcctgctt

SEQ ID NO: 2810800 - DNA, 18 bp, Homo sapiens
cccggagaaggccgctgc

SEQ ID NO: 2810801 - DNA, 19 bp, Homo sapiens
cccggagaaggccgctgcc

SEQ ID NO: 2810802 - DNA, 20 bp, Homo sapiens
cccggagaaggccgctgccc

SEQ ID NO: 2810803 - DNA, 18 bp, Homo sapiens
cccggcaccccctgcagc

SEQ ID NO: 2810804 - DNA, 16 bp, Homo sapiens
cccggcccctgctggt

SEQ ID NO: 2810805 - DNA, 21 bp, Homo sapiens
cccggcctgctcccagcagcc

SEQ ID NO: 2810806 - DNA, 19 bp, Homo sapiens
cccggcgcggtggctcacg

SEQ ID NO: 2810807 - DNA, 11 bp, Homo sapiens
cccggctccag

SEQ ID NO: 2810808 - DNA, 13 bp, Homo sapiens
cccggctccaggc

SEQ ID NO: 2810809 - DNA, 16 bp, Homo sapiens
cccggctccccctgct

SEQ ID NO: 2810810 - DNA, 14 bp, Homo sapiens
cccgggcctgcctc

SEQ ID NO: 2810811 - DNA, 16 bp, Homo sapiens
cccgggcctgcctctg

SEQ ID NO: 2810812 - DNA, 17 bp, Homo sapiens
cccgtacccccgtggtc

SEQ ID NO: 2810813 - DNA, 20 bp, Homo sapiens
cccgtacccccgtggtcttt

SEQ ID NO: 2810814 - DNA, 18 bp, Homo sapiens
cccgtcatgttcctcaaa

SEQ ID NO: 2810815 - DNA, 20 bp, Homo sapiens
cccgtctggggttcagcccc

SEQ ID NO: 2810816 - DNA, 23 bp, Homo sapiens
cccgtctggggttcagcccctcc

SEQ ID NO: 2810817 - DNA, 12 bp, Homo sapiens
cccgtcttcagc

SEQ ID NO: 2810818 - DNA, 13 bp, Homo sapiens
cccgtcttcagcc

SEQ ID NO: 2810819 - DNA, 14 bp, Homo sapiens
cccgtcttcagcct

SEQ ID NO: 2810820 - DNA, 15 bp, Homo sapiens
cccgtcttcagccta

SEQ ID NO: 2810821 - DNA, 18 bp, Homo sapiens
cccgtcttcagcctagcc

SEQ ID NO: 2810822 - DNA, 13 bp, Homo sapiens
cccgtggaggctg

SEQ ID NO: 2810823 - DNA, 14 bp, Homo sapiens
cccgtggtctttga

SEQ ID NO: 2810824 - DNA, 13 bp, Homo sapiens
ccctaaaataaaa

SEQ ID NO: 2810825 - DNA, 14 bp, Homo sapiens
ccctaaaataaaaa

SEQ ID NO: 2810826 - DNA, 18 bp, Homo sapiens
ccctacttcttttgctct

SEQ ID NO: 2810827 - DNA, 19 bp, Homo sapiens
ccctacttcttttgctctt

SEQ ID NO: 2810828 - DNA, 20 bp, Homo sapiens
ccctagaggcaaacatttct

SEQ ID NO: 2810829 - DNA, 14 bp, Homo sapiens
ccctaggagaccaa

SEQ ID NO: 2810830 - DNA, 23 bp, Homo sapiens
ccctatatgtagtataaagaaaa

SEQ ID NO: 2810831 - DNA, 15 bp, Homo sapiens
ccctatcaaaacata

SEQ ID NO: 2810832 - DNA, 16 bp, Homo sapiens
ccctatccacccagcc

SEQ ID NO: 2810833 - DNA, 18 bp, Homo sapiens
ccctatccacccagccca

SEQ ID NO: 2810834 - DNA, 16 bp, Homo sapiens
ccctatggatgtgggg

SEQ ID NO: 2810835 - DNA, 18 bp, Homo sapiens
ccctcaaatgacccaaag

SEQ ID NO: 2810836 - DNA, 22 bp, Homo sapiens
ccctcaatccccaagctggcag

SEQ ID NO: 2810837 - DNA, 12 bp, Homo sapiens
ccctcactgcct

SEQ ID NO: 2810838 - DNA, 16 bp, Homo sapiens
ccctcactgccttcca

SEQ ID NO: 2810839 - DNA, 16 bp, Homo sapiens
ccctcataccatctgc

SEQ ID NO: 2810840 - DNA, 17 bp, Homo sapiens
ccctcattcaggaaaac

SEQ ID NO: 2810841 - DNA, 14 bp, Homo sapiens
ccctccaccccagg

SEQ ID NO: 2810842 - DNA, 15 bp, Homo sapiens
ccctccaccccagga

SEQ ID NO: 2810843 - DNA, 13 bp, Homo sapiens
ccctccagctgga

SEQ ID NO: 2810844 - DNA, 11 bp, Homo sapiens
ccctccaggca

SEQ ID NO: 2810845 - DNA, 16 bp, Homo sapiens
ccctcccaccatgcgc

SEQ ID NO: 2810846 - DNA, 20 bp, Homo sapiens
ccctcccacccccagccccg

SEQ ID NO: 2810847 - DNA, 22 bp, Homo sapiens
ccctcccagggccagggccctg

SEQ ID NO: 2810848 - DNA, 12 bp, Homo sapiens
ccctccccaggg

SEQ ID NO: 2810849 - DNA, 14 bp, Homo sapiens
ccctcccctccccc

SEQ ID NO: 2810850 - DNA, 13 bp, Homo sapiens
ccctccctggcct

SEQ ID NO: 2810851 - DNA, 14 bp, Homo sapiens
ccctccctggcctc

SEQ ID NO: 2810852 - DNA, 13 bp, Homo sapiens
ccgggccacagag

SEQ ID NO: 2810853 - DNA, 20 bp, Homo sapiens
ccgggccactccttcctgcc

SEQ ID NO: 2810854 - DNA, 13 bp, Homo sapiens
ccgggcctgcctc

SEQ ID NO: 2810855 - DNA, 21 bp, Homo sapiens
ccgggcttgggccctgcacag

SEQ ID NO: 2810856 - DNA, 15 bp, Homo sapiens
ccggggaactggcca

SEQ ID NO: 2810857 - DNA, 17 bp, Homo sapiens
ccggggaactggccaag

SEQ ID NO: 2810858 - DNA, 21 bp, Homo sapiens
ccggggaagctggcagcactc

SEQ ID NO: 2810859 - DNA, 13 bp, Homo sapiens
ccgggtccccagc

SEQ ID NO: 2810860 - DNA, 15 bp, Homo sapiens
ccgggtccccagctc

SEQ ID NO: 2810861 - DNA, 17 bp, Homo sapiens
ccgggtccccagctccc

SEQ ID NO: 2810862 - DNA, 18 bp, Homo sapiens
ccggtcccttgagacctc

SEQ ID NO: 2810863 - DNA, 16 bp, Homo sapiens
ccggtgtgcctgcagc

SEQ ID NO: 2810864 - DNA, 23 bp, Homo sapiens
ccgtacccccgtggtctttgaat

SEQ ID NO: 2810865 - DNA, 22 bp, Homo sapiens
ccgtagttccctgaaaacccag

SEQ ID NO: 2810866 - DNA, 15 bp, Homo sapiens
ccgtcatgttcctca

SEQ ID NO: 2810867 - DNA, 16 bp, Homo sapiens
ccgtcatgttcctcaa

SEQ ID NO: 2810868 - DNA, 17 bp, Homo sapiens
ccgtcatgttcctcaaa

SEQ ID NO: 2810869 - DNA, 21 bp, Homo sapiens
ccgtctggggttcagcccctc

SEQ ID NO: 2810870 - DNA, 22 bp, Homo sapiens
ccgtcttagaagtggaccagga

SEQ ID NO: 2810871 - DNA, 14 bp, Homo sapiens
ccgtcttctctcca

SEQ ID NO: 2810872 - DNA, 12 bp, Homo sapiens
ccgtgcccaggg

SEQ ID NO: 2810873 - DNA, 14 bp, Homo sapiens
ccgtggaccttcct

SEQ ID NO: 2810874 - DNA, 16 bp, Homo sapiens
ccgtggaccttcctgc

SEQ ID NO: 2810875 - DNA, 15 bp, Homo sapiens
ccgtggaggctgctc

SEQ ID NO: 2810876 - DNA, 16 bp, Homo sapiens
ccgtggaggctgctcg

SEQ ID NO: 2810877 - DNA, 16 bp, Homo sapiens
ccgtggcccttcctgg

SEQ ID NO: 2810878 - DNA, 20 bp, Homo sapiens
ccgtggcccttcctggacag

SEQ ID NO: 2810879 - DNA, 21 bp, Homo sapiens
ccgtggcccttcctggacagc

SEQ ID NO: 2810880 - DNA, 13 bp, Homo sapiens
ccgtggtccagct

SEQ ID NO: 2810881 - DNA, 15 bp, Homo sapiens
ccgtggtccagctct

SEQ ID NO: 2810882 - DNA, 16 bp, Homo sapiens
ccgtggtctttgaata

SEQ ID NO: 2810883 - DNA, 20 bp, Homo sapiens
ccgtggtctttgaataaagt

SEQ ID NO: 2810884 - DNA, 22 bp, Homo sapiens
ccgtggtctttgaataaagtct

SEQ ID NO: 2810885 - DNA, 23 bp, Homo sapiens
ccgtggtctttgaataaagtctg

SEQ ID NO: 2810886 - DNA, 13 bp, Homo sapiens
ccgtgtccagcac

SEQ ID NO: 2810887 - DNA, 20 bp, Homo sapiens
ccgttccttccgatgacagt

SEQ ID NO: 2810888 - DNA, 15 bp, Homo sapiens
ccgttctgctggcct

SEQ ID NO: 2810889 - DNA, 14 bp, Homo sapiens
ccgtttttcaagaa

SEQ ID NO: 2810890 - DNA, 14 bp, Homo sapiens
cctaaaagtaaaca

SEQ ID NO: 2810891 - DNA, 12 bp, Homo sapiens
cctaaaataaaa

SEQ ID NO: 2810892 - DNA, 14 bp, Homo sapiens
cctaaatccaaaga

SEQ ID NO: 2810893 - DNA, 15 bp, Homo sapiens
cctaaatccaaagaa

SEQ ID NO: 2810894 - DNA, 15 bp, Homo sapiens
cctaacccctttcct

SEQ ID NO: 2810895 - DNA, 14 bp, Homo sapiens
cctaaggacacact

SEQ ID NO: 2810896 - DNA, 17 bp, Homo sapiens
cctaaggatctctcagg

SEQ ID NO: 2810897 - DNA, 23 bp, Homo sapiens
cctaaggatctctcaggagcaca

SEQ ID NO: 2810898 - DNA, 24 bp, Homo sapiens
cctaaggatctctcaggagcacag

SEQ ID NO: 2810899 - DNA, 14 bp, Homo sapiens
cctaagtggctgct

SEQ ID NO: 2810900 - DNA, 18 bp, Homo sapiens
cctaataaacatccttca

SEQ ID NO: 2810901 - DNA, 14 bp, Homo sapiens
cctacatccccagg

SEQ ID NO: 2810902 - DNA, 20 bp, Homo sapiens
cctacatccccaggtctctc

SEQ ID NO: 2810903 - DNA, 19 bp, Homo sapiens
cctacatgaaacagaaaca

SEQ ID NO: 2810904 - DNA, 15 bp, Homo sapiens
cctacattccctggc

SEQ ID NO: 2810905 - DNA, 18 bp, Homo sapiens
cctaccaaatataaactt

SEQ ID NO: 2810906 - DNA, 13 bp, Homo sapiens
cctaccacagtgt

SEQ ID NO: 2810907 - DNA, 17 bp, Homo sapiens
cctaccaccccttcctg

SEQ ID NO: 2810908 - DNA, 15 bp, Homo sapiens
cctacccaaccactc

SEQ ID NO: 2810909 - DNA, 13 bp, Homo sapiens
cctaccccaccac

SEQ ID NO: 2810910 - DNA, 20 bp, Homo sapiens
cctaccccacctcatgcctg

SEQ ID NO: 2810911 - DNA, 14 bp, Homo sapiens
cctacctcagccta

SEQ ID NO: 2810912 - DNA, 21 bp, Homo sapiens
cctacctcagcctagaccctc

SEQ ID NO: 2810913 - DNA, 16 bp, Homo sapiens
cctactcacacaggca

SEQ ID NO: 2810914 - DNA, 13 bp, Homo sapiens
cctactgaatgct

SEQ ID NO: 2810915 - DNA, 20 bp, Homo sapiens
cctacttcattttcagagtg

SEQ ID NO: 2810916 - DNA, 21 bp, Homo sapiens
cctacttcattttcagagtga

SEQ ID NO: 2810917 - DNA, 16 bp, Homo sapiens
cctacttgtaatttct

SEQ ID NO: 2810918 - DNA, 16 bp, Homo sapiens
cctactttagccactg

SEQ ID NO: 2810919 - DNA, 20 bp, Homo sapiens
cctagaagagtcaggaaggg

SEQ ID NO: 2810920 - DNA, 15 bp, Homo sapiens
cctagagcacactgt

SEQ ID NO: 2810921 - DNA, 21 bp, Homo sapiens
cctagaggcaaacatttctta

SEQ ID NO: 2810922 - DNA, 17 bp, Homo sapiens
cctagcaggcacaggac

SEQ ID NO: 2810923 - DNA, 20 bp, Homo sapiens
cctagccctctcacatttat

SEQ ID NO: 2810924 - DNA, 14 bp, Homo sapiens
cctagccgacctca

SEQ ID NO: 2810925 - DNA, 15 bp, Homo sapiens
cctagccgacctcag

SEQ ID NO: 2810926 - DNA, 20 bp, Homo sapiens
cctagccgacctcagccttc

SEQ ID NO: 2810927 - DNA, 19 bp, Homo sapiens
cctaggacttgagcctcca

SEQ ID NO: 2810928 - DNA, 12 bp, Homo sapiens
cctaggagacca

SEQ ID NO: 2810929 - DNA, 13 bp, Homo sapiens
cctaggaggcctt

SEQ ID NO: 2810930 - DNA, 19 bp, Homo sapiens
cctaggccactcctccaaa

SEQ ID NO: 2810931 - DNA, 21 bp, Homo sapiens
cctagtggggtctccctctcc

SEQ ID NO: 2810932 - DNA, 24 bp, Homo sapiens
cctagtggggtctccctctcctgc

SEQ ID NO: 2810933 - DNA, 23 bp, Homo sapiens
  misc_feature (5)..(5): n is a, c, g or t
  misc_feature (12)..(12): n is a, c, g or t
cctanccccccnacccccagtgt

SEQ ID NO: 2810934 - DNA, 18 bp, Homo sapiens
cctatacctgtgtttctt

SEQ ID NO: 2810935 - DNA, 15 bp, Homo sapiens
cctatcaaaacatat

SEQ ID NO: 2810936 - DNA, 16 bp, Homo sapiens
cctatccacccagccc

SEQ ID NO: 2810937 - DNA, 17 bp, Homo sapiens
cctatccacccagccca

SEQ ID NO: 2810938 - DNA, 13 bp, Homo sapiens
cctatccatcctg

SEQ ID NO: 2810939 - DNA, 22 bp, Homo sapiens
cctatgacttgggcacccccag

SEQ ID NO: 2810940 - DNA, 13 bp, Homo sapiens
cctatggagagcc

SEQ ID NO: 2810941 - DNA, 14 bp, Homo sapiens
cctatggagagccc

SEQ ID NO: 2810942 - DNA, 15 bp, Homo sapiens
cctatggagagccct

SEQ ID NO: 2810943 - DNA, 12 bp, Homo sapiens
cctccctgccct

SEQ ID NO: 2810944 - DNA, 14 bp, Homo sapiens
cctccctgccctgt

SEQ ID NO: 2810945 - DNA, 21 bp, Homo sapiens
cctccctgccctgtcctccag

SEQ ID NO: 2810946 - DNA, 13 bp, Homo sapiens
cctccctggcctc

SEQ ID NO: 2810947 - DNA, 24 bp, Homo sapiens
cctccctggcctcacgcccagcct

SEQ ID NO: 2810948 - DNA, 20 bp, Homo sapiens
cctccgccccagacacaccc

SEQ ID NO: 2810949 - DNA, 14 bp, Homo sapiens
cctccgcctcttgg

SEQ ID NO: 2810950 - DNA, 18 bp, Homo sapiens
cctccgtccaggagcctg

SEQ ID NO: 2810951 - DNA, 15 bp, Homo sapiens
cctccgtctgcaatg

SEQ ID NO: 2810952 - DNA, 20 bp, Homo sapiens
cctcctagggaaaagttcat

SEQ ID NO: 2810953 - DNA, 20 bp, Homo sapiens
cctcctccccttcctgcacc

SEQ ID NO: 2810954 - DNA, 12 bp, Homo sapiens
cctcctcctgac

SEQ ID NO: 2810955 - DNA, 15 bp, Homo sapiens
cctcctcctgccctc

SEQ ID NO: 2810956 - DNA, 14 bp, Homo sapiens
cctcctctgccacc

SEQ ID NO: 2810957 - DNA, 12 bp, Homo sapiens
cctcctctgtcc

SEQ ID NO: 2810958 - DNA, 12 bp, Homo sapiens
cctcctgcccag

SEQ ID NO: 2810959 - DNA, 13 bp, Homo sapiens
cctcctgcccagg

SEQ ID NO: 2810960 - DNA, 19 bp, Homo sapiens
cctcctgcccaggagagcc

SEQ ID NO: 2810961 - DNA, 14 bp, Homo sapiens
cctcctgtccagca

SEQ ID NO: 2810962 - DNA, 15 bp, Homo sapiens
cctccttggtgcctg

SEQ ID NO: 2810963 - DNA, 18 bp, Homo sapiens
cctccttttgcttgaaac

SEQ ID NO: 2810964 - DNA, 15 bp, Homo sapiens
cctcgaactggctgc

SEQ ID NO: 2810965 - DNA, 19 bp, Homo sapiens
cctcgctccccactctgct

SEQ ID NO: 2810966 - DNA, 13 bp, Homo sapiens
cctcgctgtcctg

SEQ ID NO: 2810967 - DNA, 19 bp, Homo sapiens
cctcggtggccatgcttct

SEQ ID NO: 2810968 - DNA, 22 bp, Homo sapiens
cctctaacccccagtgccacag

SEQ ID NO: 2810969 - DNA, 14 bp, Homo sapiens
cctctactgggaag

SEQ ID NO: 2810970 - DNA, 16 bp, Homo sapiens
cctctactgggaaggc

SEQ ID NO: 2810971 - DNA, 17 bp, Homo sapiens
cctctactgggaaggct

SEQ ID NO: 2810972 - DNA, 20 bp, Homo sapiens
cctctcaatattcaataaag

SEQ ID NO: 2810973 - DNA, 22 bp, Homo sapiens
cctctcaatattcaataaagct

SEQ ID NO: 2810974 - DNA, 18 bp, Homo sapiens
cctctccaattgtaaaaa

SEQ ID NO: 2810975 - DNA, 19 bp, Homo sapiens
cctctccaattgtaaaaaa

SEQ ID NO: 2810976 - DNA, 12 bp, Homo sapiens
cctctcccaggc

SEQ ID NO: 2810977 - DNA, 13 bp, Homo sapiens
cctctcccaggcc

SEQ ID NO: 2810978 - DNA, 15 bp, Homo sapiens
cctctcccaggcccc

SEQ ID NO: 2810979 - DNA, 16 bp, Homo sapiens
cctctcccaggcccca

SEQ ID NO: 2810980 - DNA, 18 bp, Homo sapiens
cctctcccaggccccatg

SEQ ID NO: 2810981 - DNA, 23 bp, Homo sapiens
cctctcccaggccccatgacctc

SEQ ID NO: 2810982 - DNA, 21 bp, Homo sapiens
cctctcggaaggctggctggg

SEQ ID NO: 2810983 - DNA, 16 bp, Homo sapiens
cctctctccttctggc

SEQ ID NO: 2810984 - DNA, 16 bp, Homo sapiens
cctctctcttcccagc

SEQ ID NO: 2810985 - DNA, 20 bp, Homo sapiens
cctctcttatagaatattta

SEQ ID NO: 2810986 - DNA, 11 bp, Homo sapiens
cctctcttgcc

SEQ ID NO: 2810987 - DNA, 17 bp, Homo sapiens
cctctgacacacagctc

SEQ ID NO: 2810988 - DNA, 20 bp, Homo sapiens
cctctgaggccagcctggcc

SEQ ID NO: 2810989 - DNA, 15 bp, Homo sapiens
cctctgatacccaga

SEQ ID NO: 2810990 - DNA, 15 bp, Homo sapiens
cctctgatacctcaa

SEQ ID NO: 2810991 - DNA, 20 bp, Homo sapiens
cctctgccacctcccctatc

SEQ ID NO: 2810992 - DNA, 11 bp, Homo sapiens
cctctgcctca

SEQ ID NO: 2810993 - DNA, 20 bp, Homo sapiens
cctctgcctctgacacacag

SEQ ID NO: 2810994 - DNA, 11 bp, Homo sapiens
cctctgcctga

SEQ ID NO: 2810995 - DNA, 20 bp, Homo sapiens
cctctgcctgtgcacggcca

SEQ ID NO: 2810996 - DNA, 21 bp, Homo sapiens
cctctgctctgaggcttccag

SEQ ID NO: 2810997 - DNA, 14 bp, Homo sapiens
cctctgctgccatg

SEQ ID NO: 2810998 - DNA, 15 bp, Homo sapiens
cctctgctgccatgg

SEQ ID NO: 2810999 - DNA, 16 bp, Homo sapiens
cctctggatggcacca

SEQ ID NO: 2811000 - DNA, 13 bp, Homo sapiens
cctctggccctgc

SEQ ID NO: 2811001 - DNA, 17 bp, Homo sapiens
cctctggccctgccttc

SEQ ID NO: 2811002 - DNA, 18 bp, Homo sapiens
cctctggccctgccttct

SEQ ID NO: 2811003 - DNA, 22 bp, Homo sapiens
cctctggctggctaactggaag

SEQ ID NO: 2811004 - DNA, 13 bp, Homo sapiens
cctctgtccctct

SEQ ID NO: 2811005 - DNA, 18 bp, Homo sapiens
cctctgtctcgagcgccc

SEQ ID NO: 2811006 - DNA, 23 bp, Homo sapiens
cctctgtctcgagcgccctgcag

SEQ ID NO: 2811007 - DNA, 17 bp, Homo sapiens
cctctgtctctgctctt

SEQ ID NO: 2811008 - DNA, 21 bp, Homo sapiens
cctcttaaagctgcctgtagt

SEQ ID NO: 2811009 - DNA, 21 bp, Homo sapiens
cctcttccccttgcccttgcc

SEQ ID NO: 2811010 - DNA, 14 bp, Homo sapiens
cctcttccttcccc

SEQ ID NO: 2811011 - DNA, 18 bp, Homo sapiens
cctcttctattttgtaaa

SEQ ID NO: 2811012 - DNA, 12 bp, Homo sapiens
cctcttctcttc

SEQ ID NO: 2811013 - DNA, 14 bp, Homo sapiens
cctcttctcttcct

SEQ ID NO: 2811014 - DNA, 16 bp, Homo sapiens
cctcttctcttcctgt

SEQ ID NO: 2811015 - DNA, 17 bp, Homo sapiens
cctcttctcttcctgta

SEQ ID NO: 2811016 - DNA, 16 bp, Homo sapiens
cctcttcttcttcaga

SEQ ID NO: 2811017 - DNA, 14 bp, Homo sapiens
cctcttgccactgc

SEQ ID NO: 2811018 - DNA, 23 bp, Homo sapiens
cctcttgccactgcctcttcctc

SEQ ID NO: 2811019 - DNA, 17 bp, Homo sapiens
cctcttggacctctgct

SEQ ID NO: 2811020 - DNA, 21 bp, Homo sapiens
cctcttggacctctgctctga

SEQ ID NO: 2811021 - DNA, 13 bp, Homo sapiens
cctcttgggttca

SEQ ID NO: 2811022 - DNA, 16 bp, Homo sapiens
cctctttgcctgtgtg

SEQ ID NO: 2811023 - DNA, 17 bp, Homo sapiens
cctctttgcctgtgtga

SEQ ID NO: 2811024 - DNA, 13 bp, Homo sapiens
cctgaaaacccag

SEQ ID NO: 2811025 - DNA, 16 bp, Homo sapiens
cctgaaaacccagaga

SEQ ID NO: 2811026 - DNA, 22 bp, Homo sapiens
cctgaaaaggtttatgaaaaag

SEQ ID NO: 2811027 - DNA, 18 bp, Homo sapiens
cctgaaagtgacagagac

SEQ ID NO: 2811028 - DNA, 14 bp, Homo sapiens
cctgaaatttcaga

SEQ ID NO: 2811029 - DNA, 21 bp, Homo sapiens
cctgaacaagaattggaagct

SEQ ID NO: 2811030 - DNA, 15 bp, Homo sapiens
cctgaacatctgtgt

SEQ ID NO: 2811031 - DNA, 20 bp, Homo sapiens
cctgaacatctgtgtgtgtc

SEQ ID NO: 2811032 - DNA, 14 bp, Homo sapiens
cctgaagaacagta

SEQ ID NO: 2811033 - DNA, 15 bp, Homo sapiens
cctgaagtcacacag

SEQ ID NO: 2811034 - DNA, 22 bp, Homo sapiens
ccttacacgtacctctcatcag

SEQ ID NO: 2811035 - DNA, 13 bp, Homo sapiens
ccttacctcctgc

SEQ ID NO: 2811036 - DNA, 22 bp, Homo sapiens
ccttactcctgtgggagcctcg

SEQ ID NO: 2811037 - DNA, 17 bp, Homo sapiens
ccttagaagtcacacag

SEQ ID NO: 2811038 - DNA, 18 bp, Homo sapiens
ccttagattagctctgga

SEQ ID NO: 2811039 - DNA, 21 bp, Homo sapiens
ccttagattagctctggacca

SEQ ID NO: 2811040 - DNA, 16 bp, Homo sapiens
ccttagcacttctttc

SEQ ID NO: 2811041 - DNA, 19 bp, Homo sapiens
ccttagctggcattacagc

SEQ ID NO: 2811042 - DNA, 22 bp, Homo sapiens
ccttagctggcattacagctgg

SEQ ID NO: 2811043 - DNA, 21 bp, Homo sapiens
ccttagcttagacctcagcct

SEQ ID NO: 2811044 - DNA, 17 bp, Homo sapiens
ccttatccaggactctg

SEQ ID NO: 2811045 - DNA, 13 bp, Homo sapiens
ccttcaactgaaa

SEQ ID NO: 2811046 - DNA, 19 bp, Homo sapiens
ccttcaagaactctgggct

SEQ ID NO: 2811047 - DNA, 20 bp, Homo sapiens
ccttcaattcctgggcccca

SEQ ID NO: 2811048 - DNA, 12 bp, Homo sapiens
ccttcacaacca

SEQ ID NO: 2811049 - DNA, 17 bp, Homo sapiens
ccttcacaaccagccac

SEQ ID NO: 2811050 - DNA, 15 bp, Homo sapiens
ccttcaccagagccc

SEQ ID NO: 2811051 - DNA, 17 bp, Homo sapiens
ccttcaccagagcccat

SEQ ID NO: 2811052 - DNA, 14 bp, Homo sapiens
ccttcatttcctcc

SEQ ID NO: 2811053 - DNA, 21 bp, Homo sapiens
ccttccacggatccatgtagc

SEQ ID NO: 2811054 - DNA, 19 bp, Homo sapiens
ccttccagtggtaccagct

SEQ ID NO: 2811055 - DNA, 22 bp, Homo sapiens
ccttccagtggtaccagctcac

SEQ ID NO: 2811056 - DNA, 24 bp, Homo sapiens
ccttccagtggtaccagctcactc

SEQ ID NO: 2811057 - DNA, 12 bp, Homo sapiens
ccttccataatt

SEQ ID NO: 2811058 - DNA, 21 bp, Homo sapiens
ccttccatgtcgcctctgcat

SEQ ID NO: 2811059 - DNA, 23 bp, Homo sapiens
ccttccatgtcgcctctgcattc

SEQ ID NO: 2811060 - DNA, 14 bp, Homo sapiens
ccttcccagctctc

SEQ ID NO: 2811061 - DNA, 17 bp, Homo sapiens
ccttcccagctctccct

SEQ ID NO: 2811062 - DNA, 18 bp, Homo sapiens
ccttcccagctctccctc

SEQ ID NO: 2811063 - DNA, 15 bp, Homo sapiens
ccttcccatctcttc

SEQ ID NO: 2811064 - DNA, 12 bp, Homo sapiens
ccttccccagac

SEQ ID NO: 2811065 - DNA, 21 bp, Homo sapiens
ccttcccccatcccctttcct

SEQ ID NO: 2811066 - DNA, 22 bp, Homo sapiens
ccttcccccatcccctttcctc

SEQ ID NO: 2811067 - DNA, 16 bp, Homo sapiens
ccttccccctcccagg

SEQ ID NO: 2811068 - DNA, 20 bp, Homo sapiens
ccttccccctcccagggcca

SEQ ID NO: 2811069 - DNA, 22 bp, Homo sapiens
ccttccccttgcccagggctca

SEQ ID NO: 2811070 - DNA, 11 bp, Homo sapiens
ccttccctggc

SEQ ID NO: 2811071 - DNA, 17 bp, Homo sapiens
ccttcctcagtcctgga

SEQ ID NO: 2811072 - DNA, 18 bp, Homo sapiens
ccttcctcagtcctggaa

SEQ ID NO: 2811073 - DNA, 14 bp, Homo sapiens
ccttcctgcacccg

SEQ ID NO: 2811074 - DNA, 16 bp, Homo sapiens
ccttcctgccaccagt

SEQ ID NO: 2811075 - DNA, 17 bp, Homo sapiens
ccttcctggacagctgt

SEQ ID NO: 2811076 - DNA, 20 bp, Homo sapiens
ccttcctggacagctgtgcc

SEQ ID NO: 2811077 - DNA, 16 bp, Homo sapiens
ccttcctgtcccacct

SEQ ID NO: 2811078 - DNA, 16 bp, Homo sapiens
ccttccttccctggct

SEQ ID NO: 2811079 - DNA, 20 bp, Homo sapiens
ccttccttgctgtcctaggc

SEQ ID NO: 2811080 - DNA, 12 bp, Homo sapiens
ccttcctttcct

SEQ ID NO: 2811081 - DNA, 13 bp, Homo sapiens
ccttcctttcctc

SEQ ID NO: 2811082 - DNA, 14 bp, Homo sapiens
ccttctcctgccta

SEQ ID NO: 2811083 - DNA, 22 bp, Homo sapiens
ccttctcgcattttctctagct

SEQ ID NO: 2811084 - DNA, 19 bp, Homo sapiens
ccttctctacccatctccc

SEQ ID NO: 2811085 - DNA, 22 bp, Homo sapiens
ccttctgtcctactctgtgtca

SEQ ID NO: 2811086 - DNA, 19 bp, Homo sapiens
ccttcttattctcactcca

SEQ ID NO: 2811087 - DNA, 23 bp, Homo sapiens
ccttcttcacccagctaatctgt

SEQ ID NO: 2811088 - DNA, 21 bp, Homo sapiens
ccttcttcggggaactcctgg

SEQ ID NO: 2811089 - DNA, 16 bp, Homo sapiens
ccttctttaaatcaaa

SEQ ID NO: 2811090 - DNA, 18 bp, Homo sapiens
ccttctttaaatcaaaag

SEQ ID NO: 2811091 - DNA, 21 bp, Homo sapiens
ccttctttaaatcaaaagctg

SEQ ID NO: 2811092 - DNA, 16 bp, Homo sapiens
ccttctttttcttctt

SEQ ID NO: 2811093 - DNA, 17 bp, Homo sapiens
ccttcttttttgtctca

SEQ ID NO: 2811094 - DNA, 19 bp, Homo sapiens
ccttgaagccactgaagct

SEQ ID NO: 2811095 - DNA, 22 bp, Homo sapiens
ccttgaagccactgaagctggg

SEQ ID NO: 2811096 - DNA, 17 bp, Homo sapiens
ccttgacagggcacacc

SEQ ID NO: 2811097 - DNA, 23 bp, Homo sapiens
ccttgacattgtagagcttctgg

SEQ ID NO: 2811098 - DNA, 20 bp, Homo sapiens
ccttgacgtcaagtctcctt

SEQ ID NO: 2811099 - DNA, 21 bp, Homo sapiens
ccttgattttagccttctctg

SEQ ID NO: 2811100 - DNA, 21 bp, Homo sapiens
ccttgcacagcccacacatga

SEQ ID NO: 2811101 - DNA, 13 bp, Homo sapiens
ccttgcacctgca

SEQ ID NO: 2811102 - DNA, 11 bp, Homo sapiens
ccttgcccaga

SEQ ID NO: 2811103 - DNA, 13 bp, Homo sapiens
ccttgcccagaga

SEQ ID NO: 2811104 - DNA, 15 bp, Homo sapiens
ccttgcccagggctc

SEQ ID NO: 2811105 - DNA, 16 bp, Homo sapiens
ccttgcccagggctca

SEQ ID NO: 2811106 - DNA, 19 bp, Homo sapiens
ccttgcccggattctggga

SEQ ID NO: 2811107 - DNA, 14 bp, Homo sapiens
ccttgccctgacct

SEQ ID NO: 2811108 - DNA, 15 bp, Homo sapiens
ccttgccctgacctc

SEQ ID NO: 2811109 - DNA, 18 bp, Homo sapiens
ccttgccttttaaaagaa

SEQ ID NO: 2811110 - DNA, 19 bp, Homo sapiens
ccttgccttttaaaagaaa

SEQ ID NO: 2811111 - DNA, 17 bp, Homo sapiens
ccttgcgaccatgtgta

SEQ ID NO: 2811112 - DNA, 20 bp, Homo sapiens
ccttgctctcccctgccctg

SEQ ID NO: 2811113 - DNA, 18 bp, Homo sapiens
ccttgcttatgacatcac

SEQ ID NO: 2811114 - DNA, 13 bp, Homo sapiens
ccttggaggacag

SEQ ID NO: 2811115 - DNA, 15 bp, Homo sapiens
ccttggaggacagtg

SEQ ID NO: 2811116 - DNA, 17 bp, Homo sapiens
ccttggaggagggctgt

SEQ ID NO: 2811117 - DNA, 18 bp, Homo sapiens
ccttggatgtagtctgag

SEQ ID NO: 2811118 - DNA, 15 bp, Homo sapiens
ccttggcgggcagcc

SEQ ID NO: 2811119 - DNA, 13 bp, Homo sapiens
ccttgggcctccc

SEQ ID NO: 2811120 - DNA, 22 bp, Homo sapiens
ccttgggcctccccccagcccc

SEQ ID NO: 2811121 - DNA, 22 bp, Homo sapiens
ccttggggattcttccatctga

SEQ ID NO: 2811122 - DNA, 15 bp, Homo sapiens
ccttggtgtccacct

SEQ ID NO: 2811123 - DNA, 16 bp, Homo sapiens
ccttgtaattctaaat

SEQ ID NO: 2811124 - DNA, 15 bp, Homo sapiens
cgtgacaacacttgt

SEQ ID NO: 2811125 - DNA, 14 bp, Homo sapiens
cgtgactcacccaa

SEQ ID NO: 2811126 - DNA, 16 bp, Homo sapiens
cgtgactcacccaagc

SEQ ID NO: 2811127 - DNA, 21 bp, Homo sapiens
cgtgactgccccaactcctgg

SEQ ID NO: 2811128 - DNA, 13 bp, Homo sapiens
cgtgagccaggta

SEQ ID NO: 2811129 - DNA, 14 bp, Homo sapiens
cgtgcacacaccag

SEQ ID NO: 2811130 - DNA, 15 bp, Homo sapiens
cgtgccaagtccagg

SEQ ID NO: 2811131 - DNA, 23 bp, Homo sapiens
cgtgccaagtccaggtcctggtg

SEQ ID NO: 2811132 - DNA, 19 bp, Homo sapiens
cgtgccaggcccggggctg

SEQ ID NO: 2811133 - DNA, 16 bp, Homo sapiens
cgtgccagtgtcccca

SEQ ID NO: 2811134 - DNA, 14 bp, Homo sapiens
cgtgctaaattttc

SEQ ID NO: 2811135 - DNA, 20 bp, Homo sapiens
cgtgctcttctgttctcaaa

SEQ ID NO: 2811136 - DNA, 15 bp, Homo sapiens
cgtggagagctagga

SEQ ID NO: 2811137 - DNA, 16 bp, Homo sapiens
cgtggcccttcctgga

SEQ ID NO: 2811138 - DNA, 17 bp, Homo sapiens
cgtggcccttcctggac

SEQ ID NO: 2811139 - DNA, 18 bp, Homo sapiens
cgtggcccttcctggaca

SEQ ID NO: 2811140 - DNA, 20 bp, Homo sapiens
cgtggccttgttctgtcacc

SEQ ID NO: 2811141 - DNA, 13 bp, Homo sapiens
cgtggtccagctc

SEQ ID NO: 2811142 - DNA, 14 bp, Homo sapiens
cgtggtccagctct

SEQ ID NO: 2811143 - DNA, 15 bp, Homo sapiens
cgtggtccagctctt

SEQ ID NO: 2811144 - DNA, 12 bp, Homo sapiens
cgtggtctttga

SEQ ID NO: 2811145 - DNA, 17 bp, Homo sapiens
cgtggtctttgaataaa

SEQ ID NO: 2811146 - DNA, 21 bp, Homo sapiens
cgtggtctttgaataaagtct

SEQ ID NO: 2811147 - DNA, 14 bp, Homo sapiens
cgtgtccagcacag

SEQ ID NO: 2811148 - DNA, 15 bp, Homo sapiens
cgtgtccagcacaga

SEQ ID NO: 2811149 - DNA, 16 bp, Homo sapiens
cgtgtccagcacagaa

SEQ ID NO: 2811150 - DNA, 19 bp, Homo sapiens
cgtgtgcagactgtggctg

SEQ ID NO: 2811151 - DNA, 13 bp, Homo sapiens
cgtgtttacaaaa

SEQ ID NO: 2811152 - DNA, 14 bp, Homo sapiens
cgtgtttacaaaag

SEQ ID NO: 2811153 - DNA, 19 bp, Homo sapiens
cgtgtttacaaaaggcagc

SEQ ID NO: 2811154 - DNA, 20 bp, Homo sapiens
cgttaagggaaggaactctg

SEQ ID NO: 2811155 - DNA, 17 bp, Homo sapiens
cgttagaggagcaacag

SEQ ID NO: 2811156 - DNA, 23 bp, Homo sapiens
cgttcgaggcggtttccaggaag

SEQ ID NO: 2811157 - DNA, 15 bp, Homo sapiens
cgttctgctgcccct

SEQ ID NO: 2811158 - DNA, 16 bp, Homo sapiens
cgttctgctgcccctg

SEQ ID NO: 2811159 - DNA, 19 bp, Homo sapiens
cgttctgctgcccctgcag

SEQ ID NO: 2811160 - DNA, 17 bp, Homo sapiens
cgttctgctggcctgga

SEQ ID NO: 2811161 - DNA, 18 bp, Homo sapiens
cgttctgctggcctggat

SEQ ID NO: 2811162 - DNA, 22 bp, Homo sapiens
cgtttaagccaaaacaatgttt

SEQ ID NO: 2811163 - DNA, 18 bp, Homo sapiens
cgtttattaatgcctctc

SEQ ID NO: 2811164 - DNA, 18 bp, Homo sapiens
cgtttattgcttaatccc

SEQ ID NO: 2811165 - DNA, 20 bp, Homo sapiens
cgtttcctgagaagtgtcta

SEQ ID NO: 2811166 - DNA, 13 bp, Homo sapiens
cgtttttcaagaa

SEQ ID NO: 2811167 - DNA, 18 bp, Homo sapiens
ctaaaaataaaatgatgt

SEQ ID NO: 2811168 - DNA, 13 bp, Homo sapiens
ctaaaaatgcaac

SEQ ID NO: 2811169 - DNA, 19 bp, Homo sapiens
ctaaaacaaaacaaaaaac

SEQ ID NO: 2811170 - DNA, 10 bp, Homo sapiens
ctaaaagaat

SEQ ID NO: 2811171 - DNA, 15 bp, Homo sapiens
ctaaaagaatttaaa

SEQ ID NO: 2811172 - DNA, 13 bp, Homo sapiens
ctaaaagtaaaca

SEQ ID NO: 2811173 - DNA, 14 bp, Homo sapiens
ctaaaagtaaacat

SEQ ID NO: 2811174 - DNA, 15 bp, Homo sapiens
ctaaaagtaaacatt

SEQ ID NO: 2811175 - DNA, 13 bp, Homo sapiens
ctaaaataaaaac

SEQ ID NO: 2811176 - DNA, 18 bp, Homo sapiens
ctaaaataaaaaccagaa

SEQ ID NO: 2811177 - DNA, 14 bp, Homo sapiens
ctaaaatatttatt

SEQ ID NO: 2811178 - DNA, 23 bp, Homo sapiens
ctaaaatatttattttttttaag

SEQ ID NO: 2811179 - DNA, 12 bp, Homo sapiens
ctaaacagatat

SEQ ID NO: 2811180 - DNA, 17 bp, Homo sapiens
ctaaacagatataaatg

SEQ ID NO: 2811181 - DNA, 23 bp, Homo sapiens
ctaaacatcattcatttttgttg

SEQ ID NO: 2811182 - DNA, 15 bp, Homo sapiens
ctaaacccaaataaa

SEQ ID NO: 2811183 - DNA, 20 bp, Homo sapiens
ctaaacgagtcaatcccctc

SEQ ID NO: 2811184 - DNA, 13 bp, Homo sapiens
ctaaagaaaaaca

SEQ ID NO: 2811185 - DNA, 14 bp, Homo sapiens
ctaaagcagtgttt

SEQ ID NO: 2811186 - DNA, 17 bp, Homo sapiens
ctaaagcccaacctcct

SEQ ID NO: 2811187 - DNA, 19 bp, Homo sapiens
ctaaatcttccttgtgagg

SEQ ID NO: 2811188 - DNA, 13 bp, Homo sapiens
ctaaatgaagtgc

SEQ ID NO: 2811189 - DNA, 14 bp, Homo sapiens
ctaaatgaatgttt

SEQ ID NO: 2811190 - DNA, 20 bp, Homo sapiens
ctaaatgcaaacactgtgta

SEQ ID NO: 2811191 - DNA, 18 bp, Homo sapiens
ctaaatggtcgcccagga

SEQ ID NO: 2811192 - DNA, 21 bp, Homo sapiens
ctaaatggtcgcccaggagac

SEQ ID NO: 2811193 - DNA, 22 bp, Homo sapiens
ctaaatgtggacatcatgaagc

SEQ ID NO: 2811194 - DNA, 19 bp, Homo sapiens
ctaaattacaattgtcatt

SEQ ID NO: 2811195 - DNA, 14 bp, Homo sapiens
ctaacacccagtct

SEQ ID NO: 2811196 - DNA, 15 bp, Homo sapiens
ctaacagggaaggca

SEQ ID NO: 2811197 - DNA, 21 bp, Homo sapiens
ctaacagggaaggcaggcagg

SEQ ID NO: 2811198 - DNA, 23 bp, Homo sapiens
ctaacatataatgttgttattta

SEQ ID NO: 2811199 - DNA, 14 bp, Homo sapiens
ctaaccacgctgga

SEQ ID NO: 2811200 - DNA, 16 bp, Homo sapiens
ctaacccccagtgcca

SEQ ID NO: 2811201 - DNA, 21 bp, Homo sapiens
ctaacccccagtgccacagag

SEQ ID NO: 2811202 - DNA, 13 bp, Homo sapiens
ctaacccctttcc

SEQ ID NO: 2811203 - DNA, 12 bp, Homo sapiens
ctaacgcctgag

SEQ ID NO: 2811204 - DNA, 13 bp, Homo sapiens
ctaacgcctgagc

SEQ ID NO: 2811205 - DNA, 13 bp, Homo sapiens
ctaagagaagtag

SEQ ID NO: 2811206 - DNA, 15 bp, Homo sapiens
ctaagagaagtagaa

SEQ ID NO: 2811207 - DNA, 19 bp, Homo sapiens
ctaagagaagtagaaatca

SEQ ID NO: 2811208 - DNA, 16 bp, Homo sapiens
ctaagagctagcgctg

SEQ ID NO: 2811209 - DNA, 14 bp, Homo sapiens
ctaagattgtacat

SEQ ID NO: 2811210 - DNA, 16 bp, Homo sapiens
ctaagcaacagaaata

SEQ ID NO: 2811211 - DNA, 20 bp, Homo sapiens
ctaagccactcttccaaagg

SEQ ID NO: 2811212 - DNA, 12 bp, Homo sapiens
ctaagccctgtc

SEQ ID NO: 2811213 - DNA, 12 bp, Homo sapiens
ctaagctgcagc

SEQ ID NO: 2811214 - DNA, 14 bp, Homo sapiens
ctaagctgcagctt

SEQ ID NO: 2811215 - DNA, 16 bp, Homo sapiens
ctaagctgcagcttcc

SEQ ID NO: 2811216 - DNA, 16 bp, Homo sapiens
ctatcacatacaattt

SEQ ID NO: 2811217 - DNA, 17 bp, Homo sapiens
ctatcacatacaatttg

SEQ ID NO: 2811218 - DNA, 19 bp, Homo sapiens
ctatccacccagcccattc

SEQ ID NO: 2811219 - DNA, 12 bp, Homo sapiens
ctatccatcctg

SEQ ID NO: 2811220 - DNA, 16 bp, Homo sapiens
ctatctatataatgta

SEQ ID NO: 2811221 - DNA, 13 bp, Homo sapiens
ctatctatttgag

SEQ ID NO: 2811222 - DNA, 14 bp, Homo sapiens
ctatctatttgagg

SEQ ID NO: 2811223 - DNA, 17 bp, Homo sapiens
ctatctctgtgtgcaca

SEQ ID NO: 2811224 - DNA, 17 bp, Homo sapiens
ctatctgcatttataaa

SEQ ID NO: 2811225 - DNA, 21 bp, Homo sapiens
ctatgaaaagctagaattgag

SEQ ID NO: 2811226 - DNA, 13 bp, Homo sapiens
ctatgaactacaa

SEQ ID NO: 2811227 - DNA, 14 bp, Homo sapiens
ctatgacactgagc

SEQ ID NO: 2811228 - DNA, 16 bp, Homo sapiens
ctatgatctcaggagc

SEQ ID NO: 2811229 - DNA, 15 bp, Homo sapiens
ctatgattttctatt

SEQ ID NO: 2811230 - DNA, 14 bp, Homo sapiens
ctatgcaattttta

SEQ ID NO: 2811231 - DNA, 21 bp, Homo sapiens
ctatgcaatttttaaactagt

SEQ ID NO: 2811232 - DNA, 21 bp, Homo sapiens
ctatgcacatatggactctgc

SEQ ID NO: 2811233 - DNA, 19 bp, Homo sapiens
ctatgccagctcagtccca

SEQ ID NO: 2811234 - DNA, 15 bp, Homo sapiens
ctatggagagccctg

SEQ ID NO: 2811235 - DNA, 17 bp, Homo sapiens
ctatggagagccctggg

SEQ ID NO: 2811236 - DNA, 18 bp, Homo sapiens
ctatggagagccctggga

SEQ ID NO: 2811237 - DNA, 19 bp, Homo sapiens
ctatggagagccctgggac

SEQ ID NO: 2811238 - DNA, 20 bp, Homo sapiens
ctatggcagtccagccagct

SEQ ID NO: 2811239 - DNA, 22 bp, Homo sapiens
ctatggcagtccagccagctcc

SEQ ID NO: 2811240 - DNA, 23 bp, Homo sapiens
ctatggcagtccagccagctcct

SEQ ID NO: 2811241 - DNA, 16 bp, Homo sapiens
ctatggctgtattttt

SEQ ID NO: 2811242 - DNA, 18 bp, Homo sapiens
ctatgggactcaatgcac

SEQ ID NO: 2811243 - DNA, 22 bp, Homo sapiens
ctatgggactcaatgcactgac

SEQ ID NO: 2811244 - DNA, 12 bp, Homo sapiens
ctatggtcatct

SEQ ID NO: 2811245 - DNA, 23 bp, Homo sapiens
ctatggttcccaataaaagtgac

SEQ ID NO: 2811246 - DNA, 22 bp, Homo sapiens
ctatgtatggaatacagtgtta

SEQ ID NO: 2811247 - DNA, 17 bp, Homo sapiens
ctatgtcaatttgtata

SEQ ID NO: 2811248 - DNA, 19 bp, Homo sapiens
ctatgtcaatttgtatatc

SEQ ID NO: 2811249 - DNA, 16 bp, Homo sapiens
ctatgtcatttcattt

SEQ ID NO: 2811250 - DNA, 16 bp, Homo sapiens
ctatgtcccttgctgt

SEQ ID NO: 2811251 - DNA, 21 bp, Homo sapiens
ctatgtcctaaggacacacta

SEQ ID NO: 2811252 - DNA, 22 bp, Homo sapiens
ctatgtgtagggcgggaggatg

SEQ ID NO: 2811253 - DNA, 16 bp, Homo sapiens
ctatgtttttaatgta

SEQ ID NO: 2811254 - DNA, 15 bp, Homo sapiens
ctattagatgtttta

SEQ ID NO: 2811255 - DNA, 14 bp, Homo sapiens
ctattagcaactgt

SEQ ID NO: 2811256 - DNA, 14 bp, Homo sapiens
ctattataaaacca

SEQ ID NO: 2811257 - DNA, 17 bp, Homo sapiens
ctattataatttaatgc

SEQ ID NO: 2811258 - DNA, 16 bp, Homo sapiens
ctattatccccatttc

SEQ ID NO: 2811259 - DNA, 17 bp, Homo sapiens
ctattcagacaagcaac

SEQ ID NO: 2811260 - DNA, 14 bp, Homo sapiens
ctattcctaggagg

SEQ ID NO: 2811261 - DNA, 15 bp, Homo sapiens
ctattctcaccagga

SEQ ID NO: 2811262 - DNA, 16 bp, Homo sapiens
ctattctctcctcaga

SEQ ID NO: 2811263 - DNA, 20 bp, Homo sapiens
ctattgaaaaggttaacaga

SEQ ID NO: 2811264 - DNA, 16 bp, Homo sapiens
ctattgacaagtcatt

SEQ ID NO: 2811265 - DNA, 12 bp, Homo sapiens
ctattgatgttt

SEQ ID NO: 2811266 - DNA, 18 bp, Homo sapiens
ctattgatgtttccagaa

SEQ ID NO: 2811267 - DNA, 21 bp, Homo sapiens
ctattgatgtttccagaaaat

SEQ ID NO: 2811268 - DNA, 18 bp, Homo sapiens
ctattgcatgtaaaatgc

SEQ ID NO: 2811269 - DNA, 21 bp, Homo sapiens
ctattgcatgtaaaatgcagt

SEQ ID NO: 2811270 - DNA, 15 bp, Homo sapiens
ctatttaaaaaagag

SEQ ID NO: 2811271 - DNA, 13 bp, Homo sapiens
ctatttaaaaaat

SEQ ID NO: 2811272 - DNA, 21 bp, Homo sapiens
ctatttataaactagatctcc

SEQ ID NO: 2811273 - DNA, 14 bp, Homo sapiens
ctatttatttactg

SEQ ID NO: 2811274 - DNA, 12 bp, Homo sapiens
ctatttctctct

SEQ ID NO: 2811275 - DNA, 15 bp, Homo sapiens
ctatttctctctttc

SEQ ID NO: 2811276 - DNA, 15 bp, Homo sapiens
ctattttaaaaccat

SEQ ID NO: 2811277 - DNA, 12 bp, Homo sapiens
ctatttttgtag

SEQ ID NO: 2811278 - DNA, 13 bp, Homo sapiens
ctatttttgtaga

SEQ ID NO: 2811279 - DNA, 21 bp, Homo sapiens
ctcaaaaaaagggcaataaat

SEQ ID NO: 2811280 - DNA, 12 bp, Homo sapiens
ctcaaaaagttt

SEQ ID NO: 2811281 - DNA, 20 bp, Homo sapiens
ctcaaaagcacccttgacgt

SEQ ID NO: 2811282 - DNA, 13 bp, Homo sapiens
ctcaaaatatttg

SEQ ID NO: 2811283 - DNA, 23 bp, Homo sapiens
ctcaaattaatctttctttacct

SEQ ID NO: 2811284 - DNA, 17 bp, Homo sapiens
ctcaaccaacctccccg

SEQ ID NO: 2811285 - DNA, 12 bp, Homo sapiens
ctcaaccactgt

SEQ ID NO: 2811286 - DNA, 14 bp, Homo sapiens
ctcaaccactgtgg

SEQ ID NO: 2811287 - DNA, 19 bp, Homo sapiens
ctcaacccccatttctatt

SEQ ID NO: 2811288 - DNA, 22 bp, Homo sapiens
ctcaacccccatttctatttat

SEQ ID NO: 2811289 - DNA, 15 bp, Homo sapiens
ctcaacctctctcct

SEQ ID NO: 2811290 - DNA, 20 bp, Homo sapiens
ctcaagattatattataata

SEQ ID NO: 2811291 - DNA, 14 bp, Homo sapiens
ctcaagtcctcttt

SEQ ID NO: 2811292 - DNA, 16 bp, Homo sapiens
ctcaagtcttccctga

SEQ ID NO: 2811293 - DNA, 17 bp, Homo sapiens
ctcaagtgattctcctg

SEQ ID NO: 2811294 - DNA, 14 bp, Homo sapiens
ctcaagtttttaca

SEQ ID NO: 2811295 - DNA, 20 bp, Homo sapiens
ctcaagtttttcagaaagca

SEQ ID NO: 2811296 - DNA, 23 bp, Homo sapiens
ctcaataaaatcatgtacatttc

SEQ ID NO: 2811297 - DNA, 16 bp, Homo sapiens
ctcaatattcaataaa

SEQ ID NO: 2811298 - DNA, 11 bp, Homo sapiens
ctcaatatttt

SEQ ID NO: 2811299 - DNA, 18 bp, Homo sapiens
ctcaatcccagctactca

SEQ ID NO: 2811300 - DNA, 18 bp, Homo sapiens
ctcaatgtgaccaggggt

SEQ ID NO: 2811301 - DNA, 16 bp, Homo sapiens
ctcaatttctgaacac

SEQ ID NO: 2811302 - DNA, 15 bp, Homo sapiens
ctcacaagaagacca

SEQ ID NO: 2811303 - DNA, 13 bp, Homo sapiens
ctcacaaggcagc

SEQ ID NO: 2811304 - DNA, 17 bp, Homo sapiens
ctcacaaggcagcaagg

SEQ ID NO: 2811305 - DNA, 19 bp, Homo sapiens
ctcacaaggcagcaaggcc

SEQ ID NO: 2811306 - DNA, 20 bp, Homo sapiens
ctcacaaggcagcaaggccc

SEQ ID NO: 2811307 - DNA, 21 bp, Homo sapiens
ctcccagccctatggatgtgg

SEQ ID NO: 2811308 - DNA, 11 bp, Homo sapiens
ctcccagcctg

SEQ ID NO: 2811309 - DNA, 18 bp, Homo sapiens
ctcccaggaactgggcca

SEQ ID NO: 2811310 - DNA, 12 bp, Homo sapiens
ctcccaggcccc

SEQ ID NO: 2811311 - DNA, 22 bp, Homo sapiens
ctcccagggccagggccctgca

SEQ ID NO: 2811312 - DNA, 12 bp, Homo sapiens
ctccccaaaaac

SEQ ID NO: 2811313 - DNA, 15 bp, Homo sapiens
ctccccaccttcccc

SEQ ID NO: 2811314 - DNA, 13 bp, Homo sapiens
ctccccactctgc

SEQ ID NO: 2811315 - DNA, 20 bp, Homo sapiens
ctccccactctgctctgatg

SEQ ID NO: 2811316 - DNA, 21 bp, Homo sapiens
ctccccactctgctctgatgc

SEQ ID NO: 2811317 - DNA, 22 bp, Homo sapiens
ctccccactctgctctgatgca

SEQ ID NO: 2811318 - DNA, 23 bp, Homo sapiens
ctccccagcaagtgagagctggg

SEQ ID NO: 2811319 - DNA, 17 bp, Homo sapiens
ctccccaggccaggcca

SEQ ID NO: 2811320 - DNA, 16 bp, Homo sapiens
ctccccattcacagag

SEQ ID NO: 2811321 - DNA, 18 bp, Homo sapiens
ctccccattcacagagcc

SEQ ID NO: 2811322 - DNA, 19 bp, Homo sapiens
ctccccattcacagagcct

SEQ ID NO: 2811323 - DNA, 17 bp, Homo sapiens
ctccccattcagacact

SEQ ID NO: 2811324 - DNA, 13 bp, Homo sapiens
ctccccccactgc

SEQ ID NO: 2811325 - DNA, 16 bp, Homo sapiens
ctccccccagcccctc

SEQ ID NO: 2811326 - DNA, 21 bp, Homo sapiens
ctccccccagcccctcctccc

SEQ ID NO: 2811327 - DNA, 13 bp, Homo sapiens
ctcccctcccccc

SEQ ID NO: 2811328 - DNA, 15 bp, Homo sapiens
ctcccctcccccctg

SEQ ID NO: 2811329 - DNA, 18 bp, Homo sapiens
ctcccctcccccctgtaa

SEQ ID NO: 2811330 - DNA, 19 bp, Homo sapiens
ctcccctccctcttccttc

SEQ ID NO: 2811331 - DNA, 14 bp, Homo sapiens
ctcccctgccctgc

SEQ ID NO: 2811332 - DNA, 22 bp, Homo sapiens
ctcccctggaactgtctctcat

SEQ ID NO: 2811333 - DNA, 14 bp, Homo sapiens
ctccccttcctgca

SEQ ID NO: 2811334 - DNA, 20 bp, Homo sapiens
ctccccttcctgcacccgta

SEQ ID NO: 2811335 - DNA, 16 bp, Homo sapiens
ctcccgaatagctggg

SEQ ID NO: 2811336 - DNA, 17 bp, Homo sapiens
ctcccgagtagctggga

SEQ ID NO: 2811337 - DNA, 18 bp, Homo sapiens
ctcccgagtagctgggac

SEQ ID NO: 2811338 - DNA, 20 bp, Homo sapiens
ctcccgagtagctgggacta

SEQ ID NO: 2811339 - DNA, 14 bp, Homo sapiens
ctcccgcaccaggc

SEQ ID NO: 2811340 - DNA, 14 bp, Homo sapiens
ctccctaaaataaa

SEQ ID NO: 2811341 - DNA, 15 bp, Homo sapiens
ctccctaaaataaaa

SEQ ID NO: 2811342 - DNA, 20 bp, Homo sapiens
ctccctaaaataaaaaccag

SEQ ID NO: 2811343 - DNA, 17 bp, Homo sapiens
ctccctagtggcttcct

SEQ ID NO: 2811344 - DNA, 22 bp, Homo sapiens
ctccctagtggcttcctccgtc

SEQ ID NO: 2811345 - DNA, 13 bp, Homo sapiens
ctccctcattcca

SEQ ID NO: 2811346 - DNA, 12 bp, Homo sapiens
ctccctccaccc

SEQ ID NO: 2811347 - DNA, 13 bp, Homo sapiens
ctccctccacccc

SEQ ID NO: 2811348 - DNA, 14 bp, Homo sapiens
ctccctccacccca

SEQ ID NO: 2811349 - DNA, 17 bp, Homo sapiens
ctccctccaccccagga

SEQ ID NO: 2811350 - DNA, 13 bp, Homo sapiens
ctccctctcctgc

SEQ ID NO: 2811351 - DNA, 14 bp, Homo sapiens
ctccctctgacctg

SEQ ID NO: 2811352 - DNA, 17 bp, Homo sapiens
ctccctctgacctgcag

SEQ ID NO: 2811353 - DNA, 18 bp, Homo sapiens
ctccctctgacctgcagg

SEQ ID NO: 2811354 - DNA, 14 bp, Homo sapiens
ctccctctggccct

SEQ ID NO: 2811355 - DNA, 18 bp, Homo sapiens
ctccctctggccctgcct

SEQ ID NO: 2811356 - DNA, 17 bp, Homo sapiens
ctccctcttccttcccc

SEQ ID NO: 2811357 - DNA, 15 bp, Homo sapiens
ctccctgccctgtcc

SEQ ID NO: 2811358 - DNA, 21 bp, Homo sapiens
ctccctgccctgtcctccagc

SEQ ID NO: 2811359 - DNA, 12 bp, Homo sapiens
ctccctggcctc

SEQ ID NO: 2811360 - DNA, 13 bp, Homo sapiens
ctccctgtcctcc

SEQ ID NO: 2811361 - DNA, 15 bp, Homo sapiens
ctccctgtcctcctc

SEQ ID NO: 2811362 - DNA, 21 bp, Homo sapiens
ctccgccttcactccggtgtg

SEQ ID NO: 2811363 - DNA, 22 bp, Homo sapiens
ctccggcctgatgacagagcga

SEQ ID NO: 2811364 - DNA, 19 bp, Homo sapiens
ctccgtccaggagcctggc

SEQ ID NO: 2811365 - DNA, 15 bp, Homo sapiens
ctcctaaacaaaaac

SEQ ID NO: 2811366 - DNA, 13 bp, Homo sapiens
ctcctacctcagc

SEQ ID NO: 2811367 - DNA, 20 bp, Homo sapiens
ctcctagggaaaagttcata

SEQ ID NO: 2811368 - DNA, 22 bp, Homo sapiens
ctcctatcagaagtttctcagc

SEQ ID NO: 2811369 - DNA, 13 bp, Homo sapiens
ctcctattttaat

SEQ ID NO: 2811370 - DNA, 17 bp, Homo sapiens
ctcctcacccccagctt

SEQ ID NO: 2811371 - DNA, 21 bp, Homo sapiens
ctcctcacccccagctttgct

SEQ ID NO: 2811372 - DNA, 15 bp, Homo sapiens
ctcctcactgcccca

SEQ ID NO: 2811373 - DNA, 21 bp, Homo sapiens
ctcctccaggcacgtcccgga

SEQ ID NO: 2811374 - DNA, 14 bp, Homo sapiens
ctcctccagggcca

SEQ ID NO: 2811375 - DNA, 20 bp, Homo sapiens
ctcctccagggccacgtgcc

SEQ ID NO: 2811376 - DNA, 14 bp, Homo sapiens
ctcctcccacaatc

SEQ ID NO: 2811377 - DNA, 20 bp, Homo sapiens
ctcctcccacaatctgggac

SEQ ID NO: 2811378 - DNA, 14 bp, Homo sapiens
ctcctcccaccacc

SEQ ID NO: 2811379 - DNA, 16 bp, Homo sapiens
ctcctcccaccaccct

SEQ ID NO: 2811380 - DNA, 12 bp, Homo sapiens
ctcctcccagga

SEQ ID NO: 2811381 - DNA, 13 bp, Homo sapiens
ctcctcccattcc

SEQ ID NO: 2811382 - DNA, 16 bp, Homo sapiens
ctcctcccccaccttc

SEQ ID NO: 2811383 - DNA, 14 bp, Homo sapiens
ctcctccccttcct

SEQ ID NO: 2811384 - DNA, 14 bp, Homo sapiens
ctcctcctccccca

SEQ ID NO: 2811385 - DNA, 18 bp, Homo sapiens
ctcctcggccccctccat

SEQ ID NO: 2811386 - DNA, 20 bp, Homo sapiens
ctcctcggccccctccatcg

SEQ ID NO: 2811387 - DNA, 13 bp, Homo sapiens
ctcctctaagcca

SEQ ID NO: 2811388 - DNA, 13 bp, Homo sapiens
ctcctctccaggc

SEQ ID NO: 2811389 - DNA, 15 bp, Homo sapiens
ctcctctccaggcac

SEQ ID NO: 2811390 - DNA, 15 bp, Homo sapiens
ctcctctccccagca

SEQ ID NO: 2811391 - DNA, 22 bp, Homo sapiens
ctcctctccccagcaagtgaga

SEQ ID NO: 2811392 - DNA, 15 bp, Homo sapiens
ctcctctccctgcac

SEQ ID NO: 2811393 - DNA, 11 bp, Homo sapiens
ctcctctctga

SEQ ID NO: 2811394 - DNA, 14 bp, Homo sapiens
ctcctctctgagac

SEQ ID NO: 2811395 - DNA, 11 bp, Homo sapiens
ctcctctgcca

SEQ ID NO: 2811396 - DNA, 12 bp, Homo sapiens
ctcctctgccac

SEQ ID NO: 2811397 - DNA, 17 bp, Homo sapiens
ctcctctgccacctccc

SEQ ID NO: 2811398 - DNA, 18 bp, Homo sapiens
ctcctctgtccagggccc

SEQ ID NO: 2811399 - DNA, 19 bp, Homo sapiens
ctctaagccactcttccaa

SEQ ID NO: 2811400 - DNA, 20 bp, Homo sapiens
ctctaattcccattttgcaa

SEQ ID NO: 2811401 - DNA, 17 bp, Homo sapiens
ctctaattggaagaaat

SEQ ID NO: 2811402 - DNA, 22 bp, Homo sapiens
ctctaattggaagaaattcctg

SEQ ID NO: 2811403 - DNA, 14 bp, Homo sapiens
ctctacagaggcca

SEQ ID NO: 2811404 - DNA, 16 bp, Homo sapiens
ctctacagaggccatg

SEQ ID NO: 2811405 - DNA, 17 bp, Homo sapiens
ctctacccggcccagag

SEQ ID NO: 2811406 - DNA, 18 bp, Homo sapiens
ctctacccggcccagaga

SEQ ID NO: 2811407 - DNA, 13 bp, Homo sapiens
ctctactgggaag

SEQ ID NO: 2811408 - DNA, 19 bp, Homo sapiens
ctctactgggaaggctact

SEQ ID NO: 2811409 - DNA, 18 bp, Homo sapiens
ctctagaacatgcacatt

SEQ ID NO: 2811410 - DNA, 23 bp, Homo sapiens
ctctagaacatgcacatttatat

SEQ ID NO: 2811411 - DNA, 20 bp, Homo sapiens
ctctagaattttaagtgctt

SEQ ID NO: 2811412 - DNA, 20 bp, Homo sapiens
ctctagcctggcaacagagc

SEQ ID NO: 2811413 - DNA, 18 bp, Homo sapiens
ctctagtgccctccacag

SEQ ID NO: 2811414 - DNA, 20 bp, Homo sapiens
ctctattgtagcatttcttg

SEQ ID NO: 2811415 - DNA, 11 bp, Homo sapiens
ctctcagccaa

SEQ ID NO: 2811416 - DNA, 14 bp, Homo sapiens
ctctcagcctccca

SEQ ID NO: 2811417 - DNA, 19 bp, Homo sapiens
ctctcagcctcccaacccc

SEQ ID NO: 2811418 - DNA, 15 bp, Homo sapiens
ctctcaggagcacag

SEQ ID NO: 2811419 - DNA, 14 bp, Homo sapiens
ctctcattccccag

SEQ ID NO: 2811420 - DNA, 13 bp, Homo sapiens
ctctccaacctgg

SEQ ID NO: 2811421 - DNA, 14 bp, Homo sapiens
ctctccaattgtaa

SEQ ID NO: 2811422 - DNA, 17 bp, Homo sapiens
ctctccacctcagcctt

SEQ ID NO: 2811423 - DNA, 19 bp, Homo sapiens
ctctccactgctctcagcc

SEQ ID NO: 2811424 - DNA, 21 bp, Homo sapiens
ctctccagccttctctctctg

SEQ ID NO: 2811425 - DNA, 22 bp, Homo sapiens
ctctccagccttctctctctgg

SEQ ID NO: 2811426 - DNA, 21 bp, Homo sapiens
ctctccaggaaggtagcccag

SEQ ID NO: 2811427 - DNA, 19 bp, Homo sapiens
ctctccaggcacccttctt

SEQ ID NO: 2811428 - DNA, 16 bp, Homo sapiens
ctctccaggctgtttc

SEQ ID NO: 2811429 - DNA, 24 bp, Homo sapiens
ctctcccaggccccatgacctcca

SEQ ID NO: 2811430 - DNA, 14 bp, Homo sapiens
ctctccccagcaag

SEQ ID NO: 2811431 - DNA, 22 bp, Homo sapiens
ctctccccagcaagtgagagct

SEQ ID NO: 2811432 - DNA, 12 bp, Homo sapiens
ctctcccctccc

SEQ ID NO: 2811433 - DNA, 15 bp, Homo sapiens
ctctcccctccctct

SEQ ID NO: 2811434 - DNA, 19 bp, Homo sapiens
ctctcccctccctcttcct

SEQ ID NO: 2811435 - DNA, 16 bp, Homo sapiens
ctctcccctgccctgc

SEQ ID NO: 2811436 - DNA, 17 bp, Homo sapiens
ctctcccgcaccaggcc

SEQ ID NO: 2811437 - DNA, 12 bp, Homo sapiens
ctctccctctgg

SEQ ID NO: 2811438 - DNA, 21 bp, Homo sapiens
ctctccctctggccctgcctt

SEQ ID NO: 2811439 - DNA, 20 bp, Homo sapiens
ctctcctaccccacctcatg

SEQ ID NO: 2811440 - DNA, 15 bp, Homo sapiens
ctctcctcttgccac

SEQ ID NO: 2811441 - DNA, 16 bp, Homo sapiens
ctctcctcttgccact

SEQ ID NO: 2811442 - DNA, 19 bp, Homo sapiens
ctctcctgcctacatccca

SEQ ID NO: 2811443 - DNA, 12 bp, Homo sapiens
ctctcctggctt

SEQ ID NO: 2811444 - DNA, 17 bp, Homo sapiens
ctctcctggcttcccat

SEQ ID NO: 2811445 - DNA, 20 bp, Homo sapiens
ctctcctgtataatctctct

SEQ ID NO: 2811446 - DNA, 14 bp, Homo sapiens
ctctccttgcctgg

SEQ ID NO: 2811447 - DNA, 16 bp, Homo sapiens
ctctccttgcctggtg

SEQ ID NO: 2811448 - DNA, 18 bp, Homo sapiens
ctctcggaaggctggctg

SEQ ID NO: 2811449 - DNA, 21 bp, Homo sapiens
ctctctaaaaataaaatgatg

SEQ ID NO: 2811450 - DNA, 20 bp, Homo sapiens
ctctctaaacccaaataaat

SEQ ID NO: 2811451 - DNA, 22 bp, Homo sapiens
ctctctaaatcttccttgtgag

SEQ ID NO: 2811452 - DNA, 18 bp, Homo sapiens
ctctctacccggcccaga

SEQ ID NO: 2811453 - DNA, 21 bp, Homo sapiens
ctctctacccggcccagagac

SEQ ID NO: 2811454 - DNA, 19 bp, Homo sapiens
ctctctactcctacctcag

SEQ ID NO: 2811455 - DNA, 15 bp, Homo sapiens
ctctctgagactgct

SEQ ID NO: 2811456 - DNA, 14 bp, Homo sapiens
ctctctgagggaga

SEQ ID NO: 2811457 - DNA, 16 bp, Homo sapiens
ctctctgcagccagcc

SEQ ID NO: 2811458 - DNA, 14 bp, Homo sapiens
ctctcttgcctttc

SEQ ID NO: 2811459 - DNA, 13 bp, Homo sapiens
ctctgaagtcaca

SEQ ID NO: 2811460 - DNA, 18 bp, Homo sapiens
ctctgacacacagctctg

SEQ ID NO: 2811461 - DNA, 15 bp, Homo sapiens
ctctgacctgcaggc

SEQ ID NO: 2811462 - DNA, 17 bp, Homo sapiens
ctctgactcttgccttt

SEQ ID NO: 2811463 - DNA, 21 bp, Homo sapiens
ctctgagaattccaaggagtt

SEQ ID NO: 2811464 - DNA, 13 bp, Homo sapiens
ctctgagaggccc

SEQ ID NO: 2811465 - DNA, 14 bp, Homo sapiens
ctctgagaggccct

SEQ ID NO: 2811466 - DNA, 14 bp, Homo sapiens
ctctgaggacacta

SEQ ID NO: 2811467 - DNA, 13 bp, Homo sapiens
ctctgaggccagc

SEQ ID NO: 2811468 - DNA, 14 bp, Homo sapiens
ctctgaggccagcc

SEQ ID NO: 2811469 - DNA, 15 bp, Homo sapiens
ctctgaggccagcct

SEQ ID NO: 2811470 - DNA, 18 bp, Homo sapiens
ctctgaggccagcctggc

SEQ ID NO: 2811471 - DNA, 20 bp, Homo sapiens
ctctgaggctctttctgggc

SEQ ID NO: 2811472 - DNA, 21 bp, Homo sapiens
ctctgaggcttccagagagtc

SEQ ID NO: 2811473 - DNA, 17 bp, Homo sapiens
ctctgagggagaggctg

SEQ ID NO: 2811474 - DNA, 22 bp, Homo sapiens
ctctgagggagaggctgtggtg

SEQ ID NO: 2811475 - DNA, 23 bp, Homo sapiens
ctctgatgagagagtgctgagaa

SEQ ID NO: 2811476 - DNA, 13 bp, Homo sapiens
ctctgcacatgtc

SEQ ID NO: 2811477 - DNA, 16 bp, Homo sapiens
ctctgcacatgtcttg

SEQ ID NO: 2811478 - DNA, 14 bp, Homo sapiens
ctctgcagccagcc

SEQ ID NO: 2811479 - DNA, 17 bp, Homo sapiens
ctctgcagccagcccag

SEQ ID NO: 2811480 - DNA, 18 bp, Homo sapiens
ctctgcagccagcccagc

SEQ ID NO: 2811481 - DNA, 13 bp, Homo sapiens
ctctgcatgtgtg

SEQ ID NO: 2811482 - DNA, 10 bp, Homo sapiens
ctctgccacc

SEQ ID NO: 2811483 - DNA, 17 bp, Homo sapiens
ctctgccccagctctgg

SEQ ID NO: 2811484 - DNA, 19 bp, Homo sapiens
ctctgccccagctctggct

SEQ ID NO: 2811485 - DNA, 14 bp, Homo sapiens
ctctgcctcctctt

SEQ ID NO: 2811486 - DNA, 14 bp, Homo sapiens
ctctgcctctgaca

SEQ ID NO: 2811487 - DNA, 16 bp, Homo sapiens
ctctgcctctgacaca

SEQ ID NO: 2811488 - DNA, 21 bp, Homo sapiens
ctctgcctgaagtcacacagt

SEQ ID NO: 2811489 - DNA, 13 bp, Homo sapiens
ctctgctcctctc

SEQ ID NO: 2811490 - DNA, 22 bp, Homo sapiens
ctctttcttattttgtaataaa

SEQ ID NO: 2811491 - DNA, 23 bp, Homo sapiens
ctctttcttattttgtaataaac

SEQ ID NO: 2811492 - DNA, 20 bp, Homo sapiens
ctctttctttcttttgtgtt

SEQ ID NO: 2811493 - DNA, 12 bp, Homo sapiens
ctctttgcctca

SEQ ID NO: 2811494 - DNA, 13 bp, Homo sapiens
ctctttgcctcaa

SEQ ID NO: 2811495 - DNA, 20 bp, Homo sapiens
ctctttgcctgtgtgagcat

SEQ ID NO: 2811496 - DNA, 17 bp, Homo sapiens
ctctttggggtcagcca

SEQ ID NO: 2811497 - DNA, 21 bp, Homo sapiens
ctctttgtcagtctgggtgtc

SEQ ID NO: 2811498 - DNA, 14 bp, Homo sapiens
ctgaaaacccagag

SEQ ID NO: 2811499 - DNA, 23 bp, Homo sapiens
ctgaaaactggaataagaagcaa

SEQ ID NO: 2811500 - DNA, 17 bp, Homo sapiens
ctgaaaattaacactgc

SEQ ID NO: 2811501 - DNA, 17 bp, Homo sapiens
ctgaaaattatttaaac

SEQ ID NO: 2811502 - DNA, 18 bp, Homo sapiens
ctgaaacacacaggccat

SEQ ID NO: 2811503 - DNA, 17 bp, Homo sapiens
ctgaaacacctcccagg

SEQ ID NO: 2811504 - DNA, 15 bp, Homo sapiens
ctgaaagaaacagtt

SEQ ID NO: 2811505 - DNA, 19 bp, Homo sapiens
ctgaaagaaacagttaact

SEQ ID NO: 2811506 - DNA, 12 bp, Homo sapiens
ctgaaagccacg

SEQ ID NO: 2811507 - DNA, 23 bp, Homo sapiens
ctgaaagccatttgttggggcag

SEQ ID NO: 2811508 - DNA, 19 bp, Homo sapiens
ctgaaatgaaacaaataat

SEQ ID NO: 2811509 - DNA, 14 bp, Homo sapiens
ctgaaatttcagat

SEQ ID NO: 2811510 - DNA, 14 bp, Homo sapiens
ctgaaccactttgc

SEQ ID NO: 2811511 - DNA, 18 bp, Homo sapiens
ctgaactcaagctgcgtt

SEQ ID NO: 2811512 - DNA, 19 bp, Homo sapiens
ctgaagactcattcttctg

SEQ ID NO: 2811513 - DNA, 21 bp, Homo sapiens
ctgaagactcattcttctgta

SEQ ID NO: 2811514 - DNA, 17 bp, Homo sapiens
ctgaagatttcagaggc

SEQ ID NO: 2811515 - DNA, 18 bp, Homo sapiens
ctgaagcccatgctttcc

SEQ ID NO: 2811516 - DNA, 19 bp, Homo sapiens
ctgaagcccatgctttccc

SEQ ID NO: 2811517 - DNA, 15 bp, Homo sapiens
ctgaagctattgatg

SEQ ID NO: 2811518 - DNA, 22 bp, Homo sapiens
ctgaaggaataaattgctcctt

SEQ ID NO: 2811519 - DNA, 15 bp, Homo sapiens
ctgaagtcacacagt

SEQ ID NO: 2811520 - DNA, 18 bp, Homo sapiens
ctgaagtcacacagtgag

SEQ ID NO: 2811521 - DNA, 19 bp, Homo sapiens
ctgaagtcacacagtgagt

SEQ ID NO: 2811522 - DNA, 21 bp, Homo sapiens
ctgaagtcacacagtgagtcg

SEQ ID NO: 2811523 - DNA, 20 bp, Homo sapiens
ctgaataacatttgtgtggt

SEQ ID NO: 2811524 - DNA, 17 bp, Homo sapiens
ctgaataccaagtgtgt

SEQ ID NO: 2811525 - DNA, 17 bp, Homo sapiens
ctgaatacccttttctg

SEQ ID NO: 2811526 - DNA, 15 bp, Homo sapiens
ctgaatattaatccc

SEQ ID NO: 2811527 - DNA, 19 bp, Homo sapiens
ctgaatccatcaggacttg

SEQ ID NO: 2811528 - DNA, 22 bp, Homo sapiens
ctgaatccatcaggacttggga

SEQ ID NO: 2811529 - DNA, 17 bp, Homo sapiens
ctgaatgaaatatcaga

SEQ ID NO: 2811530 - DNA, 22 bp, Homo sapiens
ctgaatgcctcaatgtgaccag

SEQ ID NO: 2811531 - DNA, 22 bp, Homo sapiens
ctgaatggaaggtttgtatatt

SEQ ID NO: 2811532 - DNA, 15 bp, Homo sapiens
ctgaatggtccaggg

SEQ ID NO: 2811533 - DNA, 22 bp, Homo sapiens
ctgaattattttgttgtgattt

SEQ ID NO: 2811534 - DNA, 16 bp, Homo sapiens
ctgaattgtccccagt

SEQ ID NO: 2811535 - DNA, 15 bp, Homo sapiens
ctgacacacagctct

SEQ ID NO: 2811536 - DNA, 16 bp, Homo sapiens
ctgacacacagctctg

SEQ ID NO: 2811537 - DNA, 17 bp, Homo sapiens
ctgacacacagctctgt

SEQ ID NO: 2811538 - DNA, 12 bp, Homo sapiens
ctgacacctcac

SEQ ID NO: 2811539 - DNA, 16 bp, Homo sapiens
ctgacagacacaggcc

SEQ ID NO: 2811540 - DNA, 18 bp, Homo sapiens
ctgacagatgtcagccga

SEQ ID NO: 2811541 - DNA, 15 bp, Homo sapiens
ctgacattctgattc

SEQ ID NO: 2811542 - DNA, 22 bp, Homo sapiens
ctgacattgttggccaaagcca

SEQ ID NO: 2811543 - DNA, 23 bp, Homo sapiens
ctgaccagcctccatgctgcctc

SEQ ID NO: 2811544 - DNA, 11 bp, Homo sapiens
ctgacccactg

SEQ ID NO: 2811545 - DNA, 16 bp, Homo sapiens
ctgacccagtccctgg

SEQ ID NO: 2811546 - DNA, 15 bp, Homo sapiens
ctgaccccatcacct

SEQ ID NO: 2811547 - DNA, 18 bp, Homo sapiens
ctgaccctccgctgcaga

SEQ ID NO: 2811548 - DNA, 22 bp, Homo sapiens
ctgaccctggagcggctctcct

SEQ ID NO: 2811549 - DNA, 11 bp, Homo sapiens
ctgacctccca

SEQ ID NO: 2811550 - DNA, 16 bp, Homo sapiens
ctgacctcccagccct

SEQ ID NO: 2811551 - DNA, 18 bp, Homo sapiens
ctgacctcccagccctat

SEQ ID NO: 2811552 - DNA, 21 bp, Homo sapiens
ctgacctttgtcatctttctt

SEQ ID NO: 2811553 - DNA, 16 bp, Homo sapiens
ctgactcacaagaaga

SEQ ID NO: 2811554 - DNA, 21 bp, Homo sapiens
ctgactcacaagaagaccaga

SEQ ID NO: 2811555 - DNA, 13 bp, Homo sapiens
ctgactccttaga

SEQ ID NO: 2811556 - DNA, 13 bp, Homo sapiens
ctgactctctgtg

SEQ ID NO: 2811557 - DNA, 16 bp, Homo sapiens
ctgactctctgtgacc

SEQ ID NO: 2811558 - DNA, 18 bp, Homo sapiens
ctgactctctgtgacctg

SEQ ID NO: 2811559 - DNA, 22 bp, Homo sapiens
ctgactggtgctataggctgga

SEQ ID NO: 2811560 - DNA, 20 bp, Homo sapiens
ctgacttggggagatggagt

SEQ ID NO: 2811561 - DNA, 19 bp, Homo sapiens
ctgagaaacccaccagcct

SEQ ID NO: 2811562 - DNA, 12 bp, Homo sapiens
ctgagaacctgg

SEQ ID NO: 2811563 - DNA, 14 bp, Homo sapiens
ctgagaacctggcc

SEQ ID NO: 2811564 - DNA, 15 bp, Homo sapiens
ctgagaacctggcct

SEQ ID NO: 2811565 - DNA, 23 bp, Homo sapiens
ctgagaaggtccttaatgatccg

SEQ ID NO: 2811566 - DNA, 16 bp, Homo sapiens
ctgagaagtgtatata

SEQ ID NO: 2811567 - DNA, 16 bp, Homo sapiens
ctgagaattccaagga

SEQ ID NO: 2811568 - DNA, 19 bp, Homo sapiens
ctgagagacccaaggagga

SEQ ID NO: 2811569 - DNA, 22 bp, Homo sapiens
ctgagaggacttttctttgtgg

SEQ ID NO: 2811570 - DNA, 16 bp, Homo sapiens
ctgagaggccctggat

SEQ ID NO: 2811571 - DNA, 17 bp, Homo sapiens
ctgagaggtgctgcagg

SEQ ID NO: 2811572 - DNA, 15 bp, Homo sapiens
ctgagattgcgccac

SEQ ID NO: 2811573 - DNA, 23 bp, Homo sapiens
ctgagcaacagagtgagaccctg

SEQ ID NO: 2811574 - DNA, 20 bp, Homo sapiens
ctgagcaagagctggcaaag

SEQ ID NO: 2811575 - DNA, 15 bp, Homo sapiens
ctgagcaagatcttg

SEQ ID NO: 2811576 - DNA, 16 bp, Homo sapiens
ctgagcaagatcttgt

SEQ ID NO: 2811577 - DNA, 20 bp, Homo sapiens
ctgagcaagatcttgtctcc

SEQ ID NO: 2811578 - DNA, 16 bp, Homo sapiens
ctgagcaccccctcat

SEQ ID NO: 2811579 - DNA, 21 bp, Homo sapiens
ctgagcaccccctcattcccc

SEQ ID NO: 2811580 - DNA, 11 bp, Homo sapiens
ctgcacccagg

SEQ ID NO: 2811581 - DNA, 16 bp, Homo sapiens
ctgcacccgtaccccc

SEQ ID NO: 2811582 - DNA, 14 bp, Homo sapiens
ctgcacccttcctc

SEQ ID NO: 2811583 - DNA, 20 bp, Homo sapiens
ctgcacccttcctcctcctt

SEQ ID NO: 2811584 - DNA, 14 bp, Homo sapiens
ctgcaccgggccac

SEQ ID NO: 2811585 - DNA, 11 bp, Homo sapiens
ctgcacctccc

SEQ ID NO: 2811586 - DNA, 14 bp, Homo sapiens
ctgcacctcccccc

SEQ ID NO: 2811587 - DNA, 21 bp, Homo sapiens
ctgcacctccccccactgcag

SEQ ID NO: 2811588 - DNA, 18 bp, Homo sapiens
ctgcacctgccagcctgg

SEQ ID NO: 2811589 - DNA, 16 bp, Homo sapiens
ctgcactatagcctag

SEQ ID NO: 2811590 - DNA, 18 bp, Homo sapiens
ctgcactatagcctaggt

SEQ ID NO: 2811591 - DNA, 16 bp, Homo sapiens
ctgcactccagcctgg

SEQ ID NO: 2811592 - DNA, 18 bp, Homo sapiens
ctgcactccagcctgggc

SEQ ID NO: 2811593 - DNA, 19 bp, Homo sapiens
ctgcactccagcctgggcg

SEQ ID NO: 2811594 - DNA, 13 bp, Homo sapiens
ctgcactctagcc

SEQ ID NO: 2811595 - DNA, 15 bp, Homo sapiens
ctgcactctagcctg

SEQ ID NO: 2811596 - DNA, 18 bp, Homo sapiens
ctgcacttgcagactcta

SEQ ID NO: 2811597 - DNA, 23 bp, Homo sapiens
ctgcacttgcagactctacagag

SEQ ID NO: 2811598 - DNA, 21 bp, Homo sapiens
ctgcagaacgtattggtccag

SEQ ID NO: 2811599 - DNA, 14 bp, Homo sapiens
ctgcagaaggccaa

SEQ ID NO: 2811600 - DNA, 13 bp, Homo sapiens
ctgcagaccctgc

SEQ ID NO: 2811601 - DNA, 14 bp, Homo sapiens
ctgcagaccctgcc

SEQ ID NO: 2811602 - DNA, 13 bp, Homo sapiens
ctgcagagacctt

SEQ ID NO: 2811603 - DNA, 13 bp, Homo sapiens
ctgcagagcacac

SEQ ID NO: 2811604 - DNA, 19 bp, Homo sapiens
ctgcagaggattgaggctt

SEQ ID NO: 2811605 - DNA, 23 bp, Homo sapiens
ctgcagaggggaaaccagtgtag

SEQ ID NO: 2811606 - DNA, 19 bp, Homo sapiens
ctgcagaggggctttctgg

SEQ ID NO: 2811607 - DNA, 19 bp, Homo sapiens
ctgcagcactttaaccctc

SEQ ID NO: 2811608 - DNA, 14 bp, Homo sapiens
ctgcagccagccca

SEQ ID NO: 2811609 - DNA, 15 bp, Homo sapiens
ctgcagccagcccag

SEQ ID NO: 2811610 - DNA, 23 bp, Homo sapiens
ctgcagcctcaacctcctgggct

SEQ ID NO: 2811611 - DNA, 18 bp, Homo sapiens
ctgcagcctcctcctgac

SEQ ID NO: 2811612 - DNA, 20 bp, Homo sapiens
ctgcagcctcctcctgacca

SEQ ID NO: 2811613 - DNA, 11 bp, Homo sapiens
ctgcagcttcc

SEQ ID NO: 2811614 - DNA, 20 bp, Homo sapiens
ctgcagcttgtagccagccg

SEQ ID NO: 2811615 - DNA, 22 bp, Homo sapiens
ctgcaggaatcaaaaattgaag

SEQ ID NO: 2811616 - DNA, 17 bp, Homo sapiens
ctgcaggcaaagtgaga

SEQ ID NO: 2811617 - DNA, 15 bp, Homo sapiens
ctgcaggccaagagc

SEQ ID NO: 2811618 - DNA, 17 bp, Homo sapiens
ctgcagggactgccagt

SEQ ID NO: 2811619 - DNA, 22 bp, Homo sapiens
ctgcagggagtccgaaagggac

SEQ ID NO: 2811620 - DNA, 16 bp, Homo sapiens
ctgcagggccaagcac

SEQ ID NO: 2811621 - DNA, 13 bp, Homo sapiens
ctgcaggtgtcta

SEQ ID NO: 2811622 - DNA, 21 bp, Homo sapiens
ctgcatccgtagttccctgaa

SEQ ID NO: 2811623 - DNA, 21 bp, Homo sapiens
ctgcatctagaggcttccttc

SEQ ID NO: 2811624 - DNA, 20 bp, Homo sapiens
ctgcattcaggatcaaaccc

SEQ ID NO: 2811625 - DNA, 14 bp, Homo sapiens
ctgcatttgtgaaa

SEQ ID NO: 2811626 - DNA, 15 bp, Homo sapiens
ctgcatttgtgaaat

SEQ ID NO: 2811627 - DNA, 22 bp, Homo sapiens
ctgcatttgtgaaatgatggtg

SEQ ID NO: 2811628 - DNA, 19 bp, Homo sapiens
ctgcattttattctggatg

SEQ ID NO: 2811629 - DNA, 20 bp, Homo sapiens
ctgcattttattctggatgg

SEQ ID NO: 2811630 - DNA, 11 bp, Homo sapiens
ctgccaagaaa

SEQ ID NO: 2811631 - DNA, 12 bp, Homo sapiens
ctgccacacagg

SEQ ID NO: 2811632 - DNA, 18 bp, Homo sapiens
ctgccacactcagtcccc

SEQ ID NO: 2811633 - DNA, 12 bp, Homo sapiens
ctgccaccagtc

SEQ ID NO: 2811634 - DNA, 21 bp, Homo sapiens
ctgccaccctggggagaaagt

SEQ ID NO: 2811635 - DNA, 11 bp, Homo sapiens
ctgccacctgt

SEQ ID NO: 2811636 - DNA, 15 bp, Homo sapiens
ctgccacctgtctgt

SEQ ID NO: 2811637 - DNA, 12 bp, Homo sapiens
ctgccagccaca

SEQ ID NO: 2811638 - DNA, 12 bp, Homo sapiens
ctgccagccagc

SEQ ID NO: 2811639 - DNA, 15 bp, Homo sapiens
ctgccagccagcagc

SEQ ID NO: 2811640 - DNA, 16 bp, Homo sapiens
ctgccagccagcagcc

SEQ ID NO: 2811641 - DNA, 23 bp, Homo sapiens
ctgccagccagcagccagctctc

SEQ ID NO: 2811642 - DNA, 13 bp, Homo sapiens
ctgccagcctggc

SEQ ID NO: 2811643 - DNA, 15 bp, Homo sapiens
ctgccagcctggctt

SEQ ID NO: 2811644 - DNA, 22 bp, Homo sapiens
ctgccagcctggcttctggagc

SEQ ID NO: 2811645 - DNA, 23 bp, Homo sapiens
ctgccagcctggcttctggagcc

SEQ ID NO: 2811646 - DNA, 22 bp, Homo sapiens
ctgccagcgtcagaggccctgg

SEQ ID NO: 2811647 - DNA, 20 bp, Homo sapiens
ctgccaggagggacaaagga

SEQ ID NO: 2811648 - DNA, 21 bp, Homo sapiens
ctgccaggagggacaaaggag

SEQ ID NO: 2811649 - DNA, 23 bp, Homo sapiens
ctgccaggagggacaaaggagcc

SEQ ID NO: 2811650 - DNA, 12 bp, Homo sapiens
ctgccagggccc

SEQ ID NO: 2811651 - DNA, 16 bp, Homo sapiens
ctgccagggcccctgt

SEQ ID NO: 2811652 - DNA, 19 bp, Homo sapiens
ctgccagggcccctgttcc

SEQ ID NO: 2811653 - DNA, 18 bp, Homo sapiens
ctgccagtgccttacctc

SEQ ID NO: 2811654 - DNA, 23 bp, Homo sapiens
ctgccagtgtttagaagagcctg

SEQ ID NO: 2811655 - DNA, 23 bp, Homo sapiens
ctgccatattctgttggccagtg

SEQ ID NO: 2811656 - DNA, 19 bp, Homo sapiens
ctgccatccaggttcagct

SEQ ID NO: 2811657 - DNA, 21 bp, Homo sapiens
ctgccatggcgtgtccctctc

SEQ ID NO: 2811658 - DNA, 17 bp, Homo sapiens
ctgcccaacctgctctc

SEQ ID NO: 2811659 - DNA, 20 bp, Homo sapiens
ctgcccagcctcgcatgcca

SEQ ID NO: 2811660 - DNA, 12 bp, Homo sapiens
ctgcccaggaga

SEQ ID NO: 2811661 - DNA, 21 bp, Homo sapiens
ctgcccaggagagccagccct

SEQ ID NO: 2811662 - DNA, 16 bp, Homo sapiens
ctgcccaggcccctgc

SEQ ID NO: 2811663 - DNA, 21 bp, Homo sapiens
ctgcccagtgcacttgctgga

SEQ ID NO: 2811664 - DNA, 17 bp, Homo sapiens
ctgccccaactcctgga

SEQ ID NO: 2811665 - DNA, 20 bp, Homo sapiens
ctgccccaactccttccagc

SEQ ID NO: 2811666 - DNA, 14 bp, Homo sapiens
ctgccccagccccg

SEQ ID NO: 2811667 - DNA, 14 bp, Homo sapiens
ctgccccagctctg

SEQ ID NO: 2811668 - DNA, 15 bp, Homo sapiens
ctgccccagctctgg

SEQ ID NO: 2811669 - DNA, 15 bp, Homo sapiens
ctgcccccagcactc

SEQ ID NO: 2811670 - DNA, 14 bp, Homo sapiens
ctgccccctggtgg

SEQ ID NO: 2811671 - DNA, 13 bp, Homo sapiens
tccaccctgctct

SEQ ID NO: 2811672 - DNA, 14 bp, Homo sapiens
tccaccctgctctc

SEQ ID NO: 2811673 - DNA, 12 bp, Homo sapiens
tccaccctggaa

SEQ ID NO: 2811674 - DNA, 19 bp, Homo sapiens
tccaccgctgcctaagtgg

SEQ ID NO: 2811675 - DNA, 11 bp, Homo sapiens
tccacctcagc

SEQ ID NO: 2811676 - DNA, 20 bp, Homo sapiens
tccacctgctttctcctggg

SEQ ID NO: 2811677 - DNA, 17 bp, Homo sapiens
tccacctggccccatgt

SEQ ID NO: 2811678 - DNA, 18 bp, Homo sapiens
tccaccttcccatgccct

SEQ ID NO: 2811679 - DNA, 17 bp, Homo sapiens
tccacgtccccctgggg

SEQ ID NO: 2811680 - DNA, 18 bp, Homo sapiens
tccacgtccccctggggc

SEQ ID NO: 2811681 - DNA, 16 bp, Homo sapiens
tccactgccaaaacaa

SEQ ID NO: 2811682 - DNA, 14 bp, Homo sapiens
tccactgctctcag

SEQ ID NO: 2811683 - DNA, 16 bp, Homo sapiens
tccactggacttgagc

SEQ ID NO: 2811684 - DNA, 12 bp, Homo sapiens
tccactgtgcag

SEQ ID NO: 2811685 - DNA, 20 bp, Homo sapiens
tccacttctctagagaacat

SEQ ID NO: 2811686 - DNA, 18 bp, Homo sapiens
tccactttcagtgaaagc

SEQ ID NO: 2811687 - DNA, 13 bp, Homo sapiens
tccagaaaatata

SEQ ID NO: 2811688 - DNA, 20 bp, Homo sapiens
tccagaaaatataaatgcat

SEQ ID NO: 2811689 - DNA, 22 bp, Homo sapiens
tccagaaaatgtgtcagcatgc

SEQ ID NO: 2811690 - DNA, 17 bp, Homo sapiens
tccagaagaatattcag

SEQ ID NO: 2811691 - DNA, 19 bp, Homo sapiens
tccagaagaatattcagga

SEQ ID NO: 2811692 - DNA, 20 bp, Homo sapiens
tccagaagaatattcaggac

SEQ ID NO: 2811693 - DNA, 21 bp, Homo sapiens
tccagaagaatattcaggact

SEQ ID NO: 2811694 - DNA, 15 bp, Homo sapiens
tccagacccggctgc

SEQ ID NO: 2811695 - DNA, 18 bp, Homo sapiens
tccagacccggctgcgtg

SEQ ID NO: 2811696 - DNA, 19 bp, Homo sapiens
tccagacccggctgcgtgg

SEQ ID NO: 2811697 - DNA, 15 bp, Homo sapiens
tccagagagtcctct

SEQ ID NO: 2811698 - DNA, 20 bp, Homo sapiens
tccagaggctattattttca

SEQ ID NO: 2811699 - DNA, 23 bp, Homo sapiens
tccagcaggtagtgggtgaatgt

SEQ ID NO: 2811700 - DNA, 10 bp, Homo sapiens
tccagccagc

SEQ ID NO: 2811701 - DNA, 23 bp, Homo sapiens
tccagccagcaatgatgtccaga

SEQ ID NO: 2811702 - DNA, 11 bp, Homo sapiens
tccagccagcg

SEQ ID NO: 2811703 - DNA, 20 bp, Homo sapiens
tccagcctgggcgacagagc

SEQ ID NO: 2811704 - DNA, 12 bp, Homo sapiens
tccagcctgggt

SEQ ID NO: 2811705 - DNA, 20 bp, Homo sapiens
tccagctagtgacccacatg

SEQ ID NO: 2811706 - DNA, 21 bp, Homo sapiens
tccagctatttttatttgttt

SEQ ID NO: 2811707 - DNA, 16 bp, Homo sapiens
tccagctcaccagccc

SEQ ID NO: 2811708 - DNA, 23 bp, Homo sapiens
tccagctcaccagccccagtgcc

SEQ ID NO: 2811709 - DNA, 10 bp, Homo sapiens
tccagctccc

SEQ ID NO: 2811710 - DNA, 10 bp, Homo sapiens
tccagctctt

SEQ ID NO: 2811711 - DNA, 20 bp, Homo sapiens
tccagctcttggcccctgtg

SEQ ID NO: 2811712 - DNA, 19 bp, Homo sapiens
tccagctggaattgctgct

SEQ ID NO: 2811713 - DNA, 20 bp, Homo sapiens
tccagctggaattgctgctc

SEQ ID NO: 2811714 - DNA, 23 bp, Homo sapiens
tccagctggaattgctgctctct

SEQ ID NO: 2811715 - DNA, 16 bp, Homo sapiens
tccagcttgctcttca

SEQ ID NO: 2811716 - DNA, 17 bp, Homo sapiens
tccagcttgctcttcag

SEQ ID NO: 2811717 - DNA, 14 bp, Homo sapiens
tccaggagcctggc

SEQ ID NO: 2811718 - DNA, 18 bp, Homo sapiens
tccaggagcctgtgcctc

SEQ ID NO: 2811719 - DNA, 15 bp, Homo sapiens
tccaggattccaaag

SEQ ID NO: 2811720 - DNA, 17 bp, Homo sapiens
tccaggattccaaagtt

SEQ ID NO: 2811721 - DNA, 20 bp, Homo sapiens
tccaggcacccttctttcct

SEQ ID NO: 2811722 - DNA, 17 bp, Homo sapiens
tccaggcacgtcccgga

SEQ ID NO: 2811723 - DNA, 18 bp, Homo sapiens
tccaggcatgctggcctc

SEQ ID NO: 2811724 - DNA, 19 bp, Homo sapiens
tccaggccaccgctctcct

SEQ ID NO: 2811725 - DNA, 12 bp, Homo sapiens
tccaggctcctt

SEQ ID NO: 2811726 - DNA, 16 bp, Homo sapiens
tccagggccctgagct

SEQ ID NO: 2811727 - DNA, 13 bp, Homo sapiens
tccagggctgccc

SEQ ID NO: 2811728 - DNA, 18 bp, Homo sapiens
tccagggttgatcacact

SEQ ID NO: 2811729 - DNA, 15 bp, Homo sapiens
tccaggtatctccag

SEQ ID NO: 2811730 - DNA, 15 bp, Homo sapiens
tccaggtcctggtgg

SEQ ID NO: 2811731 - DNA, 15 bp, Homo sapiens
tccaggttcagcttg

SEQ ID NO: 2811732 - DNA, 15 bp, Homo sapiens
tccagtatggaagaa

SEQ ID NO: 2811733 - DNA, 20 bp, Homo sapiens
tccagtctgggtaacaggga

SEQ ID NO: 2811734 - DNA, 22 bp, Homo sapiens
tccagtgagccgagatggcgct

SEQ ID NO: 2811735 - DNA, 12 bp, Homo sapiens
tccagtgcatgt

SEQ ID NO: 2811736 - DNA, 15 bp, Homo sapiens
tccagtggtaccagc

SEQ ID NO: 2811737 - DNA, 19 bp, Homo sapiens
tccagtggtgaagaaaact

SEQ ID NO: 2811738 - DNA, 19 bp, Homo sapiens
tccagtggttgctgttgat

SEQ ID NO: 2811739 - DNA, 16 bp, Homo sapiens
tccagtgtgcacccct

SEQ ID NO: 2811740 - DNA, 22 bp, Homo sapiens
tccagtgtgcacccctccccat

SEQ ID NO: 2811741 - DNA, 23 bp, Homo sapiens
tccagtgtgcacccctccccatt

SEQ ID NO: 2811742 - DNA, 14 bp, Homo sapiens
tccagttagttctc

SEQ ID NO: 2811743 - DNA, 15 bp, Homo sapiens
tccagttgcaataaa

SEQ ID NO: 2811744 - DNA, 21 bp, Homo sapiens
tccagttgcaataaaatagta

SEQ ID NO: 2811745 - DNA, 14 bp, Homo sapiens
tccagtttccaaag

SEQ ID NO: 2811746 - DNA, 16 bp, Homo sapiens
tccataatcaatctat

SEQ ID NO: 2811747 - DNA, 21 bp, Homo sapiens
tccataatctggactcctctg

SEQ ID NO: 2811748 - DNA, 23 bp, Homo sapiens
tccataatctggactcctctgtc

SEQ ID NO: 2811749 - DNA, 12 bp, Homo sapiens
tccataatgtat

SEQ ID NO: 2811750 - DNA, 12 bp, Homo sapiens
tccataattatg

SEQ ID NO: 2811751 - DNA, 17 bp, Homo sapiens
tccatacacatccccag

SEQ ID NO: 2811752 - DNA, 17 bp, Homo sapiens
tccatatattagcattt

SEQ ID NO: 2811753 - DNA, 15 bp, Homo sapiens
tccatatcagacctc

SEQ ID NO: 2811754 - DNA, 23 bp, Homo sapiens
tccatatcagacctctgatccct

SEQ ID NO: 2811755 - DNA, 13 bp, Homo sapiens
tccatcagctccc

SEQ ID NO: 2811756 - DNA, 18 bp, Homo sapiens
tccatcaggttccatccc

SEQ ID NO: 2811757 - DNA, 15 bp, Homo sapiens
tccatctggcagggt

SEQ ID NO: 2811758 - DNA, 20 bp, Homo sapiens
tccatctgggctaccccacc

SEQ ID NO: 2811759 - DNA, 19 bp, Homo sapiens
tccatctgtggaaatgaca

SEQ ID NO: 2811760 - DNA, 12 bp, Homo sapiens
tccatgaaaatg

SEQ ID NO: 2811761 - DNA, 15 bp, Homo sapiens
tccatgaaaatgcaa

SEQ ID NO: 2811762 - DNA, 17 bp, Homo sapiens
tccgccccagacacacc

SEQ ID NO: 2811763 - DNA, 19 bp, Homo sapiens
tccgcctggccggctccag

SEQ ID NO: 2811764 - DNA, 21 bp, Homo sapiens
tccgcctggccggctccagtt

SEQ ID NO: 2811765 - DNA, 17 bp, Homo sapiens
tccgccttcactccggt

SEQ ID NO: 2811766 - DNA, 22 bp, Homo sapiens
tccggtgtctggaaaagcactt

SEQ ID NO: 2811767 - DNA, 23 bp, Homo sapiens
tccggtgtctggaaaagcacttt

SEQ ID NO: 2811768 - DNA, 15 bp, Homo sapiens
tccggtgtgcctgca

SEQ ID NO: 2811769 - DNA, 17 bp, Homo sapiens
tccggtgtgcctgcagc

SEQ ID NO: 2811770 - DNA, 15 bp, Homo sapiens
tccgtaaaaatgatt

SEQ ID NO: 2811771 - DNA, 16 bp, Homo sapiens
tccgtcaaaacagatt

SEQ ID NO: 2811772 - DNA, 19 bp, Homo sapiens
tcctaaatgcagtgaattg

SEQ ID NO: 2811773 - DNA, 14 bp, Homo sapiens
tcctacagcctcag

SEQ ID NO: 2811774 - DNA, 18 bp, Homo sapiens
tcctacccaccctccttt

SEQ ID NO: 2811775 - DNA, 16 bp, Homo sapiens
tcctacctcagcctag

SEQ ID NO: 2811776 - DNA, 17 bp, Homo sapiens
tcctacctcagcctaga

SEQ ID NO: 2811777 - DNA, 13 bp, Homo sapiens
tcctactctgtgt

SEQ ID NO: 2811778 - DNA, 20 bp, Homo sapiens
tcctagaagagtcaggaagg

SEQ ID NO: 2811779 - DNA, 22 bp, Homo sapiens
tcctagaagagtcaggaaggga

SEQ ID NO: 2811780 - DNA, 20 bp, Homo sapiens
tcctaggcttaaatgcaata

SEQ ID NO: 2811781 - DNA, 20 bp, Homo sapiens
tcctagttttctcctcccag

SEQ ID NO: 2811782 - DNA, 19 bp, Homo sapiens
tcctattaaaacacagctt

SEQ ID NO: 2811783 - DNA, 20 bp, Homo sapiens
tcctattaaaacacagcttt

SEQ ID NO: 2811784 - DNA, 17 bp, Homo sapiens
tcctattctcaccagga

SEQ ID NO: 2811785 - DNA, 20 bp, Homo sapiens
tcctattctcaccaggaagg

SEQ ID NO: 2811786 - DNA, 16 bp, Homo sapiens
tcctatttgcactgta

SEQ ID NO: 2811787 - DNA, 16 bp, Homo sapiens
tcctattttaaaacca

SEQ ID NO: 2811788 - DNA, 17 bp, Homo sapiens
tcctattttaaaaccat

SEQ ID NO: 2811789 - DNA, 13 bp, Homo sapiens
tcctcacccccag

SEQ ID NO: 2811790 - DNA, 20 bp, Homo sapiens
tcctcacccccagctttgct

SEQ ID NO: 2811791 - DNA, 12 bp, Homo sapiens
tcctcactgccc

SEQ ID NO: 2811792 - DNA, 17 bp, Homo sapiens
tcctcagagaatttcta

SEQ ID NO: 2811793 - DNA, 20 bp, Homo sapiens
tcctcagagaatttctacca

SEQ ID NO: 2811794 - DNA, 22 bp, Homo sapiens
tcctcagggacagagacacctg

SEQ ID NO: 2811795 - DNA, 24 bp, Homo sapiens
tcctcagggacagagacacctgca

SEQ ID NO: 2811796 - DNA, 23 bp, Homo sapiens
tcctccaaaggaagtctaggagc

SEQ ID NO: 2811797 - DNA, 19 bp, Homo sapiens
tcctccaacaataaagagc

SEQ ID NO: 2811798 - DNA, 21 bp, Homo sapiens
tcctccaacaataaagagctc

SEQ ID NO: 2811799 - DNA, 19 bp, Homo sapiens
tcctccaacgttaaaagac

SEQ ID NO: 2811800 - DNA, 22 bp, Homo sapiens
tcctccaacgttaaaagacagt

SEQ ID NO: 2811801 - DNA, 15 bp, Homo sapiens
tcctccaagtcttca

SEQ ID NO: 2811802 - DNA, 22 bp, Homo sapiens
tcctccaattccacagtctctg

SEQ ID NO: 2811803 - DNA, 23 bp, Homo sapiens
tcctccaattccacagtctctgg

SEQ ID NO: 2811804 - DNA, 13 bp, Homo sapiens
tcctccagggcca

SEQ ID NO: 2811805 - DNA, 13 bp, Homo sapiens
tcctcccacaatc

SEQ ID NO: 2811806 - DNA, 18 bp, Homo sapiens
tcctcccacctcagcctc

SEQ ID NO: 2811807 - DNA, 22 bp, Homo sapiens
tcctccccaccttccccagact

SEQ ID NO: 2811808 - DNA, 24 bp, Homo sapiens
tcctcccccaccttcaagcaccct

SEQ ID NO: 2811809 - DNA, 10 bp, Homo sapiens
tcctcccctt

SEQ ID NO: 2811810 - DNA, 15 bp, Homo sapiens
tcctcctcccccaga

SEQ ID NO: 2811811 - DNA, 19 bp, Homo sapiens
tcctccttggtgcctggcc

SEQ ID NO: 2811812 - DNA, 16 bp, Homo sapiens
tcctcggatcaccgag

SEQ ID NO: 2811813 - DNA, 15 bp, Homo sapiens
tcctcggccccctcc

SEQ ID NO: 2811814 - DNA, 21 bp, Homo sapiens
tcctctaagccactcttccaa

SEQ ID NO: 2811815 - DNA, 18 bp, Homo sapiens
tcctctacttaatgagat

SEQ ID NO: 2811816 - DNA, 17 bp, Homo sapiens
tcctctccaattgtaaa

SEQ ID NO: 2811817 - DNA, 17 bp, Homo sapiens
tcctctccagccttctc

SEQ ID NO: 2811818 - DNA, 12 bp, Homo sapiens
tcctctccaggc

SEQ ID NO: 2811819 - DNA, 14 bp, Homo sapiens
tcctctctgagact

SEQ ID NO: 2811820 - DNA, 15 bp, Homo sapiens
tcctctgcagcactt

SEQ ID NO: 2811821 - DNA, 12 bp, Homo sapiens
tcctctgccacc

SEQ ID NO: 2811822 - DNA, 15 bp, Homo sapiens
tcctctgccacctcc

SEQ ID NO: 2811823 - DNA, 22 bp, Homo sapiens
tcctctgccacctcccctatcc

SEQ ID NO: 2811824 - DNA, 23 bp, Homo sapiens
tcctctggctggctaactggaag

SEQ ID NO: 2811825 - DNA, 13 bp, Homo sapiens
tcctctgtccagg

SEQ ID NO: 2811826 - DNA, 16 bp, Homo sapiens
tcctctgtccagggcc

SEQ ID NO: 2811827 - DNA, 13 bp, Homo sapiens
tcctctgtctctg

SEQ ID NO: 2811828 - DNA, 19 bp, Homo sapiens
tcctcttctattttgtaaa

SEQ ID NO: 2811829 - DNA, 21 bp, Homo sapiens
tcctcttttatcttggactga

SEQ ID NO: 2811830 - DNA, 21 bp, Homo sapiens
tcctgaaagaaacagttaact

SEQ ID NO: 2811831 - DNA, 15 bp, Homo sapiens
tcctgaaatttcaga

SEQ ID NO: 2811832 - DNA, 14 bp, Homo sapiens
tcctgaatgaaata

SEQ ID NO: 2811833 - DNA, 19 bp, Homo sapiens
tcctgaatgaaatatcaga

SEQ ID NO: 2811834 - DNA, 16 bp, Homo sapiens
tcctgagcactgccag

SEQ ID NO: 2811835 - DNA, 20 bp, Homo sapiens
tcctgagcactgccaggagg

SEQ ID NO: 2811836 - DNA, 22 bp, Homo sapiens
tcctgagcactgccaggaggga

SEQ ID NO: 2811837 - DNA, 23 bp, Homo sapiens
tcctgaggagctgttggcctggg

SEQ ID NO: 2811838 - DNA, 16 bp, Homo sapiens
tcctgcaatctccagg

SEQ ID NO: 2811839 - DNA, 17 bp, Homo sapiens
tcctgcaatctccaggg

SEQ ID NO: 2811840 - DNA, 21 bp, Homo sapiens
tcctgcaatctccagggctgc

SEQ ID NO: 2811841 - DNA, 15 bp, Homo sapiens
tcctgcagcctcctc

SEQ ID NO: 2811842 - DNA, 19 bp, Homo sapiens
tcctgcagcctcctcctga

SEQ ID NO: 2811843 - DNA, 14 bp, Homo sapiens
tcctgccaccagtc

SEQ ID NO: 2811844 - DNA, 22 bp, Homo sapiens
tcctgccaccagtcactgtccc

SEQ ID NO: 2811845 - DNA, 12 bp, Homo sapiens
tcctgcccagga

SEQ ID NO: 2811846 - DNA, 14 bp, Homo sapiens
tcctgcccaggaga

SEQ ID NO: 2811847 - DNA, 22 bp, Homo sapiens
tcctgcccaggagagccagccc

SEQ ID NO: 2811848 - DNA, 14 bp, Homo sapiens
tcctgccctcccct

SEQ ID NO: 2811849 - DNA, 12 bp, Homo sapiens
tcctgccctgtt

SEQ ID NO: 2811850 - DNA, 18 bp, Homo sapiens
tcctgccctgttgtgtat

SEQ ID NO: 2811851 - DNA, 15 bp, Homo sapiens
tcctgcctacatccc

SEQ ID NO: 2811852 - DNA, 17 bp, Homo sapiens
tctactaaatattttat

SEQ ID NO: 2811853 - DNA, 19 bp, Homo sapiens
tctactccatgcacatagt

SEQ ID NO: 2811854 - DNA, 22 bp, Homo sapiens
tctactcctacctcagcctaga

SEQ ID NO: 2811855 - DNA, 17 bp, Homo sapiens
tctactgagacatgact

SEQ ID NO: 2811856 - DNA, 14 bp, Homo sapiens
tctagactttctca

SEQ ID NO: 2811857 - DNA, 16 bp, Homo sapiens
tctagagaagaggctg

SEQ ID NO: 2811858 - DNA, 16 bp, Homo sapiens
tctagagatagtacat

SEQ ID NO: 2811859 - DNA, 16 bp, Homo sapiens
tctagaggcttccttc

SEQ ID NO: 2811860 - DNA, 21 bp, Homo sapiens
tctagatcaattaattcttaa

SEQ ID NO: 2811861 - DNA, 13 bp, Homo sapiens
tctagcaactgtt

SEQ ID NO: 2811862 - DNA, 21 bp, Homo sapiens
tctagcaactgttggataata

SEQ ID NO: 2811863 - DNA, 18 bp, Homo sapiens
tctagctgttgagctgtt

SEQ ID NO: 2811864 - DNA, 19 bp, Homo sapiens
tctagctgttgagctgttt

SEQ ID NO: 2811865 - DNA, 19 bp, Homo sapiens
tctaggggtcaggctccat

SEQ ID NO: 2811866 - DNA, 17 bp, Homo sapiens
tctaggtaggaaatgtg

SEQ ID NO: 2811867 - DNA, 24 bp, Homo sapiens
tctagtattccagacctgaagaat

SEQ ID NO: 2811868 - DNA, 20 bp, Homo sapiens
tctagtctcctttgcactga

SEQ ID NO: 2811869 - DNA, 19 bp, Homo sapiens
tctatagccaaaaatagct

SEQ ID NO: 2811870 - DNA, 18 bp, Homo sapiens
tctatagctcttctattt

SEQ ID NO: 2811871 - DNA, 17 bp, Homo sapiens
tctatagtagtcaatta

SEQ ID NO: 2811872 - DNA, 15 bp, Homo sapiens
tctatatatacatgt

SEQ ID NO: 2811873 - DNA, 21 bp, Homo sapiens
tctatcaaccccagacactgg

SEQ ID NO: 2811874 - DNA, 14 bp, Homo sapiens
tctatcaccaggat

SEQ ID NO: 2811875 - DNA, 14 bp, Homo sapiens
tctatctatttgag

SEQ ID NO: 2811876 - DNA, 15 bp, Homo sapiens
tctatctatttgagg

SEQ ID NO: 2811877 - DNA, 20 bp, Homo sapiens
tctatgcaatttttaaacta

SEQ ID NO: 2811878 - DNA, 19 bp, Homo sapiens
tctatggcagtccagccag

SEQ ID NO: 2811879 - DNA, 22 bp, Homo sapiens
tctatggcagtccagccagctc

SEQ ID NO: 2811880 - DNA, 23 bp, Homo sapiens
tctatggcagtccagccagctcc

SEQ ID NO: 2811881 - DNA, 13 bp, Homo sapiens
tctatgggactca

SEQ ID NO: 2811882 - DNA, 23 bp, Homo sapiens
tctatgggactcaatgcactgac

SEQ ID NO: 2811883 - DNA, 17 bp, Homo sapiens
tctattataaaaccatg

SEQ ID NO: 2811884 - DNA, 17 bp, Homo sapiens
tctattgtagcatttct

SEQ ID NO: 2811885 - DNA, 18 bp, Homo sapiens
tctattgtagcatttctt

SEQ ID NO: 2811886 - DNA, 17 bp, Homo sapiens
tctatttaaaaaataaa

SEQ ID NO: 2811887 - DNA, 15 bp, Homo sapiens
tctatttatttactg

SEQ ID NO: 2811888 - DNA, 22 bp, Homo sapiens
tctatttatttactgagcttct

SEQ ID NO: 2811889 - DNA, 13 bp, Homo sapiens
tctatttctctct

SEQ ID NO: 2811890 - DNA, 13 bp, Homo sapiens
tctatttctgaga

SEQ ID NO: 2811891 - DNA, 20 bp, Homo sapiens
tctatttctgagaaggtcct

SEQ ID NO: 2811892 - DNA, 14 bp, Homo sapiens
tctatttttcttct

SEQ ID NO: 2811893 - DNA, 14 bp, Homo sapiens
tctatttttgtaga

SEQ ID NO: 2811894 - DNA, 13 bp, Homo sapiens
tctcaaaaaataa

SEQ ID NO: 2811895 - DNA, 17 bp, Homo sapiens
tctcaaatgctaaatgc

SEQ ID NO: 2811896 - DNA, 23 bp, Homo sapiens
tctcaacctaccaccccttcctg

SEQ ID NO: 2811897 - DNA, 15 bp, Homo sapiens
tctcaagagccctgt

SEQ ID NO: 2811898 - DNA, 16 bp, Homo sapiens
tctcaatgcttttcta

SEQ ID NO: 2811899 - DNA, 12 bp, Homo sapiens
tctcaccaggaa

SEQ ID NO: 2811900 - DNA, 20 bp, Homo sapiens
tctcactatgttgcccaggc

SEQ ID NO: 2811901 - DNA, 23 bp, Homo sapiens
tctcactatgttgcccaggcagg

SEQ ID NO: 2811902 - DNA, 14 bp, Homo sapiens
tctcactccaccac

SEQ ID NO: 2811903 - DNA, 18 bp, Homo sapiens
tctcactccaccacccaa

SEQ ID NO: 2811904 - DNA, 12 bp, Homo sapiens
tctcactctgtc

SEQ ID NO: 2811905 - DNA, 18 bp, Homo sapiens
tctcactctgtcgcccag

SEQ ID NO: 2811906 - DNA, 22 bp, Homo sapiens
tctcactctgtcgcccagtctg

SEQ ID NO: 2811907 - DNA, 17 bp, Homo sapiens
tctcactgttgcccagg

SEQ ID NO: 2811908 - DNA, 18 bp, Homo sapiens
tctcactgttgcccaggc

SEQ ID NO: 2811909 - DNA, 18 bp, Homo sapiens
tctcagataaagtgacca

SEQ ID NO: 2811910 - DNA, 15 bp, Homo sapiens
tctcagccaacgagt

SEQ ID NO: 2811911 - DNA, 19 bp, Homo sapiens
tctcagccccgggcctgcc

SEQ ID NO: 2811912 - DNA, 20 bp, Homo sapiens
tctcagccccgggcctgcct

SEQ ID NO: 2811913 - DNA, 21 bp, Homo sapiens
tctcagccccgggcctgcctc

SEQ ID NO: 2811914 - DNA, 19 bp, Homo sapiens
tctcagcctcccaacccca

SEQ ID NO: 2811915 - DNA, 19 bp, Homo sapiens
tctcaggacacaggcctgt

SEQ ID NO: 2811916 - DNA, 15 bp, Homo sapiens
tctcaggagcacagg

SEQ ID NO: 2811917 - DNA, 20 bp, Homo sapiens
tctcaggagcacaggcagct

SEQ ID NO: 2811918 - DNA, 18 bp, Homo sapiens
tctcaggagcttgcaaga

SEQ ID NO: 2811919 - DNA, 16 bp, Homo sapiens
tctcagtgaagaatac

SEQ ID NO: 2811920 - DNA, 15 bp, Homo sapiens
tctcatcagaaatgt

SEQ ID NO: 2811921 - DNA, 15 bp, Homo sapiens
tctcatcagtgtcct

SEQ ID NO: 2811922 - DNA, 13 bp, Homo sapiens
tctcatgaacctc

SEQ ID NO: 2811923 - DNA, 22 bp, Homo sapiens
tctcatgaacctcaagctgcat

SEQ ID NO: 2811924 - DNA, 18 bp, Homo sapiens
tctcatggaaactggcca

SEQ ID NO: 2811925 - DNA, 19 bp, Homo sapiens
tctcatggaaactggccag

SEQ ID NO: 2811926 - DNA, 15 bp, Homo sapiens
tctcatgtgatcctt

SEQ ID NO: 2811927 - DNA, 18 bp, Homo sapiens
tctcatgtgatcctttta

SEQ ID NO: 2811928 - DNA, 23 bp, Homo sapiens
tctcatgtgatccttttatgtta

SEQ ID NO: 2811929 - DNA, 14 bp, Homo sapiens
tctcattccccagg

SEQ ID NO: 2811930 - DNA, 15 bp, Homo sapiens
tctcatttaagggaa

SEQ ID NO: 2811931 - DNA, 16 bp, Homo sapiens
tctcatttaagggaaa

SEQ ID NO: 2811932 - DNA, 17 bp, Homo sapiens
tctcatttaagggaaaa

SEQ ID NO: 2811933 - DNA, 19 bp, Homo sapiens
tctcatttaagggaaaaat

SEQ ID NO: 2811934 - DNA, 14 bp, Homo sapiens
tctcatttgtcaca

SEQ ID NO: 2811935 - DNA, 16 bp, Homo sapiens
tctcatttgtcacaca

SEQ ID NO: 2811936 - DNA, 18 bp, Homo sapiens
tctccaaaggccctacca

SEQ ID NO: 2811937 - DNA, 24 bp, Homo sapiens
tctccaaatgagatctaagccttt

SEQ ID NO: 2811938 - DNA, 18 bp, Homo sapiens
tctccaaatgattttcat

SEQ ID NO: 2811939 - DNA, 14 bp, Homo sapiens
tctccaattgtaaa

SEQ ID NO: 2811940 - DNA, 21 bp, Homo sapiens
tctccaccaactggagcactg

SEQ ID NO: 2811941 - DNA, 16 bp, Homo sapiens
tctccaccctgagcct

SEQ ID NO: 2811942 - DNA, 17 bp, Homo sapiens
tctccaccctgagcctg

SEQ ID NO: 2811943 - DNA, 19 bp, Homo sapiens
tctccaccctgagcctgac

SEQ ID NO: 2811944 - DNA, 21 bp, Homo sapiens
tctccaccctgagcctgacct

SEQ ID NO: 2811945 - DNA, 12 bp, Homo sapiens
tctccaccctgc

SEQ ID NO: 2811946 - DNA, 11 bp, Homo sapiens
tctccacctca

SEQ ID NO: 2811947 - DNA, 15 bp, Homo sapiens
tctccacctcagcct

SEQ ID NO: 2811948 - DNA, 17 bp, Homo sapiens
tctccacctgaagtgat

SEQ ID NO: 2811949 - DNA, 12 bp, Homo sapiens
tctccagccagc

SEQ ID NO: 2811950 - DNA, 14 bp, Homo sapiens
tctccagccttctc

SEQ ID NO: 2811951 - DNA, 20 bp, Homo sapiens
tctccaggaaggtagcccag

SEQ ID NO: 2811952 - DNA, 21 bp, Homo sapiens
tctccaggaaggtagcccagc

SEQ ID NO: 2811953 - DNA, 23 bp, Homo sapiens
tctccaggcacccttctttcctc

SEQ ID NO: 2811954 - DNA, 11 bp, Homo sapiens
tctccaggctg

SEQ ID NO: 2811955 - DNA, 16 bp, Homo sapiens
tctccaggctgtttct

SEQ ID NO: 2811956 - DNA, 24 bp, Homo sapiens
tctccagggctgcccctgtaggtt

SEQ ID NO: 2811957 - DNA, 15 bp, Homo sapiens
tctccagttttcagt

SEQ ID NO: 2811958 - DNA, 12 bp, Homo sapiens
tctccccctggg

SEQ ID NO: 2811959 - DNA, 15 bp, Homo sapiens
tctcccctccctctt

SEQ ID NO: 2811960 - DNA, 14 bp, Homo sapiens
tctcccctgccctg

SEQ ID NO: 2811961 - DNA, 14 bp, Homo sapiens
tctcccgcaccagg

SEQ ID NO: 2811962 - DNA, 19 bp, Homo sapiens
tctccctaaaataaaaacc

SEQ ID NO: 2811963 - DNA, 21 bp, Homo sapiens
tctccctaaaataaaaaccag

SEQ ID NO: 2811964 - DNA, 22 bp, Homo sapiens
tctccctaaaataaaaaccaga

SEQ ID NO: 2811965 - DNA, 16 bp, Homo sapiens
tctccctccagctgga

SEQ ID NO: 2811966 - DNA, 16 bp, Homo sapiens
tctccctctcctgcct

SEQ ID NO: 2811967 - DNA, 12 bp, Homo sapiens
tctccctctggc

SEQ ID NO: 2811968 - DNA, 15 bp, Homo sapiens
tctccctctggccct

SEQ ID NO: 2811969 - DNA, 16 bp, Homo sapiens
tctccctctggccctg

SEQ ID NO: 2811970 - DNA, 20 bp, Homo sapiens
tctccctctggccctgcctt

SEQ ID NO: 2811971 - DNA, 13 bp, Homo sapiens
tctccctgccgcc

SEQ ID NO: 2811972 - DNA, 23 bp, Homo sapiens
tctccgaccagacaccttgacag

SEQ ID NO: 2811973 - DNA, 17 bp, Homo sapiens
tctccgactgctaggga

SEQ ID NO: 2811974 - DNA, 15 bp, Homo sapiens
tctcctaccccacct

SEQ ID NO: 2811975 - DNA, 17 bp, Homo sapiens
tctcctcccccaccttc

SEQ ID NO: 2811976 - DNA, 14 bp, Homo sapiens
tctcctcttaaaaa

SEQ ID NO: 2811977 - DNA, 15 bp, Homo sapiens
tctcctgagaggtgc

SEQ ID NO: 2811978 - DNA, 16 bp, Homo sapiens
tctcctgagaggtgct

SEQ ID NO: 2811979 - DNA, 11 bp, Homo sapiens
tctcctgccta

SEQ ID NO: 2811980 - DNA, 14 bp, Homo sapiens
tctcctgcctactc

SEQ ID NO: 2811981 - DNA, 22 bp, Homo sapiens
tctcctgcctcagcctcccaaa

SEQ ID NO: 2811982 - DNA, 13 bp, Homo sapiens
tctcctggcttcc

SEQ ID NO: 2811983 - DNA, 18 bp, Homo sapiens
tctcctggcttcccatcc

SEQ ID NO: 2811984 - DNA, 22 bp, Homo sapiens
tctcctggcttcccatccccag

SEQ ID NO: 2811985 - DNA, 23 bp, Homo sapiens
tctcctggcttcccatccccagc

SEQ ID NO: 2811986 - DNA, 22 bp, Homo sapiens
tctcctgggcccgctttgcctg

SEQ ID NO: 2811987 - DNA, 23 bp, Homo sapiens
tctcctgggcccgctttgcctgc

SEQ ID NO: 2811988 - DNA, 16 bp, Homo sapiens
tctcctgtaattttgt

SEQ ID NO: 2811989 - DNA, 20 bp, Homo sapiens
tctcctgtataaccccacct

SEQ ID NO: 2811990 - DNA, 16 bp, Homo sapiens
tctcctgtccaaccta

SEQ ID NO: 2811991 - DNA, 16 bp, Homo sapiens
tctcctgtgcccacat

SEQ ID NO: 2811992 - DNA, 17 bp, Homo sapiens
tctcctgtgcccacatc

SEQ ID NO: 2811993 - DNA, 13 bp, Homo sapiens
tctccttggagga

SEQ ID NO: 2811994 - DNA, 14 bp, Homo sapiens
tctccttgttctga

SEQ ID NO: 2811995 - DNA, 16 bp, Homo sapiens
tctccttgttctgata

SEQ ID NO: 2811996 - DNA, 17 bp, Homo sapiens
tctcctttattgctcct

SEQ ID NO: 2811997 - DNA, 15 bp, Homo sapiens
tctcctttctttcta

SEQ ID NO: 2811998 - DNA, 19 bp, Homo sapiens
tctcctttgcactgagggc

SEQ ID NO: 2811999 - DNA, 22 bp, Homo sapiens
tctcgagcgccctgcagaccct

SEQ ID NO: 2812000 - DNA, 17 bp, Homo sapiens
tctcggaaggctggctg

SEQ ID NO: 2812001 - DNA, 21 bp, Homo sapiens
tctcggggcgacccctcagtg

SEQ ID NO: 2812002 - DNA, 16 bp, Homo sapiens
tctctaaaaataaaat

SEQ ID NO: 2812003 - DNA, 17 bp, Homo sapiens
tctctaaaaataaaatg

SEQ ID NO: 2812004 - DNA, 19 bp, Homo sapiens
tctctaaaaataaaatgat

SEQ ID NO: 2812005 - DNA, 20 bp, Homo sapiens
tctctaaaaataaaatgatg

SEQ ID NO: 2812006 - DNA, 15 bp, Homo sapiens
tctctacccatctcc

SEQ ID NO: 2812007 - DNA, 19 bp, Homo sapiens
tctctacccggcccagaga

SEQ ID NO: 2812008 - DNA, 19 bp, Homo sapiens
tctctactcctacctcagc

SEQ ID NO: 2812009 - DNA, 16 bp, Homo sapiens
tctctaggctgttttc

SEQ ID NO: 2812010 - DNA, 15 bp, Homo sapiens
tctctatatatacat

SEQ ID NO: 2812011 - DNA, 19 bp, Homo sapiens
tctctcaggagcacaggca

SEQ ID NO: 2812012 - DNA, 12 bp, Homo sapiens
tctctcatgaac

SEQ ID NO: 2812013 - DNA, 14 bp, Homo sapiens
tctctccactgctc

SEQ ID NO: 2812014 - DNA, 15 bp, Homo sapiens
tctctccaggaaggt

SEQ ID NO: 2812015 - DNA, 24 bp, Homo sapiens
tctctccaggaaggtagcccagca

SEQ ID NO: 2812016 - DNA, 16 bp, Homo sapiens
tctctccatcctcaaa

SEQ ID NO: 2812017 - DNA, 14 bp, Homo sapiens
tctctcctcagact

SEQ ID NO: 2812018 - DNA, 16 bp, Homo sapiens
tctctcctcagactgc

SEQ ID NO: 2812019 - DNA, 14 bp, Homo sapiens
tctctccttctggc

SEQ ID NO: 2812020 - DNA, 15 bp, Homo sapiens
tctctccttgttctg

SEQ ID NO: 2812021 - DNA, 18 bp, Homo sapiens
tctctcggggcgacccct

SEQ ID NO: 2812022 - DNA, 18 bp, Homo sapiens
tctctcggttccacgtcc

SEQ ID NO: 2812023 - DNA, 19 bp, Homo sapiens
tctctctaaaaataaaatg

SEQ ID NO: 2812024 - DNA, 19 bp, Homo sapiens
tctctctactcctacctca

SEQ ID NO: 2812025 - DNA, 11 bp, Homo sapiens
tctctctcctg

SEQ ID NO: 2812026 - DNA, 12 bp, Homo sapiens
tctctctcctgt

SEQ ID NO: 2812027 - DNA, 14 bp, Homo sapiens
tctctgaatcctaa

SEQ ID NO: 2812028 - DNA, 13 bp, Homo sapiens
tctctgaggacac

SEQ ID NO: 2812029 - DNA, 14 bp, Homo sapiens
tctctgaggacact

SEQ ID NO: 2812030 - DNA, 19 bp, Homo sapiens
tctctgagggagaggctgt

SEQ ID NO: 2812031 - DNA, 20 bp, Homo sapiens
tctctgattttcaaagcttt

SEQ ID NO: 2812032 - DNA, 18 bp, Homo sapiens
tctctgcagccagcccag

SEQ ID NO: 2812033 - DNA, 15 bp, Homo sapiens
tctgtgtcagcctgt

SEQ ID NO: 2812034 - DNA, 20 bp, Homo sapiens
tctgtgtcaggtggggcagc

SEQ ID NO: 2812035 - DNA, 22 bp, Homo sapiens
tctgtgtcaggtggggcagctt

SEQ ID NO: 2812036 - DNA, 14 bp, Homo sapiens
tctgtgtgcacaaa

SEQ ID NO: 2812037 - DNA, 16 bp, Homo sapiens
tctgttaaaatcagga

SEQ ID NO: 2812038 - DNA, 21 bp, Homo sapiens
tctgttcacttttcctccctc

SEQ ID NO: 2812039 - DNA, 22 bp, Homo sapiens
tctgttcacttttcctccctca

SEQ ID NO: 2812040 - DNA, 12 bp, Homo sapiens
tctgttctcaaa

SEQ ID NO: 2812041 - DNA, 18 bp, Homo sapiens
tctgttgccacaaccctg

SEQ ID NO: 2812042 - DNA, 17 bp, Homo sapiens
tctgttggccagtgtga

SEQ ID NO: 2812043 - DNA, 14 bp, Homo sapiens
tctgtttttctttt

SEQ ID NO: 2812044 - DNA, 14 bp, Homo sapiens
tcttaaaataactt

SEQ ID NO: 2812045 - DNA, 16 bp, Homo sapiens
tcttaaagctgcctgt

SEQ ID NO: 2812046 - DNA, 21 bp, Homo sapiens
tcttaaagctgcctgtagtta

SEQ ID NO: 2812047 - DNA, 15 bp, Homo sapiens
tcttaaataagaaac

SEQ ID NO: 2812048 - DNA, 18 bp, Homo sapiens
tcttaaataagaaacttt

SEQ ID NO: 2812049 - DNA, 18 bp, Homo sapiens
tcttaatgctttcctccc

SEQ ID NO: 2812050 - DNA, 21 bp, Homo sapiens
tcttaatgctttcctccctgg

SEQ ID NO: 2812051 - DNA, 19 bp, Homo sapiens
tcttacaataattctatga

SEQ ID NO: 2812052 - DNA, 19 bp, Homo sapiens
tcttaccttaaaaagtaat

SEQ ID NO: 2812053 - DNA, 15 bp, Homo sapiens
tcttactatttcaca

SEQ ID NO: 2812054 - DNA, 13 bp, Homo sapiens
tcttagctttcca

SEQ ID NO: 2812055 - DNA, 20 bp, Homo sapiens
tcttatagaatatttattac

SEQ ID NO: 2812056 - DNA, 22 bp, Homo sapiens
tcttatagtcaatgtttctttt

SEQ ID NO: 2812057 - DNA, 13 bp, Homo sapiens
tcttatgaaatgg

SEQ ID NO: 2812058 - DNA, 22 bp, Homo sapiens
tcttattagaacaggcaagtga

SEQ ID NO: 2812059 - DNA, 14 bp, Homo sapiens
tcttattgcccacg

SEQ ID NO: 2812060 - DNA, 18 bp, Homo sapiens
tcttattgcccacgctgg

SEQ ID NO: 2812061 - DNA, 22 bp, Homo sapiens
tcttattgcccacgctggagtg

SEQ ID NO: 2812062 - DNA, 14 bp, Homo sapiens
tcttatttatatat

SEQ ID NO: 2812063 - DNA, 17 bp, Homo sapiens
tcttatttatatatgaa

SEQ ID NO: 2812064 - DNA, 13 bp, Homo sapiens
tcttatttattat

SEQ ID NO: 2812065 - DNA, 14 bp, Homo sapiens
tcttatttgcaata

SEQ ID NO: 2812066 - DNA, 16 bp, Homo sapiens
tcttatttgcaataaa

SEQ ID NO: 2812067 - DNA, 13 bp, Homo sapiens
tcttattttgtaa

SEQ ID NO: 2812068 - DNA, 17 bp, Homo sapiens
tcttattttgtaataaa

SEQ ID NO: 2812069 - DNA, 21 bp, Homo sapiens
tcttattttgtaataaactct

SEQ ID NO: 2812070 - DNA, 22 bp, Homo sapiens
tcttattttgtaataaactctc

SEQ ID NO: 2812071 - DNA, 19 bp, Homo sapiens
tcttcacccagctaatctg

SEQ ID NO: 2812072 - DNA, 20 bp, Homo sapiens
tcttcacccagctaatctgt

SEQ ID NO: 2812073 - DNA, 11 bp, Homo sapiens
tcttcagccta

SEQ ID NO: 2812074 - DNA, 22 bp, Homo sapiens
tcttcagcctagccgacctcag

SEQ ID NO: 2812075 - DNA, 19 bp, Homo sapiens
tcttcagtgggagaaaaca

SEQ ID NO: 2812076 - DNA, 20 bp, Homo sapiens
tcttcataacaattttagga

SEQ ID NO: 2812077 - DNA, 23 bp, Homo sapiens
tcttcatcagcatttaataaatg

SEQ ID NO: 2812078 - DNA, 14 bp, Homo sapiens
tcttcatgcaatga

SEQ ID NO: 2812079 - DNA, 16 bp, Homo sapiens
tcttcatgtttcagga

SEQ ID NO: 2812080 - DNA, 14 bp, Homo sapiens
tcttccaaagcaca

SEQ ID NO: 2812081 - DNA, 15 bp, Homo sapiens
tcttccatttattgc

SEQ ID NO: 2812082 - DNA, 16 bp, Homo sapiens
tcttcccatcactgga

SEQ ID NO: 2812083 - DNA, 18 bp, Homo sapiens
tcttcccatttgtaatgt

SEQ ID NO: 2812084 - DNA, 22 bp, Homo sapiens
tcttccccttgcccttgccctg

SEQ ID NO: 2812085 - DNA, 18 bp, Homo sapiens
tcttcctaccaaatataa

SEQ ID NO: 2812086 - DNA, 18 bp, Homo sapiens
tcttcctgcaaggactac

SEQ ID NO: 2812087 - DNA, 16 bp, Homo sapiens
tcttcctgccaagcca

SEQ ID NO: 2812088 - DNA, 11 bp, Homo sapiens
tcttccttccc

SEQ ID NO: 2812089 - DNA, 20 bp, Homo sapiens
tcttcgctgctagagaaggg

SEQ ID NO: 2812090 - DNA, 19 bp, Homo sapiens
tcttcggggaactcctgga

SEQ ID NO: 2812091 - DNA, 15 bp, Homo sapiens
tcttctaaaattgaa

SEQ ID NO: 2812092 - DNA, 16 bp, Homo sapiens
tcttctacaaccagag

SEQ ID NO: 2812093 - DNA, 22 bp, Homo sapiens
tcttctactttcatctattctt

SEQ ID NO: 2812094 - DNA, 13 bp, Homo sapiens
tcttctatttaaa

SEQ ID NO: 2812095 - DNA, 16 bp, Homo sapiens
tcttctatttaaaaaa

SEQ ID NO: 2812096 - DNA, 16 bp, Homo sapiens
tcttctattttattcc

SEQ ID NO: 2812097 - DNA, 12 bp, Homo sapiens
tcttctccaggc

SEQ ID NO: 2812098 - DNA, 20 bp, Homo sapiens
tcttctcttacgctctctgt

SEQ ID NO: 2812099 - DNA, 22 bp, Homo sapiens
tcttctgaaatgaaacaaataa

SEQ ID NO: 2812100 - DNA, 12 bp, Homo sapiens
tcttctgtcatc

SEQ ID NO: 2812101 - DNA, 13 bp, Homo sapiens
tcttctgtcatcc

SEQ ID NO: 2812102 - DNA, 17 bp, Homo sapiens
tcttctgtcatcccgct

SEQ ID NO: 2812103 - DNA, 13 bp, Homo sapiens
tcttctgttctca

SEQ ID NO: 2812104 - DNA, 12 bp, Homo sapiens
tcttcttatgca

SEQ ID NO: 2812105 - DNA, 14 bp, Homo sapiens
tcttcttcagaaga

SEQ ID NO: 2812106 - DNA, 16 bp, Homo sapiens
tcttcttcagaagaca

SEQ ID NO: 2812107 - DNA, 14 bp, Homo sapiens
tcttcttcttcaga

SEQ ID NO: 2812108 - DNA, 18 bp, Homo sapiens
tcttctttttttgtgatg

SEQ ID NO: 2812109 - DNA, 14 bp, Homo sapiens
tcttgaaagctgtg

SEQ ID NO: 2812110 - DNA, 15 bp, Homo sapiens
tcttgaactcctggc

SEQ ID NO: 2812111 - DNA, 16 bp, Homo sapiens
tcttgatgttgcttag

SEQ ID NO: 2812112 - DNA, 22 bp, Homo sapiens
tcttgcaatggcagccttggca

SEQ ID NO: 2812113 - DNA, 23 bp, Homo sapiens
tcttgcatggcaaggactgcagg

SEQ ID NO: 2812114 - DNA, 12 bp, Homo sapiens
tcttgccagcca

SEQ ID NO: 2812115 - DNA, 18 bp, Homo sapiens
tcttgcctgccagggccc

SEQ ID NO: 2812116 - DNA, 18 bp, Homo sapiens
tcttgcctttccacctgc

SEQ ID NO: 2812117 - DNA, 19 bp, Homo sapiens
tcttgcctttccacctgct

SEQ ID NO: 2812118 - DNA, 22 bp, Homo sapiens
tcttgcctttccacctgctttc

SEQ ID NO: 2812119 - DNA, 23 bp, Homo sapiens
tcttgcctttccacctgctttct

SEQ ID NO: 2812120 - DNA, 18 bp, Homo sapiens
tcttgctcaaaaatctgt

SEQ ID NO: 2812121 - DNA, 11 bp, Homo sapiens
tcttgctctgc

SEQ ID NO: 2812122 - DNA, 12 bp, Homo sapiens
tcttgctctgct

SEQ ID NO: 2812123 - DNA, 23 bp, Homo sapiens
tcttgctctgctgacagacacag

SEQ ID NO: 2812124 - DNA, 22 bp, Homo sapiens
tgaattgcctgcagagagaagc

SEQ ID NO: 2812125 - DNA, 16 bp, Homo sapiens
tgaatttatctgaata

SEQ ID NO: 2812126 - DNA, 17 bp, Homo sapiens
tgaatttttaaacaagt

SEQ ID NO: 2812127 - DNA, 16 bp, Homo sapiens
tgaatttttttttcct

SEQ ID NO: 2812128 - DNA, 20 bp, Homo sapiens
tgaatttttttttcctagcc

SEQ ID NO: 2812129 - DNA, 15 bp, Homo sapiens
tgacaaaatatataa

SEQ ID NO: 2812130 - DNA, 20 bp, Homo sapiens
tgacaaaatatataatggtt

SEQ ID NO: 2812131 - DNA, 17 bp, Homo sapiens
tgacaaagaaacccaag

SEQ ID NO: 2812132 - DNA, 14 bp, Homo sapiens
tgacaacctttgtg

SEQ ID NO: 2812133 - DNA, 17 bp, Homo sapiens
tgacaacctttgtgtaa

SEQ ID NO: 2812134 - DNA, 13 bp, Homo sapiens
tgacacacagcac

SEQ ID NO: 2812135 - DNA, 14 bp, Homo sapiens
tgacacacagcact

SEQ ID NO: 2812136 - DNA, 18 bp, Homo sapiens
tgacacacagctctgtcc

SEQ ID NO: 2812137 - DNA, 21 bp, Homo sapiens
tgacacacagctctgtcctgg

SEQ ID NO: 2812138 - DNA, 21 bp, Homo sapiens
tgacacataatttgaatggtg

SEQ ID NO: 2812139 - DNA, 17 bp, Homo sapiens
tgacagaacactgtctt

SEQ ID NO: 2812140 - DNA, 21 bp, Homo sapiens
tgacagaacactgtcttgaag

SEQ ID NO: 2812141 - DNA, 17 bp, Homo sapiens
tgacagacacaggcccg

SEQ ID NO: 2812142 - DNA, 18 bp, Homo sapiens
tgacagacacaggcccgg

SEQ ID NO: 2812143 - DNA, 23 bp, Homo sapiens
tgacagacacaggcccggctcca

SEQ ID NO: 2812144 - DNA, 17 bp, Homo sapiens
tgacagagacccagatc

SEQ ID NO: 2812145 - DNA, 15 bp, Homo sapiens
tgacagaggcagccc

SEQ ID NO: 2812146 - DNA, 19 bp, Homo sapiens
tgacagagtgagactctgt

SEQ ID NO: 2812147 - DNA, 12 bp, Homo sapiens
tgacagccagag

SEQ ID NO: 2812148 - DNA, 14 bp, Homo sapiens
tgacagctgtccct

SEQ ID NO: 2812149 - DNA, 21 bp, Homo sapiens
tgacagctgtccctgtcacca

SEQ ID NO: 2812150 - DNA, 21 bp, Homo sapiens
tgacaggaagcccaaggcagt

SEQ ID NO: 2812151 - DNA, 17 bp, Homo sapiens
tgacaggcaatgctggc

SEQ ID NO: 2812152 - DNA, 16 bp, Homo sapiens
tgacagggcacaccgg

SEQ ID NO: 2812153 - DNA, 20 bp, Homo sapiens
tgacagggcacaccgggcac

SEQ ID NO: 2812154 - DNA, 16 bp, Homo sapiens
tgacagtgttgaaaat

SEQ ID NO: 2812155 - DNA, 21 bp, Homo sapiens
tgacataacactataaaggtt

SEQ ID NO: 2812156 - DNA, 16 bp, Homo sapiens
tgacatcacttgtaca

SEQ ID NO: 2812157 - DNA, 13 bp, Homo sapiens
tgacatctctttg

SEQ ID NO: 2812158 - DNA, 16 bp, Homo sapiens
tgacatcttcaaagct

SEQ ID NO: 2812159 - DNA, 16 bp, Homo sapiens
tgacatgtccctacac

SEQ ID NO: 2812160 - DNA, 15 bp, Homo sapiens
tgacattcaaggcat

SEQ ID NO: 2812161 - DNA, 22 bp, Homo sapiens
tgacattgtagagcttctggca

SEQ ID NO: 2812162 - DNA, 20 bp, Homo sapiens
tgacattgttggccaaagcc

SEQ ID NO: 2812163 - DNA, 16 bp, Homo sapiens
tgaccaaaagttacat

SEQ ID NO: 2812164 - DNA, 17 bp, Homo sapiens
tgaccaacatggagaaa

SEQ ID NO: 2812165 - DNA, 15 bp, Homo sapiens
tgaccaagatactta

SEQ ID NO: 2812166 - DNA, 20 bp, Homo sapiens
tgaccaagttataaatcaat

SEQ ID NO: 2812167 - DNA, 16 bp, Homo sapiens
tgaccaatctctgtga

SEQ ID NO: 2812168 - DNA, 22 bp, Homo sapiens
tgaccacgctttctagctgttg

SEQ ID NO: 2812169 - DNA, 20 bp, Homo sapiens
tgaccacggacgtttccatc

SEQ ID NO: 2812170 - DNA, 22 bp, Homo sapiens
tgaccacggacgtttccatcag

SEQ ID NO: 2812171 - DNA, 21 bp, Homo sapiens
tgaccagcctccatgctgcct

SEQ ID NO: 2812172 - DNA, 22 bp, Homo sapiens
tgaccagcctccatgctgcctc

SEQ ID NO: 2812173 - DNA, 23 bp, Homo sapiens
tgaccagcctccatgctgcctcc

SEQ ID NO: 2812174 - DNA, 16 bp, Homo sapiens
tgacccaaagaccaat

SEQ ID NO: 2812175 - DNA, 13 bp, Homo sapiens
tgacccacagcct

SEQ ID NO: 2812176 - DNA, 15 bp, Homo sapiens
tgacccacagcctct

SEQ ID NO: 2812177 - DNA, 20 bp, Homo sapiens
tgacccacagcctctgcctg

SEQ ID NO: 2812178 - DNA, 15 bp, Homo sapiens
tgacccacatgccat

SEQ ID NO: 2812179 - DNA, 13 bp, Homo sapiens
tgacccactgctt

SEQ ID NO: 2812180 - DNA, 21 bp, Homo sapiens
tgacccagccccttgagaaac

SEQ ID NO: 2812181 - DNA, 20 bp, Homo sapiens
tgacccagtccctgggggaa

SEQ ID NO: 2812182 - DNA, 11 bp, Homo sapiens
tgaccccaggg

SEQ ID NO: 2812183 - DNA, 17 bp, Homo sapiens
tgaccccagggcacagg

SEQ ID NO: 2812184 - DNA, 19 bp, Homo sapiens
tgaccccagggcacaggag

SEQ ID NO: 2812185 - DNA, 22 bp, Homo sapiens
tgaccccagggcacaggagcta

SEQ ID NO: 2812186 - DNA, 22 bp, Homo sapiens
tgacccccaaccaagtggctcc

SEQ ID NO: 2812187 - DNA, 23 bp, Homo sapiens
tgaccctctgaatggtccagggt

SEQ ID NO: 2812188 - DNA, 21 bp, Homo sapiens
tgaccctgcgaaggggccctg

SEQ ID NO: 2812189 - DNA, 23 bp, Homo sapiens
tgaccctggagcggctctcctga

SEQ ID NO: 2812190 - DNA, 17 bp, Homo sapiens
tgacctatacctgtgtt

SEQ ID NO: 2812191 - DNA, 20 bp, Homo sapiens
tgacctcaggtgatccaccc

SEQ ID NO: 2812192 - DNA, 16 bp, Homo sapiens
tgacctcccagcccta

SEQ ID NO: 2812193 - DNA, 22 bp, Homo sapiens
tgacctcccagccctatggatg

SEQ ID NO: 2812194 - DNA, 12 bp, Homo sapiens
tgacctctgcct

SEQ ID NO: 2812195 - DNA, 11 bp, Homo sapiens
tgacctgcagg

SEQ ID NO: 2812196 - DNA, 20 bp, Homo sapiens
tgacctgcaggccaagagca

SEQ ID NO: 2812197 - DNA, 20 bp, Homo sapiens
tgacctgccccgcccagctg

SEQ ID NO: 2812198 - DNA, 19 bp, Homo sapiens
tgacctgctgagctctgag

SEQ ID NO: 2812199 - DNA, 21 bp, Homo sapiens
tgacctgctgagctctgagag

SEQ ID NO: 2812200 - DNA, 12 bp, Homo sapiens
tgacctgtcacc

SEQ ID NO: 2812201 - DNA, 23 bp, Homo sapiens
tgacggtcccacactggtgactg

SEQ ID NO: 2812202 - DNA, 23 bp, Homo sapiens
tgacgtgcacctgtactcaggag

SEQ ID NO: 2812203 - DNA, 21 bp, Homo sapiens
tgactagaggcagggagggga

SEQ ID NO: 2812204 - DNA, 17 bp, Homo sapiens
tgactaggaagaaaaca

SEQ ID NO: 2812205 - DNA, 22 bp, Homo sapiens
tgactataaacattaaaagaag

SEQ ID NO: 2812206 - DNA, 16 bp, Homo sapiens
tgactatcaaactgaa

SEQ ID NO: 2812207 - DNA, 22 bp, Homo sapiens
tgactatcaaactgaagccaga

SEQ ID NO: 2812208 - DNA, 15 bp, Homo sapiens
tgactatcacataca

SEQ ID NO: 2812209 - DNA, 23 bp, Homo sapiens
tgactatcacatacaatttgcac

SEQ ID NO: 2812210 - DNA, 21 bp, Homo sapiens
tgactcaagtttttacaaaat

SEQ ID NO: 2812211 - DNA, 20 bp, Homo sapiens
tgactcacaagaagaccaga

SEQ ID NO: 2812212 - DNA, 12 bp, Homo sapiens
tgactcacccaa

SEQ ID NO: 2812213 - DNA, 15 bp, Homo sapiens
tgactcacccaagca

SEQ ID NO: 2812214 - DNA, 19 bp, Homo sapiens
tgagctgagatcgtgccgt

SEQ ID NO: 2812215 - DNA, 19 bp, Homo sapiens
tgagctggccctttccagc

SEQ ID NO: 2812216 - DNA, 11 bp, Homo sapiens
tgagctgtttt

SEQ ID NO: 2812217 - DNA, 15 bp, Homo sapiens
tgagcttatcatgct

SEQ ID NO: 2812218 - DNA, 15 bp, Homo sapiens
tgagcttctctgtga

SEQ ID NO: 2812219 - DNA, 19 bp, Homo sapiens
tgagcttggcagctgaact

SEQ ID NO: 2812220 - DNA, 16 bp, Homo sapiens
tgaggaacctcaaact

SEQ ID NO: 2812221 - DNA, 18 bp, Homo sapiens
tgaggaacctcaaactgg

SEQ ID NO: 2812222 - DNA, 19 bp, Homo sapiens
tgaggaatatgactgtttt

SEQ ID NO: 2812223 - DNA, 19 bp, Homo sapiens
tgaggacaaccattccaga

SEQ ID NO: 2812224 - DNA, 14 bp, Homo sapiens
tgaggacacatgtc

SEQ ID NO: 2812225 - DNA, 17 bp, Homo sapiens
tgaggagtctgaggtcc

SEQ ID NO: 2812226 - DNA, 23 bp, Homo sapiens
tgaggattatgggtcctgcaatt

SEQ ID NO: 2812227 - DNA, 13 bp, Homo sapiens
tgaggatttcaag

SEQ ID NO: 2812228 - DNA, 13 bp, Homo sapiens
tgaggcagacagc

SEQ ID NO: 2812229 - DNA, 23 bp, Homo sapiens
tgaggcagacagcagctcaggca

SEQ ID NO: 2812230 - DNA, 24 bp, Homo sapiens
tgaggcagacagcagctcaggcac

SEQ ID NO: 2812231 - DNA, 15 bp, Homo sapiens
tgaggccagcctggc

SEQ ID NO: 2812232 - DNA, 16 bp, Homo sapiens
tgaggccagcctggcc

SEQ ID NO: 2812233 - DNA, 17 bp, Homo sapiens
tgaggccagcctggcct

SEQ ID NO: 2812234 - DNA, 13 bp, Homo sapiens
tgaggccaggagt

SEQ ID NO: 2812235 - DNA, 12 bp, Homo sapiens
tgaggccgcccg

SEQ ID NO: 2812236 - DNA, 21 bp, Homo sapiens
tgaggcctcttggacctctgc

SEQ ID NO: 2812237 - DNA, 18 bp, Homo sapiens
tgaggcctgccctcaggg

SEQ ID NO: 2812238 - DNA, 14 bp, Homo sapiens
tgaggcctggccag

SEQ ID NO: 2812239 - DNA, 15 bp, Homo sapiens
tgaggcctggccagg

SEQ ID NO: 2812240 - DNA, 18 bp, Homo sapiens
tgaggcctttccccagtg

SEQ ID NO: 2812241 - DNA, 19 bp, Homo sapiens
tgaggcctttccccagtgt

SEQ ID NO: 2812242 - DNA, 15 bp, Homo sapiens
tgaggctggcactcc

SEQ ID NO: 2812243 - DNA, 21 bp, Homo sapiens
tgaggctgggggcgggggagc

SEQ ID NO: 2812244 - DNA, 14 bp, Homo sapiens
tgagggaaaacata

SEQ ID NO: 2812245 - DNA, 18 bp, Homo sapiens
tgagggactggaaccagg

SEQ ID NO: 2812246 - DNA, 16 bp, Homo sapiens
tgagggcagcagccag

SEQ ID NO: 2812247 - DNA, 20 bp, Homo sapiens
tgagggcagcagccagccct

SEQ ID NO: 2812248 - DNA, 21 bp, Homo sapiens
tgaggggaggatcactggagc

SEQ ID NO: 2812249 - DNA, 22 bp, Homo sapiens
tgaggggaggatcactggagcc

SEQ ID NO: 2812250 - DNA, 14 bp, Homo sapiens
tgaggggctcctgg

SEQ ID NO: 2812251 - DNA, 14 bp, Homo sapiens
tgagggtggagact

SEQ ID NO: 2812252 - DNA, 17 bp, Homo sapiens
tgaggtcagagcctgca

SEQ ID NO: 2812253 - DNA, 19 bp, Homo sapiens
tgaggtcagagcctgcagt

SEQ ID NO: 2812254 - DNA, 17 bp, Homo sapiens
tgaggtcccaggcagag

SEQ ID NO: 2812255 - DNA, 13 bp, Homo sapiens
tgaggtcctgagc

SEQ ID NO: 2812256 - DNA, 14 bp, Homo sapiens
tgaggtcctgagca

SEQ ID NO: 2812257 - DNA, 22 bp, Homo sapiens
tgaggtcctgagcactgccagg

SEQ ID NO: 2812258 - DNA, 23 bp, Homo sapiens
tgaggtcctgagcactgccagga

SEQ ID NO: 2812259 - DNA, 12 bp, Homo sapiens
tgaggtgcccag

SEQ ID NO: 2812260 - DNA, 13 bp, Homo sapiens
tgaggtgcccagg

SEQ ID NO: 2812261 - DNA, 15 bp, Homo sapiens
tgaggtgcccaggag

SEQ ID NO: 2812262 - DNA, 15 bp, Homo sapiens
tgaggtggaagccct

SEQ ID NO: 2812263 - DNA, 16 bp, Homo sapiens
tgaggtggaagccctc

SEQ ID NO: 2812264 - DNA, 17 bp, Homo sapiens
tgaggtggaagccctcc

SEQ ID NO: 2812265 - DNA, 21 bp, Homo sapiens
tgagtaattctagctttcaaa

SEQ ID NO: 2812266 - DNA, 18 bp, Homo sapiens
tgagtcgaggacagggag

SEQ ID NO: 2812267 - DNA, 14 bp, Homo sapiens
tgagtctcttcaga

SEQ ID NO: 2812268 - DNA, 21 bp, Homo sapiens
tgagtctttaacatcttgaac

SEQ ID NO: 2812269 - DNA, 15 bp, Homo sapiens
tgagtgagccacaga

SEQ ID NO: 2812270 - DNA, 22 bp, Homo sapiens
tgagtgattgacacacagcact

SEQ ID NO: 2812271 - DNA, 23 bp, Homo sapiens
tgagttgacttgacagaacactg

SEQ ID NO: 2812272 - DNA, 17 bp, Homo sapiens
tgagtttaagtctctga

SEQ ID NO: 2812273 - DNA, 12 bp, Homo sapiens
tgagtttatggg

SEQ ID NO: 2812274 - DNA, 22 bp, Homo sapiens
tgagtttatgggaatgcctttt

SEQ ID NO: 2812275 - DNA, 19 bp, Homo sapiens
tgagtttttatggggctga

SEQ ID NO: 2812276 - DNA, 16 bp, Homo sapiens
tgataaacattaaaca

SEQ ID NO: 2812277 - DNA, 18 bp, Homo sapiens
tgataatgaacagaacat

SEQ ID NO: 2812278 - DNA, 14 bp, Homo sapiens
tgatagattttctg

SEQ ID NO: 2812279 - DNA, 13 bp, Homo sapiens
tgatagctttatt

SEQ ID NO: 2812280 - DNA, 16 bp, Homo sapiens
tgatatagaaagctgt

SEQ ID NO: 2812281 - DNA, 17 bp, Homo sapiens
tgatatagaaagctgtt

SEQ ID NO: 2812282 - DNA, 14 bp, Homo sapiens
tgatatatgtattt

SEQ ID NO: 2812283 - DNA, 15 bp, Homo sapiens
tgatatatgtattta

SEQ ID NO: 2812284 - DNA, 14 bp, Homo sapiens
tgatatattttcca

SEQ ID NO: 2812285 - DNA, 16 bp, Homo sapiens
tgatatcccccagcct

SEQ ID NO: 2812286 - DNA, 17 bp, Homo sapiens
tgatatctgaacacata

SEQ ID NO: 2812287 - DNA, 11 bp, Homo sapiens
tgatatgaaaa

SEQ ID NO: 2812288 - DNA, 15 bp, Homo sapiens
tgatatgaaaaatat

SEQ ID NO: 2812289 - DNA, 19 bp, Homo sapiens
tgatatgaaaaatatgata

SEQ ID NO: 2812290 - DNA, 21 bp, Homo sapiens
tgatatgtaaacataattctt

SEQ ID NO: 2812291 - DNA, 13 bp, Homo sapiens
tgatattaaagga

SEQ ID NO: 2812292 - DNA, 17 bp, Homo sapiens
tgatattgcatatgcat

SEQ ID NO: 2812293 - DNA, 17 bp, Homo sapiens
tgatcaattaaatgtag

SEQ ID NO: 2812294 - DNA, 13 bp, Homo sapiens
tgatcacggctca

SEQ ID NO: 2812295 - DNA, 21 bp, Homo sapiens
tgatcactttgttaaaaatat

SEQ ID NO: 2812296 - DNA, 22 bp, Homo sapiens
tgatcactttgttaaaaatatt

SEQ ID NO: 2812297 - DNA, 16 bp, Homo sapiens
tgatcagctgtttgtc

SEQ ID NO: 2812298 - DNA, 18 bp, Homo sapiens
tgatcagtatgctgtttt

SEQ ID NO: 2812299 - DNA, 13 bp, Homo sapiens
tgatcatccactg

SEQ ID NO: 2812300 - DNA, 13 bp, Homo sapiens
tgatccaagctgg

SEQ ID NO: 2812301 - DNA, 14 bp, Homo sapiens
tgatccaagctggt

SEQ ID NO: 2812302 - DNA, 16 bp, Homo sapiens
tgatccacccacctca

SEQ ID NO: 2812303 - DNA, 18 bp, Homo sapiens
tgatccacccacctcagc

SEQ ID NO: 2812304 - DNA, 19 bp, Homo sapiens
tgatccacccacctcagcc

SEQ ID NO: 2812305 - DNA, 16 bp, Homo sapiens
tgcaatggcagccttg

SEQ ID NO: 2812306 - DNA, 15 bp, Homo sapiens
tgcaattgcttagga

SEQ ID NO: 2812307 - DNA, 15 bp, Homo sapiens
tgcaatttttaaact

SEQ ID NO: 2812308 - DNA, 17 bp, Homo sapiens
tgcaatttttaaactag

SEQ ID NO: 2812309 - DNA, 17 bp, Homo sapiens
tgcacaaagcccttcca

SEQ ID NO: 2812310 - DNA, 16 bp, Homo sapiens
tgcacaagcttgtata

SEQ ID NO: 2812311 - DNA, 18 bp, Homo sapiens
tgcacaagcttgtatata

SEQ ID NO: 2812312 - DNA, 11 bp, Homo sapiens
tgcacaattta

SEQ ID NO: 2812313 - DNA, 15 bp, Homo sapiens
tgcacaatttgagca

SEQ ID NO: 2812314 - DNA, 19 bp, Homo sapiens
tgcacactagcctctccag

SEQ ID NO: 2812315 - DNA, 14 bp, Homo sapiens
tgcacacttgtata

SEQ ID NO: 2812316 - DNA, 18 bp, Homo sapiens
tgcacatatggactctgc

SEQ ID NO: 2812317 - DNA, 15 bp, Homo sapiens
tgcacatgtcttgta

SEQ ID NO: 2812318 - DNA, 19 bp, Homo sapiens
tgcacatgtcttgtacatg

SEQ ID NO: 2812319 - DNA, 16 bp, Homo sapiens
tgcacatttatatata

SEQ ID NO: 2812320 - DNA, 23 bp, Homo sapiens
tgcacattttgtacaaagatatg

SEQ ID NO: 2812321 - DNA, 13 bp, Homo sapiens
tgcaccagccctt

SEQ ID NO: 2812322 - DNA, 23 bp, Homo sapiens
tgcaccagcccttccctgctttg

SEQ ID NO: 2812323 - DNA, 17 bp, Homo sapiens
tgcaccagtgccgcctg

SEQ ID NO: 2812324 - DNA, 16 bp, Homo sapiens
tgcacccatgccatag

SEQ ID NO: 2812325 - DNA, 15 bp, Homo sapiens
tgcacccctccccat

SEQ ID NO: 2812326 - DNA, 18 bp, Homo sapiens
tgcacccctccccattca

SEQ ID NO: 2812327 - DNA, 15 bp, Homo sapiens
tgcacccttcctcct

SEQ ID NO: 2812328 - DNA, 14 bp, Homo sapiens
tgcaccgggccaca

SEQ ID NO: 2812329 - DNA, 16 bp, Homo sapiens
tgcacctaaagaaaaa

SEQ ID NO: 2812330 - DNA, 17 bp, Homo sapiens
tgcacctccccccactg

SEQ ID NO: 2812331 - DNA, 20 bp, Homo sapiens
tgcacctccccccactgcag

SEQ ID NO: 2812332 - DNA, 18 bp, Homo sapiens
tgcacctgcatccgtagt

SEQ ID NO: 2812333 - DNA, 18 bp, Homo sapiens
tgcacctgccagcctggc

SEQ ID NO: 2812334 - DNA, 20 bp, Homo sapiens
tgcacctgtactcaggaggc

SEQ ID NO: 2812335 - DNA, 16 bp, Homo sapiens
tgcaccttgtgtctgt

SEQ ID NO: 2812336 - DNA, 12 bp, Homo sapiens
tgcacgccgtgg

SEQ ID NO: 2812337 - DNA, 16 bp, Homo sapiens
tgcacgtacacacaca

SEQ ID NO: 2812338 - DNA, 20 bp, Homo sapiens
tgcacgtgctcttctgttct

SEQ ID NO: 2812339 - DNA, 14 bp, Homo sapiens
tgcacgtgtgtgca

SEQ ID NO: 2812340 - DNA, 15 bp, Homo sapiens
tgcacgtgtgtgcac

SEQ ID NO: 2812341 - DNA, 16 bp, Homo sapiens
tgcactccagcctggg

SEQ ID NO: 2812342 - DNA, 18 bp, Homo sapiens
tgcactgacccacagcct

SEQ ID NO: 2812343 - DNA, 22 bp, Homo sapiens
tgcactgacccacagcctctgc

SEQ ID NO: 2812344 - DNA, 16 bp, Homo sapiens
tgcacttgcagactct

SEQ ID NO: 2812345 - DNA, 16 bp, Homo sapiens
tgcacttggctgcata

SEQ ID NO: 2812346 - DNA, 18 bp, Homo sapiens
tgcagaaaagcacctgcc

SEQ ID NO: 2812347 - DNA, 21 bp, Homo sapiens
tgcagaaaagcacctgccgac

SEQ ID NO: 2812348 - DNA, 13 bp, Homo sapiens
tgcagaaggccaa

SEQ ID NO: 2812349 - DNA, 15 bp, Homo sapiens
tgcagaaggccaaga

SEQ ID NO: 2812350 - DNA, 22 bp, Homo sapiens
tgcagacaggcaagcacctcct

SEQ ID NO: 2812351 - DNA, 14 bp, Homo sapiens
tgcagactcagttt

SEQ ID NO: 2812352 - DNA, 17 bp, Homo sapiens
tgcagactctacagagg

SEQ ID NO: 2812353 - DNA, 22 bp, Homo sapiens
tgcagactctacagaggccatg

SEQ ID NO: 2812354 - DNA, 14 bp, Homo sapiens
tgcagactgtggct

SEQ ID NO: 2812355 - DNA, 15 bp, Homo sapiens
tgcagactgtggctg

SEQ ID NO: 2812356 - DNA, 22 bp, Homo sapiens
tgcagactgtggctgcagagac

SEQ ID NO: 2812357 - DNA, 17 bp, Homo sapiens
tgcagagacaggacctg

SEQ ID NO: 2812358 - DNA, 20 bp, Homo sapiens
tgcagagacaggacctgact

SEQ ID NO: 2812359 - DNA, 15 bp, Homo sapiens
tgcagagagaagcct

SEQ ID NO: 2812360 - DNA, 18 bp, Homo sapiens
tgcagagcacacaggtac

SEQ ID NO: 2812361 - DNA, 13 bp, Homo sapiens
tgcagaggggaaa

SEQ ID NO: 2812362 - DNA, 21 bp, Homo sapiens
tgcagatctttttgtgaaatt

SEQ ID NO: 2812363 - DNA, 22 bp, Homo sapiens
tgcagatgagcagtcacactgt

SEQ ID NO: 2812364 - DNA, 22 bp, Homo sapiens
tgcagattattttagtctgtca

SEQ ID NO: 2812365 - DNA, 19 bp, Homo sapiens
tgcagcactttaaccctct

SEQ ID NO: 2812366 - DNA, 18 bp, Homo sapiens
tgcagcagtgagtctctt

SEQ ID NO: 2812367 - DNA, 16 bp, Homo sapiens
tgcagccagcccagcc

SEQ ID NO: 2812368 - DNA, 17 bp, Homo sapiens
tgcagccagcccagccc

SEQ ID NO: 2812369 - DNA, 19 bp, Homo sapiens
tgcagccagcccagcccag

SEQ ID NO: 2812370 - DNA, 22 bp, Homo sapiens
tgcagccagcccagcccagctg

SEQ ID NO: 2812371 - DNA, 21 bp, Homo sapiens
tgcagccccgcgcctccttcc

SEQ ID NO: 2812372 - DNA, 20 bp, Homo sapiens
tgcagcctcaacctcctggg

SEQ ID NO: 2812373 - DNA, 23 bp, Homo sapiens
tgcagcctcaacctcctgggcta

SEQ ID NO: 2812374 - DNA, 16 bp, Homo sapiens
tgcagcctcctcctga

SEQ ID NO: 2812375 - DNA, 15 bp, Homo sapiens
tgcagcctggtagaa

SEQ ID NO: 2812376 - DNA, 20 bp, Homo sapiens
cagctccctaggagaccaag

SEQ ID NO: 2812377 - DNA, 15 bp, Homo sapiens
cagctcctctgtctc

SEQ ID NO: 2812378 - DNA, 19 bp, Homo sapiens
cagctcctgggcagcttga

SEQ ID NO: 2812379 - DNA, 17 bp, Homo sapiens
cagctccttctgtccta

SEQ ID NO: 2812380 - DNA, 21 bp, Homo sapiens
cagctccttctgtcctactct

SEQ ID NO: 2812381 - DNA, 15 bp, Homo sapiens
cagctctactggtct

SEQ ID NO: 2812382 - DNA, 20 bp, Homo sapiens
cagctctagacactgccaca

SEQ ID NO: 2812383 - DNA, 12 bp, Homo sapiens
cagctctcagcc

SEQ ID NO: 2812384 - DNA, 12 bp, Homo sapiens
cagctctccctc

SEQ ID NO: 2812385 - DNA, 19 bp, Homo sapiens
cagctctccctctggccct

SEQ ID NO: 2812386 - DNA, 14 bp, Homo sapiens
cagctctggcttcc

SEQ ID NO: 2812387 - DNA, 14 bp, Homo sapiens
cagctctgtcctgg

SEQ ID NO: 2812388 - DNA, 18 bp, Homo sapiens
cagctctgtcctgggagt

SEQ ID NO: 2812389 - DNA, 23 bp, Homo sapiens
cagctctgtcctgggagtgagct

SEQ ID NO: 2812390 - DNA, 13 bp, Homo sapiens
cagctcttctcca

SEQ ID NO: 2812391 - DNA, 17 bp, Homo sapiens
cagctcttctccaggct

SEQ ID NO: 2812392 - DNA, 23 bp, Homo sapiens
cagctcttctccaggctgtatcc

SEQ ID NO: 2812393 - DNA, 15 bp, Homo sapiens
cagctcttggcccct

SEQ ID NO: 2812394 - DNA, 16 bp, Homo sapiens
cagctctttgttcagt

SEQ ID NO: 2812395 - DNA, 15 bp, Homo sapiens
cagctgaacagccaa

SEQ ID NO: 2812396 - DNA, 19 bp, Homo sapiens
cagctgacacataatttga

SEQ ID NO: 2812397 - DNA, 21 bp, Homo sapiens
cagctgacacataatttgaat

SEQ ID NO: 2812398 - DNA, 13 bp, Homo sapiens
cagctgagcaggg

SEQ ID NO: 2812399 - DNA, 16 bp, Homo sapiens
cagctgagcagggccg

SEQ ID NO: 2812400 - DNA, 20 bp, Homo sapiens
cagctgagcagggccgggga

SEQ ID NO: 2812401 - DNA, 13 bp, Homo sapiens
cagctgaggctgg

SEQ ID NO: 2812402 - DNA, 18 bp, Homo sapiens
cagctgcacctgccagcc

SEQ ID NO: 2812403 - DNA, 21 bp, Homo sapiens
cagctgcacctgccagcctgg

SEQ ID NO: 2812404 - DNA, 22 bp, Homo sapiens
cagctgcacctgccagcctggc

SEQ ID NO: 2812405 - DNA, 23 bp, Homo sapiens
cagctgcttttgtctatgggact

SEQ ID NO: 2812406 - DNA, 20 bp, Homo sapiens
cagctggaattgctgctctc

SEQ ID NO: 2812407 - DNA, 21 bp, Homo sapiens
cagctggaattgctgctctct

SEQ ID NO: 2812408 - DNA, 19 bp, Homo sapiens
cagctggtggtatctgagt

SEQ ID NO: 2812409 - DNA, 18 bp, Homo sapiens
cagctgtcatcaattaaa

SEQ ID NO: 2812410 - DNA, 15 bp, Homo sapiens
cagctgtcattcagg

SEQ ID NO: 2812411 - DNA, 13 bp, Homo sapiens
cagctgtgcctcg

SEQ ID NO: 2812412 - DNA, 20 bp, Homo sapiens
cagctgtgcctcgctcccca

SEQ ID NO: 2812413 - DNA, 18 bp, Homo sapiens
cagctgtgctctggacag

SEQ ID NO: 2812414 - DNA, 14 bp, Homo sapiens
cagctgtttgtcat

SEQ ID NO: 2812415 - DNA, 19 bp, Homo sapiens
cagcttatggggtatttta

SEQ ID NO: 2812416 - DNA, 17 bp, Homo sapiens
cagcttcatttccgtga

SEQ ID NO: 2812417 - DNA, 21 bp, Homo sapiens
cagcttcatttccgtgaaggg

SEQ ID NO: 2812418 - DNA, 19 bp, Homo sapiens
cagcttcatttcctgtgtc

SEQ ID NO: 2812419 - DNA, 12 bp, Homo sapiens
cagcttcctgtc

SEQ ID NO: 2812420 - DNA, 16 bp, Homo sapiens
cagcttgagcctgtca

SEQ ID NO: 2812421 - DNA, 14 bp, Homo sapiens
cagcttgagggttg

SEQ ID NO: 2812422 - DNA, 15 bp, Homo sapiens
cagcttgagggttgg

SEQ ID NO: 2812423 - DNA, 18 bp, Homo sapiens
cagcttgagggttgggct

SEQ ID NO: 2812424 - DNA, 19 bp, Homo sapiens
cagcttgagggttgggctg

SEQ ID NO: 2812425 - DNA, 23 bp, Homo sapiens
cagcttgctcttcagtgggagaa

SEQ ID NO: 2812426 - DNA, 22 bp, Homo sapiens
cagcttgtaaatagctcaggtg

SEQ ID NO: 2812427 - DNA, 12 bp, Homo sapiens
cagcttgtagcc

SEQ ID NO: 2812428 - DNA, 19 bp, Homo sapiens
cagcttgtagccagccggg

SEQ ID NO: 2812429 - DNA, 18 bp, Homo sapiens
cagcttgtggcaagtgaa

SEQ ID NO: 2812430 - DNA, 22 bp, Homo sapiens
cagctttgctaccaaagcacct

SEQ ID NO: 2812431 - DNA, 15 bp, Homo sapiens
cagcttttaataaaa

SEQ ID NO: 2812432 - DNA, 19 bp, Homo sapiens
caggaaaactgacagagga

SEQ ID NO: 2812433 - DNA, 17 bp, Homo sapiens
caggaaaactgtttttc

SEQ ID NO: 2812434 - DNA, 18 bp, Homo sapiens
caggaaaactgtttttca

SEQ ID NO: 2812435 - DNA, 13 bp, Homo sapiens
caggaaaaggcct

SEQ ID NO: 2812436 - DNA, 14 bp, Homo sapiens
caggaaaaggcctg

SEQ ID NO: 2812437 - DNA, 16 bp, Homo sapiens
caggaaaatcctctgg

SEQ ID NO: 2812438 - DNA, 13 bp, Homo sapiens
caggaaaattgaa

SEQ ID NO: 2812439 - DNA, 17 bp, Homo sapiens
caggaaaattgaatgca

SEQ ID NO: 2812440 - DNA, 16 bp, Homo sapiens
caggaactcccagcaa

SEQ ID NO: 2812441 - DNA, 21 bp, Homo sapiens
caggaagatgaaagaggaggt

SEQ ID NO: 2812442 - DNA, 19 bp, Homo sapiens
caggaagccaggctgagtg

SEQ ID NO: 2812443 - DNA, 16 bp, Homo sapiens
caggaagcccaaggca

SEQ ID NO: 2812444 - DNA, 19 bp, Homo sapiens
caggaaggactatgaaaag

SEQ ID NO: 2812445 - DNA, 23 bp, Homo sapiens
caggaagggggtccacccagcaa

SEQ ID NO: 2812446 - DNA, 21 bp, Homo sapiens
caggaaggtagcccagcactg

SEQ ID NO: 2812447 - DNA, 22 bp, Homo sapiens
caggaaggtagcccagcactgt

SEQ ID NO: 2812448 - DNA, 23 bp, Homo sapiens
caggaataaggccttaatatgtt

SEQ ID NO: 2812449 - DNA, 18 bp, Homo sapiens
caggaatcaaaaattgaa

SEQ ID NO: 2812450 - DNA, 17 bp, Homo sapiens
caggaatgtgtggcaga

SEQ ID NO: 2812451 - DNA, 18 bp, Homo sapiens
caggaatgttaaagtcag

SEQ ID NO: 2812452 - DNA, 18 bp, Homo sapiens
caggacacaggcctgtgt

SEQ ID NO: 2812453 - DNA, 13 bp, Homo sapiens
caggacaggagac

SEQ ID NO: 2812454 - DNA, 13 bp, Homo sapiens
caggaccaggact

SEQ ID NO: 2812455 - DNA, 15 bp, Homo sapiens
caggacctggcttgg

SEQ ID NO: 2812456 - DNA, 21 bp, Homo sapiens
caggactaacactcagaagcc

SEQ ID NO: 2812457 - DNA, 18 bp, Homo sapiens
caggactccccaggccag

SEQ ID NO: 2812458 - DNA, 20 bp, Homo sapiens
caggactccccaggccaggc

SEQ ID NO: 2812459 - DNA, 15 bp, Homo sapiens
caggactctgcctcc

SEQ ID NO: 2812460 - DNA, 16 bp, Homo sapiens
caggactctgcctcct

SEQ ID NO: 2812461 - DNA, 19 bp, Homo sapiens
caggactgaattgtcccca

SEQ ID NO: 2812462 - DNA, 21 bp, Homo sapiens
caggactgaattgtccccagt

SEQ ID NO: 2812463 - DNA, 19 bp, Homo sapiens
caggacttaacggctccag

SEQ ID NO: 2812464 - DNA, 20 bp, Homo sapiens
caggacttaacggctccagg

SEQ ID NO: 2812465 - DNA, 12 bp, Homo sapiens
caggagacatcc

SEQ ID NO: 2812466 - DNA, 16 bp, Homo sapiens
cactgcaggccccgct

SEQ ID NO: 2812467 - DNA, 15 bp, Homo sapiens
cactgccacaccctc

SEQ ID NO: 2812468 - DNA, 20 bp, Homo sapiens
cactgccacaccctccccat

SEQ ID NO: 2812469 - DNA, 13 bp, Homo sapiens
cactgccaggagg

SEQ ID NO: 2812470 - DNA, 17 bp, Homo sapiens
cactgccccaccagcca

SEQ ID NO: 2812471 - DNA, 20 bp, Homo sapiens
cactgccccaccagccacct

SEQ ID NO: 2812472 - DNA, 20 bp, Homo sapiens
cactgcgtagagcctggaag

SEQ ID NO: 2812473 - DNA, 15 bp, Homo sapiens
cactgctctcagcct

SEQ ID NO: 2812474 - DNA, 16 bp, Homo sapiens
cactgctctcagcctc

SEQ ID NO: 2812475 - DNA, 18 bp, Homo sapiens
cactgctctcagcctccc

SEQ ID NO: 2812476 - DNA, 15 bp, Homo sapiens
cactgctgcccagcc

SEQ ID NO: 2812477 - DNA, 17 bp, Homo sapiens
cactgctgcccagcctc

SEQ ID NO: 2812478 - DNA, 21 bp, Homo sapiens
cactggaatcgatctgtactg

SEQ ID NO: 2812479 - DNA, 11 bp, Homo sapiens
cactggagccc

SEQ ID NO: 2812480 - DNA, 13 bp, Homo sapiens
cactggagcccag

SEQ ID NO: 2812481 - DNA, 15 bp, Homo sapiens
cactggagcccagga

SEQ ID NO: 2812482 - DNA, 20 bp, Homo sapiens
cactggagtgcagggaggag

SEQ ID NO: 2812483 - DNA, 23 bp, Homo sapiens
cactggagtgcagggaggagagg

SEQ ID NO: 2812484 - DNA, 15 bp, Homo sapiens
cactgggggagggga

SEQ ID NO: 2812485 - DNA, 18 bp, Homo sapiens
cactgggggaggggacat

SEQ ID NO: 2812486 - DNA, 15 bp, Homo sapiens
cactggggtcctggg

SEQ ID NO: 2812487 - DNA, 13 bp, Homo sapiens
cactgtaaaatga

SEQ ID NO: 2812488 - DNA, 14 bp, Homo sapiens
cactgtaagtttat

SEQ ID NO: 2812489 - DNA, 22 bp, Homo sapiens
cactgtaagtttattttttcta

SEQ ID NO: 2812490 - DNA, 21 bp, Homo sapiens
cactgtaatcttaaaagtgta

SEQ ID NO: 2812491 - DNA, 16 bp, Homo sapiens
cactgtatgctggacg

SEQ ID NO: 2812492 - DNA, 16 bp, Homo sapiens
cactgtcttgcctgcc

SEQ ID NO: 2812493 - DNA, 18 bp, Homo sapiens
cactgtcttgcctgccag

SEQ ID NO: 2812494 - DNA, 19 bp, Homo sapiens
cactgtgaagacccagcag

SEQ ID NO: 2812495 - DNA, 15 bp, Homo sapiens
cactgtgccatgtgc

SEQ ID NO: 2812496 - DNA, 16 bp, Homo sapiens
cactgtgcttacagtg

SEQ ID NO: 2812497 - DNA, 18 bp, Homo sapiens
cactgtgcttacagtgac

SEQ ID NO: 2812498 - DNA, 16 bp, Homo sapiens
cactgttactccacag

SEQ ID NO: 2812499 - DNA, 21 bp, Homo sapiens
cactgttactttttagtcttt

SEQ ID NO: 2812500 - DNA, 15 bp, Homo sapiens
cactgttgcccaggc

SEQ ID NO: 2812501 - DNA, 18 bp, Homo sapiens
cactgttgcccaggctgg

SEQ ID NO: 2812502 - DNA, 19 bp, Homo sapiens
cactgttgcccaggctggc

SEQ ID NO: 2812503 - DNA, 14 bp, Homo sapiens
cacttaccttcaat

SEQ ID NO: 2812504 - DNA, 16 bp, Homo sapiens
cacttaccttcaataa

SEQ ID NO: 2812505 - DNA, 21 bp, Homo sapiens
cacttcaagtgaccaccagga

SEQ ID NO: 2812506 - DNA, 13 bp, Homo sapiens
cacttctcaggac

SEQ ID NO: 2812507 - DNA, 22 bp, Homo sapiens
cacttctctccaggctgtttct

SEQ ID NO: 2812508 - DNA, 19 bp, Homo sapiens
cacttcttacaataattct

SEQ ID NO: 2812509 - DNA, 23 bp, Homo sapiens
cacttcttcttggtcttatttat

SEQ ID NO: 2812510 - DNA, 16 bp, Homo sapiens
cacttgaggctggcac

SEQ ID NO: 2812511 - DNA, 19 bp, Homo sapiens
cacttgatgacccccaacc

SEQ ID NO: 2812512 - DNA, 22 bp, Homo sapiens
cacttgcagactctacagaggc

SEQ ID NO: 2812513 - DNA, 23 bp, Homo sapiens
cacttggctgcataaatgtggta

SEQ ID NO: 2812514 - DNA, 17 bp, Homo sapiens
cacttgtacaaaataaa

SEQ ID NO: 2812515 - DNA, 22 bp, Homo sapiens
cactttgccccagttacaaaaa

SEQ ID NO: 2812516 - DNA, 19 bp, Homo sapiens
cagaaaaaaaaaaagaaac

SEQ ID NO: 2812517 - DNA, 16 bp, Homo sapiens
cagaaaaactctggga

SEQ ID NO: 2812518 - DNA, 19 bp, Homo sapiens
cagaaaaactctgggaaat

SEQ ID NO: 2812519 - DNA, 14 bp, Homo sapiens
cagaaaaccccagc

SEQ ID NO: 2812520 - DNA, 17 bp, Homo sapiens
cagaaaagaaaaccatt

SEQ ID NO: 2812521 - DNA, 14 bp, Homo sapiens
cagaaaagcacctg

SEQ ID NO: 2812522 - DNA, 16 bp, Homo sapiens
cagaaaagcacctgcc

SEQ ID NO: 2812523 - DNA, 17 bp, Homo sapiens
cagaaaagcacctgccg

SEQ ID NO: 2812524 - DNA, 12 bp, Homo sapiens
cagaaaagtaga

SEQ ID NO: 2812525 - DNA, 22 bp, Homo sapiens
cagaaaagtagaattatatcta

SEQ ID NO: 2812526 - DNA, 22 bp, Homo sapiens
cagaaaagtgcttagaaagtta

SEQ ID NO: 2812527 - DNA, 14 bp, Homo sapiens
cagaaaatataaat

SEQ ID NO: 2812528 - DNA, 15 bp, Homo sapiens
cagaaaatataaatg

SEQ ID NO: 2812529 - DNA, 19 bp, Homo sapiens
cagaaaatgtgtcagcatg

SEQ ID NO: 2812530 - DNA, 14 bp, Homo sapiens
cagaaaccagttat

SEQ ID NO: 2812531 - DNA, 20 bp, Homo sapiens
cagaaactcgatgaatgtgt

SEQ ID NO: 2812532 - DNA, 21 bp, Homo sapiens
cagaaagatggatgtgctttg

SEQ ID NO: 2812533 - DNA, 18 bp, Homo sapiens
cagaaagggagggctctg

SEQ ID NO: 2812534 - DNA, 19 bp, Homo sapiens
cagaaagggagggctctga

SEQ ID NO: 2812535 - DNA, 21 bp, Homo sapiens
cagagactcagggccccagca

SEQ ID NO: 2812536 - DNA, 14 bp, Homo sapiens
cagagagaagcctg

SEQ ID NO: 2812537 - DNA, 12 bp, Homo sapiens
cagagagagtgt

SEQ ID NO: 2812538 - DNA, 15 bp, Homo sapiens
cagagaggaatcaga

SEQ ID NO: 2812539 - DNA, 21 bp, Homo sapiens
cagagaggggacatttccctc

SEQ ID NO: 2812540 - DNA, 23 bp, Homo sapiens
cagagaggggacatttccctcct

SEQ ID NO: 2812541 - DNA, 12 bp, Homo sapiens
cagagagggtgg

SEQ ID NO: 2812542 - DNA, 20 bp, Homo sapiens
cagagagggtggtgacctct

SEQ ID NO: 2812543 - DNA, 22 bp, Homo sapiens
cagagagggtggtgacctctgc

SEQ ID NO: 2812544 - DNA, 15 bp, Homo sapiens
cagagagtcctctgg

SEQ ID NO: 2812545 - DNA, 16 bp, Homo sapiens
cagagagtcctctgga

SEQ ID NO: 2812546 - DNA, 18 bp, Homo sapiens
cagagagtcctctggatg

SEQ ID NO: 2812547 - DNA, 13 bp, Homo sapiens
cagagatgcctcc

SEQ ID NO: 2812548 - DNA, 21 bp, Homo sapiens
cagagatgcctccaccgctgc

SEQ ID NO: 2812549 - DNA, 11 bp, Homo sapiens
cagagatgtac

SEQ ID NO: 2812550 - DNA, 14 bp, Homo sapiens
cagagatgtaccat

SEQ ID NO: 2812551 - DNA, 20 bp, Homo sapiens
cagagcaagatcctgtcttt

SEQ ID NO: 2812552 - DNA, 15 bp, Homo sapiens
cagagcacacaggta

SEQ ID NO: 2812553 - DNA, 20 bp, Homo sapiens
cagagcacacaggtacagca

SEQ ID NO: 2812554 - DNA, 15 bp, Homo sapiens
cagagcagagagcag

SEQ ID NO: 2812555 - DNA, 23 bp, Homo sapiens
cagagcaggggtccttggtgtga

SEQ ID NO: 2812556 - DNA, 18 bp, Homo sapiens
cagagcattacgtgagcc

SEQ ID NO: 2812557 - DNA, 20 bp, Homo sapiens
cagagcattacgtgagccag

SEQ ID NO: 2812558 - DNA, 21 bp, Homo sapiens
cagagcattacgtgagccagg

SEQ ID NO: 2812559 - DNA, 22 bp, Homo sapiens
cagagcccatgctcaaccactg

SEQ ID NO: 2812560 - DNA, 13 bp, Homo sapiens
cagagccccacac

SEQ ID NO: 2812561 - DNA, 20 bp, Homo sapiens
cagagccccacacggaggca

SEQ ID NO: 2812562 - DNA, 23 bp, Homo sapiens
cagagccccacacggaggcatct

SEQ ID NO: 2812563 - DNA, 15 bp, Homo sapiens
cagagcctgcctcag

SEQ ID NO: 2812564 - DNA, 19 bp, Homo sapiens
cagagcctgcctcagctgc

SEQ ID NO: 2812565 - DNA, 20 bp, Homo sapiens
cagagcctgcctcagctgct

SEQ ID NO: 2812566 - DNA, 24 bp, Homo sapiens
cagagcctgcctcagctgctcgca

SEQ ID NO: 2812567 - DNA, 11 bp, Homo sapiens
cagagcctggg

SEQ ID NO: 2812568 - DNA, 17 bp, Homo sapiens
cagagcctgtctttcag

SEQ ID NO: 2812569 - DNA, 22 bp, Homo sapiens
cagagcctgtctttcagcattc

SEQ ID NO: 2812570 - DNA, 22 bp, Homo sapiens
cagagccttcacaaccagccac

SEQ ID NO: 2812571 - DNA, 21 bp, Homo sapiens
cagagccttctcctgcctaca

SEQ ID NO: 2812572 - DNA, 17 bp, Homo sapiens
cagagctcccttcctga

SEQ ID NO: 2812573 - DNA, 20 bp, Homo sapiens
cagaggagtccagggcggga

SEQ ID NO: 2812574 - DNA, 16 bp, Homo sapiens
cagaggattgaggctt

SEQ ID NO: 2812575 - DNA, 12 bp, Homo sapiens
cagaggcagccc

SEQ ID NO: 2812576 - DNA, 18 bp, Homo sapiens
cagaggcagccccattct

SEQ ID NO: 2812577 - DNA, 23 bp, Homo sapiens
cagaggcagctgtgtgggctgca

SEQ ID NO: 2812578 - DNA, 14 bp, Homo sapiens
cagaggccatggca

SEQ ID NO: 2812579 - DNA, 19 bp, Homo sapiens
cagaggccatgggcctcct

SEQ ID NO: 2812580 - DNA, 17 bp, Homo sapiens
cagaggctggaggcagg

SEQ ID NO: 2812581 - DNA, 22 bp, Homo sapiens
cagaggctgggggaggcggcac

SEQ ID NO: 2812582 - DNA, 15 bp, Homo sapiens
cagaggcttcttcag

SEQ ID NO: 2812583 - DNA, 23 bp, Homo sapiens
cagagggaaagtaaatatttcag

SEQ ID NO: 2812584 - DNA, 21 bp, Homo sapiens
cagagggagtgacagaggcag

SEQ ID NO: 2812585 - DNA, 17 bp, Homo sapiens
cagagggcagaggctgg

SEQ ID NO: 2812586 - DNA, 18 bp, Homo sapiens
cagagggcccaggcaggc

SEQ ID NO: 2812587 - DNA, 22 bp, Homo sapiens
cagagggcccaggcaggccacc

SEQ ID NO: 2812588 - DNA, 21 bp, Homo sapiens
cagaggggtaggcagagcctt

SEQ ID NO: 2812589 - DNA, 18 bp, Homo sapiens
cagaggtgagcagaggag

SEQ ID NO: 2812590 - DNA, 13 bp, Homo sapiens
cagagtctcactg

SEQ ID NO: 2812591 - DNA, 22 bp, Homo sapiens
cagagtgacacccaagagggct

SEQ ID NO: 2812592 - DNA, 16 bp, Homo sapiens
cagagtgagactctgt

SEQ ID NO: 2812593 - DNA, 20 bp, Homo sapiens
cagagtgtgggaagggagag

SEQ ID NO: 2812594 - DNA, 14 bp, Homo sapiens
cagagttcactata

SEQ ID NO: 2812595 - DNA, 19 bp, Homo sapiens
cagataagaatgctggttt

SEQ ID NO: 2812596 - DNA, 15 bp, Homo sapiens
cagataatcagcctc

SEQ ID NO: 2812597 - DNA, 19 bp, Homo sapiens
cagataatcagcctcttaa

SEQ ID NO: 2812598 - DNA, 21 bp, Homo sapiens
cagataatttattttgtattt

SEQ ID NO: 2812599 - DNA, 21 bp, Homo sapiens
cagatacaggaaaagctgctg

SEQ ID NO: 2812600 - DNA, 22 bp, Homo sapiens
cagatacaggaaaagctgctga

SEQ ID NO: 2812601 - DNA, 22 bp, Homo sapiens
cagatataaatggctggttttt

SEQ ID NO: 2812602 - DNA, 23 bp, Homo sapiens
cagatataaatggctggttttta

SEQ ID NO: 2812603 - DNA, 18 bp, Homo sapiens
cagatatatttttcacag

SEQ ID NO: 2812604 - DNA, 19 bp, Homo sapiens
cagatatatttttcacagt

SEQ ID NO: 2812605 - DNA, 12 bp, Homo sapiens
cagatatttcca

SEQ ID NO: 2812606 - DNA, 22 bp, Homo sapiens
cagatcaccagcccggcctgct

SEQ ID NO: 2812607 - DNA, 22 bp, Homo sapiens
cagatcccatccatcagctccc

SEQ ID NO: 2812608 - DNA, 21 bp, Homo sapiens
cagatcgtattaattatctga

SEQ ID NO: 2812609 - DNA, 12 bp, Homo sapiens
cagatgagaagt

SEQ ID NO: 2812610 - DNA, 22 bp, Homo sapiens
cagatgagcagtcacactgtta

SEQ ID NO: 2812611 - DNA, 13 bp, Homo sapiens
cagatgcaccagc

SEQ ID NO: 2812612 - DNA, 16 bp, Homo sapiens
cagatgcaccagccct

SEQ ID NO: 2812613 - DNA, 22 bp, Homo sapiens
cagatgcaccagcccttagcag

SEQ ID NO: 2812614 - DNA, 20 bp, Homo sapiens
cagatgcccagagggcccag

SEQ ID NO: 2812615 - DNA, 14 bp, Homo sapiens
cagatggaaagaaa

SEQ ID NO: 2812616 - DNA, 16 bp, Homo sapiens
cagatggcatgtgttt

SEQ ID NO: 2812617 - DNA, 22 bp, Homo sapiens
cagatggcatgtgtttacttta

SEQ ID NO: 2812618 - DNA, 16 bp, Homo sapiens
cagatgggtattaaac

SEQ ID NO: 2812619 - DNA, 23 bp, Homo sapiens
cagatgttgaatgcccacaggca

SEQ ID NO: 2812620 - DNA, 14 bp, Homo sapiens
cagattcccagagc

SEQ ID NO: 2812621 - DNA, 17 bp, Homo sapiens
cagattcccagagcaaa

SEQ ID NO: 2812622 - DNA, 21 bp, Homo sapiens
cagattcccagagcaaaataa

SEQ ID NO: 2812623 - DNA, 17 bp, Homo sapiens
cagatttagtgaaagct

SEQ ID NO: 2812624 - DNA, 20 bp, Homo sapiens
cagatttagtgaaagctaga

SEQ ID NO: 2812625 - DNA, 19 bp, Homo sapiens
cagccctccctgtcctcct

SEQ ID NO: 2812626 - DNA, 22 bp, Homo sapiens
cagccctcctcaccccgtctgg

SEQ ID NO: 2812627 - DNA, 13 bp, Homo sapiens
cagccctgcctgg

SEQ ID NO: 2812628 - DNA, 12 bp, Homo sapiens
cagccctgggcc

SEQ ID NO: 2812629 - DNA, 13 bp, Homo sapiens
cagccctgggccc

SEQ ID NO: 2812630 - DNA, 19 bp, Homo sapiens
cagccctgggccccaccac

SEQ ID NO: 2812631 - DNA, 20 bp, Homo sapiens
cagccctgggccccaccacc

SEQ ID NO: 2812632 - DNA, 22 bp, Homo sapiens
cagccctgggccccaccaccta

SEQ ID NO: 2812633 - DNA, 23 bp, Homo sapiens
cagccctgggccccaccacctag

SEQ ID NO: 2812634 - DNA, 13 bp, Homo sapiens
cagcccttagcag

SEQ ID NO: 2812635 - DNA, 22 bp, Homo sapiens
cagcccttccctgctttgagga

SEQ ID NO: 2812636 - DNA, 19 bp, Homo sapiens
cagccctttgggaggctga

SEQ ID NO: 2812637 - DNA, 14 bp, Homo sapiens
cagccgctcctgtc

SEQ ID NO: 2812638 - DNA, 22 bp, Homo sapiens
cagccgctcctgtctgccagcc

SEQ ID NO: 2812639 - DNA, 23 bp, Homo sapiens
cagccgctcctgtctgccagcca

SEQ ID NO: 2812640 - DNA, 20 bp, Homo sapiens
cagccggggcgagtggcacg

SEQ ID NO: 2812641 - DNA, 17 bp, Homo sapiens
cagccgggtacctcagt

SEQ ID NO: 2812642 - DNA, 13 bp, Homo sapiens
cagccggtgcctg

SEQ ID NO: 2812643 - DNA, 17 bp, Homo sapiens
cagcctagccgacctca

SEQ ID NO: 2812644 - DNA, 18 bp, Homo sapiens
cagcctagccgacctcag

SEQ ID NO: 2812645 - DNA, 18 bp, Homo sapiens
atctttgcagacaggcaa

SEQ ID NO: 2812646 - DNA, 14 bp, Homo sapiens
atcttttgtgagat

SEQ ID NO: 2812647 - DNA, 14 bp, Homo sapiens
atgaaaagaataaa

SEQ ID NO: 2812648 - DNA, 13 bp, Homo sapiens
atgaaaatgaata

SEQ ID NO: 2812649 - DNA, 20 bp, Homo sapiens
atgaaaatgcaacaacatgt

SEQ ID NO: 2812650 - DNA, 12 bp, Homo sapiens
atgaaaatgtca

SEQ ID NO: 2812651 - DNA, 13 bp, Homo sapiens
atgaaaatgtcag

SEQ ID NO: 2812652 - DNA, 14 bp, Homo sapiens
atgaaaattgtatg

SEQ ID NO: 2812653 - DNA, 17 bp, Homo sapiens
atgaaacacttctcatc

SEQ ID NO: 2812654 - DNA, 23 bp, Homo sapiens
atgaaagatggctgtgcctctgc

SEQ ID NO: 2812655 - DNA, 18 bp, Homo sapiens
atgaaagcatgtggcatg

SEQ ID NO: 2812656 - DNA, 15 bp, Homo sapiens
atgaaatatttgctt

SEQ ID NO: 2812657 - DNA, 18 bp, Homo sapiens
atgaaatgataaagatgt

SEQ ID NO: 2812658 - DNA, 21 bp, Homo sapiens
atgaaatgataaagatgtcaa

SEQ ID NO: 2812659 - DNA, 22 bp, Homo sapiens
atgaaattgtctagcagagcag

SEQ ID NO: 2812660 - DNA, 23 bp, Homo sapiens
atgaaattgtctagcagagcagg

SEQ ID NO: 2812661 - DNA, 17 bp, Homo sapiens
atgaaatttaatatagc

SEQ ID NO: 2812662 - DNA, 13 bp, Homo sapiens
atgaacaaagaaa

SEQ ID NO: 2812663 - DNA, 21 bp, Homo sapiens
atgaacaaagaaaaaaatata

SEQ ID NO: 2812664 - DNA, 22 bp, Homo sapiens
atgaacaaagaaaaaaatatat

SEQ ID NO: 2812665 - DNA, 23 bp, Homo sapiens
atgaacctcaagctgcatctaga

SEQ ID NO: 2812666 - DNA, 13 bp, Homo sapiens
atgaacttgagga

SEQ ID NO: 2812667 - DNA, 19 bp, Homo sapiens
atgaacttgaggacacatg

SEQ ID NO: 2812668 - DNA, 12 bp, Homo sapiens
atgaagacccag

SEQ ID NO: 2812669 - DNA, 18 bp, Homo sapiens
atgaagagtgagagggca

SEQ ID NO: 2812670 - DNA, 21 bp, Homo sapiens
atgaagatgtctaatagttat

SEQ ID NO: 2812671 - DNA, 13 bp, Homo sapiens
atgaagcatgtag

SEQ ID NO: 2812672 - DNA, 17 bp, Homo sapiens
atgaagcccaagtgaaa

SEQ ID NO: 2812673 - DNA, 16 bp, Homo sapiens
atgaagcccaataaac

SEQ ID NO: 2812674 - DNA, 15 bp, Homo sapiens
atgaagctctggcca

SEQ ID NO: 2812675 - DNA, 16 bp, Homo sapiens
atgaagctctggccaa

SEQ ID NO: 2812676 - DNA, 14 bp, Homo sapiens
atgaagtaagttct

SEQ ID NO: 2812677 - DNA, 19 bp, Homo sapiens
atgaagtgtgtttccttca

SEQ ID NO: 2812678 - DNA, 16 bp, Homo sapiens
atgaatatctgcttta

SEQ ID NO: 2812679 - DNA, 17 bp, Homo sapiens
atgaatatttcaaaata

SEQ ID NO: 2812680 - DNA, 19 bp, Homo sapiens
atgaatatttcaaaataaa

SEQ ID NO: 2812681 - DNA, 18 bp, Homo sapiens
atgaatcccacccacatg

SEQ ID NO: 2812682 - DNA, 16 bp, Homo sapiens
atgaattaaataaacc

SEQ ID NO: 2812683 - DNA, 23 bp, Homo sapiens
atgaatttatctgaatataggaa

SEQ ID NO: 2812684 - DNA, 21 bp, Homo sapiens
atgaatttggagactctgtgg

SEQ ID NO: 2812685 - DNA, 16 bp, Homo sapiens
atgacagatgttgaat

SEQ ID NO: 2812686 - DNA, 13 bp, Homo sapiens
atgacagccagag

SEQ ID NO: 2812687 - DNA, 15 bp, Homo sapiens
atgacagccagagcc

SEQ ID NO: 2812688 - DNA, 17 bp, Homo sapiens
atgacagctgtccctgt

SEQ ID NO: 2812689 - DNA, 21 bp, Homo sapiens
atgacagctgtccctgtcacc

SEQ ID NO: 2812690 - DNA, 19 bp, Homo sapiens
atgacagtccgtcaaaaca

SEQ ID NO: 2812691 - DNA, 19 bp, Homo sapiens
atgacatcacttgtacaaa

SEQ ID NO: 2812692 - DNA, 16 bp, Homo sapiens
atgaccaatctctgtg

SEQ ID NO: 2812693 - DNA, 13 bp, Homo sapiens
atgacccaaagac

SEQ ID NO: 2812694 - DNA, 15 bp, Homo sapiens
atgacccaaagacca

SEQ ID NO: 2812695 - DNA, 21 bp, Homo sapiens
atgacctccagctttcctgta

SEQ ID NO: 2812696 - DNA, 21 bp, Homo sapiens
atgacgtcaatagcagcccag

SEQ ID NO: 2812697 - DNA, 23 bp, Homo sapiens
atgactaaaaatattataactta

SEQ ID NO: 2812698 - DNA, 19 bp, Homo sapiens
atgactagaggcagggagg

SEQ ID NO: 2812699 - DNA, 14 bp, Homo sapiens
atgactataaacat

SEQ ID NO: 2812700 - DNA, 23 bp, Homo sapiens
atgactataaacattaaaagaag

SEQ ID NO: 2812701 - DNA, 21 bp, Homo sapiens
atgacttgggcacccccagcc

SEQ ID NO: 2812702 - DNA, 21 bp, Homo sapiens
atgagaaaggttgaagcacca

SEQ ID NO: 2812703 - DNA, 13 bp, Homo sapiens
atgagaaatgtga

SEQ ID NO: 2812704 - DNA, 14 bp, Homo sapiens
atgagaaatgtgaa

SEQ ID NO: 2812705 - DNA, 16 bp, Homo sapiens
atgagaagagggcctg

SEQ ID NO: 2812706 - DNA, 18 bp, Homo sapiens
atgagaagagggcctgtg

SEQ ID NO: 2812707 - DNA, 18 bp, Homo sapiens
atgagaagttaagcagcc

SEQ ID NO: 2812708 - DNA, 19 bp, Homo sapiens
atgagaagttaagcagcct

SEQ ID NO: 2812709 - DNA, 16 bp, Homo sapiens
atgagattccctctcc

SEQ ID NO: 2812710 - DNA, 21 bp, Homo sapiens
atgagattccctctcctcccc

SEQ ID NO: 2812711 - DNA, 14 bp, Homo sapiens
atgagcagtcacac

SEQ ID NO: 2812712 - DNA, 21 bp, Homo sapiens
atgagcctcagcatcctggca

SEQ ID NO: 2812713 - DNA, 14 bp, Homo sapiens
atgaggagttgctg

SEQ ID NO: 2812714 - DNA, 21 bp, Homo sapiens
atgaggcctcttggacctctg

SEQ ID NO: 2812715 - DNA, 19 bp, Homo sapiens
atgaggcctttccccagtg

SEQ ID NO: 2812716 - DNA, 13 bp, Homo sapiens
atgagggcagcag

SEQ ID NO: 2812717 - DNA, 15 bp, Homo sapiens
atgagggcagcagcc

SEQ ID NO: 2812718 - DNA, 23 bp, Homo sapiens
atgagggcagcagccagccctgc

SEQ ID NO: 2812719 - DNA, 18 bp, Homo sapiens
atgaggtcagagcctgca

SEQ ID NO: 2812720 - DNA, 19 bp, Homo sapiens
atgaggtcagagcctgcag

SEQ ID NO: 2812721 - DNA, 16 bp, Homo sapiens
atgaggtcccaggcag

SEQ ID NO: 2812722 - DNA, 17 bp, Homo sapiens
atgaggtcccaggcaga

SEQ ID NO: 2812723 - DNA, 18 bp, Homo sapiens
atgaggtcccaggcagag

SEQ ID NO: 2812724 - DNA, 15 bp, Homo sapiens
atgaggtctgaaatg

SEQ ID NO: 2812725 - DNA, 19 bp, Homo sapiens
atgagttgttttcagactc

SEQ ID NO: 2812726 - DNA, 22 bp, Homo sapiens
atgagttgttttcagactcaga

SEQ ID NO: 2812727 - DNA, 18 bp, Homo sapiens
atgataaagatgtcaaat

SEQ ID NO: 2812728 - DNA, 15 bp, Homo sapiens
atgataatgaacaga

SEQ ID NO: 2812729 - DNA, 22 bp, Homo sapiens
atgataccctgaatttggcctg

SEQ ID NO: 2812730 - DNA, 21 bp, Homo sapiens
atgatatgtaaacataattct

SEQ ID NO: 2812731 - DNA, 13 bp, Homo sapiens
atgatattgcata

SEQ ID NO: 2812732 - DNA, 18 bp, Homo sapiens
atgatattgcatatgcat

SEQ ID NO: 2812733 - DNA, 15 bp, Homo sapiens
atgatcacggctcac

SEQ ID NO: 2812734 - DNA, 19 bp, Homo sapiens
atgatcacggctcactgca

SEQ ID NO: 2812735 - DNA, 13 bp, Homo sapiens
caagttagctcag

SEQ ID NO: 2812736 - DNA, 19 bp, Homo sapiens
caagttagctcaggaggct

SEQ ID NO: 2812737 - DNA, 19 bp, Homo sapiens
caagttctagagaagaggc

SEQ ID NO: 2812738 - DNA, 23 bp, Homo sapiens
caagttctagagaagaggctggt

SEQ ID NO: 2812739 - DNA, 21 bp, Homo sapiens
caagttgttccttaagtcaga

SEQ ID NO: 2812740 - DNA, 22 bp, Homo sapiens
caagttgttccttaagtcagaa

SEQ ID NO: 2812741 - DNA, 13 bp, Homo sapiens
caagtttataagc

SEQ ID NO: 2812742 - DNA, 12 bp, Homo sapiens
caataaaacatt

SEQ ID NO: 2812743 - DNA, 13 bp, Homo sapiens
caataaaatagta

SEQ ID NO: 2812744 - DNA, 17 bp, Homo sapiens
caataaacctcttttct

SEQ ID NO: 2812745 - DNA, 15 bp, Homo sapiens
caataaagctgctga

SEQ ID NO: 2812746 - DNA, 22 bp, Homo sapiens
caataaagctgctgagaatcta

SEQ ID NO: 2812747 - DNA, 22 bp, Homo sapiens
caataaagctggacaagaagct

SEQ ID NO: 2812748 - DNA, 16 bp, Homo sapiens
caataaagtatctaca

SEQ ID NO: 2812749 - DNA, 13 bp, Homo sapiens
caataaatattct

SEQ ID NO: 2812750 - DNA, 15 bp, Homo sapiens
caataaatgccctct

SEQ ID NO: 2812751 - DNA, 19 bp, Homo sapiens
caataaatgccctctctga

SEQ ID NO: 2812752 - DNA, 19 bp, Homo sapiens
caataacttcagagaagtc

SEQ ID NO: 2812753 - DNA, 20 bp, Homo sapiens
caataacttcagagaagtca

SEQ ID NO: 2812754 - DNA, 17 bp, Homo sapiens
caataaggtcaatgcca

SEQ ID NO: 2812755 - DNA, 17 bp, Homo sapiens
caataagttccatgtta

SEQ ID NO: 2812756 - DNA, 20 bp, Homo sapiens
caataattaggatctatgca

SEQ ID NO: 2812757 - DNA, 23 bp, Homo sapiens
caatagaaactcaccatgtaaaa

SEQ ID NO: 2812758 - DNA, 20 bp, Homo sapiens
caatagctattgcatgtaaa

SEQ ID NO: 2812759 - DNA, 22 bp, Homo sapiens
caatagctattgcatgtaaaat

SEQ ID NO: 2812760 - DNA, 13 bp, Homo sapiens
caatataaattgg

SEQ ID NO: 2812761 - DNA, 16 bp, Homo sapiens
caatatgtattaatat

SEQ ID NO: 2812762 - DNA, 20 bp, Homo sapiens
caatattaaatacagacact

SEQ ID NO: 2812763 - DNA, 23 bp, Homo sapiens
caatattaaatacagacactaag

SEQ ID NO: 2812764 - DNA, 13 bp, Homo sapiens
caatattcctgaa

SEQ ID NO: 2812765 - DNA, 20 bp, Homo sapiens
caatattcctggtattattt

SEQ ID NO: 2812766 - DNA, 12 bp, Homo sapiens
caatatttatta

SEQ ID NO: 2812767 - DNA, 13 bp, Homo sapiens
caatatttattat

SEQ ID NO: 2812768 - DNA, 14 bp, Homo sapiens
caatatttattatt

SEQ ID NO: 2812769 - DNA, 13 bp, Homo sapiens
caatatttgtaga

SEQ ID NO: 2812770 - DNA, 16 bp, Homo sapiens
caatattttccatgaa

SEQ ID NO: 2812771 - DNA, 22 bp, Homo sapiens
caatcccctcattcaggaaaac

SEQ ID NO: 2812772 - DNA, 15 bp, Homo sapiens
caatcccgtgaaaga

SEQ ID NO: 2812773 - DNA, 15 bp, Homo sapiens
caatcctttgagtta

SEQ ID NO: 2812774 - DNA, 20 bp, Homo sapiens
caatctcaaattctcaacct

SEQ ID NO: 2812775 - DNA, 20 bp, Homo sapiens
caatctccagggctgcccct

SEQ ID NO: 2812776 - DNA, 20 bp, Homo sapiens
caatgaaatatttgcttatt

SEQ ID NO: 2812777 - DNA, 23 bp, Homo sapiens
caatgaaatatttgcttatttat

SEQ ID NO: 2812778 - DNA, 20 bp, Homo sapiens
caatgatgattaaacacctg

SEQ ID NO: 2812779 - DNA, 16 bp, Homo sapiens
caatgatggcaatttt

SEQ ID NO: 2812780 - DNA, 24 bp, Homo sapiens
caatgatggcaattttgtaacgaa

SEQ ID NO: 2812781 - DNA, 14 bp, Homo sapiens
caatgatgtccaga

SEQ ID NO: 2812782 - DNA, 20 bp, Homo sapiens
caatgctggctgttggctgg

SEQ ID NO: 2812783 - DNA, 14 bp, Homo sapiens
caatggcagccttg

SEQ ID NO: 2812784 - DNA, 15 bp, Homo sapiens
caatggcagccttgg

SEQ ID NO: 2812785 - DNA, 17 bp, Homo sapiens
caatggtttgcaaggaa

SEQ ID NO: 2812786 - DNA, 14 bp, Homo sapiens
caatgtaaatattt

SEQ ID NO: 2812787 - DNA, 17 bp, Homo sapiens
caatgtaaatattttaa

SEQ ID NO: 2812788 - DNA, 19 bp, Homo sapiens
caatgtaaatattttaaag

SEQ ID NO: 2812789 - DNA, 23 bp, Homo sapiens
caatgtaacattaattctactaa

SEQ ID NO: 2812790 - DNA, 19 bp, Homo sapiens
caatgtacccaccgggcca

SEQ ID NO: 2812791 - DNA, 22 bp, Homo sapiens
caatgtacccaccgggccactc

SEQ ID NO: 2812792 - DNA, 17 bp, Homo sapiens
caatgtagaaagctttg

SEQ ID NO: 2812793 - DNA, 15 bp, Homo sapiens
caatgtcagaaactc

SEQ ID NO: 2812794 - DNA, 16 bp, Homo sapiens
caatgtcaggaacaga

SEQ ID NO: 2812795 - DNA, 21 bp, Homo sapiens
caatgtcccttgcacagccca

SEQ ID NO: 2812796 - DNA, 15 bp, Homo sapiens
caatgttagcctcaa

SEQ ID NO: 2812797 - DNA, 23 bp, Homo sapiens
caatgtttatgcaaggaaggaaa

SEQ ID NO: 2812798 - DNA, 17 bp, Homo sapiens
caatgtttcttctaggt

SEQ ID NO: 2812799 - DNA, 16 bp, Homo sapiens
caatgtttcttttatc

SEQ ID NO: 2812800 - DNA, 22 bp, Homo sapiens
caattaaaatatatataaatat

SEQ ID NO: 2812801 - DNA, 12 bp, Homo sapiens
caattaaatgta

SEQ ID NO: 2812802 - DNA, 14 bp, Homo sapiens
caattaaatgtagg

SEQ ID NO: 2812803 - DNA, 22 bp, Homo sapiens
caattaaatgtaggtatgaata

SEQ ID NO: 2812804 - DNA, 16 bp, Homo sapiens
caattagggcctagcc

SEQ ID NO: 2812805 - DNA, 13 bp, Homo sapiens
caattatgtgaca

SEQ ID NO: 2812806 - DNA, 20 bp, Homo sapiens
caattatgtgacaacctttg

SEQ ID NO: 2812807 - DNA, 13 bp, Homo sapiens
caattcaaagctg

SEQ ID NO: 2812808 - DNA, 14 bp, Homo sapiens
caattcaacacatt

SEQ ID NO: 2812809 - DNA, 15 bp, Homo sapiens
caattccaaaggaat

SEQ ID NO: 2812810 - DNA, 18 bp, Homo sapiens
caattccacagtctctgg

SEQ ID NO: 2812811 - DNA, 19 bp, Homo sapiens
caattccacagtctctggg

SEQ ID NO: 2812812 - DNA, 13 bp, Homo sapiens
caattccacctgc

SEQ ID NO: 2812813 - DNA, 13 bp, Homo sapiens
caattcctctggg

SEQ ID NO: 2812814 - DNA, 15 bp, Homo sapiens
caattcctctgggaa

SEQ ID NO: 2812815 - DNA, 16 bp, Homo sapiens
caattcctgggcccca

SEQ ID NO: 2812816 - DNA, 17 bp, Homo sapiens
caattctacccagagcc

SEQ ID NO: 2812817 - DNA, 20 bp, Homo sapiens
caattctacccagagccttc

SEQ ID NO: 2812818 - DNA, 15 bp, Homo sapiens
caattgtcatttata

SEQ ID NO: 2812819 - DNA, 12 bp, Homo sapiens
caatttaaagca

SEQ ID NO: 2812820 - DNA, 14 bp, Homo sapiens
caatttagaaaaca

SEQ ID NO: 2812821 - DNA, 16 bp, Homo sapiens
caatttgagcaattca

SEQ ID NO: 2812822 - DNA, 17 bp, Homo sapiens
caatttgagcaattcat

SEQ ID NO: 2812823 - DNA, 21 bp, Homo sapiens
caatttgagcaattcatttca

SEQ ID NO: 2812824 - DNA, 19 bp, Homo sapiens
caattttctggaatacatg

SEQ ID NO: 2812825 - DNA, 20 bp, Homo sapiens
caattttctggaatacatga

SEQ ID NO: 2812826 - DNA, 20 bp, Homo sapiens
caccaggcacgaacccacct

SEQ ID NO: 2812827 - DNA, 23 bp, Homo sapiens
caccaggccgggcttgggccctg

SEQ ID NO: 2812828 - DNA, 17 bp, Homo sapiens
caccagtcactgtccct

SEQ ID NO: 2812829 - DNA, 15 bp, Homo sapiens
caccagtgccgcctg

SEQ ID NO: 2812830 - DNA, 18 bp, Homo sapiens
caccagtgccgcctgtgc

SEQ ID NO: 2812831 - DNA, 21 bp, Homo sapiens
caccatattcagtgctgtggc

SEQ ID NO: 2812832 - DNA, 20 bp, Homo sapiens
caccatcctgcagcctcctc

SEQ ID NO: 2812833 - DNA, 19 bp, Homo sapiens
caccatgtttgagctcaga

SEQ ID NO: 2812834 - DNA, 20 bp, Homo sapiens
caccattcacatttgatgta

SEQ ID NO: 2812835 - DNA, 16 bp, Homo sapiens
cacccaagagggctgc

SEQ ID NO: 2812836 - DNA, 12 bp, Homo sapiens
cacccacatgtg

SEQ ID NO: 2812837 - DNA, 22 bp, Homo sapiens
cacccaccatcatgtctggcta

SEQ ID NO: 2812838 - DNA, 18 bp, Homo sapiens
cacccacctcagcctccc

SEQ ID NO: 2812839 - DNA, 12 bp, Homo sapiens
cacccagcccac

SEQ ID NO: 2812840 - DNA, 15 bp, Homo sapiens
cacccagcccattct

SEQ ID NO: 2812841 - DNA, 23 bp, Homo sapiens
cacccagcccattctctctcctg

SEQ ID NO: 2812842 - DNA, 23 bp, Homo sapiens
cacccaggagccccgaggccttc

SEQ ID NO: 2812843 - DNA, 19 bp, Homo sapiens
cacccatagtgcacacttg

SEQ ID NO: 2812844 - DNA, 13 bp, Homo sapiens
caccccaccccct

SEQ ID NO: 2812845 - DNA, 15 bp, Homo sapiens
cacccccagcctggg

SEQ ID NO: 2812846 - DNA, 18 bp, Homo sapiens
cacccccagcctgggcct

SEQ ID NO: 2812847 - DNA, 14 bp, Homo sapiens
caccccccaagctg

SEQ ID NO: 2812848 - DNA, 12 bp, Homo sapiens
caccccctgcag

SEQ ID NO: 2812849 - DNA, 18 bp, Homo sapiens
caccccttatccaggact

SEQ ID NO: 2812850 - DNA, 14 bp, Homo sapiens
caccccttcctgtc

SEQ ID NO: 2812851 - DNA, 12 bp, Homo sapiens
cacccgaggctg

SEQ ID NO: 2812852 - DNA, 15 bp, Homo sapiens
cacccgaggctgccc

SEQ ID NO: 2812853 - DNA, 12 bp, Homo sapiens
cacccggaaaga

SEQ ID NO: 2812854 - DNA, 14 bp, Homo sapiens
cacccggcccctgc

SEQ ID NO: 2812855 - DNA, 19 bp, Homo sapiens
cacccgttctgctggcctg

SEQ ID NO: 2812856 - DNA, 20 bp, Homo sapiens
cacccgttctgctggcctgg

SEQ ID NO: 2812857 - DNA, 21 bp, Homo sapiens
cacccgttctgctggcctgga

SEQ ID NO: 2812858 - DNA, 19 bp, Homo sapiens
caccctcataccatctgct

SEQ ID NO: 2812859 - DNA, 14 bp, Homo sapiens
caccctcccaccat

SEQ ID NO: 2812860 - DNA, 17 bp, Homo sapiens
caccctcgtggacacct

SEQ ID NO: 2812861 - DNA, 19 bp, Homo sapiens
caccctcgtggacacctgc

SEQ ID NO: 2812862 - DNA, 23 bp, Homo sapiens
caccctcgtggacacctgccctg

SEQ ID NO: 2812863 - DNA, 13 bp, Homo sapiens
caccctgagcctg

SEQ ID NO: 2812864 - DNA, 18 bp, Homo sapiens
caccctgaggagtctgag

SEQ ID NO: 2812865 - DNA, 17 bp, Homo sapiens
caccctgcagagcacac

SEQ ID NO: 2812866 - DNA, 20 bp, Homo sapiens
caccctgcagagcacacagg

SEQ ID NO: 2812867 - DNA, 21 bp, Homo sapiens
caccctggattgatcggagcc

SEQ ID NO: 2812868 - DNA, 16 bp, Homo sapiens
caccctggggagaaag

SEQ ID NO: 2812869 - DNA, 19 bp, Homo sapiens
caccctgttccctctttct

SEQ ID NO: 2812870 - DNA, 18 bp, Homo sapiens
cacccttctttcctcttc

SEQ ID NO: 2812871 - DNA, 19 bp, Homo sapiens
cacccttctttcctcttcc

SEQ ID NO: 2812872 - DNA, 14 bp, Homo sapiens
caccgcagcatgtg

SEQ ID NO: 2812873 - DNA, 19 bp, Homo sapiens
caccgctgcctaagtggct

SEQ ID NO: 2812874 - DNA, 19 bp, Homo sapiens
caccgggacagacctggac

SEQ ID NO: 2812875 - DNA, 18 bp, Homo sapiens
caccgggccacagagaaa

SEQ ID NO: 2812876 - DNA, 19 bp, Homo sapiens
caccgggccactccttcct

SEQ ID NO: 2812877 - DNA, 16 bp, Homo sapiens
caccgtggaccttcct

SEQ ID NO: 2812878 - DNA, 18 bp, Homo sapiens
caccgtggaccttcctgc

SEQ ID NO: 2812879 - DNA, 20 bp, Homo sapiens
caccgtggaccttcctgcca

SEQ ID NO: 2812880 - DNA, 21 bp, Homo sapiens
caccgttggggattggggaag

SEQ ID NO: 2812881 - DNA, 19 bp, Homo sapiens
cacctacatccccaggtct

SEQ ID NO: 2812882 - DNA, 17 bp, Homo sapiens
cacctaggccactcctc

SEQ ID NO: 2812883 - DNA, 15 bp, Homo sapiens
cacctcagccttgga

SEQ ID NO: 2812884 - DNA, 12 bp, Homo sapiens
cacctcatatgc

SEQ ID NO: 2812885 - DNA, 16 bp, Homo sapiens
cacctcatgcctggcc

SEQ ID NO: 2812886 - DNA, 11 bp, Homo sapiens
cacctcccagg

SEQ ID NO: 2812887 - DNA, 12 bp, Homo sapiens
cacctcccaggg

SEQ ID NO: 2812888 - DNA, 15 bp, Homo sapiens
cacctcccaggggct

SEQ ID NO: 2812889 - DNA, 18 bp, Homo sapiens
cacctccccccactgcag

SEQ ID NO: 2812890 - DNA, 21 bp, Homo sapiens
cacctccccccactgcaggcc

SEQ ID NO: 2812891 - DNA, 16 bp, Homo sapiens
cacctccctgccctgt

SEQ ID NO: 2812892 - DNA, 18 bp, Homo sapiens
cacctccgccccagacac

SEQ ID NO: 2812893 - DNA, 11 bp, Homo sapiens
cacctcctgcc

SEQ ID NO: 2812894 - DNA, 13 bp, Homo sapiens
cacctctcaatat

SEQ ID NO: 2812895 - DNA, 22 bp, Homo sapiens
cacctctcaatattcaataaag

SEQ ID NO: 2812896 - DNA, 23 bp, Homo sapiens
cacctctcaatattcaataaagc

SEQ ID NO: 2812897 - DNA, 17 bp, Homo sapiens
cacctcttctcttcctg

SEQ ID NO: 2812898 - DNA, 22 bp, Homo sapiens
cacctcttctcttcctgtaaca

SEQ ID NO: 2812899 - DNA, 15 bp, Homo sapiens
cacctgcacctcccc

SEQ ID NO: 2812900 - DNA, 14 bp, Homo sapiens
cacctgccagcctg

SEQ ID NO: 2812901 - DNA, 16 bp, Homo sapiens
cacctgccagcctggc

SEQ ID NO: 2812902 - DNA, 20 bp, Homo sapiens
cacctgccagcctggcttct

SEQ ID NO: 2812903 - DNA, 22 bp, Homo sapiens
cacctgccatttgcaccctccg

SEQ ID NO: 2812904 - DNA, 13 bp, Homo sapiens
cacctgcccaacc

SEQ ID NO: 2812905 - DNA, 19 bp, Homo sapiens
cacctgccctgccctgcca

SEQ ID NO: 2812906 - DNA, 21 bp, Homo sapiens
cacctgccgacctcgtcctcc

SEQ ID NO: 2812907 - DNA, 15 bp, Homo sapiens
cacctgcctgccctc

SEQ ID NO: 2812908 - DNA, 18 bp, Homo sapiens
cacctgctgagagaccca

SEQ ID NO: 2812909 - DNA, 19 bp, Homo sapiens
cacctgctgagagacccaa

SEQ ID NO: 2812910 - DNA, 22 bp, Homo sapiens
cacctgctgagagacccaagga

SEQ ID NO: 2812911 - DNA, 15 bp, Homo sapiens
cacctgctttctcct

SEQ ID NO: 2812912 - DNA, 16 bp, Homo sapiens
cacctgctttctcctg

SEQ ID NO: 2812913 - DNA, 15 bp, Homo sapiens
cacctggccccatgt

SEQ ID NO: 2812914 - DNA, 18 bp, Homo sapiens
cacctggccgcctccagg

SEQ ID NO: 2812915 - DNA, 21 bp, Homo sapiens
cacctggccgcctccaggagc

SEQ ID NO: 2812916 - DNA, 22 bp, Homo sapiens
cacctggccgcctccaggagcc

SEQ ID NO: 2812917 - DNA, 19 bp, Homo sapiens
gctgtgtccttgcacctgc

SEQ ID NO: 2812918 - DNA, 20 bp, Homo sapiens
gctgtgtccttgcacctgca

SEQ ID NO: 2812919 - DNA, 20 bp, Homo sapiens
gctgttctggagctgctgtt

SEQ ID NO: 2812920 - DNA, 14 bp, Homo sapiens
gctgttggcctggg

SEQ ID NO: 2812921 - DNA, 13 bp, Homo sapiens
gctgttggctggg

SEQ ID NO: 2812922 - DNA, 17 bp, Homo sapiens
gctgtttatttattcac

SEQ ID NO: 2812923 - DNA, 18 bp, Homo sapiens
gctgtttatttattcact

SEQ ID NO: 2812924 - DNA, 23 bp, Homo sapiens
gctgtttctttttttatgactgt

SEQ ID NO: 2812925 - DNA, 20 bp, Homo sapiens
gctgtttgagatgtgatgct

SEQ ID NO: 2812926 - DNA, 20 bp, Homo sapiens
gctgtttgtttgacaaagaa

SEQ ID NO: 2812927 - DNA, 18 bp, Homo sapiens
gcttaaataaattcaaac

SEQ ID NO: 2812928 - DNA, 14 bp, Homo sapiens
gcttaaatgcaata

SEQ ID NO: 2812929 - DNA, 14 bp, Homo sapiens
gcttagacctcagc

SEQ ID NO: 2812930 - DNA, 15 bp, Homo sapiens
gcttagacctcagcc

SEQ ID NO: 2812931 - DNA, 21 bp, Homo sapiens
gcttagacttcgactcaggat

SEQ ID NO: 2812932 - DNA, 23 bp, Homo sapiens
gcttagcagggtgctaacgtatc

SEQ ID NO: 2812933 - DNA, 13 bp, Homo sapiens
gcttagctgaaac

SEQ ID NO: 2812934 - DNA, 21 bp, Homo sapiens
gcttagctgaaacctaaggca

SEQ ID NO: 2812935 - DNA, 22 bp, Homo sapiens
gcttagtatctcatcaacaaag

SEQ ID NO: 2812936 - DNA, 23 bp, Homo sapiens
gcttatcatgctgtctttacatg

SEQ ID NO: 2812937 - DNA, 22 bp, Homo sapiens
gcttatgacatcacttgtacaa

SEQ ID NO: 2812938 - DNA, 18 bp, Homo sapiens
gcttatttaattaaaaaa

SEQ ID NO: 2812939 - DNA, 22 bp, Homo sapiens
gcttatttatattcagagatgt

SEQ ID NO: 2812940 - DNA, 18 bp, Homo sapiens
gcttcaaccctcagcctt

SEQ ID NO: 2812941 - DNA, 22 bp, Homo sapiens
gcttcaagtgatatatgtattt

SEQ ID NO: 2812942 - DNA, 17 bp, Homo sapiens
gcttcagcatatttata

SEQ ID NO: 2812943 - DNA, 17 bp, Homo sapiens
gcttcagcctccccacc

SEQ ID NO: 2812944 - DNA, 14 bp, Homo sapiens
gcttcagcctgagg

SEQ ID NO: 2812945 - DNA, 15 bp, Homo sapiens
gcttcagcctgaggc

SEQ ID NO: 2812946 - DNA, 15 bp, Homo sapiens
gcttcagtggcagct

SEQ ID NO: 2812947 - DNA, 13 bp, Homo sapiens
gcttcatcaattt

SEQ ID NO: 2812948 - DNA, 14 bp, Homo sapiens
gcttcatcaatttt

SEQ ID NO: 2812949 - DNA, 20 bp, Homo sapiens
gcttcatcaatttttataca

SEQ ID NO: 2812950 - DNA, 21 bp, Homo sapiens
gcttcatcaatttttatacat

SEQ ID NO: 2812951 - DNA, 23 bp, Homo sapiens
gcttcatcaatttttatacatat

SEQ ID NO: 2812952 - DNA, 18 bp, Homo sapiens
gcttcatgctcagccctg

SEQ ID NO: 2812953 - DNA, 19 bp, Homo sapiens
gcttccagaaaaccccagc

SEQ ID NO: 2812954 - DNA, 13 bp, Homo sapiens
gcttccagagagt

SEQ ID NO: 2812955 - DNA, 19 bp, Homo sapiens
gcttccagagagtcctctg

SEQ ID NO: 2812956 - DNA, 13 bp, Homo sapiens
gcttcccatcccc

SEQ ID NO: 2812957 - DNA, 17 bp, Homo sapiens
gcttcccatgtctttct

SEQ ID NO: 2812958 - DNA, 13 bp, Homo sapiens
gcttccccacaga

SEQ ID NO: 2812959 - DNA, 15 bp, Homo sapiens
gcttccccacagaac

SEQ ID NO: 2812960 - DNA, 16 bp, Homo sapiens
gcttcctccgtctgca

SEQ ID NO: 2812961 - DNA, 18 bp, Homo sapiens
gcttcctccgtctgcaat

SEQ ID NO: 2812962 - DNA, 13 bp, Homo sapiens
gcttccttcattt

SEQ ID NO: 2812963 - DNA, 16 bp, Homo sapiens
gcttctagtctggtgt

SEQ ID NO: 2812964 - DNA, 20 bp, Homo sapiens
gcttctatcccaggaggtgg

SEQ ID NO: 2812965 - DNA, 14 bp, Homo sapiens
gcttctcagccccg

SEQ ID NO: 2812966 - DNA, 22 bp, Homo sapiens
gcttctcagccccgggcctgcc

SEQ ID NO: 2812967 - DNA, 14 bp, Homo sapiens
gcttctctacagac

SEQ ID NO: 2812968 - DNA, 22 bp, Homo sapiens
gcttctctgtgcccctgtaaat

SEQ ID NO: 2812969 - DNA, 12 bp, Homo sapiens
gcttctggagcc

SEQ ID NO: 2812970 - DNA, 14 bp, Homo sapiens
gcttctggagccct

SEQ ID NO: 2812971 - DNA, 17 bp, Homo sapiens
gcttctggagcccttgg

SEQ ID NO: 2812972 - DNA, 13 bp, Homo sapiens
gcttcttgcccct

SEQ ID NO: 2812973 - DNA, 15 bp, Homo sapiens
gcttcttgccccttg

SEQ ID NO: 2812974 - DNA, 19 bp, Homo sapiens
gcttcttgccccttgggcc

SEQ ID NO: 2812975 - DNA, 23 bp, Homo sapiens
gcttgaaaactcacttcaatgaa

SEQ ID NO: 2812976 - DNA, 19 bp, Homo sapiens
gcttgactatcacatacaa

SEQ ID NO: 2812977 - DNA, 12 bp, Homo sapiens
gcttgagcccag

SEQ ID NO: 2812978 - DNA, 12 bp, Homo sapiens
gcttgagcctgt

SEQ ID NO: 2812979 - DNA, 16 bp, Homo sapiens
gcttgagggttgggct

SEQ ID NO: 2812980 - DNA, 22 bp, Homo sapiens
gcttgagggttgggctggtgtc

SEQ ID NO: 2812981 - DNA, 19 bp, Homo sapiens
gcttgcactttgtaacatg

SEQ ID NO: 2812982 - DNA, 22 bp, Homo sapiens
gcttgcactttgtaacatgttt

SEQ ID NO: 2812983 - DNA, 21 bp, Homo sapiens
gcttggaaagcatcacctcag

SEQ ID NO: 2812984 - DNA, 20 bp, Homo sapiens
gcttgggtggtgggtgctgg

SEQ ID NO: 2812985 - DNA, 21 bp, Homo sapiens
gcttgggtgtaacaggtctcc

SEQ ID NO: 2812986 - DNA, 22 bp, Homo sapiens
gcttgtagccagccggggcgag

SEQ ID NO: 2812987 - DNA, 15 bp, Homo sapiens
gcttgtatatacata

SEQ ID NO: 2812988 - DNA, 16 bp, Homo sapiens
gcttgtatatacatat

SEQ ID NO: 2812989 - DNA, 17 bp, Homo sapiens
gcttgtatatacatatt

SEQ ID NO: 2812990 - DNA, 13 bp, Homo sapiens
gcttgtattttcc

SEQ ID NO: 2812991 - DNA, 16 bp, Homo sapiens
gcttgtcatctgccac

SEQ ID NO: 2812992 - DNA, 23 bp, Homo sapiens
gcttgtggattgagggtaggagg

SEQ ID NO: 2812993 - DNA, 15 bp, Homo sapiens
gcttgttatttataa

SEQ ID NO: 2812994 - DNA, 16 bp, Homo sapiens
gctttaaacacccttc

SEQ ID NO: 2812995 - DNA, 23 bp, Homo sapiens
gctttaacaaaacaagaaagaaa

SEQ ID NO: 2812996 - DNA, 14 bp, Homo sapiens
gctttacattttat

SEQ ID NO: 2812997 - DNA, 14 bp, Homo sapiens
gctttacctttatt

SEQ ID NO: 2812998 - DNA, 13 bp, Homo sapiens
gctttatttttta

SEQ ID NO: 2812999 - DNA, 17 bp, Homo sapiens
gctttattttttaagta

SEQ ID NO: 2813000 - DNA, 21 bp, Homo sapiens
gctttattttttaagtattta

SEQ ID NO: 2813001 - DNA, 12 bp, Homo sapiens
gctttccacagg

SEQ ID NO: 2813002 - DNA, 23 bp, Homo sapiens
gctttctacccagcgagccctgg

SEQ ID NO: 2813003 - DNA, 22 bp, Homo sapiens
gctttcttctacaaccagagcc

SEQ ID NO: 2813004 - DNA, 17 bp, Homo sapiens
gctttgacatgaaaaga

SEQ ID NO: 2813005 - DNA, 18 bp, Homo sapiens
gctttgaggacaaagaga

SEQ ID NO: 2813006 - DNA, 14 bp, Homo sapiens
gctttgcctgcttg

SEQ ID NO: 2813007 - DNA, 15 bp, Homo sapiens
ggaggatgttctggg

SEQ ID NO: 2813008 - DNA, 18 bp, Homo sapiens
ggaggatgttctgggaca

SEQ ID NO: 2813009 - DNA, 20 bp, Homo sapiens
ggaggattgcttgagcccag

SEQ ID NO: 2813010 - DNA, 22 bp, Homo sapiens
ggaggattgcttgagcccagga

SEQ ID NO: 2813011 - DNA, 12 bp, Homo sapiens
ggaggcaagaac

SEQ ID NO: 2813012 - DNA, 14 bp, Homo sapiens
ggaggcagaggtgg

SEQ ID NO: 2813013 - DNA, 16 bp, Homo sapiens
ggaggcatcagtgtcc

SEQ ID NO: 2813014 - DNA, 22 bp, Homo sapiens
ggaggctgaagtgggtggatca

SEQ ID NO: 2813015 - DNA, 17 bp, Homo sapiens
ggaggctgaggcaggag

SEQ ID NO: 2813016 - DNA, 19 bp, Homo sapiens
ggaggctgaggcaggagga

SEQ ID NO: 2813017 - DNA, 12 bp, Homo sapiens
ggaggctgctcg

SEQ ID NO: 2813018 - DNA, 22 bp, Homo sapiens
ggagggacaaaggagcctgtga

SEQ ID NO: 2813019 - DNA, 12 bp, Homo sapiens
ggagggagagaa

SEQ ID NO: 2813020 - DNA, 12 bp, Homo sapiens
ggagggctctga

SEQ ID NO: 2813021 - DNA, 14 bp, Homo sapiens
ggagggctctgagg

SEQ ID NO: 2813022 - DNA, 15 bp, Homo sapiens
ggagggctctgaggc

SEQ ID NO: 2813023 - DNA, 21 bp, Homo sapiens
ggaggggactatttatgaagg

SEQ ID NO: 2813024 - DNA, 15 bp, Homo sapiens
ggaggggcctaggga

SEQ ID NO: 2813025 - DNA, 22 bp, Homo sapiens
ggagggggtcgtggagagctag

SEQ ID NO: 2813026 - DNA, 20 bp, Homo sapiens
ggaggtagaggttgtggtga

SEQ ID NO: 2813027 - DNA, 16 bp, Homo sapiens
ggaggtagctcccagc

SEQ ID NO: 2813028 - DNA, 18 bp, Homo sapiens
ggaggtccctgccagtgt

SEQ ID NO: 2813029 - DNA, 13 bp, Homo sapiens
ggaggtgagggat

SEQ ID NO: 2813030 - DNA, 15 bp, Homo sapiens
ggaggtggcagccct

SEQ ID NO: 2813031 - DNA, 18 bp, Homo sapiens
ggaggttccagtgagccg

SEQ ID NO: 2813032 - DNA, 12 bp, Homo sapiens
ggaggttgcagg

SEQ ID NO: 2813033 - DNA, 13 bp, Homo sapiens
ggagtctgaggtc

SEQ ID NO: 2813034 - DNA, 18 bp, Homo sapiens
ggagtctgaggtcctgag

SEQ ID NO: 2813035 - DNA, 19 bp, Homo sapiens
ggagtctgaggtcctgagc

SEQ ID NO: 2813036 - DNA, 20 bp, Homo sapiens
ggagtctgaggtcctgagca

SEQ ID NO: 2813037 - DNA, 21 bp, Homo sapiens
ggagtctgaggtcctgagcac

SEQ ID NO: 2813038 - DNA, 17 bp, Homo sapiens
ggagtgacagaggcagc

SEQ ID NO: 2813039 - DNA, 14 bp, Homo sapiens
ggagtgcagtgagc

SEQ ID NO: 2813040 - DNA, 12 bp, Homo sapiens
ggagtgcagtgg

SEQ ID NO: 2813041 - DNA, 21 bp, Homo sapiens
ggagtgggggctgtgccgtga

SEQ ID NO: 2813042 - DNA, 19 bp, Homo sapiens
ggagtttgaggctgcagcg

SEQ ID NO: 2813043 - DNA, 15 bp, Homo sapiens
ggagtttgtgtgtct

SEQ ID NO: 2813044 - DNA, 18 bp, Homo sapiens
ggatactctgtcagatgg

SEQ ID NO: 2813045 - DNA, 16 bp, Homo sapiens
ggatatgtaaaacatt

SEQ ID NO: 2813046 - DNA, 22 bp, Homo sapiens
ggatcaaaccccgaccacctgc

SEQ ID NO: 2813047 - DNA, 13 bp, Homo sapiens
ggatcacagggcc

SEQ ID NO: 2813048 - DNA, 14 bp, Homo sapiens
ggatcactggagcc

SEQ ID NO: 2813049 - DNA, 18 bp, Homo sapiens
ggatcactggagcccagg

SEQ ID NO: 2813050 - DNA, 16 bp, Homo sapiens
ggatcagaacagcaga

SEQ ID NO: 2813051 - DNA, 18 bp, Homo sapiens
ggatcagcgtggccttgt

SEQ ID NO: 2813052 - DNA, 20 bp, Homo sapiens
ggatcagtatgggaacccca

SEQ ID NO: 2813053 - DNA, 15 bp, Homo sapiens
ggatccactgtgcag

SEQ ID NO: 2813054 - DNA, 21 bp, Homo sapiens
ggatcctattctcaccaggaa

SEQ ID NO: 2813055 - DNA, 14 bp, Homo sapiens
ggatctatgcaatt

SEQ ID NO: 2813056 - DNA, 14 bp, Homo sapiens
ggatctccaaggac

SEQ ID NO: 2813057 - DNA, 14 bp, Homo sapiens
ggatctccccactc

SEQ ID NO: 2813058 - DNA, 21 bp, Homo sapiens
ggatctctcaggagcacaggc

SEQ ID NO: 2813059 - DNA, 15 bp, Homo sapiens
ggatgacatgtccct

SEQ ID NO: 2813060 - DNA, 20 bp, Homo sapiens
ggatgacatgtccctacacc

SEQ ID NO: 2813061 - DNA, 19 bp, Homo sapiens
ggatgcctggtggcagctg

SEQ ID NO: 2813062 - DNA, 14 bp, Homo sapiens
ggatggtcctgggg

SEQ ID NO: 2813063 - DNA, 23 bp, Homo sapiens
ggatgtcccatctgctcctccca

SEQ ID NO: 2813064 - DNA, 22 bp, Homo sapiens
ggatgtgaattgcctgcagaga

SEQ ID NO: 2813065 - DNA, 15 bp, Homo sapiens
ggatgtgtaaatgga

SEQ ID NO: 2813066 - DNA, 13 bp, Homo sapiens
ggatgttctggga

SEQ ID NO: 2813067 - DNA, 18 bp, Homo sapiens
ggatgttgtcaggaatca

SEQ ID NO: 2813068 - DNA, 19 bp, Homo sapiens
ggatgttgtcaggaatcat

SEQ ID NO: 2813069 - DNA, 20 bp, Homo sapiens
ggatttcatgatttcatttc

SEQ ID NO: 2813070 - DNA, 20 bp, Homo sapiens
ggattttaaaaacatgagaa

SEQ ID NO: 2813071 - DNA, 22 bp, Homo sapiens
ggattttaaaaacatgagaaat

SEQ ID NO: 2813072 - DNA, 21 bp, Homo sapiens
ggattttgatccaagctggtc

SEQ ID NO: 2813073 - DNA, 21 bp, Homo sapiens
ggatttttacaaataaagatg

SEQ ID NO: 2813074 - DNA, 21 bp, Homo sapiens
ggatttttttgttttctgatg

SEQ ID NO: 2813075 - DNA, 15 bp, Homo sapiens
ggcaaaaaaattaaa

SEQ ID NO: 2813076 - DNA, 22 bp, Homo sapiens
ggcaaagcacgaaatgttattt

SEQ ID NO: 2813077 - DNA, 19 bp, Homo sapiens
ggcaacagagcaagatcct

SEQ ID NO: 2813078 - DNA, 15 bp, Homo sapiens
ggcaactgaggcaga

SEQ ID NO: 2813079 - DNA, 19 bp, Homo sapiens
ggcaagcacctcctgcctc

SEQ ID NO: 2813080 - DNA, 15 bp, Homo sapiens
ggcaatgctggctgt

SEQ ID NO: 2813081 - DNA, 18 bp, Homo sapiens
ggcaatgtcaggaacaga

SEQ ID NO: 2813082 - DNA, 18 bp, Homo sapiens
ggcacagcggggccccag

SEQ ID NO: 2813083 - DNA, 19 bp, Homo sapiens
ggcacaggagctacctgtg

SEQ ID NO: 2813084 - DNA, 12 bp, Homo sapiens
ggcaccagaggc

SEQ ID NO: 2813085 - DNA, 19 bp, Homo sapiens
ggcaccagaggctgcagaa

SEQ ID NO: 2813086 - DNA, 15 bp, Homo sapiens
ggcacccccagcctg

SEQ ID NO: 2813087 - DNA, 21 bp, Homo sapiens
ggcacccccagcctgggccta

SEQ ID NO: 2813088 - DNA, 15 bp, Homo sapiens
ggcaccccctgcagc

SEQ ID NO: 2813089 - DNA, 16 bp, Homo sapiens
ggcaccccctgcagct

SEQ ID NO: 2813090 - DNA, 18 bp, Homo sapiens
ggcaccccctgcagcttg

SEQ ID NO: 2813091 - DNA, 19 bp, Homo sapiens
ggcaccccctgcagcttgt

SEQ ID NO: 2813092 - DNA, 16 bp, Homo sapiens
ggcaccccctggagag

SEQ ID NO: 2813093 - DNA, 18 bp, Homo sapiens
ggcaccccctggagagaa

SEQ ID NO: 2813094 - DNA, 20 bp, Homo sapiens
ggcaccccctggagagaagt

SEQ ID NO: 2813095 - DNA, 17 bp, Homo sapiens
ggcacccggcccctgct

SEQ ID NO: 2813096 - DNA, 20 bp, Homo sapiens
ggcacccttctttcctcttc

SEQ ID NO: 2813097 - DNA, 17 bp, Homo sapiens
ggcacctacatccccag

SEQ ID NO: 2813098 - DNA, 19 bp, Homo sapiens
ggccagatgcaccagccct

SEQ ID NO: 2813099 - DNA, 12 bp, Homo sapiens
ggccagcctggc

SEQ ID NO: 2813100 - DNA, 15 bp, Homo sapiens
ggccagcctggcctc

SEQ ID NO: 2813101 - DNA, 17 bp, Homo sapiens
ggccagcctggcctcct

SEQ ID NO: 2813102 - DNA, 18 bp, Homo sapiens
ggccagcctggcctcctg

SEQ ID NO: 2813103 - DNA, 19 bp, Homo sapiens
ggccagcctggcctcctgc

SEQ ID NO: 2813104 - DNA, 21 bp, Homo sapiens
ggccagcctggcctcctgcct

SEQ ID NO: 2813105 - DNA, 16 bp, Homo sapiens
ggccaggccaccagga

SEQ ID NO: 2813106 - DNA, 16 bp, Homo sapiens
ggccaggccagaggga

SEQ ID NO: 2813107 - DNA, 16 bp, Homo sapiens
ggccaggctggtctca

SEQ ID NO: 2813108 - DNA, 18 bp, Homo sapiens
ggccaggctggtctcaaa

SEQ ID NO: 2813109 - DNA, 13 bp, Homo sapiens
ggccagggccctg

SEQ ID NO: 2813110 - DNA, 17 bp, Homo sapiens
ggccagggccctgcaga

SEQ ID NO: 2813111 - DNA, 18 bp, Homo sapiens
ggccagggccctgcagag

SEQ ID NO: 2813112 - DNA, 14 bp, Homo sapiens
ggccaggtgcagtg

SEQ ID NO: 2813113 - DNA, 17 bp, Homo sapiens
ggccaggttatgcctca

SEQ ID NO: 2813114 - DNA, 17 bp, Homo sapiens
ggccaggtttctgccca

SEQ ID NO: 2813115 - DNA, 16 bp, Homo sapiens
ggccagtctgggctgc

SEQ ID NO: 2813116 - DNA, 20 bp, Homo sapiens
ggccagtgtgacaaggattg

SEQ ID NO: 2813117 - DNA, 20 bp, Homo sapiens
ggccatgcttcttgcccctt

SEQ ID NO: 2813118 - DNA, 13 bp, Homo sapiens
ggcccacagctcc

SEQ ID NO: 2813119 - DNA, 20 bp, Homo sapiens
ggcccacagggaaccctgct

SEQ ID NO: 2813120 - DNA, 15 bp, Homo sapiens
ggcccactgcagaga

SEQ ID NO: 2813121 - DNA, 16 bp, Homo sapiens
ggcccagagacccctt

SEQ ID NO: 2813122 - DNA, 18 bp, Homo sapiens
ggcccagagaccccttcc

SEQ ID NO: 2813123 - DNA, 12 bp, Homo sapiens
ggcccagagagg

SEQ ID NO: 2813124 - DNA, 17 bp, Homo sapiens
ggcccagagctggaaca

SEQ ID NO: 2813125 - DNA, 15 bp, Homo sapiens
ggccccaccacctag

SEQ ID NO: 2813126 - DNA, 23 bp, Homo sapiens
ggccccaccctcgtggacacctg

SEQ ID NO: 2813127 - DNA, 19 bp, Homo sapiens
ggccccagaaggcagggaa

SEQ ID NO: 2813128 - DNA, 13 bp, Homo sapiens
ggccccagcacta

SEQ ID NO: 2813129 - DNA, 18 bp, Homo sapiens
ggccccagggctaccctc

SEQ ID NO: 2813130 - DNA, 16 bp, Homo sapiens
ggccccatcagaggct

SEQ ID NO: 2813131 - DNA, 23 bp, Homo sapiens
ggccccatcagaggctgggggag

SEQ ID NO: 2813132 - DNA, 14 bp, Homo sapiens
ggccccatgacctc

SEQ ID NO: 2813133 - DNA, 14 bp, Homo sapiens
ggcccccccagctg

SEQ ID NO: 2813134 - DNA, 17 bp, Homo sapiens
ggccccccgcagcaccc

SEQ ID NO: 2813135 - DNA, 15 bp, Homo sapiens
ggcccccctccaggc

SEQ ID NO: 2813136 - DNA, 18 bp, Homo sapiens
ggcccccctccaggcatg

SEQ ID NO: 2813137 - DNA, 20 bp, Homo sapiens
ggccccgtcagccacacctg

SEQ ID NO: 2813138 - DNA, 17 bp, Homo sapiens
ggcccctgccaccctgg

SEQ ID NO: 2813139 - DNA, 17 bp, Homo sapiens
ggcccctgcccggctgc

SEQ ID NO: 2813140 - DNA, 13 bp, Homo sapiens
ggcccctgctggt

SEQ ID NO: 2813141 - DNA, 20 bp, Homo sapiens
ggcccgagcagctgagcagg

SEQ ID NO: 2813142 - DNA, 18 bp, Homo sapiens
ggcccgctttgcctgctt

SEQ ID NO: 2813143 - DNA, 13 bp, Homo sapiens
ggcccggctccag

SEQ ID NO: 2813144 - DNA, 15 bp, Homo sapiens
ggcccggctccaggc

SEQ ID NO: 2813145 - DNA, 15 bp, Homo sapiens
ggccctaccagaggg

SEQ ID NO: 2813146 - DNA, 18 bp, Homo sapiens
ggccctggatcagcgtgg

SEQ ID NO: 2813147 - DNA, 23 bp, Homo sapiens
ggccctggatcagcgtggccttg

SEQ ID NO: 2813148 - DNA, 20 bp, Homo sapiens
ggccctggatgtgcccacag

SEQ ID NO: 2813149 - DNA, 21 bp, Homo sapiens
ggccctggatgtgcccacagg

SEQ ID NO: 2813150 - DNA, 22 bp, Homo sapiens
ggccctggatgtgcccacaggg

SEQ ID NO: 2813151 - DNA, 23 bp, Homo sapiens
ggccctggatgtgcccacaggga

SEQ ID NO: 2813152 - DNA, 16 bp, Homo sapiens
ggccctggcctgctgg

SEQ ID NO: 2813153 - DNA, 16 bp, Homo sapiens
ggccctggggcctgta

SEQ ID NO: 2813154 - DNA, 12 bp, Homo sapiens
ggccctggtcct

SEQ ID NO: 2813155 - DNA, 15 bp, Homo sapiens
ggccctggtccttcc

SEQ ID NO: 2813156 - DNA, 12 bp, Homo sapiens
ggcccttcctgg

SEQ ID NO: 2813157 - DNA, 20 bp, Homo sapiens
ggcccttcctggacagctgt

SEQ ID NO: 2813158 - DNA, 21 bp, Homo sapiens
ggcccttcctggacagctgtg

SEQ ID NO: 2813159 - DNA, 22 bp, Homo sapiens
ggcccttcctggacagctgtgc

SEQ ID NO: 2813160 - DNA, 17 bp, Homo sapiens
ggccgagggaaatgctg

SEQ ID NO: 2813161 - DNA, 16 bp, Homo sapiens
ggccgcattccctgag

SEQ ID NO: 2813162 - DNA, 17 bp, Homo sapiens
ggccgcattccctgagt

SEQ ID NO: 2813163 - DNA, 16 bp, Homo sapiens
ggccgctgccccagcc

SEQ ID NO: 2813164 - DNA, 18 bp, Homo sapiens
ggccgctgctttgcgctg

SEQ ID NO: 2813165 - DNA, 24 bp, Homo sapiens
ggccgctgctttgcgctggtggac

SEQ ID NO: 2813166 - DNA, 19 bp, Homo sapiens
ggccgctgttcacccacag

SEQ ID NO: 2813167 - DNA, 19 bp, Homo sapiens
ggccggggaactggccaag

SEQ ID NO: 2813168 - DNA, 20 bp, Homo sapiens
ggccggggaactggccaagc

SEQ ID NO: 2813169 - DNA, 17 bp, Homo sapiens
ggcctagatccacacac

SEQ ID NO: 2813170 - DNA, 16 bp, Homo sapiens
ggcctagcaggcacag

SEQ ID NO: 2813171 - DNA, 18 bp, Homo sapiens
ggcctatgacttgggcac

SEQ ID NO: 2813172 - DNA, 20 bp, Homo sapiens
ggcctatgcacatatggact

SEQ ID NO: 2813173 - DNA, 15 bp, Homo sapiens
ggcctatggagagcc

SEQ ID NO: 2813174 - DNA, 19 bp, Homo sapiens
ggcctatggagagccctgg

SEQ ID NO: 2813175 - DNA, 23 bp, Homo sapiens
ggcctcaaagcaagcattcagaa

SEQ ID NO: 2813176 - DNA, 22 bp, Homo sapiens
ggcctcaagtgattctcctgcc

SEQ ID NO: 2813177 - DNA, 18 bp, Homo sapiens
ggcctcacgcccagcctc

SEQ ID NO: 2813178 - DNA, 21 bp, Homo sapiens
ggcctcacgcccagcctcctc

SEQ ID NO: 2813179 - DNA, 18 bp, Homo sapiens
ggcctcccaataaagctg

SEQ ID NO: 2813180 - DNA, 19 bp, Homo sapiens
ggcctcccaataaagctgg

SEQ ID NO: 2813181 - DNA, 20 bp, Homo sapiens
ggcctcccaataaagctgga

SEQ ID NO: 2813182 - DNA, 22 bp, Homo sapiens
ggcctccccccagcccctcctc

SEQ ID NO: 2813183 - DNA, 23 bp, Homo sapiens
ggcctccccccagcccctcctcc

SEQ ID NO: 2813184 - DNA, 14 bp, Homo sapiens
ggcctcctgtgtgt

SEQ ID NO: 2813185 - DNA, 13 bp, Homo sapiens
ggcctcggagcct

SEQ ID NO: 2813186 - DNA, 19 bp, Homo sapiens
ggcctcggagcctcatccg

SEQ ID NO: 2813187 - DNA, 18 bp, Homo sapiens
ggcctctctcttcccagc

SEQ ID NO: 2813188 - DNA, 20 bp, Homo sapiens
gggcagcagccagccctgcc

SEQ ID NO: 2813189 - DNA, 20 bp, Homo sapiens
gggcagcatagcaagacaca

SEQ ID NO: 2813190 - DNA, 12 bp, Homo sapiens
gggcagctcctc

SEQ ID NO: 2813191 - DNA, 14 bp, Homo sapiens
gggcagctcctctg

SEQ ID NO: 2813192 - DNA, 17 bp, Homo sapiens
gggcagctcctctgtct

SEQ ID NO: 2813193 - DNA, 21 bp, Homo sapiens
gggcagctcctctgtctcgag

SEQ ID NO: 2813194 - DNA, 19 bp, Homo sapiens
gggcaggagtagctgagct

SEQ ID NO: 2813195 - DNA, 12 bp, Homo sapiens
gggcagggctgg

SEQ ID NO: 2813196 - DNA, 21 bp, Homo sapiens
gggcagtggtaagctctggct

SEQ ID NO: 2813197 - DNA, 22 bp, Homo sapiens
gggcagtggtaagctctggctt

SEQ ID NO: 2813198 - DNA, 19 bp, Homo sapiens
gggcagttcgcagccaccc

SEQ ID NO: 2813199 - DNA, 21 bp, Homo sapiens
gggcagttcgcagccaccctg

SEQ ID NO: 2813200 - DNA, 18 bp, Homo sapiens
gggcatattaaaggcttt

SEQ ID NO: 2813201 - DNA, 17 bp, Homo sapiens
gggcatgctggggcaag

SEQ ID NO: 2813202 - DNA, 15 bp, Homo sapiens
gggcattgagcaagc

SEQ ID NO: 2813203 - DNA, 14 bp, Homo sapiens
gggccacgtgccag

SEQ ID NO: 2813204 - DNA, 19 bp, Homo sapiens
gggccacgtgccaggcccg

SEQ ID NO: 2813205 - DNA, 17 bp, Homo sapiens
gggccactccttcctgc

SEQ ID NO: 2813206 - DNA, 19 bp, Homo sapiens
gggccactccttcctgccc

SEQ ID NO: 2813207 - DNA, 17 bp, Homo sapiens
gggccactctcccctcc

SEQ ID NO: 2813208 - DNA, 18 bp, Homo sapiens
gggccactctcccctccc

SEQ ID NO: 2813209 - DNA, 14 bp, Homo sapiens
gggccagggccctg

SEQ ID NO: 2813210 - DNA, 16 bp, Homo sapiens
gggccagggccctgca

SEQ ID NO: 2813211 - DNA, 18 bp, Homo sapiens
gggccagggccctgcaga

SEQ ID NO: 2813212 - DNA, 20 bp, Homo sapiens
gggcccacagacagatccca

SEQ ID NO: 2813213 - DNA, 15 bp, Homo sapiens
gggccccaccaccta

SEQ ID NO: 2813214 - DNA, 18 bp, Homo sapiens
gggccccagaaggcaggg

SEQ ID NO: 2813215 - DNA, 22 bp, Homo sapiens
gggccctgagctcggtggaccc

SEQ ID NO: 2813216 - DNA, 15 bp, Homo sapiens
gggccctggggcctg

SEQ ID NO: 2813217 - DNA, 17 bp, Homo sapiens
gggccggggaactggcc

SEQ ID NO: 2813218 - DNA, 20 bp, Homo sapiens
gggccggggaactggccaag

SEQ ID NO: 2813219 - DNA, 22 bp, Homo sapiens
gggcctagatccacacacagag

SEQ ID NO: 2813220 - DNA, 23 bp, Homo sapiens
gggcctagatccacacacagagg

SEQ ID NO: 2813221 - DNA, 14 bp, Homo sapiens
gggcctatggagag

SEQ ID NO: 2813222 - DNA, 21 bp, Homo sapiens
gggcctatggagagccctggg

SEQ ID NO: 2813223 - DNA, 14 bp, Homo sapiens
gggcctcagtgcca

SEQ ID NO: 2813224 - DNA, 15 bp, Homo sapiens
gggcctgctgctgag

SEQ ID NO: 2813225 - DNA, 16 bp, Homo sapiens
gggcctgctgctgaga

SEQ ID NO: 2813226 - DNA, 23 bp, Homo sapiens
gggcctgctgctgagaacctggc

SEQ ID NO: 2813227 - DNA, 13 bp, Homo sapiens
gggcctggctggc

SEQ ID NO: 2813228 - DNA, 16 bp, Homo sapiens
gggcctggctggctga

SEQ ID NO: 2813229 - DNA, 17 bp, Homo sapiens
gggcctggctggctgag

SEQ ID NO: 2813230 - DNA, 18 bp, Homo sapiens
gggcctggctggctgagg

SEQ ID NO: 2813231 - DNA, 15 bp, Homo sapiens
gggcctgtactgcct

SEQ ID NO: 2813232 - DNA, 16 bp, Homo sapiens
gggcctgtactgcctg

SEQ ID NO: 2813233 - DNA, 17 bp, Homo sapiens
gggcctgtactgcctgc

SEQ ID NO: 2813234 - DNA, 12 bp, Homo sapiens
gggccttgccca

SEQ ID NO: 2813235 - DNA, 14 bp, Homo sapiens
gggccttgcccaga

SEQ ID NO: 2813236 - DNA, 17 bp, Homo sapiens
gggccttgcccagagat

SEQ ID NO: 2813237 - DNA, 14 bp, Homo sapiens
gggcgggggagcca

SEQ ID NO: 2813238 - DNA, 20 bp, Homo sapiens
gggcgtcgctggacaaccca

SEQ ID NO: 2813239 - DNA, 23 bp, Homo sapiens
gggctaagagctagcgctgccgc

SEQ ID NO: 2813240 - DNA, 14 bp, Homo sapiens
gggctagcagaagt

SEQ ID NO: 2813241 - DNA, 15 bp, Homo sapiens
gggctagttgggctt

SEQ ID NO: 2813242 - DNA, 20 bp, Homo sapiens
gggctcagcagccagaggag

SEQ ID NO: 2813243 - DNA, 16 bp, Homo sapiens
gggctcagcctggtgg

SEQ ID NO: 2813244 - DNA, 19 bp, Homo sapiens
gggctcagcggggacagct

SEQ ID NO: 2813245 - DNA, 21 bp, Homo sapiens
gggctcagcggggacagctcc

SEQ ID NO: 2813246 - DNA, 23 bp, Homo sapiens
gggctcctggaaaggctcagtct

SEQ ID NO: 2813247 - DNA, 18 bp, Homo sapiens
gggctcctttctccagcc

SEQ ID NO: 2813248 - DNA, 20 bp, Homo sapiens
gggctcctttctccagccag

SEQ ID NO: 2813249 - DNA, 21 bp, Homo sapiens
gggctcctttctccagccagc

SEQ ID NO: 2813250 - DNA, 16 bp, Homo sapiens
gggctctaacgcctga

SEQ ID NO: 2813251 - DNA, 18 bp, Homo sapiens
gggctctaacgcctgagc

SEQ ID NO: 2813252 - DNA, 20 bp, Homo sapiens
gggctctaacgcctgagccc

SEQ ID NO: 2813253 - DNA, 19 bp, Homo sapiens
gggctctccacctcagcct

SEQ ID NO: 2813254 - DNA, 22 bp, Homo sapiens
gggctctcctggcttcccatcc

SEQ ID NO: 2813255 - DNA, 11 bp, Homo sapiens
gggctctgagg

SEQ ID NO: 2813256 - DNA, 15 bp, Homo sapiens
gggctctgaggcgcc

SEQ ID NO: 2813257 - DNA, 20 bp, Homo sapiens
gggctctgccccagctctgg

SEQ ID NO: 2813258 - DNA, 18 bp, Homo sapiens
gggctgaacggggagaaa

SEQ ID NO: 2813259 - DNA, 18 bp, Homo sapiens
gggctgaactgagcctag

SEQ ID NO: 2813260 - DNA, 16 bp, Homo sapiens
gggctgagccctggca

SEQ ID NO: 2813261 - DNA, 18 bp, Homo sapiens
gggctgagccctggcagg

SEQ ID NO: 2813262 - DNA, 22 bp, Homo sapiens
gggctgcccctgtaggttgctt

SEQ ID NO: 2813263 - DNA, 12 bp, Homo sapiens
gggctgccctgc

SEQ ID NO: 2813264 - DNA, 13 bp, Homo sapiens
gggctgccctgcc

SEQ ID NO: 2813265 - DNA, 16 bp, Homo sapiens
gggctgctcctccagg

SEQ ID NO: 2813266 - DNA, 18 bp, Homo sapiens
gggctgctcctccagggc

SEQ ID NO: 2813267 - DNA, 19 bp, Homo sapiens
gggctgctcctccagggcc

SEQ ID NO: 2813268 - DNA, 23 bp, Homo sapiens
gggctggaaaagtcacacagaca

SEQ ID NO: 2813269 - DNA, 18 bp, Homo sapiens
gggctgggagctctgcag

SEQ ID NO: 2813270 - DNA, 16 bp, Homo sapiens
gggcttcagtggcagc

SEQ ID NO: 2813271 - DNA, 16 bp, Homo sapiens
gggcttctcctgaccc

SEQ ID NO: 2813272 - DNA, 15 bp, Homo sapiens
gggcttgggccctgc

SEQ ID NO: 2813273 - DNA, 19 bp, Homo sapiens
gggcttgggccctgcacag

SEQ ID NO: 2813274 - DNA, 22 bp, Homo sapiens
ggggaagcaagacgtcctggaa

SEQ ID NO: 2813275 - DNA, 13 bp, Homo sapiens
ggggaagccctgg

SEQ ID NO: 2813276 - DNA, 14 bp, Homo sapiens
ggggaagccctgga

SEQ ID NO: 2813277 - DNA, 13 bp, Homo sapiens
ggggaagggccag

SEQ ID NO: 2813278 - DNA, 19 bp, Homo sapiens
ggtcaacatggtgaaaccc

SEQ ID NO: 2813279 - DNA, 17 bp, Homo sapiens
ggtcacattcaggaaga

SEQ ID NO: 2813280 - DNA, 21 bp, Homo sapiens
ggtcacattcaggaagatgaa

SEQ ID NO: 2813281 - DNA, 17 bp, Homo sapiens
ggtcactggagtagttg

SEQ ID NO: 2813282 - DNA, 15 bp, Homo sapiens
ggtcagagcctgcag

SEQ ID NO: 2813283 - DNA, 16 bp, Homo sapiens
ggtcagagcctgcagt

SEQ ID NO: 2813284 - DNA, 13 bp, Homo sapiens
ggtcagccagggc

SEQ ID NO: 2813285 - DNA, 22 bp, Homo sapiens
ggtcaggcggggtgctgtggtg

SEQ ID NO: 2813286 - DNA, 13 bp, Homo sapiens
ggtcaggctccat

SEQ ID NO: 2813287 - DNA, 19 bp, Homo sapiens
ggtcaggtgttcaagacca

SEQ ID NO: 2813288 - DNA, 13 bp, Homo sapiens
ggtccacccagga

SEQ ID NO: 2813289 - DNA, 20 bp, Homo sapiens
ggtccagctcttggcccctg

SEQ ID NO: 2813290 - DNA, 21 bp, Homo sapiens
ggtccagctcttggcccctgt

SEQ ID NO: 2813291 - DNA, 21 bp, Homo sapiens
ggtccagggttgatcacactc

SEQ ID NO: 2813292 - DNA, 16 bp, Homo sapiens
ggtcccacatccctgg

SEQ ID NO: 2813293 - DNA, 17 bp, Homo sapiens
ggtcccacatccctggg

SEQ ID NO: 2813294 - DNA, 23 bp, Homo sapiens
ggtcccacatccctgggcctgct

SEQ ID NO: 2813295 - DNA, 14 bp, Homo sapiens
ggtcccactcagtc

SEQ ID NO: 2813296 - DNA, 22 bp, Homo sapiens
ggtcccactcagtccatagcag

SEQ ID NO: 2813297 - DNA, 16 bp, Homo sapiens
ggtccccatcatccca

SEQ ID NO: 2813298 - DNA, 18 bp, Homo sapiens
ggtccccatcatcccagc

SEQ ID NO: 2813299 - DNA, 15 bp, Homo sapiens
ggtccctgccagtgt

SEQ ID NO: 2813300 - DNA, 20 bp, Homo sapiens
ggtcccttgagacctcagcc

SEQ ID NO: 2813301 - DNA, 21 bp, Homo sapiens
ggtcccttgagacctcagcca

SEQ ID NO: 2813302 - DNA, 23 bp, Homo sapiens
ggtcctgagcactgccaggaggg

SEQ ID NO: 2813303 - DNA, 18 bp, Homo sapiens
ggtcctgcaatctccagg

SEQ ID NO: 2813304 - DNA, 19 bp, Homo sapiens
ggtcctgcaatctccaggg

SEQ ID NO: 2813305 - DNA, 22 bp, Homo sapiens
ggtcctggggctctgtgcaggg

SEQ ID NO: 2813306 - DNA, 21 bp, Homo sapiens
ggtcctggtggggcagctcct

SEQ ID NO: 2813307 - DNA, 14 bp, Homo sapiens
ggtcgcccaggaga

SEQ ID NO: 2813308 - DNA, 21 bp, Homo sapiens
ggtctcactatgttgcccagg

SEQ ID NO: 2813309 - DNA, 16 bp, Homo sapiens
ggtctcactctgtcgc

SEQ ID NO: 2813310 - DNA, 22 bp, Homo sapiens
ggtctcactctgtcgcccagtc

SEQ ID NO: 2813311 - DNA, 23 bp, Homo sapiens
ggtctcactctgtcgcccagtct

SEQ ID NO: 2813312 - DNA, 14 bp, Homo sapiens
ggtctcagcttcat

SEQ ID NO: 2813313 - DNA, 15 bp, Homo sapiens
ggtctcagcttcatt

SEQ ID NO: 2813314 - DNA, 17 bp, Homo sapiens
ggtctcagcttcatttc

SEQ ID NO: 2813315 - DNA, 14 bp, Homo sapiens
ggtctctccactgc

SEQ ID NO: 2813316 - DNA, 13 bp, Homo sapiens
ggtctgaaatgga

SEQ ID NO: 2813317 - DNA, 16 bp, Homo sapiens
ggtctgagcaccccct

SEQ ID NO: 2813318 - DNA, 12 bp, Homo sapiens
ggtctgccacca

SEQ ID NO: 2813319 - DNA, 13 bp, Homo sapiens
ggtctgccctggg

SEQ ID NO: 2813320 - DNA, 15 bp, Homo sapiens
ggtctgccctgggct

SEQ ID NO: 2813321 - DNA, 13 bp, Homo sapiens
ggtctttgaataa

SEQ ID NO: 2813322 - DNA, 19 bp, Homo sapiens
ggtctttgaataaagtctg

SEQ ID NO: 2813323 - DNA, 10 bp, Homo sapiens
ggtgaaatta

SEQ ID NO: 2813324 - DNA, 12 bp, Homo sapiens
ggtgaaattatg

SEQ ID NO: 2813325 - DNA, 16 bp, Homo sapiens
ggtgaagaaaactcct

SEQ ID NO: 2813326 - DNA, 15 bp, Homo sapiens
ggtgaccccagggca

SEQ ID NO: 2813327 - DNA, 22 bp, Homo sapiens
ggtgacccggcaccccctgcag

SEQ ID NO: 2813328 - DNA, 14 bp, Homo sapiens
ggtgacctctgcct

SEQ ID NO: 2813329 - DNA, 15 bp, Homo sapiens
ggtgagaccacctct

SEQ ID NO: 2813330 - DNA, 12 bp, Homo sapiens
ggtgagagctgc

SEQ ID NO: 2813331 - DNA, 14 bp, Homo sapiens
ggtgataagtggaa

SEQ ID NO: 2813332 - DNA, 19 bp, Homo sapiens
ggtgatcaattaaatgtag

SEQ ID NO: 2813333 - DNA, 19 bp, Homo sapiens
ggtgatgagggcagcagcc

SEQ ID NO: 2813334 - DNA, 13 bp, Homo sapiens
ggtgcacaggagg

SEQ ID NO: 2813335 - DNA, 16 bp, Homo sapiens
ggtgcagagctgaaga

SEQ ID NO: 2813336 - DNA, 22 bp, Homo sapiens
ggtgcagaggtgagcagaggag

SEQ ID NO: 2813337 - DNA, 22 bp, Homo sapiens
ggtgccccccttgccagacatg

SEQ ID NO: 2813338 - DNA, 10 bp, Homo sapiens
ggtgcctggc

SEQ ID NO: 2813339 - DNA, 19 bp, Homo sapiens
ggtgcctgggtggggctgc

SEQ ID NO: 2813340 - DNA, 21 bp, Homo sapiens
ggtgcctgtgaggcaggggcg

SEQ ID NO: 2813341 - DNA, 23 bp, Homo sapiens
ggtgccttcttattctcactcca

SEQ ID NO: 2813342 - DNA, 23 bp, Homo sapiens
ggtgcgagagaggtgggcagcag

SEQ ID NO: 2813343 - DNA, 15 bp, Homo sapiens
ggtgcgatctgggtt

SEQ ID NO: 2813344 - DNA, 23 bp, Homo sapiens
ggtgctaaatggtcgcccaggag

SEQ ID NO: 2813345 - DNA, 17 bp, Homo sapiens
ggtgctataggctggag

SEQ ID NO: 2813346 - DNA, 13 bp, Homo sapiens
ggtgctggaggat

SEQ ID NO: 2813347 - DNA, 22 bp, Homo sapiens
ggtggatccactgtgcaggagt

SEQ ID NO: 2813348 - DNA, 14 bp, Homo sapiens
ggtggatgcctggt

SEQ ID NO: 2813349 - DNA, 20 bp, Homo sapiens
ggtggcacacgcctgtaatc

SEQ ID NO: 2813350 - DNA, 18 bp, Homo sapiens
ggtggcagccctgtaggg

SEQ ID NO: 2813351 - DNA, 11 bp, Homo sapiens
ggtggcagctg

SEQ ID NO: 2813352 - DNA, 15 bp, Homo sapiens
ggtggcagctgcggt

SEQ ID NO: 2813353 - DNA, 23 bp, Homo sapiens
ggtggcagctgcggtccacccag

SEQ ID NO: 2813354 - DNA, 17 bp, Homo sapiens
ggtggcaggaccaggac

SEQ ID NO: 2813355 - DNA, 22 bp, Homo sapiens
ggtggcagtgggagctgcctgt

SEQ ID NO: 2813356 - DNA, 17 bp, Homo sapiens
ggtggccatgcttcttg

SEQ ID NO: 2813357 - DNA, 21 bp, Homo sapiens
ggtggcgactctatagactct

SEQ ID NO: 2813358 - DNA, 19 bp, Homo sapiens
ggtggcgggcacctatagt

SEQ ID NO: 2813359 - DNA, 14 bp, Homo sapiens
ggtggctactctgt

SEQ ID NO: 2813360 - DNA, 22 bp, Homo sapiens
ggtggctactctgtgccagagc

SEQ ID NO: 2813361 - DNA, 16 bp, Homo sapiens
ggtggctagtcagaga

SEQ ID NO: 2813362 - DNA, 22 bp, Homo sapiens
ggtggctgacccagtccctggg

SEQ ID NO: 2813363 - DNA, 18 bp, Homo sapiens
ggtggctgggttggaggg

SEQ ID NO: 2813364 - DNA, 22 bp, Homo sapiens
ggtgggaaatggtatgagctga

SEQ ID NO: 2813365 - DNA, 16 bp, Homo sapiens
ggtgggaatcagatct

SEQ ID NO: 2813366 - DNA, 14 bp, Homo sapiens
ggtgggcagcagct

SEQ ID NO: 2813367 - DNA, 16 bp, Homo sapiens
ggtgggcagcagctca

SEQ ID NO: 2813368 - DNA, 23 bp, Homo sapiens
gtaatgcacaatttagaaaacat

SEQ ID NO: 2813369 - DNA, 16 bp, Homo sapiens
gtaatgggccaattaa

SEQ ID NO: 2813370 - DNA, 20 bp, Homo sapiens
gtaatgggccaattaaaata

SEQ ID NO: 2813371 - DNA, 17 bp, Homo sapiens
gtaatgtatcttattta

SEQ ID NO: 2813372 - DNA, 16 bp, Homo sapiens
gtaattaataaacgaa

SEQ ID NO: 2813373 - DNA, 22 bp, Homo sapiens
gtaattctaaatgaatgtttac

SEQ ID NO: 2813374 - DNA, 16 bp, Homo sapiens
gtaattgaataaagtt

SEQ ID NO: 2813375 - DNA, 21 bp, Homo sapiens
gtaattggtgacaatgtcaca

SEQ ID NO: 2813376 - DNA, 15 bp, Homo sapiens
gtaattttgtttgta

SEQ ID NO: 2813377 - DNA, 18 bp, Homo sapiens
gtaattttgtttgtaatc

SEQ ID NO: 2813378 - DNA, 15 bp, Homo sapiens
gtacaagaagcattt

SEQ ID NO: 2813379 - DNA, 13 bp, Homo sapiens
gtacaatatttaa

SEQ ID NO: 2813380 - DNA, 16 bp, Homo sapiens
gtacacacacatacac

SEQ ID NO: 2813381 - DNA, 18 bp, Homo sapiens
gtacacagcaccagaatg

SEQ ID NO: 2813382 - DNA, 15 bp, Homo sapiens
gtacacgtgtcctgt

SEQ ID NO: 2813383 - DNA, 23 bp, Homo sapiens
gtacagaatttttaatgactttt

SEQ ID NO: 2813384 - DNA, 23 bp, Homo sapiens
gtacagtagcttaaataaattca

SEQ ID NO: 2813385 - DNA, 17 bp, Homo sapiens
gtacagtggagaaatat

SEQ ID NO: 2813386 - DNA, 21 bp, Homo sapiens
gtacagttatttatgcctctg

SEQ ID NO: 2813387 - DNA, 23 bp, Homo sapiens
gtacataaaggtggtatgtgtgt

SEQ ID NO: 2813388 - DNA, 19 bp, Homo sapiens
gtacatatggaaatcctgt

SEQ ID NO: 2813389 - DNA, 17 bp, Homo sapiens
gtacattcaatgtttat

SEQ ID NO: 2813390 - DNA, 13 bp, Homo sapiens
gtacattcctgat

SEQ ID NO: 2813391 - DNA, 23 bp, Homo sapiens
gtacattcctgatactgggtaca

SEQ ID NO: 2813392 - DNA, 15 bp, Homo sapiens
gtaccaatcatttta

SEQ ID NO: 2813393 - DNA, 21 bp, Homo sapiens
gtaccaatcattttaattatt

SEQ ID NO: 2813394 - DNA, 18 bp, Homo sapiens
gtaccagctcactccctg

SEQ ID NO: 2813395 - DNA, 19 bp, Homo sapiens
gtaccagtgtactgctttc

SEQ ID NO: 2813396 - DNA, 19 bp, Homo sapiens
gtacccaccgggccactcc

SEQ ID NO: 2813397 - DNA, 17 bp, Homo sapiens
gtacccccgtggtcttt

SEQ ID NO: 2813398 - DNA, 20 bp, Homo sapiens
gtacccccgtggtctttgaa

SEQ ID NO: 2813399 - DNA, 23 bp, Homo sapiens
gtacccccgtggtctttgaataa

SEQ ID NO: 2813400 - DNA, 20 bp, Homo sapiens
gtaccgcgtctaccctggga

SEQ ID NO: 2813401 - DNA, 17 bp, Homo sapiens
gtacgtctgacaggcaa

SEQ ID NO: 2813402 - DNA, 21 bp, Homo sapiens
gtactactagatgtctttagg

SEQ ID NO: 2813403 - DNA, 18 bp, Homo sapiens
gtactactgctgcaaagt

SEQ ID NO: 2813404 - DNA, 20 bp, Homo sapiens
gtactactgctgcaaagtgc

SEQ ID NO: 2813405 - DNA, 22 bp, Homo sapiens
gtactactgctgcaaagtgcaa

SEQ ID NO: 2813406 - DNA, 19 bp, Homo sapiens
gtactagaatttgtatttt

SEQ ID NO: 2813407 - DNA, 17 bp, Homo sapiens
gtactcaggaggctgag

SEQ ID NO: 2813408 - DNA, 16 bp, Homo sapiens
gtactgagccttgtaa

SEQ ID NO: 2813409 - DNA, 21 bp, Homo sapiens
gtactgtaattttgtttgtaa

SEQ ID NO: 2813410 - DNA, 23 bp, Homo sapiens
gtactgtgtacagaattctgcta

SEQ ID NO: 2813411 - DNA, 16 bp, Homo sapiens
gtacttacccggagaa

SEQ ID NO: 2813412 - DNA, 16 bp, Homo sapiens
gtacttcagtcttgga

SEQ ID NO: 2813413 - DNA, 17 bp, Homo sapiens
gtacttcagtcttggag

SEQ ID NO: 2813414 - DNA, 16 bp, Homo sapiens
gtacttctccaccctg

SEQ ID NO: 2813415 - DNA, 21 bp, Homo sapiens
gtacttctccaccctgctctc

SEQ ID NO: 2813416 - DNA, 13 bp, Homo sapiens
gtagaaaagctat

SEQ ID NO: 2813417 - DNA, 17 bp, Homo sapiens
gtagaagggttatattt

SEQ ID NO: 2813418 - DNA, 17 bp, Homo sapiens
gtagaatggcagctgga

SEQ ID NO: 2813419 - DNA, 15 bp, Homo sapiens
gtagaattatatcta

SEQ ID NO: 2813420 - DNA, 17 bp, Homo sapiens
gtagaattatatctaat

SEQ ID NO: 2813421 - DNA, 18 bp, Homo sapiens
gtagaattgggaagctgg

SEQ ID NO: 2813422 - DNA, 15 bp, Homo sapiens
gtagaccaaaataaa

SEQ ID NO: 2813423 - DNA, 11 bp, Homo sapiens
gtagagacagg

SEQ ID NO: 2813424 - DNA, 12 bp, Homo sapiens
gtagagacaggg

SEQ ID NO: 2813425 - DNA, 11 bp, Homo sapiens
gtagagccagg

SEQ ID NO: 2813426 - DNA, 15 bp, Homo sapiens
gtagagccagggtct

SEQ ID NO: 2813427 - DNA, 14 bp, Homo sapiens
gtagagtcactgac

SEQ ID NO: 2813428 - DNA, 21 bp, Homo sapiens
gtagagtggcccagaattgca

SEQ ID NO: 2813429 - DNA, 13 bp, Homo sapiens
gtagcatacattt

SEQ ID NO: 2813430 - DNA, 18 bp, Homo sapiens
gtagccaaggtgggctga

SEQ ID NO: 2813431 - DNA, 11 bp, Homo sapiens
gtagccagccg

SEQ ID NO: 2813432 - DNA, 15 bp, Homo sapiens
gtagccagccggggc

SEQ ID NO: 2813433 - DNA, 14 bp, Homo sapiens
gtagcccagcactg

SEQ ID NO: 2813434 - DNA, 17 bp, Homo sapiens
gtagcccagcactgtga

SEQ ID NO: 2813435 - DNA, 22 bp, Homo sapiens
gtagccttgccttttaaaagaa

SEQ ID NO: 2813436 - DNA, 13 bp, Homo sapiens
gtagctcccagca

SEQ ID NO: 2813437 - DNA, 18 bp, Homo sapiens
gtagctctgtccactctg

SEQ ID NO: 2813438 - DNA, 22 bp, Homo sapiens
gtagctgagctcacaaggcagc

SEQ ID NO: 2813439 - DNA, 18 bp, Homo sapiens
gtagctgggactacaggc

SEQ ID NO: 2813440 - DNA, 13 bp, Homo sapiens
gtagctgtgacct

SEQ ID NO: 2813441 - DNA, 21 bp, Homo sapiens
gtagctgtgacctgctgagct

SEQ ID NO: 2813442 - DNA, 19 bp, Homo sapiens
gtaggactttcctaaatgt

SEQ ID NO: 2813443 - DNA, 17 bp, Homo sapiens
gtaggcatgagggatca

SEQ ID NO: 2813444 - DNA, 20 bp, Homo sapiens
gtaggcatgagggatcacag

SEQ ID NO: 2813445 - DNA, 22 bp, Homo sapiens
gtaggcccggtgtggtggctca

SEQ ID NO: 2813446 - DNA, 23 bp, Homo sapiens
gtagtagttgatgaccaatctct

SEQ ID NO: 2813447 - DNA, 13 bp, Homo sapiens
gtagtatgatggg

SEQ ID NO: 2813448 - DNA, 20 bp, Homo sapiens
gtagtatggcctgtgtcact

SEQ ID NO: 2813449 - DNA, 22 bp, Homo sapiens
gtagtgcccacttgaggctggc

SEQ ID NO: 2813450 - DNA, 21 bp, Homo sapiens
gtagtgtcttcctagtatatt

SEQ ID NO: 2813451 - DNA, 11 bp, Homo sapiens
gtagttaggaa

SEQ ID NO: 2813452 - DNA, 16 bp, Homo sapiens
gtagttaggaaataaa

SEQ ID NO: 2813453 - DNA, 13 bp, Homo sapiens
gtagttccctgaa

SEQ ID NO: 2813454 - DNA, 20 bp, Homo sapiens
gtagttccctgaaaacccag

SEQ ID NO: 2813455 - DNA, 20 bp, Homo sapiens
gtagttgatgaccaatctct

SEQ ID NO: 2813456 - DNA, 24 bp, Homo sapiens
gtagttgatgaccaatctctgtga

SEQ ID NO: 2813457 - DNA, 19 bp, Homo sapiens
gtagtttttcagctagttt

SEQ ID NO: 2813458 - DNA, 16 bp, Homo sapiens
gtcgccacacccggct

SEQ ID NO: 2813459 - DNA, 22 bp, Homo sapiens
gtcgccacacccggctccccct

SEQ ID NO: 2813460 - DNA, 14 bp, Homo sapiens
gtcgcccagtctgg

SEQ ID NO: 2813461 - DNA, 14 bp, Homo sapiens
gtcgcctgccccca

SEQ ID NO: 2813462 - DNA, 20 bp, Homo sapiens
gtcgctctgctggcctggcc

SEQ ID NO: 2813463 - DNA, 16 bp, Homo sapiens
gtcgctggacaaccca

SEQ ID NO: 2813464 - DNA, 17 bp, Homo sapiens
gtcgctggacaacccag

SEQ ID NO: 2813465 - DNA, 22 bp, Homo sapiens
gtcggcacgtcccatgtgcatg

SEQ ID NO: 2813466 - DNA, 18 bp, Homo sapiens
gtcgggagttcgagacca

SEQ ID NO: 2813467 - DNA, 17 bp, Homo sapiens
gtcgtccttactcctgt

SEQ ID NO: 2813468 - DNA, 24 bp, Homo sapiens
gtcgtggagagctaggagcaaagc

SEQ ID NO: 2813469 - DNA, 22 bp, Homo sapiens
gtcgtggcagataatcagcctc

SEQ ID NO: 2813470 - DNA, 16 bp, Homo sapiens
gtcgtgtttacaaaag

SEQ ID NO: 2813471 - DNA, 14 bp, Homo sapiens
gtctaccctgggat

SEQ ID NO: 2813472 - DNA, 14 bp, Homo sapiens
gtctagggagagac

SEQ ID NO: 2813473 - DNA, 20 bp, Homo sapiens
gtctataatggaaacattta

SEQ ID NO: 2813474 - DNA, 21 bp, Homo sapiens
gtctatcaaccccagacactg

SEQ ID NO: 2813475 - DNA, 21 bp, Homo sapiens
gtctatgtaggcccctggtct

SEQ ID NO: 2813476 - DNA, 19 bp, Homo sapiens
gtctcaagcactaaaaagt

SEQ ID NO: 2813477 - DNA, 15 bp, Homo sapiens
gtctcacatttttac

SEQ ID NO: 2813478 - DNA, 11 bp, Homo sapiens
gtctcactctg

SEQ ID NO: 2813479 - DNA, 19 bp, Homo sapiens
gtctcactctgtcgcccag

SEQ ID NO: 2813480 - DNA, 16 bp, Homo sapiens
gtctcactgttgccca

SEQ ID NO: 2813481 - DNA, 22 bp, Homo sapiens
gtctccactaaatgagctcctg

SEQ ID NO: 2813482 - DNA, 23 bp, Homo sapiens
gtctccactaaatgagctcctgc

SEQ ID NO: 2813483 - DNA, 19 bp, Homo sapiens
gtctccagtggttgctgtt

SEQ ID NO: 2813484 - DNA, 20 bp, Homo sapiens
gtctccagtggttgctgttg

SEQ ID NO: 2813485 - DNA, 23 bp, Homo sapiens
gtctccctaaaataaaaaccaga

SEQ ID NO: 2813486 - DNA, 17 bp, Homo sapiens
gtctccctctcctgcct

SEQ ID NO: 2813487 - DNA, 21 bp, Homo sapiens
gtctccctctcctgcctactc

SEQ ID NO: 2813488 - DNA, 22 bp, Homo sapiens
gtctcctcttaaaaaataaaaa

SEQ ID NO: 2813489 - DNA, 20 bp, Homo sapiens
gtctcctttgcactgagggc

SEQ ID NO: 2813490 - DNA, 13 bp, Homo sapiens
gtctcgagcgccc

SEQ ID NO: 2813491 - DNA, 14 bp, Homo sapiens
gtctcgagcgccct

SEQ ID NO: 2813492 - DNA, 23 bp, Homo sapiens
gtctctatgccagctcagtccca

SEQ ID NO: 2813493 - DNA, 12 bp, Homo sapiens
gtctctcagaat

SEQ ID NO: 2813494 - DNA, 15 bp, Homo sapiens
gtctctcatgaacct

SEQ ID NO: 2813495 - DNA, 19 bp, Homo sapiens
gtctctccactgctctcag

SEQ ID NO: 2813496 - DNA, 16 bp, Homo sapiens
gtctctgactcttgcc

SEQ ID NO: 2813497 - DNA, 12 bp, Homo sapiens
gtctctgctgaa

SEQ ID NO: 2813498 - DNA, 16 bp, Homo sapiens
gtctctggaacccagg

SEQ ID NO: 2813499 - DNA, 18 bp, Homo sapiens
gtctctgtccctcactgc

SEQ ID NO: 2813500 - DNA, 21 bp, Homo sapiens
gtctcttccagtttgctttgc

SEQ ID NO: 2813501 - DNA, 22 bp, Homo sapiens
gtctcttttgttcctggctttg

SEQ ID NO: 2813502 - DNA, 18 bp, Homo sapiens
gtctgacaggcaatgctg

SEQ ID NO: 2813503 - DNA, 22 bp, Homo sapiens
gtctgacaggcaatgctggctg

SEQ ID NO: 2813504 - DNA, 13 bp, Homo sapiens
gtctgacccactg

SEQ ID NO: 2813505 - DNA, 19 bp, Homo sapiens
gtctgaggaatccagaccc

SEQ ID NO: 2813506 - DNA, 15 bp, Homo sapiens
gtctgaggtcctgag

SEQ ID NO: 2813507 - DNA, 17 bp, Homo sapiens
gtctgattcccaagctc

SEQ ID NO: 2813508 - DNA, 20 bp, Homo sapiens
gtctgattcccaagctctgc

SEQ ID NO: 2813509 - DNA, 16 bp, Homo sapiens
gtctgccagccagcag

SEQ ID NO: 2813510 - DNA, 18 bp, Homo sapiens
gtctgctcaggaattgaa

SEQ ID NO: 2813511 - DNA, 17 bp, Homo sapiens
gtctggaaaagcacttt

SEQ ID NO: 2813512 - DNA, 15 bp, Homo sapiens
gtctggaatgcagtg

SEQ ID NO: 2813513 - DNA, 16 bp, Homo sapiens
gtctggaatgcagtgg

SEQ ID NO: 2813514 - DNA, 22 bp, Homo sapiens
gtctggatctgggaccctttcc

SEQ ID NO: 2813515 - DNA, 15 bp, Homo sapiens
gtctggctgagctga

SEQ ID NO: 2813516 - DNA, 17 bp, Homo sapiens
gtctggggttcagcccc

SEQ ID NO: 2813517 - DNA, 23 bp, Homo sapiens
gtctggggttcagcccctcctct

SEQ ID NO: 2813518 - DNA, 20 bp, Homo sapiens
gtctgtacacgtgtcctgta

SEQ ID NO: 2813519 - DNA, 21 bp, Homo sapiens
gtctgtacacgtgtcctgtag

SEQ ID NO: 2813520 - DNA, 18 bp, Homo sapiens
gtctgtcctttgccccct

SEQ ID NO: 2813521 - DNA, 11 bp, Homo sapiens
gtctgtgcagc

SEQ ID NO: 2813522 - DNA, 16 bp, Homo sapiens
gtctgttaacttaata

SEQ ID NO: 2813523 - DNA, 17 bp, Homo sapiens
gtctgttcacttttcct

SEQ ID NO: 2813524 - DNA, 12 bp, Homo sapiens
gtcttaaaataa

SEQ ID NO: 2813525 - DNA, 15 bp, Homo sapiens
gtcttaaaataactt

SEQ ID NO: 2813526 - DNA, 22 bp, Homo sapiens
gtcttaaaataacttatatcat

SEQ ID NO: 2813527 - DNA, 19 bp, Homo sapiens
gtcttagaagtggaccagg

SEQ ID NO: 2813528 - DNA, 23 bp, Homo sapiens
gtcttagaagtggaccaggacag

SEQ ID NO: 2813529 - DNA, 18 bp, Homo sapiens
gtcttataggtttccact

SEQ ID NO: 2813530 - DNA, 20 bp, Homo sapiens
gtcttcaaattgtcttttgt

SEQ ID NO: 2813531 - DNA, 12 bp, Homo sapiens
gtcttcagccta

SEQ ID NO: 2813532 - DNA, 17 bp, Homo sapiens
gtcttcagcgagaccct

SEQ ID NO: 2813533 - DNA, 17 bp, Homo sapiens
gtcttcttacttggaac

SEQ ID NO: 2813534 - DNA, 17 bp, Homo sapiens
gtcttgaactcctggcc

SEQ ID NO: 2813535 - DNA, 21 bp, Homo sapiens
gtcttgaactcctggcctcaa

SEQ ID NO: 2813536 - DNA, 19 bp, Homo sapiens
gtcttgcaatggcagcctt

SEQ ID NO: 2813537 - DNA, 22 bp, Homo sapiens
gtcttgcctgccagggcccctg

SEQ ID NO: 2813538 - DNA, 15 bp, Homo sapiens
gtcttggacactgta

SEQ ID NO: 2813539 - DNA, 18 bp, Homo sapiens
gtcttggacactgtacaa

SEQ ID NO: 2813540 - DNA, 15 bp, Homo sapiens
gtcttgtacatgtgt

SEQ ID NO: 2813541 - DNA, 12 bp, Homo sapiens
gtcttgtatttt

SEQ ID NO: 2813542 - DNA, 14 bp, Homo sapiens
gtcttgtattttct

SEQ ID NO: 2813543 - DNA, 16 bp, Homo sapiens
gtctttgaataaagtc

SEQ ID NO: 2813544 - DNA, 17 bp, Homo sapiens
gtctttgaataaagtct

SEQ ID NO: 2813545 - DNA, 19 bp, Homo sapiens
gtctttgtaatgtcaccac

SEQ ID NO: 2813546 - DNA, 16 bp, Homo sapiens
gtcttttttcactaca

SEQ ID NO: 2813547 - DNA, 19 bp, Homo sapiens
gtgaaaataggtatacagt

SEQ ID NO: 2813548 - DNA, 18 bp, Homo sapiens
gtgggagctgcctgttca

SEQ ID NO: 2813549 - DNA, 17 bp, Homo sapiens
gtgggaggtgagaccac

SEQ ID NO: 2813550 - DNA, 16 bp, Homo sapiens
gtgggatggaggagaa

SEQ ID NO: 2813551 - DNA, 17 bp, Homo sapiens
gtgggatggaggagaag

SEQ ID NO: 2813552 - DNA, 17 bp, Homo sapiens
gtgggccactctcccct

SEQ ID NO: 2813553 - DNA, 16 bp, Homo sapiens
gtgggctgagccctgg

SEQ ID NO: 2813554 - DNA, 21 bp, Homo sapiens
gtggggaagcaagacgtcctg

SEQ ID NO: 2813555 - DNA, 14 bp, Homo sapiens
gtggggagacctgg

SEQ ID NO: 2813556 - DNA, 17 bp, Homo sapiens
gtggggcagcttgaggg

SEQ ID NO: 2813557 - DNA, 15 bp, Homo sapiens
gtggggcctagatcc

SEQ ID NO: 2813558 - DNA, 16 bp, Homo sapiens
gtggggctgctcctcc

SEQ ID NO: 2813559 - DNA, 15 bp, Homo sapiens
gtgggggaggtccct

SEQ ID NO: 2813560 - DNA, 17 bp, Homo sapiens
gtgggggcagagggcag

SEQ ID NO: 2813561 - DNA, 18 bp, Homo sapiens
gtgggggcagagggcaga

SEQ ID NO: 2813562 - DNA, 22 bp, Homo sapiens
gtgggggcagagggcagaggct

SEQ ID NO: 2813563 - DNA, 17 bp, Homo sapiens
gtgggggctgtgccgtg

SEQ ID NO: 2813564 - DNA, 14 bp, Homo sapiens
gtggggtctccctc

SEQ ID NO: 2813565 - DNA, 21 bp, Homo sapiens
gtggggtctccctctcctgcc

SEQ ID NO: 2813566 - DNA, 12 bp, Homo sapiens
gtgggtggtgga

SEQ ID NO: 2813567 - DNA, 16 bp, Homo sapiens
gtggtaagctctggct

SEQ ID NO: 2813568 - DNA, 15 bp, Homo sapiens
gtggtatgtgtgtgt

SEQ ID NO: 2813569 - DNA, 15 bp, Homo sapiens
gtggtccagctcttg

SEQ ID NO: 2813570 - DNA, 19 bp, Homo sapiens
gtggtctttgaataaagtc

SEQ ID NO: 2813571 - DNA, 20 bp, Homo sapiens
gtggtgaaggaccctggctc

SEQ ID NO: 2813572 - DNA, 14 bp, Homo sapiens
gtggtgacctctgc

SEQ ID NO: 2813573 - DNA, 19 bp, Homo sapiens
gtggtgcgatctgggttca

SEQ ID NO: 2813574 - DNA, 15 bp, Homo sapiens
gtggtggctgtctct

SEQ ID NO: 2813575 - DNA, 18 bp, Homo sapiens
gtggtggctgtctctgtc

SEQ ID NO: 2813576 - DNA, 21 bp, Homo sapiens
gtggtttgatggtgacttcct

SEQ ID NO: 2813577 - DNA, 17 bp, Homo sapiens
gtgtaacaggtctcctc

SEQ ID NO: 2813578 - DNA, 16 bp, Homo sapiens
gtgtaatgcacaattt

SEQ ID NO: 2813579 - DNA, 21 bp, Homo sapiens
gtgtaatgcacaatttagaaa

SEQ ID NO: 2813580 - DNA, 13 bp, Homo sapiens
gtgtacaaagtag

SEQ ID NO: 2813581 - DNA, 18 bp, Homo sapiens
gtgtacagaattctgcta

SEQ ID NO: 2813582 - DNA, 14 bp, Homo sapiens
gtgtacccactcct

SEQ ID NO: 2813583 - DNA, 21 bp, Homo sapiens
gtgtacccactcctcactgcc

SEQ ID NO: 2813584 - DNA, 14 bp, Homo sapiens
gtgtagccaaggtc

SEQ ID NO: 2813585 - DNA, 16 bp, Homo sapiens
gtgtagccttgcccgg

SEQ ID NO: 2813586 - DNA, 12 bp, Homo sapiens
gtgtagctgtga

SEQ ID NO: 2813587 - DNA, 15 bp, Homo sapiens
gtgtagctgtgacct

SEQ ID NO: 2813588 - DNA, 16 bp, Homo sapiens
gtgtagctgtgacctg

SEQ ID NO: 2813589 - DNA, 18 bp, Homo sapiens
gtgtagctgtgacctgct

SEQ ID NO: 2813590 - DNA, 19 bp, Homo sapiens
gtgtatggaaataaatgta

SEQ ID NO: 2813591 - DNA, 19 bp, Homo sapiens
gtgtatttttgtttaatca

SEQ ID NO: 2813592 - DNA, 18 bp, Homo sapiens
gtgtcaggtggggcagct

SEQ ID NO: 2813593 - DNA, 19 bp, Homo sapiens
gtgtcatattaaacttctg

SEQ ID NO: 2813594 - DNA, 13 bp, Homo sapiens
gtgtcatgatttc

SEQ ID NO: 2813595 - DNA, 23 bp, Homo sapiens
gtgtccctgcacttgcagactct

SEQ ID NO: 2813596 - DNA, 20 bp, Homo sapiens
gtgtctctggaacccaggac

SEQ ID NO: 2813597 - DNA, 22 bp, Homo sapiens
gtgtctctggaacccaggacct

SEQ ID NO: 2813598 - DNA, 12 bp, Homo sapiens
gtgtctgtacac

SEQ ID NO: 2813599 - DNA, 13 bp, Homo sapiens
gtgtctgtacacg

SEQ ID NO: 2813600 - DNA, 21 bp, Homo sapiens
gtgtctgtacacgtgtcctgt

SEQ ID NO: 2813601 - DNA, 13 bp, Homo sapiens
gtgtcttccataa

SEQ ID NO: 2813602 - DNA, 18 bp, Homo sapiens
gtgtcttgcaatggcagc

SEQ ID NO: 2813603 - DNA, 11 bp, Homo sapiens
gtgtgaagaaa

SEQ ID NO: 2813604 - DNA, 13 bp, Homo sapiens
gtgtgagcagtga

SEQ ID NO: 2813605 - DNA, 17 bp, Homo sapiens
gtgtgagcatctctgtg

SEQ ID NO: 2813606 - DNA, 18 bp, Homo sapiens
gtgtgagcatctctgtgt

SEQ ID NO: 2813607 - DNA, 18 bp, Homo sapiens
gtgtgagtcaccaagccc

SEQ ID NO: 2813608 - DNA, 19 bp, Homo sapiens
gtgtgatcccaagtgccag

SEQ ID NO: 2813609 - DNA, 18 bp, Homo sapiens
gtgtgcacccctccccat

SEQ ID NO: 2813610 - DNA, 22 bp, Homo sapiens
gtgtgccaggctagactaggag

SEQ ID NO: 2813611 - DNA, 14 bp, Homo sapiens
gtgtgcctgcagcc

SEQ ID NO: 2813612 - DNA, 15 bp, Homo sapiens
gtgtgcctgcagccc

SEQ ID NO: 2813613 - DNA, 14 bp, Homo sapiens
gtgtgggctgtgtc

SEQ ID NO: 2813614 - DNA, 18 bp, Homo sapiens
gtgtgtatgggtgtgtgt

SEQ ID NO: 2813615 - DNA, 18 bp, Homo sapiens
gtgtgtcttttataaaaa

SEQ ID NO: 2813616 - DNA, 15 bp, Homo sapiens
gtgtgtgtatatata

SEQ ID NO: 2813617 - DNA, 17 bp, Homo sapiens
gtgttcagtgccttgga

SEQ ID NO: 2813618 - DNA, 19 bp, Homo sapiens
gtgttctcaatgcttttct

SEQ ID NO: 2813619 - DNA, 14 bp, Homo sapiens
gtgttctctcttat

SEQ ID NO: 2813620 - DNA, 20 bp, Homo sapiens
gtgttgaagaagagtttgca

SEQ ID NO: 2813621 - DNA, 15 bp, Homo sapiens
gtgttgatcccaaga

SEQ ID NO: 2813622 - DNA, 18 bp, Homo sapiens
gtgttgatttgagaaatt

SEQ ID NO: 2813623 - DNA, 16 bp, Homo sapiens
gtgttgggaattgcat

SEQ ID NO: 2813624 - DNA, 17 bp, Homo sapiens
gtgttgggaattgcatg

SEQ ID NO: 2813625 - DNA, 21 bp, Homo sapiens
gtgtttaaagttcaacatgtt

SEQ ID NO: 2813626 - DNA, 14 bp, Homo sapiens
gtgtttcttgcctc

SEQ ID NO: 2813627 - DNA, 16 bp, Homo sapiens
gtgtttcttgcctcat

SEQ ID NO: 2813628 - DNA, 12 bp, Homo sapiens
gtgtttgtgtga

SEQ ID NO: 2813629 - DNA, 15 bp, Homo sapiens
gtgtttttaactcaa

SEQ ID NO: 2813630 - DNA, 14 bp, Homo sapiens
gttaaaagacagtg

SEQ ID NO: 2813631 - DNA, 15 bp, Homo sapiens
gttaaaattccatcc

SEQ ID NO: 2813632 - DNA, 12 bp, Homo sapiens
gttaaatattta

SEQ ID NO: 2813633 - DNA, 16 bp, Homo sapiens
gttaaatatttacata

SEQ ID NO: 2813634 - DNA, 19 bp, Homo sapiens
gttaacactacttaaaagt

SEQ ID NO: 2813635 - DNA, 13 bp, Homo sapiens
gttaagggaagga

SEQ ID NO: 2813636 - DNA, 14 bp, Homo sapiens
gttaagtcatccac

SEQ ID NO: 2813637 - DNA, 14 bp, Homo sapiens
gttaatcttcatgg

SEQ ID NO: 2813638 - DNA, 17 bp, Homo sapiens
gttaatgttgggattta

SEQ ID NO: 2813639 - DNA, 22 bp, Homo sapiens
gttgagggaacagacaggagaa

SEQ ID NO: 2813640 - DNA, 14 bp, Homo sapiens
gttgagtctcctct

SEQ ID NO: 2813641 - DNA, 20 bp, Homo sapiens
gttgagtctcctctctgaga

SEQ ID NO: 2813642 - DNA, 21 bp, Homo sapiens
gttgataaattccactggact

SEQ ID NO: 2813643 - DNA, 13 bp, Homo sapiens
gttgatgaccaat

SEQ ID NO: 2813644 - DNA, 14 bp, Homo sapiens
gttgcaaccactgc

SEQ ID NO: 2813645 - DNA, 17 bp, Homo sapiens
gttgcaagtactgctgt

SEQ ID NO: 2813646 - DNA, 15 bp, Homo sapiens
gttgcaataaaatag

SEQ ID NO: 2813647 - DNA, 22 bp, Homo sapiens
gttgcagatctttttgtgaaat

SEQ ID NO: 2813648 - DNA, 14 bp, Homo sapiens
gttgcaggccaggt

SEQ ID NO: 2813649 - DNA, 15 bp, Homo sapiens
gttgcagtgagctga

SEQ ID NO: 2813650 - DNA, 12 bp, Homo sapiens
gttgcccaggca

SEQ ID NO: 2813651 - DNA, 13 bp, Homo sapiens
gttgcccaggctg

SEQ ID NO: 2813652 - DNA, 18 bp, Homo sapiens
gttgccttagcacttctt

SEQ ID NO: 2813653 - DNA, 14 bp, Homo sapiens
gttgctatttgttg

SEQ ID NO: 2813654 - DNA, 19 bp, Homo sapiens
gttgctgtcataagaatga

SEQ ID NO: 2813655 - DNA, 13 bp, Homo sapiens
gttggaaccgtgt

SEQ ID NO: 2813656 - DNA, 14 bp, Homo sapiens
gttggccaggctgg

SEQ ID NO: 2813657 - DNA, 19 bp, Homo sapiens
gttggccaggctggtctca

SEQ ID NO: 2813658 - DNA, 12 bp, Homo sapiens
gttggctggggg

SEQ ID NO: 2813659 - DNA, 16 bp, Homo sapiens
gttgggagcactggag

SEQ ID NO: 2813660 - DNA, 15 bp, Homo sapiens
gttgggatttatatc

SEQ ID NO: 2813661 - DNA, 18 bp, Homo sapiens
gttgggatttatatctat

SEQ ID NO: 2813662 - DNA, 15 bp, Homo sapiens
gttgggctggtgtca

SEQ ID NO: 2813663 - DNA, 16 bp, Homo sapiens
gttgtcaagagagagt

SEQ ID NO: 2813664 - DNA, 16 bp, Homo sapiens
gttgtcaatattaaat

SEQ ID NO: 2813665 - DNA, 19 bp, Homo sapiens
gttgtcaatattaaataca

SEQ ID NO: 2813666 - DNA, 13 bp, Homo sapiens
gttgtgaggcctg

SEQ ID NO: 2813667 - DNA, 16 bp, Homo sapiens
gttgtgattttgtaca

SEQ ID NO: 2813668 - DNA, 17 bp, Homo sapiens
gttgtgattttgtacag

SEQ ID NO: 2813669 - DNA, 19 bp, Homo sapiens
gttgtgattttgtacagaa

SEQ ID NO: 2813670 - DNA, 19 bp, Homo sapiens
gttgttaaaactggtttag

SEQ ID NO: 2813671 - DNA, 19 bp, Homo sapiens
gttgttaatgaaaatgtca

SEQ ID NO: 2813672 - DNA, 14 bp, Homo sapiens
gtttaaaaaaagta

SEQ ID NO: 2813673 - DNA, 17 bp, Homo sapiens
gtttaaaaaaagtatat

SEQ ID NO: 2813674 - DNA, 15 bp, Homo sapiens
gtttaaaaaatacac

SEQ ID NO: 2813675 - DNA, 15 bp, Homo sapiens
gtttacaaaaggcag

SEQ ID NO: 2813676 - DNA, 16 bp, Homo sapiens
gtttacaaaaggcagc

SEQ ID NO: 2813677 - DNA, 12 bp, Homo sapiens
gtttactgctgt

SEQ ID NO: 2813678 - DNA, 13 bp, Homo sapiens
gtttactgctgtc

SEQ ID NO: 2813679 - DNA, 17 bp, Homo sapiens
gtttatgcaaggaagga

SEQ ID NO: 2813680 - DNA, 17 bp, Homo sapiens
gtttattaatgcctctc

SEQ ID NO: 2813681 - DNA, 17 bp, Homo sapiens
gtttattgcttaatccc

SEQ ID NO: 2813682 - DNA, 14 bp, Homo sapiens
gtttatttatcagt

SEQ ID NO: 2813683 - DNA, 14 bp, Homo sapiens
gtttatttattcac

SEQ ID NO: 2813684 - DNA, 15 bp, Homo sapiens
gtttatttattcact

SEQ ID NO: 2813685 - DNA, 13 bp, Homo sapiens
gtttattttttct

SEQ ID NO: 2813686 - DNA, 18 bp, Homo sapiens
gtttattttttctacaca

SEQ ID NO: 2813687 - DNA, 15 bp, Homo sapiens
gtttcaattcagtgc

SEQ ID NO: 2813688 - DNA, 22 bp, Homo sapiens
gtttcaattccacctgcaatca

SEQ ID NO: 2813689 - DNA, 23 bp, Homo sapiens
gtttcacagcctataaccagaca

SEQ ID NO: 2813690 - DNA, 20 bp, Homo sapiens
gtttcactatgattttctat

SEQ ID NO: 2813691 - DNA, 23 bp, Homo sapiens
gtttcaggagagagttgaaccta

SEQ ID NO: 2813692 - DNA, 22 bp, Homo sapiens
gtttccaggccaccgctctcct

SEQ ID NO: 2813693 - DNA, 15 bp, Homo sapiens
gtttcccataatttt

SEQ ID NO: 2813694 - DNA, 20 bp, Homo sapiens
gtttcccataattttcttca

SEQ ID NO: 2813695 - DNA, 14 bp, Homo sapiens
gtttccttcagtgc

SEQ ID NO: 2813696 - DNA, 19 bp, Homo sapiens
gtttctatgtgtagggcgg

SEQ ID NO: 2813697 - DNA, 20 bp, Homo sapiens
gtttctcagaatccaaagat

SEQ ID NO: 2813698 - DNA, 20 bp, Homo sapiens
gtttctgaaaattaacactg

SEQ ID NO: 2813699 - DNA, 14 bp, Homo sapiens
gtttctgcagtagt

SEQ ID NO: 2813700 - DNA, 21 bp, Homo sapiens
gtttcttaaataagaaacttt

SEQ ID NO: 2813701 - DNA, 23 bp, Homo sapiens
gtttcttgcctcatttttttcct

SEQ ID NO: 2813702 - DNA, 18 bp, Homo sapiens
gtttcttggtctcagctt

SEQ ID NO: 2813703 - DNA, 19 bp, Homo sapiens
gtttctttttttatgactg

SEQ ID NO: 2813704 - DNA, 16 bp, Homo sapiens
gtttgaggctgcagcg

SEQ ID NO: 2813705 - DNA, 14 bp, Homo sapiens
gtttgcaaggaagc

SEQ ID NO: 2813706 - DNA, 22 bp, Homo sapiens
gtttgcaaggaagccacagctg

SEQ ID NO: 2813707 - DNA, 17 bp, Homo sapiens
gtttgcacctttctagt

SEQ ID NO: 2813708 - DNA, 19 bp, Homo sapiens
gtttgcactgtatgctgga

SEQ ID NO: 2813709 - DNA, 22 bp, Homo sapiens
gtttgcactgtatgctggacgg

SEQ ID NO: 2813710 - DNA, 21 bp, Homo sapiens
gtttgcagaaaagcacctgcc

SEQ ID NO: 2813711 - DNA, 20 bp, Homo sapiens
gtttggatgggagtgagaca

SEQ ID NO: 2813712 - DNA, 21 bp, Homo sapiens
gtttgggcagaagggagaagg

SEQ ID NO: 2813713 - DNA, 22 bp, Homo sapiens
gtttgggccactgcactctagc

SEQ ID NO: 2813714 - DNA, 15 bp, Homo sapiens
gtttggggcaggagt

SEQ ID NO: 2813715 - DNA, 17 bp, Homo sapiens
gtttggggcaggagtag

SEQ ID NO: 2813716 - DNA, 23 bp, Homo sapiens
gtttggggcaggagtagctgagc

SEQ ID NO: 2813717 - DNA, 15 bp, Homo sapiens
gtttgtcatatattc

SEQ ID NO: 2813718 - DNA, 18 bp, Homo sapiens
gtttgtcatatattcatg

SEQ ID NO: 2813719 - DNA, 13 bp, Homo sapiens
gtttgtgtggatg

SEQ ID NO: 2813720 - DNA, 19 bp, Homo sapiens
gtttgtttctccccctggg

SEQ ID NO: 2813721 - DNA, 16 bp, Homo sapiens
gtttgtttttcaaagc

SEQ ID NO: 2813722 - DNA, 16 bp, Homo sapiens
gttttaagaggcaggg

SEQ ID NO: 2813723 - DNA, 21 bp, Homo sapiens
gttttagttgcagaaacattt

SEQ ID NO: 2813724 - DNA, 18 bp, Homo sapiens
gttttatactgtacttaa

SEQ ID NO: 2813725 - DNA, 23 bp, Homo sapiens
gttttatactgtacttaataaat

SEQ ID NO: 2813726 - DNA, 19 bp, Homo sapiens
gttttcacatacactcaaa

SEQ ID NO: 2813727 - DNA, 11 bp, Homo sapiens
gttttcactct

SEQ ID NO: 2813728 - DNA, 12 bp, Homo sapiens
gttttcactctt

SEQ ID NO: 2813729 - DNA, 14 bp, Homo sapiens
gttttcagactcag

SEQ ID NO: 2813730 - DNA, 21 bp, Homo sapiens
taagtaattatcgggaacagt

SEQ ID NO: 2813731 - DNA, 18 bp, Homo sapiens
taagtaattgcatttctg

SEQ ID NO: 2813732 - DNA, 17 bp, Homo sapiens
taagtaccactcaggcc

SEQ ID NO: 2813733 - DNA, 18 bp, Homo sapiens
taagtaccactcaggcca

SEQ ID NO: 2813734 - DNA, 14 bp, Homo sapiens
taagtatatagtat

SEQ ID NO: 2813735 - DNA, 15 bp, Homo sapiens
taagtatttatatat

SEQ ID NO: 2813736 - DNA, 17 bp, Homo sapiens
taagtatttatatattt

SEQ ID NO: 2813737 - DNA, 23 bp, Homo sapiens
taagtatttatatatttataact

SEQ ID NO: 2813738 - DNA, 16 bp, Homo sapiens
taagtctccaagaata

SEQ ID NO: 2813739 - DNA, 15 bp, Homo sapiens
taagtgctgtttgag

SEQ ID NO: 2813740 - DNA, 13 bp, Homo sapiens
taagtgctttgta

SEQ ID NO: 2813741 - DNA, 18 bp, Homo sapiens
taagtggaaaaaagagaa

SEQ ID NO: 2813742 - DNA, 20 bp, Homo sapiens
taagtggaaaaaagagaaaa

SEQ ID NO: 2813743 - DNA, 14 bp, Homo sapiens
taagttatagtata

SEQ ID NO: 2813744 - DNA, 17 bp, Homo sapiens
taagttggaccagagga

SEQ ID NO: 2813745 - DNA, 14 bp, Homo sapiens
taataaaaaatgga

SEQ ID NO: 2813746 - DNA, 19 bp, Homo sapiens
taataaaaaatggaaagaa

SEQ ID NO: 2813747 - DNA, 18 bp, Homo sapiens
taataaacgaagataaat

SEQ ID NO: 2813748 - DNA, 20 bp, Homo sapiens
taataaacgaagataaatca

SEQ ID NO: 2813749 - DNA, 13 bp, Homo sapiens
taataaactctct

SEQ ID NO: 2813750 - DNA, 22 bp, Homo sapiens
taataaatctgagcctaaatct

SEQ ID NO: 2813751 - DNA, 19 bp, Homo sapiens
taataaatgtacattaatt

SEQ ID NO: 2813752 - DNA, 16 bp, Homo sapiens
taataactagatctcc

SEQ ID NO: 2813753 - DNA, 20 bp, Homo sapiens
taataactagatctcctgta

SEQ ID NO: 2813754 - DNA, 15 bp, Homo sapiens
taataagtttgatca

SEQ ID NO: 2813755 - DNA, 21 bp, Homo sapiens
taataagtttgatcaaatcta

SEQ ID NO: 2813756 - DNA, 19 bp, Homo sapiens
taataattatgtgccattt

SEQ ID NO: 2813757 - DNA, 21 bp, Homo sapiens
taatagaagaacatccaagga

SEQ ID NO: 2813758 - DNA, 21 bp, Homo sapiens
taatagaatataattatcgga

SEQ ID NO: 2813759 - DNA, 15 bp, Homo sapiens
taatatcctaaacat

SEQ ID NO: 2813760 - DNA, 17 bp, Homo sapiens
taatatctgagaagtgt

SEQ ID NO: 2813761 - DNA, 22 bp, Homo sapiens
taatatctgagaagtgtatata

SEQ ID NO: 2813762 - DNA, 16 bp, Homo sapiens
taatatcttgaagaat

SEQ ID NO: 2813763 - DNA, 22 bp, Homo sapiens
taatatcttgaagaatattgtt

SEQ ID NO: 2813764 - DNA, 16 bp, Homo sapiens
taatatgctgccaaat

SEQ ID NO: 2813765 - DNA, 20 bp, Homo sapiens
taatatgttaacctcagtgt

SEQ ID NO: 2813766 - DNA, 23 bp, Homo sapiens
taatatgttaacctcagtgtcat

SEQ ID NO: 2813767 - DNA, 16 bp, Homo sapiens
taatatgttcattaaa

SEQ ID NO: 2813768 - DNA, 16 bp, Homo sapiens
taatattcattgtata

SEQ ID NO: 2813769 - DNA, 14 bp, Homo sapiens
taatatttgctgac

SEQ ID NO: 2813770 - DNA, 14 bp, Homo sapiens
taatatttttaatt

SEQ ID NO: 2813771 - DNA, 12 bp, Homo sapiens
taatcaaagcta

SEQ ID NO: 2813772 - DNA, 12 bp, Homo sapiens
taatcagcctct

SEQ ID NO: 2813773 - DNA, 19 bp, Homo sapiens
taatcaggtcctcagagaa

SEQ ID NO: 2813774 - DNA, 22 bp, Homo sapiens
taatcatataataaatgtacat

SEQ ID NO: 2813775 - DNA, 21 bp, Homo sapiens
taatcccagcatgctgagatt

SEQ ID NO: 2813776 - DNA, 21 bp, Homo sapiens
taatcctattaaaacacagct

SEQ ID NO: 2813777 - DNA, 17 bp, Homo sapiens
taatcgttatgtgtgta

SEQ ID NO: 2813778 - DNA, 21 bp, Homo sapiens
taatctggactcctctgtcca

SEQ ID NO: 2813779 - DNA, 22 bp, Homo sapiens
taatctggactcctctgtccag

SEQ ID NO: 2813780 - DNA, 16 bp, Homo sapiens
taatctgtagggctgg

SEQ ID NO: 2813781 - DNA, 20 bp, Homo sapiens
taatcttaggggagagcttt

SEQ ID NO: 2813782 - DNA, 12 bp, Homo sapiens
taatctttgggt

SEQ ID NO: 2813783 - DNA, 13 bp, Homo sapiens
taatgaaaatgtc

SEQ ID NO: 2813784 - DNA, 13 bp, Homo sapiens
taatgaacaaatg

SEQ ID NO: 2813785 - DNA, 13 bp, Homo sapiens
taatgaactgtga

SEQ ID NO: 2813786 - DNA, 16 bp, Homo sapiens
taatgaactgtgacag

SEQ ID NO: 2813787 - DNA, 22 bp, Homo sapiens
taatgaagggaaaggatatttt

SEQ ID NO: 2813788 - DNA, 13 bp, Homo sapiens
taatgaatatctg

SEQ ID NO: 2813789 - DNA, 15 bp, Homo sapiens
taatgaatatctgct

SEQ ID NO: 2813790 - DNA, 11 bp, Homo sapiens
taatgcacaat

SEQ ID NO: 2813791 - DNA, 12 bp, Homo sapiens
taatgcacaatt

SEQ ID NO: 2813792 - DNA, 17 bp, Homo sapiens
taatgcacaatttagaa

SEQ ID NO: 2813793 - DNA, 12 bp, Homo sapiens
taatgccttcca

SEQ ID NO: 2813794 - DNA, 16 bp, Homo sapiens
taatgctgttgcctca

SEQ ID NO: 2813795 - DNA, 17 bp, Homo sapiens
taatgctttatgtttaa

SEQ ID NO: 2813796 - DNA, 18 bp, Homo sapiens
taatgctttcctccctgg

SEQ ID NO: 2813797 - DNA, 18 bp, Homo sapiens
taatggaaacatttacaa

SEQ ID NO: 2813798 - DNA, 20 bp, Homo sapiens
taatggaaacatttacaata

SEQ ID NO: 2813799 - DNA, 18 bp, Homo sapiens
taatgggccaattaaaat

SEQ ID NO: 2813800 - DNA, 20 bp, Homo sapiens
taatgggccaattaaaatat

SEQ ID NO: 2813801 - DNA, 23 bp, Homo sapiens
taatgggccaattaaaatatata

SEQ ID NO: 2813802 - DNA, 16 bp, Homo sapiens
taatggtgccttcatt

SEQ ID NO: 2813803 - DNA, 18 bp, Homo sapiens
taatggtgccttcatttg

SEQ ID NO: 2813804 - DNA, 15 bp, Homo sapiens
taatggtttactgct

SEQ ID NO: 2813805 - DNA, 16 bp, Homo sapiens
taatggtttactgctg

SEQ ID NO: 2813806 - DNA, 19 bp, Homo sapiens
taatggtttactgctgtca

SEQ ID NO: 2813807 - DNA, 20 bp, Homo sapiens
taatgtagtatgatgtaatg

SEQ ID NO: 2813808 - DNA, 16 bp, Homo sapiens
taatgtcacaggcagg

SEQ ID NO: 2813809 - DNA, 17 bp, Homo sapiens
taatgtcacaggcaggt

SEQ ID NO: 2813810 - DNA, 18 bp, Homo sapiens
taatgtcacaggcaggtc

SEQ ID NO: 2813811 - DNA, 22 bp, Homo sapiens
taatgtcaccaccttcccagct

SEQ ID NO: 2813812 - DNA, 22 bp, Homo sapiens
taatgttctctgggtaggtgtt

SEQ ID NO: 2813813 - DNA, 14 bp, Homo sapiens
taatgttgttattt

SEQ ID NO: 2813814 - DNA, 18 bp, Homo sapiens
taatgttgttatttaaag

SEQ ID NO: 2813815 - DNA, 14 bp, Homo sapiens
taattaaaaaattt

SEQ ID NO: 2813816 - DNA, 22 bp, Homo sapiens
taattaaaaaccactgaacatt

SEQ ID NO: 2813817 - DNA, 18 bp, Homo sapiens
taattaaaaagttaatct

SEQ ID NO: 2813818 - DNA, 20 bp, Homo sapiens
taattaataaacgaagataa

SEQ ID NO: 2813819 - DNA, 22 bp, Homo sapiens
taattaatcgaaatgaatttat

SEQ ID NO: 2813820 - DNA, 18 bp, Homo sapiens
tacagaggccatgggcct

SEQ ID NO: 2813821 - DNA, 21 bp, Homo sapiens
tacagataatttattttgtat

SEQ ID NO: 2813822 - DNA, 23 bp, Homo sapiens
tacagcaacaggaatctcagaga

SEQ ID NO: 2813823 - DNA, 12 bp, Homo sapiens
tacagccagaag

SEQ ID NO: 2813824 - DNA, 20 bp, Homo sapiens
tacagcgagaggcagagaaa

SEQ ID NO: 2813825 - DNA, 16 bp, Homo sapiens
tacaggcacccaccat

SEQ ID NO: 2813826 - DNA, 21 bp, Homo sapiens
tacagggcatgcattttgcag

SEQ ID NO: 2813827 - DNA, 18 bp, Homo sapiens
tacagggtagcaggtacc

SEQ ID NO: 2813828 - DNA, 13 bp, Homo sapiens
tacagtaaagttt

SEQ ID NO: 2813829 - DNA, 14 bp, Homo sapiens
tacagtaagctgct

SEQ ID NO: 2813830 - DNA, 18 bp, Homo sapiens
tacagtagcttaaataaa

SEQ ID NO: 2813831 - DNA, 14 bp, Homo sapiens
tacagtcaatttta

SEQ ID NO: 2813832 - DNA, 14 bp, Homo sapiens
tacagtgagccaag

SEQ ID NO: 2813833 - DNA, 15 bp, Homo sapiens
tacagtggagaaata

SEQ ID NO: 2813834 - DNA, 14 bp, Homo sapiens
tacagttatacata

SEQ ID NO: 2813835 - DNA, 23 bp, Homo sapiens
tacatacctctctctatatatac

SEQ ID NO: 2813836 - DNA, 18 bp, Homo sapiens
tacatagtcacaaaaatg

SEQ ID NO: 2813837 - DNA, 20 bp, Homo sapiens
tacatagtcacaaaaatggt

SEQ ID NO: 2813838 - DNA, 13 bp, Homo sapiens
tacatatcagaaa

SEQ ID NO: 2813839 - DNA, 15 bp, Homo sapiens
tacatatcagaaaag

SEQ ID NO: 2813840 - DNA, 16 bp, Homo sapiens
tacatatgtaaaataa

SEQ ID NO: 2813841 - DNA, 14 bp, Homo sapiens
tacatattctttaa

SEQ ID NO: 2813842 - DNA, 14 bp, Homo sapiens
tacatattggaaag

SEQ ID NO: 2813843 - DNA, 21 bp, Homo sapiens
tacatgaaacagaaacaaaaa

SEQ ID NO: 2813844 - DNA, 21 bp, Homo sapiens
tacatgcacttggctgcataa

SEQ ID NO: 2813845 - DNA, 16 bp, Homo sapiens
tacatggtattgtaat

SEQ ID NO: 2813846 - DNA, 20 bp, Homo sapiens
tacatggtattgtaatgaat

SEQ ID NO: 2813847 - DNA, 23 bp, Homo sapiens
tacatgtatagtgagtgtggctt

SEQ ID NO: 2813848 - DNA, 16 bp, Homo sapiens
tacatgtgtagcctgt

SEQ ID NO: 2813849 - DNA, 18 bp, Homo sapiens
tacatgtgtagcctgtgc

SEQ ID NO: 2813850 - DNA, 16 bp, Homo sapiens
tacattccctatcaaa

SEQ ID NO: 2813851 - DNA, 17 bp, Homo sapiens
tacattccctatcaaaa

SEQ ID NO: 2813852 - DNA, 18 bp, Homo sapiens
tacattccctatcaaaac

SEQ ID NO: 2813853 - DNA, 16 bp, Homo sapiens
tacattccctggcctg

SEQ ID NO: 2813854 - DNA, 16 bp, Homo sapiens
tacattgtgaaacttc

SEQ ID NO: 2813855 - DNA, 23 bp, Homo sapiens
tacattgtttgtctgtcttcata

SEQ ID NO: 2813856 - DNA, 19 bp, Homo sapiens
tacatttataatgtttgct

SEQ ID NO: 2813857 - DNA, 16 bp, Homo sapiens
tacatttctgaaatga

SEQ ID NO: 2813858 - DNA, 16 bp, Homo sapiens
tacattttatttatta

SEQ ID NO: 2813859 - DNA, 13 bp, Homo sapiens
taccaagtgtgtt

SEQ ID NO: 2813860 - DNA, 19 bp, Homo sapiens
taccaagtgtgttgggaat

SEQ ID NO: 2813861 - DNA, 13 bp, Homo sapiens
taccacagtgtct

SEQ ID NO: 2813862 - DNA, 14 bp, Homo sapiens
taccaccccttcct

SEQ ID NO: 2813863 - DNA, 14 bp, Homo sapiens
taccactcaggcca

SEQ ID NO: 2813864 - DNA, 17 bp, Homo sapiens
taccagctcactccctg

SEQ ID NO: 2813865 - DNA, 18 bp, Homo sapiens
taccagctcactccctgg

SEQ ID NO: 2813866 - DNA, 14 bp, Homo sapiens
taccaggttgaaag

SEQ ID NO: 2813867 - DNA, 15 bp, Homo sapiens
taccaggttgaaaga

SEQ ID NO: 2813868 - DNA, 13 bp, Homo sapiens
taccagtgtactg

SEQ ID NO: 2813869 - DNA, 14 bp, Homo sapiens
taccagtgtactgc

SEQ ID NO: 2813870 - DNA, 19 bp, Homo sapiens
taccagtgtactgctttca

SEQ ID NO: 2813871 - DNA, 20 bp, Homo sapiens
taccatgagaagagggcctg

SEQ ID NO: 2813872 - DNA, 22 bp, Homo sapiens
taccatgagaagagggcctgtg

SEQ ID NO: 2813873 - DNA, 15 bp, Homo sapiens
taccatgttaaagag

SEQ ID NO: 2813874 - DNA, 21 bp, Homo sapiens
tacccaaccactcaaattaat

SEQ ID NO: 2813875 - DNA, 18 bp, Homo sapiens
tacccaatttaattccat

SEQ ID NO: 2813876 - DNA, 12 bp, Homo sapiens
tacccactgctc

SEQ ID NO: 2813877 - DNA, 14 bp, Homo sapiens
tacccactgctctg

SEQ ID NO: 2813878 - DNA, 15 bp, Homo sapiens
tacccactgctctgg

SEQ ID NO: 2813879 - DNA, 21 bp, Homo sapiens
tacccacttctaaatagcaat

SEQ ID NO: 2813880 - DNA, 15 bp, Homo sapiens
tacccagagaatata

SEQ ID NO: 2813881 - DNA, 16 bp, Homo sapiens
tacccagagccttctc

SEQ ID NO: 2813882 - DNA, 20 bp, Homo sapiens
tacccagagccttctcctgc

SEQ ID NO: 2813883 - DNA, 21 bp, Homo sapiens
tacccagagccttctcctgcc

SEQ ID NO: 2813884 - DNA, 16 bp, Homo sapiens
tacccagcgagccctg

SEQ ID NO: 2813885 - DNA, 20 bp, Homo sapiens
taccccaagtccacctgcct

SEQ ID NO: 2813886 - DNA, 17 bp, Homo sapiens
tacccccgtggtctttg

SEQ ID NO: 2813887 - DNA, 18 bp, Homo sapiens
tacccccgtggtctttga

SEQ ID NO: 2813888 - DNA, 19 bp, Homo sapiens
tacccccgtggtctttgaa

SEQ ID NO: 2813889 - DNA, 22 bp, Homo sapiens
tacccccgtggtctttgaataa

SEQ ID NO: 2813890 - DNA, 18 bp, Homo sapiens
tacccctttctggctctc

SEQ ID NO: 2813891 - DNA, 11 bp, Homo sapiens
taccctccccc

SEQ ID NO: 2813892 - DNA, 20 bp, Homo sapiens
tacccttggctcaatcctct

SEQ ID NO: 2813893 - DNA, 22 bp, Homo sapiens
tacccttttctgaccaaagaga

SEQ ID NO: 2813894 - DNA, 22 bp, Homo sapiens
taccgacctgtctccctggggt

SEQ ID NO: 2813895 - DNA, 19 bp, Homo sapiens
taccgcgtctaccctggga

SEQ ID NO: 2813896 - DNA, 22 bp, Homo sapiens
tacctaaacagatataaatggc

SEQ ID NO: 2813897 - DNA, 22 bp, Homo sapiens
tacctacataggcaaattggaa

SEQ ID NO: 2813898 - DNA, 16 bp, Homo sapiens
tacctagatttacagc

SEQ ID NO: 2813899 - DNA, 22 bp, Homo sapiens
tacctcaacccccatttctatt

SEQ ID NO: 2813900 - DNA, 13 bp, Homo sapiens
tacctcctgccca

SEQ ID NO: 2813901 - DNA, 17 bp, Homo sapiens
tacctctcttatagaat

SEQ ID NO: 2813902 - DNA, 23 bp, Homo sapiens
tacctctcttatagaatatttat

SEQ ID NO: 2813903 - DNA, 17 bp, Homo sapiens
tacctctgatacctcaa

SEQ ID NO: 2813904 - DNA, 20 bp, Homo sapiens
tacctgtagtgagaaactga

SEQ ID NO: 2813905 - DNA, 16 bp, Homo sapiens
taccttagattagctc

SEQ ID NO: 2813906 - DNA, 21 bp, Homo sapiens
taccttagattagctctggac

SEQ ID NO: 2813907 - DNA, 20 bp, Homo sapiens
taccttcaataaagtatcta

SEQ ID NO: 2813908 - DNA, 18 bp, Homo sapiens
taccttgaacactggggg

SEQ ID NO: 2813909 - DNA, 22 bp, Homo sapiens
tacctttattaatgaactgtga

SEQ ID NO: 2813910 - DNA, 11 bp, Homo sapiens
taggaaagcac

SEQ ID NO: 2813911 - DNA, 21 bp, Homo sapiens
taggaaagcaccgcagcatgt

SEQ ID NO: 2813912 - DNA, 22 bp, Homo sapiens
taggaaagcaccgcagcatgtg

SEQ ID NO: 2813913 - DNA, 21 bp, Homo sapiens
taggaaagcctcactgatata

SEQ ID NO: 2813914 - DNA, 14 bp, Homo sapiens
taggaaataaaacc

SEQ ID NO: 2813915 - DNA, 20 bp, Homo sapiens
taggaaataaaacctttcaa

SEQ ID NO: 2813916 - DNA, 17 bp, Homo sapiens
taggaacagagtatata

SEQ ID NO: 2813917 - DNA, 22 bp, Homo sapiens
taggaacagagtatatatgtac

SEQ ID NO: 2813918 - DNA, 14 bp, Homo sapiens
taggaagagaaacc

SEQ ID NO: 2813919 - DNA, 21 bp, Homo sapiens
taggaattcccagcccaaagc

SEQ ID NO: 2813920 - DNA, 15 bp, Homo sapiens
taggaccaatgttgt

SEQ ID NO: 2813921 - DNA, 16 bp, Homo sapiens
taggactctgaggctc

SEQ ID NO: 2813922 - DNA, 12 bp, Homo sapiens
taggagacagtc

SEQ ID NO: 2813923 - DNA, 19 bp, Homo sapiens
taggagagataccttgaaa

SEQ ID NO: 2813924 - DNA, 20 bp, Homo sapiens
taggagagataccttgaaaa

SEQ ID NO: 2813925 - DNA, 20 bp, Homo sapiens
taggaggaccagagctactg

SEQ ID NO: 2813926 - DNA, 21 bp, Homo sapiens
taggaggttccggtgtctgga

SEQ ID NO: 2813927 - DNA, 16 bp, Homo sapiens
taggatctatgcaatt

SEQ ID NO: 2813928 - DNA, 18 bp, Homo sapiens
taggatctatgcaatttt

SEQ ID NO: 2813929 - DNA, 17 bp, Homo sapiens
taggatttatttaaaat

SEQ ID NO: 2813930 - DNA, 12 bp, Homo sapiens
taggcagagcct

SEQ ID NO: 2813931 - DNA, 16 bp, Homo sapiens
taggcagagcctttgg

SEQ ID NO: 2813932 - DNA, 13 bp, Homo sapiens
taggcagcagctt

SEQ ID NO: 2813933 - DNA, 14 bp, Homo sapiens
taggcatcccaggg

SEQ ID NO: 2813934 - DNA, 19 bp, Homo sapiens
taggcatcccaggggacca

SEQ ID NO: 2813935 - DNA, 20 bp, Homo sapiens
taggccctggatgtgcccac

SEQ ID NO: 2813936 - DNA, 22 bp, Homo sapiens
taggccctggatgtgcccacag

SEQ ID NO: 2813937 - DNA, 23 bp, Homo sapiens
taggccctggatgtgcccacagg

SEQ ID NO: 2813938 - DNA, 12 bp, Homo sapiens
taggcctatcaa

SEQ ID NO: 2813939 - DNA, 18 bp, Homo sapiens
taggcctggccagatgca

SEQ ID NO: 2813940 - DNA, 21 bp, Homo sapiens
taggctgccccgggtccccag

SEQ ID NO: 2813941 - DNA, 23 bp, Homo sapiens
taggctgccccgggtccccagct

SEQ ID NO: 2813942 - DNA, 14 bp, Homo sapiens
taggctggagaagc

SEQ ID NO: 2813943 - DNA, 17 bp, Homo sapiens
taggcttatcaaaatct

SEQ ID NO: 2813944 - DNA, 18 bp, Homo sapiens
taggcttatcaaaatctt

SEQ ID NO: 2813945 - DNA, 14 bp, Homo sapiens
tagggacttaaaaa

SEQ ID NO: 2813946 - DNA, 18 bp, Homo sapiens
taggggccgagggaaatg

SEQ ID NO: 2813947 - DNA, 13 bp, Homo sapiens
taggggttgctaa

SEQ ID NO: 2813948 - DNA, 18 bp, Homo sapiens
tagggtaaggtgccttct

SEQ ID NO: 2813949 - DNA, 15 bp, Homo sapiens
tagggtctcttcagg

SEQ ID NO: 2813950 - DNA, 14 bp, Homo sapiens
taggtaggaaatgt

SEQ ID NO: 2813951 - DNA, 14 bp, Homo sapiens
taggtgcctcctgt

SEQ ID NO: 2813952 - DNA, 14 bp, Homo sapiens
taggtgtgccaaac

SEQ ID NO: 2813953 - DNA, 18 bp, Homo sapiens
taggtttgagttcaaatt

SEQ ID NO: 2813954 - DNA, 15 bp, Homo sapiens
taggtttttttgtat

SEQ ID NO: 2813955 - DNA, 21 bp, Homo sapiens
tagtaaatcacgctttttgaa

SEQ ID NO: 2813956 - DNA, 14 bp, Homo sapiens
tagtaatctgcatt

SEQ ID NO: 2813957 - DNA, 17 bp, Homo sapiens
tagtaatctgcattatt

SEQ ID NO: 2813958 - DNA, 16 bp, Homo sapiens
tagtaccaatcatttt

SEQ ID NO: 2813959 - DNA, 23 bp, Homo sapiens
tagtaccaatcattttaattatt

SEQ ID NO: 2813960 - DNA, 19 bp, Homo sapiens
tagtactcctgcaaaattt

SEQ ID NO: 2813961 - DNA, 20 bp, Homo sapiens
tagtactcctgcaaaatttt

SEQ ID NO: 2813962 - DNA, 21 bp, Homo sapiens
tagtactcctgcaaaatttta

SEQ ID NO: 2813963 - DNA, 15 bp, Homo sapiens
tagtagagacagggt

SEQ ID NO: 2813964 - DNA, 22 bp, Homo sapiens
tagtagcagagtcattgttaca

SEQ ID NO: 2813965 - DNA, 16 bp, Homo sapiens
tagtagtcaattagta

SEQ ID NO: 2813966 - DNA, 18 bp, Homo sapiens
tagtatcatcagatagca

SEQ ID NO: 2813967 - DNA, 14 bp, Homo sapiens
tagtatctaacatg

SEQ ID NO: 2813968 - DNA, 15 bp, Homo sapiens
tagtatctaacatgt

SEQ ID NO: 2813969 - DNA, 16 bp, Homo sapiens
tagtatggtggctggg

SEQ ID NO: 2813970 - DNA, 23 bp, Homo sapiens
tagtcaagaaaaattattgtata

SEQ ID NO: 2813971 - DNA, 15 bp, Homo sapiens
tagtcaattagtaca

SEQ ID NO: 2813972 - DNA, 19 bp, Homo sapiens
tagtcaattagtacagtag

SEQ ID NO: 2813973 - DNA, 18 bp, Homo sapiens
tagtcacaaaaatggtgg

SEQ ID NO: 2813974 - DNA, 22 bp, Homo sapiens
tagtccaatgtctttttaagct

SEQ ID NO: 2813975 - DNA, 22 bp, Homo sapiens
tagtcctattctattgcagtta

SEQ ID NO: 2813976 - DNA, 18 bp, Homo sapiens
tagtctcctttgcactga

SEQ ID NO: 2813977 - DNA, 19 bp, Homo sapiens
tagtctcctttgcactgag

SEQ ID NO: 2813978 - DNA, 17 bp, Homo sapiens
tagtctctgtgctttga

SEQ ID NO: 2813979 - DNA, 15 bp, Homo sapiens
tagtgagatttgtat

SEQ ID NO: 2813980 - DNA, 17 bp, Homo sapiens
tagtgagatttgtattt

SEQ ID NO: 2813981 - DNA, 22 bp, Homo sapiens
tagtgagtgtggcttagtaata

SEQ ID NO: 2813982 - DNA, 13 bp, Homo sapiens
tagtgcacacttg

SEQ ID NO: 2813983 - DNA, 14 bp, Homo sapiens
tagtgcggacaagt

SEQ ID NO: 2813984 - DNA, 17 bp, Homo sapiens
tagtgctttattttgtt

SEQ ID NO: 2813985 - DNA, 15 bp, Homo sapiens
tagtggcttcctccg

SEQ ID NO: 2813986 - DNA, 20 bp, Homo sapiens
tagtggggtctccctctcct

SEQ ID NO: 2813987 - DNA, 22 bp, Homo sapiens
tagtggggtctccctctcctgc

SEQ ID NO: 2813988 - DNA, 17 bp, Homo sapiens
tagtgtcacttacctag

SEQ ID NO: 2813989 - DNA, 18 bp, Homo sapiens
tagtgtgttgtctgtgca

SEQ ID NO: 2813990 - DNA, 22 bp, Homo sapiens
tagttagctgctttaaatctat

SEQ ID NO: 2813991 - DNA, 16 bp, Homo sapiens
tagttaggaaataaaa

SEQ ID NO: 2813992 - DNA, 16 bp, Homo sapiens
tagttaggtgtgccaa

SEQ ID NO: 2813993 - DNA, 21 bp, Homo sapiens
tagttgatgaccaatctctgt

SEQ ID NO: 2813994 - DNA, 15 bp, Homo sapiens
tagttggtgttcaaa

SEQ ID NO: 2813995 - DNA, 17 bp, Homo sapiens
tagttgtgggtgggaga

SEQ ID NO: 2813996 - DNA, 12 bp, Homo sapiens
tagttgtgtctg

SEQ ID NO: 2813997 - DNA, 20 bp, Homo sapiens
tagtttcatataaagtatca

SEQ ID NO: 2813998 - DNA, 12 bp, Homo sapiens
tagtttcttgtg

SEQ ID NO: 2813999 - DNA, 14 bp, Homo sapiens
tagtttctttggga

SEQ ID NO: 2814000 - DNA, 20 bp, Homo sapiens
tagtttgatttaatatctga

SEQ ID NO: 2814001 - DNA, 21 bp, Homo sapiens
tatatctggatttttacaaat

SEQ ID NO: 2814002 - DNA, 18 bp, Homo sapiens
tatatgaaatgtttcact

SEQ ID NO: 2814003 - DNA, 19 bp, Homo sapiens
tatatgaggacttgtgtct

SEQ ID NO: 2814004 - DNA, 12 bp, Homo sapiens
tatatgtatatg

SEQ ID NO: 2814005 - DNA, 17 bp, Homo sapiens
tatatgtatatgtatat

SEQ ID NO: 2814006 - DNA, 12 bp, Homo sapiens
tatatgtatgtg

SEQ ID NO: 2814007 - DNA, 12 bp, Homo sapiens
tatatgtattta

SEQ ID NO: 2814008 - DNA, 21 bp, Homo sapiens
tatattacctcaaattcctaa

SEQ ID NO: 2814009 - DNA, 16 bp, Homo sapiens
tatattatggtgtaat

SEQ ID NO: 2814010 - DNA, 19 bp, Homo sapiens
tatattatggtgtaatgca

SEQ ID NO: 2814011 - DNA, 17 bp, Homo sapiens
tatattcagagatgtac

SEQ ID NO: 2814012 - DNA, 21 bp, Homo sapiens
tatattcagagatgtaccatg

SEQ ID NO: 2814013 - DNA, 16 bp, Homo sapiens
tatattcatgtaataa

SEQ ID NO: 2814014 - DNA, 12 bp, Homo sapiens
tatatttataac

SEQ ID NO: 2814015 - DNA, 22 bp, Homo sapiens
tatatttataactcatcataaa

SEQ ID NO: 2814016 - DNA, 14 bp, Homo sapiens
tatatttatactct

SEQ ID NO: 2814017 - DNA, 16 bp, Homo sapiens
tatatttggaaagaga

SEQ ID NO: 2814018 - DNA, 10 bp, Homo sapiens
tatattttat

SEQ ID NO: 2814019 - DNA, 17 bp, Homo sapiens
tatattttatgatttaa

SEQ ID NO: 2814020 - DNA, 17 bp, Homo sapiens
tatattttccctctctt

SEQ ID NO: 2814021 - DNA, 18 bp, Homo sapiens
tatatttttggttgtcaa

SEQ ID NO: 2814022 - DNA, 21 bp, Homo sapiens
tatcaaaacatatcaattcaa

SEQ ID NO: 2814023 - DNA, 21 bp, Homo sapiens
tatcaaaatcactatctttct

SEQ ID NO: 2814024 - DNA, 23 bp, Homo sapiens
tatcaaacaccaacataaaaatg

SEQ ID NO: 2814025 - DNA, 16 bp, Homo sapiens
tatcaaactgaagcca

SEQ ID NO: 2814026 - DNA, 19 bp, Homo sapiens
tatcaaggatgttctggct

SEQ ID NO: 2814027 - DNA, 13 bp, Homo sapiens
tatcaatagtcaa

SEQ ID NO: 2814028 - DNA, 20 bp, Homo sapiens
tatcaatagtcaagaaaaat

SEQ ID NO: 2814029 - DNA, 12 bp, Homo sapiens
tatcacatacaa

SEQ ID NO: 2814030 - DNA, 14 bp, Homo sapiens
tatcacatacaatt

SEQ ID NO: 2814031 - DNA, 17 bp, Homo sapiens
tatcacatacaatttgc

SEQ ID NO: 2814032 - DNA, 20 bp, Homo sapiens
tatcacatacaatttgcact

SEQ ID NO: 2814033 - DNA, 14 bp, Homo sapiens
tatcagaaaagtag

SEQ ID NO: 2814034 - DNA, 19 bp, Homo sapiens
tatcagaaaagtagaatta

SEQ ID NO: 2814035 - DNA, 20 bp, Homo sapiens
tatcagaaaagtagaattat

SEQ ID NO: 2814036 - DNA, 21 bp, Homo sapiens
tatcagaaaagtagaattata

SEQ ID NO: 2814037 - DNA, 18 bp, Homo sapiens
tatcagacctctgatccc

SEQ ID NO: 2814038 - DNA, 21 bp, Homo sapiens
tatcagagttgcttttctaat

SEQ ID NO: 2814039 - DNA, 22 bp, Homo sapiens
tatcagtcataactaaataaag

SEQ ID NO: 2814040 - DNA, 22 bp, Homo sapiens
tatcagtgacagagttcactat

SEQ ID NO: 2814041 - DNA, 17 bp, Homo sapiens
tatcagttactcagccc

SEQ ID NO: 2814042 - DNA, 19 bp, Homo sapiens
tatcagttactcagccctg

SEQ ID NO: 2814043 - DNA, 11 bp, Homo sapiens
tatcataaagt

SEQ ID NO: 2814044 - DNA, 15 bp, Homo sapiens
tatcatagaaatgta

SEQ ID NO: 2814045 - DNA, 14 bp, Homo sapiens
tatccaattatgtg

SEQ ID NO: 2814046 - DNA, 21 bp, Homo sapiens
tatccaattatgtgacaacct

SEQ ID NO: 2814047 - DNA, 19 bp, Homo sapiens
tatccacccagcccattct

SEQ ID NO: 2814048 - DNA, 20 bp, Homo sapiens
tatccacccagcccattctc

SEQ ID NO: 2814049 - DNA, 16 bp, Homo sapiens
tatcctaaacatcatt

SEQ ID NO: 2814050 - DNA, 17 bp, Homo sapiens
tatcctgaaatttcaga

SEQ ID NO: 2814051 - DNA, 18 bp, Homo sapiens
tatcctgttaggggaaaa

SEQ ID NO: 2814052 - DNA, 17 bp, Homo sapiens
tatcgggagcagtgtct

SEQ ID NO: 2814053 - DNA, 22 bp, Homo sapiens
tatctaaaagaatttaaattct

SEQ ID NO: 2814054 - DNA, 20 bp, Homo sapiens
tatctaatacctctgtgtgc

SEQ ID NO: 2814055 - DNA, 14 bp, Homo sapiens
tatctaatttatac

SEQ ID NO: 2814056 - DNA, 15 bp, Homo sapiens
tatctaatttataca

SEQ ID NO: 2814057 - DNA, 17 bp, Homo sapiens
tatctaatttatacaaa

SEQ ID NO: 2814058 - DNA, 16 bp, Homo sapiens
tatctatctatttgag

SEQ ID NO: 2814059 - DNA, 13 bp, Homo sapiens
tatctatcttata

SEQ ID NO: 2814060 - DNA, 12 bp, Homo sapiens
tatctatttgag

SEQ ID NO: 2814061 - DNA, 17 bp, Homo sapiens
tatctctaggctgtttt

SEQ ID NO: 2814062 - DNA, 23 bp, Homo sapiens
tatctcttttgaatccatgcttg

SEQ ID NO: 2814063 - DNA, 14 bp, Homo sapiens
tatctgaaaactgg

SEQ ID NO: 2814064 - DNA, 16 bp, Homo sapiens
tatctgaaaactggaa

SEQ ID NO: 2814065 - DNA, 22 bp, Homo sapiens
tatctgaacacatactagaaag

SEQ ID NO: 2814066 - DNA, 19 bp, Homo sapiens
tatctgagaagtgtatata

SEQ ID NO: 2814067 - DNA, 22 bp, Homo sapiens
tatctgagaagtgtatatagtt

SEQ ID NO: 2814068 - DNA, 11 bp, Homo sapiens
tatctgcattt

SEQ ID NO: 2814069 - DNA, 20 bp, Homo sapiens
tatctgcatttataaatgtg

SEQ ID NO: 2814070 - DNA, 13 bp, Homo sapiens
tatctgtggtctt

SEQ ID NO: 2814071 - DNA, 17 bp, Homo sapiens
tatcttactatttcaca

SEQ ID NO: 2814072 - DNA, 14 bp, Homo sapiens
tatcttatgttaaa

SEQ ID NO: 2814073 - DNA, 14 bp, Homo sapiens
tatcttatttatat

SEQ ID NO: 2814074 - DNA, 20 bp, Homo sapiens
tatcttggactgacatttag

SEQ ID NO: 2814075 - DNA, 23 bp, Homo sapiens
tatcttggtgaatttttttttcc

SEQ ID NO: 2814076 - DNA, 15 bp, Homo sapiens
tatcttgtctctggg

SEQ ID NO: 2814077 - DNA, 20 bp, Homo sapiens
tatctttaaaaagcagtcct

SEQ ID NO: 2814078 - DNA, 15 bp, Homo sapiens
tatgaaaaagaagaa

SEQ ID NO: 2814079 - DNA, 23 bp, Homo sapiens
tatgaaagatggctgtgcctctg

SEQ ID NO: 2814080 - DNA, 17 bp, Homo sapiens
tatgaaatgtttcacta

SEQ ID NO: 2814081 - DNA, 20 bp, Homo sapiens
tatgaaatttaatatagcta

SEQ ID NO: 2814082 - DNA, 20 bp, Homo sapiens
tatgaacaaagaaaaaaata

SEQ ID NO: 2814083 - DNA, 23 bp, Homo sapiens
tatgaacaaagaaaaaaatatat

SEQ ID NO: 2814084 - DNA, 22 bp, Homo sapiens
tatgaacttgaggacacatgtc

SEQ ID NO: 2814085 - DNA, 23 bp, Homo sapiens
tatgaacttgaggacacatgtcc

SEQ ID NO: 2814086 - DNA, 16 bp, Homo sapiens
tatgaagaaaaaatac

SEQ ID NO: 2814087 - DNA, 13 bp, Homo sapiens
tatgacactgagc

SEQ ID NO: 2814088 - DNA, 20 bp, Homo sapiens
tatgacatcacttgtacaaa

SEQ ID NO: 2814089 - DNA, 21 bp, Homo sapiens
tatgacttgggcacccccagc

SEQ ID NO: 2814090 - DNA, 15 bp, Homo sapiens
tatgagctcttcatg

SEQ ID NO: 2814091 - DNA, 19 bp, Homo sapiens
tattccttttgtgtacagt

SEQ ID NO: 2814092 - DNA, 20 bp, Homo sapiens
tattctacacatatatgtat

SEQ ID NO: 2814093 - DNA, 22 bp, Homo sapiens
tattctacacatatatgtatat

SEQ ID NO: 2814094 - DNA, 15 bp, Homo sapiens
tattctcaccaggaa

SEQ ID NO: 2814095 - DNA, 13 bp, Homo sapiens
tattctcactcca

SEQ ID NO: 2814096 - DNA, 15 bp, Homo sapiens
tattctcactccacc

SEQ ID NO: 2814097 - DNA, 19 bp, Homo sapiens
tattctcactccaccaccc

SEQ ID NO: 2814098 - DNA, 20 bp, Homo sapiens
tattctgggctcctggaacc

SEQ ID NO: 2814099 - DNA, 14 bp, Homo sapiens
tattcttcataaca

SEQ ID NO: 2814100 - DNA, 21 bp, Homo sapiens
tattcttggagaactttccat

SEQ ID NO: 2814101 - DNA, 15 bp, Homo sapiens
tattgaacctaggac

SEQ ID NO: 2814102 - DNA, 17 bp, Homo sapiens
tattgaagaaaagcact

SEQ ID NO: 2814103 - DNA, 13 bp, Homo sapiens
tattgaataagta

SEQ ID NO: 2814104 - DNA, 18 bp, Homo sapiens
tattgatgtttccagaaa

SEQ ID NO: 2814105 - DNA, 19 bp, Homo sapiens
tattgatgtttccagaaaa

SEQ ID NO: 2814106 - DNA, 20 bp, Homo sapiens
tattgatgtttccagaaaat

SEQ ID NO: 2814107 - DNA, 18 bp, Homo sapiens
tattgcactcagcttttt

SEQ ID NO: 2814108 - DNA, 15 bp, Homo sapiens
tattgcagttataga

SEQ ID NO: 2814109 - DNA, 15 bp, Homo sapiens
tattgcatatgcata

SEQ ID NO: 2814110 - DNA, 18 bp, Homo sapiens
tattgcatgtaaaatgca

SEQ ID NO: 2814111 - DNA, 13 bp, Homo sapiens
tattgcccacgct

SEQ ID NO: 2814112 - DNA, 14 bp, Homo sapiens
tattgcccacgctg

SEQ ID NO: 2814113 - DNA, 15 bp, Homo sapiens
tattggtaacatcct

SEQ ID NO: 2814114 - DNA, 22 bp, Homo sapiens
tattggtaacatcctttctatt

SEQ ID NO: 2814115 - DNA, 13 bp, Homo sapiens
tattgtacctctc

SEQ ID NO: 2814116 - DNA, 16 bp, Homo sapiens
tattgtagcatttctt

SEQ ID NO: 2814117 - DNA, 23 bp, Homo sapiens
tattgtccatatcagacctctga

SEQ ID NO: 2814118 - DNA, 19 bp, Homo sapiens
tattgtgcaatgtaaatat

SEQ ID NO: 2814119 - DNA, 21 bp, Homo sapiens
tattgtgttgccttagcactt

SEQ ID NO: 2814120 - DNA, 20 bp, Homo sapiens
tattgttaaaaccttactta

SEQ ID NO: 2814121 - DNA, 18 bp, Homo sapiens
tatttaaaaaataaaaaa

SEQ ID NO: 2814122 - DNA, 23 bp, Homo sapiens
tatttaaaatagcaaaagaagaa

SEQ ID NO: 2814123 - DNA, 19 bp, Homo sapiens
tatttaaaccgctaaaaga

SEQ ID NO: 2814124 - DNA, 23 bp, Homo sapiens
tatttaactctctttatgtctgt

SEQ ID NO: 2814125 - DNA, 20 bp, Homo sapiens
tatttaagatagttttgcca

SEQ ID NO: 2814126 - DNA, 16 bp, Homo sapiens
tatttaagcttatgtc

SEQ ID NO: 2814127 - DNA, 16 bp, Homo sapiens
tatttaagtatatagt

SEQ ID NO: 2814128 - DNA, 19 bp, Homo sapiens
tatttaatagcaaagaatt

SEQ ID NO: 2814129 - DNA, 23 bp, Homo sapiens
tatttaatatgggtgaacaccaa

SEQ ID NO: 2814130 - DNA, 12 bp, Homo sapiens
tatttaattgtg

SEQ ID NO: 2814131 - DNA, 23 bp, Homo sapiens
tatttaatttttttgagacagag

SEQ ID NO: 2814132 - DNA, 13 bp, Homo sapiens
tatttacaatgca

SEQ ID NO: 2814133 - DNA, 14 bp, Homo sapiens
tatttacatatgaa

SEQ ID NO: 2814134 - DNA, 16 bp, Homo sapiens
tatttacatatgaaat

SEQ ID NO: 2814135 - DNA, 17 bp, Homo sapiens
tatttacatatgaaatt

SEQ ID NO: 2814136 - DNA, 13 bp, Homo sapiens
tatttagaatata

SEQ ID NO: 2814137 - DNA, 20 bp, Homo sapiens
tatttagaatatattaaatc

SEQ ID NO: 2814138 - DNA, 19 bp, Homo sapiens
tatttataaatatatttaa

SEQ ID NO: 2814139 - DNA, 19 bp, Homo sapiens
tatttataacaacctaaat

SEQ ID NO: 2814140 - DNA, 20 bp, Homo sapiens
tatttataactcatcataaa

SEQ ID NO: 2814141 - DNA, 23 bp, Homo sapiens
tatttataactcatcataaaata

SEQ ID NO: 2814142 - DNA, 16 bp, Homo sapiens
tatttatatatgtatt

SEQ ID NO: 2814143 - DNA, 23 bp, Homo sapiens
tatttatatatgtatttataaat

SEQ ID NO: 2814144 - DNA, 17 bp, Homo sapiens
tatttatatatttgaat

SEQ ID NO: 2814145 - DNA, 23 bp, Homo sapiens
tatttatattcagagatgtacca

SEQ ID NO: 2814146 - DNA, 21 bp, Homo sapiens
tatttatatttggaaagagac

SEQ ID NO: 2814147 - DNA, 20 bp, Homo sapiens
tatttatgcctctgtattta

SEQ ID NO: 2814148 - DNA, 13 bp, Homo sapiens
tatttattacctc

SEQ ID NO: 2814149 - DNA, 15 bp, Homo sapiens
tatttattacctctg

SEQ ID NO: 2814150 - DNA, 16 bp, Homo sapiens
tatttattacctctga

SEQ ID NO: 2814151 - DNA, 19 bp, Homo sapiens
tatttattcactgtaagtt

SEQ ID NO: 2814152 - DNA, 16 bp, Homo sapiens
tatttattgtttattt

SEQ ID NO: 2814153 - DNA, 17 bp, Homo sapiens
tatttatttactgagct

SEQ ID NO: 2814154 - DNA, 17 bp, Homo sapiens
tatttcaaaataaactg

SEQ ID NO: 2814155 - DNA, 15 bp, Homo sapiens
tatttcaatgttagc

SEQ ID NO: 2814156 - DNA, 16 bp, Homo sapiens
tatttcaatgttagcc

SEQ ID NO: 2814157 - DNA, 15 bp, Homo sapiens
tatttcattctctta

SEQ ID NO: 2814158 - DNA, 16 bp, Homo sapiens
tatttccacataaagg

SEQ ID NO: 2814159 - DNA, 16 bp, Homo sapiens
tatttgcactgtagcc

SEQ ID NO: 2814160 - DNA, 15 bp, Homo sapiens
tatttgcatgttacc

SEQ ID NO: 2814161 - DNA, 16 bp, Homo sapiens
tatttgcatgttacct

SEQ ID NO: 2814162 - DNA, 15 bp, Homo sapiens
tatttgctaattaaa

SEQ ID NO: 2814163 - DNA, 23 bp, Homo sapiens
tatttgtaaaagaacagtaaaca

SEQ ID NO: 2814164 - DNA, 20 bp, Homo sapiens
tatttgttaatggtttgaat

SEQ ID NO: 2814165 - DNA, 22 bp, Homo sapiens
tatttgttaatggtttgaatat

SEQ ID NO: 2814166 - DNA, 19 bp, Homo sapiens
tattttaatttatgagttt

SEQ ID NO: 2814167 - DNA, 16 bp, Homo sapiens
tattttaggagacagt

SEQ ID NO: 2814168 - DNA, 14 bp, Homo sapiens
tattttccaataaa

SEQ ID NO: 2814169 - DNA, 16 bp, Homo sapiens
tattttccatgaaaat

SEQ ID NO: 2814170 - DNA, 17 bp, Homo sapiens
tattttcgtgcatttgt

SEQ ID NO: 2814171 - DNA, 20 bp, Homo sapiens
tattttcgtgcatttgtgag

SEQ ID NO: 2814172 - DNA, 14 bp, Homo sapiens
tattttctttgaaa

SEQ ID NO: 2814173 - DNA, 16 bp, Homo sapiens
tattttgaatgtgaag

SEQ ID NO: 2814174 - DNA, 21 bp, Homo sapiens
tattttgtaaactcaaaatat

SEQ ID NO: 2814175 - DNA, 12 bp, Homo sapiens
tattttgtaata

SEQ ID NO: 2814176 - DNA, 14 bp, Homo sapiens
tattttgtaataaa

SEQ ID NO: 2814177 - DNA, 16 bp, Homo sapiens
tattttgtaataaact

SEQ ID NO: 2814178 - DNA, 18 bp, Homo sapiens
tattttgtaataaactct

SEQ ID NO: 2814179 - DNA, 22 bp, Homo sapiens
tattttgttgtgattttgtaca

SEQ ID NO: 2814180 - DNA, 17 bp, Homo sapiens
tatttttaattaaataa

SEQ ID NO: 2814181 - DNA, 14 bp, Homo sapiens
tcaattcctctggg

SEQ ID NO: 2814182 - DNA, 14 bp, Homo sapiens
tcaatttttataca

SEQ ID NO: 2814183 - DNA, 22 bp, Homo sapiens
tcaatttttatacatatcagaa

SEQ ID NO: 2814184 - DNA, 13 bp, Homo sapiens
tcacaaaaatggt

SEQ ID NO: 2814185 - DNA, 21 bp, Homo sapiens
tcacaaaacctggcacaatgg

SEQ ID NO: 2814186 - DNA, 14 bp, Homo sapiens
tcacaacagcctga

SEQ ID NO: 2814187 - DNA, 16 bp, Homo sapiens
tcacaaccagccacac

SEQ ID NO: 2814188 - DNA, 18 bp, Homo sapiens
tcacaaccagccacacag

SEQ ID NO: 2814189 - DNA, 21 bp, Homo sapiens
tcacaaccagccacacagagc

SEQ ID NO: 2814190 - DNA, 12 bp, Homo sapiens
tcacaactgttt

SEQ ID NO: 2814191 - DNA, 17 bp, Homo sapiens
tcacaagcaataattag

SEQ ID NO: 2814192 - DNA, 19 bp, Homo sapiens
tcacaagcaataattagga

SEQ ID NO: 2814193 - DNA, 12 bp, Homo sapiens
tcacaaggcagc

SEQ ID NO: 2814194 - DNA, 16 bp, Homo sapiens
tcacaataattttcta

SEQ ID NO: 2814195 - DNA, 23 bp, Homo sapiens
tcacaatgaaatgctctcctttc

SEQ ID NO: 2814196 - DNA, 15 bp, Homo sapiens
tcacacactttggct

SEQ ID NO: 2814197 - DNA, 10 bp, Homo sapiens
tcacacagac

SEQ ID NO: 2814198 - DNA, 11 bp, Homo sapiens
tcacacagaca

SEQ ID NO: 2814199 - DNA, 14 bp, Homo sapiens
tcacacagacacac

SEQ ID NO: 2814200 - DNA, 21 bp, Homo sapiens
tcacacaggcatttcctgggt

SEQ ID NO: 2814201 - DNA, 23 bp, Homo sapiens
tcacacaggcatttcctgggtgg

SEQ ID NO: 2814202 - DNA, 22 bp, Homo sapiens
tcacacagtattacttctgcta

SEQ ID NO: 2814203 - DNA, 15 bp, Homo sapiens
tcacactgagctggg

SEQ ID NO: 2814204 - DNA, 21 bp, Homo sapiens
tcacactgcaagagccttggt

SEQ ID NO: 2814205 - DNA, 21 bp, Homo sapiens
tcacactgtgcgttttagagt

SEQ ID NO: 2814206 - DNA, 11 bp, Homo sapiens
tcacagaagaa

SEQ ID NO: 2814207 - DNA, 12 bp, Homo sapiens
tcacagaagaat

SEQ ID NO: 2814208 - DNA, 22 bp, Homo sapiens
tcacagatgggtattaaacttg

SEQ ID NO: 2814209 - DNA, 23 bp, Homo sapiens
tcacaggactctgcctcctcttc

SEQ ID NO: 2814210 - DNA, 11 bp, Homo sapiens
tcacaggcagg

SEQ ID NO: 2814211 - DNA, 15 bp, Homo sapiens
tcacaggcaggtcca

SEQ ID NO: 2814212 - DNA, 19 bp, Homo sapiens
tcacagtctctttaatctt

SEQ ID NO: 2814213 - DNA, 14 bp, Homo sapiens
tcacagtgtttcga

SEQ ID NO: 2814214 - DNA, 18 bp, Homo sapiens
tcacagtgtttgcaatgg

SEQ ID NO: 2814215 - DNA, 22 bp, Homo sapiens
tcacagtgtttgcaatggtgtt

SEQ ID NO: 2814216 - DNA, 19 bp, Homo sapiens
tcacagttcctcgccctgg

SEQ ID NO: 2814217 - DNA, 21 bp, Homo sapiens
tcacagttcctcgccctgggt

SEQ ID NO: 2814218 - DNA, 17 bp, Homo sapiens
tcacatacaatttgcac

SEQ ID NO: 2814219 - DNA, 18 bp, Homo sapiens
tcacatacaatttgcact

SEQ ID NO: 2814220 - DNA, 13 bp, Homo sapiens
tcacatacactca

SEQ ID NO: 2814221 - DNA, 14 bp, Homo sapiens
tcacataccctccc

SEQ ID NO: 2814222 - DNA, 14 bp, Homo sapiens
tcacatcttatgct

SEQ ID NO: 2814223 - DNA, 16 bp, Homo sapiens
tcacattatttgcatg

SEQ ID NO: 2814224 - DNA, 15 bp, Homo sapiens
tcacatttgatgtac

SEQ ID NO: 2814225 - DNA, 16 bp, Homo sapiens
tcacatttgatgtaca

SEQ ID NO: 2814226 - DNA, 13 bp, Homo sapiens
tcaccaagcccag

SEQ ID NO: 2814227 - DNA, 18 bp, Homo sapiens
tcaccaataacttcagag

SEQ ID NO: 2814228 - DNA, 19 bp, Homo sapiens
tcaccaataacttcagaga

SEQ ID NO: 2814229 - DNA, 20 bp, Homo sapiens
tcaccaataacttcagagaa

SEQ ID NO: 2814230 - DNA, 22 bp, Homo sapiens
tcaccaataacttcagagaagt

SEQ ID NO: 2814231 - DNA, 15 bp, Homo sapiens
tcaccaccttcccag

SEQ ID NO: 2814232 - DNA, 21 bp, Homo sapiens
tcaccacttcaatagatcaaa

SEQ ID NO: 2814233 - DNA, 15 bp, Homo sapiens
tcaccagatttgcta

SEQ ID NO: 2814234 - DNA, 13 bp, Homo sapiens
tcaccagccccag

SEQ ID NO: 2814235 - DNA, 16 bp, Homo sapiens
tcaccagccccagtgc

SEQ ID NO: 2814236 - DNA, 19 bp, Homo sapiens
tcaccagcccggcctgctc

SEQ ID NO: 2814237 - DNA, 20 bp, Homo sapiens
tcaccagctgccaaaatcgt

SEQ ID NO: 2814238 - DNA, 12 bp, Homo sapiens
tcacccacaggg

SEQ ID NO: 2814239 - DNA, 21 bp, Homo sapiens
tcacccagctaatctgtaggg

SEQ ID NO: 2814240 - DNA, 17 bp, Homo sapiens
tcaccccctaccccaga

SEQ ID NO: 2814241 - DNA, 19 bp, Homo sapiens
tcaccccctcccaccccca

SEQ ID NO: 2814242 - DNA, 20 bp, Homo sapiens
tcaccccctcccacccccag

SEQ ID NO: 2814243 - DNA, 22 bp, Homo sapiens
tcaccccctcccacccccagcc

SEQ ID NO: 2814244 - DNA, 19 bp, Homo sapiens
tcacccgaggctgcccact

SEQ ID NO: 2814245 - DNA, 23 bp, Homo sapiens
tcaccgagagtagccgagagcct

SEQ ID NO: 2814246 - DNA, 20 bp, Homo sapiens
tcaccgtggaccttcctgcc

SEQ ID NO: 2814247 - DNA, 18 bp, Homo sapiens
tcacctcaggccaggtgc

SEQ ID NO: 2814248 - DNA, 15 bp, Homo sapiens
tcacctctgcctcaa

SEQ ID NO: 2814249 - DNA, 15 bp, Homo sapiens
tcacctgatcatata

SEQ ID NO: 2814250 - DNA, 21 bp, Homo sapiens
tcacctgtttttaagctgttt

SEQ ID NO: 2814251 - DNA, 17 bp, Homo sapiens
tcaccttatgtattatt

SEQ ID NO: 2814252 - DNA, 22 bp, Homo sapiens
tcaccttatgtattattttcta

SEQ ID NO: 2814253 - DNA, 17 bp, Homo sapiens
tcaccttcttggttgaa

SEQ ID NO: 2814254 - DNA, 13 bp, Homo sapiens
tcacgccactgca

SEQ ID NO: 2814255 - DNA, 14 bp, Homo sapiens
tcacgcccagcctc

SEQ ID NO: 2814256 - DNA, 23 bp, Homo sapiens
tcacgcccagcctcctcccacca

SEQ ID NO: 2814257 - DNA, 19 bp, Homo sapiens
tcacgcctgtaatcccagc

SEQ ID NO: 2814258 - DNA, 21 bp, Homo sapiens
tcacgcctgtaatcccagcag

SEQ ID NO: 2814259 - DNA, 15 bp, Homo sapiens
tcacggctcactgca

SEQ ID NO: 2814260 - DNA, 22 bp, Homo sapiens
tcactactcacagtctctttaa

SEQ ID NO: 2814261 - DNA, 15 bp, Homo sapiens
tcactagcagctgca

SEQ ID NO: 2814262 - DNA, 16 bp, Homo sapiens
tcactagcagctgcag

SEQ ID NO: 2814263 - DNA, 17 bp, Homo sapiens
tcactagcagctgcagt

SEQ ID NO: 2814264 - DNA, 17 bp, Homo sapiens
tcactataaatggtgtt

SEQ ID NO: 2814265 - DNA, 15 bp, Homo sapiens
tcactatctttctga

SEQ ID NO: 2814266 - DNA, 19 bp, Homo sapiens
tcactatgacactgagcaa

SEQ ID NO: 2814267 - DNA, 17 bp, Homo sapiens
tcactatgattttctat

SEQ ID NO: 2814268 - DNA, 17 bp, Homo sapiens
tcactatgttgcccagg

SEQ ID NO: 2814269 - DNA, 18 bp, Homo sapiens
tcactatgttgcccaggc

SEQ ID NO: 2814270 - DNA, 18 bp, Homo sapiens
tcactattcctaggagga

SEQ ID NO: 2814271 - DNA, 14 bp, Homo sapiens
tcactccaccaccc

SEQ ID NO: 2814272 - DNA, 18 bp, Homo sapiens
tcatctgttatcctgcta

SEQ ID NO: 2814273 - DNA, 17 bp, Homo sapiens
tcatctgtttttctttt

SEQ ID NO: 2814274 - DNA, 22 bp, Homo sapiens
tcatcttggtactactagatgt

SEQ ID NO: 2814275 - DNA, 11 bp, Homo sapiens
tcatgaaaagt

SEQ ID NO: 2814276 - DNA, 22 bp, Homo sapiens
tcatgaacctcaagctgcatct

SEQ ID NO: 2814277 - DNA, 12 bp, Homo sapiens
tcatgaagccca

SEQ ID NO: 2814278 - DNA, 21 bp, Homo sapiens
tcatgaggaggtcagcccatt

SEQ ID NO: 2814279 - DNA, 16 bp, Homo sapiens
tcatgatctccctgcc

SEQ ID NO: 2814280 - DNA, 13 bp, Homo sapiens
tcatgcaatgaca

SEQ ID NO: 2814281 - DNA, 15 bp, Homo sapiens
tcatgcaatgacatc

SEQ ID NO: 2814282 - DNA, 15 bp, Homo sapiens
tcatgcctctgaggc

SEQ ID NO: 2814283 - DNA, 22 bp, Homo sapiens
tcatgcctggcccccctccagg

SEQ ID NO: 2814284 - DNA, 23 bp, Homo sapiens
tcatgcctggcccccctccaggc

SEQ ID NO: 2814285 - DNA, 17 bp, Homo sapiens
tcatggaaactggccag

SEQ ID NO: 2814286 - DNA, 19 bp, Homo sapiens
tcatgtaaacctaagcacg

SEQ ID NO: 2814287 - DNA, 20 bp, Homo sapiens
tcatgtaaacctaagcacgt

SEQ ID NO: 2814288 - DNA, 15 bp, Homo sapiens
tcatgtacagcatgc

SEQ ID NO: 2814289 - DNA, 20 bp, Homo sapiens
tcatgtgatccttttatgtt

SEQ ID NO: 2814290 - DNA, 13 bp, Homo sapiens
tcatgtgcctgga

SEQ ID NO: 2814291 - DNA, 14 bp, Homo sapiens
tcatgtgcctggaa

SEQ ID NO: 2814292 - DNA, 21 bp, Homo sapiens
tcattaaaataaataaatgca

SEQ ID NO: 2814293 - DNA, 15 bp, Homo sapiens
tcattaaagcattta

SEQ ID NO: 2814294 - DNA, 20 bp, Homo sapiens
tcattagactggaacttgaa

SEQ ID NO: 2814295 - DNA, 15 bp, Homo sapiens
tcattataaacgtga

SEQ ID NO: 2814296 - DNA, 16 bp, Homo sapiens
tcattatttgcagaga

SEQ ID NO: 2814297 - DNA, 18 bp, Homo sapiens
tcattcaagcctgtgaat

SEQ ID NO: 2814298 - DNA, 14 bp, Homo sapiens
tcattccccaggtg

SEQ ID NO: 2814299 - DNA, 12 bp, Homo sapiens
tcattcccctcg

SEQ ID NO: 2814300 - DNA, 12 bp, Homo sapiens
tcattcttctgt

SEQ ID NO: 2814301 - DNA, 17 bp, Homo sapiens
tcattcttgaaagctgt

SEQ ID NO: 2814302 - DNA, 20 bp, Homo sapiens
tcattgactatcaaactgaa

SEQ ID NO: 2814303 - DNA, 21 bp, Homo sapiens
tcattgactatcaaactgaag

SEQ ID NO: 2814304 - DNA, 15 bp, Homo sapiens
tcattgatatgaaaa

SEQ ID NO: 2814305 - DNA, 15 bp, Homo sapiens
tcattgtataaaaat

SEQ ID NO: 2814306 - DNA, 13 bp, Homo sapiens
tcattgtggctat

SEQ ID NO: 2814307 - DNA, 18 bp, Homo sapiens
tcattgtggctatctgca

SEQ ID NO: 2814308 - DNA, 21 bp, Homo sapiens
tcattgttacaggtgtactat

SEQ ID NO: 2814309 - DNA, 22 bp, Homo sapiens
tcattgttacaggtgtactatg

SEQ ID NO: 2814310 - DNA, 17 bp, Homo sapiens
tcatttaagggaaaaat

SEQ ID NO: 2814311 - DNA, 14 bp, Homo sapiens
tcatttatgaaaag

SEQ ID NO: 2814312 - DNA, 15 bp, Homo sapiens
tcatttcactttaaa

SEQ ID NO: 2814313 - DNA, 18 bp, Homo sapiens
tcatttcatctcatttaa

SEQ ID NO: 2814314 - DNA, 20 bp, Homo sapiens
tcatttcatctcatttaagg

SEQ ID NO: 2814315 - DNA, 12 bp, Homo sapiens
tcatttccgtga

SEQ ID NO: 2814316 - DNA, 13 bp, Homo sapiens
tcatttcctcaaa

SEQ ID NO: 2814317 - DNA, 13 bp, Homo sapiens
tcatttcctgtgt

SEQ ID NO: 2814318 - DNA, 15 bp, Homo sapiens
tcatttctactgtga

SEQ ID NO: 2814319 - DNA, 18 bp, Homo sapiens
tcatttctactgtgactg

SEQ ID NO: 2814320 - DNA, 19 bp, Homo sapiens
tcatttcttttccaaaatt

SEQ ID NO: 2814321 - DNA, 14 bp, Homo sapiens
tcatttgtcacaca

SEQ ID NO: 2814322 - DNA, 15 bp, Homo sapiens
tcatttgttggaatg

SEQ ID NO: 2814323 - DNA, 14 bp, Homo sapiens
tcattttaattatt

SEQ ID NO: 2814324 - DNA, 12 bp, Homo sapiens
tcattttcagag

SEQ ID NO: 2814325 - DNA, 13 bp, Homo sapiens
tcattttcagagt

SEQ ID NO: 2814326 - DNA, 15 bp, Homo sapiens
tcattttcagagtga

SEQ ID NO: 2814327 - DNA, 21 bp, Homo sapiens
tcattttcttatcttctgcaa

SEQ ID NO: 2814328 - DNA, 14 bp, Homo sapiens
tcattttggtactt

SEQ ID NO: 2814329 - DNA, 12 bp, Homo sapiens
tccaaacaccgg

SEQ ID NO: 2814330 - DNA, 19 bp, Homo sapiens
tccaaacaccggcagaaaa

SEQ ID NO: 2814331 - DNA, 15 bp, Homo sapiens
tccaaacttctaaat

SEQ ID NO: 2814332 - DNA, 13 bp, Homo sapiens
tccaaagagaaaa

SEQ ID NO: 2814333 - DNA, 20 bp, Homo sapiens
tccaaagggcagtaaagttt

SEQ ID NO: 2814334 - DNA, 22 bp, Homo sapiens
tccaaatgattttcatcaattt

SEQ ID NO: 2814335 - DNA, 14 bp, Homo sapiens
tccaacctggacaa

SEQ ID NO: 2814336 - DNA, 12 bp, Homo sapiens
tccaagagctga

SEQ ID NO: 2814337 - DNA, 21 bp, Homo sapiens
tccaagcgaggtcaacagaga

SEQ ID NO: 2814338 - DNA, 23 bp, Homo sapiens
tccaagcgaggtcaacagagaag

SEQ ID NO: 2814339 - DNA, 20 bp, Homo sapiens
tccaagctggtcccactcag

SEQ ID NO: 2814340 - DNA, 15 bp, Homo sapiens
tccaaggagaaacag

SEQ ID NO: 2814341 - DNA, 20 bp, Homo sapiens
tccaaggagaaacagagaca

SEQ ID NO: 2814342 - DNA, 23 bp, Homo sapiens
tccaagggttgaattctggagga

SEQ ID NO: 2814343 - DNA, 17 bp, Homo sapiens
tccaagtattttatctg

SEQ ID NO: 2814344 - DNA, 12 bp, Homo sapiens
tccaatataaat

SEQ ID NO: 2814345 - DNA, 12 bp, Homo sapiens
tccaattgtaaa

SEQ ID NO: 2814346 - DNA, 22 bp, Homo sapiens
tccaattttctggaatacatga

SEQ ID NO: 2814347 - DNA, 16 bp, Homo sapiens
tccacaagattcccag

SEQ ID NO: 2814348 - DNA, 18 bp, Homo sapiens
tccacaagattcccagag

SEQ ID NO: 2814349 - DNA, 14 bp, Homo sapiens
ctgccccgcttccc

SEQ ID NO: 2814350 - DNA, 20 bp, Homo sapiens
ctgccccgcttccccacaga

SEQ ID NO: 2814351 - DNA, 18 bp, Homo sapiens
ctgccccgggtccccagc

SEQ ID NO: 2814352 - DNA, 21 bp, Homo sapiens
ctgccccgggtccccagctcc

SEQ ID NO: 2814353 - DNA, 15 bp, Homo sapiens
ctgcccgtcttcagc

SEQ ID NO: 2814354 - DNA, 16 bp, Homo sapiens
ctgcccgtcttcagcc

SEQ ID NO: 2814355 - DNA, 17 bp, Homo sapiens
ctgcccgtcttcagcct

SEQ ID NO: 2814356 - DNA, 18 bp, Homo sapiens
ctgcccgtcttcagccta

SEQ ID NO: 2814357 - DNA, 21 bp, Homo sapiens
ctgccctagagcacactgtag

SEQ ID NO: 2814358 - DNA, 17 bp, Homo sapiens
ctgccctccctggcctc

SEQ ID NO: 2814359 - DNA, 21 bp, Homo sapiens
ctgccctgccacctgtctgtc

SEQ ID NO: 2814360 - DNA, 11 bp, Homo sapiens
ctgccctgccc

SEQ ID NO: 2814361 - DNA, 15 bp, Homo sapiens
ctgccctgccctgcc

SEQ ID NO: 2814362 - DNA, 22 bp, Homo sapiens
ctgccctgctgccgcctcccag

SEQ ID NO: 2814363 - DNA, 19 bp, Homo sapiens
ctgccctgttgtgtataga

SEQ ID NO: 2814364 - DNA, 12 bp, Homo sapiens
ctgcccttgttt

SEQ ID NO: 2814365 - DNA, 21 bp, Homo sapiens
ctgccgagcaaccgtggccct

SEQ ID NO: 2814366 - DNA, 14 bp, Homo sapiens
ctgccgcctcccag

SEQ ID NO: 2814367 - DNA, 20 bp, Homo sapiens
ctgccgggttctagtctcct

SEQ ID NO: 2814368 - DNA, 23 bp, Homo sapiens
ctgccgggttctagtctcctttg

SEQ ID NO: 2814369 - DNA, 14 bp, Homo sapiens
ctgcctaagtggct

SEQ ID NO: 2814370 - DNA, 15 bp, Homo sapiens
ctgcctaagtggctg

SEQ ID NO: 2814371 - DNA, 19 bp, Homo sapiens
ctgcctaagtggctgctga

SEQ ID NO: 2814372 - DNA, 20 bp, Homo sapiens
ctgcctaagtggctgctgac

SEQ ID NO: 2814373 - DNA, 14 bp, Homo sapiens
ctgcctacatccca

SEQ ID NO: 2814374 - DNA, 19 bp, Homo sapiens
ctgcctacattccctggcc

SEQ ID NO: 2814375 - DNA, 22 bp, Homo sapiens
ctgcctacattccctggcctgg

SEQ ID NO: 2814376 - DNA, 23 bp, Homo sapiens
ctgcctacattccctggcctggc

SEQ ID NO: 2814377 - DNA, 13 bp, Homo sapiens
ctgcctactcacg

SEQ ID NO: 2814378 - DNA, 24 bp, Homo sapiens
ctgcctcaatgtgaatcagaccct

SEQ ID NO: 2814379 - DNA, 14 bp, Homo sapiens
ctgcctcagctgct

SEQ ID NO: 2814380 - DNA, 22 bp, Homo sapiens
ctgcctcagctgctcgcacaga

SEQ ID NO: 2814381 - DNA, 22 bp, Homo sapiens
ctgcctccagaatggtctttct

SEQ ID NO: 2814382 - DNA, 12 bp, Homo sapiens
ctgcctccctag

SEQ ID NO: 2814383 - DNA, 13 bp, Homo sapiens
ctgcctcctcttc

SEQ ID NO: 2814384 - DNA, 14 bp, Homo sapiens
ctgcctcctcttca

SEQ ID NO: 2814385 - DNA, 20 bp, Homo sapiens
ctgcctcgaactggctgcaa

SEQ ID NO: 2814386 - DNA, 15 bp, Homo sapiens
ctgcctctactggga

SEQ ID NO: 2814387 - DNA, 18 bp, Homo sapiens
ctgcctctactgggaagg

SEQ ID NO: 2814388 - DNA, 19 bp, Homo sapiens
ctgcctctactgggaaggc

SEQ ID NO: 2814389 - DNA, 22 bp, Homo sapiens
ctgcctctactgggaaggctac

SEQ ID NO: 2814390 - DNA, 21 bp, Homo sapiens
ctgcctctgacacacagctct

SEQ ID NO: 2814391 - DNA, 22 bp, Homo sapiens
ctgcctctgacacacagctctg

SEQ ID NO: 2814392 - DNA, 16 bp, Homo sapiens
ctgcctgaaaaccatc

SEQ ID NO: 2814393 - DNA, 15 bp, Homo sapiens
ctgcctgaagtcaca

SEQ ID NO: 2814394 - DNA, 21 bp, Homo sapiens
ctgcctgcccaggcccctgcc

SEQ ID NO: 2814395 - DNA, 16 bp, Homo sapiens
ctgcctgccttggcct

SEQ ID NO: 2814396 - DNA, 12 bp, Homo sapiens
ctgcctggagga

SEQ ID NO: 2814397 - DNA, 15 bp, Homo sapiens
ctgcctggaggacct

SEQ ID NO: 2814398 - DNA, 16 bp, Homo sapiens
ctgcctggaggacctg

SEQ ID NO: 2814399 - DNA, 17 bp, Homo sapiens
ctgcctggaggacctga

SEQ ID NO: 2814400 - DNA, 18 bp, Homo sapiens
ctgcctgtagttaggaaa

SEQ ID NO: 2814401 - DNA, 18 bp, Homo sapiens
ctgcctgttcagctccag

SEQ ID NO: 2814402 - DNA, 15 bp, Homo sapiens
ctgcctgttcccatt

SEQ ID NO: 2814403 - DNA, 16 bp, Homo sapiens
ctgccttccaggagca

SEQ ID NO: 2814404 - DNA, 16 bp, Homo sapiens
ctgccttgaagccact

SEQ ID NO: 2814405 - DNA, 22 bp, Homo sapiens
ctgccttgaagccactgaagct

SEQ ID NO: 2814406 - DNA, 14 bp, Homo sapiens
ctgccttgtgtaca

SEQ ID NO: 2814407 - DNA, 15 bp, Homo sapiens
ctgcctttggaagaa

SEQ ID NO: 2814408 - DNA, 17 bp, Homo sapiens
ctgcgaaggggccctgg

SEQ ID NO: 2814409 - DNA, 18 bp, Homo sapiens
ctgcgaaggggccctggt

SEQ ID NO: 2814410 - DNA, 19 bp, Homo sapiens
ctgcgaaggggccctggtc

SEQ ID NO: 2814411 - DNA, 20 bp, Homo sapiens
ctgcgagcatttccctcccg

SEQ ID NO: 2814412 - DNA, 21 bp, Homo sapiens
ctgcgagcatttccctcccgg

SEQ ID NO: 2814413 - DNA, 14 bp, Homo sapiens
ctgcgatcttcaga

SEQ ID NO: 2814414 - DNA, 17 bp, Homo sapiens
ctgcggtccacccagga

SEQ ID NO: 2814415 - DNA, 19 bp, Homo sapiens
ctgcggtccacccaggagc

SEQ ID NO: 2814416 - DNA, 20 bp, Homo sapiens
ctgcggtccacccaggagcc

SEQ ID NO: 2814417 - DNA, 13 bp, Homo sapiens
ctgcgtctgtgtt

SEQ ID NO: 2814418 - DNA, 14 bp, Homo sapiens
ctgctaagtagggg

SEQ ID NO: 2814419 - DNA, 16 bp, Homo sapiens
ctgctaataaaaccca

SEQ ID NO: 2814420 - DNA, 12 bp, Homo sapiens
ctgctacctcac

SEQ ID NO: 2814421 - DNA, 21 bp, Homo sapiens
ctgctagcacttggagccaag

SEQ ID NO: 2814422 - DNA, 19 bp, Homo sapiens
ctgctagctgtagaaatgt

SEQ ID NO: 2814423 - DNA, 15 bp, Homo sapiens
ctgctaggcgagtgc

SEQ ID NO: 2814424 - DNA, 18 bp, Homo sapiens
ctgctcaacctctctcct

SEQ ID NO: 2814425 - DNA, 19 bp, Homo sapiens
ctgctcacatatctgtcat

SEQ ID NO: 2814426 - DNA, 13 bp, Homo sapiens
ctgctcagacaga

SEQ ID NO: 2814427 - DNA, 16 bp, Homo sapiens
ctgctcagaggggccc

SEQ ID NO: 2814428 - DNA, 21 bp, Homo sapiens
ctgctcagaggggccccggtc

SEQ ID NO: 2814429 - DNA, 13 bp, Homo sapiens
ctgctcccccacc

SEQ ID NO: 2814430 - DNA, 14 bp, Homo sapiens
ctgctcccccaccc

SEQ ID NO: 2814431 - DNA, 14 bp, Homo sapiens
ctgctcctctccag

SEQ ID NO: 2814432 - DNA, 15 bp, Homo sapiens
ctgctcctctccagg

SEQ ID NO: 2814433 - DNA, 16 bp, Homo sapiens
ctgctcctctccaggc

SEQ ID NO: 2814434 - DNA, 14 bp, Homo sapiens
ctgctcgaagaaca

SEQ ID NO: 2814435 - DNA, 14 bp, Homo sapiens
ctgctcgcacagat

SEQ ID NO: 2814436 - DNA, 18 bp, Homo sapiens
ctgctcggggtgcacagg

SEQ ID NO: 2814437 - DNA, 21 bp, Homo sapiens
ctgctcgtccccaagtgacct

SEQ ID NO: 2814438 - DNA, 21 bp, Homo sapiens
gctagaattgagtgtttaaag

SEQ ID NO: 2814439 - DNA, 13 bp, Homo sapiens
gctagagaagggg

SEQ ID NO: 2814440 - DNA, 21 bp, Homo sapiens
gctagagatatggcagcgaaa

SEQ ID NO: 2814441 - DNA, 23 bp, Homo sapiens
gctagcgctgccgcaccccagag

SEQ ID NO: 2814442 - DNA, 13 bp, Homo sapiens
gctagctgtagaa

SEQ ID NO: 2814443 - DNA, 20 bp, Homo sapiens
gctaggacccctccatgtgg

SEQ ID NO: 2814444 - DNA, 14 bp, Homo sapiens
gctaggcctggcca

SEQ ID NO: 2814445 - DNA, 18 bp, Homo sapiens
gctaggcgagtgccagga

SEQ ID NO: 2814446 - DNA, 13 bp, Homo sapiens
gctagggctggac

SEQ ID NO: 2814447 - DNA, 14 bp, Homo sapiens
gctagtcagagaga

SEQ ID NO: 2814448 - DNA, 14 bp, Homo sapiens
gctagttgggcttc

SEQ ID NO: 2814449 - DNA, 16 bp, Homo sapiens
gctagttgggcttcct

SEQ ID NO: 2814450 - DNA, 21 bp, Homo sapiens
gctagttgggcttcctcatag

SEQ ID NO: 2814451 - DNA, 17 bp, Homo sapiens
gctataggtcagagatg

SEQ ID NO: 2814452 - DNA, 13 bp, Homo sapiens
gctatcacacagt

SEQ ID NO: 2814453 - DNA, 20 bp, Homo sapiens
gctatctactgagacatgac

SEQ ID NO: 2814454 - DNA, 20 bp, Homo sapiens
gctatctctgtgtgcacaaa

SEQ ID NO: 2814455 - DNA, 21 bp, Homo sapiens
gctatctgcatttataaatgt

SEQ ID NO: 2814456 - DNA, 23 bp, Homo sapiens
gctatgagggtccccgggagcac

SEQ ID NO: 2814457 - DNA, 18 bp, Homo sapiens
gctattattttcactgta

SEQ ID NO: 2814458 - DNA, 20 bp, Homo sapiens
gctattgcatgtaaaatgca

SEQ ID NO: 2814459 - DNA, 22 bp, Homo sapiens
gctattgtttctttaagaaagt

SEQ ID NO: 2814460 - DNA, 22 bp, Homo sapiens
gctcaaccactgtggcgttctg

SEQ ID NO: 2814461 - DNA, 21 bp, Homo sapiens
gctcaagaagacatggagact

SEQ ID NO: 2814462 - DNA, 19 bp, Homo sapiens
gctcaagatgacagctctt

SEQ ID NO: 2814463 - DNA, 18 bp, Homo sapiens
gctcaagtcctcttttct

SEQ ID NO: 2814464 - DNA, 17 bp, Homo sapiens
gctcacaactgtttttg

SEQ ID NO: 2814465 - DNA, 15 bp, Homo sapiens
gctcacaaggcagca

SEQ ID NO: 2814466 - DNA, 22 bp, Homo sapiens
gctcacagttcctcgccctggg

SEQ ID NO: 2814467 - DNA, 13 bp, Homo sapiens
gctcaccagcccc

SEQ ID NO: 2814468 - DNA, 18 bp, Homo sapiens
gctcaccagccccagtgc

SEQ ID NO: 2814469 - DNA, 19 bp, Homo sapiens
gctcaccagccccagtgcc

SEQ ID NO: 2814470 - DNA, 23 bp, Homo sapiens
gctcaccagccccagtgcccaca

SEQ ID NO: 2814471 - DNA, 22 bp, Homo sapiens
gctcacgcctatgatcccagca

SEQ ID NO: 2814472 - DNA, 21 bp, Homo sapiens
gctcacgcctgtaatcccagc

SEQ ID NO: 2814473 - DNA, 22 bp, Homo sapiens
gctcacgcctgtaatcccagca

SEQ ID NO: 2814474 - DNA, 13 bp, Homo sapiens
gctcactccctgg

SEQ ID NO: 2814475 - DNA, 14 bp, Homo sapiens
gctcactccctggg

SEQ ID NO: 2814476 - DNA, 11 bp, Homo sapiens
gctcactgcag

SEQ ID NO: 2814477 - DNA, 12 bp, Homo sapiens
gctcactgcagc

SEQ ID NO: 2814478 - DNA, 13 bp, Homo sapiens
gctcactgcagcc

SEQ ID NO: 2814479 - DNA, 19 bp, Homo sapiens
gctcagacccccactctca

SEQ ID NO: 2814480 - DNA, 23 bp, Homo sapiens
gctcagacccccactctcattcc

SEQ ID NO: 2814481 - DNA, 15 bp, Homo sapiens
gctcagaggcccagg

SEQ ID NO: 2814482 - DNA, 16 bp, Homo sapiens
gctcagaggggccccg

SEQ ID NO: 2814483 - DNA, 21 bp, Homo sapiens
gctcagccctgactggtgcta

SEQ ID NO: 2814484 - DNA, 14 bp, Homo sapiens
gctcagcccttcct

SEQ ID NO: 2814485 - DNA, 18 bp, Homo sapiens
gctcagcccttcctagaa

SEQ ID NO: 2814486 - DNA, 11 bp, Homo sapiens
gctcagcctgg

SEQ ID NO: 2814487 - DNA, 19 bp, Homo sapiens
gctcagcctggtgggcctc

SEQ ID NO: 2814488 - DNA, 22 bp, Homo sapiens
gctcagcggggacagctccttc

SEQ ID NO: 2814489 - DNA, 23 bp, Homo sapiens
gctcagcggggacagctccttct

SEQ ID NO: 2814490 - DNA, 21 bp, Homo sapiens
gctcaggaattgaagatgtaa

SEQ ID NO: 2814491 - DNA, 15 bp, Homo sapiens
gctcaggaggcttgg

SEQ ID NO: 2814492 - DNA, 17 bp, Homo sapiens
gctcaggtgtccctgca

SEQ ID NO: 2814493 - DNA, 14 bp, Homo sapiens
gctcagtctcagga

SEQ ID NO: 2814494 - DNA, 19 bp, Homo sapiens
gctccacctgttcaggagc

SEQ ID NO: 2814495 - DNA, 17 bp, Homo sapiens
gctccagctcaccagcc

SEQ ID NO: 2814496 - DNA, 18 bp, Homo sapiens
gctccagctcaccagccc

SEQ ID NO: 2814497 - DNA, 12 bp, Homo sapiens
gctccaggctcc

SEQ ID NO: 2814498 - DNA, 23 bp, Homo sapiens
gctccaggctcctttagcgccca

SEQ ID NO: 2814499 - DNA, 14 bp, Homo sapiens
gctccatctccact

SEQ ID NO: 2814500 - DNA, 18 bp, Homo sapiens
gctcccaccccaccccct

SEQ ID NO: 2814501 - DNA, 17 bp, Homo sapiens
gctccccactctgctct

SEQ ID NO: 2814502 - DNA, 18 bp, Homo sapiens
gctccccactctgctctg

SEQ ID NO: 2814503 - DNA, 19 bp, Homo sapiens
gctccccactctgctctga

SEQ ID NO: 2814504 - DNA, 14 bp, Homo sapiens
gctcccccaccccc

SEQ ID NO: 2814505 - DNA, 15 bp, Homo sapiens
gctcccccaccccct

SEQ ID NO: 2814506 - DNA, 22 bp, Homo sapiens
gctcccccaccccctccccagg

SEQ ID NO: 2814507 - DNA, 18 bp, Homo sapiens
gctcccctgggggctagc

SEQ ID NO: 2814508 - DNA, 18 bp, Homo sapiens
gctccgctttctacccag

SEQ ID NO: 2814509 - DNA, 22 bp, Homo sapiens
gctccgtgagtgaaccatcatt

SEQ ID NO: 2814510 - DNA, 22 bp, Homo sapiens
gctcctccagggccacgtgcca

SEQ ID NO: 2814511 - DNA, 13 bp, Homo sapiens
gctcctctgtctc

SEQ ID NO: 2814512 - DNA, 23 bp, Homo sapiens
gctcctctgtctcgagcgccctg

SEQ ID NO: 2814513 - DNA, 18 bp, Homo sapiens
gctcctggaaaggctcag

SEQ ID NO: 2814514 - DNA, 23 bp, Homo sapiens
gctcctggaaaggctcagtctca

SEQ ID NO: 2814515 - DNA, 23 bp, Homo sapiens
gctcctgtacgaacccctcccct

SEQ ID NO: 2814516 - DNA, 17 bp, Homo sapiens
gctcctgtctgccagcc

SEQ ID NO: 2814517 - DNA, 21 bp, Homo sapiens
gctcctgtctgccagccagca

SEQ ID NO: 2814518 - DNA, 14 bp, Homo sapiens
gctcctttctccag

SEQ ID NO: 2814519 - DNA, 21 bp, Homo sapiens
gctcggggtgcacaggagggg

SEQ ID NO: 2814520 - DNA, 15 bp, Homo sapiens
aaaataaactgggga

SEQ ID NO: 2814521 - DNA, 16 bp, Homo sapiens
aaaataaatataattg

SEQ ID NO: 2814522 - DNA, 14 bp, Homo sapiens
aaaataacatttga

SEQ ID NO: 2814523 - DNA, 15 bp, Homo sapiens
aaaataacttatatc

SEQ ID NO: 2814524 - DNA, 14 bp, Homo sapiens
aaaataatgattta

SEQ ID NO: 2814525 - DNA, 14 bp, Homo sapiens
aaaataatttaact

SEQ ID NO: 2814526 - DNA, 18 bp, Homo sapiens
aaaataatttaactaatt

SEQ ID NO: 2814527 - DNA, 19 bp, Homo sapiens
aaaataattttaaacaaag

SEQ ID NO: 2814528 - DNA, 11 bp, Homo sapiens
aaaatacaact

SEQ ID NO: 2814529 - DNA, 19 bp, Homo sapiens
aaaatacaccacgaatttg

SEQ ID NO: 2814530 - DNA, 12 bp, Homo sapiens
aaaatacagtaa

SEQ ID NO: 2814531 - DNA, 14 bp, Homo sapiens
aaaatacattttat

SEQ ID NO: 2814532 - DNA, 21 bp, Homo sapiens
aaaatagcaacactctatatt

SEQ ID NO: 2814533 - DNA, 16 bp, Homo sapiens
aaaatagtttggatat

SEQ ID NO: 2814534 - DNA, 19 bp, Homo sapiens
aaaatagtttggatatgta

SEQ ID NO: 2814535 - DNA, 14 bp, Homo sapiens
aaaatatatataaa

SEQ ID NO: 2814536 - DNA, 14 bp, Homo sapiens
aaaatatatatcta

SEQ ID NO: 2814537 - DNA, 13 bp, Homo sapiens
aaaatatgatatt

SEQ ID NO: 2814538 - DNA, 15 bp, Homo sapiens
aaaatatttgtacat

SEQ ID NO: 2814539 - DNA, 18 bp, Homo sapiens
aaaatattttataatttt

SEQ ID NO: 2814540 - DNA, 21 bp, Homo sapiens
aaaatcacaagcaataattag

SEQ ID NO: 2814541 - DNA, 22 bp, Homo sapiens
aaaatcacaagcaataattagg

SEQ ID NO: 2814542 - DNA, 16 bp, Homo sapiens
aaaatcatgtacattt

SEQ ID NO: 2814543 - DNA, 14 bp, Homo sapiens
aaaatccctattta

SEQ ID NO: 2814544 - DNA, 13 bp, Homo sapiens
aaaatccttgctt

SEQ ID NO: 2814545 - DNA, 16 bp, Homo sapiens
aaaatctgtggtggtc

SEQ ID NO: 2814546 - DNA, 12 bp, Homo sapiens
aaaatctttcag

SEQ ID NO: 2814547 - DNA, 22 bp, Homo sapiens
aaaatgaaagcatgtctcaata

SEQ ID NO: 2814548 - DNA, 18 bp, Homo sapiens
aaaatgaaagccaaattt

SEQ ID NO: 2814549 - DNA, 13 bp, Homo sapiens
aaaatgacagatg

SEQ ID NO: 2814550 - DNA, 17 bp, Homo sapiens
aaaatgagctaggcatg

SEQ ID NO: 2814551 - DNA, 19 bp, Homo sapiens
aaaatgcagtccagaataa

SEQ ID NO: 2814552 - DNA, 23 bp, Homo sapiens
aaaatggccatttgctttttcac

SEQ ID NO: 2814553 - DNA, 21 bp, Homo sapiens
aaaatgtacactggatatgtt

SEQ ID NO: 2814554 - DNA, 16 bp, Homo sapiens
aaaatgtgacccagat

SEQ ID NO: 2814555 - DNA, 16 bp, Homo sapiens
aaaatgttcagaaggt

SEQ ID NO: 2814556 - DNA, 19 bp, Homo sapiens
aaaattaagagatacattc

SEQ ID NO: 2814557 - DNA, 23 bp, Homo sapiens
aaaattacttctctctatctgga

SEQ ID NO: 2814558 - DNA, 14 bp, Homo sapiens
aaaattagaaattg

SEQ ID NO: 2814559 - DNA, 20 bp, Homo sapiens
aaaattagaaattggctgga

SEQ ID NO: 2814560 - DNA, 22 bp, Homo sapiens
aaaattagtgagatttgtattt

SEQ ID NO: 2814561 - DNA, 13 bp, Homo sapiens
aaaattatttaaa

SEQ ID NO: 2814562 - DNA, 20 bp, Homo sapiens
aaaattctcagtcagtaatt

SEQ ID NO: 2814563 - DNA, 21 bp, Homo sapiens
aaaattgaatgcaaaccatag

SEQ ID NO: 2814564 - DNA, 22 bp, Homo sapiens
aaaattgcacaatttgagcaat

SEQ ID NO: 2814565 - DNA, 21 bp, Homo sapiens
aaaattgtatgttaagttact

SEQ ID NO: 2814566 - DNA, 20 bp, Homo sapiens
aaaattgtgtttagatttta

SEQ ID NO: 2814567 - DNA, 20 bp, Homo sapiens
aaaatttatattgtaaatat

SEQ ID NO: 2814568 - DNA, 13 bp, Homo sapiens
aaaatttcacatt

SEQ ID NO: 2814569 - DNA, 20 bp, Homo sapiens
aaaatttcacattaatattt

SEQ ID NO: 2814570 - DNA, 19 bp, Homo sapiens
aaaattttacttttgttct

SEQ ID NO: 2814571 - DNA, 23 bp, Homo sapiens
aaaattttacttttgttctgtat

SEQ ID NO: 2814572 - DNA, 13 bp, Homo sapiens
aaaattttattcc

SEQ ID NO: 2814573 - DNA, 13 bp, Homo sapiens
aaacaaaaataaa

SEQ ID NO: 2814574 - DNA, 20 bp, Homo sapiens
aaacaaactcgttttttaca

SEQ ID NO: 2814575 - DNA, 17 bp, Homo sapiens
aaacaaaggttgagatg

SEQ ID NO: 2814576 - DNA, 16 bp, Homo sapiens
aaacaaataatcacat

SEQ ID NO: 2814577 - DNA, 23 bp, Homo sapiens
aaacaagtatttgttaatttaga

SEQ ID NO: 2814578 - DNA, 14 bp, Homo sapiens
aaacaatgtttaaa

SEQ ID NO: 2814579 - DNA, 20 bp, Homo sapiens
aaacacaaatgtaaaataag

SEQ ID NO: 2814580 - DNA, 13 bp, Homo sapiens
aaacacctcccag

SEQ ID NO: 2814581 - DNA, 13 bp, Homo sapiens
aaacacctgacac

SEQ ID NO: 2814582 - DNA, 14 bp, Homo sapiens
aaacacctgacaca

SEQ ID NO: 2814583 - DNA, 21 bp, Homo sapiens
aaacacgtgtctataatggaa

SEQ ID NO: 2814584 - DNA, 15 bp, Homo sapiens
aaacactgtaatctt

SEQ ID NO: 2814585 - DNA, 23 bp, Homo sapiens
aaacactgtaatcttaaaagtgt

SEQ ID NO: 2814586 - DNA, 13 bp, Homo sapiens
aaacactgtgtat

SEQ ID NO: 2814587 - DNA, 13 bp, Homo sapiens
aaacagaaacaaa

SEQ ID NO: 2814588 - DNA, 19 bp, Homo sapiens
aaacagaaacaaaaacact

SEQ ID NO: 2814589 - DNA, 17 bp, Homo sapiens
aaacagagaaccctgtg

SEQ ID NO: 2814590 - DNA, 16 bp, Homo sapiens
aaacagagatgtgata

SEQ ID NO: 2814591 - DNA, 20 bp, Homo sapiens
aaacagaggccatggcagaa

SEQ ID NO: 2814592 - DNA, 12 bp, Homo sapiens
aaacagatataa

SEQ ID NO: 2814593 - DNA, 23 bp, Homo sapiens
aaacagccgtcagccaaatgtaa

SEQ ID NO: 2814594 - DNA, 15 bp, Homo sapiens
aaacagcctcacaga

SEQ ID NO: 2814595 - DNA, 12 bp, Homo sapiens
aaacagtgcctg

SEQ ID NO: 2814596 - DNA, 18 bp, Homo sapiens
aaacagtgcctgctgaat

SEQ ID NO: 2814597 - DNA, 18 bp, Homo sapiens
aaacataaaatatacaaa

SEQ ID NO: 2814598 - DNA, 24 bp, Homo sapiens
aaacataaaatatacaaacatgtg

SEQ ID NO: 2814599 - DNA, 20 bp, Homo sapiens
aaacataatatcttgaagaa

SEQ ID NO: 2814600 - DNA, 13 bp, Homo sapiens
aaacataattctt

SEQ ID NO: 2814601 - DNA, 18 bp, Homo sapiens
aaacatagatagtgcttt

SEQ ID NO: 2814602 - DNA, 16 bp, Homo sapiens
aaacatatcaattcaa

SEQ ID NO: 2814603 - DNA, 20 bp, Homo sapiens
aaacatccttcaagaactct

SEQ ID NO: 2814604 - DNA, 14 bp, Homo sapiens
aaacatgagaaatg

SEQ ID NO: 2814605 - DNA, 18 bp, Homo sapiens
aaacatgtacaaaatcga

SEQ ID NO: 2814606 - DNA, 15 bp, Homo sapiens
aaacattaaaagaag

SEQ ID NO: 2814607 - DNA, 21 bp, Homo sapiens
aaacattaaaagaagactgga

SEQ ID NO: 2814608 - DNA, 13 bp, Homo sapiens
aaacattaaacac

SEQ ID NO: 2814609 - DNA, 13 bp, Homo sapiens
aaacattcatcca

SEQ ID NO: 2814610 - DNA, 21 bp, Homo sapiens
aaacattcatccagttgcaat

SEQ ID NO: 2814611 - DNA, 19 bp, Homo sapiens
aaatagttttaaatatgaa

SEQ ID NO: 2814612 - DNA, 23 bp, Homo sapiens
aaatagttttaaatatgaacaaa

SEQ ID NO: 2814613 - DNA, 14 bp, Homo sapiens
aaatatacaaacat

SEQ ID NO: 2814614 - DNA, 18 bp, Homo sapiens
aaatatagatcagttata

SEQ ID NO: 2814615 - DNA, 18 bp, Homo sapiens
aaatatataatggtttac

SEQ ID NO: 2814616 - DNA, 15 bp, Homo sapiens
aaatatatataaata

SEQ ID NO: 2814617 - DNA, 20 bp, Homo sapiens
aaatatatatttttcaacca

SEQ ID NO: 2814618 - DNA, 22 bp, Homo sapiens
aaatatatatttttcaaccagc

SEQ ID NO: 2814619 - DNA, 21 bp, Homo sapiens
aaatatatttaagataattat

SEQ ID NO: 2814620 - DNA, 22 bp, Homo sapiens
aaatatatttaagataattata

SEQ ID NO: 2814621 - DNA, 17 bp, Homo sapiens
aaatatatttaattgtg

SEQ ID NO: 2814622 - DNA, 16 bp, Homo sapiens
aaatatattttatgat

SEQ ID NO: 2814623 - DNA, 21 bp, Homo sapiens
aaatatattttatgatttaaa

SEQ ID NO: 2814624 - DNA, 15 bp, Homo sapiens
aaatatcagactagt

SEQ ID NO: 2814625 - DNA, 18 bp, Homo sapiens
aaatatcagttactcagc

SEQ ID NO: 2814626 - DNA, 20 bp, Homo sapiens
aaatatcagttactcagccc

SEQ ID NO: 2814627 - DNA, 13 bp, Homo sapiens
aaatatctcagag

SEQ ID NO: 2814628 - DNA, 24 bp, Homo sapiens
aaatatgaaatgataaagatgtca

SEQ ID NO: 2814629 - DNA, 12 bp, Homo sapiens
aaatatgaacaa

SEQ ID NO: 2814630 - DNA, 13 bp, Homo sapiens
aaatatgaacaaa

SEQ ID NO: 2814631 - DNA, 19 bp, Homo sapiens
aaatatgatattgcatatg

SEQ ID NO: 2814632 - DNA, 20 bp, Homo sapiens
aaatatgttagcaaagagtt

SEQ ID NO: 2814633 - DNA, 19 bp, Homo sapiens
aaatattgaataagtattc

SEQ ID NO: 2814634 - DNA, 17 bp, Homo sapiens
aaatatttaagtatata

SEQ ID NO: 2814635 - DNA, 15 bp, Homo sapiens
aaatatttatgtaaa

SEQ ID NO: 2814636 - DNA, 14 bp, Homo sapiens
aaatatttgtacat

SEQ ID NO: 2814637 - DNA, 17 bp, Homo sapiens
aaatcacaagcaataat

SEQ ID NO: 2814638 - DNA, 18 bp, Homo sapiens
aaatcacaagcaataatt

SEQ ID NO: 2814639 - DNA, 23 bp, Homo sapiens
aaatcacagatgggtattaaact

SEQ ID NO: 2814640 - DNA, 17 bp, Homo sapiens
aaatcacgctttttgaa

SEQ ID NO: 2814641 - DNA, 20 bp, Homo sapiens
aaatcacgctttttgaaaaa

SEQ ID NO: 2814642 - DNA, 16 bp, Homo sapiens
aaatcagttatgtcaa

SEQ ID NO: 2814643 - DNA, 17 bp, Homo sapiens
aaatcatgtacatttct

SEQ ID NO: 2814644 - DNA, 11 bp, Homo sapiens
aaatccaaaga

SEQ ID NO: 2814645 - DNA, 14 bp, Homo sapiens
aaatccagaaagaa

SEQ ID NO: 2814646 - DNA, 19 bp, Homo sapiens
aaatccagtgtgcacccct

SEQ ID NO: 2814647 - DNA, 16 bp, Homo sapiens
aaatccttccatgaaa

SEQ ID NO: 2814648 - DNA, 17 bp, Homo sapiens
aaatcctttttctttat

SEQ ID NO: 2814649 - DNA, 18 bp, Homo sapiens
aaatcctttttctttata

SEQ ID NO: 2814650 - DNA, 22 bp, Homo sapiens
aaatcggatctggggctctggg

SEQ ID NO: 2814651 - DNA, 19 bp, Homo sapiens
aaatctaatgtaagaaaat

SEQ ID NO: 2814652 - DNA, 20 bp, Homo sapiens
aaatctgagcctaaatctaa

SEQ ID NO: 2814653 - DNA, 19 bp, Homo sapiens
aaatctgtttgatccctgt

SEQ ID NO: 2814654 - DNA, 21 bp, Homo sapiens
aaatcttatattccatatatt

SEQ ID NO: 2814655 - DNA, 18 bp, Homo sapiens
aaatcttccttgtgagga

SEQ ID NO: 2814656 - DNA, 18 bp, Homo sapiens
aaatcttttataggattt

SEQ ID NO: 2814657 - DNA, 22 bp, Homo sapiens
aaatgaaagccaaatttatatg

SEQ ID NO: 2814658 - DNA, 15 bp, Homo sapiens
aaatgacagcgggga

SEQ ID NO: 2814659 - DNA, 14 bp, Homo sapiens
aaatgacatttttg

SEQ ID NO: 2814660 - DNA, 15 bp, Homo sapiens
aaatgacatttttga

SEQ ID NO: 2814661 - DNA, 17 bp, Homo sapiens
aaatgactaaaaatatt

SEQ ID NO: 2814662 - DNA, 20 bp, Homo sapiens
aaatgactaaaaatattata

SEQ ID NO: 2814663 - DNA, 15 bp, Homo sapiens
aaatgagcctgtaat

SEQ ID NO: 2814664 - DNA, 19 bp, Homo sapiens
aaatgaggtcagagcctgc

SEQ ID NO: 2814665 - DNA, 12 bp, Homo sapiens
aaatgagtgtgt

SEQ ID NO: 2814666 - DNA, 22 bp, Homo sapiens
aaatgagtttttatggggctga

SEQ ID NO: 2814667 - DNA, 17 bp, Homo sapiens
aaatgataaagatgtca

SEQ ID NO: 2814668 - DNA, 19 bp, Homo sapiens
aaatgataaagatgtcaaa

SEQ ID NO: 2814669 - DNA, 20 bp, Homo sapiens
aaatgataaagatgtcaaat

SEQ ID NO: 2814670 - DNA, 16 bp, Homo sapiens
aaatgatcttttcaag

SEQ ID NO: 2814671 - DNA, 13 bp, Homo sapiens
aaatgattttcat

SEQ ID NO: 2814672 - DNA, 16 bp, Homo sapiens
aaatgcaacaacatgt

SEQ ID NO: 2814673 - DNA, 13 bp, Homo sapiens
aaatgcaatatgt

SEQ ID NO: 2814674 - DNA, 16 bp, Homo sapiens
aaatgcaatatgtatt

SEQ ID NO: 2814675 - DNA, 12 bp, Homo sapiens
aaatgcagtgaa

SEQ ID NO: 2814676 - DNA, 15 bp, Homo sapiens
aaatgcatgatttta

SEQ ID NO: 2814677 - DNA, 13 bp, Homo sapiens
aaatgcattatgt

SEQ ID NO: 2814678 - DNA, 22 bp, Homo sapiens
aaatggaggtccttctgctgga

SEQ ID NO: 2814679 - DNA, 16 bp, Homo sapiens
aaatggccatttgctt

SEQ ID NO: 2814680 - DNA, 14 bp, Homo sapiens
aaatggtgtttttt

SEQ ID NO: 2814681 - DNA, 12 bp, Homo sapiens
aaatgtaattga

SEQ ID NO: 2814682 - DNA, 22 bp, Homo sapiens
aaatgtagtatggcctgtgtca

SEQ ID NO: 2814683 - DNA, 17 bp, Homo sapiens
aaatgtatcatagaaat

SEQ ID NO: 2814684 - DNA, 18 bp, Homo sapiens
aaatgtatgattacatca

SEQ ID NO: 2814685 - DNA, 21 bp, Homo sapiens
aaatgtctatagagaaaaact

SEQ ID NO: 2814686 - DNA, 16 bp, Homo sapiens
aaatgtgtggtgctaa

SEQ ID NO: 2814687 - DNA, 21 bp, Homo sapiens
aaatgttattttttaattatt

SEQ ID NO: 2814688 - DNA, 23 bp, Homo sapiens
aaatgttgaaatatgatgttaaa

SEQ ID NO: 2814689 - DNA, 17 bp, Homo sapiens
aaatgttggaattttca

SEQ ID NO: 2814690 - DNA, 19 bp, Homo sapiens
aaatgttggaattttcaaa

SEQ ID NO: 2814691 - DNA, 18 bp, Homo sapiens
aaatgtttcactatgatt

SEQ ID NO: 2814692 - DNA, 15 bp, Homo sapiens
aaatgtttctgcagt

SEQ ID NO: 2814693 - DNA, 17 bp, Homo sapiens
aaattaagagatacatt

SEQ ID NO: 2814694 - DNA, 16 bp, Homo sapiens
aaattacacccaaaga

SEQ ID NO: 2814695 - DNA, 22 bp, Homo sapiens
aaattacttctctctatctgga

SEQ ID NO: 2814696 - DNA, 14 bp, Homo sapiens
aaattagatgaact

SEQ ID NO: 2814697 - DNA, 17 bp, Homo sapiens
aaattaggttttgtaca

SEQ ID NO: 2814698 - DNA, 17 bp, Homo sapiens
aaattagtgaagttctt

SEQ ID NO: 2814699 - DNA, 18 bp, Homo sapiens
aaattagtgagatttgta

SEQ ID NO: 2814700 - DNA, 16 bp, Homo sapiens
aaattataacttaaaa

SEQ ID NO: 2814701 - DNA, 14 bp, Homo sapiens
tacctaaacagata

SEQ ID NO: 2814702 - DNA, 12 bp, Homo sapiens
tacctcagccta

SEQ ID NO: 2814703 - DNA, 14 bp, Homo sapiens
tacctcagcctaga

SEQ ID NO: 2814704 - DNA, 16 bp, Homo sapiens
tacctcagcctagacc

SEQ ID NO: 2814705 - DNA, 10 bp, Homo sapiens
tacctcagtt

SEQ ID NO: 2814706 - DNA, 14 bp, Homo sapiens
tacctcagtttctc

SEQ ID NO: 2814707 - DNA, 11 bp, Homo sapiens
tacctcctgcc

SEQ ID NO: 2814708 - DNA, 15 bp, Homo sapiens
tacctcctgcccagg

SEQ ID NO: 2814709 - DNA, 20 bp, Homo sapiens
tacctctctctatatataca

SEQ ID NO: 2814710 - DNA, 14 bp, Homo sapiens
tacctctgatacct

SEQ ID NO: 2814711 - DNA, 12 bp, Homo sapiens
tacctctgtgtg

SEQ ID NO: 2814712 - DNA, 19 bp, Homo sapiens
tacctctttattttttgat

SEQ ID NO: 2814713 - DNA, 12 bp, Homo sapiens
tacctgagacca

SEQ ID NO: 2814714 - DNA, 13 bp, Homo sapiens
tacctgagaccag

SEQ ID NO: 2814715 - DNA, 16 bp, Homo sapiens
tacctgtagtgagaaa

SEQ ID NO: 2814716 - DNA, 12 bp, Homo sapiens
tacctgtgcctg

SEQ ID NO: 2814717 - DNA, 17 bp, Homo sapiens
tacctgtgtttcttgcc

SEQ ID NO: 2814718 - DNA, 20 bp, Homo sapiens
tacctgtgtttcttgcctca

SEQ ID NO: 2814719 - DNA, 14 bp, Homo sapiens
taccttcaataaag

SEQ ID NO: 2814720 - DNA, 15 bp, Homo sapiens
taccttcttcgctgc

SEQ ID NO: 2814721 - DNA, 16 bp, Homo sapiens
tacctttatggtttct

SEQ ID NO: 2814722 - DNA, 18 bp, Homo sapiens
tacctttcccatgctgaa

SEQ ID NO: 2814723 - DNA, 14 bp, Homo sapiens
tacgctctctgtct

SEQ ID NO: 2814724 - DNA, 17 bp, Homo sapiens
tacgtataaatatgaaa

SEQ ID NO: 2814725 - DNA, 20 bp, Homo sapiens
tacgtataaatatgaaatga

SEQ ID NO: 2814726 - DNA, 14 bp, Homo sapiens
tacgtctggtgttc

SEQ ID NO: 2814727 - DNA, 14 bp, Homo sapiens
tacgtgagccaggt

SEQ ID NO: 2814728 - DNA, 18 bp, Homo sapiens
tactaaacattttgttat

SEQ ID NO: 2814729 - DNA, 12 bp, Homo sapiens
tactaaagcagt

SEQ ID NO: 2814730 - DNA, 14 bp, Homo sapiens
tactaaagcagtgt

SEQ ID NO: 2814731 - DNA, 20 bp, Homo sapiens
tactaagcattgaatggcta

SEQ ID NO: 2814732 - DNA, 23 bp, Homo sapiens
tactacagttgttttttgaaaac

SEQ ID NO: 2814733 - DNA, 18 bp, Homo sapiens
tactaccggctacatcaa

SEQ ID NO: 2814734 - DNA, 17 bp, Homo sapiens
tactactagatgtcttt

SEQ ID NO: 2814735 - DNA, 14 bp, Homo sapiens
tactactattctgt

SEQ ID NO: 2814736 - DNA, 20 bp, Homo sapiens
tactactgtggaaaaatatt

SEQ ID NO: 2814737 - DNA, 19 bp, Homo sapiens
tactagatgtctttaggca

SEQ ID NO: 2814738 - DNA, 13 bp, Homo sapiens
tactattctgtta

SEQ ID NO: 2814739 - DNA, 15 bp, Homo sapiens
tactcacagtctctt

SEQ ID NO: 2814740 - DNA, 16 bp, Homo sapiens
tactcagaagcctgag

SEQ ID NO: 2814741 - DNA, 15 bp, Homo sapiens
tactcagcagccctc

SEQ ID NO: 2814742 - DNA, 16 bp, Homo sapiens
tactcagcagccctcc

SEQ ID NO: 2814743 - DNA, 18 bp, Homo sapiens
tactcagcagccctcctc

SEQ ID NO: 2814744 - DNA, 20 bp, Homo sapiens
tactcagcagccctcctcac

SEQ ID NO: 2814745 - DNA, 12 bp, Homo sapiens
tactcagccctg

SEQ ID NO: 2814746 - DNA, 16 bp, Homo sapiens
tactcagccctgggcc

SEQ ID NO: 2814747 - DNA, 12 bp, Homo sapiens
tactcaggaggc

SEQ ID NO: 2814748 - DNA, 22 bp, Homo sapiens
tactcaggaggctgaggcagaa

SEQ ID NO: 2814749 - DNA, 19 bp, Homo sapiens
tactcatatatatctatct

SEQ ID NO: 2814750 - DNA, 23 bp, Homo sapiens
tactcatatatatctatcttata

SEQ ID NO: 2814751 - DNA, 11 bp, Homo sapiens
tactcattttt

SEQ ID NO: 2814752 - DNA, 15 bp, Homo sapiens
tactcctacctcagc

SEQ ID NO: 2814753 - DNA, 17 bp, Homo sapiens
tactcctgcaaaatttt

SEQ ID NO: 2814754 - DNA, 11 bp, Homo sapiens
tactcctgtgg

SEQ ID NO: 2814755 - DNA, 17 bp, Homo sapiens
tactcctgtgggagcct

SEQ ID NO: 2814756 - DNA, 20 bp, Homo sapiens
tactcctgtgggagcctcgc

SEQ ID NO: 2814757 - DNA, 21 bp, Homo sapiens
tactcctgtgggagcctcgca

SEQ ID NO: 2814758 - DNA, 14 bp, Homo sapiens
tactctagaacatg

SEQ ID NO: 2814759 - DNA, 14 bp, Homo sapiens
tactctccaacctg

SEQ ID NO: 2814760 - DNA, 19 bp, Homo sapiens
tactctcctcggccccctc

SEQ ID NO: 2814761 - DNA, 20 bp, Homo sapiens
tactctcctcggccccctcc

SEQ ID NO: 2814762 - DNA, 21 bp, Homo sapiens
tactctgtgccagagcctggg

SEQ ID NO: 2814763 - DNA, 21 bp, Homo sapiens
tactctgtgtcaggtggggca

SEQ ID NO: 2814764 - DNA, 21 bp, Homo sapiens
tactcttaggaagagaaacca

SEQ ID NO: 2814765 - DNA, 22 bp, Homo sapiens
tactcttcagaatatggacaaa

SEQ ID NO: 2814766 - DNA, 17 bp, Homo sapiens
tactgagcttctctgtg

SEQ ID NO: 2814767 - DNA, 15 bp, Homo sapiens
tactgcacattttgt

SEQ ID NO: 2814768 - DNA, 11 bp, Homo sapiens
tactgcctgct

SEQ ID NO: 2814769 - DNA, 12 bp, Homo sapiens
tactgcctgctt

SEQ ID NO: 2814770 - DNA, 14 bp, Homo sapiens
tactgcctgcttgg

SEQ ID NO: 2814771 - DNA, 16 bp, Homo sapiens
tactgcctgcttgggg

SEQ ID NO: 2814772 - DNA, 13 bp, Homo sapiens
tactgcctttgga

SEQ ID NO: 2814773 - DNA, 22 bp, Homo sapiens
tactgcctttggaagaaacagg

SEQ ID NO: 2814774 - DNA, 19 bp, Homo sapiens
tactgctgcaaagtgcaaa

SEQ ID NO: 2814775 - DNA, 17 bp, Homo sapiens
tactggaagttttgcat

SEQ ID NO: 2814776 - DNA, 13 bp, Homo sapiens
tactgggaaggct

SEQ ID NO: 2814777 - DNA, 17 bp, Homo sapiens
tactgggaaggctactt

SEQ ID NO: 2814778 - DNA, 20 bp, Homo sapiens
tactgtaattttgtttgtaa

SEQ ID NO: 2814779 - DNA, 19 bp, Homo sapiens
tactgtggaaaaatattta

SEQ ID NO: 2814780 - DNA, 20 bp, Homo sapiens
tactgtggaaaaatatttaa

SEQ ID NO: 2814781 - DNA, 23 bp, Homo sapiens
tactgtgtacagaattctgctac

SEQ ID NO: 2814782 - DNA, 13 bp, Homo sapiens
tacttaaagcttg

SEQ ID NO: 2814783 - DNA, 18 bp, Homo sapiens
tacttaaatgaaagcatg

SEQ ID NO: 2814784 - DNA, 20 bp, Homo sapiens
tacttaactgtgtgaagaaa

SEQ ID NO: 2814785 - DNA, 17 bp, Homo sapiens
tacttaataaattcaga

SEQ ID NO: 2814786 - DNA, 19 bp, Homo sapiens
tacttacatgcattactgc

SEQ ID NO: 2814787 - DNA, 18 bp, Homo sapiens
tacttagcaaagttttac

SEQ ID NO: 2814788 - DNA, 19 bp, Homo sapiens
tacttattttccaataaaa

SEQ ID NO: 2814789 - DNA, 20 bp, Homo sapiens
tacttattttccaataaaat

SEQ ID NO: 2814790 - DNA, 18 bp, Homo sapiens
tacttcaagttaaagtga

SEQ ID NO: 2814791 - DNA, 21 bp, Homo sapiens
tacttcaagttaaagtgaata

SEQ ID NO: 2814792 - DNA, 17 bp, Homo sapiens
taggggtcaggctccat

SEQ ID NO: 2814793 - DNA, 13 bp, Homo sapiens
tagggtcaggcgg

SEQ ID NO: 2814794 - DNA, 14 bp, Homo sapiens
taggtatacagtgg

SEQ ID NO: 2814795 - DNA, 15 bp, Homo sapiens
taggtatgaataagt

SEQ ID NO: 2814796 - DNA, 11 bp, Homo sapiens
taggtgacaga

SEQ ID NO: 2814797 - DNA, 16 bp, Homo sapiens
taggtgacagagtgag

SEQ ID NO: 2814798 - DNA, 23 bp, Homo sapiens
taggtgacagagtgagactctgt

SEQ ID NO: 2814799 - DNA, 13 bp, Homo sapiens
taggtgcctcctg

SEQ ID NO: 2814800 - DNA, 16 bp, Homo sapiens
taggtgcctcctgtct

SEQ ID NO: 2814801 - DNA, 18 bp, Homo sapiens
taggtgcctcctgtctta

SEQ ID NO: 2814802 - DNA, 16 bp, Homo sapiens
taggtggatcacctga

SEQ ID NO: 2814803 - DNA, 12 bp, Homo sapiens
taggttataaga

SEQ ID NO: 2814804 - DNA, 12 bp, Homo sapiens
taggttctaaaa

SEQ ID NO: 2814805 - DNA, 17 bp, Homo sapiens
tagtaaagtcaaggaga

SEQ ID NO: 2814806 - DNA, 18 bp, Homo sapiens
tagtaaatcacgcttttt

SEQ ID NO: 2814807 - DNA, 18 bp, Homo sapiens
tagtaatgggccaattaa

SEQ ID NO: 2814808 - DNA, 20 bp, Homo sapiens
tagtaatgggccaattaaaa

SEQ ID NO: 2814809 - DNA, 23 bp, Homo sapiens
tagtaatgggccaattaaaatat

SEQ ID NO: 2814810 - DNA, 14 bp, Homo sapiens
tagtagagacaggg

SEQ ID NO: 2814811 - DNA, 20 bp, Homo sapiens
tagtagcagtgattgtctta

SEQ ID NO: 2814812 - DNA, 20 bp, Homo sapiens
tagtagtcaattagtacagt

SEQ ID NO: 2814813 - DNA, 23 bp, Homo sapiens
tagtagtcaattagtacagtagc

SEQ ID NO: 2814814 - DNA, 13 bp, Homo sapiens
tagtagtgtcttc

SEQ ID NO: 2814815 - DNA, 17 bp, Homo sapiens
tagtagttgatgaccaa

SEQ ID NO: 2814816 - DNA, 16 bp, Homo sapiens
tagtataaagaaaagt

SEQ ID NO: 2814817 - DNA, 20 bp, Homo sapiens
tagtatattagtttgattta

SEQ ID NO: 2814818 - DNA, 13 bp, Homo sapiens
tagtatatttata

SEQ ID NO: 2814819 - DNA, 16 bp, Homo sapiens
tagtatatttatactc

SEQ ID NO: 2814820 - DNA, 17 bp, Homo sapiens
tagtatatttatactct

SEQ ID NO: 2814821 - DNA, 16 bp, Homo sapiens
tagtatggcctgtgtc

SEQ ID NO: 2814822 - DNA, 13 bp, Homo sapiens
tagtcacaaaaat

SEQ ID NO: 2814823 - DNA, 16 bp, Homo sapiens
tagtcacaaaaatggt

SEQ ID NO: 2814824 - DNA, 17 bp, Homo sapiens
tagtcacaaaaatggtg

SEQ ID NO: 2814825 - DNA, 23 bp, Homo sapiens
tagtcacatggcctatgcacata

SEQ ID NO: 2814826 - DNA, 22 bp, Homo sapiens
tagtctcctttgcactgagggc

SEQ ID NO: 2814827 - DNA, 20 bp, Homo sapiens
tagtctgaggccccttaact

SEQ ID NO: 2814828 - DNA, 19 bp, Homo sapiens
tagtctggtgttctgagta

SEQ ID NO: 2814829 - DNA, 13 bp, Homo sapiens
tagtctgtcatcc

SEQ ID NO: 2814830 - DNA, 18 bp, Homo sapiens
tagtctgtcatccagaaa

SEQ ID NO: 2814831 - DNA, 15 bp, Homo sapiens
tagtgacccacatgc

SEQ ID NO: 2814832 - DNA, 16 bp, Homo sapiens
tagtgcacacttgtat

SEQ ID NO: 2814833 - DNA, 19 bp, Homo sapiens
tagtgcggacaagttttaa

SEQ ID NO: 2814834 - DNA, 23 bp, Homo sapiens
tagtgctttacctttattaatga

SEQ ID NO: 2814835 - DNA, 15 bp, Homo sapiens
tagttaagtcatcca

SEQ ID NO: 2814836 - DNA, 18 bp, Homo sapiens
tagttagcaggaaatagt

SEQ ID NO: 2814837 - DNA, 23 bp, Homo sapiens
tagttaggaaataaaacctttca

SEQ ID NO: 2814838 - DNA, 17 bp, Homo sapiens
tagttaggtgtgccaaa

SEQ ID NO: 2814839 - DNA, 17 bp, Homo sapiens
tagttgaaaataaagtg

SEQ ID NO: 2814840 - DNA, 23 bp, Homo sapiens
tagttgatgaccaatctctgtga

SEQ ID NO: 2814841 - DNA, 19 bp, Homo sapiens
tagttgcagaaacattttg

SEQ ID NO: 2814842 - DNA, 22 bp, Homo sapiens
tagttgcgtggactctgcacat

SEQ ID NO: 2814843 - DNA, 14 bp, Homo sapiens
tagttttagttgca

SEQ ID NO: 2814844 - DNA, 18 bp, Homo sapiens
tagtttttacctaccaca

SEQ ID NO: 2814845 - DNA, 14 bp, Homo sapiens
tagtttttcagcta

SEQ ID NO: 2814846 - DNA, 17 bp, Homo sapiens
tataaaatctagatcaa

SEQ ID NO: 2814847 - DNA, 13 bp, Homo sapiens
tataaactttaga

SEQ ID NO: 2814848 - DNA, 22 bp, Homo sapiens
tataaactttagagtagcatga

SEQ ID NO: 2814849 - DNA, 15 bp, Homo sapiens
tataaagaacaaggt

SEQ ID NO: 2814850 - DNA, 16 bp, Homo sapiens
tataaaggttgacaat

SEQ ID NO: 2814851 - DNA, 16 bp, Homo sapiens
tataaataaatgccaa

SEQ ID NO: 2814852 - DNA, 15 bp, Homo sapiens
tataaatatatattt

SEQ ID NO: 2814853 - DNA, 23 bp, Homo sapiens
tataaatatatatttttcaacca

SEQ ID NO: 2814854 - DNA, 11 bp, Homo sapiens
tataaatgcat

SEQ ID NO: 2814855 - DNA, 13 bp, Homo sapiens
tataaatgcatga

SEQ ID NO: 2814856 - DNA, 22 bp, Homo sapiens
tataaatgcatgattttataca

SEQ ID NO: 2814857 - DNA, 23 bp, Homo sapiens
tataaccccaccttgccaagctt

SEQ ID NO: 2814858 - DNA, 16 bp, Homo sapiens
tataactagctagaag

SEQ ID NO: 2814859 - DNA, 18 bp, Homo sapiens
tataactcatcataaaat

SEQ ID NO: 2814860 - DNA, 19 bp, Homo sapiens
tataactcatcataaaata

SEQ ID NO: 2814861 - DNA, 20 bp, Homo sapiens
tataactcatcataaaataa

SEQ ID NO: 2814862 - DNA, 16 bp, Homo sapiens
tataactgaaggagaa

SEQ ID NO: 2814863 - DNA, 22 bp, Homo sapiens
tataagcaagaaggcaaaaata

SEQ ID NO: 2814864 - DNA, 17 bp, Homo sapiens
tataaggtttaaaaaga

SEQ ID NO: 2814865 - DNA, 18 bp, Homo sapiens
tataataatgttctctgg

SEQ ID NO: 2814866 - DNA, 15 bp, Homo sapiens
tataatggtttactg

SEQ ID NO: 2814867 - DNA, 19 bp, Homo sapiens
tataatgttgttatttaaa

SEQ ID NO: 2814868 - DNA, 22 bp, Homo sapiens
tataattgttttatctgaattt

SEQ ID NO: 2814869 - DNA, 17 bp, Homo sapiens
tataattttatgaatgt

SEQ ID NO: 2814870 - DNA, 22 bp, Homo sapiens
tataattttatgaatgtctttg

SEQ ID NO: 2814871 - DNA, 15 bp, Homo sapiens
tatacaaaataattt

SEQ ID NO: 2814872 - DNA, 19 bp, Homo sapiens
tatacaaaataatttaact

SEQ ID NO: 2814873 - DNA, 23 bp, Homo sapiens
tatacaaaataatttaactaatt

SEQ ID NO: 2814874 - DNA, 19 bp, Homo sapiens
tatacatagtcacaaaaat

SEQ ID NO: 2814875 - DNA, 14 bp, Homo sapiens
tatacatatcagaa

SEQ ID NO: 2814876 - DNA, 18 bp, Homo sapiens
tatacatatcagaaaagt

SEQ ID NO: 2814877 - DNA, 21 bp, Homo sapiens
tatacatattataaataaatg

SEQ ID NO: 2814878 - DNA, 16 bp, Homo sapiens
tatactccatacataa

SEQ ID NO: 2814879 - DNA, 17 bp, Homo sapiens
tatacttttttcttatt

SEQ ID NO: 2814880 - DNA, 19 bp, Homo sapiens
tatacttttttcttattta

SEQ ID NO: 2814881 - DNA, 21 bp, Homo sapiens
tatacttttttcttatttaac

SEQ ID NO: 2814882 - DNA, 18 bp, Homo sapiens
catctaagcctgttgaga

SEQ ID NO: 2814883 - DNA, 15 bp, Homo sapiens
catctaagctgcagc

SEQ ID NO: 2814884 - DNA, 22 bp, Homo sapiens
catctagaggcttccttcattt

SEQ ID NO: 2814885 - DNA, 23 bp, Homo sapiens
catctagaggcttccttcatttc

SEQ ID NO: 2814886 - DNA, 21 bp, Homo sapiens
catctatggcagtccagccag

SEQ ID NO: 2814887 - DNA, 20 bp, Homo sapiens
catctattataaaaccatgt

SEQ ID NO: 2814888 - DNA, 17 bp, Homo sapiens
catctattctttcccta

SEQ ID NO: 2814889 - DNA, 23 bp, Homo sapiens
catctattctttccctagaggca

SEQ ID NO: 2814890 - DNA, 21 bp, Homo sapiens
catctattctttgtaccatct

SEQ ID NO: 2814891 - DNA, 22 bp, Homo sapiens
catctattctttgtaccatctg

SEQ ID NO: 2814892 - DNA, 14 bp, Homo sapiens
catctatttctgag

SEQ ID NO: 2814893 - DNA, 13 bp, Homo sapiens
catctcactttgc

SEQ ID NO: 2814894 - DNA, 19 bp, Homo sapiens
catctcagggtccagaccc

SEQ ID NO: 2814895 - DNA, 21 bp, Homo sapiens
catctcagtgaagaatacttc

SEQ ID NO: 2814896 - DNA, 22 bp, Homo sapiens
catctcagtgaagaatacttct

SEQ ID NO: 2814897 - DNA, 19 bp, Homo sapiens
catctcatttaagggaaaa

SEQ ID NO: 2814898 - DNA, 23 bp, Homo sapiens
catctcatttaagggaaaaatat

SEQ ID NO: 2814899 - DNA, 20 bp, Homo sapiens
catctccaccctgagcctga

SEQ ID NO: 2814900 - DNA, 19 bp, Homo sapiens
catctctaattggaagaaa

SEQ ID NO: 2814901 - DNA, 12 bp, Homo sapiens
catctgaaagcc

SEQ ID NO: 2814902 - DNA, 15 bp, Homo sapiens
catctgagcaagagc

SEQ ID NO: 2814903 - DNA, 18 bp, Homo sapiens
catctgagcaagagctgg

SEQ ID NO: 2814904 - DNA, 15 bp, Homo sapiens
catctgctcctccca

SEQ ID NO: 2814905 - DNA, 14 bp, Homo sapiens
catctgctcttctc

SEQ ID NO: 2814906 - DNA, 18 bp, Homo sapiens
catctgggaggctggtct

SEQ ID NO: 2814907 - DNA, 13 bp, Homo sapiens
catgtaataaatc

SEQ ID NO: 2814908 - DNA, 14 bp, Homo sapiens
catgtacagcatgc

SEQ ID NO: 2814909 - DNA, 20 bp, Homo sapiens
catgtacatgaagaagctaa

SEQ ID NO: 2814910 - DNA, 21 bp, Homo sapiens
catgtaccatcaataaagtac

SEQ ID NO: 2814911 - DNA, 22 bp, Homo sapiens
catgtactgagccttgtaattc

SEQ ID NO: 2814912 - DNA, 14 bp, Homo sapiens
catgtagcaggact

SEQ ID NO: 2814913 - DNA, 20 bp, Homo sapiens
catgtagcaggactgaattg

SEQ ID NO: 2814914 - DNA, 23 bp, Homo sapiens
catgtagctctatggggggaggg

SEQ ID NO: 2814915 - DNA, 18 bp, Homo sapiens
catgtataatatttttaa

SEQ ID NO: 2814916 - DNA, 18 bp, Homo sapiens
catgtatgtcttggacac

SEQ ID NO: 2814917 - DNA, 20 bp, Homo sapiens
catgtcaccgtggaccttcc

SEQ ID NO: 2814918 - DNA, 23 bp, Homo sapiens
catgtcaccgtggaccttcctgc

SEQ ID NO: 2814919 - DNA, 17 bp, Homo sapiens
catgtccctacacccct

SEQ ID NO: 2814920 - DNA, 15 bp, Homo sapiens
catgtcctatccaaa

SEQ ID NO: 2814921 - DNA, 13 bp, Homo sapiens
catgtcgcctgcc

SEQ ID NO: 2814922 - DNA, 20 bp, Homo sapiens
catgtcgcctgcccccagca

SEQ ID NO: 2814923 - DNA, 16 bp, Homo sapiens
catgtcggagtagaaa

SEQ ID NO: 2814924 - DNA, 12 bp, Homo sapiens
catgtgacacat

SEQ ID NO: 2814925 - DNA, 13 bp, Homo sapiens
catgtgacacata

SEQ ID NO: 2814926 - DNA, 21 bp, Homo sapiens
catgtgcatggaaatgtcctc

SEQ ID NO: 2814927 - DNA, 22 bp, Homo sapiens
catgtgccaggtttttggtctg

SEQ ID NO: 2814928 - DNA, 12 bp, Homo sapiens
catgtggtggga

SEQ ID NO: 2814929 - DNA, 18 bp, Homo sapiens
catgtgtggatgtgtaaa

SEQ ID NO: 2814930 - DNA, 13 bp, Homo sapiens
catgttaaagagg

SEQ ID NO: 2814931 - DNA, 13 bp, Homo sapiens
catgttggccagg

SEQ ID NO: 2814932 - DNA, 17 bp, Homo sapiens
catgttggccaggctgg

SEQ ID NO: 2814933 - DNA, 21 bp, Homo sapiens
catgtttacttttcagggcat

SEQ ID NO: 2814934 - DNA, 20 bp, Homo sapiens
catgtttgcacctttctagt

SEQ ID NO: 2814935 - DNA, 22 bp, Homo sapiens
catgtttgcacctttctagttg

SEQ ID NO: 2814936 - DNA, 20 bp, Homo sapiens
cattaaaagaagactggaag

SEQ ID NO: 2814937 - DNA, 20 bp, Homo sapiens
cattaaattggaattttctt

SEQ ID NO: 2814938 - DNA, 12 bp, Homo sapiens
cattaaatttct

SEQ ID NO: 2814939 - DNA, 13 bp, Homo sapiens
cattaaattttct

SEQ ID NO: 2814940 - DNA, 17 bp, Homo sapiens
cattaacttagcatgtg

SEQ ID NO: 2814941 - DNA, 16 bp, Homo sapiens
cattaatatttgctga

SEQ ID NO: 2814942 - DNA, 17 bp, Homo sapiens
cattaatatttgctgac

SEQ ID NO: 2814943 - DNA, 20 bp, Homo sapiens
cattaattctactaaatatt

SEQ ID NO: 2814944 - DNA, 22 bp, Homo sapiens
cattaattctactaaatatttt

SEQ ID NO: 2814945 - DNA, 23 bp, Homo sapiens
cattactgcatgcacttcttaca

SEQ ID NO: 2814946 - DNA, 21 bp, Homo sapiens
cattactgcctttggaagaaa

SEQ ID NO: 2814947 - DNA, 22 bp, Homo sapiens
cattacttgcacaagcttgtat

SEQ ID NO: 2814948 - DNA, 23 bp, Homo sapiens
cattagaaactgaaaactgtaaa

SEQ ID NO: 2814949 - DNA, 20 bp, Homo sapiens
cattagactggaacttgaac

SEQ ID NO: 2814950 - DNA, 22 bp, Homo sapiens
cattaggaacagagtatatatg

SEQ ID NO: 2814951 - DNA, 21 bp, Homo sapiens
cattagtacacagcaccagaa

SEQ ID NO: 2814952 - DNA, 18 bp, Homo sapiens
cattatcgggagcagtgt

SEQ ID NO: 2814953 - DNA, 21 bp, Homo sapiens
cattatgatgtgggtcaagga

SEQ ID NO: 2814954 - DNA, 18 bp, Homo sapiens
cattcaagcctgtgaata

SEQ ID NO: 2814955 - DNA, 16 bp, Homo sapiens
cattcaatacaagtgt

SEQ ID NO: 2814956 - DNA, 18 bp, Homo sapiens
cattcaatatctgacagt

SEQ ID NO: 2814957 - DNA, 13 bp, Homo sapiens
cattcacagagcc

SEQ ID NO: 2814958 - DNA, 21 bp, Homo sapiens
cattcacatttgatgtacatg

SEQ ID NO: 2814959 - DNA, 13 bp, Homo sapiens
cattcaggaaaac

SEQ ID NO: 2814960 - DNA, 17 bp, Homo sapiens
cattcaggaagatgaaa

SEQ ID NO: 2814961 - DNA, 16 bp, Homo sapiens
cattcatccagttgca

SEQ ID NO: 2814962 - DNA, 19 bp, Homo sapiens
cattcatccagttgcaata

SEQ ID NO: 2814963 - DNA, 20 bp, Homo sapiens
cattcatccagttgcaataa

SEQ ID NO: 2814964 - DNA, 18 bp, Homo sapiens
cattcatgccaaagcaaa

SEQ ID NO: 2814965 - DNA, 21 bp, Homo sapiens
cattcatgccaaagcaaaaga

SEQ ID NO: 2814966 - DNA, 14 bp, Homo sapiens
cattccatgatttt

SEQ ID NO: 2814967 - DNA, 23 bp, Homo sapiens
cattccccaggtggctgacccag

SEQ ID NO: 2814968 - DNA, 17 bp, Homo sapiens
cattccctatcaaaaca

SEQ ID NO: 2814969 - DNA, 18 bp, Homo sapiens
cattccctgagtcaccag

SEQ ID NO: 2814970 - DNA, 21 bp, Homo sapiens
cattccctgagtcaccaggaa

SEQ ID NO: 2814971 - DNA, 13 bp, Homo sapiens
cattcctcaggga

SEQ ID NO: 2814972 - DNA, 19 bp, Homo sapiens
cattcctgaaagaaacagt

SEQ ID NO: 2814973 - DNA, 12 bp, Homo sapiens
cattctctctcc

SEQ ID NO: 2814974 - DNA, 21 bp, Homo sapiens
tatggttcccaataaaagtga

SEQ ID NO: 2814975 - DNA, 22 bp, Homo sapiens
tatggttcccaataaaagtgac

SEQ ID NO: 2814976 - DNA, 19 bp, Homo sapiens
tatgtaaactgcattagaa

SEQ ID NO: 2814977 - DNA, 12 bp, Homo sapiens
tatgtacagtta

SEQ ID NO: 2814978 - DNA, 17 bp, Homo sapiens
tatgtatatgtatatat

SEQ ID NO: 2814979 - DNA, 19 bp, Homo sapiens
tatgtatatgtatatctat

SEQ ID NO: 2814980 - DNA, 22 bp, Homo sapiens
tatgtattattttctatagctc

SEQ ID NO: 2814981 - DNA, 16 bp, Homo sapiens
tatgtcaatttgtata

SEQ ID NO: 2814982 - DNA, 17 bp, Homo sapiens
tatgtcaatttgtatat

SEQ ID NO: 2814983 - DNA, 20 bp, Homo sapiens
tatgtcaatttgtatatcat

SEQ ID NO: 2814984 - DNA, 16 bp, Homo sapiens
tatgtcatttcatttc

SEQ ID NO: 2814985 - DNA, 15 bp, Homo sapiens
tatgtcccttgctgt

SEQ ID NO: 2814986 - DNA, 22 bp, Homo sapiens
tatgtgaaagtgtaaaatagaa

SEQ ID NO: 2814987 - DNA, 12 bp, Homo sapiens
tatgtgaatgat

SEQ ID NO: 2814988 - DNA, 12 bp, Homo sapiens
tatgtgtcatga

SEQ ID NO: 2814989 - DNA, 12 bp, Homo sapiens
tatgtgtgtatg

SEQ ID NO: 2814990 - DNA, 21 bp, Homo sapiens
tatgtgtgtatgggtgtgtgt

SEQ ID NO: 2814991 - DNA, 18 bp, Homo sapiens
tatgttactacatgcact

SEQ ID NO: 2814992 - DNA, 19 bp, Homo sapiens
tatgttgcccaggcaggtc

SEQ ID NO: 2814993 - DNA, 16 bp, Homo sapiens
tatgttgctgaaacac

SEQ ID NO: 2814994 - DNA, 16 bp, Homo sapiens
tatgttgtgttctaat

SEQ ID NO: 2814995 - DNA, 19 bp, Homo sapiens
tatgtttgctttaatgtgt

SEQ ID NO: 2814996 - DNA, 18 bp, Homo sapiens
tattaaatacagacacta

SEQ ID NO: 2814997 - DNA, 21 bp, Homo sapiens
tattaaatacagacactaagt

SEQ ID NO: 2814998 - DNA, 16 bp, Homo sapiens
tattaacaaattatgt

SEQ ID NO: 2814999 - DNA, 18 bp, Homo sapiens
tattaacaaattatgtta

SEQ ID NO: 2815000 - DNA, 20 bp, Homo sapiens
tattaatattcattgtataa

SEQ ID NO: 2815001 - DNA, 15 bp, Homo sapiens
tattaatgaactgtg

SEQ ID NO: 2815002 - DNA, 16 bp, Homo sapiens
tattaatgaactgtga

SEQ ID NO: 2815003 - DNA, 18 bp, Homo sapiens
tattaatgaactgtgaca

SEQ ID NO: 2815004 - DNA, 14 bp, Homo sapiens
tattagctgtaaat

SEQ ID NO: 2815005 - DNA, 22 bp, Homo sapiens
tattagctgtaaatacatgtgt

SEQ ID NO: 2815006 - DNA, 22 bp, Homo sapiens
tattagtttgatttaatatctg

SEQ ID NO: 2815007 - DNA, 19 bp, Homo sapiens
tattataaataaatgccaa

SEQ ID NO: 2815008 - DNA, 17 bp, Homo sapiens
tattataataatgttct

SEQ ID NO: 2815009 - DNA, 12 bp, Homo sapiens
tattataattta

SEQ ID NO: 2815010 - DNA, 19 bp, Homo sapiens
tattataatttttttcaat

SEQ ID NO: 2815011 - DNA, 13 bp, Homo sapiens
tattatcctgcat

SEQ ID NO: 2815012 - DNA, 21 bp, Homo sapiens
tattatggaagattttaaatt

SEQ ID NO: 2815013 - DNA, 15 bp, Homo sapiens
tattatggtgtaatg

SEQ ID NO: 2815014 - DNA, 18 bp, Homo sapiens
tattatggtgtaatgcac

SEQ ID NO: 2815015 - DNA, 21 bp, Homo sapiens
tattatggtgtaatgcacaat

SEQ ID NO: 2815016 - DNA, 22 bp, Homo sapiens
tattatggtgtaatgcacaatt

SEQ ID NO: 2815017 - DNA, 19 bp, Homo sapiens
tattattacttatttttga

SEQ ID NO: 2815018 - DNA, 13 bp, Homo sapiens
tattatttatata

SEQ ID NO: 2815019 - DNA, 14 bp, Homo sapiens
tattcaataaagct

SEQ ID NO: 2815020 - DNA, 17 bp, Homo sapiens
tattcaattcctctggg

SEQ ID NO: 2815021 - DNA, 14 bp, Homo sapiens
tattcactgtaagt

SEQ ID NO: 2815022 - DNA, 18 bp, Homo sapiens
tattcagacaagcaacag

SEQ ID NO: 2815023 - DNA, 21 bp, Homo sapiens
tattcagtgctgtggcctggg

SEQ ID NO: 2815024 - DNA, 16 bp, Homo sapiens
tattcatgtaataaat

SEQ ID NO: 2815025 - DNA, 19 bp, Homo sapiens
tattccatccatatacttt

SEQ ID NO: 2815026 - DNA, 23 bp, Homo sapiens
tattccatttttactaaagcagt

SEQ ID NO: 2815027 - DNA, 17 bp, Homo sapiens
tattccccattcttcct

SEQ ID NO: 2815028 - DNA, 21 bp, Homo sapiens
tattccctgtacaatatttaa

SEQ ID NO: 2815029 - DNA, 14 bp, Homo sapiens
tattcctgaatgaa

SEQ ID NO: 2815030 - DNA, 21 bp, Homo sapiens
tattcctgcatttgtgaaatg

SEQ ID NO: 2815031 - DNA, 20 bp, Homo sapiens
tattccttttgtgtacagtg

SEQ ID NO: 2815032 - DNA, 15 bp, Homo sapiens
tattctaattttata

SEQ ID NO: 2815033 - DNA, 14 bp, Homo sapiens
tattctcaccagga

SEQ ID NO: 2815034 - DNA, 11 bp, Homo sapiens
tattctccatg

SEQ ID NO: 2815035 - DNA, 16 bp, Homo sapiens
tattctctcctcagac

SEQ ID NO: 2815036 - DNA, 17 bp, Homo sapiens
tattctctcctcagact

SEQ ID NO: 2815037 - DNA, 17 bp, Homo sapiens
tattcttggagaacttt

SEQ ID NO: 2815038 - DNA, 18 bp, Homo sapiens
tattgaacttggaaagaa

SEQ ID NO: 2815039 - DNA, 16 bp, Homo sapiens
tattgaagaaaagcac

SEQ ID NO: 2815040 - DNA, 18 bp, Homo sapiens
tattgaagaaaagcactt

SEQ ID NO: 2815041 - DNA, 17 bp, Homo sapiens
tattgaataagtattct

SEQ ID NO: 2815042 - DNA, 18 bp, Homo sapiens
tattgacaataatttcag

SEQ ID NO: 2815043 - DNA, 20 bp, Homo sapiens
tattgcatgtaaaatgcagt

SEQ ID NO: 2815044 - DNA, 16 bp, Homo sapiens
tattggaatataattg

SEQ ID NO: 2815045 - DNA, 13 bp, Homo sapiens
tattggtccagct

SEQ ID NO: 2815046 - DNA, 16 bp, Homo sapiens
tattgtaatgaatatc

SEQ ID NO: 2815047 - DNA, 22 bp, Homo sapiens
tattgtataagattagaatgaa

SEQ ID NO: 2815048 - DNA, 12 bp, Homo sapiens
tattgtatgtaa

SEQ ID NO: 2815049 - DNA, 16 bp, Homo sapiens
tattgtcagatatttt

SEQ ID NO: 2815050 - DNA, 21 bp, Homo sapiens
tattgtgatctatcaatagtc

SEQ ID NO: 2815051 - DNA, 17 bp, Homo sapiens
tattgtgtgttatttaa

SEQ ID NO: 2815052 - DNA, 16 bp, Homo sapiens
tatttaaaaaactaaa

SEQ ID NO: 2815053 - DNA, 20 bp, Homo sapiens
tatttaaaaaactaaaaact

SEQ ID NO: 2815054 - DNA, 14 bp, Homo sapiens
tatttaaaatagca

SEQ ID NO: 2815055 - DNA, 19 bp, Homo sapiens
tatttaaaatttattgctt

SEQ ID NO: 2815056 - DNA, 21 bp, Homo sapiens
tatttaaaccgctaaaagaaa

SEQ ID NO: 2815057 - DNA, 21 bp, Homo sapiens
tatttaactgccttgtgtaca

SEQ ID NO: 2815058 - DNA, 19 bp, Homo sapiens
tatttaagtatatagtata

SEQ ID NO: 2815059 - DNA, 18 bp, Homo sapiens
tatttaatagcaaagaat

SEQ ID NO: 2815060 - DNA, 20 bp, Homo sapiens
tatttaatagcaaagaattg

SEQ ID NO: 2815061 - DNA, 16 bp, Homo sapiens
tatttaatttttgcaa

SEQ ID NO: 2815062 - DNA, 21 bp, Homo sapiens
tatttacatatgaaatttaat

SEQ ID NO: 2815063 - DNA, 21 bp, Homo sapiens
tatttacatgaattgcatttt

SEQ ID NO: 2815064 - DNA, 14 bp, Homo sapiens
aaaaaaaaattgca

SEQ ID NO: 2815065 - DNA, 13 bp, Homo sapiens
aaaaaaatacagt

SEQ ID NO: 2815066 - DNA, 13 bp, Homo sapiens
aaaaaaatgacta

SEQ ID NO: 2815067 - DNA, 15 bp, Homo sapiens
aaaaaacagaggcca

SEQ ID NO: 2815068 - DNA, 12 bp, Homo sapiens
aaaaaattgcac

SEQ ID NO: 2815069 - DNA, 15 bp, Homo sapiens
aaaaaattgcacaat

SEQ ID NO: 2815070 - DNA, 22 bp, Homo sapiens
aaaaaatttgagaaagccttca

SEQ ID NO: 2815071 - DNA, 14 bp, Homo sapiens
aaaaacagaggcca

SEQ ID NO: 2815072 - DNA, 19 bp, Homo sapiens
aaaaacagcctcacagaag

SEQ ID NO: 2815073 - DNA, 14 bp, Homo sapiens
aaaaacatttgtac

SEQ ID NO: 2815074 - DNA, 20 bp, Homo sapiens
aaaaaccaaataagcatctg

SEQ ID NO: 2815075 - DNA, 17 bp, Homo sapiens
aaaaaccaatgattcat

SEQ ID NO: 2815076 - DNA, 18 bp, Homo sapiens
aaaaaccactgaacattt

SEQ ID NO: 2815077 - DNA, 22 bp, Homo sapiens
aaaaaccagaatcataattttc

SEQ ID NO: 2815078 - DNA, 14 bp, Homo sapiens
aaaaactaaaaact

SEQ ID NO: 2815079 - DNA, 18 bp, Homo sapiens
aaaaacttgtactatgtt

SEQ ID NO: 2815080 - DNA, 22 bp, Homo sapiens
aaaaacttgtactatgttaata

SEQ ID NO: 2815081 - DNA, 18 bp, Homo sapiens
aaaaagattatatatcat

SEQ ID NO: 2815082 - DNA, 13 bp, Homo sapiens
aaaaagatttgtt

SEQ ID NO: 2815083 - DNA, 20 bp, Homo sapiens
aaaaagcttaaaactttgaa

SEQ ID NO: 2815084 - DNA, 21 bp, Homo sapiens
aaaaagggatccgtacattca

SEQ ID NO: 2815085 - DNA, 21 bp, Homo sapiens
aaaaagtaattgtagatggaa

SEQ ID NO: 2815086 - DNA, 14 bp, Homo sapiens
aaaaagtatatatt

SEQ ID NO: 2815087 - DNA, 13 bp, Homo sapiens
aaaaagtattttt

SEQ ID NO: 2815088 - DNA, 15 bp, Homo sapiens
aaaaagttgcacatt

SEQ ID NO: 2815089 - DNA, 17 bp, Homo sapiens
aaaaagtttgccagaag

SEQ ID NO: 2815090 - DNA, 18 bp, Homo sapiens
aaaaataaaaacataaaa

SEQ ID NO: 2815091 - DNA, 15 bp, Homo sapiens
aaaaataaaatgatg

SEQ ID NO: 2815092 - DNA, 14 bp, Homo sapiens
aaaaataagaagaa

SEQ ID NO: 2815093 - DNA, 16 bp, Homo sapiens
aaaaataagaagaatg

SEQ ID NO: 2815094 - DNA, 18 bp, Homo sapiens
aaaaatacaccacgaatt

SEQ ID NO: 2815095 - DNA, 14 bp, Homo sapiens
aaaaatacagtaaa

SEQ ID NO: 2815096 - DNA, 16 bp, Homo sapiens
aaaaatacagtaaagt

SEQ ID NO: 2815097 - DNA, 18 bp, Homo sapiens
aaaaatacagtaaagttt

SEQ ID NO: 2815098 - DNA, 15 bp, Homo sapiens
aaaaatacattttat

SEQ ID NO: 2815099 - DNA, 15 bp, Homo sapiens
aaaaatattttctga

SEQ ID NO: 2815100 - DNA, 17 bp, Homo sapiens
aaaaatcataaactgtg

SEQ ID NO: 2815101 - DNA, 12 bp, Homo sapiens
aaaaatgaaagc

SEQ ID NO: 2815102 - DNA, 17 bp, Homo sapiens
aaaaatgacagatgttg

SEQ ID NO: 2815103 - DNA, 13 bp, Homo sapiens
aaaaatggtaatt

SEQ ID NO: 2815104 - DNA, 19 bp, Homo sapiens
aaaaattagtgaagttctt

SEQ ID NO: 2815105 - DNA, 13 bp, Homo sapiens
aaaaattgcacaa

SEQ ID NO: 2815106 - DNA, 15 bp, Homo sapiens
aaaaattgcacaatt

SEQ ID NO: 2815107 - DNA, 23 bp, Homo sapiens
aaaaattgtgtttagattttatg

SEQ ID NO: 2815108 - DNA, 16 bp, Homo sapiens
aaaaatttgtttaaag

SEQ ID NO: 2815109 - DNA, 18 bp, Homo sapiens
aaaacaaaaccagctgct

SEQ ID NO: 2815110 - DNA, 21 bp, Homo sapiens
aaaacaccaccaaatgacaag

SEQ ID NO: 2815111 - DNA, 14 bp, Homo sapiens
aaaacactagtttt

SEQ ID NO: 2815112 - DNA, 18 bp, Homo sapiens
aaaacaggtggagaaatt

SEQ ID NO: 2815113 - DNA, 13 bp, Homo sapiens
aaaacatatcaat

SEQ ID NO: 2815114 - DNA, 16 bp, Homo sapiens
aaaacatgagaaatgt

SEQ ID NO: 2815115 - DNA, 22 bp, Homo sapiens
aaaacattcatccagttgcaat

SEQ ID NO: 2815116 - DNA, 12 bp, Homo sapiens
aaaacatttatt

SEQ ID NO: 2815117 - DNA, 15 bp, Homo sapiens
aaaacatttgtacat

SEQ ID NO: 2815118 - DNA, 23 bp, Homo sapiens
aaaaccaatgattcataacaatg

SEQ ID NO: 2815119 - DNA, 17 bp, Homo sapiens
aaaaccagaatcataat

SEQ ID NO: 2815120 - DNA, 20 bp, Homo sapiens
aaaaccagctgctactcata

SEQ ID NO: 2815121 - DNA, 18 bp, Homo sapiens
aaaaccctgctttttgac

SEQ ID NO: 2815122 - DNA, 14 bp, Homo sapiens
aaaagaagaagttt

SEQ ID NO: 2815123 - DNA, 13 bp, Homo sapiens
aaaagaagactgg

SEQ ID NO: 2815124 - DNA, 15 bp, Homo sapiens
aaaagaagactggaa

SEQ ID NO: 2815125 - DNA, 11 bp, Homo sapiens
aaaagaagtaa

SEQ ID NO: 2815126 - DNA, 16 bp, Homo sapiens
aaaagactcagtgttc

SEQ ID NO: 2815127 - DNA, 17 bp, Homo sapiens
aaaagattatatatcat

SEQ ID NO: 2815128 - DNA, 23 bp, Homo sapiens
aaaagattatatatcataaagta

SEQ ID NO: 2815129 - DNA, 14 bp, Homo sapiens
aaaagcaaatgaga

SEQ ID NO: 2815130 - DNA, 11 bp, Homo sapiens
aaaagcacttt

SEQ ID NO: 2815131 - DNA, 14 bp, Homo sapiens
aaaagctagaattg

SEQ ID NO: 2815132 - DNA, 21 bp, Homo sapiens
aaaagctgcttgactatcaca

SEQ ID NO: 2815133 - DNA, 22 bp, Homo sapiens
aaaagctgcttgactatcacat

SEQ ID NO: 2815134 - DNA, 22 bp, Homo sapiens
aaaaggagccaatttaaagaaa

SEQ ID NO: 2815135 - DNA, 13 bp, Homo sapiens
aaaaggcctgggg

SEQ ID NO: 2815136 - DNA, 14 bp, Homo sapiens
aaaaggtttatgaa

SEQ ID NO: 2815137 - DNA, 23 bp, Homo sapiens
aaaaggtttatgaaaaagaagaa

SEQ ID NO: 2815138 - DNA, 11 bp, Homo sapiens
aaaagtaaaca

SEQ ID NO: 2815139 - DNA, 22 bp, Homo sapiens
aaaagtaagtaccactcaggcc

SEQ ID NO: 2815140 - DNA, 23 bp, Homo sapiens
aaaagtaagtaccactcaggcca

SEQ ID NO: 2815141 - DNA, 19 bp, Homo sapiens
aaaagtatgtgaatatgaa

SEQ ID NO: 2815142 - DNA, 12 bp, Homo sapiens
aaaagtcacaca

SEQ ID NO: 2815143 - DNA, 18 bp, Homo sapiens
aaaagtcacacagacaca

SEQ ID NO: 2815144 - DNA, 17 bp, Homo sapiens
aaaagtgcttagaaagt

SEQ ID NO: 2815145 - DNA, 18 bp, Homo sapiens
aaaagttacatgtttgca

SEQ ID NO: 2815146 - DNA, 18 bp, Homo sapiens
aaaataaaaacataaaat

SEQ ID NO: 2815147 - DNA, 17 bp, Homo sapiens
aaaataaaaaccagaat

SEQ ID NO: 2815148 - DNA, 14 bp, Homo sapiens
aaaataaacaaata

SEQ ID NO: 2815149 - DNA, 12 bp, Homo sapiens
aaaataaattga

SEQ ID NO: 2815150 - DNA, 17 bp, Homo sapiens
aaaataatttaactaat

SEQ ID NO: 2815151 - DNA, 16 bp, Homo sapiens
aaaatacaactagaga

SEQ ID NO: 2815152 - DNA, 22 bp, Homo sapiens
aaaatacagtaaagtttaaaaa

SEQ ID NO: 2815153 - DNA, 12 bp, Homo sapiens
aaaatacatttt

SEQ ID NO: 2815154 - DNA, 17 bp, Homo sapiens
aaaatagcaaaagaaga

SEQ ID NO: 2815155 - DNA, 10 bp, Homo sapiens
aaaatagcca

SEQ ID NO: 2815156 - DNA, 15 bp, Homo sapiens
aaaatagtagaacaa

SEQ ID NO: 2815157 - DNA, 13 bp, Homo sapiens
aaaatagtttgga

SEQ ID NO: 2815158 - DNA, 20 bp, Homo sapiens
aaaatagtttggatatgtaa

SEQ ID NO: 2815159 - DNA, 13 bp, Homo sapiens
aaaatataaatgc

SEQ ID NO: 2815160 - DNA, 14 bp, Homo sapiens
aaaatataaatgca

SEQ ID NO: 2815161 - DNA, 20 bp, Homo sapiens
aaaatataaatgcatgattt

SEQ ID NO: 2815162 - DNA, 13 bp, Homo sapiens
aaaatatatataa

SEQ ID NO: 2815163 - DNA, 21 bp, Homo sapiens
aaaatatatataaatatatat

SEQ ID NO: 2815164 - DNA, 23 bp, Homo sapiens
aaaatatatataaatatatattt

SEQ ID NO: 2815165 - DNA, 13 bp, Homo sapiens
aaaatatatatct

SEQ ID NO: 2815166 - DNA, 15 bp, Homo sapiens
aaaatattcctgcat

SEQ ID NO: 2815167 - DNA, 14 bp, Homo sapiens
aaaatattctccat

SEQ ID NO: 2815168 - DNA, 12 bp, Homo sapiens
aaaatattttct

SEQ ID NO: 2815169 - DNA, 16 bp, Homo sapiens
aaaatattttctgaat

SEQ ID NO: 2815170 - DNA, 20 bp, Homo sapiens
aaaatcacaagcaataatta

SEQ ID NO: 2815171 - DNA, 21 bp, Homo sapiens
aaaatcaggtggcttttgcgg

SEQ ID NO: 2815172 - DNA, 22 bp, Homo sapiens
aaaatcataaactgtgtgcaga

SEQ ID NO: 2815173 - DNA, 19 bp, Homo sapiens
aaaatcattcaatatctga

SEQ ID NO: 2815174 - DNA, 17 bp, Homo sapiens
aaaatccctatttaatt

SEQ ID NO: 2815175 - DNA, 21 bp, Homo sapiens
aaaatgactaaaaatattata

SEQ ID NO: 2815176 - DNA, 17 bp, Homo sapiens
aaaatgagcctgtaatc

SEQ ID NO: 2815177 - DNA, 23 bp, Homo sapiens
aaaatgagtttttatggggctga

SEQ ID NO: 2815178 - DNA, 19 bp, Homo sapiens
aaaatgatgtatgatttgt

SEQ ID NO: 2815179 - DNA, 17 bp, Homo sapiens
aaaatgcagtccagaat

SEQ ID NO: 2815180 - DNA, 14 bp, Homo sapiens
aaaatgcttttaat

SEQ ID NO: 2815181 - DNA, 22 bp, Homo sapiens
aaaatggtggtttgtcatatat

SEQ ID NO: 2815182 - DNA, 12 bp, Homo sapiens
aaaatgtacact

SEQ ID NO: 2815183 - DNA, 19 bp, Homo sapiens
aaaattacactacaagttt

SEQ ID NO: 2815184 - DNA, 23 bp, Homo sapiens
aaaattagtgagatttgtattta

SEQ ID NO: 2815185 - DNA, 18 bp, Homo sapiens
aaaattatggtgaaatta

SEQ ID NO: 2815186 - DNA, 20 bp, Homo sapiens
aaaattctgtaggttctgtg

SEQ ID NO: 2815187 - DNA, 12 bp, Homo sapiens
aaaattgaatgc

SEQ ID NO: 2815188 - DNA, 13 bp, Homo sapiens
aaaattgcacaat

SEQ ID NO: 2815189 - DNA, 17 bp, Homo sapiens
aaaattgcacaatttga

SEQ ID NO: 2815190 - DNA, 13 bp, Homo sapiens
aaaattgtgttta

SEQ ID NO: 2815191 - DNA, 19 bp, Homo sapiens
aaaattgtgtttagatttt

SEQ ID NO: 2815192 - DNA, 17 bp, Homo sapiens
aaaatttccagtacctt

SEQ ID NO: 2815193 - DNA, 23 bp, Homo sapiens
aaaatttccagtacctttgtcac

SEQ ID NO: 2815194 - DNA, 14 bp, Homo sapiens
aaaattttatagct

SEQ ID NO: 2815195 - DNA, 19 bp, Homo sapiens
aaaattttcaaactttgta

SEQ ID NO: 2815196 - DNA, 12 bp, Homo sapiens
aaacaaaaccag

SEQ ID NO: 2815197 - DNA, 17 bp, Homo sapiens
aaacaaaaccagctgct

SEQ ID NO: 2815198 - DNA, 18 bp, Homo sapiens
aaacaaagagttcaagaa

SEQ ID NO: 2815199 - DNA, 12 bp, Homo sapiens
aaacaagaaaga

SEQ ID NO: 2815200 - DNA, 16 bp, Homo sapiens
aaacaaggttttcagt

SEQ ID NO: 2815201 - DNA, 13 bp, Homo sapiens
aaacaagtatttg

SEQ ID NO: 2815202 - DNA, 19 bp, Homo sapiens
aaacacacaggccatttca

SEQ ID NO: 2815203 - DNA, 11 bp, Homo sapiens
aaacacagctt

SEQ ID NO: 2815204 - DNA, 18 bp, Homo sapiens
acctgtctgtctgtctgt

SEQ ID NO: 2815205 - DNA, 14 bp, Homo sapiens
acctgtggggcccc

SEQ ID NO: 2815206 - DNA, 12 bp, Homo sapiens
acctgtgtctta

SEQ ID NO: 2815207 - DNA, 17 bp, Homo sapiens
acctgtgtttcttgcct

SEQ ID NO: 2815208 - DNA, 19 bp, Homo sapiens
acctgtgtttcttgcctca

SEQ ID NO: 2815209 - DNA, 15 bp, Homo sapiens
acctgttcaggagct

SEQ ID NO: 2815210 - DNA, 16 bp, Homo sapiens
acctgttcaggagctg

SEQ ID NO: 2815211 - DNA, 16 bp, Homo sapiens
actaaatgagctcctg

SEQ ID NO: 2815212 - DNA, 18 bp, Homo sapiens
actaacactcagaagcct

SEQ ID NO: 2815213 - DNA, 16 bp, Homo sapiens
actaagccctgtcgag

SEQ ID NO: 2815214 - DNA, 22 bp, Homo sapiens
actaagccctgtcgagacactt

SEQ ID NO: 2815215 - DNA, 22 bp, Homo sapiens
actaataaaagcataaatgcaa

SEQ ID NO: 2815216 - DNA, 18 bp, Homo sapiens
actaatggggcggtgaga

SEQ ID NO: 2815217 - DNA, 12 bp, Homo sapiens
actaatttaaac

SEQ ID NO: 2815218 - DNA, 15 bp, Homo sapiens
actaatttaaaccag

SEQ ID NO: 2815219 - DNA, 17 bp, Homo sapiens
actaatttaaaccagca

SEQ ID NO: 2815220 - DNA, 22 bp, Homo sapiens
actaatttaaaccagcagaaaa

SEQ ID NO: 2815221 - DNA, 23 bp, Homo sapiens
actaatttaaaccagcagaaaag

SEQ ID NO: 2815222 - DNA, 20 bp, Homo sapiens
actacactccagcctgagca

SEQ ID NO: 2815223 - DNA, 14 bp, Homo sapiens
actacatgcacttg

SEQ ID NO: 2815224 - DNA, 15 bp, Homo sapiens
actacgttaagggaa

SEQ ID NO: 2815225 - DNA, 21 bp, Homo sapiens
actactgctgcaaagtgcaaa

SEQ ID NO: 2815226 - DNA, 21 bp, Homo sapiens
actactgtggaaaaatattta

SEQ ID NO: 2815227 - DNA, 16 bp, Homo sapiens
actacttgttaccttt

SEQ ID NO: 2815228 - DNA, 14 bp, Homo sapiens
actactttttatac

SEQ ID NO: 2815229 - DNA, 15 bp, Homo sapiens
actactttttatact

SEQ ID NO: 2815230 - DNA, 17 bp, Homo sapiens
actactttttatactcc

SEQ ID NO: 2815231 - DNA, 16 bp, Homo sapiens
actagaaagctctgca

SEQ ID NO: 2815232 - DNA, 18 bp, Homo sapiens
actagaatttgtattttg

SEQ ID NO: 2815233 - DNA, 22 bp, Homo sapiens
actagatctcctatttttcaga

SEQ ID NO: 2815234 - DNA, 17 bp, Homo sapiens
actagatctcctgtaat

SEQ ID NO: 2815235 - DNA, 19 bp, Homo sapiens
actagttgaacatctcact

SEQ ID NO: 2815236 - DNA, 17 bp, Homo sapiens
actagttttgtgccagc

SEQ ID NO: 2815237 - DNA, 15 bp, Homo sapiens
actatctttctgata

SEQ ID NO: 2815238 - DNA, 23 bp, Homo sapiens
actatctttctgataacagaatt

SEQ ID NO: 2815239 - DNA, 20 bp, Homo sapiens
actatgaaaagctagaattg

SEQ ID NO: 2815240 - DNA, 17 bp, Homo sapiens
actatgatctcaggagc

SEQ ID NO: 2815241 - DNA, 16 bp, Homo sapiens
actatggctgtatttt

SEQ ID NO: 2815242 - DNA, 22 bp, Homo sapiens
actatggctgtatttttagaga

SEQ ID NO: 2815243 - DNA, 15 bp, Homo sapiens
actatggtatttgag

SEQ ID NO: 2815244 - DNA, 22 bp, Homo sapiens
actatggttcccaataaaagtg

SEQ ID NO: 2815245 - DNA, 14 bp, Homo sapiens
actatgttgcccag

SEQ ID NO: 2815246 - DNA, 18 bp, Homo sapiens
actatgttgcccaggcag

SEQ ID NO: 2815247 - DNA, 20 bp, Homo sapiens
actatgttgcccaggcaggt

SEQ ID NO: 2815248 - DNA, 14 bp, Homo sapiens
actattcctaggag

SEQ ID NO: 2815249 - DNA, 21 bp, Homo sapiens
actattctgttaaaatcagga

SEQ ID NO: 2815250 - DNA, 13 bp, Homo sapiens
actattggagggt

SEQ ID NO: 2815251 - DNA, 13 bp, Homo sapiens
actattttacttc

SEQ ID NO: 2815252 - DNA, 20 bp, Homo sapiens
actcaaaatatttgtacata

SEQ ID NO: 2815253 - DNA, 18 bp, Homo sapiens
actcaagaggctgaggca

SEQ ID NO: 2815254 - DNA, 21 bp, Homo sapiens
actcaatattttccatgaaaa

SEQ ID NO: 2815255 - DNA, 23 bp, Homo sapiens
actcaatattttccatgaaaatg

SEQ ID NO: 2815256 - DNA, 16 bp, Homo sapiens
actcacaagaagacca

SEQ ID NO: 2815257 - DNA, 18 bp, Homo sapiens
actcacaagaagaccaga

SEQ ID NO: 2815258 - DNA, 19 bp, Homo sapiens
actcacatgccgcccccag

SEQ ID NO: 2815259 - DNA, 12 bp, Homo sapiens
actcacccaagc

SEQ ID NO: 2815260 - DNA, 13 bp, Homo sapiens
actcacctctgcc

SEQ ID NO: 2815261 - DNA, 16 bp, Homo sapiens
actcacctctgcctca

SEQ ID NO: 2815262 - DNA, 17 bp, Homo sapiens
actcacctctgcctcaa

SEQ ID NO: 2815263 - DNA, 13 bp, Homo sapiens
actcacttcaatg

SEQ ID NO: 2815264 - DNA, 14 bp, Homo sapiens
actcagaagacact

SEQ ID NO: 2815265 - DNA, 17 bp, Homo sapiens
actcagaagacactgat

SEQ ID NO: 2815266 - DNA, 14 bp, Homo sapiens
actcagaagcctga

SEQ ID NO: 2815267 - DNA, 15 bp, Homo sapiens
actcagaagcctgag

SEQ ID NO: 2815268 - DNA, 18 bp, Homo sapiens
actcagaagcctgaggct

SEQ ID NO: 2815269 - DNA, 15 bp, Homo sapiens
actcagaagcctggg

SEQ ID NO: 2815270 - DNA, 12 bp, Homo sapiens
actcagccctgg

SEQ ID NO: 2815271 - DNA, 13 bp, Homo sapiens
actcagccctggg

SEQ ID NO: 2815272 - DNA, 14 bp, Homo sapiens
actcagctccagaa

SEQ ID NO: 2815273 - DNA, 11 bp, Homo sapiens
actcagctctg

SEQ ID NO: 2815274 - DNA, 19 bp, Homo sapiens
actcagctctgacattctg

SEQ ID NO: 2815275 - DNA, 18 bp, Homo sapiens
actcagctgtctgtggct

SEQ ID NO: 2815276 - DNA, 13 bp, Homo sapiens
actcaggaggctg

SEQ ID NO: 2815277 - DNA, 14 bp, Homo sapiens
actcaggaggctga

SEQ ID NO: 2815278 - DNA, 18 bp, Homo sapiens
actcaggaggctgaggca

SEQ ID NO: 2815279 - DNA, 23 bp, Homo sapiens
actcaggcccccacctggctcac

SEQ ID NO: 2815280 - DNA, 22 bp, Homo sapiens
actcagggccccagcactaaag

SEQ ID NO: 2815281 - DNA, 16 bp, Homo sapiens
actcagtcccccacca

SEQ ID NO: 2815282 - DNA, 13 bp, Homo sapiens
actcagtttgtca

SEQ ID NO: 2815283 - DNA, 14 bp, Homo sapiens
actcagtttgtcag

SEQ ID NO: 2815284 - DNA, 19 bp, Homo sapiens
actcagtttgtcagacttt

SEQ ID NO: 2815285 - DNA, 13 bp, Homo sapiens
actcagttttctt

SEQ ID NO: 2815286 - DNA, 20 bp, Homo sapiens
actcataagttggaccagag

SEQ ID NO: 2815287 - DNA, 20 bp, Homo sapiens
actcatattctgggctcctg

SEQ ID NO: 2815288 - DNA, 13 bp, Homo sapiens
actcatcataaaa

SEQ ID NO: 2815289 - DNA, 17 bp, Homo sapiens
actcatcataaaataaa

SEQ ID NO: 2815290 - DNA, 13 bp, Homo sapiens
actcattagactg

SEQ ID NO: 2815291 - DNA, 21 bp, Homo sapiens
actcattagactggaacttga

SEQ ID NO: 2815292 - DNA, 14 bp, Homo sapiens
actcatttcatctc

SEQ ID NO: 2815293 - DNA, 13 bp, Homo sapiens
actccaagcttca

SEQ ID NO: 2815294 - DNA, 14 bp, Homo sapiens
actccaagcttcaa

SEQ ID NO: 2815295 - DNA, 13 bp, Homo sapiens
actccacagcgga

SEQ ID NO: 2815296 - DNA, 20 bp, Homo sapiens
actccacagcggaggagacc

SEQ ID NO: 2815297 - DNA, 14 bp, Homo sapiens
actccaccacccaa

SEQ ID NO: 2815298 - DNA, 14 bp, Homo sapiens
actccagccagcgc

SEQ ID NO: 2815299 - DNA, 15 bp, Homo sapiens
actccagccagcgcc

SEQ ID NO: 2815300 - DNA, 18 bp, Homo sapiens
actccagccagcgcctcc

SEQ ID NO: 2815301 - DNA, 11 bp, Homo sapiens
acatttccctc

SEQ ID NO: 2815302 - DNA, 18 bp, Homo sapiens
acatttgagtatccgatt

SEQ ID NO: 2815303 - DNA, 13 bp, Homo sapiens
acatttgatgtac

SEQ ID NO: 2815304 - DNA, 16 bp, Homo sapiens
acatttgatgtacatg

SEQ ID NO: 2815305 - DNA, 17 bp, Homo sapiens
acatttgatgtacatgt

SEQ ID NO: 2815306 - DNA, 19 bp, Homo sapiens
acatttgatgtacatgtgt

SEQ ID NO: 2815307 - DNA, 15 bp, Homo sapiens
acatttgtacattcc

SEQ ID NO: 2815308 - DNA, 19 bp, Homo sapiens
acatttgtacattcctgat

SEQ ID NO: 2815309 - DNA, 17 bp, Homo sapiens
accaaaaaagtattttt

SEQ ID NO: 2815310 - DNA, 15 bp, Homo sapiens
accaaaagaacaaga

SEQ ID NO: 2815311 - DNA, 14 bp, Homo sapiens
accaaaagaagtaa

SEQ ID NO: 2815312 - DNA, 21 bp, Homo sapiens
accaaaagaagtaaaagcaaa

SEQ ID NO: 2815313 - DNA, 12 bp, Homo sapiens
accaaatataaa

SEQ ID NO: 2815314 - DNA, 17 bp, Homo sapiens
accaaatataaacttgt

SEQ ID NO: 2815315 - DNA, 21 bp, Homo sapiens
accaaatataaacttgtgtat

SEQ ID NO: 2815316 - DNA, 21 bp, Homo sapiens
accaaatgagcattagctact

SEQ ID NO: 2815317 - DNA, 16 bp, Homo sapiens
accaacatggagaaac

SEQ ID NO: 2815318 - DNA, 23 bp, Homo sapiens
accaacatggagaaaccctgtct

SEQ ID NO: 2815319 - DNA, 16 bp, Homo sapiens
accaaccctgtttcct

SEQ ID NO: 2815320 - DNA, 19 bp, Homo sapiens
accaaccctgtttcctgag

SEQ ID NO: 2815321 - DNA, 16 bp, Homo sapiens
accaagatgatcacat

SEQ ID NO: 2815322 - DNA, 12 bp, Homo sapiens
accaagcccagt

SEQ ID NO: 2815323 - DNA, 18 bp, Homo sapiens
accaagctcacagttcct

SEQ ID NO: 2815324 - DNA, 15 bp, Homo sapiens
accaaggtcttcagc

SEQ ID NO: 2815325 - DNA, 16 bp, Homo sapiens
accaataacttcagag

SEQ ID NO: 2815326 - DNA, 19 bp, Homo sapiens
accaataacttcagagaag

SEQ ID NO: 2815327 - DNA, 20 bp, Homo sapiens
accaataacttcagagaagt

SEQ ID NO: 2815328 - DNA, 16 bp, Homo sapiens
accaatatttgtagaa

SEQ ID NO: 2815329 - DNA, 20 bp, Homo sapiens
accaatcattttaattatta

SEQ ID NO: 2815330 - DNA, 14 bp, Homo sapiens
accaatctctgtga

SEQ ID NO: 2815331 - DNA, 12 bp, Homo sapiens
accaatgattca

SEQ ID NO: 2815332 - DNA, 21 bp, Homo sapiens
accaatgtacccaccgggcca

SEQ ID NO: 2815333 - DNA, 16 bp, Homo sapiens
accacaaccaggaaga

SEQ ID NO: 2815334 - DNA, 15 bp, Homo sapiens
accacacccagccca

SEQ ID NO: 2815335 - DNA, 20 bp, Homo sapiens
accacacccagcccacttct

SEQ ID NO: 2815336 - DNA, 16 bp, Homo sapiens
accacaccgcagaagc

SEQ ID NO: 2815337 - DNA, 11 bp, Homo sapiens
accacactgaa

SEQ ID NO: 2815338 - DNA, 18 bp, Homo sapiens
accacactgaatctcccc

SEQ ID NO: 2815339 - DNA, 16 bp, Homo sapiens
accacagcagctgaac

SEQ ID NO: 2815340 - DNA, 23 bp, Homo sapiens
accacaggctgcctcatgaccct

SEQ ID NO: 2815341 - DNA, 11 bp, Homo sapiens
accacagtgtc

SEQ ID NO: 2815342 - DNA, 14 bp, Homo sapiens
accacatcttgctc

SEQ ID NO: 2815343 - DNA, 20 bp, Homo sapiens
accacatcttgctctgctga

SEQ ID NO: 2815344 - DNA, 13 bp, Homo sapiens
accaccaaatgac

SEQ ID NO: 2815345 - DNA, 20 bp, Homo sapiens
accaccacacccagcccact

SEQ ID NO: 2815346 - DNA, 17 bp, Homo sapiens
accaccctcccaccatg

SEQ ID NO: 2815347 - DNA, 16 bp, Homo sapiens
accacctaggccactc

SEQ ID NO: 2815348 - DNA, 13 bp, Homo sapiens
accaccttcccag

SEQ ID NO: 2815349 - DNA, 16 bp, Homo sapiens
accaccttcccagctc

SEQ ID NO: 2815350 - DNA, 17 bp, Homo sapiens
accaccttcccagctct

SEQ ID NO: 2815351 - DNA, 19 bp, Homo sapiens
accaccttcccagctctcc

SEQ ID NO: 2815352 - DNA, 20 bp, Homo sapiens
accaccttcccagctctccc

SEQ ID NO: 2815353 - DNA, 21 bp, Homo sapiens
accaccttcccagctctccct

SEQ ID NO: 2815354 - DNA, 22 bp, Homo sapiens
accaccttcccagctctccctc

SEQ ID NO: 2815355 - DNA, 21 bp, Homo sapiens
accaccttggactcctcccac

SEQ ID NO: 2815356 - DNA, 17 bp, Homo sapiens
accacgatgtggccctg

SEQ ID NO: 2815357 - DNA, 18 bp, Homo sapiens
accacgatgtggccctgg

SEQ ID NO: 2815358 - DNA, 14 bp, Homo sapiens
accacgctggacct

SEQ ID NO: 2815359 - DNA, 16 bp, Homo sapiens
accacgctggaccttg

SEQ ID NO: 2815360 - DNA, 18 bp, Homo sapiens
accacgctggaccttgaa

SEQ ID NO: 2815361 - DNA, 18 bp, Homo sapiens
accacggaaaagagcgca

SEQ ID NO: 2815362 - DNA, 20 bp, Homo sapiens
accacggacgtttccatcag

SEQ ID NO: 2815363 - DNA, 13 bp, Homo sapiens
accactagaactc

SEQ ID NO: 2815364 - DNA, 20 bp, Homo sapiens
accactcaaattaatctttc

SEQ ID NO: 2815365 - DNA, 12 bp, Homo sapiens
accactctggca

SEQ ID NO: 2815366 - DNA, 13 bp, Homo sapiens
accactctggcag

SEQ ID NO: 2815367 - DNA, 16 bp, Homo sapiens
accactctggcagcca

SEQ ID NO: 2815368 - DNA, 18 bp, Homo sapiens
accactctggcagccaca

SEQ ID NO: 2815369 - DNA, 20 bp, Homo sapiens
accactgtaaaatgaaatta

SEQ ID NO: 2815370 - DNA, 12 bp, Homo sapiens
accactgtggcg

SEQ ID NO: 2815371 - DNA, 21 bp, Homo sapiens
accactgtggcgttctgctgc

SEQ ID NO: 2815372 - DNA, 22 bp, Homo sapiens
accactgtggcgttctgctgcc

SEQ ID NO: 2815373 - DNA, 16 bp, Homo sapiens
accactgtgtatttaa

SEQ ID NO: 2815374 - DNA, 16 bp, Homo sapiens
accacttcttttataa

SEQ ID NO: 2815375 - DNA, 17 bp, Homo sapiens
accacttcttttataac

SEQ ID NO: 2815376 - DNA, 16 bp, Homo sapiens
accagaatcataattt

SEQ ID NO: 2815377 - DNA, 19 bp, Homo sapiens
accagaatcataattttca

SEQ ID NO: 2815378 - DNA, 23 bp, Homo sapiens
accagaatcataattttcaagag

SEQ ID NO: 2815379 - DNA, 14 bp, Homo sapiens
accagacaccttga

SEQ ID NO: 2815380 - DNA, 23 bp, Homo sapiens
accagacaccttgacagggcaca

SEQ ID NO: 2815381 - DNA, 21 bp, Homo sapiens
accagactgtggagaaataaa

SEQ ID NO: 2815382 - DNA, 16 bp, Homo sapiens
accagagccccccaca

SEQ ID NO: 2815383 - DNA, 13 bp, Homo sapiens
accagaggaagcc

SEQ ID NO: 2815384 - DNA, 14 bp, Homo sapiens
accagaggctgcag

SEQ ID NO: 2815385 - DNA, 19 bp, Homo sapiens
accagaggctgcagaaggc

SEQ ID NO: 2815386 - DNA, 21 bp, Homo sapiens
accagaggctgcagaaggcca

SEQ ID NO: 2815387 - DNA, 15 bp, Homo sapiens
accagcagaaaagtg

SEQ ID NO: 2815388 - DNA, 18 bp, Homo sapiens
accagcatgtcactccca

SEQ ID NO: 2815389 - DNA, 16 bp, Homo sapiens
accagccacacagagc

SEQ ID NO: 2815390 - DNA, 22 bp, Homo sapiens
accagccacacagagcctgcct

SEQ ID NO: 2815391 - DNA, 20 bp, Homo sapiens
accagccatcatgtgcctgg

SEQ ID NO: 2815392 - DNA, 18 bp, Homo sapiens
acaaatatttattttctt

SEQ ID NO: 2815393 - DNA, 22 bp, Homo sapiens
acaaatatttattttctttctg

SEQ ID NO: 2815394 - DNA, 15 bp, Homo sapiens
acaacaacctggtca

SEQ ID NO: 2815395 - DNA, 14 bp, Homo sapiens
acaacacacacact

SEQ ID NO: 2815396 - DNA, 12 bp, Homo sapiens
acaacactcaca

SEQ ID NO: 2815397 - DNA, 17 bp, Homo sapiens
acaacaggttttcacca

SEQ ID NO: 2815398 - DNA, 18 bp, Homo sapiens
acaacaggttttcaccat

SEQ ID NO: 2815399 - DNA, 14 bp, Homo sapiens
acaacatgtataat

SEQ ID NO: 2815400 - DNA, 12 bp, Homo sapiens
acaaccagagcc

SEQ ID NO: 2815401 - DNA, 14 bp, Homo sapiens
acaaccagagcccc

SEQ ID NO: 2815402 - DNA, 19 bp, Homo sapiens
acaaccagccacacagagc

SEQ ID NO: 2815403 - DNA, 20 bp, Homo sapiens
acaactccaggaaaactgtt

SEQ ID NO: 2815404 - DNA, 21 bp, Homo sapiens
acaactccaggaaaactgttt

SEQ ID NO: 2815405 - DNA, 18 bp, Homo sapiens
acaactcttccatttatt

SEQ ID NO: 2815406 - DNA, 18 bp, Homo sapiens
acaactgtttttgaagaa

SEQ ID NO: 2815407 - DNA, 19 bp, Homo sapiens
acaactgtttttgaagaag

SEQ ID NO: 2815408 - DNA, 18 bp, Homo sapiens
acaagaagcattttgtaa

SEQ ID NO: 2815409 - DNA, 23 bp, Homo sapiens
acaagaagggttttccaccctgg

SEQ ID NO: 2815410 - DNA, 19 bp, Homo sapiens
acaagagccatgtaccagt

SEQ ID NO: 2815411 - DNA, 16 bp, Homo sapiens
acaagagcgaaactcc

SEQ ID NO: 2815412 - DNA, 17 bp, Homo sapiens
acaagagcgaaactccg

SEQ ID NO: 2815413 - DNA, 20 bp, Homo sapiens
acaagatctttcaggaaaga

SEQ ID NO: 2815414 - DNA, 18 bp, Homo sapiens
acaagattcccagagaca

SEQ ID NO: 2815415 - DNA, 14 bp, Homo sapiens
acaagcaataatta

SEQ ID NO: 2815416 - DNA, 21 bp, Homo sapiens
acaagcaataattaggatcta

SEQ ID NO: 2815417 - DNA, 19 bp, Homo sapiens
acaagcacaaagctcaaga

SEQ ID NO: 2815418 - DNA, 23 bp, Homo sapiens
acaagcatggtcccacatccctg

SEQ ID NO: 2815419 - DNA, 21 bp, Homo sapiens
acaagccaacttgtaaataca

SEQ ID NO: 2815420 - DNA, 17 bp, Homo sapiens
acaagcgtgagccactg

SEQ ID NO: 2815421 - DNA, 16 bp, Homo sapiens
acaagctggaagcaca

SEQ ID NO: 2815422 - DNA, 18 bp, Homo sapiens
acaagcttgtatatacat

SEQ ID NO: 2815423 - DNA, 22 bp, Homo sapiens
acaaggctgaccaagagagaaa

SEQ ID NO: 2815424 - DNA, 14 bp, Homo sapiens
acaaggtagttttt

SEQ ID NO: 2815425 - DNA, 17 bp, Homo sapiens
acaagtatttgttaatt

SEQ ID NO: 2815426 - DNA, 21 bp, Homo sapiens
acaagtcattttaactttatc

SEQ ID NO: 2815427 - DNA, 14 bp, Homo sapiens
acaataaaacattc

SEQ ID NO: 2815428 - DNA, 15 bp, Homo sapiens
acaataaatgtgctt

SEQ ID NO: 2815429 - DNA, 12 bp, Homo sapiens
acaataatttca

SEQ ID NO: 2815430 - DNA, 18 bp, Homo sapiens
acataagccattattcac

SEQ ID NO: 2815431 - DNA, 15 bp, Homo sapiens
acataatatcttgaa

SEQ ID NO: 2815432 - DNA, 17 bp, Homo sapiens
acataatatcttgaaga

SEQ ID NO: 2815433 - DNA, 19 bp, Homo sapiens
acataatatcttgaagaat

SEQ ID NO: 2815434 - DNA, 16 bp, Homo sapiens
acataatcaaagctac

SEQ ID NO: 2815435 - DNA, 23 bp, Homo sapiens
acataattatccaggaagggaat

SEQ ID NO: 2815436 - DNA, 13 bp, Homo sapiens
acatacaatttgc

SEQ ID NO: 2815437 - DNA, 14 bp, Homo sapiens
acatacaatttgca

SEQ ID NO: 2815438 - DNA, 17 bp, Homo sapiens
acatacaatttgcactg

SEQ ID NO: 2815439 - DNA, 14 bp, Homo sapiens
acataccctccccc

SEQ ID NO: 2815440 - DNA, 12 bp, Homo sapiens
acatagaaagtt

SEQ ID NO: 2815441 - DNA, 21 bp, Homo sapiens
acatagaaattgcctgacgaa

SEQ ID NO: 2815442 - DNA, 16 bp, Homo sapiens
acatagacagaagaaa

SEQ ID NO: 2815443 - DNA, 18 bp, Homo sapiens
acatagacagaagaaaca

SEQ ID NO: 2815444 - DNA, 17 bp, Homo sapiens
acataggcaaattggaa

SEQ ID NO: 2815445 - DNA, 18 bp, Homo sapiens
acataggcaaattggaaa

SEQ ID NO: 2815446 - DNA, 14 bp, Homo sapiens
acatataaaagtta

SEQ ID NO: 2815447 - DNA, 23 bp, Homo sapiens
acatataatgttgttatttaaag

SEQ ID NO: 2815448 - DNA, 16 bp, Homo sapiens
acatataggagcaata

SEQ ID NO: 2815449 - DNA, 11 bp, Homo sapiens
aattgcacaat

SEQ ID NO: 2815450 - DNA, 15 bp, Homo sapiens
aattgcacaatttga

SEQ ID NO: 2815451 - DNA, 22 bp, Homo sapiens
aattgcatgccatctccaccct

SEQ ID NO: 2815452 - DNA, 12 bp, Homo sapiens
aattgctccttg

SEQ ID NO: 2815453 - DNA, 16 bp, Homo sapiens
aattgctgctctctga

SEQ ID NO: 2815454 - DNA, 22 bp, Homo sapiens
aattgggattttaaaaacatga

SEQ ID NO: 2815455 - DNA, 24 bp, Homo sapiens
aattgtatcatttgaacaactagg

SEQ ID NO: 2815456 - DNA, 12 bp, Homo sapiens
aattgtgtacaa

SEQ ID NO: 2815457 - DNA, 13 bp, Homo sapiens
aattgtgtacaaa

SEQ ID NO: 2815458 - DNA, 13 bp, Homo sapiens
aattgtgtttaga

SEQ ID NO: 2815459 - DNA, 22 bp, Homo sapiens
aattgttttatctgaattttta

SEQ ID NO: 2815460 - DNA, 22 bp, Homo sapiens
aatttaaaccagcagaaaagtg

SEQ ID NO: 2815461 - DNA, 22 bp, Homo sapiens
aatttaaactataagcaagaag

SEQ ID NO: 2815462 - DNA, 22 bp, Homo sapiens
aatttaaagttgtttgtgcctt

SEQ ID NO: 2815463 - DNA, 16 bp, Homo sapiens
aatttaactaatttaa

SEQ ID NO: 2815464 - DNA, 19 bp, Homo sapiens
aatttaactaatttaaacc

SEQ ID NO: 2815465 - DNA, 20 bp, Homo sapiens
aatttaactaatttaaacca

SEQ ID NO: 2815466 - DNA, 14 bp, Homo sapiens
aatttaatatagct

SEQ ID NO: 2815467 - DNA, 14 bp, Homo sapiens
aatttaatgcatgt

SEQ ID NO: 2815468 - DNA, 17 bp, Homo sapiens
aatttaattaatcgaaa

SEQ ID NO: 2815469 - DNA, 23 bp, Homo sapiens
aatttaattaatcgaaatgaatt

SEQ ID NO: 2815470 - DNA, 14 bp, Homo sapiens
aatttagaaatcat

SEQ ID NO: 2815471 - DNA, 12 bp, Homo sapiens
aatttatacaaa

SEQ ID NO: 2815472 - DNA, 23 bp, Homo sapiens
aatttatcctgaaatttcagatt

SEQ ID NO: 2815473 - DNA, 13 bp, Homo sapiens
aatttatctgaat

SEQ ID NO: 2815474 - DNA, 14 bp, Homo sapiens
aatttatctgaata

SEQ ID NO: 2815475 - DNA, 18 bp, Homo sapiens
aatttatcttgtctctgg

SEQ ID NO: 2815476 - DNA, 21 bp, Homo sapiens
aatttattcaattcctctggg

SEQ ID NO: 2815477 - DNA, 16 bp, Homo sapiens
aatttattgcttgata

SEQ ID NO: 2815478 - DNA, 13 bp, Homo sapiens
aatttattttctt

SEQ ID NO: 2815479 - DNA, 14 bp, Homo sapiens
aatttcacattaat

SEQ ID NO: 2815480 - DNA, 15 bp, Homo sapiens
aatttccagtacctt

SEQ ID NO: 2815481 - DNA, 20 bp, Homo sapiens
aatttccagtacctttgtca

SEQ ID NO: 2815482 - DNA, 21 bp, Homo sapiens
aatttcttactaaacattttg

SEQ ID NO: 2815483 - DNA, 19 bp, Homo sapiens
aatttgaaaataattgttc

SEQ ID NO: 2815484 - DNA, 19 bp, Homo sapiens
aatttgagcaattcatttc

SEQ ID NO: 2815485 - DNA, 20 bp, Homo sapiens
aatttgatacatatgtgaat

SEQ ID NO: 2815486 - DNA, 22 bp, Homo sapiens
aatttggatttacgactgaaga

SEQ ID NO: 2815487 - DNA, 18 bp, Homo sapiens
aatttgggggacttacat

SEQ ID NO: 2815488 - DNA, 23 bp, Homo sapiens
aatttggtgtggctgtattcaga

SEQ ID NO: 2815489 - DNA, 16 bp, Homo sapiens
aatatattataatctt

SEQ ID NO: 2815490 - DNA, 16 bp, Homo sapiens
aatatatttaattgtg

SEQ ID NO: 2815491 - DNA, 14 bp, Homo sapiens
aatatattttatga

SEQ ID NO: 2815492 - DNA, 19 bp, Homo sapiens
aatatcagttactcagccc

SEQ ID NO: 2815493 - DNA, 21 bp, Homo sapiens
aatatcagttactcagccctg

SEQ ID NO: 2815494 - DNA, 17 bp, Homo sapiens
aatatcctaaacatcat

SEQ ID NO: 2815495 - DNA, 14 bp, Homo sapiens
aatatgaaatgata

SEQ ID NO: 2815496 - DNA, 16 bp, Homo sapiens
aatatgaaatgataaa

SEQ ID NO: 2815497 - DNA, 11 bp, Homo sapiens
aatatgaacaa

SEQ ID NO: 2815498 - DNA, 16 bp, Homo sapiens
aatatgacagctgtcc

SEQ ID NO: 2815499 - DNA, 17 bp, Homo sapiens
aatatgatattgcatat

SEQ ID NO: 2815500 - DNA, 19 bp, Homo sapiens
aatatgctgccaaattttg

SEQ ID NO: 2815501 - DNA, 22 bp, Homo sapiens
aatatgttaacctcagtgtcat

SEQ ID NO: 2815502 - DNA, 14 bp, Homo sapiens
aatattaaatacag

SEQ ID NO: 2815503 - DNA, 16 bp, Homo sapiens
aatattaaatacagac

SEQ ID NO: 2815504 - DNA, 20 bp, Homo sapiens
aatattaaatacagacacta

SEQ ID NO: 2815505 - DNA, 22 bp, Homo sapiens
aatattaaatacagacactaag

SEQ ID NO: 2815506 - DNA, 22 bp, Homo sapiens
aatattaccaaaaaagtatttt

SEQ ID NO: 2815507 - DNA, 14 bp, Homo sapiens
aatattcaataaag

SEQ ID NO: 2815508 - DNA, 16 bp, Homo sapiens
aatattcaataaagct

SEQ ID NO: 2815509 - DNA, 15 bp, Homo sapiens
aatattcctgcattt

SEQ ID NO: 2815510 - DNA, 22 bp, Homo sapiens
aatattgaataagtattcttca

SEQ ID NO: 2815511 - DNA, 12 bp, Homo sapiens
aatattgttaaa

SEQ ID NO: 2815512 - DNA, 22 bp, Homo sapiens
aatattgttaaaaccttactta

SEQ ID NO: 2815513 - DNA, 20 bp, Homo sapiens
aatatttaaaatttattgct

SEQ ID NO: 2815514 - DNA, 17 bp, Homo sapiens
aatatttaagatagttt

SEQ ID NO: 2815515 - DNA, 16 bp, Homo sapiens
aatatttattacctct

SEQ ID NO: 2815516 - DNA, 19 bp, Homo sapiens
aatatttattattttcacc

SEQ ID NO: 2815517 - DNA, 12 bp, Homo sapiens
aatatttgctga

SEQ ID NO: 2815518 - DNA, 15 bp, Homo sapiens
aatatttgcttattt

SEQ ID NO: 2815519 - DNA, 12 bp, Homo sapiens
aatatttgtaca

SEQ ID NO: 2815520 - DNA, 11 bp, Homo sapiens
aatattttaaa

SEQ ID NO: 2815521 - DNA, 13 bp, Homo sapiens
aatattttaaaga

SEQ ID NO: 2815522 - DNA, 16 bp, Homo sapiens
aatattttaaagaatt

SEQ ID NO: 2815523 - DNA, 21 bp, Homo sapiens
aatattttccatgaaaatgca

SEQ ID NO: 2815524 - DNA, 13 bp, Homo sapiens
aatcaaaagctgc

SEQ ID NO: 2815525 - DNA, 16 bp, Homo sapiens
aatcaaagacatggaa

SEQ ID NO: 2815526 - DNA, 17 bp, Homo sapiens
aatcaatgtcacttaaa

SEQ ID NO: 2815527 - DNA, 23 bp, Homo sapiens
aatcaatgttcacgcaacttgaa

SEQ ID NO: 2815528 - DNA, 15 bp, Homo sapiens
aatcacaagcaataa

SEQ ID NO: 2815529 - DNA, 22 bp, Homo sapiens
aatcacagatgggtattaaact

SEQ ID NO: 2815530 - DNA, 23 bp, Homo sapiens
aatcacagatgggtattaaactt

SEQ ID NO: 2815531 - DNA, 20 bp, Homo sapiens
aatcacgctttttgaaaaag

SEQ ID NO: 2815532 - DNA, 21 bp, Homo sapiens
aatcactataaccatcagtta

SEQ ID NO: 2815533 - DNA, 19 bp, Homo sapiens
aatcactgaggcattttta

SEQ ID NO: 2815534 - DNA, 21 bp, Homo sapiens
aatcagaagtgcaaaggtgtg

SEQ ID NO: 2815535 - DNA, 17 bp, Homo sapiens
aatgcaaaatgaaataa

SEQ ID NO: 2815536 - DNA, 20 bp, Homo sapiens
aatgcaaacacacaaaggta

SEQ ID NO: 2815537 - DNA, 16 bp, Homo sapiens
aatgcacaatttagaa

SEQ ID NO: 2815538 - DNA, 15 bp, Homo sapiens
aatgcacctaaagaa

SEQ ID NO: 2815539 - DNA, 16 bp, Homo sapiens
aatgcacctaaagaaa

SEQ ID NO: 2815540 - DNA, 22 bp, Homo sapiens
aatgcagcgaaccaatatttgt

SEQ ID NO: 2815541 - DNA, 19 bp, Homo sapiens
aatgcagtccagaataagt

SEQ ID NO: 2815542 - DNA, 23 bp, Homo sapiens
aatgcagtccagaataagtgctg

SEQ ID NO: 2815543 - DNA, 17 bp, Homo sapiens
aatgcagtgaattgtga

SEQ ID NO: 2815544 - DNA, 22 bp, Homo sapiens
aatgcattataggatcatttgt

SEQ ID NO: 2815545 - DNA, 22 bp, Homo sapiens
aatgccaacatacccttcttta

SEQ ID NO: 2815546 - DNA, 15 bp, Homo sapiens
aatgcctcctccctg

SEQ ID NO: 2815547 - DNA, 15 bp, Homo sapiens
aatgccttttcccaa

SEQ ID NO: 2815548 - DNA, 22 bp, Homo sapiens
aatgctggttttcctaaatgca

SEQ ID NO: 2815549 - DNA, 23 bp, Homo sapiens
aatgctggttttcctaaatgcag

SEQ ID NO: 2815550 - DNA, 17 bp, Homo sapiens
aatgctgtcaactatga

SEQ ID NO: 2815551 - DNA, 19 bp, Homo sapiens
aatgctgttggtgagaatc

SEQ ID NO: 2815552 - DNA, 14 bp, Homo sapiens
aatgcttaatcaga

SEQ ID NO: 2815553 - DNA, 16 bp, Homo sapiens
aatgctttcctccctg

SEQ ID NO: 2815554 - DNA, 14 bp, Homo sapiens
aatggagaagctct

SEQ ID NO: 2815555 - DNA, 13 bp, Homo sapiens
aatggagcttgta

SEQ ID NO: 2815556 - DNA, 20 bp, Homo sapiens
aatggcctgccttgaagcca

SEQ ID NO: 2815557 - DNA, 14 bp, Homo sapiens
aatggctatgtttt

SEQ ID NO: 2815558 - DNA, 20 bp, Homo sapiens
aatggctatgtttttaatgt

SEQ ID NO: 2815559 - DNA, 16 bp, Homo sapiens
aatggctgataatttt

SEQ ID NO: 2815560 - DNA, 19 bp, Homo sapiens
aatggctgataattttaaa

SEQ ID NO: 2815561 - DNA, 20 bp, Homo sapiens
aatgggccaattaaaatata

SEQ ID NO: 2815562 - DNA, 14 bp, Homo sapiens
aatggtccagggtt

SEQ ID NO: 2815563 - DNA, 22 bp, Homo sapiens
aatggtctttctaatgtgtgaa

SEQ ID NO: 2815564 - DNA, 13 bp, Homo sapiens
aatggtgcagaaa

SEQ ID NO: 2815565 - DNA, 23 bp, Homo sapiens
aatggtggtttgtcatatattca

SEQ ID NO: 2815566 - DNA, 17 bp, Homo sapiens
aatggttgactgggttt

SEQ ID NO: 2815567 - DNA, 16 bp, Homo sapiens
aatggtttactgctgt

SEQ ID NO: 2815568 - DNA, 18 bp, Homo sapiens
aatggtttactgctgtca

SEQ ID NO: 2815569 - DNA, 17 bp, Homo sapiens
aatggtttgaatataaa

SEQ ID NO: 2815570 - DNA, 23 bp, Homo sapiens
aatggtttgaatataaacactat

SEQ ID NO: 2815571 - DNA, 17 bp, Homo sapiens
aatggtttgcaaggaag

SEQ ID NO: 2815572 - DNA, 19 bp, Homo sapiens
aatgtaaagcttgtctgat

SEQ ID NO: 2815573 - DNA, 17 bp, Homo sapiens
aatgtaaatattttaaa

SEQ ID NO: 2815574 - DNA, 22 bp, Homo sapiens
aatgtaaatattttaaagaatt

SEQ ID NO: 2815575 - DNA, 16 bp, Homo sapiens
aatgtaacttttgtaa

SEQ ID NO: 2815576 - DNA, 16 bp, Homo sapiens
aatgtaattgaataaa

SEQ ID NO: 2815577 - DNA, 15 bp, Homo sapiens
aatgtacattaatta

SEQ ID NO: 2815578 - DNA, 22 bp, Homo sapiens
aatgtacccaccgggccactcc

SEQ ID NO: 2815579 - DNA, 17 bp, Homo sapiens
aatgtagctggtttcct

SEQ ID NO: 2815580 - DNA, 20 bp, Homo sapiens
aatgtaggtatgaataagtt

SEQ ID NO: 2815581 - DNA, 16 bp, Homo sapiens
aaacagattgtttgca

SEQ ID NO: 2815582 - DNA, 17 bp, Homo sapiens
aaacagctaatgggaca

SEQ ID NO: 2815583 - DNA, 19 bp, Homo sapiens
aaacaggggatcaaagttc

SEQ ID NO: 2815584 - DNA, 18 bp, Homo sapiens
aaacagttaactttcaga

SEQ ID NO: 2815585 - DNA, 14 bp, Homo sapiens
aaacatatcaattc

SEQ ID NO: 2815586 - DNA, 15 bp, Homo sapiens
aaacatatcaattca

SEQ ID NO: 2815587 - DNA, 18 bp, Homo sapiens
aaacatccttcaagaact

SEQ ID NO: 2815588 - DNA, 14 bp, Homo sapiens
aaacattaaaagaa

SEQ ID NO: 2815589 - DNA, 13 bp, Homo sapiens
aaacatttacaat

SEQ ID NO: 2815590 - DNA, 18 bp, Homo sapiens
aaacatttattttgacat

SEQ ID NO: 2815591 - DNA, 11 bp, Homo sapiens
aaacatttctt

SEQ ID NO: 2815592 - DNA, 22 bp, Homo sapiens
aaaccaaaaaggctagtttatt

SEQ ID NO: 2815593 - DNA, 16 bp, Homo sapiens
aaaccactagaactct

SEQ ID NO: 2815594 - DNA, 17 bp, Homo sapiens
aaaccagaatcataatt

SEQ ID NO: 2815595 - DNA, 16 bp, Homo sapiens
aaaccagcagaaaagt

SEQ ID NO: 2815596 - DNA, 19 bp, Homo sapiens
aaaccagcagaaaagtgct

SEQ ID NO: 2815597 - DNA, 21 bp, Homo sapiens
aaaccagcagaaaagtgctta

SEQ ID NO: 2815598 - DNA, 12 bp, Homo sapiens
aaaccagggagc

SEQ ID NO: 2815599 - DNA, 19 bp, Homo sapiens
aaaccagtgtagccttgcc

SEQ ID NO: 2815600 - DNA, 20 bp, Homo sapiens
aaaccattatgaagaagaga

SEQ ID NO: 2815601 - DNA, 15 bp, Homo sapiens
aaaccatttaattca

SEQ ID NO: 2815602 - DNA, 12 bp, Homo sapiens
aaacccagagag

SEQ ID NO: 2815603 - DNA, 16 bp, Homo sapiens
aaaccgctaaaagaaa

SEQ ID NO: 2815604 - DNA, 18 bp, Homo sapiens
aaaccgctaaaagaaact

SEQ ID NO: 2815605 - DNA, 21 bp, Homo sapiens
aaaccgctaaaagaaactttc

SEQ ID NO: 2815606 - DNA, 23 bp, Homo sapiens
aaaccgctaaaagaaactttctt

SEQ ID NO: 2815607 - DNA, 15 bp, Homo sapiens
aaaccgtaattttat

SEQ ID NO: 2815608 - DNA, 19 bp, Homo sapiens
aaaccgtaattttattatt

SEQ ID NO: 2815609 - DNA, 14 bp, Homo sapiens
aaacctgatgttaa

SEQ ID NO: 2815610 - DNA, 16 bp, Homo sapiens
aaaccttattgtacct

SEQ ID NO: 2815611 - DNA, 11 bp, Homo sapiens
aaacctttcaa

SEQ ID NO: 2815612 - DNA, 19 bp, Homo sapiens
aaacctttcaaatttcaca

SEQ ID NO: 2815613 - DNA, 19 bp, Homo sapiens
aaacgcaaagggctgaaag

SEQ ID NO: 2815614 - DNA, 14 bp, Homo sapiens
aaactaaaaactag

SEQ ID NO: 2815615 - DNA, 16 bp, Homo sapiens
aaactatcttggtgaa

SEQ ID NO: 2815616 - DNA, 16 bp, Homo sapiens
aaactatggttcccaa

SEQ ID NO: 2815617 - DNA, 21 bp, Homo sapiens
aaactatggttcccaataaaa

SEQ ID NO: 2815618 - DNA, 23 bp, Homo sapiens
aaactatggttcccaataaaagt

SEQ ID NO: 2815619 - DNA, 18 bp, Homo sapiens
aaactcaccatgtaaaag

SEQ ID NO: 2815620 - DNA, 20 bp, Homo sapiens
aaactcactgctcaagaaga

SEQ ID NO: 2815621 - DNA, 21 bp, Homo sapiens
aaactcacttcaatgaacaaa

SEQ ID NO: 2815622 - DNA, 23 bp, Homo sapiens
aaactcccacttgtcatgtgaca

SEQ ID NO: 2815623 - DNA, 19 bp, Homo sapiens
aaactccgtcttagaagtg

SEQ ID NO: 2815624 - DNA, 13 bp, Homo sapiens
aaactcttctact

SEQ ID NO: 2815625 - DNA, 17 bp, Homo sapiens
aaactgaaaactgtaaa

SEQ ID NO: 2815626 - DNA, 19 bp, Homo sapiens
aaactgaggccattatttc

SEQ ID NO: 2815627 - DNA, 13 bp, Homo sapiens
aaactgagtgact

SEQ ID NO: 2815628 - DNA, 11 bp, Homo sapiens
aaactggaaat

SEQ ID NO: 2815629 - DNA, 15 bp, Homo sapiens
aaactggaataagaa

SEQ ID NO: 2815630 - DNA, 23 bp, Homo sapiens
aaactggtttagcacaatttata

SEQ ID NO: 2815631 - DNA, 13 bp, Homo sapiens
aaacttcagcacc

SEQ ID NO: 2815632 - DNA, 23 bp, Homo sapiens
aaacttccatgaggccaaacgtt

SEQ ID NO: 2815633 - DNA, 18 bp, Homo sapiens
aaactttcatttttggta

SEQ ID NO: 2815634 - DNA, 19 bp, Homo sapiens
aaacttttttatttaaaaa

SEQ ID NO: 2815635 - DNA, 13 bp, Homo sapiens
aaagaaaaacaaa

SEQ ID NO: 2815636 - DNA, 13 bp, Homo sapiens
aaagaaaaagtat

SEQ ID NO: 2815637 - DNA, 13 bp, Homo sapiens
aaagaaaaccatt

SEQ ID NO: 2815638 - DNA, 13 bp, Homo sapiens
aaagaaaaccttt

SEQ ID NO: 2815639 - DNA, 18 bp, Homo sapiens
aaagaaaattcttggaat

SEQ ID NO: 2815640 - DNA, 22 bp, Homo sapiens
aaagaaaccgtaattttattat

SEQ ID NO: 2815641 - DNA, 12 bp, Homo sapiens
aaagaagagaca

SEQ ID NO: 2815642 - DNA, 16 bp, Homo sapiens
aaagaagtaaaagcta

SEQ ID NO: 2815643 - DNA, 14 bp, Homo sapiens
aaagaatacatttt

SEQ ID NO: 2815644 - DNA, 15 bp, Homo sapiens
aaagaatccctgcag

SEQ ID NO: 2815645 - DNA, 19 bp, Homo sapiens
aaagaatccctgcagcctg

SEQ ID NO: 2815646 - DNA, 22 bp, Homo sapiens
aaagaattatttttgtgtttct

SEQ ID NO: 2815647 - DNA, 20 bp, Homo sapiens
aaagactgaaagaatacatt

SEQ ID NO: 2815648 - DNA, 18 bp, Homo sapiens
aaagacttagtatatttt

SEQ ID NO: 2815649 - DNA, 20 bp, Homo sapiens
aaagacttagtatattttct

SEQ ID NO: 2815650 - DNA, 15 bp, Homo sapiens
aaagacttcatgttc

SEQ ID NO: 2815651 - DNA, 23 bp, Homo sapiens
aaagagcaagtctggatctggga

SEQ ID NO: 2815652 - DNA, 18 bp, Homo sapiens
aaagaggcgtcttgtatt

SEQ ID NO: 2815653 - DNA, 19 bp, Homo sapiens
aaagaggcgtcttgtattt

SEQ ID NO: 2815654 - DNA, 19 bp, Homo sapiens
aaagaggtgaccccagggc

SEQ ID NO: 2815655 - DNA, 14 bp, Homo sapiens
aaagagttcaagaa

SEQ ID NO: 2815656 - DNA, 16 bp, Homo sapiens
aaagagttcaagaaat

SEQ ID NO: 2815657 - DNA, 20 bp, Homo sapiens
aaagataacaagatctttca

SEQ ID NO: 2815658 - DNA, 17 bp, Homo sapiens
aaagatatatacacagg

SEQ ID NO: 2815659 - DNA, 22 bp, Homo sapiens
aaagatgccgggttttatattt

SEQ ID NO: 2815660 - DNA, 21 bp, Homo sapiens
aaagatgtcaaatatctcaga

SEQ ID NO: 2815661 - DNA, 21 bp, Homo sapiens
aaagatgtttgtcagatatga

SEQ ID NO: 2815662 - DNA, 13 bp, Homo sapiens
aaagattcactaa

SEQ ID NO: 2815663 - DNA, 19 bp, Homo sapiens
aaagattttttaataattt

SEQ ID NO: 2815664 - DNA, 18 bp, Homo sapiens
aagagcctgactgtgttc

SEQ ID NO: 2815665 - DNA, 21 bp, Homo sapiens
aagagcctggagaagctgatg

SEQ ID NO: 2815666 - DNA, 14 bp, Homo sapiens
aagagctacataat

SEQ ID NO: 2815667 - DNA, 18 bp, Homo sapiens
aagagctacgtatttaat

SEQ ID NO: 2815668 - DNA, 18 bp, Homo sapiens
aagagctgaggcaattct

SEQ ID NO: 2815669 - DNA, 14 bp, Homo sapiens
aagaggaagagaga

SEQ ID NO: 2815670 - DNA, 18 bp, Homo sapiens
aagaggcacctgtcccag

SEQ ID NO: 2815671 - DNA, 13 bp, Homo sapiens
aagaggctgaggc

SEQ ID NO: 2815672 - DNA, 17 bp, Homo sapiens
aagaggctggtgctgtg

SEQ ID NO: 2815673 - DNA, 12 bp, Homo sapiens
aagagggcctgt

SEQ ID NO: 2815674 - DNA, 19 bp, Homo sapiens
aagagggcctgtgggagcc

SEQ ID NO: 2815675 - DNA, 19 bp, Homo sapiens
aagaggggaccagaagcca

SEQ ID NO: 2815676 - DNA, 21 bp, Homo sapiens
aagaggtatttatctttactt

SEQ ID NO: 2815677 - DNA, 21 bp, Homo sapiens
aagaggtgaccccagggcaca

SEQ ID NO: 2815678 - DNA, 14 bp, Homo sapiens
aagagtattccatt

SEQ ID NO: 2815679 - DNA, 20 bp, Homo sapiens
aagataacaagatctttcag

SEQ ID NO: 2815680 - DNA, 12 bp, Homo sapiens
aagataattata

SEQ ID NO: 2815681 - DNA, 14 bp, Homo sapiens
aagatacttaagtg

SEQ ID NO: 2815682 - DNA, 17 bp, Homo sapiens
aagatacttaagtgctg

SEQ ID NO: 2815683 - DNA, 17 bp, Homo sapiens
aagataggtttgagttc

SEQ ID NO: 2815684 - DNA, 23 bp, Homo sapiens
aagataggtttgagttcaaattt

SEQ ID NO: 2815685 - DNA, 23 bp, Homo sapiens
aagatatatatttactaaaagaa

SEQ ID NO: 2815686 - DNA, 21 bp, Homo sapiens
aagatcctgtctttaaggaaa

SEQ ID NO: 2815687 - DNA, 23 bp, Homo sapiens
aagatctgcagggggtgtgtctg

SEQ ID NO: 2815688 - DNA, 15 bp, Homo sapiens
aagatgacagctctt

SEQ ID NO: 2815689 - DNA, 21 bp, Homo sapiens
aagatggctgtgcctctgcct

SEQ ID NO: 2815690 - DNA, 15 bp, Homo sapiens
aagattaaaggaagg

SEQ ID NO: 2815691 - DNA, 18 bp, Homo sapiens
aagattaaaggaaggaaa

SEQ ID NO: 2815692 - DNA, 18 bp, Homo sapiens
aagattagaatgaaaatt

SEQ ID NO: 2815693 - DNA, 19 bp, Homo sapiens
aagattatattataataat

SEQ ID NO: 2815694 - DNA, 16 bp, Homo sapiens
aagattgcttaaaata

SEQ ID NO: 2815695 - DNA, 13 bp, Homo sapiens
aagattttttaat

SEQ ID NO: 2815696 - DNA, 14 bp, Homo sapiens
aagattttttaata

SEQ ID NO: 2815697 - DNA, 17 bp, Homo sapiens
aagcaaagcaccagctt

SEQ ID NO: 2815698 - DNA, 12 bp, Homo sapiens
aagcaacataaa

SEQ ID NO: 2815699 - DNA, 15 bp, Homo sapiens
aagcaacctcagtaa

SEQ ID NO: 2815700 - DNA, 20 bp, Homo sapiens
aagcaacctcagtaatttag

SEQ ID NO: 2815701 - DNA, 21 bp, Homo sapiens
aagcaacctcagtaatttaga

SEQ ID NO: 2815702 - DNA, 19 bp, Homo sapiens
aagcaagacgtcctggaat

SEQ ID NO: 2815703 - DNA, 15 bp, Homo sapiens
aagcaagcattcaga

SEQ ID NO: 2815704 - DNA, 21 bp, Homo sapiens
aagcaagcattcagaagaaaa

SEQ ID NO: 2815705 - DNA, 20 bp, Homo sapiens
aagcaataattaggatctat

SEQ ID NO: 2815706 - DNA, 23 bp, Homo sapiens
aagcaataattaggatctatgca

SEQ ID NO: 2815707 - DNA, 20 bp, Homo sapiens
aagcaccagcttctccaggc

SEQ ID NO: 2815708 - DNA, 16 bp, Homo sapiens
aagcacctcctgcctc

SEQ ID NO: 2815709 - DNA, 18 bp, Homo sapiens
aagcagagaggtggagaa

SEQ ID NO: 2815710 - DNA, 15 bp, Homo sapiens
aagcagcctttctgt

SEQ ID NO: 2815711 - DNA, 21 bp, Homo sapiens
aagcagcctttctgtggagag

SEQ ID NO: 2815712 - DNA, 16 bp, Homo sapiens
aagcagtgcttgtaaa

SEQ ID NO: 2815713 - DNA, 17 bp, Homo sapiens
aagcagtggacaccagg

SEQ ID NO: 2815714 - DNA, 11 bp, Homo sapiens
aagcagtgttt

SEQ ID NO: 2815715 - DNA, 22 bp, Homo sapiens
aagcataaatgcaaacacacaa

SEQ ID NO: 2815716 - DNA, 15 bp, Homo sapiens
aagcatcacctcagg

SEQ ID NO: 2815717 - DNA, 19 bp, Homo sapiens
aagcatcacctcaggccag

SEQ ID NO: 2815718 - DNA, 12 bp, Homo sapiens
aagcatctgtgt

SEQ ID NO: 2815719 - DNA, 16 bp, Homo sapiens
aagcatgtaggagaat

SEQ ID NO: 2815720 - DNA, 13 bp, Homo sapiens
aagcatgtggcat

SEQ ID NO: 2815721 - DNA, 22 bp, Homo sapiens
aagcattgggtgggtaaattca

SEQ ID NO: 2815722 - DNA, 23 bp, Homo sapiens
aagcatttgtttctactttgata

SEQ ID NO: 2815723 - DNA, 20 bp, Homo sapiens
aagcattttactgtctgtaa

SEQ ID NO: 2815724 - DNA, 22 bp, Homo sapiens
aagcattttactgtctgtaaga

SEQ ID NO: 2815725 - DNA, 23 bp, Homo sapiens
aagcattttgtaagttgaagcaa

SEQ ID NO: 2815726 - DNA, 18 bp, Homo sapiens
aagccaaaacaatgttta

SEQ ID NO: 2815727 - DNA, 16 bp, Homo sapiens
aagccaaactctgcca

SEQ ID NO: 2815728 - DNA, 20 bp, Homo sapiens
aagccaaactctgccagcca

SEQ ID NO: 2815729 - DNA, 16 bp, Homo sapiens
aagccaaagacttagt

SEQ ID NO: 2815730 - DNA, 20 bp, Homo sapiens
aagccaaagctaggcctggc

SEQ ID NO: 2815731 - DNA, 22 bp, Homo sapiens
aagccaaagctaggcctggcca

SEQ ID NO: 2815732 - DNA, 21 bp, Homo sapiens
aagccaaatttatatgccacc

SEQ ID NO: 2815733 - DNA, 16 bp, Homo sapiens
aagccaacttgtaaat

SEQ ID NO: 2815734 - DNA, 19 bp, Homo sapiens
aagccaacttgtaaataca

SEQ ID NO: 2815735 - DNA, 11 bp, Homo sapiens
aagccacagaa

SEQ ID NO: 2815736 - DNA, 23 bp, Homo sapiens
aagccagattttttaaaatttat

SEQ ID NO: 2815737 - DNA, 21 bp, Homo sapiens
aagccaggagcaaatgtttct

SEQ ID NO: 2815738 - DNA, 20 bp, Homo sapiens
aagcccaaatggctctgtga

SEQ ID NO: 2815739 - DNA, 19 bp, Homo sapiens
aagcccaaggcagtgttcc

SEQ ID NO: 2815740 - DNA, 14 bp, Homo sapiens
aagcccatgctttc

SEQ ID NO: 2815741 - DNA, 11 bp, Homo sapiens
aagccctcctt

SEQ ID NO: 2815742 - DNA, 18 bp, Homo sapiens
aagccctgtcgagacact

SEQ ID NO: 2815743 - DNA, 15 bp, Homo sapiens
aagcccttccatgtc

SEQ ID NO: 2815744 - DNA, 14 bp, Homo sapiens
aagcctctggtgga

SEQ ID NO: 2815745 - DNA, 15 bp, Homo sapiens
aacagacaggagaaa

SEQ ID NO: 2815746 - DNA, 20 bp, Homo sapiens
aacagactggaagcacagct

SEQ ID NO: 2815747 - DNA, 13 bp, Homo sapiens
aacagagaaggca

SEQ ID NO: 2815748 - DNA, 15 bp, Homo sapiens
aacagagaaggcagg

SEQ ID NO: 2815749 - DNA, 15 bp, Homo sapiens
aacagagccttcaca

SEQ ID NO: 2815750 - DNA, 19 bp, Homo sapiens
aacagagccttcacaacca

SEQ ID NO: 2815751 - DNA, 21 bp, Homo sapiens
aacagagtatatatgtacagt

SEQ ID NO: 2815752 - DNA, 23 bp, Homo sapiens
aacagatactggaagttttgcat

SEQ ID NO: 2815753 - DNA, 19 bp, Homo sapiens
aacagcagactcagctctg

SEQ ID NO: 2815754 - DNA, 20 bp, Homo sapiens
aacagcagactcagctctga

SEQ ID NO: 2815755 - DNA, 21 bp, Homo sapiens
aacagcagaggttcttttaaa

SEQ ID NO: 2815756 - DNA, 9 bp, Homo sapiens
aacagcagc

SEQ ID NO: 2815757 - DNA, 22 bp, Homo sapiens
aacagccgtcagccaaatgtaa

SEQ ID NO: 2815758 - DNA, 14 bp, Homo sapiens
aacagcctcacaga

SEQ ID NO: 2815759 - DNA, 18 bp, Homo sapiens
aacagcctgacaacattt

SEQ ID NO: 2815760 - DNA, 16 bp, Homo sapiens
aacaggaatctcagag

SEQ ID NO: 2815761 - DNA, 21 bp, Homo sapiens
aacaggaatctcagagacagg

SEQ ID NO: 2815762 - DNA, 20 bp, Homo sapiens
aacaggaccacaaaaatgaa

SEQ ID NO: 2815763 - DNA, 22 bp, Homo sapiens
aacaggctgggcttcagtggca

SEQ ID NO: 2815764 - DNA, 15 bp, Homo sapiens
aacagggaaggcagg

SEQ ID NO: 2815765 - DNA, 20 bp, Homo sapiens
aacagggaaggcaggcaggg

SEQ ID NO: 2815766 - DNA, 17 bp, Homo sapiens
aacaggtctcctcttaa

SEQ ID NO: 2815767 - DNA, 19 bp, Homo sapiens
aacaggtctcctcttaaaa

SEQ ID NO: 2815768 - DNA, 21 bp, Homo sapiens
aacaggtggcaggaccaggac

SEQ ID NO: 2815769 - DNA, 22 bp, Homo sapiens
aacaggtggcaggaccaggact

SEQ ID NO: 2815770 - DNA, 15 bp, Homo sapiens
aacagtgcctgctga

SEQ ID NO: 2815771 - DNA, 13 bp, Homo sapiens
aacagtgtttccc

SEQ ID NO: 2815772 - DNA, 21 bp, Homo sapiens
aacagtgtttcccataatttt

SEQ ID NO: 2815773 - DNA, 20 bp, Homo sapiens
aacagttaactttcagaaga

SEQ ID NO: 2815774 - DNA, 11 bp, Homo sapiens
aacagttcaaa

SEQ ID NO: 2815775 - DNA, 13 bp, Homo sapiens
aacagtttgtaca

SEQ ID NO: 2815776 - DNA, 21 bp, Homo sapiens
aacagttttttatgctaatca

SEQ ID NO: 2815777 - DNA, 13 bp, Homo sapiens
aacataaaaatga

SEQ ID NO: 2815778 - DNA, 22 bp, Homo sapiens
aacataatatcttgaagaatat

SEQ ID NO: 2815779 - DNA, 18 bp, Homo sapiens
aacataattcttgtatat

SEQ ID NO: 2815780 - DNA, 18 bp, Homo sapiens
aacatacccttctttaaa

SEQ ID NO: 2815781 - DNA, 19 bp, Homo sapiens
aacatacccttctttaaat

SEQ ID NO: 2815782 - DNA, 22 bp, Homo sapiens
aacatacccttctttaaatcaa

SEQ ID NO: 2815783 - DNA, 22 bp, Homo sapiens
aacatagaaattgcctgacgaa

SEQ ID NO: 2815784 - DNA, 12 bp, Homo sapiens
aacatagattta

SEQ ID NO: 2815785 - DNA, 22 bp, Homo sapiens
aacatataatgttgttatttaa

SEQ ID NO: 2815786 - DNA, 16 bp, Homo sapiens
aacatatcaattcaac

SEQ ID NO: 2815787 - DNA, 19 bp, Homo sapiens
aacatccttcaagaactct

SEQ ID NO: 2815788 - DNA, 22 bp, Homo sapiens
aacatcctttctattgaaaaat

SEQ ID NO: 2815789 - DNA, 11 bp, Homo sapiens
aacatctgtgt

SEQ ID NO: 2815790 - DNA, 12 bp, Homo sapiens
aacatgagaaat

SEQ ID NO: 2815791 - DNA, 14 bp, Homo sapiens
aacatgagtttatg

SEQ ID NO: 2815792 - DNA, 19 bp, Homo sapiens
aacatgcacatttatatat

SEQ ID NO: 2815793 - DNA, 15 bp, Homo sapiens
aacatgcctgatttt

SEQ ID NO: 2815794 - DNA, 20 bp, Homo sapiens
aacatggagaaaccctgtct

SEQ ID NO: 2815795 - DNA, 17 bp, Homo sapiens
aacatgtataatatttt

SEQ ID NO: 2815796 - DNA, 19 bp, Homo sapiens
aacatgtcggagtagaaat

SEQ ID NO: 2815797 - DNA, 15 bp, Homo sapiens
aacattaaacactgt

SEQ ID NO: 2815798 - DNA, 16 bp, Homo sapiens
aacattaaacactgta

SEQ ID NO: 2815799 - DNA, 20 bp, Homo sapiens
aacattcatccagttgcaat

SEQ ID NO: 2815800 - DNA, 18 bp, Homo sapiens
aacattgggaaatcttat

SEQ ID NO: 2815801 - DNA, 22 bp, Homo sapiens
aacatttacaataaatattctg

SEQ ID NO: 2815802 - DNA, 15 bp, Homo sapiens
aacatttattttgac

SEQ ID NO: 2815803 - DNA, 17 bp, Homo sapiens
aacatttattttgacat

SEQ ID NO: 2815804 - DNA, 19 bp, Homo sapiens
aacatttattttgacataa

SEQ ID NO: 2815805 - DNA, 13 bp, Homo sapiens
aacatttgagtat

SEQ ID NO: 2815806 - DNA, 16 bp, Homo sapiens
aaccaaagagactgga

SEQ ID NO: 2815807 - DNA, 23 bp, Homo sapiens
aaccaaagagactggagcatctg

SEQ ID NO: 2815808 - DNA, 23 bp, Homo sapiens
aaccaatcccgtgaaagaattat

SEQ ID NO: 2815809 - DNA, 18 bp, Homo sapiens
aaccaatgattcataaca

SEQ ID NO: 2815810 - DNA, 19 bp, Homo sapiens
aaccaccacacccagccca

SEQ ID NO: 2815811 - DNA, 14 bp, Homo sapiens
aaccacggaaaaga

SEQ ID NO: 2815812 - DNA, 14 bp, Homo sapiens
aaccactgcaacgg

SEQ ID NO: 2815813 - DNA, 16 bp, Homo sapiens
aaccactgtaaaatga

SEQ ID NO: 2815814 - DNA, 14 bp, Homo sapiens
aaccagaatcataa

SEQ ID NO: 2815815 - DNA, 14 bp, Homo sapiens
aaccagcagaaaag

SEQ ID NO: 2815816 - DNA, 16 bp, Homo sapiens
aaccagcagaaaagtg

SEQ ID NO: 2815817 - DNA, 15 bp, Homo sapiens
aaccagcattttact

SEQ ID NO: 2815818 - DNA, 16 bp, Homo sapiens
aaccagcattttacta

SEQ ID NO: 2815819 - DNA, 15 bp, Homo sapiens
aaccagccacacaga

SEQ ID NO: 2815820 - DNA, 17 bp, Homo sapiens
aaccagccacacagagc

SEQ ID NO: 2815821 - DNA, 14 bp, Homo sapiens
aaccagttatgtga

SEQ ID NO: 2815822 - DNA, 18 bp, Homo sapiens
aaccagtttcaggtgttt

SEQ ID NO: 2815823 - DNA, 13 bp, Homo sapiens
aaccataaacttc

SEQ ID NO: 2815824 - DNA, 18 bp, Homo sapiens
aaccataaacttcatggt

SEQ ID NO: 2815825 - DNA, 17 bp, Homo sapiens
aaccatcagttactggt

SEQ ID NO: 2815826 - DNA, 19 bp, Homo sapiens
aaccatcagttactggttt

SEQ ID NO: 2815827 - DNA, 22 bp, Homo sapiens
aaccatccctgatgtctgtctg

SEQ ID NO: 2815828 - DNA, 16 bp, Homo sapiens
aaccatgcagcttcat

SEQ ID NO: 2815829 - DNA, 21 bp, Homo sapiens
aaccatgcagcttcatcaatt

SEQ ID NO: 2815830 - DNA, 22 bp, Homo sapiens
aaccatgcagcttcatcaattt

SEQ ID NO: 2815831 - DNA, 14 bp, Homo sapiens
aaccatttaattca

SEQ ID NO: 2815832 - DNA, 13 bp, Homo sapiens
aactgaagccaga

SEQ ID NO: 2815833 - DNA, 14 bp, Homo sapiens
aactgaccagcctc

SEQ ID NO: 2815834 - DNA, 19 bp, Homo sapiens
aactgaccagcctccatgc

SEQ ID NO: 2815835 - DNA, 20 bp, Homo sapiens
aactgaggcagacagcagct

SEQ ID NO: 2815836 - DNA, 12 bp, Homo sapiens
aactgccaagaa

SEQ ID NO: 2815837 - DNA, 11 bp, Homo sapiens
aagagaattct

SEQ ID NO: 2815838 - DNA, 21 bp, Homo sapiens
aagagaattctaagattgtac

SEQ ID NO: 2815839 - DNA, 14 bp, Homo sapiens
aagagactggagca

SEQ ID NO: 2815840 - DNA, 18 bp, Homo sapiens
aagagactggagcatctg

SEQ ID NO: 2815841 - DNA, 18 bp, Homo sapiens
aagagatgggcttgtttt

SEQ ID NO: 2815842 - DNA, 10 bp, Homo sapiens
aagagcacaa

SEQ ID NO: 2815843 - DNA, 23 bp, Homo sapiens
aagagcatcatgcctctgaggcc

SEQ ID NO: 2815844 - DNA, 16 bp, Homo sapiens
caggtggtcctgagac

SEQ ID NO: 2815845 - DNA, 14 bp, Homo sapiens
caggtgtaaatata

SEQ ID NO: 2815846 - DNA, 21 bp, Homo sapiens
caggtgtaaatatagtagcag

SEQ ID NO: 2815847 - DNA, 15 bp, Homo sapiens
caggtgtccctgcac

SEQ ID NO: 2815848 - DNA, 12 bp, Homo sapiens
caggtgtgaacc

SEQ ID NO: 2815849 - DNA, 19 bp, Homo sapiens
caggtgtgaaccaccacac

SEQ ID NO: 2815850 - DNA, 16 bp, Homo sapiens
caggtgtgagtcacca

SEQ ID NO: 2815851 - DNA, 13 bp, Homo sapiens
caggttcagcttg

SEQ ID NO: 2815852 - DNA, 21 bp, Homo sapiens
caggttgaggggctcctggaa

SEQ ID NO: 2815853 - DNA, 21 bp, Homo sapiens
caggtttggggagggggaaga

SEQ ID NO: 2815854 - DNA, 23 bp, Homo sapiens
caggtttttggtctgacccactg

SEQ ID NO: 2815855 - DNA, 15 bp, Homo sapiens
cagtaaagtttaaaa

SEQ ID NO: 2815856 - DNA, 18 bp, Homo sapiens
cagtaaagtttaaaaaat

SEQ ID NO: 2815857 - DNA, 19 bp, Homo sapiens
cagtaaagtttaaaaaata

SEQ ID NO: 2815858 - DNA, 15 bp, Homo sapiens
cagtacctttgtcac

SEQ ID NO: 2815859 - DNA, 16 bp, Homo sapiens
cagtacctttgtcaca

SEQ ID NO: 2815860 - DNA, 18 bp, Homo sapiens
cagtagcacaagttattt

SEQ ID NO: 2815861 - DNA, 20 bp, Homo sapiens
cagtagctgtggtgaggtgg

SEQ ID NO: 2815862 - DNA, 18 bp, Homo sapiens
cagtagcttaaataaatt

SEQ ID NO: 2815863 - DNA, 18 bp, Homo sapiens
cagtaggtttgtgtggat

SEQ ID NO: 2815864 - DNA, 16 bp, Homo sapiens
cagtagtcgtcaagtt

SEQ ID NO: 2815865 - DNA, 17 bp, Homo sapiens
cagtagtttgagaccag

SEQ ID NO: 2815866 - DNA, 23 bp, Homo sapiens
cagtagtttgagaccagcctggc

SEQ ID NO: 2815867 - DNA, 16 bp, Homo sapiens
cagtataaaagacaaa

SEQ ID NO: 2815868 - DNA, 22 bp, Homo sapiens
cagtatatttatagtcacaaga

SEQ ID NO: 2815869 - DNA, 19 bp, Homo sapiens
cagtatgctgttttaataa

SEQ ID NO: 2815870 - DNA, 15 bp, Homo sapiens
cagtcaaaacagaga

SEQ ID NO: 2815871 - DNA, 14 bp, Homo sapiens
cagtcaacagttca

SEQ ID NO: 2815872 - DNA, 13 bp, Homo sapiens
cagtcacactgtt

SEQ ID NO: 2815873 - DNA, 22 bp, Homo sapiens
cagtcactgtccctcaaatgac

SEQ ID NO: 2815874 - DNA, 15 bp, Homo sapiens
cagtcataactaaat

SEQ ID NO: 2815875 - DNA, 14 bp, Homo sapiens
cagtccagaataag

SEQ ID NO: 2815876 - DNA, 18 bp, Homo sapiens
cagtccagaataagtgct

SEQ ID NO: 2815877 - DNA, 19 bp, Homo sapiens
cagtccagaataagtgctg

SEQ ID NO: 2815878 - DNA, 13 bp, Homo sapiens
cagtccagccagc

SEQ ID NO: 2815879 - DNA, 15 bp, Homo sapiens
cagtccagccagctc

SEQ ID NO: 2815880 - DNA, 17 bp, Homo sapiens
cagtccagccagctcct

SEQ ID NO: 2815881 - DNA, 16 bp, Homo sapiens
cagtccatagcagaga

SEQ ID NO: 2815882 - DNA, 19 bp, Homo sapiens
cagtcccatcagagagcga

SEQ ID NO: 2815883 - DNA, 17 bp, Homo sapiens
cagtccccctgccccag

SEQ ID NO: 2815884 - DNA, 20 bp, Homo sapiens
cagtccctgggggaagccct

SEQ ID NO: 2815885 - DNA, 15 bp, Homo sapiens
cagtccgcctggccg

SEQ ID NO: 2815886 - DNA, 21 bp, Homo sapiens
cagtccgcctggccggctcca

SEQ ID NO: 2815887 - DNA, 22 bp, Homo sapiens
cagtccgcctggccggctccag

SEQ ID NO: 2815888 - DNA, 11 bp, Homo sapiens
cagtcctggaa

SEQ ID NO: 2815889 - DNA, 21 bp, Homo sapiens
cagtcctgggagaacctcagg

SEQ ID NO: 2815890 - DNA, 20 bp, Homo sapiens
cagtcctggtctgctcagga

SEQ ID NO: 2815891 - DNA, 20 bp, Homo sapiens
cagtcgagccctgcagccaa

SEQ ID NO: 2815892 - DNA, 22 bp, Homo sapiens
cagtctaaagctggtttaatgt

SEQ ID NO: 2815893 - DNA, 22 bp, Homo sapiens
cagtctagattagaagtgtttt

SEQ ID NO: 2815894 - DNA, 19 bp, Homo sapiens
cagtctcaggagcatgggg

SEQ ID NO: 2815895 - DNA, 14 bp, Homo sapiens
cagtctctgggaga

SEQ ID NO: 2815896 - DNA, 15 bp, Homo sapiens
cagtctctttaatct

SEQ ID NO: 2815897 - DNA, 19 bp, Homo sapiens
cagtctctttaatcttcag

SEQ ID NO: 2815898 - DNA, 20 bp, Homo sapiens
cagtctctttaatcttcagt

SEQ ID NO: 2815899 - DNA, 19 bp, Homo sapiens
cagtctgattcccaagctc

SEQ ID NO: 2815900 - DNA, 17 bp, Homo sapiens
cagtctggaatgcagtg

SEQ ID NO: 2815901 - DNA, 20 bp, Homo sapiens
cagtctgggtaacagggaga

SEQ ID NO: 2815902 - DNA, 22 bp, Homo sapiens
cagtcttgaatttctaaaaaac

SEQ ID NO: 2815903 - DNA, 23 bp, Homo sapiens
cagtcttgaatttctaaaaaaca

SEQ ID NO: 2815904 - DNA, 14 bp, Homo sapiens
cagtgaaaaactat

SEQ ID NO: 2815905 - DNA, 16 bp, Homo sapiens
cagtgacagagttcac

SEQ ID NO: 2815906 - DNA, 19 bp, Homo sapiens
cagccagcgcctccctcca

SEQ ID NO: 2815907 - DNA, 20 bp, Homo sapiens
cagccagctcctgggcagct

SEQ ID NO: 2815908 - DNA, 20 bp, Homo sapiens
cagccatcatgtgcctggaa

SEQ ID NO: 2815909 - DNA, 15 bp, Homo sapiens
cagcccaagcagagt

SEQ ID NO: 2815910 - DNA, 15 bp, Homo sapiens
cagcccagcctctgt

SEQ ID NO: 2815911 - DNA, 21 bp, Homo sapiens
cagcccagcctctgtccctct

SEQ ID NO: 2815912 - DNA, 16 bp, Homo sapiens
cagcccagggcacttc

SEQ ID NO: 2815913 - DNA, 14 bp, Homo sapiens
cagccccagtgccc

SEQ ID NO: 2815914 - DNA, 18 bp, Homo sapiens
cagccccagtgcccacag

SEQ ID NO: 2815915 - DNA, 20 bp, Homo sapiens
cagccccattctgcctgccc

SEQ ID NO: 2815916 - DNA, 18 bp, Homo sapiens
cagccccgactccagcca

SEQ ID NO: 2815917 - DNA, 19 bp, Homo sapiens
cagccccgactccagccag

SEQ ID NO: 2815918 - DNA, 21 bp, Homo sapiens
cagccccgactccagccagcg

SEQ ID NO: 2815919 - DNA, 14 bp, Homo sapiens
cagccccgggcctg

SEQ ID NO: 2815920 - DNA, 17 bp, Homo sapiens
cagcccctcctcccctt

SEQ ID NO: 2815921 - DNA, 23 bp, Homo sapiens
cagcccctcctctgccacctccc

SEQ ID NO: 2815922 - DNA, 20 bp, Homo sapiens
cagcccggcctgctcccagc

SEQ ID NO: 2815923 - DNA, 19 bp, Homo sapiens
cagccctaaggatctctca

SEQ ID NO: 2815924 - DNA, 14 bp, Homo sapiens
cagccctatggatg

SEQ ID NO: 2815925 - DNA, 15 bp, Homo sapiens
cagccctatggatgt

SEQ ID NO: 2815926 - DNA, 16 bp, Homo sapiens
cagccctccctgtcct

SEQ ID NO: 2815927 - DNA, 12 bp, Homo sapiens
cagccctcctca

SEQ ID NO: 2815928 - DNA, 13 bp, Homo sapiens
cagccctcctcac

SEQ ID NO: 2815929 - DNA, 14 bp, Homo sapiens
cagccctcctcacc

SEQ ID NO: 2815930 - DNA, 16 bp, Homo sapiens
cagccctcctcacccc

SEQ ID NO: 2815931 - DNA, 15 bp, Homo sapiens
cagccctgcctggag

SEQ ID NO: 2815932 - DNA, 19 bp, Homo sapiens
cagccctgcctggaggacc

SEQ ID NO: 2815933 - DNA, 21 bp, Homo sapiens
cagccctgcctggaggacctg

SEQ ID NO: 2815934 - DNA, 22 bp, Homo sapiens
cagccctggcccagagctggaa

SEQ ID NO: 2815935 - DNA, 11 bp, Homo sapiens
cagccctgggc

SEQ ID NO: 2815936 - DNA, 16 bp, Homo sapiens
cagcccttagcaggga

SEQ ID NO: 2815937 - DNA, 15 bp, Homo sapiens
cagcccttccctgct

SEQ ID NO: 2815938 - DNA, 16 bp, Homo sapiens
cagcccttccctgctt

SEQ ID NO: 2815939 - DNA, 20 bp, Homo sapiens
cagccctttgggaggctgag

SEQ ID NO: 2815940 - DNA, 12 bp, Homo sapiens
cagccgctcctg

SEQ ID NO: 2815941 - DNA, 18 bp, Homo sapiens
cagccgctcctgtctgcc

SEQ ID NO: 2815942 - DNA, 16 bp, Homo sapiens
cagccgtgatgctcag

SEQ ID NO: 2815943 - DNA, 17 bp, Homo sapiens
cagccgtgatgctcagg

SEQ ID NO: 2815944 - DNA, 23 bp, Homo sapiens
cagcctaagaagctctggcccca

SEQ ID NO: 2815945 - DNA, 15 bp, Homo sapiens
cagcctaccatgaga

SEQ ID NO: 2815946 - DNA, 15 bp, Homo sapiens
cagcctagccgacct

SEQ ID NO: 2815947 - DNA, 20 bp, Homo sapiens
cagcctagccgacctcagcc

SEQ ID NO: 2815948 - DNA, 21 bp, Homo sapiens
cagcctagccgacctcagcct

SEQ ID NO: 2815949 - DNA, 22 bp, Homo sapiens
cagcctagccgacctcagcctt

SEQ ID NO: 2815950 - DNA, 17 bp, Homo sapiens
cagcctcaacctcctgg

SEQ ID NO: 2815951 - DNA, 18 bp, Homo sapiens
cagcctcaacctcctggg

SEQ ID NO: 2815952 - DNA, 21 bp, Homo sapiens
cagcctcaacctcctgggcta

SEQ ID NO: 2815953 - DNA, 14 bp, Homo sapiens
cagcctcacagaag

SEQ ID NO: 2815954 - DNA, 18 bp, Homo sapiens
cagcctccatgctgcctc

SEQ ID NO: 2815955 - DNA, 20 bp, Homo sapiens
cagcctcccaaagtgctggg

SEQ ID NO: 2815956 - DNA, 21 bp, Homo sapiens
cagcctcccaaagtgctggga

SEQ ID NO: 2815957 - DNA, 20 bp, Homo sapiens
cagcctcccaaccccagggc

SEQ ID NO: 2815958 - DNA, 12 bp, Homo sapiens
cagcctcccccc

SEQ ID NO: 2815959 - DNA, 16 bp, Homo sapiens
cagcctccccccgctg

SEQ ID NO: 2815960 - DNA, 17 bp, Homo sapiens
cagcctccccccgctgg

SEQ ID NO: 2815961 - DNA, 18 bp, Homo sapiens
cagcctccccccgctggg

SEQ ID NO: 2815962 - DNA, 15 bp, Homo sapiens
cagcctcctcccacc

SEQ ID NO: 2815963 - DNA, 15 bp, Homo sapiens
cagcctcctcctgac

SEQ ID NO: 2815964 - DNA, 15 bp, Homo sapiens
cagcctcgcatgcca

SEQ ID NO: 2815965 - DNA, 16 bp, Homo sapiens
cagcctcgcatgccag

SEQ ID NO: 2815966 - DNA, 17 bp, Homo sapiens
cagcctctgtccctctt

SEQ ID NO: 2815967 - DNA, 11 bp, Homo sapiens
cagcctcttaa

SEQ ID NO: 2815968 - DNA, 18 bp, Homo sapiens
cagcctgaggctgagact

SEQ ID NO: 2815969 - DNA, 22 bp, Homo sapiens
cagcctggactttggttctctc

SEQ ID NO: 2815970 - DNA, 11 bp, Homo sapiens
cagcctggcct

SEQ ID NO: 2815971 - DNA, 13 bp, Homo sapiens
cagcctggcctcc

SEQ ID NO: 2815972 - DNA, 20 bp, Homo sapiens
cagcctggcctcctgcctct

SEQ ID NO: 2815973 - DNA, 21 bp, Homo sapiens
cagcctggcctcctgcctcta

SEQ ID NO: 2815974 - DNA, 15 bp, Homo sapiens
cagcctggcttctgg

SEQ ID NO: 2815975 - DNA, 20 bp, Homo sapiens
cagcctggcttctggagccc

SEQ ID NO: 2815976 - DNA, 21 bp, Homo sapiens
cagcctggcttctggagccct

SEQ ID NO: 2815977 - DNA, 19 bp, Homo sapiens
cagcctgggaccagggcat

SEQ ID NO: 2815978 - DNA, 19 bp, Homo sapiens
cagcctgggcaacagagca

SEQ ID NO: 2815979 - DNA, 11 bp, Homo sapiens
cagcctgggcc

SEQ ID NO: 2815980 - DNA, 12 bp, Homo sapiens
cagcctgggcct

SEQ ID NO: 2815981 - DNA, 16 bp, Homo sapiens
cagcctgggcctatgg

SEQ ID NO: 2815982 - DNA, 20 bp, Homo sapiens
cagcctgggcctatggagag

SEQ ID NO: 2815983 - DNA, 18 bp, Homo sapiens
cagcctggtgggcctcct

SEQ ID NO: 2815984 - DNA, 14 bp, Homo sapiens
cagccttccccctc

SEQ ID NO: 2815985 - DNA, 16 bp, Homo sapiens
cagccttccccttgcc

SEQ ID NO: 2815986 - DNA, 13 bp, Homo sapiens
cagccttcctgac

SEQ ID NO: 2815987 - DNA, 17 bp, Homo sapiens
cagccttctctctctgg

SEQ ID NO: 2815988 - DNA, 13 bp, Homo sapiens
cagcctttctgtg

SEQ ID NO: 2815989 - DNA, 13 bp, Homo sapiens
cagcgagaggcag

SEQ ID NO: 2815990 - DNA, 21 bp, Homo sapiens
cagcgattccctctcccaggc

SEQ ID NO: 2815991 - DNA, 22 bp, Homo sapiens
cagcgcctagtggggtctccct

SEQ ID NO: 2815992 - DNA, 23 bp, Homo sapiens
cagcgcctccctccaccccagga

SEQ ID NO: 2815993 - DNA, 15 bp, Homo sapiens
cagcggaggagacca

SEQ ID NO: 2815994 - DNA, 21 bp, Homo sapiens
cagcggaggagaccagctcag

SEQ ID NO: 2815995 - DNA, 20 bp, Homo sapiens
cataaatgttcagcttcaga

SEQ ID NO: 2815996 - DNA, 13 bp, Homo sapiens
cataacaatgtat

SEQ ID NO: 2815997 - DNA, 11 bp, Homo sapiens
cataagattaa

SEQ ID NO: 2815998 - DNA, 23 bp, Homo sapiens
cataagttggaccagaggaagcc

SEQ ID NO: 2815999 - DNA, 21 bp, Homo sapiens
cataatatcttgaagaatatt

SEQ ID NO: 2816000 - DNA, 21 bp, Homo sapiens
cataatctggactcctctgtc

SEQ ID NO: 2816001 - DNA, 17 bp, Homo sapiens
cataatgttacattatt

SEQ ID NO: 2816002 - DNA, 16 bp, Homo sapiens
cataattagaacaata

SEQ ID NO: 2816003 - DNA, 22 bp, Homo sapiens
cataattagaacaatagctatt

SEQ ID NO: 2816004 - DNA, 16 bp, Homo sapiens
cataattcttgtatat

SEQ ID NO: 2816005 - DNA, 21 bp, Homo sapiens
cataatttgtacatatgtaaa

SEQ ID NO: 2816006 - DNA, 23 bp, Homo sapiens
cataatttgtacatatgtaaaat

SEQ ID NO: 2816007 - DNA, 13 bp, Homo sapiens
cataattttcaag

SEQ ID NO: 2816008 - DNA, 22 bp, Homo sapiens
cataattttcaagagaagaaaa

SEQ ID NO: 2816009 - DNA, 20 bp, Homo sapiens
cataattttcttcatgcaat

SEQ ID NO: 2816010 - DNA, 14 bp, Homo sapiens
catacaatttgcac

SEQ ID NO: 2816011 - DNA, 21 bp, Homo sapiens
catacatttataatgtttgct

SEQ ID NO: 2816012 - DNA, 19 bp, Homo sapiens
cataccatctgctgccccg

SEQ ID NO: 2816013 - DNA, 14 bp, Homo sapiens
catagatcttctga

SEQ ID NO: 2816014 - DNA, 16 bp, Homo sapiens
catagcagattttaat

SEQ ID NO: 2816015 - DNA, 18 bp, Homo sapiens
catagtatggtggctggg

SEQ ID NO: 2816016 - DNA, 14 bp, Homo sapiens
catagtcacaaaaa

SEQ ID NO: 2816017 - DNA, 18 bp, Homo sapiens
catagtgcacacttgtat

SEQ ID NO: 2816018 - DNA, 12 bp, Homo sapiens
catataaagtat

SEQ ID NO: 2816019 - DNA, 23 bp, Homo sapiens
catatatatgttttaagaggcag

SEQ ID NO: 2816020 - DNA, 15 bp, Homo sapiens
catatatattaaaat

SEQ ID NO: 2816021 - DNA, 17 bp, Homo sapiens
catatatgaggacttgt

SEQ ID NO: 2816022 - DNA, 14 bp, Homo sapiens
catatatgtatatg

SEQ ID NO: 2816023 - DNA, 12 bp, Homo sapiens
catatattcatg

SEQ ID NO: 2816024 - DNA, 19 bp, Homo sapiens
catatattcatgtaataaa

SEQ ID NO: 2816025 - DNA, 13 bp, Homo sapiens
catatcagaaaag

SEQ ID NO: 2816026 - DNA, 17 bp, Homo sapiens
catatcagaaaagtaga

SEQ ID NO: 2816027 - DNA, 18 bp, Homo sapiens
catatcagaaaagtagaa

SEQ ID NO: 2816028 - DNA, 22 bp, Homo sapiens
catatcagaaaagtagaattat

SEQ ID NO: 2816029 - DNA, 20 bp, Homo sapiens
catttatggtcaacacttaa

SEQ ID NO: 2816030 - DNA, 21 bp, Homo sapiens
catttatggtcaacacttaag

SEQ ID NO: 2816031 - DNA, 14 bp, Homo sapiens
catttatgtttatt

SEQ ID NO: 2816032 - DNA, 15 bp, Homo sapiens
catttattctgctca

SEQ ID NO: 2816033 - DNA, 22 bp, Homo sapiens
catttattgcactcagcttttt

SEQ ID NO: 2816034 - DNA, 13 bp, Homo sapiens
catttcactttaa

SEQ ID NO: 2816035 - DNA, 17 bp, Homo sapiens
catttcatctatttctg

SEQ ID NO: 2816036 - DNA, 16 bp, Homo sapiens
catttcatctcattta

SEQ ID NO: 2816037 - DNA, 14 bp, Homo sapiens
catttcatttccta

SEQ ID NO: 2816038 - DNA, 19 bp, Homo sapiens
catttcctgagaccacaga

SEQ ID NO: 2816039 - DNA, 11 bp, Homo sapiens
catttccttgg

SEQ ID NO: 2816040 - DNA, 14 bp, Homo sapiens
catttccttggagg

SEQ ID NO: 2816041 - DNA, 23 bp, Homo sapiens
catttctatagccaaaaatagct

SEQ ID NO: 2816042 - DNA, 14 bp, Homo sapiens
catttctatttatt

SEQ ID NO: 2816043 - DNA, 19 bp, Homo sapiens
catttcttttccaaaatta

SEQ ID NO: 2816044 - DNA, 21 bp, Homo sapiens
catttgaataaagcctgcttt

SEQ ID NO: 2816045 - DNA, 20 bp, Homo sapiens
catttgatgtacatgtgtag

SEQ ID NO: 2816046 - DNA, 20 bp, Homo sapiens
catttgctaactagcttgga

SEQ ID NO: 2816047 - DNA, 23 bp, Homo sapiens
catttggtatattacctcaaatt

SEQ ID NO: 2816048 - DNA, 15 bp, Homo sapiens
catttgtaatgtatc

SEQ ID NO: 2816049 - DNA, 22 bp, Homo sapiens
catttgtaatgtatcttattta

SEQ ID NO: 2816050 - DNA, 15 bp, Homo sapiens
catttgtacattcct

SEQ ID NO: 2816051 - DNA, 16 bp, Homo sapiens
catttgttggaatgaa

SEQ ID NO: 2816052 - DNA, 12 bp, Homo sapiens
cattttaataaa

SEQ ID NO: 2816053 - DNA, 17 bp, Homo sapiens
cattttaattattattc

SEQ ID NO: 2816054 - DNA, 16 bp, Homo sapiens
cattttactacttgtt

SEQ ID NO: 2816055 - DNA, 15 bp, Homo sapiens
cattttactgtctgt

SEQ ID NO: 2816056 - DNA, 16 bp, Homo sapiens
cattttactgtctgta

SEQ ID NO: 2816057 - DNA, 18 bp, Homo sapiens
cattttagttcctttatt

SEQ ID NO: 2816058 - DNA, 15 bp, Homo sapiens
cattttatattagaa

SEQ ID NO: 2816059 - DNA, 11 bp, Homo sapiens
cattttattac

SEQ ID NO: 2816060 - DNA, 21 bp, Homo sapiens
cattttatttattagctgtaa

SEQ ID NO: 2816061 - DNA, 17 bp, Homo sapiens
cattttgagtgactcga

SEQ ID NO: 2816062 - DNA, 20 bp, Homo sapiens
cattttgagtgactcgaggg

SEQ ID NO: 2816063 - DNA, 15 bp, Homo sapiens
cattttgcaaaattt

SEQ ID NO: 2816064 - DNA, 15 bp, Homo sapiens
cattttgcagcagtg

SEQ ID NO: 2816065 - DNA, 18 bp, Homo sapiens
cattttgcagcagtgagt

SEQ ID NO: 2816066 - DNA, 22 bp, Homo sapiens
cattttgcagcagtgagtctct

SEQ ID NO: 2816067 - DNA, 19 bp, Homo sapiens
cattttgcattagacagat

SEQ ID NO: 2816068 - DNA, 23 bp, Homo sapiens
catttttactactattctgttaa

SEQ ID NO: 2816069 - DNA, 16 bp, Homo sapiens
catttttccgtaaaaa

SEQ ID NO: 2816070 - DNA, 13 bp, Homo sapiens
catttttgagcca

SEQ ID NO: 2816071 - DNA, 19 bp, Homo sapiens
ccaaaaaaaaatacatgct

SEQ ID NO: 2816072 - DNA, 14 bp, Homo sapiens
catgctgcctccag

SEQ ID NO: 2816073 - DNA, 14 bp, Homo sapiens
catgcttcttgccc

SEQ ID NO: 2816074 - DNA, 23 bp, Homo sapiens
catggaatgtaactatatcatcc

SEQ ID NO: 2816075 - DNA, 14 bp, Homo sapiens
catggacacccctt

SEQ ID NO: 2816076 - DNA, 21 bp, Homo sapiens
catggacaccccttatccagg

SEQ ID NO: 2816077 - DNA, 22 bp, Homo sapiens
catggacaccccttatccagga

SEQ ID NO: 2816078 - DNA, 15 bp, Homo sapiens
catggacagaagaag

SEQ ID NO: 2816079 - DNA, 19 bp, Homo sapiens
catggacgttcggggcatg

SEQ ID NO: 2816080 - DNA, 11 bp, Homo sapiens
catggagaaac

SEQ ID NO: 2816081 - DNA, 16 bp, Homo sapiens
catggagaaaccctgt

SEQ ID NO: 2816082 - DNA, 21 bp, Homo sapiens
catggagaagttgccaagagt

SEQ ID NO: 2816083 - DNA, 15 bp, Homo sapiens
catggagactcctgc

SEQ ID NO: 2816084 - DNA, 16 bp, Homo sapiens
catggagactcctgcc

SEQ ID NO: 2816085 - DNA, 21 bp, Homo sapiens
catggagactcctgccctgtt

SEQ ID NO: 2816086 - DNA, 14 bp, Homo sapiens
catggagtgagcag

SEQ ID NO: 2816087 - DNA, 23 bp, Homo sapiens
catggcagatgtaggagggactg

SEQ ID NO: 2816088 - DNA, 22 bp, Homo sapiens
catggccacttgggtcttccct

SEQ ID NO: 2816089 - DNA, 18 bp, Homo sapiens
catggcccaaatccagtg

SEQ ID NO: 2816090 - DNA, 14 bp, Homo sapiens
catggctaactggc

SEQ ID NO: 2816091 - DNA, 16 bp, Homo sapiens
catggctaactggcga

SEQ ID NO: 2816092 - DNA, 14 bp, Homo sapiens
catggctattttat

SEQ ID NO: 2816093 - DNA, 17 bp, Homo sapiens
catgggcctcctgtgtg

SEQ ID NO: 2816094 - DNA, 17 bp, Homo sapiens
catgggtgtgccaggct

SEQ ID NO: 2816095 - DNA, 17 bp, Homo sapiens
catggtcccacatccct

SEQ ID NO: 2816096 - DNA, 17 bp, Homo sapiens
catggtccggtgtcctt

SEQ ID NO: 2816097 - DNA, 12 bp, Homo sapiens
catggtggcgca

SEQ ID NO: 2816098 - DNA, 20 bp, Homo sapiens
catggtggcgcaagcctgta

SEQ ID NO: 2816099 - DNA, 14 bp, Homo sapiens
catgtaaaagagtc

SEQ ID NO: 2816100 - DNA, 17 bp, Homo sapiens
catgtaaaatgcagtcc

SEQ ID NO: 2816101 - DNA, 20 bp, Homo sapiens
catgtaaaatgcagtccaga

SEQ ID NO: 2816102 - DNA, 16 bp, Homo sapiens
catgtaataaatctga

SEQ ID NO: 2816103 - DNA, 21 bp, Homo sapiens
catgtacaaaatcgattggct

SEQ ID NO: 2816104 - DNA, 23 bp, Homo sapiens
catgtacaaaatcgattggcttt

SEQ ID NO: 2816105 - DNA, 16 bp, Homo sapiens
catgtacagcatgcat

SEQ ID NO: 2816106 - DNA, 20 bp, Homo sapiens
catgtaccagtgtactgctt

SEQ ID NO: 2816107 - DNA, 17 bp, Homo sapiens
catgtaccatcaataaa

SEQ ID NO: 2816108 - DNA, 19 bp, Homo sapiens
catgtactgagccttgtaa

SEQ ID NO: 2816109 - DNA, 23 bp, Homo sapiens
catgtactgagccttgtaattct

SEQ ID NO: 2816110 - DNA, 20 bp, Homo sapiens
catgtataatatttttaatt

SEQ ID NO: 2816111 - DNA, 13 bp, Homo sapiens
catgtatagtgag

SEQ ID NO: 2816112 - DNA, 21 bp, Homo sapiens
catgtatcccaactcctataa

SEQ ID NO: 2816113 - DNA, 20 bp, Homo sapiens
catgtatctatgcattttct

SEQ ID NO: 2816114 - DNA, 13 bp, Homo sapiens
catgtatgtcttg

SEQ ID NO: 2816115 - DNA, 17 bp, Homo sapiens
catgtatgtcttggaca

SEQ ID NO: 2816116 - DNA, 14 bp, Homo sapiens
catgtattcacaca

SEQ ID NO: 2816117 - DNA, 21 bp, Homo sapiens
catgtattcacacacccctca

SEQ ID NO: 2816118 - DNA, 15 bp, Homo sapiens
catgtcaaacaaata

SEQ ID NO: 2816119 - DNA, 22 bp, Homo sapiens
catgtcaccgtggaccttcctg

SEQ ID NO: 2816120 - DNA, 15 bp, Homo sapiens
catgtcactcccaga

SEQ ID NO: 2816121 - DNA, 20 bp, Homo sapiens
catgtcggagtagaaattgt

SEQ ID NO: 2816122 - DNA, 12 bp, Homo sapiens
catgtctggcta

SEQ ID NO: 2816123 - DNA, 15 bp, Homo sapiens
catgtcttgtacatg

SEQ ID NO: 2816124 - DNA, 17 bp, Homo sapiens
catgtcttgtacatgtg

SEQ ID NO: 2816125 - DNA, 22 bp, Homo sapiens
catgtgaattctgtgaagaatg

SEQ ID NO: 2816126 - DNA, 12 bp, Homo sapiens
catgtgatcctt

SEQ ID NO: 2816127 - DNA, 18 bp, Homo sapiens
catgtgatccttttatgt

SEQ ID NO: 2816128 - DNA, 22 bp, Homo sapiens
catgtgatccttttatgttatt

SEQ ID NO: 2816129 - DNA, 21 bp, Homo sapiens
catgtgccaggtttttggtct

SEQ ID NO: 2816130 - DNA, 17 bp, Homo sapiens
catgtggaatataaaga

SEQ ID NO: 2816131 - DNA, 17 bp, Homo sapiens
catgtggggaagcaaga

SEQ ID NO: 2816132 - DNA, 18 bp, Homo sapiens
catgtgtagattgcgtgg

SEQ ID NO: 2816133 - DNA, 19 bp, Homo sapiens
catgtgtagattgcgtgga

SEQ ID NO: 2816134 - DNA, 14 bp, Homo sapiens
catgtgttgaaaaa

SEQ ID NO: 2816135 - DNA, 22 bp, Homo sapiens
catgttaaagaggcgtcttgta

SEQ ID NO: 2816136 - DNA, 17 bp, Homo sapiens
catgttacctcctataa

SEQ ID NO: 2816137 - DNA, 14 bp, Homo sapiens
catgttaggaaaat

SEQ ID NO: 2816138 - DNA, 14 bp, Homo sapiens
catgttatttgtaa

SEQ ID NO: 2816139 - DNA, 16 bp, Homo sapiens
catgttcttgcagtca

SEQ ID NO: 2816140 - DNA, 19 bp, Homo sapiens
catgttggccaggctggtc

SEQ ID NO: 2816141 - DNA, 20 bp, Homo sapiens
catgtttgagctcagacccc

SEQ ID NO: 2816142 - DNA, 22 bp, Homo sapiens
cattaaaaatgcatatacttta

SEQ ID NO: 2816143 - DNA, 18 bp, Homo sapiens
cattaaagcatttacttt

SEQ ID NO: 2816144 - DNA, 14 bp, Homo sapiens
cattaaattttcta

SEQ ID NO: 2816145 - DNA, 18 bp, Homo sapiens
cattaattctactaaata

SEQ ID NO: 2816146 - DNA, 13 bp, Homo sapiens
cattacgtgagcc

SEQ ID NO: 2816147 - DNA, 17 bp, Homo sapiens
cattacgtgagccaggt

SEQ ID NO: 2816148 - DNA, 13 bp, Homo sapiens
cattactgcatgc

SEQ ID NO: 2816149 - DNA, 17 bp, Homo sapiens
cattactgcctttggaa

SEQ ID NO: 2816150 - DNA, 15 bp, Homo sapiens
cattacttgcacaag

SEQ ID NO: 2816151 - DNA, 17 bp, Homo sapiens
cattagaaatagacagt

SEQ ID NO: 2816152 - DNA, 16 bp, Homo sapiens
cattagactggaactt

SEQ ID NO: 2816153 - DNA, 23 bp, Homo sapiens
cattaggaacagagtatatatgt

SEQ ID NO: 2816154 - DNA, 18 bp, Homo sapiens
cattataactgaaggaga

SEQ ID NO: 2816155 - DNA, 17 bp, Homo sapiens
cattatcgggagcagtg

SEQ ID NO: 2816156 - DNA, 21 bp, Homo sapiens
cattatcgggagcagtgtctt

SEQ ID NO: 2816157 - DNA, 23 bp, Homo sapiens
cattatcgggagcagtgtcttcc

SEQ ID NO: 2816158 - DNA, 23 bp, Homo sapiens
cattatgatgtgggtcaaggaat

SEQ ID NO: 2816159 - DNA, 14 bp, Homo sapiens
cattatttgcatgt

SEQ ID NO: 2816160 - DNA, 13 bp, Homo sapiens
cattcaatgttta

SEQ ID NO: 2816161 - DNA, 14 bp, Homo sapiens
cattcacagagcct

SEQ ID NO: 2816162 - DNA, 17 bp, Homo sapiens
caggcccggctccaggc

SEQ ID NO: 2816163 - DNA, 18 bp, Homo sapiens
caggcccggctccaggct

SEQ ID NO: 2816164 - DNA, 19 bp, Homo sapiens
caggccgggcttgggccct

SEQ ID NO: 2816165 - DNA, 20 bp, Homo sapiens
caggcctgcctgttcccatt

SEQ ID NO: 2816166 - DNA, 19 bp, Homo sapiens
caggcctgtgtagctgtga

SEQ ID NO: 2816167 - DNA, 23 bp, Homo sapiens
caggcctgtgtagctgtgacctg

SEQ ID NO: 2816168 - DNA, 21 bp, Homo sapiens
caggcgcggtggctcacgcct

SEQ ID NO: 2816169 - DNA, 15 bp, Homo sapiens
caggcggggtgctgt

SEQ ID NO: 2816170 - DNA, 17 bp, Homo sapiens
caggcggggtgctgtgg

SEQ ID NO: 2816171 - DNA, 14 bp, Homo sapiens
caggctactctcct

SEQ ID NO: 2816172 - DNA, 20 bp, Homo sapiens
caggctcctttagcgcccag

SEQ ID NO: 2816173 - DNA, 21 bp, Homo sapiens
caggctcctttagcgcccagt

SEQ ID NO: 2816174 - DNA, 16 bp, Homo sapiens
caggctgatttctagg

SEQ ID NO: 2816175 - DNA, 19 bp, Homo sapiens
caggctggcgtgcagtggt

SEQ ID NO: 2816176 - DNA, 22 bp, Homo sapiens
caggctgggcttcagtggcagc

SEQ ID NO: 2816177 - DNA, 19 bp, Homo sapiens
caggctggtctcaaactct

SEQ ID NO: 2816178 - DNA, 14 bp, Homo sapiens
caggctgtatccca

SEQ ID NO: 2816179 - DNA, 21 bp, Homo sapiens
caggctgtatcccatgagcct

SEQ ID NO: 2816180 - DNA, 22 bp, Homo sapiens
caggctgtatcccatgagcctc

SEQ ID NO: 2816181 - DNA, 23 bp, Homo sapiens
caggctgtatcccatgagcctca

SEQ ID NO: 2816182 - DNA, 15 bp, Homo sapiens
caggctgtttctttt

SEQ ID NO: 2816183 - DNA, 14 bp, Homo sapiens
caggcttccttggc

SEQ ID NO: 2816184 - DNA, 21 bp, Homo sapiens
caggcttgtcactagcagctg

SEQ ID NO: 2816185 - DNA, 22 bp, Homo sapiens
cagggaaacagctaatgggaca

SEQ ID NO: 2816186 - DNA, 23 bp, Homo sapiens
cagggaaaggctctgaaagccag

SEQ ID NO: 2816187 - DNA, 19 bp, Homo sapiens
cagggaaccctgcttgcac

SEQ ID NO: 2816188 - DNA, 17 bp, Homo sapiens
cagggaaggcaggcagg

SEQ ID NO: 2816189 - DNA, 20 bp, Homo sapiens
cagggaaggcaggcagggct

SEQ ID NO: 2816190 - DNA, 23 bp, Homo sapiens
cagggaaggcaggcagggctctc

SEQ ID NO: 2816191 - DNA, 17 bp, Homo sapiens
cagggacagagacacct

SEQ ID NO: 2816192 - DNA, 19 bp, Homo sapiens
cagggagaccgagcgcttt

SEQ ID NO: 2816193 - DNA, 18 bp, Homo sapiens
cagggaggaggtggcagc

SEQ ID NO: 2816194 - DNA, 12 bp, Homo sapiens
cagggaggggac

SEQ ID NO: 2816195 - DNA, 16 bp, Homo sapiens
cagggaggtcattttg

SEQ ID NO: 2816196 - DNA, 18 bp, Homo sapiens
cagggaggtgaccccagg

SEQ ID NO: 2816197 - DNA, 22 bp, Homo sapiens
cagggagtccgaaagggacttg

SEQ ID NO: 2816198 - DNA, 18 bp, Homo sapiens
cagggcaactcggagagg

SEQ ID NO: 2816199 - DNA, 16 bp, Homo sapiens
cagggcacaggagcta

SEQ ID NO: 2816200 - DNA, 20 bp, Homo sapiens
cagggcacaggagctacctg

SEQ ID NO: 2816201 - DNA, 12 bp, Homo sapiens
cagggcagagcc

SEQ ID NO: 2816202 - DNA, 17 bp, Homo sapiens
cagggccacgtgccagg

SEQ ID NO: 2816203 - DNA, 13 bp, Homo sapiens
cagggccagggcc

SEQ ID NO: 2816204 - DNA, 16 bp, Homo sapiens
cagggccagggccctg

SEQ ID NO: 2816205 - DNA, 13 bp, Homo sapiens
cagggccccagaa

SEQ ID NO: 2816206 - DNA, 15 bp, Homo sapiens
cagggccccagaagg

SEQ ID NO: 2816207 - DNA, 21 bp, Homo sapiens
cagggccccagaaggcaggga

SEQ ID NO: 2816208 - DNA, 14 bp, Homo sapiens
cagggccccagcac

SEQ ID NO: 2816209 - DNA, 16 bp, Homo sapiens
cagggcccctgttccc

SEQ ID NO: 2816210 - DNA, 13 bp, Homo sapiens
cagggccctgcag

SEQ ID NO: 2816211 - DNA, 20 bp, Homo sapiens
cagggccggggaactggcca

SEQ ID NO: 2816212 - DNA, 17 bp, Homo sapiens
cagggctaccctccccc

SEQ ID NO: 2816213 - DNA, 18 bp, Homo sapiens
cagggctgcccctgtagg

SEQ ID NO: 2816214 - DNA, 19 bp, Homo sapiens
cagggctggaaaagtcaca

SEQ ID NO: 2816215 - DNA, 17 bp, Homo sapiens
caggggagagggtctgg

SEQ ID NO: 2816216 - DNA, 21 bp, Homo sapiens
caggggagagggtctggagaa

SEQ ID NO: 2816217 - DNA, 17 bp, Homo sapiens
caggggcctcaggggag

SEQ ID NO: 2816218 - DNA, 19 bp, Homo sapiens
caggggggttgtgaggcct

SEQ ID NO: 2816219 - DNA, 16 bp, Homo sapiens
cagggggtgtgtctgc

SEQ ID NO: 2816220 - DNA, 20 bp, Homo sapiens
caggggtgatttcagagagg

SEQ ID NO: 2816221 - DNA, 15 bp, Homo sapiens
caggggtgggagagc

SEQ ID NO: 2816222 - DNA, 17 bp, Homo sapiens
caggggtgggagagcca

SEQ ID NO: 2816223 - DNA, 23 bp, Homo sapiens
cagggtagataacctgtacttca

SEQ ID NO: 2816224 - DNA, 14 bp, Homo sapiens
cagggtcaggagag

SEQ ID NO: 2816225 - DNA, 14 bp, Homo sapiens
cagggtccagaccc

SEQ ID NO: 2816226 - DNA, 18 bp, Homo sapiens
cagggtctcactctgtcg

SEQ ID NO: 2816227 - DNA, 21 bp, Homo sapiens
cagggtctcactctgtcgccc

SEQ ID NO: 2816228 - DNA, 22 bp, Homo sapiens
cagggtctcactctgtcgccca

SEQ ID NO: 2816229 - DNA, 18 bp, Homo sapiens
cagggttgatcacactct

SEQ ID NO: 2816230 - DNA, 21 bp, Homo sapiens
cagggttggcccctgcccggc

SEQ ID NO: 2816231 - DNA, 14 bp, Homo sapiens
caggtaacaggcag

SEQ ID NO: 2816232 - DNA, 20 bp, Homo sapiens
caggtaacaggcagatacag

SEQ ID NO: 2816233 - DNA, 15 bp, Homo sapiens
caggtaatgagggac

SEQ ID NO: 2816234 - DNA, 23 bp, Homo sapiens
caggtacagcaacaggaatctca

SEQ ID NO: 2816235 - DNA, 14 bp, Homo sapiens
caggtaggaggcaa

SEQ ID NO: 2816236 - DNA, 23 bp, Homo sapiens
caggtaggaggcaaatatcttga

SEQ ID NO: 2816237 - DNA, 22 bp, Homo sapiens
caggtatctccaggattgaaga

SEQ ID NO: 2816238 - DNA, 20 bp, Homo sapiens
caggtcctcagagaatttct

SEQ ID NO: 2816239 - DNA, 20 bp, Homo sapiens
caggtcctcagtgtcctcag

SEQ ID NO: 2816240 - DNA, 23 bp, Homo sapiens
caggtcctggtggggcagctcct

SEQ ID NO: 2816241 - DNA, 15 bp, Homo sapiens
caggtctagactttc

SEQ ID NO: 2816242 - DNA, 15 bp, Homo sapiens
caggtctcctcttaa

SEQ ID NO: 2816243 - DNA, 17 bp, Homo sapiens
caggtctcctcttaaaa

SEQ ID NO: 2816244 - DNA, 22 bp, Homo sapiens
caggtctcctcttaaaaaataa

SEQ ID NO: 2816245 - DNA, 20 bp, Homo sapiens
caggtgatccacccacctca

SEQ ID NO: 2816246 - DNA, 13 bp, Homo sapiens
caggtgcagtggc

SEQ ID NO: 2816247 - DNA, 18 bp, Homo sapiens
caggtggatcacctgacg

SEQ ID NO: 2816248 - DNA, 16 bp, Homo sapiens
caggtggcaggaccag

SEQ ID NO: 2816249 - DNA, 21 bp, Homo sapiens
caggtggcaggaccaggacta

SEQ ID NO: 2816250 - DNA, 14 bp, Homo sapiens
caggtggctgaccc

SEQ ID NO: 2816251 - DNA, 12 bp, Homo sapiens
caggacacaggc

SEQ ID NO: 2816252 - DNA, 16 bp, Homo sapiens
caggacacaggcctgt

SEQ ID NO: 2816253 - DNA, 20 bp, Homo sapiens
caggacacaggcctgtgtag

SEQ ID NO: 2816254 - DNA, 15 bp, Homo sapiens
caggacacctggccg

SEQ ID NO: 2816255 - DNA, 18 bp, Homo sapiens
caggacacctggccgcct

SEQ ID NO: 2816256 - DNA, 20 bp, Homo sapiens
caggacagtgcttcagcctg

SEQ ID NO: 2816257 - DNA, 16 bp, Homo sapiens
caggaccccaacccct

SEQ ID NO: 2816258 - DNA, 20 bp, Homo sapiens
caggacctctggacctcagg

SEQ ID NO: 2816259 - DNA, 13 bp, Homo sapiens
caggacctggctt

SEQ ID NO: 2816260 - DNA, 16 bp, Homo sapiens
caggacgccactcatt

SEQ ID NO: 2816261 - DNA, 17 bp, Homo sapiens
caggactaacactcaga

SEQ ID NO: 2816262 - DNA, 23 bp, Homo sapiens
caggactaacactcagaagcctg

SEQ ID NO: 2816263 - DNA, 16 bp, Homo sapiens
caggactatagcccag

SEQ ID NO: 2816264 - DNA, 15 bp, Homo sapiens
caggactccccaggc

SEQ ID NO: 2816265 - DNA, 16 bp, Homo sapiens
caggactccccaggcc

SEQ ID NO: 2816266 - DNA, 19 bp, Homo sapiens
caggactccccaggccagg

SEQ ID NO: 2816267 - DNA, 12 bp, Homo sapiens
caggactctgcc

SEQ ID NO: 2816268 - DNA, 19 bp, Homo sapiens
caggacttctgcctgaacc

SEQ ID NO: 2816269 - DNA, 23 bp, Homo sapiens
caggagaaatgcatccattcctc

SEQ ID NO: 2816270 - DNA, 21 bp, Homo sapiens
caggagaagaaagaggtgacc

SEQ ID NO: 2816271 - DNA, 13 bp, Homo sapiens
caggagagccagc

SEQ ID NO: 2816272 - DNA, 23 bp, Homo sapiens
caggagagccagccctccctgtc

SEQ ID NO: 2816273 - DNA, 12 bp, Homo sapiens
caggagagggaa

SEQ ID NO: 2816274 - DNA, 16 bp, Homo sapiens
caggagcacaggcagc

SEQ ID NO: 2816275 - DNA, 23 bp, Homo sapiens
caggagcacaggcagctggatga

SEQ ID NO: 2816276 - DNA, 22 bp, Homo sapiens
caggagccccgaggccttctct

SEQ ID NO: 2816277 - DNA, 19 bp, Homo sapiens
caggaggattgatggtgct

SEQ ID NO: 2816278 - DNA, 12 bp, Homo sapiens
caggaggctgag

SEQ ID NO: 2816279 - DNA, 15 bp, Homo sapiens
caggaggctgaggca

SEQ ID NO: 2816280 - DNA, 20 bp, Homo sapiens
caggaggctgaggcagaaga

SEQ ID NO: 2816281 - DNA, 18 bp, Homo sapiens
caggagggacaaaggagc

SEQ ID NO: 2816282 - DNA, 20 bp, Homo sapiens
caggagggacaaaggagcct

SEQ ID NO: 2816283 - DNA, 18 bp, Homo sapiens
caggagggagagaactta

SEQ ID NO: 2816284 - DNA, 17 bp, Homo sapiens
caggagggcaagggcca

SEQ ID NO: 2816285 - DNA, 16 bp, Homo sapiens
caggagggggtcgtgg

SEQ ID NO: 2816286 - DNA, 23 bp, Homo sapiens
caggagggggtcgtggagagcta

SEQ ID NO: 2816287 - DNA, 18 bp, Homo sapiens
caggaggtggctatggcc

SEQ ID NO: 2816288 - DNA, 13 bp, Homo sapiens
caggagtagctga

SEQ ID NO: 2816289 - DNA, 17 bp, Homo sapiens
caggagtagctgagctc

SEQ ID NO: 2816290 - DNA, 18 bp, Homo sapiens
caggagtcccaaggaaag

SEQ ID NO: 2816291 - DNA, 14 bp, Homo sapiens
caggagtccctggt

SEQ ID NO: 2816292 - DNA, 20 bp, Homo sapiens
caggagtggccggggaagct

SEQ ID NO: 2816293 - DNA, 23 bp, Homo sapiens
caggagttcaataaatgtctgtt

SEQ ID NO: 2816294 - DNA, 17 bp, Homo sapiens
caggatactctgtcaga

SEQ ID NO: 2816295 - DNA, 23 bp, Homo sapiens
caggatactctgtcagatgggaa

SEQ ID NO: 2816296 - DNA, 20 bp, Homo sapiens
caggatcctattctcaccag

SEQ ID NO: 2816297 - DNA, 21 bp, Homo sapiens
caggatcctattctcaccagg

SEQ ID NO: 2816298 - DNA, 21 bp, Homo sapiens
caggattccaaagttttgaag

SEQ ID NO: 2816299 - DNA, 22 bp, Homo sapiens
caggattttaacaaaagcaaga

SEQ ID NO: 2816300 - DNA, 17 bp, Homo sapiens
caggcaaattggggagg

SEQ ID NO: 2816301 - DNA, 16 bp, Homo sapiens
caggcaactgaggcag

SEQ ID NO: 2816302 - DNA, 17 bp, Homo sapiens
caggcaactgaggcaga

SEQ ID NO: 2816303 - DNA, 18 bp, Homo sapiens
caggcaactgaggcagac

SEQ ID NO: 2816304 - DNA, 16 bp, Homo sapiens
caggcaagcacctcct

SEQ ID NO: 2816305 - DNA, 15 bp, Homo sapiens
caggcacacttcttc

SEQ ID NO: 2816306 - DNA, 19 bp, Homo sapiens
caggcaccaaaagaagtaa

SEQ ID NO: 2816307 - DNA, 17 bp, Homo sapiens
caggcaccccctggaga

SEQ ID NO: 2816308 - DNA, 18 bp, Homo sapiens
caggcaccccctggagag

SEQ ID NO: 2816309 - DNA, 16 bp, Homo sapiens
caggcacgaacccacc

SEQ ID NO: 2816310 - DNA, 15 bp, Homo sapiens
caggcacgtcccgga

SEQ ID NO: 2816311 - DNA, 23 bp, Homo sapiens
caggcagagaatcatacttagca

SEQ ID NO: 2816312 - DNA, 23 bp, Homo sapiens
caggcagagacaataaaacattc

SEQ ID NO: 2816313 - DNA, 16 bp, Homo sapiens
caggcagggctctcct

SEQ ID NO: 2816314 - DNA, 12 bp, Homo sapiens
caggcaggtctt

SEQ ID NO: 2816315 - DNA, 13 bp, Homo sapiens
caggcaggtcttg

SEQ ID NO: 2816316 - DNA, 17 bp, Homo sapiens
caggcatctacacagcc

SEQ ID NO: 2816317 - DNA, 20 bp, Homo sapiens
caggcatctacacagcctgg

SEQ ID NO: 2816318 - DNA, 23 bp, Homo sapiens
caggcatctacacagcctggact

SEQ ID NO: 2816319 - DNA, 19 bp, Homo sapiens
caggcatgttctctgagga

SEQ ID NO: 2816320 - DNA, 14 bp, Homo sapiens
caggcatttcctgg

SEQ ID NO: 2816321 - DNA, 16 bp, Homo sapiens
caggcatttcctgggt

SEQ ID NO: 2816322 - DNA, 23 bp, Homo sapiens
caggccaagagcagaggcagcga

SEQ ID NO: 2816323 - DNA, 15 bp, Homo sapiens
caggccaccaggatg

SEQ ID NO: 2816324 - DNA, 23 bp, Homo sapiens
caggccaccatattcagtgctgt

SEQ ID NO: 2816325 - DNA, 14 bp, Homo sapiens
caggccaggccacc

SEQ ID NO: 2816326 - DNA, 16 bp, Homo sapiens
caggccaggccaccag

SEQ ID NO: 2816327 - DNA, 15 bp, Homo sapiens
caggccaggtgcagt

SEQ ID NO: 2816328 - DNA, 19 bp, Homo sapiens
caggccaggttatgcctca

SEQ ID NO: 2816329 - DNA, 18 bp, Homo sapiens
caggcccaagagatgaag

SEQ ID NO: 2816330 - DNA, 17 bp, Homo sapiens
caggcccactgcagaga

SEQ ID NO: 2816331 - DNA, 12 bp, Homo sapiens
caggccccaagg

SEQ ID NO: 2816332 - DNA, 14 bp, Homo sapiens
caggccccatgacc

SEQ ID NO: 2816333 - DNA, 19 bp, Homo sapiens
caggccccatgacctccag

SEQ ID NO: 2816334 - DNA, 20 bp, Homo sapiens
caggccccatgacctccagc

SEQ ID NO: 2816335 - DNA, 21 bp, Homo sapiens
caggccccccgcagcaccctg

SEQ ID NO: 2816336 - DNA, 23 bp, Homo sapiens
caggcccccgctggctcctccag

SEQ ID NO: 2816337 - DNA, 18 bp, Homo sapiens
caggccccgcttgtccag

SEQ ID NO: 2816338 - DNA, 13 bp, Homo sapiens
caggcccctgcca

SEQ ID NO: 2816339 - DNA, 20 bp, Homo sapiens
caggcccctgccaccctggg

SEQ ID NO: 2816340 - DNA, 18 bp, Homo sapiens
caggcccggcgcggtggc

SEQ ID NO: 2816341 - DNA, 23 bp, Homo sapiens
cccctgggctctgccccagctct

SEQ ID NO: 2816342 - DNA, 18 bp, Homo sapiens
cccctggggcttctcctg

SEQ ID NO: 2816343 - DNA, 19 bp, Homo sapiens
cccctggggcttctcctga

SEQ ID NO: 2816344 - DNA, 23 bp, Homo sapiens
cccctggtggacagtcctgggag

SEQ ID NO: 2816345 - DNA, 24 bp, Homo sapiens
cccctgtgtgagttgagtctcctc

SEQ ID NO: 2816346 - DNA, 14 bp, Homo sapiens
ccccttatccagga

SEQ ID NO: 2816347 - DNA, 14 bp, Homo sapiens
ccccttcagtgccc

SEQ ID NO: 2816348 - DNA, 23 bp, Homo sapiens
ccccttcctttcctctgcagcac

SEQ ID NO: 2816349 - DNA, 14 bp, Homo sapiens
ccccttcgctcctg

SEQ ID NO: 2816350 - DNA, 21 bp, Homo sapiens
ccccttgcccagggctcagcc

SEQ ID NO: 2816351 - DNA, 23 bp, Homo sapiens
ccccttgcccagggctcagcctg

SEQ ID NO: 2816352 - DNA, 19 bp, Homo sapiens
ccccttggaggagggctgt

SEQ ID NO: 2816353 - DNA, 22 bp, Homo sapiens
cccgaatagctgggactacagg

SEQ ID NO: 2816354 - DNA, 16 bp, Homo sapiens
cccgactccagccagc

SEQ ID NO: 2816355 - DNA, 20 bp, Homo sapiens
cccgactccagccagcgcct

SEQ ID NO: 2816356 - DNA, 14 bp, Homo sapiens
cccgagtagctggg

SEQ ID NO: 2816357 - DNA, 15 bp, Homo sapiens
cccgagtagctggga

SEQ ID NO: 2816358 - DNA, 16 bp, Homo sapiens
cccgagtagctgggac

SEQ ID NO: 2816359 - DNA, 17 bp, Homo sapiens
cccgagtagctgggact

SEQ ID NO: 2816360 - DNA, 21 bp, Homo sapiens
cccgagtagctgggactacag

SEQ ID NO: 2816361 - DNA, 19 bp, Homo sapiens
cccgcagcaccctgcagag

SEQ ID NO: 2816362 - DNA, 18 bp, Homo sapiens
cccgctggctcctccagg

SEQ ID NO: 2816363 - DNA, 12 bp, Homo sapiens
cccgcttcccca

SEQ ID NO: 2816364 - DNA, 16 bp, Homo sapiens
cccgcttccccacaga

SEQ ID NO: 2816365 - DNA, 19 bp, Homo sapiens
cccgcttccccacagaact

SEQ ID NO: 2816366 - DNA, 15 bp, Homo sapiens
cccgctttgcctgct

SEQ ID NO: 2816367 - DNA, 20 bp, Homo sapiens
cccgctttgcctgcttgaag

SEQ ID NO: 2816368 - DNA, 14 bp, Homo sapiens
cccggattctggga

SEQ ID NO: 2816369 - DNA, 16 bp, Homo sapiens
cccggcaccccctgca

SEQ ID NO: 2816370 - DNA, 22 bp, Homo sapiens
cccggcccagagaccccttcct

SEQ ID NO: 2816371 - DNA, 14 bp, Homo sapiens
cccggcgcggtggc

SEQ ID NO: 2816372 - DNA, 22 bp, Homo sapiens
cccggcgcggtggctcacgcct

SEQ ID NO: 2816373 - DNA, 12 bp, Homo sapiens
cccggctccagg

SEQ ID NO: 2816374 - DNA, 15 bp, Homo sapiens
cccggctccaggctc

SEQ ID NO: 2816375 - DNA, 14 bp, Homo sapiens
cccggctccccctg

SEQ ID NO: 2816376 - DNA, 12 bp, Homo sapiens
cccggctgcgga

SEQ ID NO: 2816377 - DNA, 23 bp, Homo sapiens
cccgggaggcggaggttccagtg

SEQ ID NO: 2816378 - DNA, 15 bp, Homo sapiens
cccgggcctgcctct

SEQ ID NO: 2816379 - DNA, 18 bp, Homo sapiens
cccgggtccccagctccc

SEQ ID NO: 2816380 - DNA, 18 bp, Homo sapiens
cccggtcctggccccagc

SEQ ID NO: 2816381 - DNA, 16 bp, Homo sapiens
cccggtgtggtggctc

SEQ ID NO: 2816382 - DNA, 22 bp, Homo sapiens
cccgtacccccgtggtctttga

SEQ ID NO: 2816383 - DNA, 16 bp, Homo sapiens
cccgtcttcagcctag

SEQ ID NO: 2816384 - DNA, 22 bp, Homo sapiens
cccgtgaatgcttacctgtgag

SEQ ID NO: 2816385 - DNA, 21 bp, Homo sapiens
cccgtgccaagtccaggtcct

SEQ ID NO: 2816386 - DNA, 12 bp, Homo sapiens
cccgtggtcttt

SEQ ID NO: 2816387 - DNA, 15 bp, Homo sapiens
cccgtggtctttgaa

SEQ ID NO: 2816388 - DNA, 14 bp, Homo sapiens
cccgttcaccttct

SEQ ID NO: 2816389 - DNA, 11 bp, Homo sapiens
ccctaaaataa

SEQ ID NO: 2816390 - DNA, 14 bp, Homo sapiens
ccctaccccaccac

SEQ ID NO: 2816391 - DNA, 14 bp, Homo sapiens
ccctacctgtgcct

SEQ ID NO: 2816392 - DNA, 14 bp, Homo sapiens
ccctactgagaaac

SEQ ID NO: 2816393 - DNA, 22 bp, Homo sapiens
ccctagtggcttcctccgtctg

SEQ ID NO: 2816394 - DNA, 19 bp, Homo sapiens
ccctcaaatgacccaaaga

SEQ ID NO: 2816395 - DNA, 18 bp, Homo sapiens
ccctcactccacactggc

SEQ ID NO: 2816396 - DNA, 13 bp, Homo sapiens
ccctcagccttga

SEQ ID NO: 2816397 - DNA, 12 bp, Homo sapiens
ccctcagggatc

SEQ ID NO: 2816398 - DNA, 17 bp, Homo sapiens
ccctcagtgctcggcag

SEQ ID NO: 2816399 - DNA, 16 bp, Homo sapiens
ccctcattcaggaaaa

SEQ ID NO: 2816400 - DNA, 13 bp, Homo sapiens
ccctcattcccct

SEQ ID NO: 2816401 - DNA, 15 bp, Homo sapiens
ccctccaggcatgct

SEQ ID NO: 2816402 - DNA, 19 bp, Homo sapiens
ccctccaggcatgctggcc

SEQ ID NO: 2816403 - DNA, 22 bp, Homo sapiens
ccctccaggcatgctggcctcc

SEQ ID NO: 2816404 - DNA, 17 bp, Homo sapiens
ccctccatgtgggctag

SEQ ID NO: 2816405 - DNA, 16 bp, Homo sapiens
ccctcccacccccagc

SEQ ID NO: 2816406 - DNA, 17 bp, Homo sapiens
ccctcccacccccagcc

SEQ ID NO: 2816407 - DNA, 13 bp, Homo sapiens
ccctccccagggg

SEQ ID NO: 2816408 - DNA, 16 bp, Homo sapiens
ccctccccgcaccccc

SEQ ID NO: 2816409 - DNA, 17 bp, Homo sapiens
ccctccccgcacccccc

SEQ ID NO: 2816410 - DNA, 11 bp, Homo sapiens
ccctccctgtc

SEQ ID NO: 2816411 - DNA, 13 bp, Homo sapiens
ccctccctgtcct

SEQ ID NO: 2816412 - DNA, 21 bp, Homo sapiens
ccctccgccttcactccggtg

SEQ ID NO: 2816413 - DNA, 13 bp, Homo sapiens
ccctcctcacccc

SEQ ID NO: 2816414 - DNA, 14 bp, Homo sapiens
ccctcctcaccccg

SEQ ID NO: 2816415 - DNA, 11 bp, Homo sapiens
ccctcctctgc

SEQ ID NO: 2816416 - DNA, 11 bp, Homo sapiens
cccttcatttg

SEQ ID NO: 2816417 - DNA, 18 bp, Homo sapiens
cccttcctggacagctgt

SEQ ID NO: 2816418 - DNA, 19 bp, Homo sapiens
cccttcctggacagctgtg

SEQ ID NO: 2816419 - DNA, 23 bp, Homo sapiens
cccttcctggacagctgtgcctc

SEQ ID NO: 2816420 - DNA, 15 bp, Homo sapiens
cccttcctttcctct

SEQ ID NO: 2816421 - DNA, 16 bp, Homo sapiens
cccttcctttcctctg

SEQ ID NO: 2816422 - DNA, 11 bp, Homo sapiens
cccttcttttt

SEQ ID NO: 2816423 - DNA, 19 bp, Homo sapiens
cccttctttttcttctttt

SEQ ID NO: 2816424 - DNA, 21 bp, Homo sapiens
cccttgaactgttctggcctc

SEQ ID NO: 2816425 - DNA, 21 bp, Homo sapiens
cccttgaagaggggaggggcc

SEQ ID NO: 2816426 - DNA, 22 bp, Homo sapiens
cccttgagaaaccttattgtac

SEQ ID NO: 2816427 - DNA, 14 bp, Homo sapiens
ccatgtagacccct

SEQ ID NO: 2816428 - DNA, 16 bp, Homo sapiens
ccatgtattcacacac

SEQ ID NO: 2816429 - DNA, 18 bp, Homo sapiens
ccatgtattcacacaccc

SEQ ID NO: 2816430 - DNA, 12 bp, Homo sapiens
ccatgtcgcctc

SEQ ID NO: 2816431 - DNA, 14 bp, Homo sapiens
ccatgtcgcctgcc

SEQ ID NO: 2816432 - DNA, 21 bp, Homo sapiens
ccatgttggccaggctggtct

SEQ ID NO: 2816433 - DNA, 21 bp, Homo sapiens
ccatgtttgagctcagacccc

SEQ ID NO: 2816434 - DNA, 16 bp, Homo sapiens
ccattcacagagcctt

SEQ ID NO: 2816435 - DNA, 13 bp, Homo sapiens
ccattcctcaggg

SEQ ID NO: 2816436 - DNA, 19 bp, Homo sapiens
ccattctctctcctgtcca

SEQ ID NO: 2816437 - DNA, 17 bp, Homo sapiens
ccattctgaccatttca

SEQ ID NO: 2816438 - DNA, 15 bp, Homo sapiens
ccattctgcctgccc

SEQ ID NO: 2816439 - DNA, 16 bp, Homo sapiens
ccattctgcctgccca

SEQ ID NO: 2816440 - DNA, 20 bp, Homo sapiens
ccattcttcctagttttctc

SEQ ID NO: 2816441 - DNA, 15 bp, Homo sapiens
ccattcttgtcctgg

SEQ ID NO: 2816442 - DNA, 13 bp, Homo sapiens
ccatttcagagag

SEQ ID NO: 2816443 - DNA, 17 bp, Homo sapiens
ccatttctatttattta

SEQ ID NO: 2816444 - DNA, 16 bp, Homo sapiens
ccatttcttcctcact

SEQ ID NO: 2816445 - DNA, 16 bp, Homo sapiens
ccatttgctttttcac

SEQ ID NO: 2816446 - DNA, 20 bp, Homo sapiens
ccattttggggtacccactg

SEQ ID NO: 2816447 - DNA, 22 bp, Homo sapiens
ccattttggggtacccactgct

SEQ ID NO: 2816448 - DNA, 20 bp, Homo sapiens
ccatttttactaaagcagtg

SEQ ID NO: 2816449 - DNA, 22 bp, Homo sapiens
ccatttttactaaagcagtgtt

SEQ ID NO: 2816450 - DNA, 16 bp, Homo sapiens
cccaaaacctcatgac

SEQ ID NO: 2816451 - DNA, 18 bp, Homo sapiens
cccaaagagcctggagaa

SEQ ID NO: 2816452 - DNA, 13 bp, Homo sapiens
cccaaagtgctgg

SEQ ID NO: 2816453 - DNA, 19 bp, Homo sapiens
cccaaataaatgtgtaaat

SEQ ID NO: 2816454 - DNA, 23 bp, Homo sapiens
cccaacccgtggaggctgctcgg

SEQ ID NO: 2816455 - DNA, 16 bp, Homo sapiens
cccaacctcctgacct

SEQ ID NO: 2816456 - DNA, 13 bp, Homo sapiens
cccaacctgctct

SEQ ID NO: 2816457 - DNA, 14 bp, Homo sapiens
cccaacctgctctc

SEQ ID NO: 2816458 - DNA, 23 bp, Homo sapiens
cccaacctgctctcctcttgcca

SEQ ID NO: 2816459 - DNA, 12 bp, Homo sapiens
cccaactcctgg

SEQ ID NO: 2816460 - DNA, 23 bp, Homo sapiens
cccaactcctggaagctgtgtcc

SEQ ID NO: 2816461 - DNA, 15 bp, Homo sapiens
cccaagagatgaaga

SEQ ID NO: 2816462 - DNA, 12 bp, Homo sapiens
cccaagagggct

SEQ ID NO: 2816463 - DNA, 13 bp, Homo sapiens
cccaagctctgct

SEQ ID NO: 2816464 - DNA, 15 bp, Homo sapiens
cccaagctctgctcc

SEQ ID NO: 2816465 - DNA, 19 bp, Homo sapiens
cccaaggaaagccccagca

SEQ ID NO: 2816466 - DNA, 22 bp, Homo sapiens
cccaaggaaagccccagcacta

SEQ ID NO: 2816467 - DNA, 14 bp, Homo sapiens
cccaaggctgctca

SEQ ID NO: 2816468 - DNA, 22 bp, Homo sapiens
cccaagtagtagtgtcttccta

SEQ ID NO: 2816469 - DNA, 12 bp, Homo sapiens
cccaataaaagt

SEQ ID NO: 2816470 - DNA, 14 bp, Homo sapiens
cccaataaagctgg

SEQ ID NO: 2816471 - DNA, 15 bp, Homo sapiens
cccaataaagctgga

SEQ ID NO: 2816472 - DNA, 16 bp, Homo sapiens
cccaataaagctggac

SEQ ID NO: 2816473 - DNA, 12 bp, Homo sapiens
cccaatattata

SEQ ID NO: 2816474 - DNA, 18 bp, Homo sapiens
cccacactcccccagact

SEQ ID NO: 2816475 - DNA, 17 bp, Homo sapiens
cccacagcctctgcctg

SEQ ID NO: 2816476 - DNA, 13 bp, Homo sapiens
cccacaggatcag

SEQ ID NO: 2816477 - DNA, 13 bp, Homo sapiens
cccacatcccagg

SEQ ID NO: 2816478 - DNA, 14 bp, Homo sapiens
cccacatcccaggc

SEQ ID NO: 2816479 - DNA, 20 bp, Homo sapiens
cccacatcccaggcttcacc

SEQ ID NO: 2816480 - DNA, 20 bp, Homo sapiens
cccacatccctgggcctgct

SEQ ID NO: 2816481 - DNA, 14 bp, Homo sapiens
cccaccacactgaa

SEQ ID NO: 2816482 - DNA, 13 bp, Homo sapiens
cccaccacctagg

SEQ ID NO: 2816483 - DNA, 21 bp, Homo sapiens
cccaccacctaggccactcct

SEQ ID NO: 2816484 - DNA, 23 bp, Homo sapiens
cccaccaccttggactcctccca

SEQ ID NO: 2816485 - DNA, 11 bp, Homo sapiens
cccaccagcct

SEQ ID NO: 2816486 - DNA, 16 bp, Homo sapiens
cccaccagcctaagaa

SEQ ID NO: 2816487 - DNA, 19 bp, Homo sapiens
cccaccccctccccagggg

SEQ ID NO: 2816488 - DNA, 23 bp, Homo sapiens
cccaccgggctgggagctctgca

SEQ ID NO: 2816489 - DNA, 14 bp, Homo sapiens
cccacctcagcctc

SEQ ID NO: 2816490 - DNA, 20 bp, Homo sapiens
cccacctcatgcctggcccc

SEQ ID NO: 2816491 - DNA, 23 bp, Homo sapiens
cccacctcatgcctggcccccct

SEQ ID NO: 2816492 - DNA, 17 bp, Homo sapiens
cccacctccgccccaga

SEQ ID NO: 2816493 - DNA, 16 bp, Homo sapiens
cccacctccgctggga

SEQ ID NO: 2816494 - DNA, 12 bp, Homo sapiens
cccacctgctga

SEQ ID NO: 2816495 - DNA, 17 bp, Homo sapiens
cccaccttggctgcagg

SEQ ID NO: 2816496 - DNA, 19 bp, Homo sapiens
cccaccttggctgcaggga

SEQ ID NO: 2816497 - DNA, 19 bp, Homo sapiens
cccacgctggagtgcagtg

SEQ ID NO: 2816498 - DNA, 22 bp, Homo sapiens
cccacggatgttgtcaggaatc

SEQ ID NO: 2816499 - DNA, 18 bp, Homo sapiens
cccactcctcactgcccc

SEQ ID NO: 2816500 - DNA, 19 bp, Homo sapiens
cccactcctcactgcccca

SEQ ID NO: 2816501 - DNA, 19 bp, Homo sapiens
cccactctcattccccagg

SEQ ID NO: 2816502 - DNA, 14 bp, Homo sapiens
cccactctgctctg

SEQ ID NO: 2816503 - DNA, 19 bp, Homo sapiens
cccactctgctctgatgca

SEQ ID NO: 2816504 - DNA, 17 bp, Homo sapiens
cccactgccacaccctc

SEQ ID NO: 2816505 - DNA, 12 bp, Homo sapiens
cccactgctctg

SEQ ID NO: 2816506 - DNA, 19 bp, Homo sapiens
cccactgcttttggtctgt

SEQ ID NO: 2816507 - DNA, 22 bp, Homo sapiens
cccactgcttttggtctgtgtg

SEQ ID NO: 2816508 - DNA, 15 bp, Homo sapiens
cccacttgaggctgg

SEQ ID NO: 2816509 - DNA, 16 bp, Homo sapiens
cccagaaaacctccag

SEQ ID NO: 2816510 - DNA, 17 bp, Homo sapiens
cccagaaaacctccagt

SEQ ID NO: 2816511 - DNA, 16 bp, Homo sapiens
cccagagacaggaaaa

SEQ ID NO: 2816512 - DNA, 17 bp, Homo sapiens
cccagagacaggaaaat

SEQ ID NO: 2816513 - DNA, 23 bp, Homo sapiens
cccagagaccccttcctttcctc

SEQ ID NO: 2816514 - DNA, 19 bp, Homo sapiens
cccagagatgcctccaccg

SEQ ID NO: 2816515 - DNA, 23 bp, Homo sapiens
cccagagatgcctccaccgctgc

SEQ ID NO: 2816516 - DNA, 23 bp, Homo sapiens
cccagagggcccaggcaggccac

SEQ ID NO: 2816517 - DNA, 12 bp, Homo sapiens
catgagcctcag

SEQ ID NO: 2816518 - DNA, 24 bp, Homo sapiens
catgaggcaatgtcaggaacagaa

SEQ ID NO: 2816519 - DNA, 15 bp, Homo sapiens
catgaggcctttccc

SEQ ID NO: 2816520 - DNA, 19 bp, Homo sapiens
catgaggcctttccccagt

SEQ ID NO: 2816521 - DNA, 16 bp, Homo sapiens
catgatctccctgccg

SEQ ID NO: 2816522 - DNA, 18 bp, Homo sapiens
catgatctccctgccgcc

SEQ ID NO: 2816523 - DNA, 20 bp, Homo sapiens
catgatctccctgccgcctc

SEQ ID NO: 2816524 - DNA, 20 bp, Homo sapiens
catgatcttgttaatgcatt

SEQ ID NO: 2816525 - DNA, 23 bp, Homo sapiens
catgatgccgctcttctgtcatc

SEQ ID NO: 2816526 - DNA, 13 bp, Homo sapiens
catgattcatttt

SEQ ID NO: 2816527 - DNA, 11 bp, Homo sapiens
catgattttac

SEQ ID NO: 2816528 - DNA, 13 bp, Homo sapiens
catgattttacag

SEQ ID NO: 2816529 - DNA, 14 bp, Homo sapiens
catgattttacaga

SEQ ID NO: 2816530 - DNA, 13 bp, Homo sapiens
catgcacatttat

SEQ ID NO: 2816531 - DNA, 12 bp, Homo sapiens
catgcagctctg

SEQ ID NO: 2816532 - DNA, 13 bp, Homo sapiens
catgcagcttcat

SEQ ID NO: 2816533 - DNA, 22 bp, Homo sapiens
catgcagcttcatcaattttta

SEQ ID NO: 2816534 - DNA, 14 bp, Homo sapiens
catgcattttgcag

SEQ ID NO: 2816535 - DNA, 20 bp, Homo sapiens
catgcattttgcagcagtga

SEQ ID NO: 2816536 - DNA, 16 bp, Homo sapiens
catgccaggctaattt

SEQ ID NO: 2816537 - DNA, 19 bp, Homo sapiens
catgccatttgtactgacc

SEQ ID NO: 2816538 - DNA, 14 bp, Homo sapiens
catgccgggcgcag

SEQ ID NO: 2816539 - DNA, 13 bp, Homo sapiens
catgcctctgagg

SEQ ID NO: 2816540 - DNA, 15 bp, Homo sapiens
catgcctctgaggcc

SEQ ID NO: 2816541 - DNA, 23 bp, Homo sapiens
catgcctctgaggccagcctggc

SEQ ID NO: 2816542 - DNA, 15 bp, Homo sapiens
catgcctgagggtgg

SEQ ID NO: 2816543 - DNA, 15 bp, Homo sapiens
catgcctgattttaa

SEQ ID NO: 2816544 - DNA, 13 bp, Homo sapiens
catgcgcacaagg

SEQ ID NO: 2816545 - DNA, 19 bp, Homo sapiens
catgcgctgctcaacctct

SEQ ID NO: 2816546 - DNA, 21 bp, Homo sapiens
catgctaagagaagtagaaat

SEQ ID NO: 2816547 - DNA, 23 bp, Homo sapiens
catgctatctctgtgtgcacaaa

SEQ ID NO: 2816548 - DNA, 16 bp, Homo sapiens
catgctcaaccactgt

SEQ ID NO: 2816549 - DNA, 20 bp, Homo sapiens
catgctcagccctgactggt

SEQ ID NO: 2816550 - DNA, 23 bp, Homo sapiens
catgctcagccctgactggtgct

SEQ ID NO: 2816551 - DNA, 16 bp, Homo sapiens
catgctcagcccttcc

SEQ ID NO: 2816552 - DNA, 13 bp, Homo sapiens
catgctctctgca

SEQ ID NO: 2816553 - DNA, 21 bp, Homo sapiens
catgctctctgcagccagccc

SEQ ID NO: 2816554 - DNA, 18 bp, Homo sapiens
catgctgaagggaccttg

SEQ ID NO: 2816555 - DNA, 18 bp, Homo sapiens
catgctgaattattttgt

SEQ ID NO: 2816556 - DNA, 15 bp, Homo sapiens
catgctgacttgcag

SEQ ID NO: 2816557 - DNA, 16 bp, Homo sapiens
ccaggcacgtcccgga

SEQ ID NO: 2816558 - DNA, 23 bp, Homo sapiens
ccaggcacgtcccggacctgtgg

SEQ ID NO: 2816559 - DNA, 16 bp, Homo sapiens
ccaggcactgctgccc

SEQ ID NO: 2816560 - DNA, 23 bp, Homo sapiens
ccaggcagagacaataaaacatt

SEQ ID NO: 2816561 - DNA, 16 bp, Homo sapiens
ccaggcaggggtggga

SEQ ID NO: 2816562 - DNA, 19 bp, Homo sapiens
ccaggcaggggtgggagag

SEQ ID NO: 2816563 - DNA, 13 bp, Homo sapiens
ccaggcatgctgg

SEQ ID NO: 2816564 - DNA, 12 bp, Homo sapiens
ccaggccaggcc

SEQ ID NO: 2816565 - DNA, 15 bp, Homo sapiens
ccaggccccatgacc

SEQ ID NO: 2816566 - DNA, 19 bp, Homo sapiens
ccaggcccctgccaccctg

SEQ ID NO: 2816567 - DNA, 21 bp, Homo sapiens
ccaggcccctgccaccctggg

SEQ ID NO: 2816568 - DNA, 23 bp, Homo sapiens
ccaggcccctgccaccctgggga

SEQ ID NO: 2816569 - DNA, 21 bp, Homo sapiens
ccaggcccggggctggcggct

SEQ ID NO: 2816570 - DNA, 12 bp, Homo sapiens
ccaggcctgcct

SEQ ID NO: 2816571 - DNA, 18 bp, Homo sapiens
ccaggcgcggtggctcac

SEQ ID NO: 2816572 - DNA, 17 bp, Homo sapiens
ccaggctcacaactgtt

SEQ ID NO: 2816573 - DNA, 19 bp, Homo sapiens
ccaggctcacaactgtttt

SEQ ID NO: 2816574 - DNA, 20 bp, Homo sapiens
ccaggctcctttagcgccca

SEQ ID NO: 2816575 - DNA, 21 bp, Homo sapiens
ccaggctcctttagcgcccag

SEQ ID NO: 2816576 - DNA, 17 bp, Homo sapiens
ccaggctgagtgagcca

SEQ ID NO: 2816577 - DNA, 24 bp, Homo sapiens
ccaggctgtatcccatgagcctca

SEQ ID NO: 2816578 - DNA, 13 bp, Homo sapiens
ccaggctgtttct

SEQ ID NO: 2816579 - DNA, 22 bp, Homo sapiens
ccaggcttgtcactagcagctg

SEQ ID NO: 2816580 - DNA, 15 bp, Homo sapiens
ccagggcacaggagc

SEQ ID NO: 2816581 - DNA, 20 bp, Homo sapiens
ccagggcacaggagctacct

SEQ ID NO: 2816582 - DNA, 19 bp, Homo sapiens
ccagggcatattaaaggct

SEQ ID NO: 2816583 - DNA, 15 bp, Homo sapiens
ccagggccaggggtc

SEQ ID NO: 2816584 - DNA, 18 bp, Homo sapiens
ccagggcccaaagcccag

SEQ ID NO: 2816585 - DNA, 19 bp, Homo sapiens
ccagggccccagaacacag

SEQ ID NO: 2816586 - DNA, 15 bp, Homo sapiens
ccagggccctgagct

SEQ ID NO: 2816587 - DNA, 18 bp, Homo sapiens
ccagggctcaaaaagttt

SEQ ID NO: 2816588 - DNA, 13 bp, Homo sapiens
ccagggctcagcc

SEQ ID NO: 2816589 - DNA, 20 bp, Homo sapiens
ccagggctcagcctggtggg

SEQ ID NO: 2816590 - DNA, 13 bp, Homo sapiens
ccagggctgcccc

SEQ ID NO: 2816591 - DNA, 13 bp, Homo sapiens
ccaggggaccaca

SEQ ID NO: 2816592 - DNA, 18 bp, Homo sapiens
ccaggggaccacacctcc

SEQ ID NO: 2816593 - DNA, 20 bp, Homo sapiens
ccaggggagagggtctggag

SEQ ID NO: 2816594 - DNA, 18 bp, Homo sapiens
ccaggggtctccctggag

SEQ ID NO: 2816595 - DNA, 21 bp, Homo sapiens
ccaggggtgatttcagagagg

SEQ ID NO: 2816596 - DNA, 16 bp, Homo sapiens
ccagggttgatcacac

SEQ ID NO: 2816597 - DNA, 22 bp, Homo sapiens
ccagggttgatcacactctggg

SEQ ID NO: 2816598 - DNA, 16 bp, Homo sapiens
ccaggtaatgagggac

SEQ ID NO: 2816599 - DNA, 18 bp, Homo sapiens
ccaggtaatgagggactg

SEQ ID NO: 2816600 - DNA, 23 bp, Homo sapiens
ccaggtaatgagggactggaacc

SEQ ID NO: 2816601 - DNA, 12 bp, Homo sapiens
ccaggtcctggt

SEQ ID NO: 2816602 - DNA, 13 bp, Homo sapiens
ccaggtcctggtg

SEQ ID NO: 2816603 - DNA, 15 bp, Homo sapiens
ccaggtcctggtggg

SEQ ID NO: 2816604 - DNA, 21 bp, Homo sapiens
ccaggtctctccactgctctc

SEQ ID NO: 2816605 - DNA, 23 bp, Homo sapiens
ccaggtctctccactgctctcag

SEQ ID NO: 2816606 - DNA, 19 bp, Homo sapiens
ccaggtggctgacccagtc

SEQ ID NO: 2816607 - DNA, 17 bp, Homo sapiens
ccccaaaagtacttacc

SEQ ID NO: 2816608 - DNA, 12 bp, Homo sapiens
ccccaaagcccc

SEQ ID NO: 2816609 - DNA, 19 bp, Homo sapiens
ccccaacctttccctcacc

SEQ ID NO: 2816610 - DNA, 14 bp, Homo sapiens
ccccaactcctgga

SEQ ID NO: 2816611 - DNA, 17 bp, Homo sapiens
ccccaactccttccagc

SEQ ID NO: 2816612 - DNA, 22 bp, Homo sapiens
ccccaactccttccagctagtg

SEQ ID NO: 2816613 - DNA, 13 bp, Homo sapiens
ccccacagaactg

SEQ ID NO: 2816614 - DNA, 12 bp, Homo sapiens
ccccaccaccta

SEQ ID NO: 2816615 - DNA, 23 bp, Homo sapiens
ccccaccacgatgtggccctggc

SEQ ID NO: 2816616 - DNA, 19 bp, Homo sapiens
ccccaccagccacctcttg

SEQ ID NO: 2816617 - DNA, 17 bp, Homo sapiens
ccccaccccctccccag

SEQ ID NO: 2816618 - DNA, 22 bp, Homo sapiens
ccccacctccgccccagacaca

SEQ ID NO: 2816619 - DNA, 15 bp, Homo sapiens
ccccactctcattcc

SEQ ID NO: 2816620 - DNA, 17 bp, Homo sapiens
ccccactctgctctgat

SEQ ID NO: 2816621 - DNA, 19 bp, Homo sapiens
ccccactctgctctgatgc

SEQ ID NO: 2816622 - DNA, 18 bp, Homo sapiens
ccccactgcaggccccgc

SEQ ID NO: 2816623 - DNA, 20 bp, Homo sapiens
ccccacttctctactctgga

SEQ ID NO: 2816624 - DNA, 23 bp, Homo sapiens
ccccacttctctactctggaagt

SEQ ID NO: 2816625 - DNA, 19 bp, Homo sapiens
ccccagactcagctccaga

SEQ ID NO: 2816626 - DNA, 20 bp, Homo sapiens
ccccagacttctctttctta

SEQ ID NO: 2816627 - DNA, 18 bp, Homo sapiens
ccccagatcaccagcccg

SEQ ID NO: 2816628 - DNA, 15 bp, Homo sapiens
ccccagattgcaaca

SEQ ID NO: 2816629 - DNA, 22 bp, Homo sapiens
ccccagattgcaacaggctggg

SEQ ID NO: 2816630 - DNA, 17 bp, Homo sapiens
ccccagcaagtgagagc

SEQ ID NO: 2816631 - DNA, 22 bp, Homo sapiens
ccccagcaagtgagagctgggt

SEQ ID NO: 2816632 - DNA, 19 bp, Homo sapiens
ccccagccccgactccagc

SEQ ID NO: 2816633 - DNA, 23 bp, Homo sapiens
ccccagccccgactccagccagc

SEQ ID NO: 2816634 - DNA, 12 bp, Homo sapiens
ccccagcctggg

SEQ ID NO: 2816635 - DNA, 17 bp, Homo sapiens
ccccagctagggctgga

SEQ ID NO: 2816636 - DNA, 11 bp, Homo sapiens
ccccagctccc

SEQ ID NO: 2816637 - DNA, 15 bp, Homo sapiens
ccccagctccccagg

SEQ ID NO: 2816638 - DNA, 12 bp, Homo sapiens
ccccaggacgcc

SEQ ID NO: 2816639 - DNA, 16 bp, Homo sapiens
ccccaggactcaccct

SEQ ID NO: 2816640 - DNA, 19 bp, Homo sapiens
ccccaggactcaccctcat

SEQ ID NO: 2816641 - DNA, 22 bp, Homo sapiens
ccccaggccaggccaccaggat

SEQ ID NO: 2816642 - DNA, 12 bp, Homo sapiens
ccccagggcaca

SEQ ID NO: 2816643 - DNA, 16 bp, Homo sapiens
ccccagggcacaggag

SEQ ID NO: 2816644 - DNA, 16 bp, Homo sapiens
ccccagggcccccaca

SEQ ID NO: 2816645 - DNA, 20 bp, Homo sapiens
ccccaggtggctgacccagt

SEQ ID NO: 2816646 - DNA, 20 bp, Homo sapiens
ccccagtcgagccctgcagc

SEQ ID NO: 2816647 - DNA, 18 bp, Homo sapiens
ccccagtgctacctctct

SEQ ID NO: 2816648 - DNA, 17 bp, Homo sapiens
ccccagttctgctcctc

SEQ ID NO: 2816649 - DNA, 23 bp, Homo sapiens
ccccagttctgctcctctccagg

SEQ ID NO: 2816650 - DNA, 14 bp, Homo sapiens
ccccatcagaggct

SEQ ID NO: 2816651 - DNA, 14 bp, Homo sapiens
ccccattctgcctg

SEQ ID NO: 2816652 - DNA, 12 bp, Homo sapiens
cccccacaggcc

SEQ ID NO: 2816653 - DNA, 14 bp, Homo sapiens
cccccactgcaggc

SEQ ID NO: 2816654 - DNA, 13 bp, Homo sapiens
cccccactgccac

SEQ ID NO: 2816655 - DNA, 24 bp, Homo sapiens
cccccagccccgactccagccagc

SEQ ID NO: 2816656 - DNA, 13 bp, Homo sapiens
cccccagcctggg

SEQ ID NO: 2816657 - DNA, 18 bp, Homo sapiens
cccccagtcgagccctgc

SEQ ID NO: 2816658 - DNA, 13 bp, Homo sapiens
cccccgcagcacc

SEQ ID NO: 2816659 - DNA, 20 bp, Homo sapiens
cccccgcagcaccctgcaga

SEQ ID NO: 2816660 - DNA, 18 bp, Homo sapiens
cccccgctggcagccacc

SEQ ID NO: 2816661 - DNA, 14 bp, Homo sapiens
ccccctctaacccc

SEQ ID NO: 2816662 - DNA, 11 bp, Homo sapiens
ccccctgcagc

SEQ ID NO: 2816663 - DNA, 23 bp, Homo sapiens
ccccctgcagcttgtagccagcc

SEQ ID NO: 2816664 - DNA, 12 bp, Homo sapiens
ccccctggagag

SEQ ID NO: 2816665 - DNA, 11 bp, Homo sapiens
ccccctgggct

SEQ ID NO: 2816666 - DNA, 23 bp, Homo sapiens
cccccttcagtgcccaccaacat

SEQ ID NO: 2816667 - DNA, 19 bp, Homo sapiens
cccccttggaggagggctg

SEQ ID NO: 2816668 - DNA, 13 bp, Homo sapiens
ccccgactccagc

SEQ ID NO: 2816669 - DNA, 15 bp, Homo sapiens
ccccgactccagcca

SEQ ID NO: 2816670 - DNA, 16 bp, Homo sapiens
ccccgactccagccag

SEQ ID NO: 2816671 - DNA, 12 bp, Homo sapiens
ccccgcttcccc

SEQ ID NO: 2816672 - DNA, 21 bp, Homo sapiens
ccccgcttccccacagaactg

SEQ ID NO: 2816673 - DNA, 17 bp, Homo sapiens
ccccgcttgtccagcgc

SEQ ID NO: 2816674 - DNA, 18 bp, Homo sapiens
ccccgcttgtccagcgcc

SEQ ID NO: 2816675 - DNA, 16 bp, Homo sapiens
ccccgggcctgcctct

SEQ ID NO: 2816676 - DNA, 24 bp, Homo sapiens
ccccggtcccttgagacctcagcc

SEQ ID NO: 2816677 - DNA, 14 bp, Homo sapiens
ccccgtctctacta

SEQ ID NO: 2816678 - DNA, 13 bp, Homo sapiens
cccctaccccaga

SEQ ID NO: 2816679 - DNA, 23 bp, Homo sapiens
catcccccactgccacaccctcc

SEQ ID NO: 2816680 - DNA, 12 bp, Homo sapiens
catcccctttcc

SEQ ID NO: 2816681 - DNA, 14 bp, Homo sapiens
catcccctttcctc

SEQ ID NO: 2816682 - DNA, 17 bp, Homo sapiens
catcccctttcctcccc

SEQ ID NO: 2816683 - DNA, 21 bp, Homo sapiens
catcccctttcctccccacct

SEQ ID NO: 2816684 - DNA, 14 bp, Homo sapiens
catcccgctcctgc

SEQ ID NO: 2816685 - DNA, 17 bp, Homo sapiens
catcccgctcctgctga

SEQ ID NO: 2816686 - DNA, 13 bp, Homo sapiens
catccgaggcagg

SEQ ID NO: 2816687 - DNA, 14 bp, Homo sapiens
catccgaggcaggg

SEQ ID NO: 2816688 - DNA, 16 bp, Homo sapiens
catccgaggcagggtc

SEQ ID NO: 2816689 - DNA, 22 bp, Homo sapiens
catccgaggcagggtcaggaga

SEQ ID NO: 2816690 - DNA, 18 bp, Homo sapiens
catccgtagttccctgaa

SEQ ID NO: 2816691 - DNA, 20 bp, Homo sapiens
catcctgcagcctcctcctg

SEQ ID NO: 2816692 - DNA, 23 bp, Homo sapiens
catcctggcacccggcccctgct

SEQ ID NO: 2816693 - DNA, 22 bp, Homo sapiens
catccttcaccagagcccatgc

SEQ ID NO: 2816694 - DNA, 21 bp, Homo sapiens
catcgattcaaactgctccaa

SEQ ID NO: 2816695 - DNA, 13 bp, Homo sapiens
catcgggctgagg

SEQ ID NO: 2816696 - DNA, 22 bp, Homo sapiens
catctacacagcagtatgaatg

SEQ ID NO: 2816697 - DNA, 17 bp, Homo sapiens
catctacacagcctgga

SEQ ID NO: 2816698 - DNA, 18 bp, Homo sapiens
catctacacagcctggac

SEQ ID NO: 2816699 - DNA, 19 bp, Homo sapiens
catctagaggcttccttca

SEQ ID NO: 2816700 - DNA, 19 bp, Homo sapiens
catctatgtcccttgctgt

SEQ ID NO: 2816701 - DNA, 18 bp, Homo sapiens
catctattataaaaccat

SEQ ID NO: 2816702 - DNA, 19 bp, Homo sapiens
catctattataaaaccatg

SEQ ID NO: 2816703 - DNA, 13 bp, Homo sapiens
catctatttctga

SEQ ID NO: 2816704 - DNA, 15 bp, Homo sapiens
catctatttctgaga

SEQ ID NO: 2816705 - DNA, 16 bp, Homo sapiens
catctatttctgagaa

SEQ ID NO: 2816706 - DNA, 20 bp, Homo sapiens
catctcagcctaccatgaga

SEQ ID NO: 2816707 - DNA, 18 bp, Homo sapiens
catctcagggtccagacc

SEQ ID NO: 2816708 - DNA, 21 bp, Homo sapiens
catctcatttaagggaaaaat

SEQ ID NO: 2816709 - DNA, 17 bp, Homo sapiens
catctccaccctgagcc

SEQ ID NO: 2816710 - DNA, 15 bp, Homo sapiens
catctctactaaaaa

SEQ ID NO: 2816711 - DNA, 21 bp, Homo sapiens
catctctctactcctacctca

SEQ ID NO: 2816712 - DNA, 22 bp, Homo sapiens
catctctctactcctacctcag

SEQ ID NO: 2816713 - DNA, 12 bp, Homo sapiens
catctctcttcc

SEQ ID NO: 2816714 - DNA, 19 bp, Homo sapiens
ccacccgttctgctggcct

SEQ ID NO: 2816715 - DNA, 21 bp, Homo sapiens
ccaccctcgtggacacctgcc

SEQ ID NO: 2816716 - DNA, 22 bp, Homo sapiens
ccaccctgagcctgacctttct

SEQ ID NO: 2816717 - DNA, 11 bp, Homo sapiens
ccaccctggaa

SEQ ID NO: 2816718 - DNA, 15 bp, Homo sapiens
ccaccgctgcctaag

SEQ ID NO: 2816719 - DNA, 14 bp, Homo sapiens
ccaccgggccactc

SEQ ID NO: 2816720 - DNA, 15 bp, Homo sapiens
ccaccgggccactcc

SEQ ID NO: 2816721 - DNA, 20 bp, Homo sapiens
ccaccgggccactccttcct

SEQ ID NO: 2816722 - DNA, 21 bp, Homo sapiens
ccaccgggccactccttcctg

SEQ ID NO: 2816723 - DNA, 19 bp, Homo sapiens
ccaccgggctgggagctct

SEQ ID NO: 2816724 - DNA, 17 bp, Homo sapiens
ccacctaatcaggctga

SEQ ID NO: 2816725 - DNA, 20 bp, Homo sapiens
ccacctaggccactcctcca

SEQ ID NO: 2816726 - DNA, 16 bp, Homo sapiens
ccacctcactcctgtt

SEQ ID NO: 2816727 - DNA, 12 bp, Homo sapiens
ccacctcagcct

SEQ ID NO: 2816728 - DNA, 13 bp, Homo sapiens
ccacctcagcctc

SEQ ID NO: 2816729 - DNA, 14 bp, Homo sapiens
ccacctcagcctcc

SEQ ID NO: 2816730 - DNA, 15 bp, Homo sapiens
ccacctcagcctccc

SEQ ID NO: 2816731 - DNA, 17 bp, Homo sapiens
ccacctcatgcctggcc

SEQ ID NO: 2816732 - DNA, 12 bp, Homo sapiens
ccacctccctgc

SEQ ID NO: 2816733 - DNA, 22 bp, Homo sapiens
ccacctccctgccctgtcctcc

SEQ ID NO: 2816734 - DNA, 20 bp, Homo sapiens
ccacctcttctcttcctgta

SEQ ID NO: 2816735 - DNA, 19 bp, Homo sapiens
ccacctcttgggcatgctc

SEQ ID NO: 2816736 - DNA, 20 bp, Homo sapiens
ccacctgcctatccatcctg

SEQ ID NO: 2816737 - DNA, 21 bp, Homo sapiens
ccacctgcctatccatcctgc

SEQ ID NO: 2816738 - DNA, 13 bp, Homo sapiens
ccacctgcttctg

SEQ ID NO: 2816739 - DNA, 18 bp, Homo sapiens
ccacctgctttctcctgg

SEQ ID NO: 2816740 - DNA, 22 bp, Homo sapiens
ccacctggccccatgtctctca

SEQ ID NO: 2816741 - DNA, 12 bp, Homo sapiens
ccacctggctca

SEQ ID NO: 2816742 - DNA, 12 bp, Homo sapiens
ccacctgtctgt

SEQ ID NO: 2816743 - DNA, 22 bp, Homo sapiens
ccacctgtctgtctgtctgtcc

SEQ ID NO: 2816744 - DNA, 19 bp, Homo sapiens
ccacctgttcaggagctga

SEQ ID NO: 2816745 - DNA, 17 bp, Homo sapiens
ccaccttcaagcaccct

SEQ ID NO: 2816746 - DNA, 17 bp, Homo sapiens
ccaccttcaattcctgg

SEQ ID NO: 2816747 - DNA, 18 bp, Homo sapiens
ccaccttcaattcctggg

SEQ ID NO: 2816748 - DNA, 13 bp, Homo sapiens
ccaccttcccagc

SEQ ID NO: 2816749 - DNA, 16 bp, Homo sapiens
ccaccttccccagact

SEQ ID NO: 2816750 - DNA, 22 bp, Homo sapiens
ccaccttccccagactcagctc

SEQ ID NO: 2816751 - DNA, 17 bp, Homo sapiens
ccaccttggactcctcc

SEQ ID NO: 2816752 - DNA, 19 bp, Homo sapiens
ccaccttggactcctccca

SEQ ID NO: 2816753 - DNA, 20 bp, Homo sapiens
ccaccttggactcctcccac

SEQ ID NO: 2816754 - DNA, 13 bp, Homo sapiens
ccaccttggctca

SEQ ID NO: 2816755 - DNA, 16 bp, Homo sapiens
ccaccttggctcaagt

SEQ ID NO: 2816756 - DNA, 20 bp, Homo sapiens
ccacgatgtggccctggcct

SEQ ID NO: 2816757 - DNA, 18 bp, Homo sapiens
ccacgctggaccttgaac

SEQ ID NO: 2816758 - DNA, 13 bp, Homo sapiens
ccacgctggagtg

SEQ ID NO: 2816759 - DNA, 14 bp, Homo sapiens
caaatactccaagc

SEQ ID NO: 2816760 - DNA, 21 bp, Homo sapiens
caaatatatttaattgtgtca

SEQ ID NO: 2816761 - DNA, 16 bp, Homo sapiens
caaatccatccagaat

SEQ ID NO: 2816762 - DNA, 14 bp, Homo sapiens
caaatcgaatgaaa

SEQ ID NO: 2816763 - DNA, 16 bp, Homo sapiens
caaatctaatgtaaga

SEQ ID NO: 2816764 - DNA, 13 bp, Homo sapiens
caaatctattcag

SEQ ID NO: 2816765 - DNA, 14 bp, Homo sapiens
caaatctattcaga

SEQ ID NO: 2816766 - DNA, 22 bp, Homo sapiens
caaatcttggttgatgccaaaa

SEQ ID NO: 2816767 - DNA, 19 bp, Homo sapiens
caaatgaatgaccttgttg

SEQ ID NO: 2816768 - DNA, 22 bp, Homo sapiens
caaatgaatgttgtctgtttgt

SEQ ID NO: 2816769 - DNA, 14 bp, Homo sapiens
caaatgctaaatgc

SEQ ID NO: 2816770 - DNA, 12 bp, Homo sapiens
caaatggctctg

SEQ ID NO: 2816771 - DNA, 16 bp, Homo sapiens
caaatggctctgtgaa

SEQ ID NO: 2816772 - DNA, 22 bp, Homo sapiens
caaatggctctgtgaaatcaga

SEQ ID NO: 2816773 - DNA, 16 bp, Homo sapiens
caaatggtttttgcaa

SEQ ID NO: 2816774 - DNA, 18 bp, Homo sapiens
caaatgtaaaataagtat

SEQ ID NO: 2816775 - DNA, 21 bp, Homo sapiens
caaatgtaattgaataaagtt

SEQ ID NO: 2816776 - DNA, 11 bp, Homo sapiens
caaatgtttct

SEQ ID NO: 2816777 - DNA, 14 bp, Homo sapiens
caaatgtttctgca

SEQ ID NO: 2816778 - DNA, 19 bp, Homo sapiens
caaattaggttttgtacaa

SEQ ID NO: 2816779 - DNA, 20 bp, Homo sapiens
caaattaggttttgtacaat

SEQ ID NO: 2816780 - DNA, 23 bp, Homo sapiens
caaattcaaggagatataaaatc

SEQ ID NO: 2816781 - DNA, 22 bp, Homo sapiens
caaattccaaacttctaaatgt

SEQ ID NO: 2816782 - DNA, 23 bp, Homo sapiens
caaattccaaacttctaaatgtt

SEQ ID NO: 2816783 - DNA, 22 bp, Homo sapiens
caaattctcaacctaccacccc

SEQ ID NO: 2816784 - DNA, 17 bp, Homo sapiens
caaattggtgtttctga

SEQ ID NO: 2816785 - DNA, 21 bp, Homo sapiens
caacaaattaggttttgtaca

SEQ ID NO: 2816786 - DNA, 21 bp, Homo sapiens
caacaacatgtataatatttt

SEQ ID NO: 2816787 - DNA, 20 bp, Homo sapiens
cacccccttcagtgcccacc

SEQ ID NO: 2816788 - DNA, 22 bp, Homo sapiens
caccccgtctggggttcagccc

SEQ ID NO: 2816789 - DNA, 23 bp, Homo sapiens
caccccgtctggggttcagcccc

SEQ ID NO: 2816790 - DNA, 13 bp, Homo sapiens
cacccctccccat

SEQ ID NO: 2816791 - DNA, 22 bp, Homo sapiens
cacccctcccctgccctagagc

SEQ ID NO: 2816792 - DNA, 17 bp, Homo sapiens
caccccttatccaggac

SEQ ID NO: 2816793 - DNA, 19 bp, Homo sapiens
caccccttatccaggactc

SEQ ID NO: 2816794 - DNA, 20 bp, Homo sapiens
caccccttatccaggactct

SEQ ID NO: 2816795 - DNA, 12 bp, Homo sapiens
caccccttcctg

SEQ ID NO: 2816796 - DNA, 22 bp, Homo sapiens
caccccttcctgtcccacctct

SEQ ID NO: 2816797 - DNA, 14 bp, Homo sapiens
cacccgactcctca

SEQ ID NO: 2816798 - DNA, 15 bp, Homo sapiens
cacccgactcctcaa

SEQ ID NO: 2816799 - DNA, 16 bp, Homo sapiens
cacccgaggctgccca

SEQ ID NO: 2816800 - DNA, 18 bp, Homo sapiens
cacccgaggctgcccact

SEQ ID NO: 2816801 - DNA, 14 bp, Homo sapiens
cacccggaaagact

SEQ ID NO: 2816802 - DNA, 16 bp, Homo sapiens
cacccggcccctgctg

SEQ ID NO: 2816803 - DNA, 18 bp, Homo sapiens
cacccggcccctgctggt

SEQ ID NO: 2816804 - DNA, 16 bp, Homo sapiens
caccctacctgtgcct

SEQ ID NO: 2816805 - DNA, 22 bp, Homo sapiens
caccctcataccatctgctgcc

SEQ ID NO: 2816806 - DNA, 20 bp, Homo sapiens
caccctcgtggacacctgcc

SEQ ID NO: 2816807 - DNA, 21 bp, Homo sapiens
caccctcgtggacacctgccc

SEQ ID NO: 2816808 - DNA, 18 bp, Homo sapiens
caccctgaatggttccat

SEQ ID NO: 2816809 - DNA, 23 bp, Homo sapiens
caccctgaatggttccatgcctg

SEQ ID NO: 2816810 - DNA, 21 bp, Homo sapiens
caccctgaggagtctgaggtc

SEQ ID NO: 2816811 - DNA, 15 bp, Homo sapiens
caccctgcagagcac

SEQ ID NO: 2816812 - DNA, 23 bp, Homo sapiens
caccctgcagagcacacaggtac

SEQ ID NO: 2816813 - DNA, 11 bp, Homo sapiens
caccctggaat

SEQ ID NO: 2816814 - DNA, 15 bp, Homo sapiens
caccctggggagaaa

SEQ ID NO: 2816815 - DNA, 21 bp, Homo sapiens
cacccttctttcctcttcccc

SEQ ID NO: 2816816 - DNA, 18 bp, Homo sapiens
caccgagagtagccgaga

SEQ ID NO: 2816817 - DNA, 12 bp, Homo sapiens
caccgctgccta

SEQ ID NO: 2816818 - DNA, 22 bp, Homo sapiens
caccggagctttcaaagaagga

SEQ ID NO: 2816819 - DNA, 18 bp, Homo sapiens
caccgggacagacctgga

SEQ ID NO: 2816820 - DNA, 22 bp, Homo sapiens
caccgggcactcagaagacact

SEQ ID NO: 2816821 - DNA, 21 bp, Homo sapiens
caccgggccactccttcctgc

SEQ ID NO: 2816822 - DNA, 23 bp, Homo sapiens
caccgggccactccttcctgccc

SEQ ID NO: 2816823 - DNA, 23 bp, Homo sapiens
caccgtggaccttcctgccacca

SEQ ID NO: 2816824 - DNA, 19 bp, Homo sapiens
cacctaatcaggctgaggt

SEQ ID NO: 2816825 - DNA, 14 bp, Homo sapiens
cacctacatcccca

SEQ ID NO: 2816826 - DNA, 16 bp, Homo sapiens
cacctacatccccagg

SEQ ID NO: 2816827 - DNA, 16 bp, Homo sapiens
cacctaggccactcct

SEQ ID NO: 2816828 - DNA, 18 bp, Homo sapiens
cacctaggccactcctcc

SEQ ID NO: 2816829 - DNA, 19 bp, Homo sapiens
cacctatgtcatttcattt

SEQ ID NO: 2816830 - DNA, 15 bp, Homo sapiens
cacctcaaatacata

SEQ ID NO: 2816831 - DNA, 15 bp, Homo sapiens
cacctcactcctgtt

SEQ ID NO: 2816832 - DNA, 14 bp, Homo sapiens
cacctcactgagga

SEQ ID NO: 2816833 - DNA, 13 bp, Homo sapiens
cacctcagcctcc

SEQ ID NO: 2816834 - DNA, 12 bp, Homo sapiens
cacctcagcctt

SEQ ID NO: 2816835 - DNA, 15 bp, Homo sapiens
cacctcaggccaggt

SEQ ID NO: 2816836 - DNA, 14 bp, Homo sapiens
cacctcatgcctgg

SEQ ID NO: 2816837 - DNA, 21 bp, Homo sapiens
cacctcccaggggctccacct

SEQ ID NO: 2816838 - DNA, 16 bp, Homo sapiens
cacctccccccactgc

SEQ ID NO: 2816839 - DNA, 17 bp, Homo sapiens
cacctccccccactgca

SEQ ID NO: 2816840 - DNA, 23 bp, Homo sapiens
cacctccccccactgcaggcccc

SEQ ID NO: 2816841 - DNA, 19 bp, Homo sapiens
cacctccctgaaccatccc

SEQ ID NO: 2816842 - DNA, 21 bp, Homo sapiens
cacctccctgccctgtcctcc

SEQ ID NO: 2816843 - DNA, 14 bp, Homo sapiens
cacctccgccccag

SEQ ID NO: 2816844 - DNA, 14 bp, Homo sapiens
cacctcctgcctcg

SEQ ID NO: 2816845 - DNA, 21 bp, Homo sapiens
cacctccttcctcagtcctgg

SEQ ID NO: 2816846 - DNA, 14 bp, Homo sapiens
cacctctgcctcaa

SEQ ID NO: 2816847 - DNA, 13 bp, Homo sapiens
cacctcttgggca

SEQ ID NO: 2816848 - DNA, 14 bp, Homo sapiens
cacctgaagactca

SEQ ID NO: 2816849 - DNA, 11 bp, Homo sapiens
cacctgacaca

SEQ ID NO: 2816850 - DNA, 17 bp, Homo sapiens
cacctgaggctgaggca

SEQ ID NO: 2816851 - DNA, 18 bp, Homo sapiens
cacctgaggttaggagtt

SEQ ID NO: 2816852 - DNA, 22 bp, Homo sapiens
cacctgcacctccccccactgc

SEQ ID NO: 2816853 - DNA, 13 bp, Homo sapiens
cacctgccagcct

SEQ ID NO: 2816854 - DNA, 17 bp, Homo sapiens
cacctgccagcctggct

SEQ ID NO: 2816855 - DNA, 16 bp, Homo sapiens
cactttaaagtctttc

SEQ ID NO: 2816856 - DNA, 15 bp, Homo sapiens
cactttaaccctctc

SEQ ID NO: 2816857 - DNA, 19 bp, Homo sapiens
cactttaaccctctcttcc

SEQ ID NO: 2816858 - DNA, 20 bp, Homo sapiens
cactttaaccctctcttccc

SEQ ID NO: 2816859 - DNA, 17 bp, Homo sapiens
cactttcagtgaaagca

SEQ ID NO: 2816860 - DNA, 17 bp, Homo sapiens
cactttgcacagctctc

SEQ ID NO: 2816861 - DNA, 19 bp, Homo sapiens
cactttggtacatggccag

SEQ ID NO: 2816862 - DNA, 17 bp, Homo sapiens
cacttttaatgaacaaa

SEQ ID NO: 2816863 - DNA, 13 bp, Homo sapiens
cagaaaacctcca

SEQ ID NO: 2816864 - DNA, 14 bp, Homo sapiens
cagaaaagaaaacc

SEQ ID NO: 2816865 - DNA, 15 bp, Homo sapiens
cagaaaagaaaacca

SEQ ID NO: 2816866 - DNA, 15 bp, Homo sapiens
cagaaaagcacctgc

SEQ ID NO: 2816867 - DNA, 19 bp, Homo sapiens
cagaaaagcacctgccgac

SEQ ID NO: 2816868 - DNA, 14 bp, Homo sapiens
cagaaaagtagaat

SEQ ID NO: 2816869 - DNA, 16 bp, Homo sapiens
cagaaaagtagaatta

SEQ ID NO: 2816870 - DNA, 19 bp, Homo sapiens
cagaaagatggatgtgctt

SEQ ID NO: 2816871 - DNA, 16 bp, Homo sapiens
cagaaagcattacatt

SEQ ID NO: 2816872 - DNA, 16 bp, Homo sapiens
cagaaagggagggctc

SEQ ID NO: 2816873 - DNA, 16 bp, Homo sapiens
cagaaattagccgggc

SEQ ID NO: 2816874 - DNA, 21 bp, Homo sapiens
cagaactggacgcccagctga

SEQ ID NO: 2816875 - DNA, 14 bp, Homo sapiens
cagaagaaggcagc

SEQ ID NO: 2816876 - DNA, 14 bp, Homo sapiens
cagaagaatattca

SEQ ID NO: 2816877 - DNA, 19 bp, Homo sapiens
cagaagaattgaacccagg

SEQ ID NO: 2816878 - DNA, 20 bp, Homo sapiens
cagaagaattgaacccagga

SEQ ID NO: 2816879 - DNA, 21 bp, Homo sapiens
cagaagaattgaacccaggag

SEQ ID NO: 2816880 - DNA, 19 bp, Homo sapiens
cagaagacactgcaaaggc

SEQ ID NO: 2816881 - DNA, 16 bp, Homo sapiens
cagaagccaggagcaa

SEQ ID NO: 2816882 - DNA, 15 bp, Homo sapiens
cagaagcctgaggct

SEQ ID NO: 2816883 - DNA, 19 bp, Homo sapiens
cagaagcctgaggctggga

SEQ ID NO: 2816884 - DNA, 19 bp, Homo sapiens
cagaagcctgggggcctgg

SEQ ID NO: 2816885 - DNA, 12 bp, Homo sapiens
cagaagcttcca

SEQ ID NO: 2816886 - DNA, 20 bp, Homo sapiens
cagaaggagaaggaaggaga

SEQ ID NO: 2816887 - DNA, 15 bp, Homo sapiens
cagaagggagaagga

SEQ ID NO: 2816888 - DNA, 16 bp, Homo sapiens
cagaagtcatgaagcc

SEQ ID NO: 2816889 - DNA, 15 bp, Homo sapiens
cagaagtttctcagc

SEQ ID NO: 2816890 - DNA, 14 bp, Homo sapiens
cagaataagtgctg

SEQ ID NO: 2816891 - DNA, 15 bp, Homo sapiens
cagaataagtgctgt

SEQ ID NO: 2816892 - DNA, 16 bp, Homo sapiens
cagaataagtgctgtt

SEQ ID NO: 2816893 - DNA, 23 bp, Homo sapiens
cagaataagtgctgtttgagatg

SEQ ID NO: 2816894 - DNA, 24 bp, Homo sapiens
cagaataagtgctgtttgagatgt

SEQ ID NO: 2816895 - DNA, 14 bp, Homo sapiens
cagaatcataattt

SEQ ID NO: 2816896 - DNA, 14 bp, Homo sapiens
cagaatccaaagat

SEQ ID NO: 2816897 - DNA, 11 bp, Homo sapiens
cagaatgaatc

SEQ ID NO: 2816898 - DNA, 15 bp, Homo sapiens
cagaatgctcttcta

SEQ ID NO: 2816899 - DNA, 15 bp, Homo sapiens
cagaattccttttct

SEQ ID NO: 2816900 - DNA, 13 bp, Homo sapiens
cagaattctgcta

SEQ ID NO: 2816901 - DNA, 19 bp, Homo sapiens
cagaatttctttgtcattc

SEQ ID NO: 2816902 - DNA, 15 bp, Homo sapiens
cagaatttttaatga

SEQ ID NO: 2816903 - DNA, 21 bp, Homo sapiens
cagaatttttaatgacttttt

SEQ ID NO: 2816904 - DNA, 22 bp, Homo sapiens
cagaatttttaatgacttttta

SEQ ID NO: 2816905 - DNA, 15 bp, Homo sapiens
cagacaacagaagtc

SEQ ID NO: 2816906 - DNA, 16 bp, Homo sapiens
cagacaacagaagtca

SEQ ID NO: 2816907 - DNA, 17 bp, Homo sapiens
cagacaacagaagtcat

SEQ ID NO: 2816908 - DNA, 13 bp, Homo sapiens
cagacacaccccc

SEQ ID NO: 2816909 - DNA, 14 bp, Homo sapiens
cagacacaggcccg

SEQ ID NO: 2816910 - DNA, 22 bp, Homo sapiens
cagacacaggcccggctccagg

SEQ ID NO: 2816911 - DNA, 11 bp, Homo sapiens
cagacactaag

SEQ ID NO: 2816912 - DNA, 12 bp, Homo sapiens
cagacactaagt

SEQ ID NO: 2816913 - DNA, 16 bp, Homo sapiens
cagacagcagctcagg

SEQ ID NO: 2816914 - DNA, 13 bp, Homo sapiens
cagacaggagaaa

SEQ ID NO: 2816915 - DNA, 21 bp, Homo sapiens
cagacaggcaagcacctcctg

SEQ ID NO: 2816916 - DNA, 22 bp, Homo sapiens
cagacaggcaagcacctcctgc

SEQ ID NO: 2816917 - DNA, 23 bp, Homo sapiens
cagacaggcaagcacctcctgcc

SEQ ID NO: 2816918 - DNA, 18 bp, Homo sapiens
cagacatgtggtgggaca

SEQ ID NO: 2816919 - DNA, 18 bp, Homo sapiens
cagaccacctgcttctga

SEQ ID NO: 2816920 - DNA, 16 bp, Homo sapiens
cagaccccagcggctg

SEQ ID NO: 2816921 - DNA, 13 bp, Homo sapiens
cagacccccactc

SEQ ID NO: 2816922 - DNA, 15 bp, Homo sapiens
cagaccctaccccac

SEQ ID NO: 2816923 - DNA, 14 bp, Homo sapiens
cagacctctgatcc

SEQ ID NO: 2816924 - DNA, 19 bp, Homo sapiens
cagacctggacactagggt

SEQ ID NO: 2816925 - DNA, 13 bp, Homo sapiens
cagaccttttatc

SEQ ID NO: 2816926 - DNA, 15 bp, Homo sapiens
cagaccttttttagg

SEQ ID NO: 2816927 - DNA, 13 bp, Homo sapiens
cagactacagcca

SEQ ID NO: 2816928 - DNA, 14 bp, Homo sapiens
cagactcagctcca

SEQ ID NO: 2816929 - DNA, 14 bp, Homo sapiens
cagacttcacactg

SEQ ID NO: 2816930 - DNA, 21 bp, Homo sapiens
cagacttccctgaatgtattg

SEQ ID NO: 2816931 - DNA, 19 bp, Homo sapiens
cagagaaagaagagacagg

SEQ ID NO: 2816932 - DNA, 12 bp, Homo sapiens
cagagaagtcag

SEQ ID NO: 2816933 - DNA, 19 bp, Homo sapiens
cagagaatcatacttagca

SEQ ID NO: 2816934 - DNA, 22 bp, Homo sapiens
cagagaatttctaccatttcag

SEQ ID NO: 2816935 - DNA, 18 bp, Homo sapiens
cagagacaataaaacatt

SEQ ID NO: 2816936 - DNA, 18 bp, Homo sapiens
cagagacacctgcacctc

SEQ ID NO: 2816937 - DNA, 21 bp, Homo sapiens
cagagacaggaaaatcctctg

SEQ ID NO: 2816938 - DNA, 21 bp, Homo sapiens
cagagacaggtggcctagcag

SEQ ID NO: 2816939 - DNA, 20 bp, Homo sapiens
cagagaccccttcctttcct

SEQ ID NO: 2816940 - DNA, 19 bp, Homo sapiens
cagagactcagggccccag

SEQ ID NO: 2816941 - DNA, 23 bp, Homo sapiens
cagagactcagggccccagcact

SEQ ID NO: 2816942 - DNA, 22 bp, Homo sapiens
cagagagaggggagaagcctgg

SEQ ID NO: 2816943 - DNA, 18 bp, Homo sapiens
cagagaggtggagaactg

SEQ ID NO: 2816944 - DNA, 23 bp, Homo sapiens
cagagaggtggagaactgggatt

SEQ ID NO: 2816945 - DNA, 17 bp, Homo sapiens
cagagagtcctctggat

SEQ ID NO: 2816946 - DNA, 14 bp, Homo sapiens
cagagatgcctcca

SEQ ID NO: 2816947 - DNA, 19 bp, Homo sapiens
cagagatgcctccaccgct

SEQ ID NO: 2816948 - DNA, 20 bp, Homo sapiens
cagagcaagactccgtctca

SEQ ID NO: 2816949 - DNA, 20 bp, Homo sapiens
cagagcaagactctgtctca

SEQ ID NO: 2816950 - DNA, 23 bp, Homo sapiens
cagagcacacaggtacagcaaca

SEQ ID NO: 2816951 - DNA, 18 bp, Homo sapiens
cagagcacagcagcccct

SEQ ID NO: 2816952 - DNA, 17 bp, Homo sapiens
cagagcccaccttggct

SEQ ID NO: 2816953 - DNA, 19 bp, Homo sapiens
cagagcccatgctcaacca

SEQ ID NO: 2816954 - DNA, 12 bp, Homo sapiens
cagagcctgggg

SEQ ID NO: 2816955 - DNA, 14 bp, Homo sapiens
cagagcctggggca

SEQ ID NO: 2816956 - DNA, 24 bp, Homo sapiens
cagagcctggggcatcccagagcc

SEQ ID NO: 2816957 - DNA, 16 bp, Homo sapiens
cagagcctggggctct

SEQ ID NO: 2816958 - DNA, 21 bp, Homo sapiens
cagagccttcacaaccagcca

SEQ ID NO: 2816959 - DNA, 13 bp, Homo sapiens
cagagccttctcc

SEQ ID NO: 2816960 - DNA, 20 bp, Homo sapiens
cagagcgagagtctgtctca

SEQ ID NO: 2816961 - DNA, 16 bp, Homo sapiens
cagaggaagagcaggc

SEQ ID NO: 2816962 - DNA, 16 bp, Homo sapiens
cagaggagtccagggc

SEQ ID NO: 2816963 - DNA, 21 bp, Homo sapiens
cagaggagtccagggcgggag

SEQ ID NO: 2816964 - DNA, 22 bp, Homo sapiens
cagaggcagccccattctgcct

SEQ ID NO: 2816965 - DNA, 13 bp, Homo sapiens
cagaggcccagga

SEQ ID NO: 2816966 - DNA, 13 bp, Homo sapiens
cagaggccctgga

SEQ ID NO: 2816967 - DNA, 20 bp, Homo sapiens
cagaggctattattttcact

SEQ ID NO: 2816968 - DNA, 14 bp, Homo sapiens
cagaggctgcagga

SEQ ID NO: 2816969 - DNA, 17 bp, Homo sapiens
cagaggctgcaggactt

SEQ ID NO: 2816970 - DNA, 18 bp, Homo sapiens
cagaggctggaggcaggg

SEQ ID NO: 2816971 - DNA, 19 bp, Homo sapiens
cagaggctggaggcagggc

SEQ ID NO: 2816972 - DNA, 20 bp, Homo sapiens
cagaggctggaggcagggcc

SEQ ID NO: 2816973 - DNA, 16 bp, Homo sapiens
cagaggcttcttcaga

SEQ ID NO: 2816974 - DNA, 14 bp, Homo sapiens
cagagggagtgaca

SEQ ID NO: 2816975 - DNA, 16 bp, Homo sapiens
cagagggagtgacaga

SEQ ID NO: 2816976 - DNA, 16 bp, Homo sapiens
cagagggcagaggctg

SEQ ID NO: 2816977 - DNA, 18 bp, Homo sapiens
cagagggcagaggctgga

SEQ ID NO: 2816978 - DNA, 19 bp, Homo sapiens
cagaggggctttctggaga

SEQ ID NO: 2816979 - DNA, 21 bp, Homo sapiens
cagaggtaaaagtgtgagcag

SEQ ID NO: 2816980 - DNA, 22 bp, Homo sapiens
cagaggtgagcagaggagtcca

SEQ ID NO: 2816981 - DNA, 12 bp, Homo sapiens
cagaggtggtgg

SEQ ID NO: 2816982 - DNA, 19 bp, Homo sapiens
cagagtagagggcttggga

SEQ ID NO: 2816983 - DNA, 14 bp, Homo sapiens
cagagtatatatgt

SEQ ID NO: 2816984 - DNA, 16 bp, Homo sapiens
cagagtatatatgtac

SEQ ID NO: 2816985 - DNA, 23 bp, Homo sapiens
cagagtatatatgtacagttata

SEQ ID NO: 2816986 - DNA, 21 bp, Homo sapiens
cagagtctcactgttgcccag

SEQ ID NO: 2816987 - DNA, 17 bp, Homo sapiens
cagagtgagactctgtc

SEQ ID NO: 2816988 - DNA, 18 bp, Homo sapiens
cagagtgagactctgtct

SEQ ID NO: 2816989 - DNA, 19 bp, Homo sapiens
cagagtgagactctgtctc

SEQ ID NO: 2816990 - DNA, 20 bp, Homo sapiens
cagagttcactataaatggt

SEQ ID NO: 2816991 - DNA, 23 bp, Homo sapiens
cagagtttagaggaaaaaaatga

SEQ ID NO: 2816992 - DNA, 22 bp, Homo sapiens
cagataactgaaaattatttaa

SEQ ID NO: 2816993 - DNA, 21 bp, Homo sapiens
cagataagaatgctggttttc

SEQ ID NO: 2816994 - DNA, 18 bp, Homo sapiens
cagataatcagcctctta

SEQ ID NO: 2816995 - DNA, 18 bp, Homo sapiens
cagataatttattttgta

SEQ ID NO: 2816996 - DNA, 20 bp, Homo sapiens
cagatacaggaaaagctgct

SEQ ID NO: 2816997 - DNA, 23 bp, Homo sapiens
cagatacaggaaaagctgctgac

SEQ ID NO: 2816998 - DNA, 17 bp, Homo sapiens
cagatacattcatgagg

SEQ ID NO: 2816999 - DNA, 18 bp, Homo sapiens
cagatactggaagttttg

SEQ ID NO: 2817000 - DNA, 22 bp, Homo sapiens
cagatactggaagttttgcatt

SEQ ID NO: 2817001 - DNA, 13 bp, Homo sapiens
cagatatattttt

SEQ ID NO: 2817002 - DNA, 14 bp, Homo sapiens
cagatatatttttc

SEQ ID NO: 2817003 - DNA, 15 bp, Homo sapiens
cagatatatttttca

SEQ ID NO: 2817004 - DNA, 15 bp, Homo sapiens
cagatattttttcag

SEQ ID NO: 2817005 - DNA, 21 bp, Homo sapiens
cagatcaccagcccggcctgc

SEQ ID NO: 2817006 - DNA, 15 bp, Homo sapiens
cagatcatccagaag

SEQ ID NO: 2817007 - DNA, 16 bp, Homo sapiens
cagatcctcacaacca

SEQ ID NO: 2817008 - DNA, 23 bp, Homo sapiens
atttgtgagccaaagagaaaaga

SEQ ID NO: 2817009 - DNA, 16 bp, Homo sapiens
atttgttaaatattta

SEQ ID NO: 2817010 - DNA, 18 bp, Homo sapiens
atttgttaaatatttaca

SEQ ID NO: 2817011 - DNA, 13 bp, Homo sapiens
atttgttgagagt

SEQ ID NO: 2817012 - DNA, 18 bp, Homo sapiens
attttaaaaacatgagaa

SEQ ID NO: 2817013 - DNA, 23 bp, Homo sapiens
attttaaaaccatgcagcttcat

SEQ ID NO: 2817014 - DNA, 17 bp, Homo sapiens
attttaaagaattgtgt

SEQ ID NO: 2817015 - DNA, 15 bp, Homo sapiens
attttaagcattctt

SEQ ID NO: 2817016 - DNA, 14 bp, Homo sapiens
attttaagtgcttt

SEQ ID NO: 2817017 - DNA, 17 bp, Homo sapiens
attttaagtgctttgta

SEQ ID NO: 2817018 - DNA, 20 bp, Homo sapiens
attttaagtgctttgtaatg

SEQ ID NO: 2817019 - DNA, 18 bp, Homo sapiens
attttaatttatgagttt

SEQ ID NO: 2817020 - DNA, 19 bp, Homo sapiens
attttacagagaatctgaa

SEQ ID NO: 2817021 - DNA, 13 bp, Homo sapiens
attttacagagct

SEQ ID NO: 2817022 - DNA, 23 bp, Homo sapiens
attttactgtctgtaagagaatt

SEQ ID NO: 2817023 - DNA, 18 bp, Homo sapiens
attttagccttctctgtt

SEQ ID NO: 2817024 - DNA, 17 bp, Homo sapiens
attttatacatagtcac

SEQ ID NO: 2817025 - DNA, 23 bp, Homo sapiens
attttatacatagtcacaaaaat

SEQ ID NO: 2817026 - DNA, 19 bp, Homo sapiens
attttatagctcagtttat

SEQ ID NO: 2817027 - DNA, 22 bp, Homo sapiens
attttatagctcagtttatcca

SEQ ID NO: 2817028 - DNA, 14 bp, Homo sapiens
attttatctgtgtt

SEQ ID NO: 2817029 - DNA, 17 bp, Homo sapiens
attttatgatttaaaaa

SEQ ID NO: 2817030 - DNA, 18 bp, Homo sapiens
attttcaaactttgtact

SEQ ID NO: 2817031 - DNA, 17 bp, Homo sapiens
attttcaagaaactgag

SEQ ID NO: 2817032 - DNA, 23 bp, Homo sapiens
attgatcggagcctcctctctca

SEQ ID NO: 2817033 - DNA, 22 bp, Homo sapiens
attgatgtttccagaaaatata

SEQ ID NO: 2817034 - DNA, 23 bp, Homo sapiens
attgatgtttccagaaaatataa

SEQ ID NO: 2817035 - DNA, 18 bp, Homo sapiens
attgcaacaggctgggct

SEQ ID NO: 2817036 - DNA, 10 bp, Homo sapiens
attgcacaat

SEQ ID NO: 2817037 - DNA, 13 bp, Homo sapiens
attgcacaatttg

SEQ ID NO: 2817038 - DNA, 16 bp, Homo sapiens
attgcacaatttgagc

SEQ ID NO: 2817039 - DNA, 18 bp, Homo sapiens
attgcacaatttgagcaa

SEQ ID NO: 2817040 - DNA, 17 bp, Homo sapiens
attgcaggacacaagca

SEQ ID NO: 2817041 - DNA, 13 bp, Homo sapiens
attgcatgtaaaa

SEQ ID NO: 2817042 - DNA, 21 bp, Homo sapiens
attgcattctgaatgaataaa

SEQ ID NO: 2817043 - DNA, 15 bp, Homo sapiens
attgcatttctgctc

SEQ ID NO: 2817044 - DNA, 20 bp, Homo sapiens
attgctactgtcctacccac

SEQ ID NO: 2817045 - DNA, 17 bp, Homo sapiens
attgcttaaaatagcaa

SEQ ID NO: 2817046 - DNA, 18 bp, Homo sapiens
attgcttgagcccaggag

SEQ ID NO: 2817047 - DNA, 15 bp, Homo sapiens
attgcttgatacttt

SEQ ID NO: 2817048 - DNA, 14 bp, Homo sapiens
attggccagagagt

SEQ ID NO: 2817049 - DNA, 23 bp, Homo sapiens
attggctttaaacacccttcaca

SEQ ID NO: 2817050 - DNA, 13 bp, Homo sapiens
attgggaaatctt

SEQ ID NO: 2817051 - DNA, 18 bp, Homo sapiens
attgggagcttgggaatg

SEQ ID NO: 2817052 - DNA, 17 bp, Homo sapiens
attgggcaagtgattga

SEQ ID NO: 2817053 - DNA, 18 bp, Homo sapiens
attgggtgggtaaattca

SEQ ID NO: 2817054 - DNA, 17 bp, Homo sapiens
atggttgccaggacgaa

SEQ ID NO: 2817055 - DNA, 18 bp, Homo sapiens
atggttgtctgtttttgt

SEQ ID NO: 2817056 - DNA, 18 bp, Homo sapiens
atggtttactgctgtcat

SEQ ID NO: 2817057 - DNA, 16 bp, Homo sapiens
atggtttgcaaggaag

SEQ ID NO: 2817058 - DNA, 18 bp, Homo sapiens
atggtttgcaaggaagcc

SEQ ID NO: 2817059 - DNA, 14 bp, Homo sapiens
atggttttctccaa

SEQ ID NO: 2817060 - DNA, 21 bp, Homo sapiens
atgtaaaacatttattttgac

SEQ ID NO: 2817061 - DNA, 13 bp, Homo sapiens
atgtaaaatgcag

SEQ ID NO: 2817062 - DNA, 18 bp, Homo sapiens
atgtaaaatgcagtccag

SEQ ID NO: 2817063 - DNA, 21 bp, Homo sapiens
atgtaaaatgcagtccagaat

SEQ ID NO: 2817064 - DNA, 23 bp, Homo sapiens
atgtaaaatgcagtccagaataa

SEQ ID NO: 2817065 - DNA, 16 bp, Homo sapiens
atgtaaacagtgcctg

SEQ ID NO: 2817066 - DNA, 21 bp, Homo sapiens
atgtaaatattttaaagaatt

SEQ ID NO: 2817067 - DNA, 21 bp, Homo sapiens
atgtaaccaagagtattccat

SEQ ID NO: 2817068 - DNA, 22 bp, Homo sapiens
atgtaacccaaatgtccaatat

SEQ ID NO: 2817069 - DNA, 16 bp, Homo sapiens
atgtaacttttgtaag

SEQ ID NO: 2817070 - DNA, 17 bp, Homo sapiens
atgtaacttttgtaaga

SEQ ID NO: 2817071 - DNA, 18 bp, Homo sapiens
atgtaacttttgtaagac

SEQ ID NO: 2817072 - DNA, 12 bp, Homo sapiens
atgtaaggaatt

SEQ ID NO: 2817073 - DNA, 22 bp, Homo sapiens
atgtaagtaattgcatttctgc

SEQ ID NO: 2817074 - DNA, 15 bp, Homo sapiens
atgtaataaatctga

SEQ ID NO: 2817075 - DNA, 18 bp, Homo sapiens
atgtaccagtgtactgct

SEQ ID NO: 2817076 - DNA, 21 bp, Homo sapiens
atgtaccatgtacatgaagaa

SEQ ID NO: 2817077 - DNA, 17 bp, Homo sapiens
atgtaccatgttaaaga

SEQ ID NO: 2817078 - DNA, 12 bp, Homo sapiens
atgtaggaggga

SEQ ID NO: 2817079 - DNA, 18 bp, Homo sapiens
atgtagggtaaggtgcct

SEQ ID NO: 2817080 - DNA, 16 bp, Homo sapiens
atgtaggtatgaataa

SEQ ID NO: 2817081 - DNA, 17 bp, Homo sapiens
atgtaggtatgaataag

SEQ ID NO: 2817082 - DNA, 15 bp, Homo sapiens
atgtaggtgtctgca

SEQ ID NO: 2817083 - DNA, 16 bp, Homo sapiens
atgtagtataaagaaa

SEQ ID NO: 2817084 - DNA, 17 bp, Homo sapiens
atgtagtataaagaaaa

SEQ ID NO: 2817085 - DNA, 19 bp, Homo sapiens
atgtagtataaagaaaagt

SEQ ID NO: 2817086 - DNA, 16 bp, Homo sapiens
atgtagtatgatgtaa

SEQ ID NO: 2817087 - DNA, 14 bp, Homo sapiens
atgtataatatttt

SEQ ID NO: 2817088 - DNA, 12 bp, Homo sapiens
atgtatagtaaa

SEQ ID NO: 2817089 - DNA, 15 bp, Homo sapiens
atgtatagtaaatca

SEQ ID NO: 2817090 - DNA, 16 bp, Homo sapiens
atgtatagtaaatcac

SEQ ID NO: 2817091 - DNA, 19 bp, Homo sapiens
atgtatatatatatagtaa

SEQ ID NO: 2817092 - DNA, 15 bp, Homo sapiens
atgtatatgtatata

SEQ ID NO: 2817093 - DNA, 17 bp, Homo sapiens
atgtatatgtatatata

SEQ ID NO: 2817094 - DNA, 16 bp, Homo sapiens
atgtatcatagaaatg

SEQ ID NO: 2817095 - DNA, 15 bp, Homo sapiens
atgtatcctgataaa

SEQ ID NO: 2817096 - DNA, 22 bp, Homo sapiens
atgtatcctgataaacattaaa

SEQ ID NO: 2817097 - DNA, 16 bp, Homo sapiens
atgtatcttatttata

SEQ ID NO: 2817098 - DNA, 19 bp, Homo sapiens
atgtatcttatttatatat

SEQ ID NO: 2817099 - DNA, 21 bp, Homo sapiens
atgtatcttatttatatatga

SEQ ID NO: 2817100 - DNA, 14 bp, Homo sapiens
atgtatgtgtgtat

SEQ ID NO: 2817101 - DNA, 15 bp, Homo sapiens
atgtatgtgtgtatg

SEQ ID NO: 2817102 - DNA, 16 bp, Homo sapiens
atgtattattttctat

SEQ ID NO: 2817103 - DNA, 17 bp, Homo sapiens
atgtattattttctata

SEQ ID NO: 2817104 - DNA, 17 bp, Homo sapiens
atgtattcacacacccc

SEQ ID NO: 2817105 - DNA, 13 bp, Homo sapiens
atgtcaaacaaat

SEQ ID NO: 2817106 - DNA, 14 bp, Homo sapiens
atgtcaaacaaata

SEQ ID NO: 2817107 - DNA, 16 bp, Homo sapiens
atgtcaatttgtatat

SEQ ID NO: 2817108 - DNA, 20 bp, Homo sapiens
atgtcaatttgtatatcatg

SEQ ID NO: 2817109 - DNA, 13 bp, Homo sapiens
atgtcacaggcag

SEQ ID NO: 2817110 - DNA, 15 bp, Homo sapiens
atgtcacaggcaggt

SEQ ID NO: 2817111 - DNA, 13 bp, Homo sapiens
atgtcaccacctt

SEQ ID NO: 2817112 - DNA, 16 bp, Homo sapiens
atgtcaccaccttccc

SEQ ID NO: 2817113 - DNA, 20 bp, Homo sapiens
atgtcaccaccttcccagct

SEQ ID NO: 2817114 - DNA, 20 bp, Homo sapiens
atgtcaccgtggaccttcct

SEQ ID NO: 2817115 - DNA, 21 bp, Homo sapiens
atgtcaccgtggaccttcctg

SEQ ID NO: 2817116 - DNA, 13 bp, Homo sapiens
atgtcagaaactc

SEQ ID NO: 2817117 - DNA, 16 bp, Homo sapiens
atgtcagactggctgg

SEQ ID NO: 2817118 - DNA, 23 bp, Homo sapiens
atgtcagccgagccgggcctggg

SEQ ID NO: 2817119 - DNA, 19 bp, Homo sapiens
atgtcaggaacagaaggat

SEQ ID NO: 2817120 - DNA, 21 bp, Homo sapiens
atgtcatattggcagttggag

SEQ ID NO: 2817121 - DNA, 22 bp, Homo sapiens
atgtcatcaaatattaccaaaa

SEQ ID NO: 2817122 - DNA, 18 bp, Homo sapiens
atgtcatttcatttccta

SEQ ID NO: 2817123 - DNA, 21 bp, Homo sapiens
atgtccagaagaatattcagg

SEQ ID NO: 2817124 - DNA, 20 bp, Homo sapiens
atgtcccatctgctcctccc

SEQ ID NO: 2817125 - DNA, 21 bp, Homo sapiens
atgtccctacacccctcccct

SEQ ID NO: 2817126 - DNA, 18 bp, Homo sapiens
atgtcctaaggacacact

SEQ ID NO: 2817127 - DNA, 20 bp, Homo sapiens
atgtcctaaggacacactaa

SEQ ID NO: 2817128 - DNA, 21 bp, Homo sapiens
atgtcctaaggacacactaat

SEQ ID NO: 2817129 - DNA, 23 bp, Homo sapiens
atgtcctccaacaataaagagct

SEQ ID NO: 2817130 - DNA, 14 bp, Homo sapiens
atgtcgcctctgca

SEQ ID NO: 2817131 - DNA, 15 bp, Homo sapiens
atgtctatagagaaa

SEQ ID NO: 2817132 - DNA, 20 bp, Homo sapiens
atgtctcaatagtaaaagat

SEQ ID NO: 2817133 - DNA, 22 bp, Homo sapiens
atgtctcaggtccctgcagggc

SEQ ID NO: 2817134 - DNA, 12 bp, Homo sapiens
caattaaaatat

SEQ ID NO: 2817135 - DNA, 14 bp, Homo sapiens
caattaaaatatat

SEQ ID NO: 2817136 - DNA, 15 bp, Homo sapiens
caattaaaatatata

SEQ ID NO: 2817137 - DNA, 16 bp, Homo sapiens
caattaaaatatatat

SEQ ID NO: 2817138 - DNA, 17 bp, Homo sapiens
caattaaaatatatata

SEQ ID NO: 2817139 - DNA, 21 bp, Homo sapiens
caattaaaatatatataaata

SEQ ID NO: 2817140 - DNA, 14 bp, Homo sapiens
caattaaaggcaaa

SEQ ID NO: 2817141 - DNA, 13 bp, Homo sapiens
caattaaatgtag

SEQ ID NO: 2817142 - DNA, 13 bp, Homo sapiens
caattaattctta

SEQ ID NO: 2817143 - DNA, 18 bp, Homo sapiens
caattatcttatttaatt

SEQ ID NO: 2817144 - DNA, 22 bp, Homo sapiens
caattatgtgacaacctttgtg

SEQ ID NO: 2817145 - DNA, 23 bp, Homo sapiens
caattatgtgacaacctttgtgt

SEQ ID NO: 2817146 - DNA, 14 bp, Homo sapiens
caattcacttcatt

SEQ ID NO: 2817147 - DNA, 21 bp, Homo sapiens
caattcacttcattgaccaag

SEQ ID NO: 2817148 - DNA, 16 bp, Homo sapiens
caattcatttcacttt

SEQ ID NO: 2817149 - DNA, 19 bp, Homo sapiens
caattcatttcactttaaa

SEQ ID NO: 2817150 - DNA, 15 bp, Homo sapiens
caattccatttccag

SEQ ID NO: 2817151 - DNA, 14 bp, Homo sapiens
caattcctctggga

SEQ ID NO: 2817152 - DNA, 23 bp, Homo sapiens
caattctcatttgtcacacactt

SEQ ID NO: 2817153 - DNA, 18 bp, Homo sapiens
caattgaacttaaataaa

SEQ ID NO: 2817154 - DNA, 21 bp, Homo sapiens
caattgcacgcggagtgagtt

SEQ ID NO: 2817155 - DNA, 12 bp, Homo sapiens
caattgtaaaaa

SEQ ID NO: 2817156 - DNA, 13 bp, Homo sapiens
caatttaaagcaa

SEQ ID NO: 2817157 - DNA, 13 bp, Homo sapiens
caatttagaaaac

SEQ ID NO: 2817158 - DNA, 22 bp, Homo sapiens
caatttagaaaacattcatcca

SEQ ID NO: 2817159 - DNA, 17 bp, Homo sapiens
caatttccaagagctga

SEQ ID NO: 2817160 - DNA, 12 bp, Homo sapiens
caattttgtaac

SEQ ID NO: 2817161 - DNA, 13 bp, Homo sapiens
caatttttaaact

SEQ ID NO: 2817162 - DNA, 22 bp, Homo sapiens
caatttttatacatatcagaaa

SEQ ID NO: 2817163 - DNA, 21 bp, Homo sapiens
cacaaaaatggtggtttgtca

SEQ ID NO: 2817164 - DNA, 15 bp, Homo sapiens
cacaaaccatgcaaa

SEQ ID NO: 2817165 - DNA, 16 bp, Homo sapiens
cacaacacacacactc

SEQ ID NO: 2817166 - DNA, 14 bp, Homo sapiens
cacaaccagccaca

SEQ ID NO: 2817167 - DNA, 14 bp, Homo sapiens
cacaaccaggaaga

SEQ ID NO: 2817168 - DNA, 17 bp, Homo sapiens
cacaaccctgttttata

SEQ ID NO: 2817169 - DNA, 18 bp, Homo sapiens
cacaactgtttttgaaga

SEQ ID NO: 2817170 - DNA, 15 bp, Homo sapiens
cacaagcaataatta

SEQ ID NO: 2817171 - DNA, 21 bp, Homo sapiens
cacaagcaataattaggatct

SEQ ID NO: 2817172 - DNA, 13 bp, Homo sapiens
cacaagcacaaag

SEQ ID NO: 2817173 - DNA, 14 bp, Homo sapiens
cacaagcacaaagc

SEQ ID NO: 2817174 - DNA, 18 bp, Homo sapiens
atggtgtaatgcacaatt

SEQ ID NO: 2817175 - DNA, 22 bp, Homo sapiens
atggtgtgaaagtcagatgccc

SEQ ID NO: 2817176 - DNA, 16 bp, Homo sapiens
atggttccatgcctga

SEQ ID NO: 2817177 - DNA, 22 bp, Homo sapiens
atggttccatgcctgagggtgg

SEQ ID NO: 2817178 - DNA, 16 bp, Homo sapiens
ataaaaaaatacagta

SEQ ID NO: 2817179 - DNA, 18 bp, Homo sapiens
ataaaaaccagaatcata

SEQ ID NO: 2817180 - DNA, 13 bp, Homo sapiens
ataaaaaccctgt

SEQ ID NO: 2817181 - DNA, 18 bp, Homo sapiens
ataaaaataatatatgct

SEQ ID NO: 2817182 - DNA, 19 bp, Homo sapiens
ataaaaataccttaaatct

SEQ ID NO: 2817183 - DNA, 12 bp, Homo sapiens
ataaaacattcc

SEQ ID NO: 2817184 - DNA, 22 bp, Homo sapiens
ataaaacctttcaaatttcaca

SEQ ID NO: 2817185 - DNA, 17 bp, Homo sapiens
ataaaactcagttaaaa

SEQ ID NO: 2817186 - DNA, 16 bp, Homo sapiens
ataaaagcagcatctg

SEQ ID NO: 2817187 - DNA, 20 bp, Homo sapiens
ataaaagcagcatctgctaa

SEQ ID NO: 2817188 - DNA, 15 bp, Homo sapiens
ataaaagcataaatg

SEQ ID NO: 2817189 - DNA, 20 bp, Homo sapiens
ataaaagcataaatgcaaac

SEQ ID NO: 2817190 - DNA, 13 bp, Homo sapiens
ataaaataaagta

SEQ ID NO: 2817191 - DNA, 14 bp, Homo sapiens
ataaaataaagtat

SEQ ID NO: 2817192 - DNA, 16 bp, Homo sapiens
ataaaataattttatt

SEQ ID NO: 2817193 - DNA, 16 bp, Homo sapiens
ataaaatagtattgaa

SEQ ID NO: 2817194 - DNA, 15 bp, Homo sapiens
ataaaatgatgtatg

SEQ ID NO: 2817195 - DNA, 19 bp, Homo sapiens
ataaaattatggtgaaatt

SEQ ID NO: 2817196 - DNA, 13 bp, Homo sapiens
ataaacattaaac

SEQ ID NO: 2817197 - DNA, 23 bp, Homo sapiens
ataaacattaagattgaggcctg

SEQ ID NO: 2817198 - DNA, 16 bp, Homo sapiens
ataaacttcagcacca

SEQ ID NO: 2817199 - DNA, 15 bp, Homo sapiens
ataaacttgtgtatg

SEQ ID NO: 2817200 - DNA, 15 bp, Homo sapiens
ataaagatggctatt

SEQ ID NO: 2817201 - DNA, 18 bp, Homo sapiens
atatctaatttatacaaa

SEQ ID NO: 2817202 - DNA, 22 bp, Homo sapiens
atatctaatttatacaaaataa

SEQ ID NO: 2817203 - DNA, 14 bp, Homo sapiens
atatctatctattt

SEQ ID NO: 2817204 - DNA, 17 bp, Homo sapiens
atatctatctatttgag

SEQ ID NO: 2817205 - DNA, 13 bp, Homo sapiens
atatctatcttat

SEQ ID NO: 2817206 - DNA, 20 bp, Homo sapiens
atatctatcttatatagttt

SEQ ID NO: 2817207 - DNA, 13 bp, Homo sapiens
atatctcagaggc

SEQ ID NO: 2817208 - DNA, 13 bp, Homo sapiens
atatctcctgaaa

SEQ ID NO: 2817209 - DNA, 14 bp, Homo sapiens
atagcccaggtcct

SEQ ID NO: 2817210 - DNA, 18 bp, Homo sapiens
atagccgggcatggtggc

SEQ ID NO: 2817211 - DNA, 13 bp, Homo sapiens
atagctaaatacc

SEQ ID NO: 2817212 - DNA, 16 bp, Homo sapiens
atagctattgcatgta

SEQ ID NO: 2817213 - DNA, 22 bp, Homo sapiens
atagctattgcatgtaaaatgc

SEQ ID NO: 2817214 - DNA, 12 bp, Homo sapiens
atagctattttt

SEQ ID NO: 2817215 - DNA, 20 bp, Homo sapiens
atagctatttttatggaatt

SEQ ID NO: 2817216 - DNA, 19 bp, Homo sapiens
atagctcaggtgtccctgc

SEQ ID NO: 2817217 - DNA, 22 bp, Homo sapiens
atagctcaggtgtccctgcact

SEQ ID NO: 2817218 - DNA, 13 bp, Homo sapiens
atagctcagttta

SEQ ID NO: 2817219 - DNA, 22 bp, Homo sapiens
atagctcagtttatccaaggtg

SEQ ID NO: 2817220 - DNA, 18 bp, Homo sapiens
atagctcttctatttaaa

SEQ ID NO: 2817221 - DNA, 10 bp, Homo sapiens
atagctttat

SEQ ID NO: 2817222 - DNA, 21 bp, Homo sapiens
atagctttattttttaagtat

SEQ ID NO: 2817223 - DNA, 22 bp, Homo sapiens
agtcccagctactcagaagcct

SEQ ID NO: 2817224 - DNA, 22 bp, Homo sapiens
agtccccacagataactgaaaa

SEQ ID NO: 2817225 - DNA, 18 bp, Homo sapiens
agtcccccaccacactga

SEQ ID NO: 2817226 - DNA, 20 bp, Homo sapiens
agtccctgggggaagccctg

SEQ ID NO: 2817227 - DNA, 22 bp, Homo sapiens
agtccctgggggaagccctgga

SEQ ID NO: 2817228 - DNA, 20 bp, Homo sapiens
agtccgcctggccggctcca

SEQ ID NO: 2817229 - DNA, 22 bp, Homo sapiens
agtccgcctggccggctccagt

SEQ ID NO: 2817230 - DNA, 12 bp, Homo sapiens
agtccgtccacc

SEQ ID NO: 2817231 - DNA, 21 bp, Homo sapiens
agtcctcgtagccatctctct

SEQ ID NO: 2817232 - DNA, 22 bp, Homo sapiens
agtcctcttttctgagaggact

SEQ ID NO: 2817233 - DNA, 14 bp, Homo sapiens
agtcgagccctgca

SEQ ID NO: 2817234 - DNA, 19 bp, Homo sapiens
agtcgtccttactcctgtg

SEQ ID NO: 2817235 - DNA, 20 bp, Homo sapiens
agtctaaagctggtttaatg

SEQ ID NO: 2817236 - DNA, 14 bp, Homo sapiens
agtctacgctctcc

SEQ ID NO: 2817237 - DNA, 16 bp, Homo sapiens
agtctaggagctggga

SEQ ID NO: 2817238 - DNA, 20 bp, Homo sapiens
agtctaggagctgggaggaa

SEQ ID NO: 2817239 - DNA, 15 bp, Homo sapiens
agtctcctctctgag

SEQ ID NO: 2817240 - DNA, 16 bp, Homo sapiens
agtctcctctctgaga

SEQ ID NO: 2817241 - DNA, 21 bp, Homo sapiens
agtctcctttgcactgagggc

SEQ ID NO: 2817242 - DNA, 13 bp, Homo sapiens
agtctctgggaga

SEQ ID NO: 2817243 - DNA, 21 bp, Homo sapiens
agtctctgggagactttccct

SEQ ID NO: 2817244 - DNA, 23 bp, Homo sapiens
agtctctttaatcttcagtttta

SEQ ID NO: 2817245 - DNA, 16 bp, Homo sapiens
agtctgaggtcctgag

SEQ ID NO: 2817246 - DNA, 12 bp, Homo sapiens
aggtcagagcct

SEQ ID NO: 2817247 - DNA, 13 bp, Homo sapiens
aggtcagagcctg

SEQ ID NO: 2817248 - DNA, 17 bp, Homo sapiens
aggtcatagctgagatt

SEQ ID NO: 2817249 - DNA, 13 bp, Homo sapiens
aggtcccaggcag

SEQ ID NO: 2817250 - DNA, 14 bp, Homo sapiens
aggtcccaggcaga

SEQ ID NO: 2817251 - DNA, 15 bp, Homo sapiens
aggtccctgccagtg

SEQ ID NO: 2817252 - DNA, 14 bp, Homo sapiens
aggtcccttgtttc

SEQ ID NO: 2817253 - DNA, 21 bp, Homo sapiens
aggtcctgagcactgccagga

SEQ ID NO: 2817254 - DNA, 17 bp, Homo sapiens
aggtcctggtggggcag

SEQ ID NO: 2817255 - DNA, 19 bp, Homo sapiens
aggtcctggtggggcagct

SEQ ID NO: 2817256 - DNA, 16 bp, Homo sapiens
aggtccttctgctgga

SEQ ID NO: 2817257 - DNA, 17 bp, Homo sapiens
aggtctagactttctca

SEQ ID NO: 2817258 - DNA, 15 bp, Homo sapiens
aggtctcctcttaaa

SEQ ID NO: 2817259 - DNA, 17 bp, Homo sapiens
aggtcttgaactcctgg

SEQ ID NO: 2817260 - DNA, 21 bp, Homo sapiens
aggtcttgaactcctggcctc

SEQ ID NO: 2817261 - DNA, 13 bp, Homo sapiens
aggtcttgcctga

SEQ ID NO: 2817262 - DNA, 23 bp, Homo sapiens
aggtcttggccgactcagggacc

SEQ ID NO: 2817263 - DNA, 19 bp, Homo sapiens
aggtgaacaccactttgtc

SEQ ID NO: 2817264 - DNA, 21 bp, Homo sapiens
aggtgaccccagggcacagga

SEQ ID NO: 2817265 - DNA, 24 bp, Homo sapiens
aggtgaccccagggcacaggagct

SEQ ID NO: 2817266 - DNA, 14 bp, Homo sapiens
aggtgagaccacct

SEQ ID NO: 2817267 - DNA, 15 bp, Homo sapiens
aggtgagaccacctc

SEQ ID NO: 2817268 - DNA, 11 bp, Homo sapiens
aggtgcagtgg

SEQ ID NO: 2817269 - DNA, 14 bp, Homo sapiens
aggtgcccaggaga

SEQ ID NO: 2817270 - DNA, 11 bp, Homo sapiens
aggtgcctgtg

SEQ ID NO: 2817271 - DNA, 19 bp, Homo sapiens
aggtgcctgtgaggcaggg

SEQ ID NO: 2817272 - DNA, 13 bp, Homo sapiens
aggtgccttctta

SEQ ID NO: 2817273 - DNA, 22 bp, Homo sapiens
aggtgccttcttattctcactc

SEQ ID NO: 2817274 - DNA, 23 bp, Homo sapiens
aggtgccttcttattctcactcc

SEQ ID NO: 2817275 - DNA, 16 bp, Homo sapiens
aggtgctgccatccag

SEQ ID NO: 2817276 - DNA, 17 bp, Homo sapiens
aggtggaagccctcctt

SEQ ID NO: 2817277 - DNA, 20 bp, Homo sapiens
aggtggaagccctccttcca

SEQ ID NO: 2817278 - DNA, 21 bp, Homo sapiens
aggtggaagccctccttccac

SEQ ID NO: 2817279 - DNA, 17 bp, Homo sapiens
aggtggatcacctgagg

SEQ ID NO: 2817280 - DNA, 15 bp, Homo sapiens
aggtggcagccctgt

SEQ ID NO: 2817281 - DNA, 15 bp, Homo sapiens
aggtggcatctctaa

SEQ ID NO: 2817282 - DNA, 15 bp, Homo sapiens
aggtggctctccagt

SEQ ID NO: 2817283 - DNA, 19 bp, Homo sapiens
aggtggctgacccagtccc

SEQ ID NO: 2817284 - DNA, 21 bp, Homo sapiens
aggtggctgacccagtccctg

SEQ ID NO: 2817285 - DNA, 16 bp, Homo sapiens
aggtggggcagcttga

SEQ ID NO: 2817286 - DNA, 21 bp, Homo sapiens
aggtgggttttcttcccatca

SEQ ID NO: 2817287 - DNA, 22 bp, Homo sapiens
aggtgggttttcttcccatcac

SEQ ID NO: 2817288 - DNA, 15 bp, Homo sapiens
aggtggtatgtgtgt

SEQ ID NO: 2817289 - DNA, 19 bp, Homo sapiens
aggtggttctaatattttt

SEQ ID NO: 2817290 - DNA, 17 bp, Homo sapiens
aggtgtactatggctgt

SEQ ID NO: 2817291 - DNA, 20 bp, Homo sapiens
aggtgtccctgcacttgcag

SEQ ID NO: 2817292 - DNA, 20 bp, Homo sapiens
aggtgtgagtcaccaagccc

SEQ ID NO: 2817293 - DNA, 21 bp, Homo sapiens
aggtgtgagtcaccaagccca

SEQ ID NO: 2817294 - DNA, 22 bp, Homo sapiens
aggtgtgagtcaccaagcccag

SEQ ID NO: 2817295 - DNA, 22 bp, Homo sapiens
aggtgttcaagaccagcctgac

SEQ ID NO: 2817296 - DNA, 12 bp, Homo sapiens
aggtgtttatac

SEQ ID NO: 2817297 - DNA, 15 bp, Homo sapiens
aggttataagaaaca

SEQ ID NO: 2817298 - DNA, 16 bp, Homo sapiens
aggttataagaaacag

SEQ ID NO: 2817299 - DNA, 14 bp, Homo sapiens
aggttatgcctcat

SEQ ID NO: 2817300 - DNA, 13 bp, Homo sapiens
aggttcagcttgt

SEQ ID NO: 2817301 - DNA, 20 bp, Homo sapiens
aggttgaggggctcctggaa

SEQ ID NO: 2817302 - DNA, 14 bp, Homo sapiens
aggtttctgaaaat

SEQ ID NO: 2817303 - DNA, 19 bp, Homo sapiens
aggtttctgagttcctgca

SEQ ID NO: 2817304 - DNA, 21 bp, Homo sapiens
aggtttctgagttcctgcatg

SEQ ID NO: 2817305 - DNA, 21 bp, Homo sapiens
aggtttggggagggggaagag

SEQ ID NO: 2817306 - DNA, 16 bp, Homo sapiens
aggtttggtgtgtgga

SEQ ID NO: 2817307 - DNA, 13 bp, Homo sapiens
aggttttgtaaag

SEQ ID NO: 2817308 - DNA, 12 bp, Homo sapiens
agtaaaagcaaa

SEQ ID NO: 2817309 - DNA, 12 bp, Homo sapiens
agtaaaagctaa

SEQ ID NO: 2817310 - DNA, 14 bp, Homo sapiens
agtaaaagctaatt

SEQ ID NO: 2817311 - DNA, 20 bp, Homo sapiens
agtaaaagctaattaggatt

SEQ ID NO: 2817312 - DNA, 18 bp, Homo sapiens
agtaaagtcaaggagaaa

SEQ ID NO: 2817313 - DNA, 17 bp, Homo sapiens
agtaaagtttaaaaaat

SEQ ID NO: 2817314 - DNA, 23 bp, Homo sapiens
agtaagtggggttgcaaccactg

SEQ ID NO: 2817315 - DNA, 14 bp, Homo sapiens
agtaagttctgaaa

SEQ ID NO: 2817316 - DNA, 19 bp, Homo sapiens
agtaagttctgaaaactgt

SEQ ID NO: 2817317 - DNA, 18 bp, Homo sapiens
agtaatgggccaattaaa

SEQ ID NO: 2817318 - DNA, 21 bp, Homo sapiens
agtaatgggccaattaaaata

SEQ ID NO: 2817319 - DNA, 22 bp, Homo sapiens
agtaatgggccaattaaaatat

SEQ ID NO: 2817320 - DNA, 19 bp, Homo sapiens
agtaattgcatttctgctc

SEQ ID NO: 2817321 - DNA, 17 bp, Homo sapiens
agtaattgtagatggaa

SEQ ID NO: 2817322 - DNA, 13 bp, Homo sapiens
agtaatttattgt

SEQ ID NO: 2817323 - DNA, 22 bp, Homo sapiens
agtacagtagcttaaataaatt

SEQ ID NO: 2817324 - DNA, 14 bp, Homo sapiens
agtacctttgtcac

SEQ ID NO: 2817325 - DNA, 15 bp, Homo sapiens
agtacctttgtcaca

SEQ ID NO: 2817326 - DNA, 16 bp, Homo sapiens
agtactcctgcaaaat

SEQ ID NO: 2817327 - DNA, 20 bp, Homo sapiens
agtagaacaagcaacataaa

SEQ ID NO: 2817328 - DNA, 18 bp, Homo sapiens
agtagaataaagaaaaac

SEQ ID NO: 2817329 - DNA, 15 bp, Homo sapiens
agtagaattatatct

SEQ ID NO: 2817330 - DNA, 17 bp, Homo sapiens
agtagaattatatctaa

SEQ ID NO: 2817331 - DNA, 21 bp, Homo sapiens
agtagaattatatctaattta

SEQ ID NO: 2817332 - DNA, 16 bp, Homo sapiens
agtagagaagtatcca

SEQ ID NO: 2817333 - DNA, 21 bp, Homo sapiens
agtagagaagtatccaattat

SEQ ID NO: 2817334 - DNA, 12 bp, Homo sapiens
agtagagacagg

SEQ ID NO: 2817335 - DNA, 16 bp, Homo sapiens
agtagcaagttctaga

SEQ ID NO: 2817336 - DNA, 23 bp, Homo sapiens
agtagcacaagttatttaaatct

SEQ ID NO: 2817337 - DNA, 16 bp, Homo sapiens
actgcattagaaatta

SEQ ID NO: 2817338 - DNA, 12 bp, Homo sapiens
actgccaggagg

SEQ ID NO: 2817339 - DNA, 13 bp, Homo sapiens
actgccaggaggg

SEQ ID NO: 2817340 - DNA, 17 bp, Homo sapiens
gttccatgcctgagggt

SEQ ID NO: 2817341 - DNA, 20 bp, Homo sapiens
gttccatgcctgagggtgga

SEQ ID NO: 2817342 - DNA, 21 bp, Homo sapiens
gttcccaagagcatcatgcct

SEQ ID NO: 2817343 - DNA, 23 bp, Homo sapiens
gttcccaagagcatcatgcctct

SEQ ID NO: 2817344 - DNA, 20 bp, Homo sapiens
gttccctacttcctgtgact

SEQ ID NO: 2817345 - DNA, 19 bp, Homo sapiens
gttccctgaacatctgtgt

SEQ ID NO: 2817346 - DNA, 23 bp, Homo sapiens
tcagatattttttcagaaatatg

SEQ ID NO: 2817347 - DNA, 13 bp, Homo sapiens
tcagatcagtgct

SEQ ID NO: 2817348 - DNA, 17 bp, Homo sapiens
tcagatcgtattaatta

SEQ ID NO: 2817349 - DNA, 18 bp, Homo sapiens
tcagatcgtattaattat

SEQ ID NO: 2817350 - DNA, 21 bp, Homo sapiens
tcagattcccagagcaaaata

SEQ ID NO: 2817351 - DNA, 15 bp, Homo sapiens
tcagcagccctcctc

SEQ ID NO: 2817352 - DNA, 16 bp, Homo sapiens
tcagcatcctggcacc

SEQ ID NO: 2817353 - DNA, 21 bp, Homo sapiens
tcagcattcagtccgcctggc

SEQ ID NO: 2817354 - DNA, 20 bp, Homo sapiens
tcagcatttaataaatgtat

SEQ ID NO: 2817355 - DNA, 14 bp, Homo sapiens
tcagccaaatgtaa

SEQ ID NO: 2817356 - DNA, 16 bp, Homo sapiens
tcagccacacctgtca

SEQ ID NO: 2817357 - DNA, 14 bp, Homo sapiens
tcagccagggccag

SEQ ID NO: 2817358 - DNA, 16 bp, Homo sapiens
tcagccagggccaggg

SEQ ID NO: 2817359 - DNA, 12 bp, Homo sapiens
tcagcccctcct

SEQ ID NO: 2817360 - DNA, 22 bp, Homo sapiens
tcagcccctcctctgccacctc

SEQ ID NO: 2817361 - DNA, 23 bp, Homo sapiens
tcagcccctcctctgccacctcc

SEQ ID NO: 2817362 - DNA, 19 bp, Homo sapiens
tcagccgagccgggcctgg

SEQ ID NO: 2817363 - DNA, 22 bp, Homo sapiens
tcagccgagccgggcctggggc

SEQ ID NO: 2817364 - DNA, 19 bp, Homo sapiens
tcagcctagccgacctcag

SEQ ID NO: 2817365 - DNA, 20 bp, Homo sapiens
tcagcctagccgacctcagc

SEQ ID NO: 2817366 - DNA, 21 bp, Homo sapiens
tcagcctagccgacctcagcc

SEQ ID NO: 2817367 - DNA, 13 bp, Homo sapiens
tcagcctcccaaa

SEQ ID NO: 2817368 - DNA, 13 bp, Homo sapiens
tcagcctcccaac

SEQ ID NO: 2817369 - DNA, 21 bp, Homo sapiens
tcagcctcccaaccccagggc

SEQ ID NO: 2817370 - DNA, 20 bp, Homo sapiens
tcagcctcccgaatagctgg

SEQ ID NO: 2817371 - DNA, 21 bp, Homo sapiens
tcagcctcccgagtagctggg

SEQ ID NO: 2817372 - DNA, 12 bp, Homo sapiens
tcagcctcttaa

SEQ ID NO: 2817373 - DNA, 22 bp, Homo sapiens
tcagcctcttaaagctgcctgt

SEQ ID NO: 2817374 - DNA, 17 bp, Homo sapiens
ggaataagaagcaaata

SEQ ID NO: 2817375 - DNA, 20 bp, Homo sapiens
ggaataagaagcaaataaat

SEQ ID NO: 2817376 - DNA, 20 bp, Homo sapiens
ggaataaggccttaatatgt

SEQ ID NO: 2817377 - DNA, 13 bp, Homo sapiens
ggaataataccta

SEQ ID NO: 2817378 - DNA, 15 bp, Homo sapiens
ggaatataattgttt

SEQ ID NO: 2817379 - DNA, 22 bp, Homo sapiens
ggaatattcccctatctctaga

SEQ ID NO: 2817380 - DNA, 16 bp, Homo sapiens
ggaatccagacccggc

SEQ ID NO: 2817381 - DNA, 23 bp, Homo sapiens
ggaatgcggccgcattccctgag

SEQ ID NO: 2817382 - DNA, 16 bp, Homo sapiens
ggaatgttaaagtcag

SEQ ID NO: 2817383 - DNA, 19 bp, Homo sapiens
ggaatgtttgggcagaagg

SEQ ID NO: 2817384 - DNA, 21 bp, Homo sapiens
ggaatgtttgggcagaaggga

SEQ ID NO: 2817385 - DNA, 13 bp, Homo sapiens
ggacaaaggagcc

SEQ ID NO: 2817386 - DNA, 18 bp, Homo sapiens
ggacaaaggagcctgtga

SEQ ID NO: 2817387 - DNA, 12 bp, Homo sapiens
ggacaacccaga

SEQ ID NO: 2817388 - DNA, 15 bp, Homo sapiens
ggacaagaagctgct

SEQ ID NO: 2817389 - DNA, 16 bp, Homo sapiens
ggacaagaagctgcta

SEQ ID NO: 2817390 - DNA, 20 bp, Homo sapiens
ggacaagccaacttgtaaat

SEQ ID NO: 2817391 - DNA, 15 bp, Homo sapiens
ggacacagctcttct

SEQ ID NO: 2817392 - DNA, 18 bp, Homo sapiens
ggacacagctcttctcca

SEQ ID NO: 2817393 - DNA, 14 bp, Homo sapiens
ggacacaggcctgt

SEQ ID NO: 2817394 - DNA, 21 bp, Homo sapiens
ggacaccccttatccaggact

SEQ ID NO: 2817395 - DNA, 13 bp, Homo sapiens
ggacacctgccct

SEQ ID NO: 2817396 - DNA, 17 bp, Homo sapiens
ggacacctggccgcctc

SEQ ID NO: 2817397 - DNA, 22 bp, Homo sapiens
ggacagcctgtggcggtgcctg

SEQ ID NO: 2817398 - DNA, 11 bp, Homo sapiens
ggacagctcct

SEQ ID NO: 2817399 - DNA, 15 bp, Homo sapiens
ggacagctccttctg

SEQ ID NO: 2817400 - DNA, 19 bp, Homo sapiens
ggacagctccttctgtcct

SEQ ID NO: 2817401 - DNA, 12 bp, Homo sapiens
ggacagctgtgc

SEQ ID NO: 2817402 - DNA, 14 bp, Homo sapiens
ggacagctgtgcct

SEQ ID NO: 2817403 - DNA, 15 bp, Homo sapiens
ggacagctgtgcctc

SEQ ID NO: 2817404 - DNA, 20 bp, Homo sapiens
ggacaggtcctcagtgtcct

SEQ ID NO: 2817405 - DNA, 20 bp, Homo sapiens
ggacagtattctcagtgctc

SEQ ID NO: 2817406 - DNA, 13 bp, Homo sapiens
ggacagtcctggg

SEQ ID NO: 2817407 - DNA, 15 bp, Homo sapiens
ggacagtcctgggag

SEQ ID NO: 2817408 - DNA, 19 bp, Homo sapiens
ggacagtcctgggagaacc

SEQ ID NO: 2817409 - DNA, 16 bp, Homo sapiens
ggacagtgcttcagcc

SEQ ID NO: 2817410 - DNA, 19 bp, Homo sapiens
ggacagtgcttcagcctga

SEQ ID NO: 2817411 - DNA, 20 bp, Homo sapiens
ggacagtgcttcagcctgag

SEQ ID NO: 2817412 - DNA, 14 bp, Homo sapiens
ggacatcatgaagc

SEQ ID NO: 2817413 - DNA, 16 bp, Homo sapiens
ggacatttccctcctg

SEQ ID NO: 2817414 - DNA, 17 bp, Homo sapiens
ggaccaaccctgtttcc

SEQ ID NO: 2817415 - DNA, 18 bp, Homo sapiens
ggaccaaccctgtttcct

SEQ ID NO: 2817416 - DNA, 20 bp, Homo sapiens
ggaccaaccctgtttcctga

SEQ ID NO: 2817417 - DNA, 11 bp, Homo sapiens
ggaccaagaat

SEQ ID NO: 2817418 - DNA, 21 bp, Homo sapiens
ggaccaagaatgagctggttt

SEQ ID NO: 2817419 - DNA, 21 bp, Homo sapiens
ggaccacacctccctgaacca

SEQ ID NO: 2817420 - DNA, 20 bp, Homo sapiens
ggaccaccagccccagcaag

SEQ ID NO: 2817421 - DNA, 17 bp, Homo sapiens
ggaccagcctgttggac

SEQ ID NO: 2817422 - DNA, 18 bp, Homo sapiens
ggaccccagctagggctg

SEQ ID NO: 2817423 - DNA, 20 bp, Homo sapiens
ggaccccagctagggctgga

SEQ ID NO: 2817424 - DNA, 19 bp, Homo sapiens
ggaccgctacaccactctg

SEQ ID NO: 2817425 - DNA, 20 bp, Homo sapiens
ggaccgctacaccactctgg

SEQ ID NO: 2817426 - DNA, 12 bp, Homo sapiens
ggacctgagcct

SEQ ID NO: 2817427 - DNA, 18 bp, Homo sapiens
ggacctgtggggccccag

SEQ ID NO: 2817428 - DNA, 22 bp, Homo sapiens
ggacgagggatgggatttcatg

SEQ ID NO: 2817429 - DNA, 19 bp, Homo sapiens
ggacgccactcatttcatc

SEQ ID NO: 2817430 - DNA, 20 bp, Homo sapiens
ggacgccactcatttcatct

SEQ ID NO: 2817431 - DNA, 20 bp, Homo sapiens
ggacgcccagctgaggctgg

SEQ ID NO: 2817432 - DNA, 18 bp, Homo sapiens
ggacggcattcctgctta

SEQ ID NO: 2817433 - DNA, 18 bp, Homo sapiens
ggactaacactcagaagc

SEQ ID NO: 2817434 - DNA, 19 bp, Homo sapiens
ggactaacactcagaagcc

SEQ ID NO: 2817435 - DNA, 13 bp, Homo sapiens
ggactcaccctca

SEQ ID NO: 2817436 - DNA, 18 bp, Homo sapiens
tataactagtcctttact

SEQ ID NO: 2817437 - DNA, 18 bp, Homo sapiens
tataacttaaaaaaatga

SEQ ID NO: 2817438 - DNA, 22 bp, Homo sapiens
tataacttaaaaaaatgacaga

SEQ ID NO: 2817439 - DNA, 14 bp, Homo sapiens
tataagaacttgat

SEQ ID NO: 2817440 - DNA, 16 bp, Homo sapiens
tataagattagaatga

SEQ ID NO: 2817441 - DNA, 23 bp, Homo sapiens
tataagcccaaatggctctgtga

SEQ ID NO: 2817442 - DNA, 16 bp, Homo sapiens
tataagtagcaggcca

SEQ ID NO: 2817443 - DNA, 16 bp, Homo sapiens
tataataaatgtacat

SEQ ID NO: 2817444 - DNA, 18 bp, Homo sapiens
tataatggtttactgctg

SEQ ID NO: 2817445 - DNA, 18 bp, Homo sapiens
tataatgttgttatttaa

SEQ ID NO: 2817446 - DNA, 15 bp, Homo sapiens
tataatgtttgctat

SEQ ID NO: 2817447 - DNA, 14 bp, Homo sapiens
tataattgggattt

SEQ ID NO: 2817448 - DNA, 15 bp, Homo sapiens
tataatttaacttca

SEQ ID NO: 2817449 - DNA, 22 bp, Homo sapiens
tataatttaacttcagagggaa

SEQ ID NO: 2817450 - DNA, 20 bp, Homo sapiens
tataattttgcagcagaagc

SEQ ID NO: 2817451 - DNA, 19 bp, Homo sapiens
tataatttttaaagtatat

SEQ ID NO: 2817452 - DNA, 18 bp, Homo sapiens
tataatttttttcaatat

SEQ ID NO: 2817453 - DNA, 21 bp, Homo sapiens
tataatttttttcaatattta

SEQ ID NO: 2817454 - DNA, 15 bp, Homo sapiens
tatacaaacatgtgg

SEQ ID NO: 2817455 - DNA, 14 bp, Homo sapiens
tatacaaatatatt

SEQ ID NO: 2817456 - DNA, 22 bp, Homo sapiens
tatacaaatatatttaattgtg

SEQ ID NO: 2817457 - DNA, 14 bp, Homo sapiens
tatacatacctctc

SEQ ID NO: 2817458 - DNA, 18 bp, Homo sapiens
tatacatacctctctcta

SEQ ID NO: 2817459 - DNA, 15 bp, Homo sapiens
tatacatatcagaaa

SEQ ID NO: 2817460 - DNA, 17 bp, Homo sapiens
tatacatatcagaaaag

SEQ ID NO: 2817461 - DNA, 18 bp, Homo sapiens
tatacatattataaataa

SEQ ID NO: 2817462 - DNA, 14 bp, Homo sapiens
tatacatgtatagt

SEQ ID NO: 2817463 - DNA, 16 bp, Homo sapiens
tatactaaaaaatgtc

SEQ ID NO: 2817464 - DNA, 16 bp, Homo sapiens
tatactgtacttaata

SEQ ID NO: 2817465 - DNA, 13 bp, Homo sapiens
tatagaaagctgt

SEQ ID NO: 2817466 - DNA, 11 bp, Homo sapiens
tatagactcta

SEQ ID NO: 2817467 - DNA, 17 bp, Homo sapiens
tatagcaatgtaacatt

SEQ ID NO: 2817468 - DNA, 21 bp, Homo sapiens
tatagcaatgtaacattaatt

SEQ ID NO: 2817469 - DNA, 19 bp, Homo sapiens
tatagccaaaaatagctaa

SEQ ID NO: 2817470 - DNA, 21 bp, Homo sapiens
tatagccacatccctttgaaa

SEQ ID NO: 2817471 - DNA, 12 bp, Homo sapiens
tatagctatttt

SEQ ID NO: 2817472 - DNA, 19 bp, Homo sapiens
tataggatttatttaaaat

SEQ ID NO: 2817473 - DNA, 17 bp, Homo sapiens
tatagtagtcaattagt

SEQ ID NO: 2817474 - DNA, 18 bp, Homo sapiens
tatagtatatctggacaa

SEQ ID NO: 2817475 - DNA, 17 bp, Homo sapiens
tatagtttactatttta

SEQ ID NO: 2817476 - DNA, 20 bp, Homo sapiens
tatataatggtttactgctg

SEQ ID NO: 2817477 - DNA, 17 bp, Homo sapiens
tatataattttgcagca

SEQ ID NO: 2817478 - DNA, 16 bp, Homo sapiens
tatatacaataacata

SEQ ID NO: 2817479 - DNA, 14 bp, Homo sapiens
tatatacatattat

SEQ ID NO: 2817480 - DNA, 21 bp, Homo sapiens
tatatacatattataaataaa

SEQ ID NO: 2817481 - DNA, 15 bp, Homo sapiens
tatatacatgtatag

SEQ ID NO: 2817482 - DNA, 17 bp, Homo sapiens
tatatacatgtatagtg

SEQ ID NO: 2817483 - DNA, 19 bp, Homo sapiens
tatatagtatatttatact

SEQ ID NO: 2817484 - DNA, 12 bp, Homo sapiens
tatatataaata

SEQ ID NO: 2817485 - DNA, 13 bp, Homo sapiens
tatatataaatat

SEQ ID NO: 2817486 - DNA, 14 bp, Homo sapiens
tatatatatagtaa

SEQ ID NO: 2817487 - DNA, 15 bp, Homo sapiens
tatatatatatagta

SEQ ID NO: 2817488 - DNA, 12 bp, Homo sapiens
tatatatcataa

SEQ ID NO: 2817489 - DNA, 15 bp, Homo sapiens
tatatatcataaagt

SEQ ID NO: 2817490 - DNA, 17 bp, Homo sapiens
tatatatcataaagtat

SEQ ID NO: 2817491 - DNA, 20 bp, Homo sapiens
tatatatctatctatttgag

SEQ ID NO: 2817492 - DNA, 15 bp, Homo sapiens
tatatatctatctta

SEQ ID NO: 2817493 - DNA, 23 bp, Homo sapiens
tatatatgaagtaagttctgaaa

SEQ ID NO: 2817494 - DNA, 15 bp, Homo sapiens
tatatatgtacagtt

SEQ ID NO: 2817495 - DNA, 21 bp, Homo sapiens
tatatatgtacagttatacat

SEQ ID NO: 2817496 - DNA, 22 bp, Homo sapiens
tatatatgtacagttatacata

SEQ ID NO: 2817497 - DNA, 14 bp, Homo sapiens
tatatatgtatatg

SEQ ID NO: 2817498 - DNA, 13 bp, Homo sapiens
tatatatttataa

SEQ ID NO: 2817499 - DNA, 14 bp, Homo sapiens
tatatatttataac

SEQ ID NO: 2817500 - DNA, 14 bp, Homo sapiens
tatatattttaatt

SEQ ID NO: 2817501 - DNA, 14 bp, Homo sapiens
tatatatttttcaa

SEQ ID NO: 2817502 - DNA, 19 bp, Homo sapiens
tatatatttttcaaccagc

SEQ ID NO: 2817503 - DNA, 20 bp, Homo sapiens
tatatatttttggttgtcaa

SEQ ID NO: 2817504 - DNA, 18 bp, Homo sapiens
tatatcaatgtaacaaaa

SEQ ID NO: 2817505 - DNA, 14 bp, Homo sapiens
tatatcataaagta

SEQ ID NO: 2817506 - DNA, 12 bp, Homo sapiens
tatatctaattt

SEQ ID NO: 2817507 - DNA, 18 bp, Homo sapiens
tatatctaatttatacaa

SEQ ID NO: 2817508 - DNA, 18 bp, Homo sapiens
tatatctatatctctaaa

SEQ ID NO: 2817509 - DNA, 19 bp, Homo sapiens
tatatctatctatttgagg

SEQ ID NO: 2817510 - DNA, 12 bp, Homo sapiens
tatatctgaaaa

SEQ ID NO: 2817511 - DNA, 16 bp, Homo sapiens
tatatctgaaaactgg

SEQ ID NO: 2817512 - DNA, 14 bp, Homo sapiens
tatgaaaaatatga

SEQ ID NO: 2817513 - DNA, 18 bp, Homo sapiens
tatgaaaaatatgatatt

SEQ ID NO: 2817514 - DNA, 16 bp, Homo sapiens
tatgaaaagaataaaa

SEQ ID NO: 2817515 - DNA, 14 bp, Homo sapiens
tatgaaaagctaga

SEQ ID NO: 2817516 - DNA, 13 bp, Homo sapiens
tatgaagaaaaaa

SEQ ID NO: 2817517 - DNA, 15 bp, Homo sapiens
tatgaagaagagagt

SEQ ID NO: 2817518 - DNA, 21 bp, Homo sapiens
tatgaaggctgtacactgcac

SEQ ID NO: 2817519 - DNA, 16 bp, Homo sapiens
tatgaatacagggcat

SEQ ID NO: 2817520 - DNA, 20 bp, Homo sapiens
tatgacagctgtccctgtca

SEQ ID NO: 2817521 - DNA, 15 bp, Homo sapiens
tatgacagttatact

SEQ ID NO: 2817522 - DNA, 23 bp, Homo sapiens
tatgacatcacttgtacaaaata

SEQ ID NO: 2817523 - DNA, 24 bp, Homo sapiens
tatgacatcacttgtacaaaataa

SEQ ID NO: 2817524 - DNA, 18 bp, Homo sapiens
tatgaccttctaggaagc

SEQ ID NO: 2817525 - DNA, 22 bp, Homo sapiens
tatgacttgggcacccccagcc

SEQ ID NO: 2817526 - DNA, 12 bp, Homo sapiens
tatgagctgagg

SEQ ID NO: 2817527 - DNA, 17 bp, Homo sapiens
tatgaggacttgtgtct

SEQ ID NO: 2817528 - DNA, 18 bp, Homo sapiens
tattcaattcctctggga

SEQ ID NO: 2817529 - DNA, 20 bp, Homo sapiens
tattcactgtaagtttattt

SEQ ID NO: 2817530 - DNA, 14 bp, Homo sapiens
tattcagagatgta

SEQ ID NO: 2817531 - DNA, 17 bp, Homo sapiens
tattcagagatgtacca

SEQ ID NO: 2817532 - DNA, 20 bp, Homo sapiens
tattcagagatgtaccatgt

SEQ ID NO: 2817533 - DNA, 21 bp, Homo sapiens
tattcagatcgtattaattat

SEQ ID NO: 2817534 - DNA, 12 bp, Homo sapiens
tattcaggactt

SEQ ID NO: 2817535 - DNA, 22 bp, Homo sapiens
tattcagtgctgtggcctgggc

SEQ ID NO: 2817536 - DNA, 15 bp, Homo sapiens
tattcatgtaataaa

SEQ ID NO: 2817537 - DNA, 17 bp, Homo sapiens
tattcatgtaataaatc

SEQ ID NO: 2817538 - DNA, 19 bp, Homo sapiens
tattcatgtaataaatctg

SEQ ID NO: 2817539 - DNA, 16 bp, Homo sapiens
tattccaccattcaca

SEQ ID NO: 2817540 - DNA, 17 bp, Homo sapiens
tattccaccattcacat

SEQ ID NO: 2817541 - DNA, 20 bp, Homo sapiens
tattcccctatctctagaat

SEQ ID NO: 2817542 - DNA, 22 bp, Homo sapiens
tattcccctatctctagaattt

SEQ ID NO: 2817543 - DNA, 21 bp, Homo sapiens
tattcctatatagtttattga

SEQ ID NO: 2817544 - DNA, 20 bp, Homo sapiens
tattcctgaatgaaatatca

SEQ ID NO: 2817545 - DNA, 19 bp, Homo sapiens
tattcctgcatttgtgaaa

SEQ ID NO: 2817546 - DNA, 12 bp, Homo sapiens
tattctattgca

SEQ ID NO: 2817547 - DNA, 14 bp, Homo sapiens
tattctcactccac

SEQ ID NO: 2817548 - DNA, 16 bp, Homo sapiens
tattctcactccacca

SEQ ID NO: 2817549 - DNA, 16 bp, Homo sapiens
tattctgttggccagt

SEQ ID NO: 2817550 - DNA, 16 bp, Homo sapiens
tattcttcatcagcat

SEQ ID NO: 2817551 - DNA, 13 bp, Homo sapiens
tattgacaataat

SEQ ID NO: 2817552 - DNA, 17 bp, Homo sapiens
tattgacaataatttca

SEQ ID NO: 2817553 - DNA, 16 bp, Homo sapiens
tattgatgtttccaga

SEQ ID NO: 2817554 - DNA, 21 bp, Homo sapiens
tattgatgtttccagaaaata

SEQ ID NO: 2817555 - DNA, 19 bp, Homo sapiens
tattgcatgtaaaatgcag

SEQ ID NO: 2817556 - DNA, 18 bp, Homo sapiens
tattggtaacatcctttc

SEQ ID NO: 2817557 - DNA, 21 bp, Homo sapiens
tattggtaacatcctttctat

SEQ ID NO: 2817558 - DNA, 15 bp, Homo sapiens
tattgtaaatattgt

SEQ ID NO: 2817559 - DNA, 23 bp, Homo sapiens
tattgtaaatttggatttacgac

SEQ ID NO: 2817560 - DNA, 15 bp, Homo sapiens
tattgtagcatttct

SEQ ID NO: 2817561 - DNA, 13 bp, Homo sapiens
tattgtatgtaag

SEQ ID NO: 2817562 - DNA, 14 bp, Homo sapiens
tattgtatgtaagt

SEQ ID NO: 2817563 - DNA, 15 bp, Homo sapiens
tattgtatgtaagta

SEQ ID NO: 2817564 - DNA, 20 bp, Homo sapiens
tattgtcattactgcctttg

SEQ ID NO: 2817565 - DNA, 17 bp, Homo sapiens
tattgtccccactaaaa

SEQ ID NO: 2817566 - DNA, 13 bp, Homo sapiens
tattgtgatctat

SEQ ID NO: 2817567 - DNA, 17 bp, Homo sapiens
tattgtgcaatgtaaat

SEQ ID NO: 2817568 - DNA, 14 bp, Homo sapiens
tattgtgttgcctt

SEQ ID NO: 2817569 - DNA, 20 bp, Homo sapiens
tattgtttctttaagaaagt

SEQ ID NO: 2817570 - DNA, 22 bp, Homo sapiens
tattgtttttccttgtatttaa

SEQ ID NO: 2817571 - DNA, 15 bp, Homo sapiens
tatttaaaaaataaa

SEQ ID NO: 2817572 - DNA, 15 bp, Homo sapiens
tatttaaaatagcaa

SEQ ID NO: 2817573 - DNA, 17 bp, Homo sapiens
tatttaagataattata

SEQ ID NO: 2817574 - DNA, 20 bp, Homo sapiens
tatttaagataattataata

SEQ ID NO: 2817575 - DNA, 22 bp, Homo sapiens
tatttaagtatatagtatattt

SEQ ID NO: 2817576 - DNA, 13 bp, Homo sapiens
tatttaattgtgt

SEQ ID NO: 2817577 - DNA, 19 bp, Homo sapiens
tatttaattgtgtcatatt

SEQ ID NO: 2817578 - DNA, 17 bp, Homo sapiens
tatttaatttttgcaat

SEQ ID NO: 2817579 - DNA, 14 bp, Homo sapiens
tatttactaaaaga

SEQ ID NO: 2817580 - DNA, 15 bp, Homo sapiens
tatttactaaaagaa

SEQ ID NO: 2817581 - DNA, 14 bp, Homo sapiens
tatttactgagctt

SEQ ID NO: 2817582 - DNA, 19 bp, Homo sapiens
tatttactgagcttctctg

SEQ ID NO: 2817583 - DNA, 22 bp, Homo sapiens
tatttactgagcttctctgtga

SEQ ID NO: 2817584 - DNA, 16 bp, Homo sapiens
tatttataaatatatt

SEQ ID NO: 2817585 - DNA, 20 bp, Homo sapiens
tatttataacaacctaaatt

SEQ ID NO: 2817586 - DNA, 13 bp, Homo sapiens
tatttataactca

SEQ ID NO: 2817587 - DNA, 21 bp, Homo sapiens
tatttataactcatcataaaa

SEQ ID NO: 2817588 - DNA, 22 bp, Homo sapiens
tatttataactcatcataaaat

SEQ ID NO: 2817589 - DNA, 14 bp, Homo sapiens
tatttataagcaga

SEQ ID NO: 2817590 - DNA, 17 bp, Homo sapiens
tatttataagcagattt

SEQ ID NO: 2817591 - DNA, 11 bp, Homo sapiens
tatttatactc

SEQ ID NO: 2817592 - DNA, 12 bp, Homo sapiens
tatttatactct

SEQ ID NO: 2817593 - DNA, 14 bp, Homo sapiens
tatttatatatatt

SEQ ID NO: 2817594 - DNA, 18 bp, Homo sapiens
tatttatatatttataac

SEQ ID NO: 2817595 - DNA, 18 bp, Homo sapiens
tatttatcagtgacagag

SEQ ID NO: 2817596 - DNA, 12 bp, Homo sapiens
tatttatcttta

SEQ ID NO: 2817597 - DNA, 16 bp, Homo sapiens
tatttattagctgtaa

SEQ ID NO: 2817598 - DNA, 15 bp, Homo sapiens
tatttattcactgta

SEQ ID NO: 2817599 - DNA, 18 bp, Homo sapiens
tcaagatgtcagactggc

SEQ ID NO: 2817600 - DNA, 17 bp, Homo sapiens
tcaagcgattcttctgc

SEQ ID NO: 2817601 - DNA, 23 bp, Homo sapiens
tcaaggagcccagaaaacctcca

SEQ ID NO: 2817602 - DNA, 12 bp, Homo sapiens
tcaagtcttccc

SEQ ID NO: 2817603 - DNA, 15 bp, Homo sapiens
tcaagtgatatatgt

SEQ ID NO: 2817604 - DNA, 18 bp, Homo sapiens
tcaagtgatatatgtatt

SEQ ID NO: 2817605 - DNA, 22 bp, Homo sapiens
tcaagtgattctcctgcctcag

SEQ ID NO: 2817606 - DNA, 22 bp, Homo sapiens
tcaagtgcatgctctctgcagc

SEQ ID NO: 2817607 - DNA, 15 bp, Homo sapiens
tcaagtttttacaaa

SEQ ID NO: 2817608 - DNA, 12 bp, Homo sapiens
tcaataaaaatc

SEQ ID NO: 2817609 - DNA, 21 bp, Homo sapiens
tcaataaaaatctttgattca

SEQ ID NO: 2817610 - DNA, 14 bp, Homo sapiens
tcaataaaatcatg

SEQ ID NO: 2817611 - DNA, 18 bp, Homo sapiens
tcaataaaatcatgtaca

SEQ ID NO: 2817612 - DNA, 16 bp, Homo sapiens
tcaataaatgtctgtt

SEQ ID NO: 2817613 - DNA, 15 bp, Homo sapiens
tcaatacttcatgat

SEQ ID NO: 2817614 - DNA, 16 bp, Homo sapiens
tcaatattaaatacag

SEQ ID NO: 2817615 - DNA, 21 bp, Homo sapiens
tcaatattaaatacagacact

SEQ ID NO: 2817616 - DNA, 17 bp, Homo sapiens
tcaatattcctgaatga

SEQ ID NO: 2817617 - DNA, 18 bp, Homo sapiens
tcaatattcctgaatgaa

SEQ ID NO: 2817618 - DNA, 11 bp, Homo sapiens
tcaatatttat

SEQ ID NO: 2817619 - DNA, 20 bp, Homo sapiens
tcaatatttattattttcac

SEQ ID NO: 2817620 - DNA, 21 bp, Homo sapiens
tcaatcagtctcagaatgtca

SEQ ID NO: 2817621 - DNA, 17 bp, Homo sapiens
tccatgcctacagataa

SEQ ID NO: 2817622 - DNA, 21 bp, Homo sapiens
tccatgcctacagataattta

SEQ ID NO: 2817623 - DNA, 12 bp, Homo sapiens
tccatgcctgag

SEQ ID NO: 2817624 - DNA, 13 bp, Homo sapiens
tccatgcctgagg

SEQ ID NO: 2817625 - DNA, 14 bp, Homo sapiens
tccatgctgcctcc

SEQ ID NO: 2817626 - DNA, 15 bp, Homo sapiens
tccatgctgcctcca

SEQ ID NO: 2817627 - DNA, 17 bp, Homo sapiens
tccatgtcgcctctgca

SEQ ID NO: 2817628 - DNA, 13 bp, Homo sapiens
tccattcctcagg

SEQ ID NO: 2817629 - DNA, 14 bp, Homo sapiens
tccattcctcaggg

SEQ ID NO: 2817630 - DNA, 15 bp, Homo sapiens
tccattcctcaggga

SEQ ID NO: 2817631 - DNA, 20 bp, Homo sapiens
tccatttagttctttgttat

SEQ ID NO: 2817632 - DNA, 21 bp, Homo sapiens
tccatttcatctatttctgag

SEQ ID NO: 2817633 - DNA, 12 bp, Homo sapiens
tccatttccagt

SEQ ID NO: 2817634 - DNA, 18 bp, Homo sapiens
tccatttttactaaagca

SEQ ID NO: 2817635 - DNA, 22 bp, Homo sapiens
tccatttttactaaagcagtgt

SEQ ID NO: 2817636 - DNA, 14 bp, Homo sapiens
tcccaaagtgctgg

SEQ ID NO: 2817637 - DNA, 15 bp, Homo sapiens
tcccaaccccagggc

SEQ ID NO: 2817638 - DNA, 16 bp, Homo sapiens
tcccaactcgatgggc

SEQ ID NO: 2817639 - DNA, 22 bp, Homo sapiens
tcccaagagcatcatgcctctg

SEQ ID NO: 2817640 - DNA, 12 bp, Homo sapiens
tcccaagctctg

SEQ ID NO: 2817641 - DNA, 13 bp, Homo sapiens
tcccaaggaaagc

SEQ ID NO: 2817642 - DNA, 18 bp, Homo sapiens
tcccaaggaaagccccag

SEQ ID NO: 2817643 - DNA, 20 bp, Homo sapiens
tcccaagtagtagtgtcttc

SEQ ID NO: 2817644 - DNA, 17 bp, Homo sapiens
tcccaagtgccagtctt

SEQ ID NO: 2817645 - DNA, 14 bp, Homo sapiens
tcccaataaaagtg

SEQ ID NO: 2817646 - DNA, 15 bp, Homo sapiens
tcccaataaaagtga

SEQ ID NO: 2817647 - DNA, 16 bp, Homo sapiens
tcccaataaagctgga

SEQ ID NO: 2817648 - DNA, 18 bp, Homo sapiens
tcccacactggtgactgc

SEQ ID NO: 2817649 - DNA, 19 bp, Homo sapiens
tcccacagcattcctccat

SEQ ID NO: 2817650 - DNA, 13 bp, Homo sapiens
tcccacatccctg

SEQ ID NO: 2817651 - DNA, 20 bp, Homo sapiens
tcccacatccctgggcctgc

SEQ ID NO: 2817652 - DNA, 21 bp, Homo sapiens
tcccaccaccttggactcctc

SEQ ID NO: 2817653 - DNA, 13 bp, Homo sapiens
tcccaccagcatg

SEQ ID NO: 2817654 - DNA, 20 bp, Homo sapiens
tcccaccatgcgctgctcaa

SEQ ID NO: 2817655 - DNA, 18 bp, Homo sapiens
tcccacccacatgtgaca

SEQ ID NO: 2817656 - DNA, 13 bp, Homo sapiens
tcccacccccagc

SEQ ID NO: 2817657 - DNA, 14 bp, Homo sapiens
tcccacccccagcc

SEQ ID NO: 2817658 - DNA, 13 bp, Homo sapiens
tcccaccttggct

SEQ ID NO: 2817659 - DNA, 15 bp, Homo sapiens
tcccagaccacctcc

SEQ ID NO: 2817660 - DNA, 18 bp, Homo sapiens
tcccagagacaggaaaat

SEQ ID NO: 2817661 - DNA, 19 bp, Homo sapiens
tcccagcactttgggaggc

SEQ ID NO: 2817662 - DNA, 21 bp, Homo sapiens
tcccagcactttgggaggctg

SEQ ID NO: 2817663 - DNA, 13 bp, Homo sapiens
tcccagcagccct

SEQ ID NO: 2817664 - DNA, 18 bp, Homo sapiens
tcccagcagccctaagga

SEQ ID NO: 2817665 - DNA, 16 bp, Homo sapiens
tcccagccctatggat

SEQ ID NO: 2817666 - DNA, 17 bp, Homo sapiens
tcccagccctatggatg

SEQ ID NO: 2817667 - DNA, 18 bp, Homo sapiens
tcccagccctatggatgt

SEQ ID NO: 2817668 - DNA, 22 bp, Homo sapiens
tcccagctacacctgaggctga

SEQ ID NO: 2817669 - DNA, 22 bp, Homo sapiens
tcccagctactcaagaggctga

SEQ ID NO: 2817670 - DNA, 17 bp, Homo sapiens
tcccagctactcaggag

SEQ ID NO: 2817671 - DNA, 18 bp, Homo sapiens
tcccagctacttgggagg

SEQ ID NO: 2817672 - DNA, 19 bp, Homo sapiens
tcccagctacttgggaggc

SEQ ID NO: 2817673 - DNA, 14 bp, Homo sapiens
tcccagctctccct

SEQ ID NO: 2817674 - DNA, 18 bp, Homo sapiens
tcccagctctccctctgg

SEQ ID NO: 2817675 - DNA, 21 bp, Homo sapiens
tcccagctctccctctggccc

SEQ ID NO: 2817676 - DNA, 22 bp, Homo sapiens
tcccagctgtctgtgtcagcct

SEQ ID NO: 2817677 - DNA, 17 bp, Homo sapiens
tcccagctgtgctctgg

SEQ ID NO: 2817678 - DNA, 15 bp, Homo sapiens
tcccaggagacagtt

SEQ ID NO: 2817679 - DNA, 21 bp, Homo sapiens
tcccaggccccatgacctcca

SEQ ID NO: 2817680 - DNA, 23 bp, Homo sapiens
tcccaggccccatgacctccagc

SEQ ID NO: 2817681 - DNA, 15 bp, Homo sapiens
tcccaggcttcaccc

SEQ ID NO: 2817682 - DNA, 22 bp, Homo sapiens
tcccaggcttcaccctgaatgg

SEQ ID NO: 2817683 - DNA, 20 bp, Homo sapiens
tcccagggccagggccctgc

SEQ ID NO: 2817684 - DNA, 22 bp, Homo sapiens
tcccagggccagggccctgcag

SEQ ID NO: 2817685 - DNA, 17 bp, Homo sapiens
tcccatagccaggaaac

SEQ ID NO: 2817686 - DNA, 22 bp, Homo sapiens
tcccatcactggagcaccaggc

SEQ ID NO: 2817687 - DNA, 15 bp, Homo sapiens
tcccatccccagcga

SEQ ID NO: 2817688 - DNA, 20 bp, Homo sapiens
tcccatctgaaccactttgc

SEQ ID NO: 2817689 - DNA, 19 bp, Homo sapiens
tcccatgagcctcagcatc

SEQ ID NO: 2817690 - DNA, 16 bp, Homo sapiens
tcccatgctgaattat

SEQ ID NO: 2817691 - DNA, 17 bp, Homo sapiens
tcccatgctgaattatt

SEQ ID NO: 2817692 - DNA, 12 bp, Homo sapiens
tcccattcccct

SEQ ID NO: 2817693 - DNA, 13 bp, Homo sapiens
tcccatttccttg

SEQ ID NO: 2817694 - DNA, 14 bp, Homo sapiens
tcccatttccttgg

SEQ ID NO: 2817695 - DNA, 12 bp, Homo sapiens
tcccatttgtaa

SEQ ID NO: 2817696 - DNA, 17 bp, Homo sapiens
tcccatttgtaatgtat

SEQ ID NO: 2817697 - DNA, 21 bp, Homo sapiens
tcccattttgcaaaatttcca

SEQ ID NO: 2817698 - DNA, 18 bp, Homo sapiens
tcccattttggaagtttt

SEQ ID NO: 2817699 - DNA, 14 bp, Homo sapiens
tccccaattatctt

SEQ ID NO: 2817700 - DNA, 12 bp, Homo sapiens
tccccacagaac

SEQ ID NO: 2817701 - DNA, 19 bp, Homo sapiens
tccccacagaactgcttac

SEQ ID NO: 2817702 - DNA, 20 bp, Homo sapiens
tccccaccttccccagactc

SEQ ID NO: 2817703 - DNA, 18 bp, Homo sapiens
tccccactctgctctgat

SEQ ID NO: 2817704 - DNA, 23 bp, Homo sapiens
tccccagacttctctttcttatt

SEQ ID NO: 2817705 - DNA, 18 bp, Homo sapiens
tccccagattgcaacagg

SEQ ID NO: 2817706 - DNA, 22 bp, Homo sapiens
tccccagattgcaacaggctgg

SEQ ID NO: 2817707 - DNA, 12 bp, Homo sapiens
tccccagccaga

SEQ ID NO: 2817708 - DNA, 17 bp, Homo sapiens
tccccagccagaagtta

SEQ ID NO: 2817709 - DNA, 23 bp, Homo sapiens
tccccagcgattccctctcccag

SEQ ID NO: 2817710 - DNA, 17 bp, Homo sapiens
tccccagctccccagga

SEQ ID NO: 2817711 - DNA, 18 bp, Homo sapiens
tagctgggactacaggtg

SEQ ID NO: 2817712 - DNA, 11 bp, Homo sapiens
tagctgtaaat

SEQ ID NO: 2817713 - DNA, 18 bp, Homo sapiens
tagctgtaaatacatgtg

SEQ ID NO: 2817714 - DNA, 19 bp, Homo sapiens
tagctgtgacctgctgagc

SEQ ID NO: 2817715 - DNA, 14 bp, Homo sapiens
tagctgtgtgaaat

SEQ ID NO: 2817716 - DNA, 16 bp, Homo sapiens
tagctgttgagctgtt

SEQ ID NO: 2817717 - DNA, 19 bp, Homo sapiens
tagcttaaataaattcaaa

SEQ ID NO: 2817718 - DNA, 20 bp, Homo sapiens
tagcttagacctcagcctgt

SEQ ID NO: 2817719 - DNA, 16 bp, Homo sapiens
tagctttaacttaaat

SEQ ID NO: 2817720 - DNA, 22 bp, Homo sapiens
tagctttaacttaaatagtatt

SEQ ID NO: 2817721 - DNA, 18 bp, Homo sapiens
tagctttattttttaagt

SEQ ID NO: 2817722 - DNA, 13 bp, Homo sapiens
tagcttttccctt

SEQ ID NO: 2817723 - DNA, 19 bp, Homo sapiens
taggaaagcctcactgata

SEQ ID NO: 2817724 - DNA, 19 bp, Homo sapiens
taggaaataaaacctttca

SEQ ID NO: 2817725 - DNA, 19 bp, Homo sapiens
taggaacagagtatatatg

SEQ ID NO: 2817726 - DNA, 15 bp, Homo sapiens
taggaagagaaacca

SEQ ID NO: 2817727 - DNA, 19 bp, Homo sapiens
taggaagagaaaccaggga

SEQ ID NO: 2817728 - DNA, 21 bp, Homo sapiens
taggagaccaaggcgggagca

SEQ ID NO: 2817729 - DNA, 15 bp, Homo sapiens
taggagctcacagtc

SEQ ID NO: 2817730 - DNA, 14 bp, Homo sapiens
taggagctgggagg

SEQ ID NO: 2817731 - DNA, 12 bp, Homo sapiens
taggagggactg

SEQ ID NO: 2817732 - DNA, 14 bp, Homo sapiens
taggagggactgtc

SEQ ID NO: 2817733 - DNA, 21 bp, Homo sapiens
taggagttcgagaccagcctg

SEQ ID NO: 2817734 - DNA, 23 bp, Homo sapiens
taggagttcgagaccagcctggc

SEQ ID NO: 2817735 - DNA, 23 bp, Homo sapiens
taggatctatgcaatttttaaac

SEQ ID NO: 2817736 - DNA, 22 bp, Homo sapiens
taggatttatttaaaatagcaa

SEQ ID NO: 2817737 - DNA, 13 bp, Homo sapiens
taggcagagcctt

SEQ ID NO: 2817738 - DNA, 21 bp, Homo sapiens
taggcatgagggatcacaggg

SEQ ID NO: 2817739 - DNA, 13 bp, Homo sapiens
taggccactcctc

SEQ ID NO: 2817740 - DNA, 15 bp, Homo sapiens
taggccactcctcca

SEQ ID NO: 2817741 - DNA, 20 bp, Homo sapiens
taggcccctggtctgccctg

SEQ ID NO: 2817742 - DNA, 13 bp, Homo sapiens
taggcctggccag

SEQ ID NO: 2817743 - DNA, 15 bp, Homo sapiens
taggcctggccagat

SEQ ID NO: 2817744 - DNA, 18 bp, Homo sapiens
taggcgagtgccaggact

SEQ ID NO: 2817745 - DNA, 16 bp, Homo sapiens
taggcgggaaggaggg

SEQ ID NO: 2817746 - DNA, 17 bp, Homo sapiens
taggctggagaagctca

SEQ ID NO: 2817747 - DNA, 21 bp, Homo sapiens
tagggaatggcacagcccaaa

SEQ ID NO: 2817748 - DNA, 13 bp, Homo sapiens
tagggacttaaaa

SEQ ID NO: 2817749 - DNA, 23 bp, Homo sapiens
tagggctacaaaacctgatgtta

SEQ ID NO: 2817750 - DNA, 23 bp, Homo sapiens
tagggtcaggcggggtgctgtgg

SEQ ID NO: 2817751 - DNA, 22 bp, Homo sapiens
taggtaaaaatataagaacttg

SEQ ID NO: 2817752 - DNA, 14 bp, Homo sapiens
taggtacacagctc

SEQ ID NO: 2817753 - DNA, 15 bp, Homo sapiens
taggtttttgtttgt

SEQ ID NO: 2817754 - DNA, 22 bp, Homo sapiens
tagtaaatcacgctttttgaaa

SEQ ID NO: 2817755 - DNA, 22 bp, Homo sapiens
tagtaatgggccaattaaaata

SEQ ID NO: 2817756 - DNA, 20 bp, Homo sapiens
tagtacagtagcttaaataa

SEQ ID NO: 2817757 - DNA, 21 bp, Homo sapiens
tagtacagtagcttaaataaa

SEQ ID NO: 2817758 - DNA, 22 bp, Homo sapiens
tagtagtcaattagtacagtag

SEQ ID NO: 2817759 - DNA, 19 bp, Homo sapiens
tagtatatctggacaagcc

SEQ ID NO: 2817760 - DNA, 17 bp, Homo sapiens
tagtatggcctgtgtca

SEQ ID NO: 2817761 - DNA, 19 bp, Homo sapiens
tagtatggcctgtgtcact

SEQ ID NO: 2817762 - DNA, 18 bp, Homo sapiens
tagtcaaaccataaactt

SEQ ID NO: 2817763 - DNA, 21 bp, Homo sapiens
tagtcacatggcctatgcaca

SEQ ID NO: 2817764 - DNA, 13 bp, Homo sapiens
tagtcagcgcagt

SEQ ID NO: 2817765 - DNA, 18 bp, Homo sapiens
tagtccaatgtcttttta

SEQ ID NO: 2817766 - DNA, 21 bp, Homo sapiens
tagtcccagctactcagaagc

SEQ ID NO: 2817767 - DNA, 17 bp, Homo sapiens
tagtctcctttgcactg

SEQ ID NO: 2817768 - DNA, 20 bp, Homo sapiens
tagtctcctttgcactgagg

SEQ ID NO: 2817769 - DNA, 21 bp, Homo sapiens
tagtctcctttgcactgaggg

SEQ ID NO: 2817770 - DNA, 20 bp, Homo sapiens
tagtctggtgttctgagtac

SEQ ID NO: 2817771 - DNA, 12 bp, Homo sapiens
tagtctgtcatc

SEQ ID NO: 2817772 - DNA, 15 bp, Homo sapiens
tagtcttttactcct

SEQ ID NO: 2817773 - DNA, 21 bp, Homo sapiens
tagtcttttactcctttgcat

SEQ ID NO: 2817774 - DNA, 20 bp, Homo sapiens
tagtgacaaaattggccaga

SEQ ID NO: 2817775 - DNA, 22 bp, Homo sapiens
tagtgcccacttgaggctggca

SEQ ID NO: 2817776 - DNA, 17 bp, Homo sapiens
tagtgccctccacagcc

SEQ ID NO: 2817777 - DNA, 17 bp, Homo sapiens
tagtgcggacaagtttt

SEQ ID NO: 2817778 - DNA, 21 bp, Homo sapiens
tagtggggtctccctctcctg

SEQ ID NO: 2817779 - DNA, 23 bp, Homo sapiens
tagtggggtctccctctcctgcc

SEQ ID NO: 2817780 - DNA, 20 bp, Homo sapiens
tagtgtcttcctagtatatt

SEQ ID NO: 2817781 - DNA, 20 bp, Homo sapiens
tagttaagtcatccacagcc

SEQ ID NO: 2817782 - DNA, 15 bp, Homo sapiens
tagttagcaggaaat

SEQ ID NO: 2817783 - DNA, 16 bp, Homo sapiens
tagttagcaggaaata

SEQ ID NO: 2817784 - DNA, 15 bp, Homo sapiens
tagttagctgcttta

SEQ ID NO: 2817785 - DNA, 18 bp, Homo sapiens
tagttaggaaataaaacc

SEQ ID NO: 2817786 - DNA, 21 bp, Homo sapiens
tagttaggaaataaaaccttt

SEQ ID NO: 2817787 - DNA, 15 bp, Homo sapiens
tagttaggtgtgcca

SEQ ID NO: 2817788 - DNA, 20 bp, Homo sapiens
tagttaggtgtgccaaacta

SEQ ID NO: 2817789 - DNA, 21 bp, Homo sapiens
tagttccccgtgaacttcctt

SEQ ID NO: 2817790 - DNA, 23 bp, Homo sapiens
tagttccctgaaaacccagagag

SEQ ID NO: 2817791 - DNA, 14 bp, Homo sapiens
tagttgatgaccaa

SEQ ID NO: 2817792 - DNA, 17 bp, Homo sapiens
tagttgcagaaacattt

SEQ ID NO: 2817793 - DNA, 18 bp, Homo sapiens
tagttttaaatatgaaca

SEQ ID NO: 2817794 - DNA, 16 bp, Homo sapiens
tagttttagttgcaga

SEQ ID NO: 2817795 - DNA, 17 bp, Homo sapiens
tagttttagttgcagaa

SEQ ID NO: 2817796 - DNA, 12 bp, Homo sapiens
tataaaaacaaa

SEQ ID NO: 2817797 - DNA, 13 bp, Homo sapiens
tataaaactcagt

SEQ ID NO: 2817798 - DNA, 21 bp, Homo sapiens
tataaaactcagttaaaatgt

SEQ ID NO: 2817799 - DNA, 16 bp, Homo sapiens
tataaaagacaaaact

SEQ ID NO: 2817800 - DNA, 14 bp, Homo sapiens
tataaacactatat

SEQ ID NO: 2817801 - DNA, 19 bp, Homo sapiens
tcaatgaaatatttgctta

SEQ ID NO: 2817802 - DNA, 18 bp, Homo sapiens
tcaatggtttgcaaggaa

SEQ ID NO: 2817803 - DNA, 22 bp, Homo sapiens
tcaatgttcacgcaacttgaaa

SEQ ID NO: 2817804 - DNA, 12 bp, Homo sapiens
tcaattaaatgt

SEQ ID NO: 2817805 - DNA, 11 bp, Homo sapiens
tcaattaataa

SEQ ID NO: 2817806 - DNA, 13 bp, Homo sapiens
tcaattaattctt

SEQ ID NO: 2817807 - DNA, 15 bp, Homo sapiens
tcaattcaaagctgt

SEQ ID NO: 2817808 - DNA, 22 bp, Homo sapiens
tcaattcaaagctgtgtgtttg

SEQ ID NO: 2817809 - DNA, 16 bp, Homo sapiens
tcaattcaacacatta

SEQ ID NO: 2817810 - DNA, 15 bp, Homo sapiens
tcaattcctctggga

SEQ ID NO: 2817811 - DNA, 16 bp, Homo sapiens
tcaattcctctgggaa

SEQ ID NO: 2817812 - DNA, 15 bp, Homo sapiens
tcaatttaaataacc

SEQ ID NO: 2817813 - DNA, 18 bp, Homo sapiens
tcaatttccaagagctga

SEQ ID NO: 2817814 - DNA, 18 bp, Homo sapiens
tcaatttccctgactcct

SEQ ID NO: 2817815 - DNA, 21 bp, Homo sapiens
tcaatttccctgactcctcta

SEQ ID NO: 2817816 - DNA, 13 bp, Homo sapiens
tcaatttgtatat

SEQ ID NO: 2817817 - DNA, 18 bp, Homo sapiens
tcacaaaaatggtggttt

SEQ ID NO: 2817818 - DNA, 12 bp, Homo sapiens
tcacaaaatgca

SEQ ID NO: 2817819 - DNA, 14 bp, Homo sapiens
tcacaaaattttat

SEQ ID NO: 2817820 - DNA, 17 bp, Homo sapiens
tcacaaccagccacaca

SEQ ID NO: 2817821 - DNA, 13 bp, Homo sapiens
tcacaactgtttt

SEQ ID NO: 2817822 - DNA, 17 bp, Homo sapiens
tcacaagagcccagcag

SEQ ID NO: 2817823 - DNA, 15 bp, Homo sapiens
tcacaagcaataatt

SEQ ID NO: 2817824 - DNA, 16 bp, Homo sapiens
tcacaaggcagcaagg

SEQ ID NO: 2817825 - DNA, 16 bp, Homo sapiens
tcacaatcctgtccct

SEQ ID NO: 2817826 - DNA, 19 bp, Homo sapiens
tcacaattccatttccagt

SEQ ID NO: 2817827 - DNA, 14 bp, Homo sapiens
tcacacacccctca

SEQ ID NO: 2817828 - DNA, 13 bp, Homo sapiens
tcacacagacaca

SEQ ID NO: 2817829 - DNA, 12 bp, Homo sapiens
tcacacaggcat

SEQ ID NO: 2817830 - DNA, 23 bp, Homo sapiens
tcacacagtgagtcgaggacagg

SEQ ID NO: 2817831 - DNA, 23 bp, Homo sapiens
tcacacagtgggtggtggatctg

SEQ ID NO: 2817832 - DNA, 19 bp, Homo sapiens
tcacactctaagttctatt

SEQ ID NO: 2817833 - DNA, 13 bp, Homo sapiens
tcacactgagctg

SEQ ID NO: 2817834 - DNA, 23 bp, Homo sapiens
tcacactgttactccacagcgga

SEQ ID NO: 2817835 - DNA, 20 bp, Homo sapiens
tcacagatgggtattaaact

SEQ ID NO: 2817836 - DNA, 21 bp, Homo sapiens
tcacagatgggtattaaactt

SEQ ID NO: 2817837 - DNA, 16 bp, Homo sapiens
tcacaggactctgcct

SEQ ID NO: 2817838 - DNA, 17 bp, Homo sapiens
tcacaggactctgcctc

SEQ ID NO: 2817839 - DNA, 17 bp, Homo sapiens
tcacaggcaggtccagg

SEQ ID NO: 2817840 - DNA, 15 bp, Homo sapiens
tcacagggcagagcc

SEQ ID NO: 2817841 - DNA, 18 bp, Homo sapiens
tcacagtctctttaatct

SEQ ID NO: 2817842 - DNA, 23 bp, Homo sapiens
tcacagtctctttaatcttcagt

SEQ ID NO: 2817843 - DNA, 11 bp, Homo sapiens
tcacagtgttt

SEQ ID NO: 2817844 - DNA, 13 bp, Homo sapiens
tcacagttcctcg

SEQ ID NO: 2817845 - DNA, 17 bp, Homo sapiens
tcacagttcctcgccct

SEQ ID NO: 2817846 - DNA, 18 bp, Homo sapiens
tcacagttcctcgccctg

SEQ ID NO: 2817847 - DNA, 17 bp, Homo sapiens
tcacataatgaatgcta

SEQ ID NO: 2817848 - DNA, 12 bp, Homo sapiens
tcacatacaatt

SEQ ID NO: 2817849 - DNA, 19 bp, Homo sapiens
tcacatacaatttgcactg

SEQ ID NO: 2817850 - DNA, 22 bp, Homo sapiens
tcacatataaaagttaaactac

SEQ ID NO: 2817851 - DNA, 12 bp, Homo sapiens
tcacatatctgt

SEQ ID NO: 2817852 - DNA, 18 bp, Homo sapiens
tcacatttattctgctca

SEQ ID NO: 2817853 - DNA, 17 bp, Homo sapiens
tcacatttgatgtacat

SEQ ID NO: 2817854 - DNA, 20 bp, Homo sapiens
tcaccaagctcacagttcct

SEQ ID NO: 2817855 - DNA, 23 bp, Homo sapiens
tcaccaatgtacccaccgggcca

SEQ ID NO: 2817856 - DNA, 23 bp, Homo sapiens
tcaccacaccaaacctctcttat

SEQ ID NO: 2817857 - DNA, 21 bp, Homo sapiens
tcaccagagcccatgctcaac

SEQ ID NO: 2817858 - DNA, 17 bp, Homo sapiens
tcacccatgaagacagg

SEQ ID NO: 2817859 - DNA, 13 bp, Homo sapiens
tcacccccagctt

SEQ ID NO: 2817860 - DNA, 15 bp, Homo sapiens
tcaccccctcccacc

SEQ ID NO: 2817861 - DNA, 23 bp, Homo sapiens
tcaccccctcccacccccagccc

SEQ ID NO: 2817862 - DNA, 16 bp, Homo sapiens
tcacccgaggctgccc

SEQ ID NO: 2817863 - DNA, 20 bp, Homo sapiens
tcaccctcataccatctgct

SEQ ID NO: 2817864 - DNA, 18 bp, Homo sapiens
tcaccgtggaccttcctg

SEQ ID NO: 2817865 - DNA, 19 bp, Homo sapiens
tcacctactcacacaggca

SEQ ID NO: 2817866 - DNA, 12 bp, Homo sapiens
tcacctctgcct

SEQ ID NO: 2817867 - DNA, 13 bp, Homo sapiens
tcacctctgcctc

SEQ ID NO: 2817868 - DNA, 14 bp, Homo sapiens
tcacctctgcctca

SEQ ID NO: 2817869 - DNA, 15 bp, Homo sapiens
tcacctgaggtcggg

SEQ ID NO: 2817870 - DNA, 19 bp, Homo sapiens
tcacctggaagcatttgtt

SEQ ID NO: 2817871 - DNA, 23 bp, Homo sapiens
tcacctgttactgaaagtggttt

SEQ ID NO: 2817872 - DNA, 18 bp, Homo sapiens
tcacctgtttttaagctg

SEQ ID NO: 2817873 - DNA, 20 bp, Homo sapiens
tcacctgtttttaagctgtt

SEQ ID NO: 2817874 - DNA, 22 bp, Homo sapiens
tcacctgtttttaagctgtttc

SEQ ID NO: 2817875 - DNA, 16 bp, Homo sapiens
tcaccttatgtattat

SEQ ID NO: 2817876 - DNA, 19 bp, Homo sapiens
tcaccttatgtattatttt

SEQ ID NO: 2817877 - DNA, 14 bp, Homo sapiens
tcacgccactgcac

SEQ ID NO: 2817878 - DNA, 16 bp, Homo sapiens
tcacgccactgcacta

SEQ ID NO: 2817879 - DNA, 22 bp, Homo sapiens
tcacgccactgcactccagcct

SEQ ID NO: 2817880 - DNA, 20 bp, Homo sapiens
tcacgcctataatcccagca

SEQ ID NO: 2817881 - DNA, 20 bp, Homo sapiens
tcacgcctgtaatcccagca

SEQ ID NO: 2817882 - DNA, 21 bp, Homo sapiens
tcacgcctgtaatcccagcac

SEQ ID NO: 2817883 - DNA, 16 bp, Homo sapiens
tcacgctttttgaaaa

SEQ ID NO: 2817884 - DNA, 13 bp, Homo sapiens
tcacggcatgttt

SEQ ID NO: 2817885 - DNA, 20 bp, Homo sapiens
tcacggctcactgcagcctc

SEQ ID NO: 2817886 - DNA, 18 bp, Homo sapiens
tcacgggcagtagctgtg

SEQ ID NO: 2817887 - DNA, 20 bp, Homo sapiens
tcacgtggtcaaggcccggc

SEQ ID NO: 2817888 - DNA, 17 bp, Homo sapiens
tcactaaatcttttata

SEQ ID NO: 2817889 - DNA, 18 bp, Homo sapiens
tcactatgacactgagca

SEQ ID NO: 2817890 - DNA, 20 bp, Homo sapiens
tcactatgttgcccaggcag

SEQ ID NO: 2817891 - DNA, 15 bp, Homo sapiens
tcttttactgtaatt

SEQ ID NO: 2817892 - DNA, 22 bp, Homo sapiens
tcttttataactagtcctttac

SEQ ID NO: 2817893 - DNA, 14 bp, Homo sapiens
tcttttataggatt

SEQ ID NO: 2817894 - DNA, 13 bp, Homo sapiens
tcttttctctgtg

SEQ ID NO: 2817895 - DNA, 21 bp, Homo sapiens
tctttttaaaaagttgcacat

SEQ ID NO: 2817896 - DNA, 14 bp, Homo sapiens
tctttttaagctta

SEQ ID NO: 2817897 - DNA, 21 bp, Homo sapiens
tctttttaagcttatttaatt

SEQ ID NO: 2817898 - DNA, 22 bp, Homo sapiens
tgaaaaccatccatctgtggaa

SEQ ID NO: 2817899 - DNA, 23 bp, Homo sapiens
tgaaaacccagagaggaatcaga

SEQ ID NO: 2817900 - DNA, 15 bp, Homo sapiens
tgaaaactgtaaata

SEQ ID NO: 2817901 - DNA, 18 bp, Homo sapiens
tgaaaactgtaaatacaa

SEQ ID NO: 2817902 - DNA, 23 bp, Homo sapiens
tgaaaactgtttatggtattttc

SEQ ID NO: 2817903 - DNA, 19 bp, Homo sapiens
tgaaaaggtttatgaaaaa

SEQ ID NO: 2817904 - DNA, 12 bp, Homo sapiens
tgaaaatcacta

SEQ ID NO: 2817905 - DNA, 14 bp, Homo sapiens
tgaaaatcactata

SEQ ID NO: 2817906 - DNA, 20 bp, Homo sapiens
tgaaaatgaatagagagtat

SEQ ID NO: 2817907 - DNA, 21 bp, Homo sapiens
tgaaaatgcaacaacatgtat

SEQ ID NO: 2817908 - DNA, 14 bp, Homo sapiens
tgaaaatgtcagaa

SEQ ID NO: 2817909 - DNA, 13 bp, Homo sapiens
tgaaaattattta

SEQ ID NO: 2817910 - DNA, 14 bp, Homo sapiens
tgaaacaaagagtt

SEQ ID NO: 2817911 - DNA, 23 bp, Homo sapiens
tgaaacaaagagttcaagaaata

SEQ ID NO: 2817912 - DNA, 16 bp, Homo sapiens
tgaaacacttctcatc

SEQ ID NO: 2817913 - DNA, 13 bp, Homo sapiens
tgaaacagaaaca

SEQ ID NO: 2817914 - DNA, 14 bp, Homo sapiens
tgaaacagaaacaa

SEQ ID NO: 2817915 - DNA, 16 bp, Homo sapiens
tgaaacctaaggcaac

SEQ ID NO: 2817916 - DNA, 20 bp, Homo sapiens
tgaaagaaacagttaacttt

SEQ ID NO: 2817917 - DNA, 22 bp, Homo sapiens
tgaaagaaacagttaactttca

SEQ ID NO: 2817918 - DNA, 18 bp, Homo sapiens
tgaaagaattatttttgt

SEQ ID NO: 2817919 - DNA, 18 bp, Homo sapiens
tgaaagagaaccagtttc

SEQ ID NO: 2817920 - DNA, 21 bp, Homo sapiens
tgaaagatggctgtgcctctg

SEQ ID NO: 2817921 - DNA, 17 bp, Homo sapiens
tgaaagccaaatttata

SEQ ID NO: 2817922 - DNA, 13 bp, Homo sapiens
tgaaagggcccag

SEQ ID NO: 2817923 - DNA, 15 bp, Homo sapiens
tgaaagggcccagag

SEQ ID NO: 2817924 - DNA, 15 bp, Homo sapiens
tgaaagtcagatgcc

SEQ ID NO: 2817925 - DNA, 18 bp, Homo sapiens
tgaaagtgtaaaatagaa

SEQ ID NO: 2817926 - DNA, 20 bp, Homo sapiens
tgaaataaattggtgataag

SEQ ID NO: 2817927 - DNA, 21 bp, Homo sapiens
tgaaataaattggtgataagt

SEQ ID NO: 2817928 - DNA, 18 bp, Homo sapiens
tgaaataattaaaaacca

SEQ ID NO: 2817929 - DNA, 22 bp, Homo sapiens
tgaaataccagtgaaccaaaga

SEQ ID NO: 2817930 - DNA, 23 bp, Homo sapiens
tgaaataccagtgaaccaaagag

SEQ ID NO: 2817931 - DNA, 20 bp, Homo sapiens
tctgcctgcccaggcccctg

SEQ ID NO: 2817932 - DNA, 12 bp, Homo sapiens
tctgcctgtctc

SEQ ID NO: 2817933 - DNA, 16 bp, Homo sapiens
tctgctactttgctgc

SEQ ID NO: 2817934 - DNA, 16 bp, Homo sapiens
tctgctcacatatctg

SEQ ID NO: 2817935 - DNA, 20 bp, Homo sapiens
tctgctcacatatctgtcat

SEQ ID NO: 2817936 - DNA, 19 bp, Homo sapiens
tctgctcaggaattgaaga

SEQ ID NO: 2817937 - DNA, 22 bp, Homo sapiens
tctgctcctcccattcccctta

SEQ ID NO: 2817938 - DNA, 18 bp, Homo sapiens
tctgctcctctccccagc

SEQ ID NO: 2817939 - DNA, 14 bp, Homo sapiens
tctgctctgatgca

SEQ ID NO: 2817940 - DNA, 18 bp, Homo sapiens
tctgctcttccaaagctc

SEQ ID NO: 2817941 - DNA, 13 bp, Homo sapiens
tctgctcttgcct

SEQ ID NO: 2817942 - DNA, 22 bp, Homo sapiens
tctgctgacagacacaggcccg

SEQ ID NO: 2817943 - DNA, 20 bp, Homo sapiens
tctgctgccccgcttcccca

SEQ ID NO: 2817944 - DNA, 15 bp, Homo sapiens
tctgctgcccctgca

SEQ ID NO: 2817945 - DNA, 16 bp, Homo sapiens
tctgctgcccctgcag

SEQ ID NO: 2817946 - DNA, 18 bp, Homo sapiens
tctgctgcccctgcagtt

SEQ ID NO: 2817947 - DNA, 13 bp, Homo sapiens
tctgctggtcact

SEQ ID NO: 2817948 - DNA, 13 bp, Homo sapiens
tctgcttcagcct

SEQ ID NO: 2817949 - DNA, 18 bp, Homo sapiens
tctgcttgtattttccat

SEQ ID NO: 2817950 - DNA, 20 bp, Homo sapiens
tctggaaaactcaggattct

SEQ ID NO: 2817951 - DNA, 19 bp, Homo sapiens
tctggaagtccccgggagc

SEQ ID NO: 2817952 - DNA, 20 bp, Homo sapiens
tctggaagtccccgggagcc

SEQ ID NO: 2817953 - DNA, 22 bp, Homo sapiens
tctggaatacatgaaatataga

SEQ ID NO: 2817954 - DNA, 16 bp, Homo sapiens
tctggaatgcagtggt

SEQ ID NO: 2817955 - DNA, 15 bp, Homo sapiens
tctggaatgtaatca

SEQ ID NO: 2817956 - DNA, 12 bp, Homo sapiens
tctggacaagcc

SEQ ID NO: 2817957 - DNA, 21 bp, Homo sapiens
tctggacaggcatgttctctg

SEQ ID NO: 2817958 - DNA, 22 bp, Homo sapiens
tctggactcctctgtccaggca

SEQ ID NO: 2817959 - DNA, 19 bp, Homo sapiens
tctggagctgctgttccaa

SEQ ID NO: 2817960 - DNA, 12 bp, Homo sapiens
tctggcagccac

SEQ ID NO: 2817961 - DNA, 13 bp, Homo sapiens
tctggcagccaca

SEQ ID NO: 2817962 - DNA, 23 bp, Homo sapiens
tctggcagccacacttctcagga

SEQ ID NO: 2817963 - DNA, 20 bp, Homo sapiens
tctggcagggtgggatggag

SEQ ID NO: 2817964 - DNA, 16 bp, Homo sapiens
tctggcctcagaccaa

SEQ ID NO: 2817965 - DNA, 16 bp, Homo sapiens
tctggctccgaaaaac

SEQ ID NO: 2817966 - DNA, 14 bp, Homo sapiens
tctggctgagctga

SEQ ID NO: 2817967 - DNA, 23 bp, Homo sapiens
tctggctttctccgactgctagg

SEQ ID NO: 2817968 - DNA, 12 bp, Homo sapiens
tctgggacacag

SEQ ID NO: 2817969 - DNA, 13 bp, Homo sapiens
tctgggacacagt

SEQ ID NO: 2817970 - DNA, 19 bp, Homo sapiens
tctgggaccctttccttcc

SEQ ID NO: 2817971 - DNA, 16 bp, Homo sapiens
tctgggacctcagttt

SEQ ID NO: 2817972 - DNA, 18 bp, Homo sapiens
tctgggctaccccaccca

SEQ ID NO: 2817973 - DNA, 15 bp, Homo sapiens
tctggggctctggga

SEQ ID NO: 2817974 - DNA, 22 bp, Homo sapiens
tctggggttcagcccctcctct

SEQ ID NO: 2817975 - DNA, 14 bp, Homo sapiens
tctgggttcactgc

SEQ ID NO: 2817976 - DNA, 16 bp, Homo sapiens
tctggtgttctcaatg

SEQ ID NO: 2817977 - DNA, 17 bp, Homo sapiens
tctgtacacgtgtcctg

SEQ ID NO: 2817978 - DNA, 13 bp, Homo sapiens
tctgtactgtaat

SEQ ID NO: 2817979 - DNA, 14 bp, Homo sapiens
tctgtactgtaatt

SEQ ID NO: 2817980 - DNA, 15 bp, Homo sapiens
tctgtattttcatgt

SEQ ID NO: 2817981 - DNA, 16 bp, Homo sapiens
tctgtattttcattta

SEQ ID NO: 2817982 - DNA, 20 bp, Homo sapiens
tccccagctccccaggactc

SEQ ID NO: 2817983 - DNA, 21 bp, Homo sapiens
tccccagctccccaggactca

SEQ ID NO: 2817984 - DNA, 14 bp, Homo sapiens
tccccaggactcac

SEQ ID NO: 2817985 - DNA, 17 bp, Homo sapiens
tccccaggactcaccct

SEQ ID NO: 2817986 - DNA, 14 bp, Homo sapiens
tccccaggccaggc

SEQ ID NO: 2817987 - DNA, 16 bp, Homo sapiens
tccccaggccaggcca

SEQ ID NO: 2817988 - DNA, 14 bp, Homo sapiens
tccccaggtctctc

SEQ ID NO: 2817989 - DNA, 20 bp, Homo sapiens
tccccaggtctctccactgc

SEQ ID NO: 2817990 - DNA, 19 bp, Homo sapiens
tccccatcatcccagctgc

SEQ ID NO: 2817991 - DNA, 19 bp, Homo sapiens
tccccattagagtcagcct

SEQ ID NO: 2817992 - DNA, 14 bp, Homo sapiens
tccccattcacaga

SEQ ID NO: 2817993 - DNA, 16 bp, Homo sapiens
tccccattcagacact

SEQ ID NO: 2817994 - DNA, 19 bp, Homo sapiens
tccccatttaggtttctga

SEQ ID NO: 2817995 - DNA, 19 bp, Homo sapiens
tcccccaccccctccccag

SEQ ID NO: 2817996 - DNA, 14 bp, Homo sapiens
tcccccactgccac

SEQ ID NO: 2817997 - DNA, 15 bp, Homo sapiens
tcccccactgccaca

SEQ ID NO: 2817998 - DNA, 12 bp, Homo sapiens
tcccccagcctc

SEQ ID NO: 2817999 - DNA, 19 bp, Homo sapiens
tcccccatcccccactgcc

SEQ ID NO: 2818000 - DNA, 19 bp, Homo sapiens
tccccccccaacctttccc

SEQ ID NO: 2818001 - DNA, 21 bp, Homo sapiens
tccccctatgctccagtatgg

SEQ ID NO: 2818002 - DNA, 17 bp, Homo sapiens
tccccctcccagggcca

SEQ ID NO: 2818003 - DNA, 18 bp, Homo sapiens
tccccctgccagtgcctt

SEQ ID NO: 2818004 - DNA, 20 bp, Homo sapiens
tccccctgcttctcagcccc

SEQ ID NO: 2818005 - DNA, 14 bp, Homo sapiens
tccccctgggctct

SEQ ID NO: 2818006 - DNA, 14 bp, Homo sapiens
tccccgcacccccc

SEQ ID NO: 2818007 - DNA, 21 bp, Homo sapiens
tccccgcaccccccaagctgt

SEQ ID NO: 2818008 - DNA, 15 bp, Homo sapiens
tccccgcagagctcc

SEQ ID NO: 2818009 - DNA, 23 bp, Homo sapiens
tccccgcagagctcccttcctga

SEQ ID NO: 2818010 - DNA, 14 bp, Homo sapiens
tcccctaacctcat

SEQ ID NO: 2818011 - DNA, 15 bp, Homo sapiens
tcccctatccaccca

SEQ ID NO: 2818012 - DNA, 16 bp, Homo sapiens
tcccctatccacccag

SEQ ID NO: 2818013 - DNA, 17 bp, Homo sapiens
tcccctatccacccagc

SEQ ID NO: 2818014 - DNA, 20 bp, Homo sapiens
tcccctatccacccagccca

SEQ ID NO: 2818015 - DNA, 13 bp, Homo sapiens
tcccctcccccct

SEQ ID NO: 2818016 - DNA, 15 bp, Homo sapiens
tcccctcccccctgt

SEQ ID NO: 2818017 - DNA, 16 bp, Homo sapiens
tcccctccctcttcct

SEQ ID NO: 2818018 - DNA, 18 bp, Homo sapiens
tcccctccctcttccttc

SEQ ID NO: 2818019 - DNA, 16 bp, Homo sapiens
tcccctcgctgtcctg

SEQ ID NO: 2818020 - DNA, 19 bp, Homo sapiens
tcccctcgtgtgactctct

SEQ ID NO: 2818021 - DNA, 15 bp, Homo sapiens
tcccctgccctgctg

SEQ ID NO: 2818022 - DNA, 17 bp, Homo sapiens
tccccttcctgcacccg

SEQ ID NO: 2818023 - DNA, 19 bp, Homo sapiens
tccccttcctgcacccgta

SEQ ID NO: 2818024 - DNA, 15 bp, Homo sapiens
tccccttgcccaggg

SEQ ID NO: 2818025 - DNA, 16 bp, Homo sapiens
tccccttgcccagggc

SEQ ID NO: 2818026 - DNA, 22 bp, Homo sapiens
tccccttgcccagggctcagcc

SEQ ID NO: 2818027 - DNA, 14 bp, Homo sapiens
tcccctttattaat

SEQ ID NO: 2818028 - DNA, 16 bp, Homo sapiens
tcccgaatagctggga

SEQ ID NO: 2818029 - DNA, 20 bp, Homo sapiens
tcccgaatagctgggactac

SEQ ID NO: 2818030 - DNA, 17 bp, Homo sapiens
tcccgagtagctgggac

SEQ ID NO: 2818031 - DNA, 13 bp, Homo sapiens
tcccgctcctgct

SEQ ID NO: 2818032 - DNA, 15 bp, Homo sapiens
tccctaaaataaaaa

SEQ ID NO: 2818033 - DNA, 17 bp, Homo sapiens
tccctacttcctgtgac

SEQ ID NO: 2818034 - DNA, 15 bp, Homo sapiens
tccctaggagaccaa

SEQ ID NO: 2818035 - DNA, 16 bp, Homo sapiens
tccaagcttcaagtga

SEQ ID NO: 2818036 - DNA, 23 bp, Homo sapiens
tccaagcttcaagtgatatatgt

SEQ ID NO: 2818037 - DNA, 23 bp, Homo sapiens
tccaaggagaaacagagacaggc

SEQ ID NO: 2818038 - DNA, 13 bp, Homo sapiens
tccaagtatttta

SEQ ID NO: 2818039 - DNA, 21 bp, Homo sapiens
tccaagtattttatctgtgtt

SEQ ID NO: 2818040 - DNA, 22 bp, Homo sapiens
tccaagtattttatctgtgttg

SEQ ID NO: 2818041 - DNA, 21 bp, Homo sapiens
tccaatgtctttttaagctta

SEQ ID NO: 2818042 - DNA, 15 bp, Homo sapiens
tccaattatgtgaca

SEQ ID NO: 2818043 - DNA, 23 bp, Homo sapiens
tccaattatgtgacaacctttgt

SEQ ID NO: 2818044 - DNA, 21 bp, Homo sapiens
tccaattccacagtctctggg

SEQ ID NO: 2818045 - DNA, 14 bp, Homo sapiens
tccaattgtaaaaa

SEQ ID NO: 2818046 - DNA, 15 bp, Homo sapiens
tccaattgtaaaaaa

SEQ ID NO: 2818047 - DNA, 18 bp, Homo sapiens
tccaattttctggaatac

SEQ ID NO: 2818048 - DNA, 20 bp, Homo sapiens
tccacaagattcccagagac

SEQ ID NO: 2818049 - DNA, 23 bp, Homo sapiens
tccacaagattcccagagacagg

SEQ ID NO: 2818050 - DNA, 14 bp, Homo sapiens
tccacacacgcagg

SEQ ID NO: 2818051 - DNA, 15 bp, Homo sapiens
tccacacacgcagga

SEQ ID NO: 2818052 - DNA, 18 bp, Homo sapiens
tccacagccgcagcctcc

SEQ ID NO: 2818053 - DNA, 16 bp, Homo sapiens
tccacagtagcatttc

SEQ ID NO: 2818054 - DNA, 18 bp, Homo sapiens
tccacatctttaagtatt

SEQ ID NO: 2818055 - DNA, 12 bp, Homo sapiens
tccacccacctc

SEQ ID NO: 2818056 - DNA, 12 bp, Homo sapiens
tccacccagcaa

SEQ ID NO: 2818057 - DNA, 14 bp, Homo sapiens
tccacccagcccat

SEQ ID NO: 2818058 - DNA, 15 bp, Homo sapiens
tccacccagcccatt

SEQ ID NO: 2818059 - DNA, 12 bp, Homo sapiens
tccacccaggag

SEQ ID NO: 2818060 - DNA, 15 bp, Homo sapiens
tccaccctgagcctg

SEQ ID NO: 2818061 - DNA, 12 bp, Homo sapiens
tccaccctgctc

SEQ ID NO: 2818062 - DNA, 14 bp, Homo sapiens
tccaccgctgccta

SEQ ID NO: 2818063 - DNA, 17 bp, Homo sapiens
tccacctcagccttgga

SEQ ID NO: 2818064 - DNA, 13 bp, Homo sapiens
tccacctgcctat

SEQ ID NO: 2818065 - DNA, 12 bp, Homo sapiens
tccacctgcttt

SEQ ID NO: 2818066 - DNA, 22 bp, Homo sapiens
tccacctgttcaggagctgaag

SEQ ID NO: 2818067 - DNA, 16 bp, Homo sapiens
tccaccttcccatgcc

SEQ ID NO: 2818068 - DNA, 18 bp, Homo sapiens
tccactgtcttgcctgcc

SEQ ID NO: 2818069 - DNA, 19 bp, Homo sapiens
tccactgtcttgcctgcca

SEQ ID NO: 2818070 - DNA, 14 bp, Homo sapiens
tccacttctctaga

SEQ ID NO: 2818071 - DNA, 20 bp, Homo sapiens
tccactttgttggaaagcag

SEQ ID NO: 2818072 - DNA, 17 bp, Homo sapiens
tccagaaaatataaatg

SEQ ID NO: 2818073 - DNA, 23 bp, Homo sapiens
tccagaaaatataaatgcatgat

SEQ ID NO: 2818074 - DNA, 18 bp, Homo sapiens
tccagaagaatattcagg

SEQ ID NO: 2818075 - DNA, 22 bp, Homo sapiens
tccagaataaaacgcaaagggc

SEQ ID NO: 2818076 - DNA, 15 bp, Homo sapiens
tccagaataagtgct

SEQ ID NO: 2818077 - DNA, 16 bp, Homo sapiens
tccagaataagtgctg

SEQ ID NO: 2818078 - DNA, 18 bp, Homo sapiens
tccagaataagtgctgtt

SEQ ID NO: 2818079 - DNA, 22 bp, Homo sapiens
tccagaccctgaagatttcaga

SEQ ID NO: 2818080 - DNA, 15 bp, Homo sapiens
tccagacctgaagaa

SEQ ID NO: 2818081 - DNA, 19 bp, Homo sapiens
tccagagagtcctctggat

SEQ ID NO: 2818082 - DNA, 22 bp, Homo sapiens
tccagattttttacagctgcct

SEQ ID NO: 2818083 - DNA, 12 bp, Homo sapiens
tccagccagcgc

SEQ ID NO: 2818084 - DNA, 18 bp, Homo sapiens
tccagccagcgcctccct

SEQ ID NO: 2818085 - DNA, 19 bp, Homo sapiens
tccagccagcgcctccctc

SEQ ID NO: 2818086 - DNA, 23 bp, Homo sapiens
tccagccagcgcctccctccacc

SEQ ID NO: 2818087 - DNA, 19 bp, Homo sapiens
tccagccatcaagagactg

SEQ ID NO: 2818088 - DNA, 13 bp, Homo sapiens
tccagcctgagca

SEQ ID NO: 2818089 - DNA, 13 bp, Homo sapiens
tccagcctgggca

SEQ ID NO: 2818090 - DNA, 18 bp, Homo sapiens
tccagccttctctctctg

SEQ ID NO: 2818091 - DNA, 19 bp, Homo sapiens
tccagccttctctctctgg

SEQ ID NO: 2818092 - DNA, 14 bp, Homo sapiens
tccagctcaccagc

SEQ ID NO: 2818093 - DNA, 18 bp, Homo sapiens
tccagctcaccagcccca

SEQ ID NO: 2818094 - DNA, 11 bp, Homo sapiens
tccagctcttg

SEQ ID NO: 2818095 - DNA, 24 bp, Homo sapiens
tccagctggaattgctgctctctg

SEQ ID NO: 2818096 - DNA, 15 bp, Homo sapiens
tccaggaaaactgtt

SEQ ID NO: 2818097 - DNA, 22 bp, Homo sapiens
tccaggaaggtagcccagcact

SEQ ID NO: 2818098 - DNA, 22 bp, Homo sapiens
tccaggaatgcctcctccctgg

SEQ ID NO: 2818099 - DNA, 15 bp, Homo sapiens
tccaggagcctgtgc

SEQ ID NO: 2818100 - DNA, 15 bp, Homo sapiens
tccaggcacccttct

SEQ ID NO: 2818101 - DNA, 16 bp, Homo sapiens
tccaggcacccttctt

SEQ ID NO: 2818102 - DNA, 19 bp, Homo sapiens
tccaggcacccttctttcc

SEQ ID NO: 2818103 - DNA, 23 bp, Homo sapiens
tccaggcacccttctttcctctt

SEQ ID NO: 2818104 - DNA, 14 bp, Homo sapiens
tccaggcatgctgg

SEQ ID NO: 2818105 - DNA, 16 bp, Homo sapiens
tccaggcatgctggcc

SEQ ID NO: 2818106 - DNA, 14 bp, Homo sapiens
tccaggctgtttct

SEQ ID NO: 2818107 - DNA, 14 bp, Homo sapiens
tccagggctgcccc

SEQ ID NO: 2818108 - DNA, 18 bp, Homo sapiens
tccagtggacctgaagga

SEQ ID NO: 2818109 - DNA, 16 bp, Homo sapiens
tccagtgtctcggagg

SEQ ID NO: 2818110 - DNA, 13 bp, Homo sapiens
tccagtgtgcacc

SEQ ID NO: 2818111 - DNA, 16 bp, Homo sapiens
tccagttcatgagaat

SEQ ID NO: 2818112 - DNA, 16 bp, Homo sapiens
tccagttgcaataaaa

SEQ ID NO: 2818113 - DNA, 17 bp, Homo sapiens
tccagttgcaataaaat

SEQ ID NO: 2818114 - DNA, 19 bp, Homo sapiens
tccagttgcaataaaatag

SEQ ID NO: 2818115 - DNA, 12 bp, Homo sapiens
tccagtttccca

SEQ ID NO: 2818116 - DNA, 14 bp, Homo sapiens
tccagtttcccacc

SEQ ID NO: 2818117 - DNA, 22 bp, Homo sapiens
tccataatctggactcctctgt

SEQ ID NO: 2818118 - DNA, 21 bp, Homo sapiens
tccataattatgacagttata

SEQ ID NO: 2818119 - DNA, 18 bp, Homo sapiens
tccatatattagcattta

SEQ ID NO: 2818120 - DNA, 20 bp, Homo sapiens
tccatatattagcatttagt

SEQ ID NO: 2818121 - DNA, 17 bp, Homo sapiens
tccatcaggacttggga

SEQ ID NO: 2818122 - DNA, 14 bp, Homo sapiens
tccatcccatcatc

SEQ ID NO: 2818123 - DNA, 21 bp, Homo sapiens
tccatgaagaccacatccaca

SEQ ID NO: 2818124 - DNA, 14 bp, Homo sapiens
tccatgatggaata

SEQ ID NO: 2818125 - DNA, 13 bp, Homo sapiens
gcagccagccctg

SEQ ID NO: 2818126 - DNA, 16 bp, Homo sapiens
gcagccagccctgcct

SEQ ID NO: 2818127 - DNA, 21 bp, Homo sapiens
gcagccagccctgcctggagg

SEQ ID NO: 2818128 - DNA, 20 bp, Homo sapiens
gcagccagccggtgcctggc

SEQ ID NO: 2818129 - DNA, 13 bp, Homo sapiens
gcagcccagcctc

SEQ ID NO: 2818130 - DNA, 14 bp, Homo sapiens
gcagcccagcctct

SEQ ID NO: 2818131 - DNA, 20 bp, Homo sapiens
gcagcccagggcacttcaga

SEQ ID NO: 2818132 - DNA, 18 bp, Homo sapiens
gcagccccattctgcctg

SEQ ID NO: 2818133 - DNA, 18 bp, Homo sapiens
gcagccctcctcaccccg

SEQ ID NO: 2818134 - DNA, 21 bp, Homo sapiens
gcagcctcaacctcctgggct

SEQ ID NO: 2818135 - DNA, 22 bp, Homo sapiens
gcagcctcaacctcctgggcta

SEQ ID NO: 2818136 - DNA, 14 bp, Homo sapiens
gcagcctccctctg

SEQ ID NO: 2818137 - DNA, 23 bp, Homo sapiens
gcagcctccctctgacctgcagg

SEQ ID NO: 2818138 - DNA, 15 bp, Homo sapiens
gcagcctcctcctga

SEQ ID NO: 2818139 - DNA, 13 bp, Homo sapiens
gcagctcctctgt

SEQ ID NO: 2818140 - DNA, 14 bp, Homo sapiens
gcagctgagcaggg

SEQ ID NO: 2818141 - DNA, 20 bp, Homo sapiens
gcagctgagcagggccgggg

SEQ ID NO: 2818142 - DNA, 19 bp, Homo sapiens
gcagctgcggtccacccag

SEQ ID NO: 2818143 - DNA, 17 bp, Homo sapiens
gcagcttcatcaatttt

SEQ ID NO: 2818144 - DNA, 18 bp, Homo sapiens
gcagcttcatcaattttt

SEQ ID NO: 2818145 - DNA, 14 bp, Homo sapiens
gcagcttcctgtca

SEQ ID NO: 2818146 - DNA, 13 bp, Homo sapiens
gcagcttgagcct

SEQ ID NO: 2818147 - DNA, 15 bp, Homo sapiens
gcaggaactcccagc

SEQ ID NO: 2818148 - DNA, 16 bp, Homo sapiens
gcaggaagccaggctg

SEQ ID NO: 2818149 - DNA, 20 bp, Homo sapiens
gcaggaagccaggctgagtg

SEQ ID NO: 2818150 - DNA, 23 bp, Homo sapiens
gcaggaaggactatgaaaagcta

SEQ ID NO: 2818151 - DNA, 19 bp, Homo sapiens
gccactgcaccgggccaca

SEQ ID NO: 2818152 - DNA, 12 bp, Homo sapiens
gccactgcactc

SEQ ID NO: 2818153 - DNA, 20 bp, Homo sapiens
gccactgcactccagcctgg

SEQ ID NO: 2818154 - DNA, 19 bp, Homo sapiens
gccactgcactccagtctg

SEQ ID NO: 2818155 - DNA, 13 bp, Homo sapiens
gccactgcctctt

SEQ ID NO: 2818156 - DNA, 16 bp, Homo sapiens
gccactggtttctcag

SEQ ID NO: 2818157 - DNA, 22 bp, Homo sapiens
gccacttaccttcaataaagta

SEQ ID NO: 2818158 - DNA, 23 bp, Homo sapiens
gccacttaccttcaataaagtat

SEQ ID NO: 2818159 - DNA, 21 bp, Homo sapiens
gccactttggtacatggccag

SEQ ID NO: 2818160 - DNA, 16 bp, Homo sapiens
gccagaacagtttgta

SEQ ID NO: 2818161 - DNA, 23 bp, Homo sapiens
gccagaagcctctgcctccctag

SEQ ID NO: 2818162 - DNA, 12 bp, Homo sapiens
gccagagcctgg

SEQ ID NO: 2818163 - DNA, 14 bp, Homo sapiens
gccagagcctgggg

SEQ ID NO: 2818164 - DNA, 18 bp, Homo sapiens
gccagagcctggggctct

SEQ ID NO: 2818165 - DNA, 21 bp, Homo sapiens
gccagagggagtgacagaggc

SEQ ID NO: 2818166 - DNA, 22 bp, Homo sapiens
gccagagggagtgacagaggca

SEQ ID NO: 2818167 - DNA, 23 bp, Homo sapiens
gccagagggagtgacagaggcag

SEQ ID NO: 2818168 - DNA, 14 bp, Homo sapiens
gccagatgcaccag

SEQ ID NO: 2818169 - DNA, 16 bp, Homo sapiens
gccagatgcaccagcc

SEQ ID NO: 2818170 - DNA, 12 bp, Homo sapiens
gccagatttttt

SEQ ID NO: 2818171 - DNA, 12 bp, Homo sapiens
gccagcagcaga

SEQ ID NO: 2818172 - DNA, 18 bp, Homo sapiens
gccagccagaagcctctg

SEQ ID NO: 2818173 - DNA, 14 bp, Homo sapiens
gccagccagcagcc

SEQ ID NO: 2818174 - DNA, 16 bp, Homo sapiens
gccagccagcagccag

SEQ ID NO: 2818175 - DNA, 13 bp, Homo sapiens
gccagccctccct

SEQ ID NO: 2818176 - DNA, 20 bp, Homo sapiens
gccagccctccctgtcctcc

SEQ ID NO: 2818177 - DNA, 22 bp, Homo sapiens
gccagccctccctgtcctcctc

SEQ ID NO: 2818178 - DNA, 10 bp, Homo sapiens
gccagccctg

SEQ ID NO: 2818179 - DNA, 16 bp, Homo sapiens
gccagccctgcctgga

SEQ ID NO: 2818180 - DNA, 19 bp, Homo sapiens
gccagccctgcctggagga

SEQ ID NO: 2818181 - DNA, 17 bp, Homo sapiens
gccagccggtgcctggc

SEQ ID NO: 2818182 - DNA, 18 bp, Homo sapiens
gccagccgtgatgctcag

SEQ ID NO: 2818183 - DNA, 20 bp, Homo sapiens
gccagccgtgatgctcaggc

SEQ ID NO: 2818184 - DNA, 11 bp, Homo sapiens
gccagcctggc

SEQ ID NO: 2818185 - DNA, 14 bp, Homo sapiens
gccagcctggcctc

SEQ ID NO: 2818186 - DNA, 22 bp, Homo sapiens
gccagcctggcctcctgcctct

SEQ ID NO: 2818187 - DNA, 23 bp, Homo sapiens
gccagcctggcctcctgcctcta

SEQ ID NO: 2818188 - DNA, 17 bp, Homo sapiens
gccagcctggcttctgg

SEQ ID NO: 2818189 - DNA, 18 bp, Homo sapiens
gccagcgcctccctccac

SEQ ID NO: 2818190 - DNA, 23 bp, Homo sapiens
gccagcgcctccctccaccccag

SEQ ID NO: 2818191 - DNA, 19 bp, Homo sapiens
gccagctcctgggcagctt

SEQ ID NO: 2818192 - DNA, 10 bp, Homo sapiens
gccagctctc

SEQ ID NO: 2818193 - DNA, 13 bp, Homo sapiens
gccagctctcagc

SEQ ID NO: 2818194 - DNA, 14 bp, Homo sapiens
gccagctgcatcta

SEQ ID NO: 2818195 - DNA, 22 bp, Homo sapiens
gccagctgcatctactcaggcc

SEQ ID NO: 2818196 - DNA, 15 bp, Homo sapiens
gccagctgccgacca

SEQ ID NO: 2818197 - DNA, 20 bp, Homo sapiens
gccagctgccgaccagagcc

SEQ ID NO: 2818198 - DNA, 14 bp, Homo sapiens
gccaggacaggccc

SEQ ID NO: 2818199 - DNA, 15 bp, Homo sapiens
gccaggacaggcccg

SEQ ID NO: 2818200 - DNA, 17 bp, Homo sapiens
gccaggactccccaggc

SEQ ID NO: 2818201 - DNA, 22 bp, Homo sapiens
gccaggactccccaggccaggc

SEQ ID NO: 2818202 - DNA, 22 bp, Homo sapiens
gccaggagggacaaaggagcct

SEQ ID NO: 2818203 - DNA, 13 bp, Homo sapiens
gccgcctccagga

SEQ ID NO: 2818204 - DNA, 16 bp, Homo sapiens
gccgcctccaggagcc

SEQ ID NO: 2818205 - DNA, 22 bp, Homo sapiens
gccgcctccaggagcctacccc

SEQ ID NO: 2818206 - DNA, 15 bp, Homo sapiens
gccgcctcccagcct

SEQ ID NO: 2818207 - DNA, 16 bp, Homo sapiens
gccgcctcccagcctg

SEQ ID NO: 2818208 - DNA, 19 bp, Homo sapiens
gccgctcttctgtcatccc

SEQ ID NO: 2818209 - DNA, 17 bp, Homo sapiens
gccgctgctttgcgctg

SEQ ID NO: 2818210 - DNA, 21 bp, Homo sapiens
gccggcaaccccagttctgct

SEQ ID NO: 2818211 - DNA, 23 bp, Homo sapiens
gccggcaaccccagttctgctcc

SEQ ID NO: 2818212 - DNA, 20 bp, Homo sapiens
gccggcacctacatccccag

SEQ ID NO: 2818213 - DNA, 22 bp, Homo sapiens
gccggcacctacatccccaggt

SEQ ID NO: 2818214 - DNA, 22 bp, Homo sapiens
gccgggaacagacaacagaagt

SEQ ID NO: 2818215 - DNA, 12 bp, Homo sapiens
gccgggcctggg

SEQ ID NO: 2818216 - DNA, 22 bp, Homo sapiens
gccgggcttgggccctgcacag

SEQ ID NO: 2818217 - DNA, 20 bp, Homo sapiens
gccggggaagctggcagcac

SEQ ID NO: 2818218 - DNA, 16 bp, Homo sapiens
gccgggtgcggtggct

SEQ ID NO: 2818219 - DNA, 19 bp, Homo sapiens
gccgggtgcggtggctcac

SEQ ID NO: 2818220 - DNA, 18 bp, Homo sapiens
gccgtcagccaaatgtaa

SEQ ID NO: 2818221 - DNA, 18 bp, Homo sapiens
gccgttactctccaacct

SEQ ID NO: 2818222 - DNA, 20 bp, Homo sapiens
gccgttactctccaacctgg

SEQ ID NO: 2818223 - DNA, 14 bp, Homo sapiens
gcctaagaagctct

SEQ ID NO: 2818224 - DNA, 16 bp, Homo sapiens
gcctaagaagctctgg

SEQ ID NO: 2818225 - DNA, 17 bp, Homo sapiens
gcctaagtggctgctga

SEQ ID NO: 2818226 - DNA, 16 bp, Homo sapiens
gcctacattccctggc

SEQ ID NO: 2818227 - DNA, 18 bp, Homo sapiens
gcctacattccctggcct

SEQ ID NO: 2818228 - DNA, 19 bp, Homo sapiens
gcctacattccctggcctg

SEQ ID NO: 2818229 - DNA, 21 bp, Homo sapiens
gcctacattccctggcctggc

SEQ ID NO: 2818230 - DNA, 12 bp, Homo sapiens
gcctactcacga

SEQ ID NO: 2818231 - DNA, 17 bp, Homo sapiens
gcctagatccacacaca

SEQ ID NO: 2818232 - DNA, 23 bp, Homo sapiens
gcctagatccacacacagaggaa

SEQ ID NO: 2818233 - DNA, 19 bp, Homo sapiens
gcctagccgacctcagcct

SEQ ID NO: 2818234 - DNA, 12 bp, Homo sapiens
gcctagggagcc

SEQ ID NO: 2818235 - DNA, 13 bp, Homo sapiens
gcctaggtgacag

SEQ ID NO: 2818236 - DNA, 18 bp, Homo sapiens
gcctagtggggtctccct

SEQ ID NO: 2818237 - DNA, 23 bp, Homo sapiens
gcctagtggggtctccctctcct

SEQ ID NO: 2818238 - DNA, 15 bp, Homo sapiens
gcctatccatcctgc

SEQ ID NO: 2818239 - DNA, 16 bp, Homo sapiens
gcctatgacttgggca

SEQ ID NO: 2818240 - DNA, 18 bp, Homo sapiens
gcctatgatcccagcact

SEQ ID NO: 2818241 - DNA, 13 bp, Homo sapiens
gcctatggagagc

SEQ ID NO: 2818242 - DNA, 20 bp, Homo sapiens
gcctattagatgttttacaa

SEQ ID NO: 2818243 - DNA, 16 bp, Homo sapiens
gcctcaacctcctggg

SEQ ID NO: 2818244 - DNA, 17 bp, Homo sapiens
gcctcaacctcctgggc

SEQ ID NO: 2818245 - DNA, 18 bp, Homo sapiens
gcctcaacctcctgggct

SEQ ID NO: 2818246 - DNA, 19 bp, Homo sapiens
gcctcaagtgattctcctg

SEQ ID NO: 2818247 - DNA, 21 bp, Homo sapiens
gcctcaatgtgaatcagaccc

SEQ ID NO: 2818248 - DNA, 22 bp, Homo sapiens
gcctcaatgtgaatcagaccct

SEQ ID NO: 2818249 - DNA, 21 bp, Homo sapiens
gcctcaatgtggttgcaaggc

SEQ ID NO: 2818250 - DNA, 12 bp, Homo sapiens
gattcttctgct

SEQ ID NO: 2818251 - DNA, 13 bp, Homo sapiens
gattgaggcctgc

SEQ ID NO: 2818252 - DNA, 19 bp, Homo sapiens
gattgatagagtgttatca

SEQ ID NO: 2818253 - DNA, 22 bp, Homo sapiens
gattgcattagaaatagacagt

SEQ ID NO: 2818254 - DNA, 15 bp, Homo sapiens
gattgctatgaatga

SEQ ID NO: 2818255 - DNA, 16 bp, Homo sapiens
gattgcttgagcccag

SEQ ID NO: 2818256 - DNA, 19 bp, Homo sapiens
gattgcttgagcccaggag

SEQ ID NO: 2818257 - DNA, 12 bp, Homo sapiens
gattggctcacc

SEQ ID NO: 2818258 - DNA, 15 bp, Homo sapiens
gattgtcttaatatt

SEQ ID NO: 2818259 - DNA, 11 bp, Homo sapiens
gattgtttgca

SEQ ID NO: 2818260 - DNA, 12 bp, Homo sapiens
gatttaaaaaat

SEQ ID NO: 2818261 - DNA, 17 bp, Homo sapiens
gatttaaaaaataaata

SEQ ID NO: 2818262 - DNA, 14 bp, Homo sapiens
gatttacgactgaa

SEQ ID NO: 2818263 - DNA, 12 bp, Homo sapiens
gatttatttaaa

SEQ ID NO: 2818264 - DNA, 12 bp, Homo sapiens
gatttcaacata

SEQ ID NO: 2818265 - DNA, 21 bp, Homo sapiens
gatttcagaaagagcaagtct

SEQ ID NO: 2818266 - DNA, 16 bp, Homo sapiens
gatttcagaggctgca

SEQ ID NO: 2818267 - DNA, 22 bp, Homo sapiens
gatttcaggatactctgtcaga

SEQ ID NO: 2818268 - DNA, 13 bp, Homo sapiens
gatttcatgattt

SEQ ID NO: 2818269 - DNA, 16 bp, Homo sapiens
gatttcatgctatctc

SEQ ID NO: 2818270 - DNA, 18 bp, Homo sapiens
gatttcatgctatctctg

SEQ ID NO: 2818271 - DNA, 18 bp, Homo sapiens
gatttctaggtaggaaat

SEQ ID NO: 2818272 - DNA, 14 bp, Homo sapiens
gatttgagaaattt

SEQ ID NO: 2818273 - DNA, 18 bp, Homo sapiens
gatttgctatcaaaataa

SEQ ID NO: 2818274 - DNA, 13 bp, Homo sapiens
gatttgtatttat

SEQ ID NO: 2818275 - DNA, 21 bp, Homo sapiens
gattttaaaaacatgagaaat

SEQ ID NO: 2818276 - DNA, 21 bp, Homo sapiens
gattttaaattcacaatagaa

SEQ ID NO: 2818277 - DNA, 13 bp, Homo sapiens
gattttaattttg

SEQ ID NO: 2818278 - DNA, 21 bp, Homo sapiens
gattttacagagaatctgaag

SEQ ID NO: 2818279 - DNA, 13 bp, Homo sapiens
gattttatacata

SEQ ID NO: 2818280 - DNA, 18 bp, Homo sapiens
gattttcatcaatttaaa

SEQ ID NO: 2818281 - DNA, 13 bp, Homo sapiens
gcaaaaaagaaaa

SEQ ID NO: 2818282 - DNA, 14 bp, Homo sapiens
gcaaaaaagaaaac

SEQ ID NO: 2818283 - DNA, 17 bp, Homo sapiens
gcaaaaaagaaaacctt

SEQ ID NO: 2818284 - DNA, 21 bp, Homo sapiens
gcaaaaccactagaactctcc

SEQ ID NO: 2818285 - DNA, 15 bp, Homo sapiens
gcaaaagaagaagtt

SEQ ID NO: 2818286 - DNA, 10 bp, Homo sapiens
gcaaaatttc

SEQ ID NO: 2818287 - DNA, 16 bp, Homo sapiens
gcaaacactgtgtatt

SEQ ID NO: 2818288 - DNA, 22 bp, Homo sapiens
gcaaacatttcttaaaatgttt

SEQ ID NO: 2818289 - DNA, 17 bp, Homo sapiens
gcaaactcactgctcaa

SEQ ID NO: 2818290 - DNA, 19 bp, Homo sapiens
gcaaactcactgctcaaga

SEQ ID NO: 2818291 - DNA, 20 bp, Homo sapiens
gcaaacttgtatctgaagac

SEQ ID NO: 2818292 - DNA, 14 bp, Homo sapiens
gcaaagaattgact

SEQ ID NO: 2818293 - DNA, 22 bp, Homo sapiens
gcaaagcaccagcttctccagg

SEQ ID NO: 2818294 - DNA, 18 bp, Homo sapiens
gcaaagggagcactgggt

SEQ ID NO: 2818295 - DNA, 18 bp, Homo sapiens
gcaaagttacagatgcac

SEQ ID NO: 2818296 - DNA, 13 bp, Homo sapiens
gcaaagttatatt

SEQ ID NO: 2818297 - DNA, 18 bp, Homo sapiens
gcaaatgcaacaaaatat

SEQ ID NO: 2818298 - DNA, 15 bp, Homo sapiens
gcaaatgtggctcct

SEQ ID NO: 2818299 - DNA, 16 bp, Homo sapiens
gcaacaaaatatttaa

SEQ ID NO: 2818300 - DNA, 23 bp, Homo sapiens
gcaacacaagctggaagcacatg

SEQ ID NO: 2818301 - DNA, 19 bp, Homo sapiens
gcaacaggaatctcagaga

SEQ ID NO: 2818302 - DNA, 16 bp, Homo sapiens
gcaacaggctgggctt

SEQ ID NO: 2818303 - DNA, 19 bp, Homo sapiens
gcaacaggctgggcttcag

SEQ ID NO: 2818304 - DNA, 15 bp, Homo sapiens
gcaacataaaacaat

SEQ ID NO: 2818305 - DNA, 16 bp, Homo sapiens
gcaaccccagttctgc

SEQ ID NO: 2818306 - DNA, 21 bp, Homo sapiens
gcaaccccagttctgctcctc

SEQ ID NO: 2818307 - DNA, 16 bp, Homo sapiens
gcaacccccagcctgc

SEQ ID NO: 2818308 - DNA, 17 bp, Homo sapiens
gcaacccccagcctgct

SEQ ID NO: 2818309 - DNA, 19 bp, Homo sapiens
gcaaccgtggcccttcctg

SEQ ID NO: 2818310 - DNA, 24 bp, Homo sapiens
gcaaccgtggcccttcctggacag

SEQ ID NO: 2818311 - DNA, 13 bp, Homo sapiens
gcaacctgttctt

SEQ ID NO: 2818312 - DNA, 20 bp, Homo sapiens
gcaacctgttcttcctacca

SEQ ID NO: 2818313 - DNA, 22 bp, Homo sapiens
gcaaccttgcatccatctgggc

SEQ ID NO: 2818314 - DNA, 19 bp, Homo sapiens
gcaactcggagagggctgc

SEQ ID NO: 2818315 - DNA, 13 bp, Homo sapiens
gcaactgaggcag

SEQ ID NO: 2818316 - DNA, 14 bp, Homo sapiens
gcaactgaggcaga

SEQ ID NO: 2818317 - DNA, 21 bp, Homo sapiens
gcaagaaggcaaaaatagttt

SEQ ID NO: 2818318 - DNA, 23 bp, Homo sapiens
gcaagaaggcaaaaatagtttgg

SEQ ID NO: 2818319 - DNA, 16 bp, Homo sapiens
gcaagacgtcctggaa

SEQ ID NO: 2818320 - DNA, 17 bp, Homo sapiens
gcaagacgtcctggaat

SEQ ID NO: 2818321 - DNA, 14 bp, Homo sapiens
gcatgcattttgca

SEQ ID NO: 2818322 - DNA, 15 bp, Homo sapiens
gcatgcattttgcag

SEQ ID NO: 2818323 - DNA, 17 bp, Homo sapiens
gcatgccatctccaccc

SEQ ID NO: 2818324 - DNA, 16 bp, Homo sapiens
gcatgctcagcccttc

SEQ ID NO: 2818325 - DNA, 15 bp, Homo sapiens
gcatgctctctgcag

SEQ ID NO: 2818326 - DNA, 13 bp, Homo sapiens
gcatgctggggca

SEQ ID NO: 2818327 - DNA, 22 bp, Homo sapiens
gcatggggataaaggagaaggc

SEQ ID NO: 2818328 - DNA, 20 bp, Homo sapiens
gcatggtcccacatccctgg

SEQ ID NO: 2818329 - DNA, 19 bp, Homo sapiens
gcatggtggcgcaagcctg

SEQ ID NO: 2818330 - DNA, 15 bp, Homo sapiens
gcatgtcactcccag

SEQ ID NO: 2818331 - DNA, 16 bp, Homo sapiens
gcatgtcactcccaga

SEQ ID NO: 2818332 - DNA, 13 bp, Homo sapiens
gcatgtgaattct

SEQ ID NO: 2818333 - DNA, 21 bp, Homo sapiens
gcatgttctctgaggacacta

SEQ ID NO: 2818334 - DNA, 22 bp, Homo sapiens
gcatgttctctgaggacactaa

SEQ ID NO: 2818335 - DNA, 23 bp, Homo sapiens
gcatgttgccatgaggcctttcc

SEQ ID NO: 2818336 - DNA, 23 bp, Homo sapiens
gcatgtttcccgctccaagagaa

SEQ ID NO: 2818337 - DNA, 18 bp, Homo sapiens
gcattacgtgagccaggt

SEQ ID NO: 2818338 - DNA, 17 bp, Homo sapiens
gcattactgcatgcact

SEQ ID NO: 2818339 - DNA, 21 bp, Homo sapiens
gcattagaaatagacagtata

SEQ ID NO: 2818340 - DNA, 13 bp, Homo sapiens
gcattagaaatta

SEQ ID NO: 2818341 - DNA, 16 bp, Homo sapiens
gcattcagaagaaaaa

SEQ ID NO: 2818342 - DNA, 11 bp, Homo sapiens
gcattccatga

SEQ ID NO: 2818343 - DNA, 13 bp, Homo sapiens
gcattccatgatt

SEQ ID NO: 2818344 - DNA, 20 bp, Homo sapiens
gcattccatgattttacaga

SEQ ID NO: 2818345 - DNA, 22 bp, Homo sapiens
gcattccatgattttacagaga

SEQ ID NO: 2818346 - DNA, 13 bp, Homo sapiens
gcattccctgagt

SEQ ID NO: 2818347 - DNA, 13 bp, Homo sapiens
gcattctagtact

SEQ ID NO: 2818348 - DNA, 13 bp, Homo sapiens
gcattcttagact

SEQ ID NO: 2818349 - DNA, 19 bp, Homo sapiens
gcattgaatggctatgttt

SEQ ID NO: 2818350 - DNA, 13 bp, Homo sapiens
gcattgcatggac

SEQ ID NO: 2818351 - DNA, 18 bp, Homo sapiens
gcatttactttgtgttca

SEQ ID NO: 2818352 - DNA, 12 bp, Homo sapiens
gcatttcctggg

SEQ ID NO: 2818353 - DNA, 14 bp, Homo sapiens
gcatttcctgggtg

SEQ ID NO: 2818354 - DNA, 12 bp, Homo sapiens
gcatttgtgaaa

SEQ ID NO: 2818355 - DNA, 15 bp, Homo sapiens
gcatttgtgagccaa

SEQ ID NO: 2818356 - DNA, 15 bp, Homo sapiens
gcatttgtgtcatct

SEQ ID NO: 2818357 - DNA, 17 bp, Homo sapiens
gcattttctctagctga

SEQ ID NO: 2818358 - DNA, 22 bp, Homo sapiens
gcattttgtaagttgaagcaaa

SEQ ID NO: 2818359 - DNA, 21 bp, Homo sapiens
gcatttttactactattctgt

SEQ ID NO: 2818360 - DNA, 16 bp, Homo sapiens
gccaaaaaaaaataca

SEQ ID NO: 2818361 - DNA, 22 bp, Homo sapiens
gccaaaatattgcttatgtctc

SEQ ID NO: 2818362 - DNA, 17 bp, Homo sapiens
gccaaactctgccagcc

SEQ ID NO: 2818363 - DNA, 18 bp, Homo sapiens
gccaaactctgccagcca

SEQ ID NO: 2818364 - DNA, 16 bp, Homo sapiens
gccaaagctaggcctg

SEQ ID NO: 2818365 - DNA, 22 bp, Homo sapiens
gccaaagctaggcctggccaga

SEQ ID NO: 2818366 - DNA, 16 bp, Homo sapiens
gccaaatgtaattgaa

SEQ ID NO: 2818367 - DNA, 14 bp, Homo sapiens
gccaacatggtgaa

SEQ ID NO: 2818368 - DNA, 15 bp, Homo sapiens
gccaaccagcttgtc

SEQ ID NO: 2818369 - DNA, 14 bp, Homo sapiens
gccaacgacaaagc

SEQ ID NO: 2818370 - DNA, 20 bp, Homo sapiens
gccaacttgtaaatacacca

SEQ ID NO: 2818371 - DNA, 16 bp, Homo sapiens
gccaagagcagaggca

SEQ ID NO: 2818372 - DNA, 20 bp, Homo sapiens
gccaagagcagaggcagcga

SEQ ID NO: 2818373 - DNA, 18 bp, Homo sapiens
gccaagatcgcgccactg

SEQ ID NO: 2818374 - DNA, 19 bp, Homo sapiens
gccaaggtgggctgagccc

SEQ ID NO: 2818375 - DNA, 21 bp, Homo sapiens
gccaaggtgggctgagccctg

SEQ ID NO: 2818376 - DNA, 16 bp, Homo sapiens
gctcttctgtcatccc

SEQ ID NO: 2818377 - DNA, 23 bp, Homo sapiens
gctcttctgttctcaaatgctaa

SEQ ID NO: 2818378 - DNA, 15 bp, Homo sapiens
gctcttgcctgcacc

SEQ ID NO: 2818379 - DNA, 19 bp, Homo sapiens
gctcttggcccctgtgtga

SEQ ID NO: 2818380 - DNA, 13 bp, Homo sapiens
gctctttcagggg

SEQ ID NO: 2818381 - DNA, 14 bp, Homo sapiens
gctctttctgggcc

SEQ ID NO: 2818382 - DNA, 18 bp, Homo sapiens
gctctttctgggccaagt

SEQ ID NO: 2818383 - DNA, 21 bp, Homo sapiens
gctctttggggtcagccaggg

SEQ ID NO: 2818384 - DNA, 23 bp, Homo sapiens
gctctttggggtcagccagggcc

SEQ ID NO: 2818385 - DNA, 13 bp, Homo sapiens
gctgaaaatcact

SEQ ID NO: 2818386 - DNA, 15 bp, Homo sapiens
gctgaaaatcactat

SEQ ID NO: 2818387 - DNA, 19 bp, Homo sapiens
gctgaaacacctcccaggg

SEQ ID NO: 2818388 - DNA, 20 bp, Homo sapiens
gctgaaataaaagcctctgg

SEQ ID NO: 2818389 - DNA, 17 bp, Homo sapiens
gctgaacggggagaaaa

SEQ ID NO: 2818390 - DNA, 17 bp, Homo sapiens
gctgaactgagcctagc

SEQ ID NO: 2818391 - DNA, 22 bp, Homo sapiens
gctgaattattttgttgtgatt

SEQ ID NO: 2818392 - DNA, 13 bp, Homo sapiens
gctgacagacaca

SEQ ID NO: 2818393 - DNA, 19 bp, Homo sapiens
gctgacagacacaggcccg

SEQ ID NO: 2818394 - DNA, 13 bp, Homo sapiens
gctgaccaagaga

SEQ ID NO: 2818395 - DNA, 13 bp, Homo sapiens
gctgacccagtcc

SEQ ID NO: 2818396 - DNA, 15 bp, Homo sapiens
gctgacccagtccct

SEQ ID NO: 2818397 - DNA, 15 bp, Homo sapiens
gctgagaacctggcc

SEQ ID NO: 2818398 - DNA, 18 bp, Homo sapiens
gctgagaacctggccttc

SEQ ID NO: 2818399 - DNA, 21 bp, Homo sapiens
gctgagaacctggccttcagt

SEQ ID NO: 2818400 - DNA, 14 bp, Homo sapiens
gctgagcagggccg

SEQ ID NO: 2818401 - DNA, 16 bp, Homo sapiens
gctgagcagggccggg

SEQ ID NO: 2818402 - DNA, 14 bp, Homo sapiens
gctgagccctggca

SEQ ID NO: 2818403 - DNA, 16 bp, Homo sapiens
gctgagccctggcagg

SEQ ID NO: 2818404 - DNA, 20 bp, Homo sapiens
gctgagctcacaaggcagca

SEQ ID NO: 2818405 - DNA, 22 bp, Homo sapiens
gctgagctcacaaggcagcaag

SEQ ID NO: 2818406 - DNA, 14 bp, Homo sapiens
gctgagctctgaga

SEQ ID NO: 2818407 - DNA, 21 bp, Homo sapiens
gctgagctctgagaggccctg

SEQ ID NO: 2818408 - DNA, 22 bp, Homo sapiens
gctgagctctgagaggccctgg

SEQ ID NO: 2818409 - DNA, 23 bp, Homo sapiens
gctgagctctgagaggccctgga

SEQ ID NO: 2818410 - DNA, 20 bp, Homo sapiens
gctgaggatttcaagcctgc

SEQ ID NO: 2818411 - DNA, 15 bp, Homo sapiens
gctgaggcaggagga

SEQ ID NO: 2818412 - DNA, 14 bp, Homo sapiens
gcgtctaccctggg

SEQ ID NO: 2818413 - DNA, 13 bp, Homo sapiens
gcgtgactcaccc

SEQ ID NO: 2818414 - DNA, 16 bp, Homo sapiens
gcgtgactcacccaag

SEQ ID NO: 2818415 - DNA, 14 bp, Homo sapiens
gcgtgagccactgc

SEQ ID NO: 2818416 - DNA, 13 bp, Homo sapiens
gcgtggactctgc

SEQ ID NO: 2818417 - DNA, 14 bp, Homo sapiens
gcgtggactctgca

SEQ ID NO: 2818418 - DNA, 19 bp, Homo sapiens
gcgtgtcgtgggtgtgtgt

SEQ ID NO: 2818419 - DNA, 22 bp, Homo sapiens
gcgttattggtcggcagccttc

SEQ ID NO: 2818420 - DNA, 19 bp, Homo sapiens
gcgttctgctgcccctgca

SEQ ID NO: 2818421 - DNA, 21 bp, Homo sapiens
gcgttctgctgcccctgcagt

SEQ ID NO: 2818422 - DNA, 22 bp, Homo sapiens
gcgtttattaatgcctctcccg

SEQ ID NO: 2818423 - DNA, 16 bp, Homo sapiens
gctaaaagaaactttc

SEQ ID NO: 2818424 - DNA, 12 bp, Homo sapiens
gctaaatgcaaa

SEQ ID NO: 2818425 - DNA, 18 bp, Homo sapiens
gctaaatgcctaataaac

SEQ ID NO: 2818426 - DNA, 19 bp, Homo sapiens
gctaaatgcctaataaaca

SEQ ID NO: 2818427 - DNA, 18 bp, Homo sapiens
gctaacagggaaggcagg

SEQ ID NO: 2818428 - DNA, 22 bp, Homo sapiens
gctaacagggaaggcaggcagg

SEQ ID NO: 2818429 - DNA, 21 bp, Homo sapiens
gctaacccccttctactgagc

SEQ ID NO: 2818430 - DNA, 13 bp, Homo sapiens
gctaactggaagc

SEQ ID NO: 2818431 - DNA, 18 bp, Homo sapiens
gctaagtgatcctcccac

SEQ ID NO: 2818432 - DNA, 19 bp, Homo sapiens
gctaatctgtagggctgga

SEQ ID NO: 2818433 - DNA, 21 bp, Homo sapiens
gctaatgaagggaaaggatat

SEQ ID NO: 2818434 - DNA, 14 bp, Homo sapiens
gctaattaaaaagt

SEQ ID NO: 2818435 - DNA, 15 bp, Homo sapiens
gctaattaaaaagtt

SEQ ID NO: 2818436 - DNA, 20 bp, Homo sapiens
gctaattcccagagtgtgaa

SEQ ID NO: 2818437 - DNA, 20 bp, Homo sapiens
gctaattttttgttgtttct

SEQ ID NO: 2818438 - DNA, 19 bp, Homo sapiens
gctaatttttttgtatttt

SEQ ID NO: 2818439 - DNA, 22 bp, Homo sapiens
gctacaccactctggcagccac

SEQ ID NO: 2818440 - DNA, 17 bp, Homo sapiens
gctacaccttagcagct

SEQ ID NO: 2818441 - DNA, 13 bp, Homo sapiens
gctacataattta

SEQ ID NO: 2818442 - DNA, 16 bp, Homo sapiens
gctactcaagaggctg

SEQ ID NO: 2818443 - DNA, 20 bp, Homo sapiens
gctactcaagaggctgaggc

SEQ ID NO: 2818444 - DNA, 19 bp, Homo sapiens
gctactcagaagcctgagg

SEQ ID NO: 2818445 - DNA, 12 bp, Homo sapiens
gctactcagcag

SEQ ID NO: 2818446 - DNA, 24 bp, Homo sapiens
gctactcagcagccctcctcaccc

SEQ ID NO: 2818447 - DNA, 14 bp, Homo sapiens
gctactcaggaggc

SEQ ID NO: 2818448 - DNA, 16 bp, Homo sapiens
gctactctgtgccaga

SEQ ID NO: 2818449 - DNA, 17 bp, Homo sapiens
gctactctgtgccagag

SEQ ID NO: 2818450 - DNA, 19 bp, Homo sapiens
gctactctgtgccagagcc

SEQ ID NO: 2818451 - DNA, 18 bp, Homo sapiens
gcttgtggcaagtgaatt

SEQ ID NO: 2818452 - DNA, 23 bp, Homo sapiens
gcttgttttcttgccaatgaggt

SEQ ID NO: 2818453 - DNA, 19 bp, Homo sapiens
gctttaacaaaacaagaaa

SEQ ID NO: 2818454 - DNA, 21 bp, Homo sapiens
gctttaacaaaacaagaaaga

SEQ ID NO: 2818455 - DNA, 22 bp, Homo sapiens
gctttaacaaaacaagaaagaa

SEQ ID NO: 2818456 - DNA, 19 bp, Homo sapiens
gctttaaccgtttttcaag

SEQ ID NO: 2818457 - DNA, 19 bp, Homo sapiens
gctttacctttattaatga

SEQ ID NO: 2818458 - DNA, 20 bp, Homo sapiens
gctttacctttattaatgaa

SEQ ID NO: 2818459 - DNA, 21 bp, Homo sapiens
gctttcatcacacccttttaa

SEQ ID NO: 2818460 - DNA, 22 bp, Homo sapiens
gctttcccaccagcatgtcact

SEQ ID NO: 2818461 - DNA, 13 bp, Homo sapiens
gctttcctccctg

SEQ ID NO: 2818462 - DNA, 22 bp, Homo sapiens
gctttctacccagcgagccctg

SEQ ID NO: 2818463 - DNA, 20 bp, Homo sapiens
gctttcttctacaaccagag

SEQ ID NO: 2818464 - DNA, 18 bp, Homo sapiens
gctttgacatgaaaagat

SEQ ID NO: 2818465 - DNA, 20 bp, Homo sapiens
gctttgactcacctgttact

SEQ ID NO: 2818466 - DNA, 22 bp, Homo sapiens
gctttgcattcctacaaagatg

SEQ ID NO: 2818467 - DNA, 18 bp, Homo sapiens
gcttttccccggtccctt

SEQ ID NO: 2818468 - DNA, 22 bp, Homo sapiens
gcttttcctttgtttttatgaa

SEQ ID NO: 2818469 - DNA, 18 bp, Homo sapiens
gcttttctaatcttgtta

SEQ ID NO: 2818470 - DNA, 23 bp, Homo sapiens
gcttttgcggttcaggaaaattg

SEQ ID NO: 2818471 - DNA, 15 bp, Homo sapiens
gcttttggtctgtgt

SEQ ID NO: 2818472 - DNA, 18 bp, Homo sapiens
gcttttgtctatgggact

SEQ ID NO: 2818473 - DNA, 13 bp, Homo sapiens
gctttttccagag

SEQ ID NO: 2818474 - DNA, 21 bp, Homo sapiens
ggaaaaacatctgaaagccac

SEQ ID NO: 2818475 - DNA, 23 bp, Homo sapiens
ggaaaagaatccctgcagcctgg

SEQ ID NO: 2818476 - DNA, 21 bp, Homo sapiens
ggaaaagaggagtttcgaggt

SEQ ID NO: 2818477 - DNA, 16 bp, Homo sapiens
ggaaaagtcacacaga

SEQ ID NO: 2818478 - DNA, 12 bp, Homo sapiens
ggaaaagtgtta

SEQ ID NO: 2818479 - DNA, 15 bp, Homo sapiens
ggaaaagtgttatta

SEQ ID NO: 2818480 - DNA, 22 bp, Homo sapiens
ggaaagaaagcacctgttttta

SEQ ID NO: 2818481 - DNA, 21 bp, Homo sapiens
ggaaagcaccgcagcatgtgg

SEQ ID NO: 2818482 - DNA, 21 bp, Homo sapiens
ggaaagcaggtggcatctcta

SEQ ID NO: 2818483 - DNA, 18 bp, Homo sapiens
ggaaagcatcacctcagg

SEQ ID NO: 2818484 - DNA, 19 bp, Homo sapiens
ggaaaggctcagtctcagg

SEQ ID NO: 2818485 - DNA, 20 bp, Homo sapiens
ggaaaggctcagtctcagga

SEQ ID NO: 2818486 - DNA, 15 bp, Homo sapiens
ggaaataaaaccttt

SEQ ID NO: 2818487 - DNA, 16 bp, Homo sapiens
ggaaataaaacctttc

SEQ ID NO: 2818488 - DNA, 15 bp, Homo sapiens
ggaaatcaaatccca

SEQ ID NO: 2818489 - DNA, 16 bp, Homo sapiens
ggaaatgacagcgggg

SEQ ID NO: 2818490 - DNA, 20 bp, Homo sapiens
ggaaattaaaccctgcccca

SEQ ID NO: 2818491 - DNA, 20 bp, Homo sapiens
ggaacagacaacagaagtca

SEQ ID NO: 2818492 - DNA, 15 bp, Homo sapiens
ggaacagacaggaga

SEQ ID NO: 2818493 - DNA, 16 bp, Homo sapiens
ggaacagacaggagaa

SEQ ID NO: 2818494 - DNA, 23 bp, Homo sapiens
ggaacagtgtttcccataatttt

SEQ ID NO: 2818495 - DNA, 14 bp, Homo sapiens
ggaaccatgaagct

SEQ ID NO: 2818496 - DNA, 17 bp, Homo sapiens
ggaaccgtgtccagcac

SEQ ID NO: 2818497 - DNA, 20 bp, Homo sapiens
ggaaccgtgtccagcacaga

SEQ ID NO: 2818498 - DNA, 22 bp, Homo sapiens
ggaactcccagcaacacaagct

SEQ ID NO: 2818499 - DNA, 15 bp, Homo sapiens
ggaactcctggaaat

SEQ ID NO: 2818500 - DNA, 19 bp, Homo sapiens
ggaactctggcttccaggt

SEQ ID NO: 2818501 - DNA, 12 bp, Homo sapiens
ggaactgaaggg

SEQ ID NO: 2818502 - DNA, 22 bp, Homo sapiens
ggaactgcagtatggccatggg

SEQ ID NO: 2818503 - DNA, 15 bp, Homo sapiens
ggaactggagggtga

SEQ ID NO: 2818504 - DNA, 16 bp, Homo sapiens
ggaactggccaagctg

SEQ ID NO: 2818505 - DNA, 17 bp, Homo sapiens
ggaactggccaagctga

SEQ ID NO: 2818506 - DNA, 18 bp, Homo sapiens
ggaacttgaactgattca

SEQ ID NO: 2818507 - DNA, 21 bp, Homo sapiens
ggaagaaacaggggatcaaag

SEQ ID NO: 2818508 - DNA, 16 bp, Homo sapiens
ggaagaaattcctgta

SEQ ID NO: 2818509 - DNA, 18 bp, Homo sapiens
ggactccccaggccaggc

SEQ ID NO: 2818510 - DNA, 19 bp, Homo sapiens
ggactccccaggccaggcc

SEQ ID NO: 2818511 - DNA, 12 bp, Homo sapiens
ggactcctccca

SEQ ID NO: 2818512 - DNA, 12 bp, Homo sapiens
ggactcctctgt

SEQ ID NO: 2818513 - DNA, 13 bp, Homo sapiens
ggactctgaggct

SEQ ID NO: 2818514 - DNA, 21 bp, Homo sapiens
ggactctgaggctctttctgg

SEQ ID NO: 2818515 - DNA, 13 bp, Homo sapiens
ggactctgcacat

SEQ ID NO: 2818516 - DNA, 21 bp, Homo sapiens
ggactctgcacatgtcttgta

SEQ ID NO: 2818517 - DNA, 15 bp, Homo sapiens
ggactggaaccaggg

SEQ ID NO: 2818518 - DNA, 19 bp, Homo sapiens
ggacttaacggctccagga

SEQ ID NO: 2818519 - DNA, 16 bp, Homo sapiens
ggacttgagcctccat

SEQ ID NO: 2818520 - DNA, 20 bp, Homo sapiens
ggactttcctaaatgtttaa

SEQ ID NO: 2818521 - DNA, 14 bp, Homo sapiens
ggagaaacagagac

SEQ ID NO: 2818522 - DNA, 23 bp, Homo sapiens
ggagaaatgcatccattcctcag

SEQ ID NO: 2818523 - DNA, 15 bp, Homo sapiens
ggagaacctcaggct

SEQ ID NO: 2818524 - DNA, 17 bp, Homo sapiens
ggagaactttccatctg

SEQ ID NO: 2818525 - DNA, 15 bp, Homo sapiens
ggagaagcagtgagc

SEQ ID NO: 2818526 - DNA, 19 bp, Homo sapiens
ggagaagcagtgagccgca

SEQ ID NO: 2818527 - DNA, 21 bp, Homo sapiens
ggagaagggatggaggtcaca

SEQ ID NO: 2818528 - DNA, 16 bp, Homo sapiens
ggagaagttgccaaga

SEQ ID NO: 2818529 - DNA, 17 bp, Homo sapiens
ggagaccaaggcgggag

SEQ ID NO: 2818530 - DNA, 16 bp, Homo sapiens
ggagactcacctctgc

SEQ ID NO: 2818531 - DNA, 19 bp, Homo sapiens
ggagactcacctctgcctc

SEQ ID NO: 2818532 - DNA, 20 bp, Homo sapiens
ggagagatcatagctcactg

SEQ ID NO: 2818533 - DNA, 11 bp, Homo sapiens
ggagagccagc

SEQ ID NO: 2818534 - DNA, 14 bp, Homo sapiens
ggagagccagctct

SEQ ID NO: 2818535 - DNA, 11 bp, Homo sapiens
ggagagcccag

SEQ ID NO: 2818536 - DNA, 17 bp, Homo sapiens
gtaagctgctctattgt

SEQ ID NO: 2818537 - DNA, 23 bp, Homo sapiens
gtaagttgaatggcctgccttga

SEQ ID NO: 2818538 - DNA, 14 bp, Homo sapiens
gtaatcccagcact

SEQ ID NO: 2818539 - DNA, 17 bp, Homo sapiens
gtaatcccagctactca

SEQ ID NO: 2818540 - DNA, 18 bp, Homo sapiens
gtaatcccagctactcag

SEQ ID NO: 2818541 - DNA, 18 bp, Homo sapiens
gtaatcctgtatattatg

SEQ ID NO: 2818542 - DNA, 18 bp, Homo sapiens
gtaatcgttatgtgtgta

SEQ ID NO: 2818543 - DNA, 13 bp, Homo sapiens
gtaatgcacaatt

SEQ ID NO: 2818544 - DNA, 21 bp, Homo sapiens
gtaatgcacaatttagaaaac

SEQ ID NO: 2818545 - DNA, 18 bp, Homo sapiens
gtaatgggccaattaaaa

SEQ ID NO: 2818546 - DNA, 22 bp, Homo sapiens
gtaatgggccaattaaaatata

SEQ ID NO: 2818547 - DNA, 12 bp, Homo sapiens
gtaatgtatctt

SEQ ID NO: 2818548 - DNA, 20 bp, Homo sapiens
gtaattatcgggaacagtgt

SEQ ID NO: 2818549 - DNA, 14 bp, Homo sapiens
gtaattctaaatga

SEQ ID NO: 2818550 - DNA, 21 bp, Homo sapiens
gtaattgttgctaatcttctt

SEQ ID NO: 2818551 - DNA, 18 bp, Homo sapiens
gtaatttagaaatcattt

SEQ ID NO: 2818552 - DNA, 21 bp, Homo sapiens
gtaatttctgtgtattttgag

SEQ ID NO: 2818553 - DNA, 14 bp, Homo sapiens
gtacaaaataaaca

SEQ ID NO: 2818554 - DNA, 21 bp, Homo sapiens
gtacaagaagcattttgtaag

SEQ ID NO: 2818555 - DNA, 14 bp, Homo sapiens
gtacaatatttaaa

SEQ ID NO: 2818556 - DNA, 18 bp, Homo sapiens
gtacaatatttaaaattt

SEQ ID NO: 2818557 - DNA, 16 bp, Homo sapiens
gtacacagcaccagaa

SEQ ID NO: 2818558 - DNA, 17 bp, Homo sapiens
gtacacgtgtcctgtag

SEQ ID NO: 2818559 - DNA, 17 bp, Homo sapiens
gtacatagttatttatt

SEQ ID NO: 2818560 - DNA, 20 bp, Homo sapiens
gtacatgtgtagcctgtgca

SEQ ID NO: 2818561 - DNA, 14 bp, Homo sapiens
gtaccaatcatttt

SEQ ID NO: 2818562 - DNA, 17 bp, Homo sapiens
gtaccagctcactccct

SEQ ID NO: 2818563 - DNA, 11 bp, Homo sapiens
gtaccatcaat

SEQ ID NO: 2818564 - DNA, 16 bp, Homo sapiens
gtaccatcaataaagt

SEQ ID NO: 2818565 - DNA, 17 bp, Homo sapiens
gtaccatcaataaagta

SEQ ID NO: 2818566 - DNA, 14 bp, Homo sapiens
gtacccactgctct

SEQ ID NO: 2818567 - DNA, 18 bp, Homo sapiens
gtaccgcgtctaccctgg

SEQ ID NO: 2818568 - DNA, 14 bp, Homo sapiens
gtacctatggctgc

SEQ ID NO: 2818569 - DNA, 16 bp, Homo sapiens
gtacctatggctgcct

SEQ ID NO: 2818570 - DNA, 23 bp, Homo sapiens
gtacctatggctgcctgcatcta

SEQ ID NO: 2818571 - DNA, 11 bp, Homo sapiens
gtacctcagtt

SEQ ID NO: 2818572 - DNA, 15 bp, Homo sapiens
gtacctcagtttctc

SEQ ID NO: 2818573 - DNA, 14 bp, Homo sapiens
gtacgaacccctcc

SEQ ID NO: 2818574 - DNA, 15 bp, Homo sapiens
gtactacaatttaaa

SEQ ID NO: 2818575 - DNA, 13 bp, Homo sapiens
gtactactgctgc

SEQ ID NO: 2818576 - DNA, 19 bp, Homo sapiens
gtactatggctgtattttt

SEQ ID NO: 2818577 - DNA, 13 bp, Homo sapiens
gtactatgttaat

SEQ ID NO: 2818578 - DNA, 23 bp, Homo sapiens
gtactcaggaggctgaggggagg

SEQ ID NO: 2818579 - DNA, 21 bp, Homo sapiens
gtactcctgcaaaattttata

SEQ ID NO: 2818580 - DNA, 17 bp, Homo sapiens
gtacttaaatgaaagca

SEQ ID NO: 2818581 - DNA, 19 bp, Homo sapiens
gtacttaaatgaaagcatg

SEQ ID NO: 2818582 - DNA, 14 bp, Homo sapiens
gtacttaactgtgt

SEQ ID NO: 2818583 - DNA, 15 bp, Homo sapiens
gtacttaataaattc

SEQ ID NO: 2818584 - DNA, 14 bp, Homo sapiens
gtacttcagtcttg

SEQ ID NO: 2818585 - DNA, 15 bp, Homo sapiens
gtacttctccaccct

SEQ ID NO: 2818586 - DNA, 17 bp, Homo sapiens
gtacttctccaccctgc

SEQ ID NO: 2818587 - DNA, 18 bp, Homo sapiens
gtacttctccaccctgct

SEQ ID NO: 2818588 - DNA, 21 bp, Homo sapiens
gtagaaagacagagctgggat

SEQ ID NO: 2818589 - DNA, 18 bp, Homo sapiens
gtagaaattgttcctgat

SEQ ID NO: 2818590 - DNA, 14 bp, Homo sapiens
gtagaacctcacct

SEQ ID NO: 2818591 - DNA, 19 bp, Homo sapiens
gtagaacgtaaccacggaa

SEQ ID NO: 2818592 - DNA, 16 bp, Homo sapiens
gtagaatgtaaagctt

SEQ ID NO: 2818593 - DNA, 19 bp, Homo sapiens
gtagacacgctcttctatt

SEQ ID NO: 2818594 - DNA, 13 bp, Homo sapiens
gtagagacagggt

SEQ ID NO: 2818595 - DNA, 23 bp, Homo sapiens
gtagatggaaatcagttgtgttt

SEQ ID NO: 2818596 - DNA, 14 bp, Homo sapiens
gtagattgcgtgga

SEQ ID NO: 2818597 - DNA, 21 bp, Homo sapiens
gtagattgtgtaaattcctgt

SEQ ID NO: 2818598 - DNA, 17 bp, Homo sapiens
gtagcaattctacccag

SEQ ID NO: 2818599 - DNA, 23 bp, Homo sapiens
gtagcacaagttatttaaatctg

SEQ ID NO: 2818600 - DNA, 18 bp, Homo sapiens
gtagcagagtcattgtta

SEQ ID NO: 2818601 - DNA, 22 bp, Homo sapiens
gtagcaggatgaggaacctcaa

SEQ ID NO: 2818602 - DNA, 16 bp, Homo sapiens
gtagcatcttctggag

SEQ ID NO: 2818603 - DNA, 12 bp, Homo sapiens
gtagcatgagag

SEQ ID NO: 2818604 - DNA, 15 bp, Homo sapiens
gtagcattacagtgg

SEQ ID NO: 2818605 - DNA, 19 bp, Homo sapiens
gtagccaaggtgggctgag

SEQ ID NO: 2818606 - DNA, 21 bp, Homo sapiens
gtagccagccggggcgagtgg

SEQ ID NO: 2818607 - DNA, 13 bp, Homo sapiens
gtagcccagcact

SEQ ID NO: 2818608 - DNA, 23 bp, Homo sapiens
gtagccttgcccggattctggga

SEQ ID NO: 2818609 - DNA, 23 bp, Homo sapiens
gtagccttgccttttaaaagaaa

SEQ ID NO: 2818610 - DNA, 12 bp, Homo sapiens
gtagctgagctc

SEQ ID NO: 2818611 - DNA, 12 bp, Homo sapiens
gtagctgggact

SEQ ID NO: 2818612 - DNA, 21 bp, Homo sapiens
gtagctgggactacaggcacc

SEQ ID NO: 2818613 - DNA, 15 bp, Homo sapiens
gtagctgtgacctgc

SEQ ID NO: 2818614 - DNA, 16 bp, Homo sapiens
gtagcttaaataaatt

SEQ ID NO: 2818615 - DNA, 19 bp, Homo sapiens
gtaggaaaaataaaaacag

SEQ ID NO: 2818616 - DNA, 13 bp, Homo sapiens
gtaggaaatgtgg

SEQ ID NO: 2818617 - DNA, 15 bp, Homo sapiens
gtaggaccaatgttg

SEQ ID NO: 2818618 - DNA, 13 bp, Homo sapiens
gtaggcagagcct

SEQ ID NO: 2818619 - DNA, 22 bp, Homo sapiens
gtaggcatgagggatcacaggg

SEQ ID NO: 2818620 - DNA, 23 bp, Homo sapiens
gtaggcatgagggatcacagggc

SEQ ID NO: 2818621 - DNA, 16 bp, Homo sapiens
gtaggtgttgaaaatg

SEQ ID NO: 2818622 - DNA, 21 bp, Homo sapiens
gtagtactcctgcaaaatttt

SEQ ID NO: 2818623 - DNA, 22 bp, Homo sapiens
gtagtactcctgcaaaatttta

SEQ ID NO: 2818624 - DNA, 14 bp, Homo sapiens
gtagtagtgtcttc

SEQ ID NO: 2818625 - DNA, 17 bp, Homo sapiens
gtagtagttgatgacca

SEQ ID NO: 2818626 - DNA, 19 bp, Homo sapiens
gtagtagttgatgaccaat

SEQ ID NO: 2818627 - DNA, 21 bp, Homo sapiens
gggcgggagtgggggctgtgc

SEQ ID NO: 2818628 - DNA, 20 bp, Homo sapiens
gggcgggggagccaacagca

SEQ ID NO: 2818629 - DNA, 21 bp, Homo sapiens
gggcggtgagaggggaacaga

SEQ ID NO: 2818630 - DNA, 16 bp, Homo sapiens
gggcgtgactcaccca

SEQ ID NO: 2818631 - DNA, 11 bp, Homo sapiens
gggctcagcct

SEQ ID NO: 2818632 - DNA, 17 bp, Homo sapiens
gggctcagcggggacag

SEQ ID NO: 2818633 - DNA, 11 bp, Homo sapiens
gggctcctgga

SEQ ID NO: 2818634 - DNA, 17 bp, Homo sapiens
gggctctaacgcctgag

SEQ ID NO: 2818635 - DNA, 17 bp, Homo sapiens
gggctgagccctggcag

SEQ ID NO: 2818636 - DNA, 15 bp, Homo sapiens
gggctgctcctccag

SEQ ID NO: 2818637 - DNA, 20 bp, Homo sapiens
gggctggactctggcaccca

SEQ ID NO: 2818638 - DNA, 19 bp, Homo sapiens
gggctggcggctactcagc

SEQ ID NO: 2818639 - DNA, 18 bp, Homo sapiens
gggcttatggccagggga

SEQ ID NO: 2818640 - DNA, 17 bp, Homo sapiens
gggcttcagtggcagct

SEQ ID NO: 2818641 - DNA, 20 bp, Homo sapiens
gggcttcagtggcagctgct

SEQ ID NO: 2818642 - DNA, 16 bp, Homo sapiens
gggcttgggccctgca

SEQ ID NO: 2818643 - DNA, 14 bp, Homo sapiens
ggggaagctggcag

SEQ ID NO: 2818644 - DNA, 15 bp, Homo sapiens
ggggaattcatctct

SEQ ID NO: 2818645 - DNA, 19 bp, Homo sapiens
ggggacatttccctcctgg

SEQ ID NO: 2818646 - DNA, 12 bp, Homo sapiens
ggggagacctgg

SEQ ID NO: 2818647 - DNA, 17 bp, Homo sapiens
ggggagccaacagcagc

SEQ ID NO: 2818648 - DNA, 23 bp, Homo sapiens
ggtagcaattctacccagagcct

SEQ ID NO: 2818649 - DNA, 15 bp, Homo sapiens
ggtagcccagcactg

SEQ ID NO: 2818650 - DNA, 13 bp, Homo sapiens
ggtaggaaagcac

SEQ ID NO: 2818651 - DNA, 22 bp, Homo sapiens
ggtaggaaagcaccgcagcatg

SEQ ID NO: 2818652 - DNA, 22 bp, Homo sapiens
ggtatatcattataactgaagg

SEQ ID NO: 2818653 - DNA, 19 bp, Homo sapiens
ggtatcaggtgctgccatc

SEQ ID NO: 2818654 - DNA, 12 bp, Homo sapiens
ggtatctccagg

SEQ ID NO: 2818655 - DNA, 14 bp, Homo sapiens
ggtatctccaggat

SEQ ID NO: 2818656 - DNA, 22 bp, Homo sapiens
ggtatgaacttgaggacacatg

SEQ ID NO: 2818657 - DNA, 23 bp, Homo sapiens
ggtatgaacttgaggacacatgt

SEQ ID NO: 2818658 - DNA, 22 bp, Homo sapiens
ggtatgatcacggctcactgca

SEQ ID NO: 2818659 - DNA, 11 bp, Homo sapiens
ggtattaaact

SEQ ID NO: 2818660 - DNA, 18 bp, Homo sapiens
ggtcacaggactctgcct

SEQ ID NO: 2818661 - DNA, 21 bp, Homo sapiens
ggtcactcttcctgcaaggac

SEQ ID NO: 2818662 - DNA, 13 bp, Homo sapiens
ggtcactgctaca

SEQ ID NO: 2818663 - DNA, 11 bp, Homo sapiens
ggtcagagcct

SEQ ID NO: 2818664 - DNA, 15 bp, Homo sapiens
ggtcagccagggcca

SEQ ID NO: 2818665 - DNA, 18 bp, Homo sapiens
ggtcagccagggccaggg

SEQ ID NO: 2818666 - DNA, 21 bp, Homo sapiens
ggtcagcccattggctcccat

SEQ ID NO: 2818667 - DNA, 21 bp, Homo sapiens
ggtcaggagttcctaaccagc

SEQ ID NO: 2818668 - DNA, 21 bp, Homo sapiens
ggtcaggcggggtgctgtggt

SEQ ID NO: 2818669 - DNA, 17 bp, Homo sapiens
ggtcatcgattcaaact

SEQ ID NO: 2818670 - DNA, 15 bp, Homo sapiens
ggtccacccaggagc

SEQ ID NO: 2818671 - DNA, 20 bp, Homo sapiens
ggtccacccaggagccccga

SEQ ID NO: 2818672 - DNA, 12 bp, Homo sapiens
ggtccagctctt

SEQ ID NO: 2818673 - DNA, 19 bp, Homo sapiens
ggtccagctcttggcccct

SEQ ID NO: 2818674 - DNA, 13 bp, Homo sapiens
ggtcccacactgg

SEQ ID NO: 2818675 - DNA, 22 bp, Homo sapiens
ggtcccacatccctgggcctgc

SEQ ID NO: 2818676 - DNA, 18 bp, Homo sapiens
ggtccccagctccccagg

SEQ ID NO: 2818677 - DNA, 20 bp, Homo sapiens
ggtccccagctccccaggac

SEQ ID NO: 2818678 - DNA, 18 bp, Homo sapiens
ggtccgccacgaggagct

SEQ ID NO: 2818679 - DNA, 14 bp, Homo sapiens
ggtcctcagagaat

SEQ ID NO: 2818680 - DNA, 21 bp, Homo sapiens
ggtcctcagagaatttctacc

SEQ ID NO: 2818681 - DNA, 13 bp, Homo sapiens
ggtcctgagacct

SEQ ID NO: 2818682 - DNA, 16 bp, Homo sapiens
ggtcctgagcactgcc

SEQ ID NO: 2818683 - DNA, 15 bp, Homo sapiens
ggtcctggccccagc

SEQ ID NO: 2818684 - DNA, 12 bp, Homo sapiens
ggtcctggggct

SEQ ID NO: 2818685 - DNA, 15 bp, Homo sapiens
ggtcctggggctctg

SEQ ID NO: 2818686 - DNA, 23 bp, Homo sapiens
ggtcctggggctctgtgcaggga

SEQ ID NO: 2818687 - DNA, 17 bp, Homo sapiens
ggtcctggtggggcagc

SEQ ID NO: 2818688 - DNA, 20 bp, Homo sapiens
ggtcctgttaacgtcatctc

SEQ ID NO: 2818689 - DNA, 22 bp, Homo sapiens
ggtcctgttaacgtcatctcag

SEQ ID NO: 2818690 - DNA, 15 bp, Homo sapiens
ggtccttccaggccc

SEQ ID NO: 2818691 - DNA, 16 bp, Homo sapiens
ggtcgccacacccggc

SEQ ID NO: 2818692 - DNA, 17 bp, Homo sapiens
ggtcgccacacccggct

SEQ ID NO: 2818693 - DNA, 21 bp, Homo sapiens
ggtcgccacacccggctcccc

SEQ ID NO: 2818694 - DNA, 14 bp, Homo sapiens
ggtcgtggagagct

SEQ ID NO: 2818695 - DNA, 16 bp, Homo sapiens
ggtctcagcttcattt

SEQ ID NO: 2818696 - DNA, 16 bp, Homo sapiens
ggtctccctccagctg

SEQ ID NO: 2818697 - DNA, 14 bp, Homo sapiens
ggtctccctctcct

SEQ ID NO: 2818698 - DNA, 15 bp, Homo sapiens
ggtctccctctcctg

SEQ ID NO: 2818699 - DNA, 17 bp, Homo sapiens
ggtctccctctcctgcc

SEQ ID NO: 2818700 - DNA, 18 bp, Homo sapiens
ggtctccctctcctgcct

SEQ ID NO: 2818701 - DNA, 15 bp, Homo sapiens
ggtctctccactgct

SEQ ID NO: 2818702 - DNA, 16 bp, Homo sapiens
ggtctctccactgctc

SEQ ID NO: 2818703 - DNA, 14 bp, Homo sapiens
ggtctgacccactg

SEQ ID NO: 2818704 - DNA, 18 bp, Homo sapiens
ggtctgagcaccccctca

SEQ ID NO: 2818705 - DNA, 12 bp, Homo sapiens
ggtctgccctgg

SEQ ID NO: 2818706 - DNA, 15 bp, Homo sapiens
ggtctggctgagctg

SEQ ID NO: 2818707 - DNA, 15 bp, Homo sapiens
ggtctggctgtccct

SEQ ID NO: 2818708 - DNA, 22 bp, Homo sapiens
ggtcttgaactcctggcctcaa

SEQ ID NO: 2818709 - DNA, 19 bp, Homo sapiens
ggtctttcctatcatggag

SEQ ID NO: 2818710 - DNA, 11 bp, Homo sapiens
ggtctttgaat

SEQ ID NO: 2818711 - DNA, 12 bp, Homo sapiens
ggtctttgaata

SEQ ID NO: 2818712 - DNA, 14 bp, Homo sapiens
ggtctttgaataaa

SEQ ID NO: 2818713 - DNA, 17 bp, Homo sapiens
ggtctttgaataaagtc

SEQ ID NO: 2818714 - DNA, 20 bp, Homo sapiens
ggtctttgaataaagtctga

SEQ ID NO: 2818715 - DNA, 21 bp, Homo sapiens
ggtgacagagtgagactctgt

SEQ ID NO: 2818716 - DNA, 16 bp, Homo sapiens
ggtgaccccagggcac

SEQ ID NO: 2818717 - DNA, 18 bp, Homo sapiens
gtccctgactctctgtga

SEQ ID NO: 2818718 - DNA, 19 bp, Homo sapiens
gtccctgcacttgcagact

SEQ ID NO: 2818719 - DNA, 21 bp, Homo sapiens
gtccctgcacttgcagactct

SEQ ID NO: 2818720 - DNA, 15 bp, Homo sapiens
gtccctgccagtgtt

SEQ ID NO: 2818721 - DNA, 21 bp, Homo sapiens
gtccctgggggaagccctgga

SEQ ID NO: 2818722 - DNA, 22 bp, Homo sapiens
gtccctgggggaagccctggat

SEQ ID NO: 2818723 - DNA, 19 bp, Homo sapiens
gtcccttgagacctcagcc

SEQ ID NO: 2818724 - DNA, 22 bp, Homo sapiens
gtccgaaagggacttggaagct

SEQ ID NO: 2818725 - DNA, 17 bp, Homo sapiens
gtccggtgtccttttca

SEQ ID NO: 2818726 - DNA, 24 bp, Homo sapiens
gtccggtgtccttttcactacacc

SEQ ID NO: 2818727 - DNA, 15 bp, Homo sapiens
gtcctacccaccctc

SEQ ID NO: 2818728 - DNA, 13 bp, Homo sapiens
gtcctactctgtg

SEQ ID NO: 2818729 - DNA, 19 bp, Homo sapiens
gtcctatccaaaggaatca

SEQ ID NO: 2818730 - DNA, 23 bp, Homo sapiens
gtcctccaacaataaagagctca

SEQ ID NO: 2818731 - DNA, 18 bp, Homo sapiens
gtggatctccaaggacca

SEQ ID NO: 2818732 - DNA, 18 bp, Homo sapiens
gtggatctgtccaaggaa

SEQ ID NO: 2818733 - DNA, 18 bp, Homo sapiens
gtggatgcctggtggcag

SEQ ID NO: 2818734 - DNA, 13 bp, Homo sapiens
gtggattgagggt

SEQ ID NO: 2818735 - DNA, 19 bp, Homo sapiens
gtggatttcctattttaaa

SEQ ID NO: 2818736 - DNA, 13 bp, Homo sapiens
gtggcagccctgt

SEQ ID NO: 2818737 - DNA, 14 bp, Homo sapiens
gtggcagctgcggt

SEQ ID NO: 2818738 - DNA, 19 bp, Homo sapiens
gtggcagctgcttttgtct

SEQ ID NO: 2818739 - DNA, 17 bp, Homo sapiens
gtggcagtgggagctgc

SEQ ID NO: 2818740 - DNA, 21 bp, Homo sapiens
gtggcagtgggagctgcctgt

SEQ ID NO: 2818741 - DNA, 18 bp, Homo sapiens
gtggccatcagggtgggc

SEQ ID NO: 2818742 - DNA, 13 bp, Homo sapiens
gccattaccatgg

SEQ ID NO: 2818743 - DNA, 14 bp, Homo sapiens
gccatttgtactga

SEQ ID NO: 2818744 - DNA, 12 bp, Homo sapiens
gccattttaata

SEQ ID NO: 2818745 - DNA, 14 bp, Homo sapiens
gccattttaataaa

SEQ ID NO: 2818746 - DNA, 18 bp, Homo sapiens
gcccaatattataatttt

SEQ ID NO: 2818747 - DNA, 13 bp, Homo sapiens
gcccacagctccc

SEQ ID NO: 2818748 - DNA, 19 bp, Homo sapiens
gcccacagggaccaagaag

SEQ ID NO: 2818749 - DNA, 16 bp, Homo sapiens
gcccacattggaccca

SEQ ID NO: 2818750 - DNA, 19 bp, Homo sapiens
gcccacgctggagtgcagt

SEQ ID NO: 2818751 - DNA, 19 bp, Homo sapiens
gcccacgtgtgcagactgt

SEQ ID NO: 2818752 - DNA, 18 bp, Homo sapiens
gcccactatggtcatctt

SEQ ID NO: 2818753 - DNA, 17 bp, Homo sapiens
gcccagaaaacctccag

SEQ ID NO: 2818754 - DNA, 21 bp, Homo sapiens
gcccagaattcccagctgtct

SEQ ID NO: 2818755 - DNA, 16 bp, Homo sapiens
gcccagagaccccttc

SEQ ID NO: 2818756 - DNA, 15 bp, Homo sapiens
gcccagagagggtgg

SEQ ID NO: 2818757 - DNA, 21 bp, Homo sapiens
gcccagagagggtggtgacct

SEQ ID NO: 2818758 - DNA, 16 bp, Homo sapiens
gcccagagatgcctcc

SEQ ID NO: 2818759 - DNA, 13 bp, Homo sapiens
gcccagagggccc

SEQ ID NO: 2818760 - DNA, 15 bp, Homo sapiens
gcccagagggcccag

SEQ ID NO: 2818761 - DNA, 20 bp, Homo sapiens
gcccagagggcccaggcagg

SEQ ID NO: 2818762 - DNA, 21 bp, Homo sapiens
gcccagagggcccaggcaggc

SEQ ID NO: 2818763 - DNA, 22 bp, Homo sapiens
gcccagccattaccatggagac

SEQ ID NO: 2818764 - DNA, 15 bp, Homo sapiens
gcccagcccagctgg

SEQ ID NO: 2818765 - DNA, 16 bp, Homo sapiens
gcccagccctaaacat

SEQ ID NO: 2818766 - DNA, 18 bp, Homo sapiens
gcccagcctcctcccacc

SEQ ID NO: 2818767 - DNA, 19 bp, Homo sapiens
gcccagcctcctcccacca

SEQ ID NO: 2818768 - DNA, 20 bp, Homo sapiens
gcccagcctcctcccaccac

SEQ ID NO: 2818769 - DNA, 13 bp, Homo sapiens
gcccagcctctgt

SEQ ID NO: 2818770 - DNA, 15 bp, Homo sapiens
gcccagcctctgtcc

SEQ ID NO: 2818771 - DNA, 13 bp, Homo sapiens
gcccagctgcacc

SEQ ID NO: 2818772 - DNA, 14 bp, Homo sapiens
gcccagctgcacct

SEQ ID NO: 2818773 - DNA, 18 bp, Homo sapiens
gcccagctgcacctgcca

SEQ ID NO: 2818774 - DNA, 23 bp, Homo sapiens
gcccagctgcacctgccagcctg

SEQ ID NO: 2818775 - DNA, 10 bp, Homo sapiens
gcccaggaga

SEQ ID NO: 2818776 - DNA, 15 bp, Homo sapiens
gcccaggagagccag

SEQ ID NO: 2818777 - DNA, 22 bp, Homo sapiens
gcccaggagtttgaggctgcag

SEQ ID NO: 2818778 - DNA, 14 bp, Homo sapiens
gcccaggcaggtct

SEQ ID NO: 2818779 - DNA, 20 bp, Homo sapiens
gcccaggcccctgccaccct

SEQ ID NO: 2818780 - DNA, 12 bp, Homo sapiens
gcccaggctggc

SEQ ID NO: 2818781 - DNA, 14 bp, Homo sapiens
gcccaggctggcgt

SEQ ID NO: 2818782 - DNA, 19 bp, Homo sapiens
gcccaggctggcgtgcagt

SEQ ID NO: 2818783 - DNA, 20 bp, Homo sapiens
gcccaggctggcgtgcagtg

SEQ ID NO: 2818784 - DNA, 15 bp, Homo sapiens
gcccagggctcagcc

SEQ ID NO: 2818785 - DNA, 16 bp, Homo sapiens
gcccagggctcagcct

SEQ ID NO: 2818786 - DNA, 19 bp, Homo sapiens
gcccaggggcccacaggga

SEQ ID NO: 2818787 - DNA, 22 bp, Homo sapiens
gcccagtctggaatgcagtggt

SEQ ID NO: 2818788 - DNA, 22 bp, Homo sapiens
gcccatctatgtcccttgctgt

SEQ ID NO: 2818789 - DNA, 21 bp, Homo sapiens
gcccatgctcaaccactgtgg

SEQ ID NO: 2818790 - DNA, 20 bp, Homo sapiens
gcccatgggagctggttaga

SEQ ID NO: 2818791 - DNA, 17 bp, Homo sapiens
gcccatgtgttccctct

SEQ ID NO: 2818792 - DNA, 22 bp, Homo sapiens
gccctgcctggaggacctgagc

SEQ ID NO: 2818793 - DNA, 23 bp, Homo sapiens
gccctgcctggaggacctgagcc

SEQ ID NO: 2818794 - DNA, 18 bp, Homo sapiens
gccctgcggagccggcac

SEQ ID NO: 2818795 - DNA, 21 bp, Homo sapiens
gccctgctgccgcctcccagc

SEQ ID NO: 2818796 - DNA, 19 bp, Homo sapiens
gccctggcaggatgaccct

SEQ ID NO: 2818797 - DNA, 15 bp, Homo sapiens
gccctggcctgctgg

SEQ ID NO: 2818798 - DNA, 17 bp, Homo sapiens
gccctggcctgctgggc

SEQ ID NO: 2818799 - DNA, 20 bp, Homo sapiens
gccctgggccccaccaccta

SEQ ID NO: 2818800 - DNA, 19 bp, Homo sapiens
gccctggggcctgtactgc

SEQ ID NO: 2818801 - DNA, 14 bp, Homo sapiens
gccctggtggcagt

SEQ ID NO: 2818802 - DNA, 17 bp, Homo sapiens
gccctggtggcagtggg

SEQ ID NO: 2818803 - DNA, 23 bp, Homo sapiens
gccctggtggcagtgggagctgc

SEQ ID NO: 2818804 - DNA, 20 bp, Homo sapiens
gcccttaaaataatgattta

SEQ ID NO: 2818805 - DNA, 19 bp, Homo sapiens
gcccttagcagggaaacag

SEQ ID NO: 2818806 - DNA, 22 bp, Homo sapiens
gcccttccatgtcgcctctgca

SEQ ID NO: 2818807 - DNA, 16 bp, Homo sapiens
gcccttcccactggag

SEQ ID NO: 2818808 - DNA, 13 bp, Homo sapiens
gcccttccctgct

SEQ ID NO: 2818809 - DNA, 14 bp, Homo sapiens
gcccttccctgctt

SEQ ID NO: 2818810 - DNA, 12 bp, Homo sapiens
gcccttcctgga

SEQ ID NO: 2818811 - DNA, 15 bp, Homo sapiens
gcccttcctggacag

SEQ ID NO: 2818812 - DNA, 17 bp, Homo sapiens
gcccttcctggacagct

SEQ ID NO: 2818813 - DNA, 22 bp, Homo sapiens
gcccttcctggacagctgtgcc

SEQ ID NO: 2818814 - DNA, 18 bp, Homo sapiens
gcccttgagctccccaaa

SEQ ID NO: 2818815 - DNA, 22 bp, Homo sapiens
gcccttgagctccccaaaaacc

SEQ ID NO: 2818816 - DNA, 21 bp, Homo sapiens
gcccttgccctgacctcccag

SEQ ID NO: 2818817 - DNA, 21 bp, Homo sapiens
gcccttgtttggggcaggagt

SEQ ID NO: 2818818 - DNA, 23 bp, Homo sapiens
gcccttgtttggggcaggagtag

SEQ ID NO: 2818819 - DNA, 14 bp, Homo sapiens
gccgaagctaacag

SEQ ID NO: 2818820 - DNA, 15 bp, Homo sapiens
gccgaagctaacagg

SEQ ID NO: 2818821 - DNA, 15 bp, Homo sapiens
gccgacctcagcctt

SEQ ID NO: 2818822 - DNA, 13 bp, Homo sapiens
gccgacctcgtcc

SEQ ID NO: 2818823 - DNA, 19 bp, Homo sapiens
gccgacctcgtcctccccc

SEQ ID NO: 2818824 - DNA, 11 bp, Homo sapiens
gccgactcagg

SEQ ID NO: 2818825 - DNA, 16 bp, Homo sapiens
gccgagagcctgctcc

SEQ ID NO: 2818826 - DNA, 20 bp, Homo sapiens
gccgagatcacgccactgca

SEQ ID NO: 2818827 - DNA, 19 bp, Homo sapiens
gccgagcaaccgtggccct

SEQ ID NO: 2818828 - DNA, 20 bp, Homo sapiens
gccgagccgggcctggggct

SEQ ID NO: 2818829 - DNA, 17 bp, Homo sapiens
gccgcagcctccctctg

SEQ ID NO: 2818830 - DNA, 15 bp, Homo sapiens
gccgcatcttctcca

SEQ ID NO: 2818831 - DNA, 20 bp, Homo sapiens
gccgcatcttctccatctgg

SEQ ID NO: 2818832 - DNA, 15 bp, Homo sapiens
gccgcattccctgag

SEQ ID NO: 2818833 - DNA, 19 bp, Homo sapiens
gcaggaatcaaaaattgaa

SEQ ID NO: 2818834 - DNA, 12 bp, Homo sapiens
gcaggaccagga

SEQ ID NO: 2818835 - DNA, 22 bp, Homo sapiens
gcaggagaatcacttgcactcc

SEQ ID NO: 2818836 - DNA, 18 bp, Homo sapiens
gcaggaggctagcaaagc

SEQ ID NO: 2818837 - DNA, 18 bp, Homo sapiens
gcaggagtagctgagctc

SEQ ID NO: 2818838 - DNA, 12 bp, Homo sapiens
gcaggcagggct

SEQ ID NO: 2818839 - DNA, 14 bp, Homo sapiens
gcaggcagggctct

SEQ ID NO: 2818840 - DNA, 15 bp, Homo sapiens
gcaggcagggctctc

SEQ ID NO: 2818841 - DNA, 16 bp, Homo sapiens
gcaggcagggctctcc

SEQ ID NO: 2818842 - DNA, 19 bp, Homo sapiens
gcaggcagggctctcctgg

SEQ ID NO: 2818843 - DNA, 20 bp, Homo sapiens
gcaggcagggctctcctggc

SEQ ID NO: 2818844 - DNA, 24 bp, Homo sapiens
gcaggccaagagcagaggcagcga

SEQ ID NO: 2818845 - DNA, 20 bp, Homo sapiens
gcaggccaagtcaggccctt

SEQ ID NO: 2818846 - DNA, 20 bp, Homo sapiens
gcaggccaggttatgcctca

SEQ ID NO: 2818847 - DNA, 17 bp, Homo sapiens
gcaggctgatttctagg

SEQ ID NO: 2818848 - DNA, 13 bp, Homo sapiens
gcagggaaacagc

SEQ ID NO: 2818849 - DNA, 22 bp, Homo sapiens
gcagggagccgagatcacgcca

SEQ ID NO: 2818850 - DNA, 14 bp, Homo sapiens
gcagggaggggact

SEQ ID NO: 2818851 - DNA, 22 bp, Homo sapiens
gcagggccggggaactggccaa

SEQ ID NO: 2818852 - DNA, 18 bp, Homo sapiens
gcagggccttgcccagag

SEQ ID NO: 2818853 - DNA, 19 bp, Homo sapiens
gcagggccttgcccagaga

SEQ ID NO: 2818854 - DNA, 12 bp, Homo sapiens
gcagggctcagc

SEQ ID NO: 2818855 - DNA, 16 bp, Homo sapiens
gcagggctctcctggc

SEQ ID NO: 2818856 - DNA, 17 bp, Homo sapiens
gcaggggtgggagagcc

SEQ ID NO: 2818857 - DNA, 18 bp, Homo sapiens
gcaggggtgggagagcca

SEQ ID NO: 2818858 - DNA, 19 bp, Homo sapiens
gcaggggtgggagagccag

SEQ ID NO: 2818859 - DNA, 16 bp, Homo sapiens
gcagggtctcactctg

SEQ ID NO: 2818860 - DNA, 20 bp, Homo sapiens
gcaggtaagagctgatgtga

SEQ ID NO: 2818861 - DNA, 14 bp, Homo sapiens
gcaggtaccactga

SEQ ID NO: 2818862 - DNA, 17 bp, Homo sapiens
gcaggtctcctctggga

SEQ ID NO: 2818863 - DNA, 20 bp, Homo sapiens
gcaggtcttgaactcctggc

SEQ ID NO: 2818864 - DNA, 16 bp, Homo sapiens
gcaggttgaggggctc

SEQ ID NO: 2818865 - DNA, 20 bp, Homo sapiens
gcaggttgaggggctcctgg

SEQ ID NO: 2818866 - DNA, 21 bp, Homo sapiens
gcaggttgaggggctcctgga

SEQ ID NO: 2818867 - DNA, 13 bp, Homo sapiens
gcagtagccagca

SEQ ID NO: 2818868 - DNA, 13 bp, Homo sapiens
gcagtatgaatga

SEQ ID NO: 2818869 - DNA, 17 bp, Homo sapiens
gcagtatgaatgatgtt

SEQ ID NO: 2818870 - DNA, 18 bp, Homo sapiens
gcagtctcgggtggctag

SEQ ID NO: 2818871 - DNA, 18 bp, Homo sapiens
gcagtgagtctcttcaga

SEQ ID NO: 2818872 - DNA, 15 bp, Homo sapiens
gcagtgccttccata

SEQ ID NO: 2818873 - DNA, 16 bp, Homo sapiens
gcagtgccttccataa

SEQ ID NO: 2818874 - DNA, 15 bp, Homo sapiens
gcagtggacaccagg

SEQ ID NO: 2818875 - DNA, 11 bp, Homo sapiens
gcagtgggagc

SEQ ID NO: 2818876 - DNA, 17 bp, Homo sapiens
gcagtgggagctgcctg

SEQ ID NO: 2818877 - DNA, 14 bp, Homo sapiens
gcagtgtcttccat

SEQ ID NO: 2818878 - DNA, 16 bp, Homo sapiens
gcagtgtcttccataa

SEQ ID NO: 2818879 - DNA, 20 bp, Homo sapiens
gcagtgtcttccataatgta

SEQ ID NO: 2818880 - DNA, 16 bp, Homo sapiens
gcagttcgcagccacc

SEQ ID NO: 2818881 - DNA, 23 bp, Homo sapiens
gcagttcgcagccaccctgagga

SEQ ID NO: 2818882 - DNA, 14 bp, Homo sapiens
gcagtttgggaggt

SEQ ID NO: 2818883 - DNA, 11 bp, Homo sapiens
gcagttttttt

SEQ ID NO: 2818884 - DNA, 13 bp, Homo sapiens
gcataagattaaa

SEQ ID NO: 2818885 - DNA, 19 bp, Homo sapiens
gcataagattaaaggaagg

SEQ ID NO: 2818886 - DNA, 23 bp, Homo sapiens
gcataattcggaagggaaaacag

SEQ ID NO: 2818887 - DNA, 16 bp, Homo sapiens
gcatagcaagacacat

SEQ ID NO: 2818888 - DNA, 18 bp, Homo sapiens
gcatagttcccatgttaa

SEQ ID NO: 2818889 - DNA, 17 bp, Homo sapiens
gcatcacagggcagagc

SEQ ID NO: 2818890 - DNA, 22 bp, Homo sapiens
gcatcacagggcagagccggga

SEQ ID NO: 2818891 - DNA, 17 bp, Homo sapiens
gcatcacctcaggccag

SEQ ID NO: 2818892 - DNA, 14 bp, Homo sapiens
gcatcatgcctctg

SEQ ID NO: 2818893 - DNA, 17 bp, Homo sapiens
gcatcatgcctctgagg

SEQ ID NO: 2818894 - DNA, 14 bp, Homo sapiens
gagcctgccgagca

SEQ ID NO: 2818895 - DNA, 21 bp, Homo sapiens
gagcctgccgagcaaccgtgg

SEQ ID NO: 2818896 - DNA, 17 bp, Homo sapiens
gagcctgcctcagctgc

SEQ ID NO: 2818897 - DNA, 13 bp, Homo sapiens
gagcctgctcccc

SEQ ID NO: 2818898 - DNA, 17 bp, Homo sapiens
gagcctgctcccccacc

SEQ ID NO: 2818899 - DNA, 19 bp, Homo sapiens
gagcctgctcccccacccc

SEQ ID NO: 2818900 - DNA, 15 bp, Homo sapiens
gagcctggagaagct

SEQ ID NO: 2818901 - DNA, 23 bp, Homo sapiens
gagcctggctccgtccaggagcc

SEQ ID NO: 2818902 - DNA, 13 bp, Homo sapiens
gagcctggggctc

SEQ ID NO: 2818903 - DNA, 23 bp, Homo sapiens
gagcctggggctctaacgcctga

SEQ ID NO: 2818904 - DNA, 23 bp, Homo sapiens
gagcctgtgaacccaggacaagc

SEQ ID NO: 2818905 - DNA, 18 bp, Homo sapiens
gagccttctcctgcctac

SEQ ID NO: 2818906 - DNA, 22 bp, Homo sapiens
gagccttggtgtccacctggcc

SEQ ID NO: 2818907 - DNA, 17 bp, Homo sapiens
gagcctttggatgacca

SEQ ID NO: 2818908 - DNA, 15 bp, Homo sapiens
gagcgaaagtttctt

SEQ ID NO: 2818909 - DNA, 20 bp, Homo sapiens
gagcgcacctgccccctggt

SEQ ID NO: 2818910 - DNA, 16 bp, Homo sapiens
gagcgcatcaggcctg

SEQ ID NO: 2818911 - DNA, 15 bp, Homo sapiens
gagcggctctcctga

SEQ ID NO: 2818912 - DNA, 21 bp, Homo sapiens
gagctaaattacaattgtcat

SEQ ID NO: 2818913 - DNA, 14 bp, Homo sapiens
gagctacctgtgtg

SEQ ID NO: 2818914 - DNA, 22 bp, Homo sapiens
gagctacctgtgtggacaggac

SEQ ID NO: 2818915 - DNA, 15 bp, Homo sapiens
gagctacgtatttaa

SEQ ID NO: 2818916 - DNA, 20 bp, Homo sapiens
gagctacgtatttaatagca

SEQ ID NO: 2818917 - DNA, 23 bp, Homo sapiens
gagctagcgctgccgcaccccag

SEQ ID NO: 2818918 - DNA, 12 bp, Homo sapiens
gagctaggagca

SEQ ID NO: 2818919 - DNA, 18 bp, Homo sapiens
gagctaggagcaaagcct

SEQ ID NO: 2818920 - DNA, 16 bp, Homo sapiens
gagctcacaaggcagc

SEQ ID NO: 2818921 - DNA, 15 bp, Homo sapiens
gagctcggtggaccc

SEQ ID NO: 2818922 - DNA, 12 bp, Homo sapiens
gagctctgagag

SEQ ID NO: 2818923 - DNA, 13 bp, Homo sapiens
gagctctgagagg

SEQ ID NO: 2818924 - DNA, 16 bp, Homo sapiens
gagctctgagaggccc

SEQ ID NO: 2818925 - DNA, 21 bp, Homo sapiens
gagctctgagaggccctggat

SEQ ID NO: 2818926 - DNA, 16 bp, Homo sapiens
gagctctgcagagcag

SEQ ID NO: 2818927 - DNA, 17 bp, Homo sapiens
gagctcttcatgtttca

SEQ ID NO: 2818928 - DNA, 19 bp, Homo sapiens
gagctgaacccattttgag

SEQ ID NO: 2818929 - DNA, 17 bp, Homo sapiens
gagctgaagcccatgct

SEQ ID NO: 2818930 - DNA, 20 bp, Homo sapiens
gagctgagattgcgccactg

SEQ ID NO: 2818931 - DNA, 16 bp, Homo sapiens
gagctgcctgttcagc

SEQ ID NO: 2818932 - DNA, 24 bp, Homo sapiens
gagctgctgttccaacagacaggg

SEQ ID NO: 2818933 - DNA, 20 bp, Homo sapiens
gagctggcaaaggtggctct

SEQ ID NO: 2818934 - DNA, 14 bp, Homo sapiens
gagctgggaggaaa

SEQ ID NO: 2818935 - DNA, 17 bp, Homo sapiens
gagctgggaggaaaaga

SEQ ID NO: 2818936 - DNA, 15 bp, Homo sapiens
gagctgttggcctgg

SEQ ID NO: 2818937 - DNA, 18 bp, Homo sapiens
gagcttccagtgcatgtt

SEQ ID NO: 2818938 - DNA, 10 bp, Homo sapiens
gagcttctct

SEQ ID NO: 2818939 - DNA, 14 bp, Homo sapiens
gagcttctggcact

SEQ ID NO: 2818940 - DNA, 23 bp, Homo sapiens
gagctttctgtccttttggcact

SEQ ID NO: 2818941 - DNA, 11 bp, Homo sapiens
gaggaacagct

SEQ ID NO: 2818942 - DNA, 17 bp, Homo sapiens
gaggaacctcaaactgg

SEQ ID NO: 2818943 - DNA, 18 bp, Homo sapiens
gaggaagagagagaccct

SEQ ID NO: 2818944 - DNA, 18 bp, Homo sapiens
gaggaatatgactgtttt

SEQ ID NO: 2818945 - DNA, 15 bp, Homo sapiens
gaggacaaccattcc

SEQ ID NO: 2818946 - DNA, 11 bp, Homo sapiens
gaggacacatg

SEQ ID NO: 2818947 - DNA, 13 bp, Homo sapiens
gaggacagggagg

SEQ ID NO: 2818948 - DNA, 22 bp, Homo sapiens
gaggacagggaggtgaccccag

SEQ ID NO: 2818949 - DNA, 22 bp, Homo sapiens
gaggacctgagcctgccgagca

SEQ ID NO: 2818950 - DNA, 23 bp, Homo sapiens
gaggacttttctttgtggcttcc

SEQ ID NO: 2818951 - DNA, 9 bp, Homo sapiens
gaggagaaa

SEQ ID NO: 2818952 - DNA, 12 bp, Homo sapiens
gaggagaagaat

SEQ ID NO: 2818953 - DNA, 13 bp, Homo sapiens
gaggagaccagct

SEQ ID NO: 2818954 - DNA, 15 bp, Homo sapiens
gaggagaccagctca

SEQ ID NO: 2818955 - DNA, 19 bp, Homo sapiens
gaggagggatgctgcctga

SEQ ID NO: 2818956 - DNA, 18 bp, Homo sapiens
gaggaggtggcagccctg

SEQ ID NO: 2818957 - DNA, 21 bp, Homo sapiens
gaggagtctgaggtcctgagc

SEQ ID NO: 2818958 - DNA, 17 bp, Homo sapiens
gaggatcactggagccc

SEQ ID NO: 2818959 - DNA, 19 bp, Homo sapiens
gaggatcactggagcccag

SEQ ID NO: 2818960 - DNA, 12 bp, Homo sapiens
gaggatgttctg

SEQ ID NO: 2818961 - DNA, 19 bp, Homo sapiens
gaggattgcttgagcccag

SEQ ID NO: 2818962 - DNA, 18 bp, Homo sapiens
gaggatttaactgtgaac

SEQ ID NO: 2818963 - DNA, 17 bp, Homo sapiens
gaggcaaaggccagcag

SEQ ID NO: 2818964 - DNA, 23 bp, Homo sapiens
gaggcaatgtcaggaacagaagg

SEQ ID NO: 2818965 - DNA, 23 bp, Homo sapiens
gaggcagaagaattgaacccagg

SEQ ID NO: 2818966 - DNA, 21 bp, Homo sapiens
gaggcagacagcagctcaggc

SEQ ID NO: 2818967 - DNA, 22 bp, Homo sapiens
gaggcagacagcagctcaggca

SEQ ID NO: 2818968 - DNA, 22 bp, Homo sapiens
gaggcagacttccctgaatgta

SEQ ID NO: 2818969 - DNA, 21 bp, Homo sapiens
gaggcagccccattctgcctg

SEQ ID NO: 2818970 - DNA, 22 bp, Homo sapiens
gaggcagggccttgcccagaga

SEQ ID NO: 2818971 - DNA, 13 bp, Homo sapiens
gaggcagggtcag

SEQ ID NO: 2818972 - DNA, 15 bp, Homo sapiens
gaggcagggtctcac

SEQ ID NO: 2818973 - DNA, 19 bp, Homo sapiens
gaggcagggtctcactctg

SEQ ID NO: 2818974 - DNA, 20 bp, Homo sapiens
gaggcagggtctcactctgt

SEQ ID NO: 2818975 - DNA, 19 bp, Homo sapiens
gaggcaggtggatcacctg

SEQ ID NO: 2818976 - DNA, 14 bp, Homo sapiens
gaggccagcctggc

SEQ ID NO: 2818977 - DNA, 22 bp, Homo sapiens
gaggccagcctggcctcctgcc

SEQ ID NO: 2818978 - DNA, 20 bp, Homo sapiens
gaggccatgggcctcctgtg

SEQ ID NO: 2818979 - DNA, 12 bp, Homo sapiens
gaggccctggat

SEQ ID NO: 2818980 - DNA, 14 bp, Homo sapiens
gaggccctggatca

SEQ ID NO: 2818981 - DNA, 18 bp, Homo sapiens
gaggcctcttggacctct

SEQ ID NO: 2818982 - DNA, 19 bp, Homo sapiens
gaggcctcttggacctctg

SEQ ID NO: 2818983 - DNA, 22 bp, Homo sapiens
gaggcctcttggacctctgctc

SEQ ID NO: 2818984 - DNA, 18 bp, Homo sapiens
ccgtacattcaatgttta

SEQ ID NO: 2818985 - DNA, 21 bp, Homo sapiens
ccgtacccccgtggtctttga

SEQ ID NO: 2818986 - DNA, 22 bp, Homo sapiens
ccgtacccccgtggtctttgaa

SEQ ID NO: 2818987 - DNA, 14 bp, Homo sapiens
ccgtagttccctga

SEQ ID NO: 2818988 - DNA, 15 bp, Homo sapiens
ccgtctacagatggc

SEQ ID NO: 2818989 - DNA, 17 bp, Homo sapiens
ccgtctggggttcagcc

SEQ ID NO: 2818990 - DNA, 19 bp, Homo sapiens
ccgtctggggttcagcccc

SEQ ID NO: 2818991 - DNA, 12 bp, Homo sapiens
ccgtctgttttt

SEQ ID NO: 2818992 - DNA, 15 bp, Homo sapiens
ccgtcttcagcctag

SEQ ID NO: 2818993 - DNA, 13 bp, Homo sapiens
ccgtcttctctcc

SEQ ID NO: 2818994 - DNA, 19 bp, Homo sapiens
ccgtgaagggcaccgagaa

SEQ ID NO: 2818995 - DNA, 20 bp, Homo sapiens
ccgtgaatgcttacctgtga

SEQ ID NO: 2818996 - DNA, 17 bp, Homo sapiens
ccgtgatgctcaggctt

SEQ ID NO: 2818997 - DNA, 14 bp, Homo sapiens
ccgtgccaagtcca

SEQ ID NO: 2818998 - DNA, 20 bp, Homo sapiens
ccgtgcccaggggcccacag

SEQ ID NO: 2818999 - DNA, 15 bp, Homo sapiens
ccgtgccccgcctcc

SEQ ID NO: 2819000 - DNA, 11 bp, Homo sapiens
ccgtggaggct

SEQ ID NO: 2819001 - DNA, 22 bp, Homo sapiens
ccgtggaggctgctcggggtgc

SEQ ID NO: 2819002 - DNA, 14 bp, Homo sapiens
ccgtggcccttcct

SEQ ID NO: 2819003 - DNA, 19 bp, Homo sapiens
ccgtggcccttcctggaca

SEQ ID NO: 2819004 - DNA, 22 bp, Homo sapiens
ccgtggcccttcctggacagct

SEQ ID NO: 2819005 - DNA, 15 bp, Homo sapiens
ccgtggtctttgaat

SEQ ID NO: 2819006 - DNA, 17 bp, Homo sapiens
ccgtggtctttgaataa

SEQ ID NO: 2819007 - DNA, 18 bp, Homo sapiens
ccgtggtctttgaataaa

SEQ ID NO: 2819008 - DNA, 19 bp, Homo sapiens
ccgtggtctttgaataaag

SEQ ID NO: 2819009 - DNA, 18 bp, Homo sapiens
ccgtgtccagcacagaag

SEQ ID NO: 2819010 - DNA, 19 bp, Homo sapiens
ccgtgtccagcacagaagg

SEQ ID NO: 2819011 - DNA, 22 bp, Homo sapiens
cctaagaagctctggccccagg

SEQ ID NO: 2819012 - DNA, 21 bp, Homo sapiens
cctaagacttcagtcctggtc

SEQ ID NO: 2819013 - DNA, 15 bp, Homo sapiens
cctaaggacacacta

SEQ ID NO: 2819014 - DNA, 22 bp, Homo sapiens
cctaaggcaacatttccgaaga

SEQ ID NO: 2819015 - DNA, 16 bp, Homo sapiens
cctaagtggctgctga

SEQ ID NO: 2819016 - DNA, 18 bp, Homo sapiens
cctaagtgttgaagaaga

SEQ ID NO: 2819017 - DNA, 16 bp, Homo sapiens
cctaattcaattcaaa

SEQ ID NO: 2819018 - DNA, 13 bp, Homo sapiens
cctacagcctcag

SEQ ID NO: 2819019 - DNA, 18 bp, Homo sapiens
cctacatccccaggtctc

SEQ ID NO: 2819020 - DNA, 19 bp, Homo sapiens
cctacatccccaggtctct

SEQ ID NO: 2819021 - DNA, 16 bp, Homo sapiens
cctacattccctggcc

SEQ ID NO: 2819022 - DNA, 14 bp, Homo sapiens
cctaccaaatataa

SEQ ID NO: 2819023 - DNA, 18 bp, Homo sapiens
cctacccaccctcctttc

SEQ ID NO: 2819024 - DNA, 18 bp, Homo sapiens
cctacctcagcctagacc

SEQ ID NO: 2819025 - DNA, 16 bp, Homo sapiens
cctacctgtgcctgac

SEQ ID NO: 2819026 - DNA, 21 bp, Homo sapiens
cctacgtcaaacatgaagtgt

SEQ ID NO: 2819027 - DNA, 14 bp, Homo sapiens
cctactcacacagg

SEQ ID NO: 2819028 - DNA, 15 bp, Homo sapiens
cctacttcctgtgac

SEQ ID NO: 2819029 - DNA, 16 bp, Homo sapiens
cctacttcttttgctc

SEQ ID NO: 2819030 - DNA, 22 bp, Homo sapiens
cctacttcttttgctcttagct

SEQ ID NO: 2819031 - DNA, 16 bp, Homo sapiens
cctagaccctcctcct

SEQ ID NO: 2819032 - DNA, 16 bp, Homo sapiens
cctagccgacctcagc

SEQ ID NO: 2819033 - DNA, 17 bp, Homo sapiens
cctaggaattcccagcc

SEQ ID NO: 2819034 - DNA, 14 bp, Homo sapiens
cctaggccactcct

SEQ ID NO: 2819035 - DNA, 18 bp, Homo sapiens
cctaggccactcctccaa

SEQ ID NO: 2819036 - DNA, 14 bp, Homo sapiens
cctagggaaaagtt

SEQ ID NO: 2819037 - DNA, 11 bp, Homo sapiens
cctagggagcc

SEQ ID NO: 2819038 - DNA, 15 bp, Homo sapiens
cctaggtgacagagt

SEQ ID NO: 2819039 - DNA, 18 bp, Homo sapiens
cctaggtgacagagtgag

SEQ ID NO: 2819040 - DNA, 15 bp, Homo sapiens
cctagtggcttcctc

SEQ ID NO: 2819041 - DNA, 17 bp, Homo sapiens
cctagtggcttcctccg

SEQ ID NO: 2819042 - DNA, 18 bp, Homo sapiens
cctagtggggtctccctc

SEQ ID NO: 2819043 - DNA, 19 bp, Homo sapiens
cctagtggggtctccctct

SEQ ID NO: 2819044 - DNA, 14 bp, Homo sapiens
cctatagtcccagc

SEQ ID NO: 2819045 - DNA, 14 bp, Homo sapiens
cctatatgtagtat

SEQ ID NO: 2819046 - DNA, 16 bp, Homo sapiens
cctatcaaaacatatc

SEQ ID NO: 2819047 - DNA, 20 bp, Homo sapiens
cctatcaacctaagcaacag

SEQ ID NO: 2819048 - DNA, 12 bp, Homo sapiens
cctatccaccca

SEQ ID NO: 2819049 - DNA, 23 bp, Homo sapiens
cctatccatcctgcgagctcctt

SEQ ID NO: 2819050 - DNA, 16 bp, Homo sapiens
cctatgacttgggcac

SEQ ID NO: 2819051 - DNA, 13 bp, Homo sapiens
cctatgatcccag

SEQ ID NO: 2819052 - DNA, 14 bp, Homo sapiens
cctatgatcccagc

SEQ ID NO: 2819053 - DNA, 20 bp, Homo sapiens
cctatgcacatatggactct

SEQ ID NO: 2819054 - DNA, 11 bp, Homo sapiens
cctatggatgt

SEQ ID NO: 2819055 - DNA, 19 bp, Homo sapiens
cctatgtcctaaggacaca

SEQ ID NO: 2819056 - DNA, 15 bp, Homo sapiens
cctattctcaccagg

SEQ ID NO: 2819057 - DNA, 14 bp, Homo sapiens
cctattttaaaacc

SEQ ID NO: 2819058 - DNA, 19 bp, Homo sapiens
cctattttaaaaccatgca

SEQ ID NO: 2819059 - DNA, 16 bp, Homo sapiens
cctcaaaagcaccctt

SEQ ID NO: 2819060 - DNA, 21 bp, Homo sapiens
cctcaaataaaaagtgctttt

SEQ ID NO: 2819061 - DNA, 15 bp, Homo sapiens
cctcaacctcctggg

SEQ ID NO: 2819062 - DNA, 20 bp, Homo sapiens
cctcaagtgattctcctgcc

SEQ ID NO: 2819063 - DNA, 22 bp, Homo sapiens
cctcaatgtgaatcagacccta

SEQ ID NO: 2819064 - DNA, 14 bp, Homo sapiens
cctcaatgtgacca

SEQ ID NO: 2819065 - DNA, 19 bp, Homo sapiens
cctcaccaataacttcaga

SEQ ID NO: 2819066 - DNA, 23 bp, Homo sapiens
cctcaccaataacttcagagaag

SEQ ID NO: 2819067 - DNA, 19 bp, Homo sapiens
cctcacccccagctttgct

SEQ ID NO: 2819068 - DNA, 21 bp, Homo sapiens
cctcaccccctcccaccccca

SEQ ID NO: 2819069 - DNA, 16 bp, Homo sapiens
cctcaccccgtctggg

SEQ ID NO: 2819070 - DNA, 18 bp, Homo sapiens
cctcacctgcctgccctc

SEQ ID NO: 2819071 - DNA, 21 bp, Homo sapiens
cctcacctttgcaaagttaca

SEQ ID NO: 2819072 - DNA, 14 bp, Homo sapiens
cctcacgcccagcc

SEQ ID NO: 2819073 - DNA, 17 bp, Homo sapiens
cctcacgcccagcctcc

SEQ ID NO: 2819074 - DNA, 20 bp, Homo sapiens
cctcactatgacactgagca

SEQ ID NO: 2819075 - DNA, 18 bp, Homo sapiens
gagtagccgagagcctgc

SEQ ID NO: 2819076 - DNA, 14 bp, Homo sapiens
gagtagctgggact

SEQ ID NO: 2819077 - DNA, 19 bp, Homo sapiens
gagtagctgggactacagg

SEQ ID NO: 2819078 - DNA, 11 bp, Homo sapiens
gagtatatatg

SEQ ID NO: 2819079 - DNA, 19 bp, Homo sapiens
gagtatatatgtacagtta

SEQ ID NO: 2819080 - DNA, 20 bp, Homo sapiens
gagtcaatcccctcattcag

SEQ ID NO: 2819081 - DNA, 16 bp, Homo sapiens
gagtcaccaagcccag

SEQ ID NO: 2819082 - DNA, 20 bp, Homo sapiens
gagtcacccatgaagacagg

SEQ ID NO: 2819083 - DNA, 16 bp, Homo sapiens
gagtcatgatctccct

SEQ ID NO: 2819084 - DNA, 16 bp, Homo sapiens
gagtcccaaggaaagc

SEQ ID NO: 2819085 - DNA, 13 bp, Homo sapiens
gagtcccaccttg

SEQ ID NO: 2819086 - DNA, 19 bp, Homo sapiens
gagtccgaaagggacttgg

SEQ ID NO: 2819087 - DNA, 12 bp, Homo sapiens
gagtcctctgga

SEQ ID NO: 2819088 - DNA, 15 bp, Homo sapiens
gagtctacctcttca

SEQ ID NO: 2819089 - DNA, 17 bp, Homo sapiens
gatcatccactgtgcca

SEQ ID NO: 2819090 - DNA, 19 bp, Homo sapiens
gatcatccactgtgccatg

SEQ ID NO: 2819091 - DNA, 22 bp, Homo sapiens
gatcatcccatctaagctgcag

SEQ ID NO: 2819092 - DNA, 16 bp, Homo sapiens
gatcatgtaaatgatt

SEQ ID NO: 2819093 - DNA, 13 bp, Homo sapiens
gatcattttctta

SEQ ID NO: 2819094 - DNA, 12 bp, Homo sapiens
gatccaagctgg

SEQ ID NO: 2819095 - DNA, 16 bp, Homo sapiens
gatccacacacagagg

SEQ ID NO: 2819096 - DNA, 19 bp, Homo sapiens
gatccacccacctcagcct

SEQ ID NO: 2819097 - DNA, 21 bp, Homo sapiens
gatccacccacctcagcctcc

SEQ ID NO: 2819098 - DNA, 22 bp, Homo sapiens
gatccacccacctcagcctccc

SEQ ID NO: 2819099 - DNA, 13 bp, Homo sapiens
gatccactgtgca

SEQ ID NO: 2819100 - DNA, 14 bp, Homo sapiens
gatccactgtgcag

SEQ ID NO: 2819101 - DNA, 19 bp, Homo sapiens
gatccatgtagcaggactg

SEQ ID NO: 2819102 - DNA, 21 bp, Homo sapiens
gatccctagctgtgacctctc

SEQ ID NO: 2819103 - DNA, 20 bp, Homo sapiens
gatcctattctcaccaggaa

SEQ ID NO: 2819104 - DNA, 16 bp, Homo sapiens
gatcctcccacctcag

SEQ ID NO: 2819105 - DNA, 20 bp, Homo sapiens
gcaagtccctgactctctgt

SEQ ID NO: 2819106 - DNA, 22 bp, Homo sapiens
gcaagtccctgactctctgtga

SEQ ID NO: 2819107 - DNA, 17 bp, Homo sapiens
gcaagtctggatctggg

SEQ ID NO: 2819108 - DNA, 13 bp, Homo sapiens
gcaagtgaagaaa

SEQ ID NO: 2819109 - DNA, 15 bp, Homo sapiens
gcaagtgagagctgg

SEQ ID NO: 2819110 - DNA, 19 bp, Homo sapiens
gcaagtgagagctgggtgt

SEQ ID NO: 2819111 - DNA, 20 bp, Homo sapiens
gcaataaatgccctctctga

SEQ ID NO: 2819112 - DNA, 23 bp, Homo sapiens
gcaataattaggatctatgcaat

SEQ ID NO: 2819113 - DNA, 13 bp, Homo sapiens
gcaatccatgtta

SEQ ID NO: 2819114 - DNA, 16 bp, Homo sapiens
gcaatgaaaaattctc

SEQ ID NO: 2819115 - DNA, 12 bp, Homo sapiens
gcaatggcagcc

SEQ ID NO: 2819116 - DNA, 15 bp, Homo sapiens
gcaatggcagccttg

SEQ ID NO: 2819117 - DNA, 23 bp, Homo sapiens
gcaatgtaaatattttaaagaat

SEQ ID NO: 2819118 - DNA, 18 bp, Homo sapiens
gcaattctacagtttctt

SEQ ID NO: 2819119 - DNA, 18 bp, Homo sapiens
gcaattttgcatttgaat

SEQ ID NO: 2819120 - DNA, 21 bp, Homo sapiens
gcacaagaggaagagagagac

SEQ ID NO: 2819121 - DNA, 20 bp, Homo sapiens
gcacaagcttgtatatacat

SEQ ID NO: 2819122 - DNA, 22 bp, Homo sapiens
gcacaagcttgtatatacatat

SEQ ID NO: 2819123 - DNA, 19 bp, Homo sapiens
gcacaaggctgaccaagag

SEQ ID NO: 2819124 - DNA, 13 bp, Homo sapiens
gcacaatttagaa

SEQ ID NO: 2819125 - DNA, 14 bp, Homo sapiens
gcacaatttatatt

SEQ ID NO: 2819126 - DNA, 11 bp, Homo sapiens
gcacaatttga

SEQ ID NO: 2819127 - DNA, 20 bp, Homo sapiens
gcacacaccagagcccacct

SEQ ID NO: 2819128 - DNA, 21 bp, Homo sapiens
gcacacgcctgtaatcccagc

SEQ ID NO: 2819129 - DNA, 12 bp, Homo sapiens
gcacactgtagc

SEQ ID NO: 2819130 - DNA, 20 bp, Homo sapiens
gcacagaaggaatctgtgca

SEQ ID NO: 2819131 - DNA, 19 bp, Homo sapiens
gcacagaggcagctgtgtg

SEQ ID NO: 2819132 - DNA, 13 bp, Homo sapiens
gcacagcagcatc

SEQ ID NO: 2819133 - DNA, 21 bp, Homo sapiens
gcacagcttcatttcctgtgt

SEQ ID NO: 2819134 - DNA, 19 bp, Homo sapiens
gcacaggacacctggccgc

SEQ ID NO: 2819135 - DNA, 16 bp, Homo sapiens
gcacaggagctacctg

SEQ ID NO: 2819136 - DNA, 21 bp, Homo sapiens
gcacaggagctacctgtgtgg

SEQ ID NO: 2819137 - DNA, 23 bp, Homo sapiens
gcacaggagggggtcgtggagag

SEQ ID NO: 2819138 - DNA, 15 bp, Homo sapiens
gcacaggtgtaaata

SEQ ID NO: 2819139 - DNA, 16 bp, Homo sapiens
gcacaggtgtaaatat

SEQ ID NO: 2819140 - DNA, 18 bp, Homo sapiens
gcacatatggactctgca

SEQ ID NO: 2819141 - DNA, 20 bp, Homo sapiens
gcacatgtcttgtacatgtg

SEQ ID NO: 2819142 - DNA, 21 bp, Homo sapiens
gcacattaggaacagagtata

SEQ ID NO: 2819143 - DNA, 17 bp, Homo sapiens
gcacattggcagtgtgt

SEQ ID NO: 2819144 - DNA, 14 bp, Homo sapiens
gcaccaaaagaagt

SEQ ID NO: 2819145 - DNA, 15 bp, Homo sapiens
gcaccacaggctgcc

SEQ ID NO: 2819146 - DNA, 19 bp, Homo sapiens
gcaccaccatgccaggcta

SEQ ID NO: 2819147 - DNA, 16 bp, Homo sapiens
gcaccagcccttccct

SEQ ID NO: 2819148 - DNA, 20 bp, Homo sapiens
gcaccagcccttccctgctt

SEQ ID NO: 2819149 - DNA, 22 bp, Homo sapiens
gcaccagcccttccctgctttg

SEQ ID NO: 2819150 - DNA, 16 bp, Homo sapiens
gcaccagtgccgcctg

SEQ ID NO: 2819151 - DNA, 20 bp, Homo sapiens
gcaccagtgccgcctgtgcc

SEQ ID NO: 2819152 - DNA, 12 bp, Homo sapiens
gcacccccagcc

SEQ ID NO: 2819153 - DNA, 18 bp, Homo sapiens
gcacccccagcctgggcc

SEQ ID NO: 2819154 - DNA, 21 bp, Homo sapiens
gcacccccagcctgggcctat

SEQ ID NO: 2819155 - DNA, 24 bp, Homo sapiens
gcaccccctgcagcttgtagccag

SEQ ID NO: 2819156 - DNA, 14 bp, Homo sapiens
gcaccccctggaga

SEQ ID NO: 2819157 - DNA, 19 bp, Homo sapiens
gcacccttctttcctcttc

SEQ ID NO: 2819158 - DNA, 14 bp, Homo sapiens
gcaccgcagcatgt

SEQ ID NO: 2819159 - DNA, 17 bp, Homo sapiens
gcacctacatccccagg

SEQ ID NO: 2819160 - DNA, 20 bp, Homo sapiens
gcacctacatccccaggtct

SEQ ID NO: 2819161 - DNA, 14 bp, Homo sapiens
gcacctacttacat

SEQ ID NO: 2819162 - DNA, 17 bp, Homo sapiens
gcacctatagtcccagc

SEQ ID NO: 2819163 - DNA, 21 bp, Homo sapiens
gcacctatagtcccagctact

SEQ ID NO: 2819164 - DNA, 18 bp, Homo sapiens
gcacctccccccactgca

SEQ ID NO: 2819165 - DNA, 12 bp, Homo sapiens
gcacctcctgcc

SEQ ID NO: 2819166 - DNA, 21 bp, Homo sapiens
gcacctgccgacctcgtcctc

SEQ ID NO: 2819167 - DNA, 20 bp, Homo sapiens
gcacctgggccctggggcct

SEQ ID NO: 2819168 - DNA, 21 bp, Homo sapiens
gcacctgtaatcccagctact

SEQ ID NO: 2819169 - DNA, 22 bp, Homo sapiens
gcacctgtcccagaaaaagcat

SEQ ID NO: 2819170 - DNA, 18 bp, Homo sapiens
gcaccttgtcatgtacca

SEQ ID NO: 2819171 - DNA, 22 bp, Homo sapiens
gcaccttgtgtctgtacacgtg

SEQ ID NO: 2819172 - DNA, 18 bp, Homo sapiens
gcacctttctagttgaaa

SEQ ID NO: 2819173 - DNA, 15 bp, Homo sapiens
gcacgaaatgttatt

SEQ ID NO: 2819174 - DNA, 20 bp, Homo sapiens
ttgccagaaagcataaaatt

SEQ ID NO: 2819175 - DNA, 12 bp, Homo sapiens
ttgccagccaga

SEQ ID NO: 2819176 - DNA, 16 bp, Homo sapiens
ttgccatgaggccttt

SEQ ID NO: 2819177 - DNA, 19 bp, Homo sapiens
ttgccatgaggcctttccc

SEQ ID NO: 2819178 - DNA, 18 bp, Homo sapiens
ttgccatgttggccaggc

SEQ ID NO: 2819179 - DNA, 19 bp, Homo sapiens
ttgccatgttggccaggct

SEQ ID NO: 2819180 - DNA, 21 bp, Homo sapiens
ttgccatgttggccaggctgg

SEQ ID NO: 2819181 - DNA, 23 bp, Homo sapiens
ttgcccacgctggagtgcagtga

SEQ ID NO: 2819182 - DNA, 11 bp, Homo sapiens
ttgcccaggca

SEQ ID NO: 2819183 - DNA, 13 bp, Homo sapiens
ttgcccaggcagg

SEQ ID NO: 2819184 - DNA, 14 bp, Homo sapiens
ttgcccaggcaggt

SEQ ID NO: 2819185 - DNA, 11 bp, Homo sapiens
ttgcccaggct

SEQ ID NO: 2819186 - DNA, 23 bp, Homo sapiens
ttgcccaggctggcgtgcagtgg

SEQ ID NO: 2819187 - DNA, 18 bp, Homo sapiens
ttgcccagggctcagcct

SEQ ID NO: 2819188 - DNA, 12 bp, Homo sapiens
ttgccccttggg

SEQ ID NO: 2819189 - DNA, 16 bp, Homo sapiens
ttgccccttgggcctc

SEQ ID NO: 2819190 - DNA, 12 bp, Homo sapiens
ttgccctgacct

SEQ ID NO: 2819191 - DNA, 15 bp, Homo sapiens
ttgccctgacctccc

SEQ ID NO: 2819192 - DNA, 17 bp, Homo sapiens
ttgcccttgccctgacc

SEQ ID NO: 2819193 - DNA, 16 bp, Homo sapiens
ttgcctctgcctctga

SEQ ID NO: 2819194 - DNA, 22 bp, Homo sapiens
ttgcctgaatccatcaggactt

SEQ ID NO: 2819195 - DNA, 13 bp, Homo sapiens
ttgcctgcagaga

SEQ ID NO: 2819196 - DNA, 15 bp, Homo sapiens
ttgcctgcagagaga

SEQ ID NO: 2819197 - DNA, 20 bp, Homo sapiens
ttgcctgcagagagaagcct

SEQ ID NO: 2819198 - DNA, 13 bp, Homo sapiens
ttgcctgccaggg

SEQ ID NO: 2819199 - DNA, 16 bp, Homo sapiens
ttgcctgccagggccc

SEQ ID NO: 2819200 - DNA, 22 bp, Homo sapiens
ttgcctgcgttttggaagctct

SEQ ID NO: 2819201 - DNA, 16 bp, Homo sapiens
ttgcgctggtggacca

SEQ ID NO: 2819202 - DNA, 12 bp, Homo sapiens
ttgctccttgac

SEQ ID NO: 2819203 - DNA, 21 bp, Homo sapiens
ttgctgcctgaagaacagtaa

SEQ ID NO: 2819204 - DNA, 21 bp, Homo sapiens
ttgctggaagacgcaagggcc

SEQ ID NO: 2819205 - DNA, 21 bp, Homo sapiens
ttgctgtcataagaatgaata

SEQ ID NO: 2819206 - DNA, 20 bp, Homo sapiens
ttgctgtgagcaagaagtca

SEQ ID NO: 2819207 - DNA, 13 bp, Homo sapiens
ttgctgttttgat

SEQ ID NO: 2819208 - DNA, 13 bp, Homo sapiens
ttgcttgaaacca

SEQ ID NO: 2819209 - DNA, 16 bp, Homo sapiens
ttgcttgagcccagga

SEQ ID NO: 2819210 - DNA, 17 bp, Homo sapiens
ttgcttgagcccaggag

SEQ ID NO: 2819211 - DNA, 16 bp, Homo sapiens
ttgcttggactattat

SEQ ID NO: 2819212 - DNA, 13 bp, Homo sapiens
ttgctttgccctt

SEQ ID NO: 2819213 - DNA, 14 bp, Homo sapiens
ttggaaaagaatac

SEQ ID NO: 2819214 - DNA, 19 bp, Homo sapiens
ttggaaaagaatacagaaa

SEQ ID NO: 2819215 - DNA, 18 bp, Homo sapiens
ttggaaagagaccagcac

SEQ ID NO: 2819216 - DNA, 21 bp, Homo sapiens
ttggaaagcaggtggcatctc

SEQ ID NO: 2819217 - DNA, 22 bp, Homo sapiens
ttggaaagcatcacctcaggcc

SEQ ID NO: 2819218 - DNA, 19 bp, Homo sapiens
ttggaagctccgctttcta

SEQ ID NO: 2819219 - DNA, 15 bp, Homo sapiens
ttggacactgtacaa

SEQ ID NO: 2819220 - DNA, 16 bp, Homo sapiens
ttggacccgctctgga

SEQ ID NO: 2819221 - DNA, 17 bp, Homo sapiens
ttggacccgctctggac

SEQ ID NO: 2819222 - DNA, 17 bp, Homo sapiens
ttggacctctgctctga

SEQ ID NO: 2819223 - DNA, 19 bp, Homo sapiens
ttggagagggacgaagaaa

SEQ ID NO: 2819224 - DNA, 21 bp, Homo sapiens
tttctagctgttgagctgttt

SEQ ID NO: 2819225 - DNA, 13 bp, Homo sapiens
tttctagttgaaa

SEQ ID NO: 2819226 - DNA, 16 bp, Homo sapiens
tttctcactaaatctt

SEQ ID NO: 2819227 - DNA, 20 bp, Homo sapiens
tttctcagaatccaaagatc

SEQ ID NO: 2819228 - DNA, 15 bp, Homo sapiens
tttctccaagagcta

SEQ ID NO: 2819229 - DNA, 21 bp, Homo sapiens
tttctccaagagctacataat

SEQ ID NO: 2819230 - DNA, 23 bp, Homo sapiens
tttctcctgggcccgctttgcct

SEQ ID NO: 2819231 - DNA, 14 bp, Homo sapiens
tttctctctttctt

SEQ ID NO: 2819232 - DNA, 16 bp, Homo sapiens
tttctctgagagagat

SEQ ID NO: 2819233 - DNA, 18 bp, Homo sapiens
tttctctgagagagatga

SEQ ID NO: 2819234 - DNA, 17 bp, Homo sapiens
tttctctgtatagtact

SEQ ID NO: 2819235 - DNA, 18 bp, Homo sapiens
tttctgaggagaaacaaa

SEQ ID NO: 2819236 - DNA, 18 bp, Homo sapiens
tttctgagtgacatgggt

SEQ ID NO: 2819237 - DNA, 19 bp, Homo sapiens
tttctgcagtagtctctgt

SEQ ID NO: 2819238 - DNA, 13 bp, Homo sapiens
tttcttaaataag

SEQ ID NO: 2819239 - DNA, 19 bp, Homo sapiens
tttcttaaataagaaactt

SEQ ID NO: 2819240 - DNA, 20 bp, Homo sapiens
tttcttaaataagaaacttt

SEQ ID NO: 2819241 - DNA, 22 bp, Homo sapiens
tttcttacccatatatcttatg

SEQ ID NO: 2819242 - DNA, 18 bp, Homo sapiens
tttcttatttaacttaac

SEQ ID NO: 2819243 - DNA, 22 bp, Homo sapiens
tttcttcatgcaatgacatctt

SEQ ID NO: 2819244 - DNA, 11 bp, Homo sapiens
tttcttcctct

SEQ ID NO: 2819245 - DNA, 13 bp, Homo sapiens
tttcttcctctgc

SEQ ID NO: 2819246 - DNA, 22 bp, Homo sapiens
tttcttttctggaatgtaatca

SEQ ID NO: 2819247 - DNA, 20 bp, Homo sapiens
tttgaaaaagcgaaaaaatc

SEQ ID NO: 2819248 - DNA, 21 bp, Homo sapiens
tttgaaagtgaataaacttca

SEQ ID NO: 2819249 - DNA, 20 bp, Homo sapiens
tttgaacccccgccatcctt

SEQ ID NO: 2819250 - DNA, 15 bp, Homo sapiens
tttgaactaataaaa

SEQ ID NO: 2819251 - DNA, 19 bp, Homo sapiens
tttgaaggaggtgagggat

SEQ ID NO: 2819252 - DNA, 23 bp, Homo sapiens
tttgaagttagctttaacttaaa

SEQ ID NO: 2819253 - DNA, 18 bp, Homo sapiens
tttgaatataaacactat

SEQ ID NO: 2819254 - DNA, 14 bp, Homo sapiens
tttgacatttcctt

SEQ ID NO: 2819255 - DNA, 12 bp, Homo sapiens
tttgactctttt

SEQ ID NO: 2819256 - DNA, 16 bp, Homo sapiens
tttgagaccagcctgg

SEQ ID NO: 2819257 - DNA, 19 bp, Homo sapiens
tttgagcgcagagtaaaat

SEQ ID NO: 2819258 - DNA, 15 bp, Homo sapiens
tttgaggctgcagcg

SEQ ID NO: 2819259 - DNA, 19 bp, Homo sapiens
tttgatacatatgtgaata

SEQ ID NO: 2819260 - DNA, 17 bp, Homo sapiens
tttgatactaagcattg

SEQ ID NO: 2819261 - DNA, 14 bp, Homo sapiens
tttgatccaagctg

SEQ ID NO: 2819262 - DNA, 21 bp, Homo sapiens
tttgatggtaagactgtaatt

SEQ ID NO: 2819263 - DNA, 12 bp, Homo sapiens
tttgcaaaattt

SEQ ID NO: 2819264 - DNA, 18 bp, Homo sapiens
tttgcaaagttacagatg

SEQ ID NO: 2819265 - DNA, 22 bp, Homo sapiens
tttgcaacaagacaaagcaaag

SEQ ID NO: 2819266 - DNA, 12 bp, Homo sapiens
tttgcaaggaag

SEQ ID NO: 2819267 - DNA, 15 bp, Homo sapiens
tttgcaattattcta

SEQ ID NO: 2819268 - DNA, 12 bp, Homo sapiens
tttgcacagctc

SEQ ID NO: 2819269 - DNA, 18 bp, Homo sapiens
tttatgcaaggaaggaaa

SEQ ID NO: 2819270 - DNA, 22 bp, Homo sapiens
tttatggggctgaacggggaga

SEQ ID NO: 2819271 - DNA, 19 bp, Homo sapiens
tttatggtattttcgtgca

SEQ ID NO: 2819272 - DNA, 20 bp, Homo sapiens
tttatgttactacatgcact

SEQ ID NO: 2819273 - DNA, 13 bp, Homo sapiens
tttattaaaaact

SEQ ID NO: 2819274 - DNA, 18 bp, Homo sapiens
tttattaacaaattatgt

SEQ ID NO: 2819275 - DNA, 20 bp, Homo sapiens
tttattaatgaactgtgaca

SEQ ID NO: 2819276 - DNA, 18 bp, Homo sapiens
tttattaattcattaaat

SEQ ID NO: 2819277 - DNA, 13 bp, Homo sapiens
tttattacctctg

SEQ ID NO: 2819278 - DNA, 20 bp, Homo sapiens
tttattacctctgatacctc

SEQ ID NO: 2819279 - DNA, 13 bp, Homo sapiens
tttattactgatt

SEQ ID NO: 2819280 - DNA, 13 bp, Homo sapiens
tttattagctgta

SEQ ID NO: 2819281 - DNA, 20 bp, Homo sapiens
tttattagctgtaaatacat

SEQ ID NO: 2819282 - DNA, 18 bp, Homo sapiens
tttattcattagctgtga

SEQ ID NO: 2819283 - DNA, 22 bp, Homo sapiens
tttatttaaaaaactaaaaact

SEQ ID NO: 2819284 - DNA, 22 bp, Homo sapiens
tttatttaacttttagtaaagt

SEQ ID NO: 2819285 - DNA, 17 bp, Homo sapiens
tttatttaatgttatgt

SEQ ID NO: 2819286 - DNA, 15 bp, Homo sapiens
tttatttatcagtga

SEQ ID NO: 2819287 - DNA, 21 bp, Homo sapiens
tttattttcttttgtaaatgt

SEQ ID NO: 2819288 - DNA, 13 bp, Homo sapiens
tttatttttgaac

SEQ ID NO: 2819289 - DNA, 17 bp, Homo sapiens
tttattttttaagtatt

SEQ ID NO: 2819290 - DNA, 17 bp, Homo sapiens
tttcaaagctttttcca

SEQ ID NO: 2819291 - DNA, 13 bp, Homo sapiens
tttcaaatatcac

SEQ ID NO: 2819292 - DNA, 13 bp, Homo sapiens
tttcaaccagcat

SEQ ID NO: 2819293 - DNA, 19 bp, Homo sapiens
tttcaaccagcattttact

SEQ ID NO: 2819294 - DNA, 18 bp, Homo sapiens
tttcaaccgcttgccata

SEQ ID NO: 2819295 - DNA, 14 bp, Homo sapiens
tttcaacttaaatc

SEQ ID NO: 2819296 - DNA, 16 bp, Homo sapiens
tttcaagaaaactgga

SEQ ID NO: 2819297 - DNA, 18 bp, Homo sapiens
tttcaagaaaactggaaa

SEQ ID NO: 2819298 - DNA, 15 bp, Homo sapiens
tttcaagagaagaaa

SEQ ID NO: 2819299 - DNA, 23 bp, Homo sapiens
tttcaagagaagaaaaaattaag

SEQ ID NO: 2819300 - DNA, 12 bp, Homo sapiens
tttcaatgattg

SEQ ID NO: 2819301 - DNA, 19 bp, Homo sapiens
tttcaatttccaagagctg

SEQ ID NO: 2819302 - DNA, 23 bp, Homo sapiens
tttcacaacagcctgacaacatt

SEQ ID NO: 2819303 - DNA, 11 bp, Homo sapiens
tttcaccattt

SEQ ID NO: 2819304 - DNA, 23 bp, Homo sapiens
tttcaccatttccgggaaacgaa

SEQ ID NO: 2819305 - DNA, 18 bp, Homo sapiens
tttcacctggaagcattt

SEQ ID NO: 2819306 - DNA, 16 bp, Homo sapiens
tttcagaaatatgtgg

SEQ ID NO: 2819307 - DNA, 23 bp, Homo sapiens
tttcagaattgaaggagaaaatg

SEQ ID NO: 2819308 - DNA, 13 bp, Homo sapiens
tttcagctagttt

SEQ ID NO: 2819309 - DNA, 13 bp, Homo sapiens
tttcaggatactc

SEQ ID NO: 2819310 - DNA, 18 bp, Homo sapiens
tttcagtccccacagata

SEQ ID NO: 2819311 - DNA, 14 bp, Homo sapiens
tttcatcaatttaa

SEQ ID NO: 2819312 - DNA, 13 bp, Homo sapiens
tttcatcattttt

SEQ ID NO: 2819313 - DNA, 16 bp, Homo sapiens
tttcatgaacacagcc

SEQ ID NO: 2819314 - DNA, 19 bp, Homo sapiens
tttcatgctatctctgtgt

SEQ ID NO: 2819315 - DNA, 23 bp, Homo sapiens
tttcatgtaaccaagagtattcc

SEQ ID NO: 2819316 - DNA, 22 bp, Homo sapiens
tttcattgactatcaaactgaa

SEQ ID NO: 2819317 - DNA, 16 bp, Homo sapiens
tttcattgagggaaaa

SEQ ID NO: 2819318 - DNA, 21 bp, Homo sapiens
tttcattgatatgaaaaatat

SEQ ID NO: 2819319 - DNA, 17 bp, Homo sapiens
tttcattttcattaaaa

SEQ ID NO: 2819320 - DNA, 16 bp, Homo sapiens
tttccaagagctgagg

SEQ ID NO: 2819321 - DNA, 20 bp, Homo sapiens
tttccacaagattcccagag

SEQ ID NO: 2819322 - DNA, 21 bp, Homo sapiens
tttccacctgctttctcctgg

SEQ ID NO: 2819323 - DNA, 15 bp, Homo sapiens
tttccactgccaaaa

SEQ ID NO: 2819324 - DNA, 18 bp, Homo sapiens
tttccactgtcttgcctg

SEQ ID NO: 2819325 - DNA, 23 bp, Homo sapiens
tttccactgtcttgcctgccagg

SEQ ID NO: 2819326 - DNA, 13 bp, Homo sapiens
tttccagaaaata

SEQ ID NO: 2819327 - DNA, 15 bp, Homo sapiens
tttccagtacctttg

SEQ ID NO: 2819328 - DNA, 15 bp, Homo sapiens
tttccataaggaatg

SEQ ID NO: 2819329 - DNA, 20 bp, Homo sapiens
tttcccaccagcatgtcact

SEQ ID NO: 2819330 - DNA, 18 bp, Homo sapiens
tttcccatgctgaattat

SEQ ID NO: 2819331 - DNA, 19 bp, Homo sapiens
tttccccagtgtggcccca

SEQ ID NO: 2819332 - DNA, 18 bp, Homo sapiens
tttccccggtcccttgag

SEQ ID NO: 2819333 - DNA, 20 bp, Homo sapiens
tttcccctgcccccagacct

SEQ ID NO: 2819334 - DNA, 13 bp, Homo sapiens
tttccctctcttg

SEQ ID NO: 2819335 - DNA, 18 bp, Homo sapiens
tttccgaagaccttctga

SEQ ID NO: 2819336 - DNA, 16 bp, Homo sapiens
tttcctacctatatta

SEQ ID NO: 2819337 - DNA, 24 bp, Homo sapiens
tttcctactctcaggatcaagaaa

SEQ ID NO: 2819338 - DNA, 15 bp, Homo sapiens
tttcctattttaaaa

SEQ ID NO: 2819339 - DNA, 16 bp, Homo sapiens
tttcctattttaaaac

SEQ ID NO: 2819340 - DNA, 19 bp, Homo sapiens
tttcctcattcctgaaaga

SEQ ID NO: 2819341 - DNA, 17 bp, Homo sapiens
tttcctccccaccttcc

SEQ ID NO: 2819342 - DNA, 19 bp, Homo sapiens
tttcctccccaccttcccc

SEQ ID NO: 2819343 - DNA, 14 bp, Homo sapiens
tttcctctgcagca

SEQ ID NO: 2819344 - DNA, 21 bp, Homo sapiens
tttcctcttctattttgtaaa

SEQ ID NO: 2819345 - DNA, 22 bp, Homo sapiens
tttcctcttctattttgtaaac

SEQ ID NO: 2819346 - DNA, 20 bp, Homo sapiens
tttcctgagaccacagagag

SEQ ID NO: 2819347 - DNA, 16 bp, Homo sapiens
tttcctggaaagactg

SEQ ID NO: 2819348 - DNA, 22 bp, Homo sapiens
tttcctgggtggctactctgtg

SEQ ID NO: 2819349 - DNA, 23 bp, Homo sapiens
tttcctgtatttgttcccaagag

SEQ ID NO: 2819350 - DNA, 18 bp, Homo sapiens
tttccttcaaagtttaat

SEQ ID NO: 2819351 - DNA, 13 bp, Homo sapiens
tttccttcagtgc

SEQ ID NO: 2819352 - DNA, 18 bp, Homo sapiens
tttccttccttccctggc

SEQ ID NO: 2819353 - DNA, 17 bp, Homo sapiens
tttccttttttgttatt

SEQ ID NO: 2819354 - DNA, 19 bp, Homo sapiens
tttcgccgttgaagaggaa

SEQ ID NO: 2819355 - DNA, 12 bp, Homo sapiens
tttcgctttcct

SEQ ID NO: 2819356 - DNA, 22 bp, Homo sapiens
tttctacacagtaaaaacttgt

SEQ ID NO: 2819357 - DNA, 18 bp, Homo sapiens
tttctacccagcgagccc

SEQ ID NO: 2819358 - DNA, 19 bp, Homo sapiens
tttctagctgttgagctgt

SEQ ID NO: 2819359 - DNA, 19 bp, Homo sapiens
tgattcccaagctctgctc

SEQ ID NO: 2819360 - DNA, 22 bp, Homo sapiens
tgattccttgatggagatattt

SEQ ID NO: 2819361 - DNA, 18 bp, Homo sapiens
tgattcggatttgacaaa

SEQ ID NO: 2819362 - DNA, 20 bp, Homo sapiens
tgattcggatttgacaaaat

SEQ ID NO: 2819363 - DNA, 14 bp, Homo sapiens
tgattgacacacag

SEQ ID NO: 2819364 - DNA, 18 bp, Homo sapiens
tgatttaagcattttact

SEQ ID NO: 2819365 - DNA, 13 bp, Homo sapiens
tgatttaatatct

SEQ ID NO: 2819366 - DNA, 19 bp, Homo sapiens
tgatttcaggatactctgt

SEQ ID NO: 2819367 - DNA, 15 bp, Homo sapiens
tgatttgtactgaaa

SEQ ID NO: 2819368 - DNA, 16 bp, Homo sapiens
tgattttacagagaat

SEQ ID NO: 2819369 - DNA, 20 bp, Homo sapiens
tgattttacagagaatctga

SEQ ID NO: 2819370 - DNA, 22 bp, Homo sapiens
tgattttacagagaatctgaag

SEQ ID NO: 2819371 - DNA, 20 bp, Homo sapiens
tgattttcaaagctttttcc

SEQ ID NO: 2819372 - DNA, 14 bp, Homo sapiens
tgattttcatcaat

SEQ ID NO: 2819373 - DNA, 12 bp, Homo sapiens
tgcaaaaaatag

SEQ ID NO: 2819374 - DNA, 16 bp, Homo sapiens
tgcaaaatttccagta

SEQ ID NO: 2819375 - DNA, 21 bp, Homo sapiens
tgcaaaatttccagtaccttt

SEQ ID NO: 2819376 - DNA, 15 bp, Homo sapiens
tgcaaacactgtgta

SEQ ID NO: 2819377 - DNA, 16 bp, Homo sapiens
tgcaaactcactgctc

SEQ ID NO: 2819378 - DNA, 21 bp, Homo sapiens
tgcaaagggtatcaggtgctg

SEQ ID NO: 2819379 - DNA, 18 bp, Homo sapiens
tgcaaagtgcaaatactc

SEQ ID NO: 2819380 - DNA, 18 bp, Homo sapiens
tgcaaagttattccccat

SEQ ID NO: 2819381 - DNA, 23 bp, Homo sapiens
tgcaaagttccctacttcctgtg

SEQ ID NO: 2819382 - DNA, 15 bp, Homo sapiens
tgcaaatgcaacaaa

SEQ ID NO: 2819383 - DNA, 13 bp, Homo sapiens
tgcaacaggctgg

SEQ ID NO: 2819384 - DNA, 15 bp, Homo sapiens
tgcaacaggctgggc

SEQ ID NO: 2819385 - DNA, 17 bp, Homo sapiens
tgcaacaggctgggctt

SEQ ID NO: 2819386 - DNA, 13 bp, Homo sapiens
tgcaacctccgcc

SEQ ID NO: 2819387 - DNA, 20 bp, Homo sapiens
tgcaacctccgcctcttggg

SEQ ID NO: 2819388 - DNA, 21 bp, Homo sapiens
tgcaacttctttttattttct

SEQ ID NO: 2819389 - DNA, 14 bp, Homo sapiens
tgcaagaagaatat

SEQ ID NO: 2819390 - DNA, 17 bp, Homo sapiens
tgcaagaagaatataaa

SEQ ID NO: 2819391 - DNA, 23 bp, Homo sapiens
tgcaaggccgctgttcacccaca

SEQ ID NO: 2819392 - DNA, 16 bp, Homo sapiens
tgcaaggtctttggtt

SEQ ID NO: 2819393 - DNA, 19 bp, Homo sapiens
tgcaatattcctggtatta

SEQ ID NO: 2819394 - DNA, 16 bp, Homo sapiens
tgcaatctccagggct

SEQ ID NO: 2819395 - DNA, 14 bp, Homo sapiens
tgcaatttttaaac

SEQ ID NO: 2819396 - DNA, 18 bp, Homo sapiens
tgcaatttttaaactagt

SEQ ID NO: 2819397 - DNA, 21 bp, Homo sapiens
tgcaatttttaaactagtaat

SEQ ID NO: 2819398 - DNA, 21 bp, Homo sapiens
tgcacaaatatttattttctt

SEQ ID NO: 2819399 - DNA, 13 bp, Homo sapiens
tgcacaatttaga

SEQ ID NO: 2819400 - DNA, 14 bp, Homo sapiens
tgcacaatttagaa

SEQ ID NO: 2819401 - DNA, 12 bp, Homo sapiens
tgcacaatttga

SEQ ID NO: 2819402 - DNA, 16 bp, Homo sapiens
tgcacaatttgagcaa

SEQ ID NO: 2819403 - DNA, 21 bp, Homo sapiens
tgcacaatttgagcaattcat

SEQ ID NO: 2819404 - DNA, 17 bp, Homo sapiens
tgcacacaccagagccc

SEQ ID NO: 2819405 - DNA, 21 bp, Homo sapiens
tgcacacaccagagcccacct

SEQ ID NO: 2819406 - DNA, 15 bp, Homo sapiens
tgcacacttgtatat

SEQ ID NO: 2819407 - DNA, 17 bp, Homo sapiens
tgcacagatatttccat

SEQ ID NO: 2819408 - DNA, 21 bp, Homo sapiens
tgcacagatatttccatttct

SEQ ID NO: 2819409 - DNA, 15 bp, Homo sapiens
tgcacaggagggggt

SEQ ID NO: 2819410 - DNA, 17 bp, Homo sapiens
tgcacatatggactctg

SEQ ID NO: 2819411 - DNA, 23 bp, Homo sapiens
tgcacatgtaacatagatttatg

SEQ ID NO: 2819412 - DNA, 22 bp, Homo sapiens
tgcacatgtcttgtacatgtgt

SEQ ID NO: 2819413 - DNA, 23 bp, Homo sapiens
tgcacatgtcttgtacatgtgta

SEQ ID NO: 2819414 - DNA, 21 bp, Homo sapiens
tgcacattaggaacagagtat

SEQ ID NO: 2819415 - DNA, 23 bp, Homo sapiens
tgcacattaggaacagagtatat

SEQ ID NO: 2819416 - DNA, 19 bp, Homo sapiens
tgcacattttgtacaaaga

SEQ ID NO: 2819417 - DNA, 17 bp, Homo sapiens
tgcaccagcccttccct

SEQ ID NO: 2819418 - DNA, 18 bp, Homo sapiens
tgcaccagcccttccctg

SEQ ID NO: 2819419 - DNA, 19 bp, Homo sapiens
tgcaccagtgccgcctgtg

SEQ ID NO: 2819420 - DNA, 20 bp, Homo sapiens
tgcaccagtgccgcctgtgc

SEQ ID NO: 2819421 - DNA, 23 bp, Homo sapiens
tgcaccattgcgctctagcctgg

SEQ ID NO: 2819422 - DNA, 15 bp, Homo sapiens
tgcacccaggggtgg

SEQ ID NO: 2819423 - DNA, 13 bp, Homo sapiens
tgcacccgtaccc

SEQ ID NO: 2819424 - DNA, 15 bp, Homo sapiens
tgcaccgggccacag

SEQ ID NO: 2819425 - DNA, 22 bp, Homo sapiens
tgcaccgggccacagagaaagt

SEQ ID NO: 2819426 - DNA, 13 bp, Homo sapiens
tgcacctaaagaa

SEQ ID NO: 2819427 - DNA, 14 bp, Homo sapiens
tgcacctaaagaaa

SEQ ID NO: 2819428 - DNA, 21 bp, Homo sapiens
tgcacctaaagaaaaacaaac

SEQ ID NO: 2819429 - DNA, 18 bp, Homo sapiens
tgcacctccccccactgc

SEQ ID NO: 2819430 - DNA, 15 bp, Homo sapiens
tgcacctgccagcct

SEQ ID NO: 2819431 - DNA, 17 bp, Homo sapiens
tgcacctgccagcctgg

SEQ ID NO: 2819432 - DNA, 19 bp, Homo sapiens
tgcacctgccagcctggct

SEQ ID NO: 2819433 - DNA, 14 bp, Homo sapiens
tgcaccttgtgtct

SEQ ID NO: 2819434 - DNA, 15 bp, Homo sapiens
tgcaccttgtgtctg

SEQ ID NO: 2819435 - DNA, 22 bp, Homo sapiens
tgcacggcagcttgagcctgtc

SEQ ID NO: 2819436 - DNA, 23 bp, Homo sapiens
tgcacgtgctcttctgttctcaa

SEQ ID NO: 2819437 - DNA, 22 bp, Homo sapiens
tgcactatagcctaggtgacag

SEQ ID NO: 2819438 - DNA, 14 bp, Homo sapiens
tgcactccagcctg

SEQ ID NO: 2819439 - DNA, 17 bp, Homo sapiens
tgcactccagcctgggc

SEQ ID NO: 2819440 - DNA, 17 bp, Homo sapiens
tgcactctagcctggca

SEQ ID NO: 2819441 - DNA, 16 bp, Homo sapiens
tgcactggccccaccc

SEQ ID NO: 2819442 - DNA, 17 bp, Homo sapiens
tgcactggccccaccct

SEQ ID NO: 2819443 - DNA, 16 bp, Homo sapiens
tgcactgtatgctgga

SEQ ID NO: 2819444 - DNA, 19 bp, Homo sapiens
tgcagaaaaaaaaaaagaa

SEQ ID NO: 2819445 - DNA, 19 bp, Homo sapiens
tgcagaaaagcacctgccg

SEQ ID NO: 2819446 - DNA, 18 bp, Homo sapiens
tgcagaattttttgagta

SEQ ID NO: 2819447 - DNA, 21 bp, Homo sapiens
tgcagacaggcaagcacctcc

SEQ ID NO: 2819448 - DNA, 19 bp, Homo sapiens
tgcagactcaataaaatca

SEQ ID NO: 2819449 - DNA, 14 bp, Homo sapiens
tcttactaaacatt

SEQ ID NO: 2819450 - DNA, 18 bp, Homo sapiens
tcttagctgtctgctcag

SEQ ID NO: 2819451 - DNA, 19 bp, Homo sapiens
tcttaggaagagaaaccag

SEQ ID NO: 2819452 - DNA, 17 bp, Homo sapiens
tcttataggtttccact

SEQ ID NO: 2819453 - DNA, 15 bp, Homo sapiens
tcttatcttctgcaa

SEQ ID NO: 2819454 - DNA, 14 bp, Homo sapiens
tcttatttaactta

SEQ ID NO: 2819455 - DNA, 16 bp, Homo sapiens
tcttattttgtaataa

SEQ ID NO: 2819456 - DNA, 18 bp, Homo sapiens
tcttattttgtaataaac

SEQ ID NO: 2819457 - DNA, 16 bp, Homo sapiens
tcttcaactgaccagc

SEQ ID NO: 2819458 - DNA, 16 bp, Homo sapiens
tcttcaccaaatcttg

SEQ ID NO: 2819459 - DNA, 13 bp, Homo sapiens
tcttcagaagaca

SEQ ID NO: 2819460 - DNA, 13 bp, Homo sapiens
tcttcagccatca

SEQ ID NO: 2819461 - DNA, 16 bp, Homo sapiens
tcttcagccatcaaca

SEQ ID NO: 2819462 - DNA, 12 bp, Homo sapiens
tcttcagcctag

SEQ ID NO: 2819463 - DNA, 23 bp, Homo sapiens
tcttcagcctagccgacctcagc

SEQ ID NO: 2819464 - DNA, 23 bp, Homo sapiens
tcttcaggtggaaaaacatctga

SEQ ID NO: 2819465 - DNA, 12 bp, Homo sapiens
tcttcagtttta

SEQ ID NO: 2819466 - DNA, 19 bp, Homo sapiens
tcttcagttttatctttaa

SEQ ID NO: 2819467 - DNA, 24 bp, Homo sapiens
tcttccaagcaaaggtgaagagac

SEQ ID NO: 2819468 - DNA, 12 bp, Homo sapiens
tcttccataatg

SEQ ID NO: 2819469 - DNA, 13 bp, Homo sapiens
tcttcccatttgt

SEQ ID NO: 2819470 - DNA, 14 bp, Homo sapiens
tcttcccatttgta

SEQ ID NO: 2819471 - DNA, 19 bp, Homo sapiens
tcttcccatttgtaatgta

SEQ ID NO: 2819472 - DNA, 24 bp, Homo sapiens
tcttcccatttgtaatgtatctta

SEQ ID NO: 2819473 - DNA, 19 bp, Homo sapiens
tcttccccactccccacct

SEQ ID NO: 2819474 - DNA, 23 bp, Homo sapiens
tcttccccttgcccttgccctga

SEQ ID NO: 2819475 - DNA, 15 bp, Homo sapiens
tcttcccctttcctg

SEQ ID NO: 2819476 - DNA, 17 bp, Homo sapiens
tcttctaggttctaaaa

SEQ ID NO: 2819477 - DNA, 22 bp, Homo sapiens
tcttctatttaaaaaataaaaa

SEQ ID NO: 2819478 - DNA, 14 bp, Homo sapiens
tcttctccaggctg

SEQ ID NO: 2819479 - DNA, 15 bp, Homo sapiens
tcttctccaggctgt

SEQ ID NO: 2819480 - DNA, 14 bp, Homo sapiens
tcttctccatctgg

SEQ ID NO: 2819481 - DNA, 14 bp, Homo sapiens
tcttctcttcctgt

SEQ ID NO: 2819482 - DNA, 15 bp, Homo sapiens
tcttctcttcctgta

SEQ ID NO: 2819483 - DNA, 20 bp, Homo sapiens
tcttctgtacgtctgacagg

SEQ ID NO: 2819484 - DNA, 21 bp, Homo sapiens
tcttctgtacgtctgacaggc

SEQ ID NO: 2819485 - DNA, 22 bp, Homo sapiens
tcttctgtacgtctgacaggca

SEQ ID NO: 2819486 - DNA, 16 bp, Homo sapiens
tcttctttttttgtga

SEQ ID NO: 2819487 - DNA, 12 bp, Homo sapiens
tcttgaactcct

SEQ ID NO: 2819488 - DNA, 16 bp, Homo sapiens
tcttgaagaatattgt

SEQ ID NO: 2819489 - DNA, 18 bp, Homo sapiens
tcttgaatttctaaaaaa

SEQ ID NO: 2819490 - DNA, 16 bp, Homo sapiens
tcttgagatgtcttct

SEQ ID NO: 2819491 - DNA, 15 bp, Homo sapiens
tcttgaggccaggag

SEQ ID NO: 2819492 - DNA, 23 bp, Homo sapiens
tcttgagtactagaatttgtatt

SEQ ID NO: 2819493 - DNA, 18 bp, Homo sapiens
tcttgcaatggcagcctt

SEQ ID NO: 2819494 - DNA, 19 bp, Homo sapiens
tcttgcaatggcagccttg

SEQ ID NO: 2819495 - DNA, 15 bp, Homo sapiens
ttctttttcaaaaat

SEQ ID NO: 2819496 - DNA, 17 bp, Homo sapiens
ttcttttttgtctcaag

SEQ ID NO: 2819497 - DNA, 20 bp, Homo sapiens
ttgaaagagaaccagtttca

SEQ ID NO: 2819498 - DNA, 16 bp, Homo sapiens
ttgaaattatatctgt

SEQ ID NO: 2819499 - DNA, 19 bp, Homo sapiens
ttgaaattgtttaagtgtt

SEQ ID NO: 2819500 - DNA, 22 bp, Homo sapiens
ttgaacttaaataaatgtcatt

SEQ ID NO: 2819501 - DNA, 21 bp, Homo sapiens
ttgaagaatgttaagacttga

SEQ ID NO: 2819502 - DNA, 21 bp, Homo sapiens
ttgaagagagatatatctgaa

SEQ ID NO: 2819503 - DNA, 18 bp, Homo sapiens
ttgaaggagaaaatgcat

SEQ ID NO: 2819504 - DNA, 20 bp, Homo sapiens
ttgaagtcatcttagctttc

SEQ ID NO: 2819505 - DNA, 18 bp, Homo sapiens
ttgaataaaaaacatttg

SEQ ID NO: 2819506 - DNA, 20 bp, Homo sapiens
ttgaataaaaaacatttgta

SEQ ID NO: 2819507 - DNA, 22 bp, Homo sapiens
ttgaataaaaaacatttgtaca

SEQ ID NO: 2819508 - DNA, 21 bp, Homo sapiens
ttgaataaagcctgcttttta

SEQ ID NO: 2819509 - DNA, 16 bp, Homo sapiens
ttgaataaagtctgag

SEQ ID NO: 2819510 - DNA, 18 bp, Homo sapiens
ttgaatataaacactata

SEQ ID NO: 2819511 - DNA, 15 bp, Homo sapiens
ttgaatcctctctct

SEQ ID NO: 2819512 - DNA, 14 bp, Homo sapiens
ttgacaacaaatta

SEQ ID NO: 2819513 - DNA, 16 bp, Homo sapiens
ttgacaacattttatt

SEQ ID NO: 2819514 - DNA, 16 bp, Homo sapiens
ttgacaaccatgagac

SEQ ID NO: 2819515 - DNA, 18 bp, Homo sapiens
ttgacaataatttcaggt

SEQ ID NO: 2819516 - DNA, 14 bp, Homo sapiens
ttgacagaacactg

SEQ ID NO: 2819517 - DNA, 15 bp, Homo sapiens
ttgacagaacactgt

SEQ ID NO: 2819518 - DNA, 10 bp, Homo sapiens
ttgacagggc

SEQ ID NO: 2819519 - DNA, 19 bp, Homo sapiens
ttgacagggcacaccgggc

SEQ ID NO: 2819520 - DNA, 20 bp, Homo sapiens
ttgacataacactataaagg

SEQ ID NO: 2819521 - DNA, 16 bp, Homo sapiens
ttgacatcatgtaaac

SEQ ID NO: 2819522 - DNA, 23 bp, Homo sapiens
ttgactccttgtggtttatgtca

SEQ ID NO: 2819523 - DNA, 12 bp, Homo sapiens
ttgactttcagg

SEQ ID NO: 2819524 - DNA, 15 bp, Homo sapiens
ttgactttcaggtac

SEQ ID NO: 2819525 - DNA, 23 bp, Homo sapiens
ttgagaaaccttattgtacctct

SEQ ID NO: 2819526 - DNA, 13 bp, Homo sapiens
ttgagaccagcct

SEQ ID NO: 2819527 - DNA, 14 bp, Homo sapiens
ttgagacctcagcc

SEQ ID NO: 2819528 - DNA, 17 bp, Homo sapiens
ttgagacctcagccatg

SEQ ID NO: 2819529 - DNA, 17 bp, Homo sapiens
ttgagagaagagacaaa

SEQ ID NO: 2819530 - DNA, 18 bp, Homo sapiens
ttgagataatatctgtga

SEQ ID NO: 2819531 - DNA, 18 bp, Homo sapiens
ttgagatgtgatgctggt

SEQ ID NO: 2819532 - DNA, 22 bp, Homo sapiens
ttgagcaattcatttcacttta

SEQ ID NO: 2819533 - DNA, 12 bp, Homo sapiens
ttgagcagggct

SEQ ID NO: 2819534 - DNA, 13 bp, Homo sapiens
ttgagcccaggag

SEQ ID NO: 2819535 - DNA, 13 bp, Homo sapiens
ttgaggagtgtga

SEQ ID NO: 2819536 - DNA, 18 bp, Homo sapiens
ttgagggaaaacataata

SEQ ID NO: 2819537 - DNA, 15 bp, Homo sapiens
ttgaggggctcctgg

SEQ ID NO: 2819538 - DNA, 13 bp, Homo sapiens
ttgagggtaggag

SEQ ID NO: 2819539 - DNA, 22 bp, Homo sapiens
ttgaggtggaagccctccttcc

SEQ ID NO: 2819540 - DNA, 18 bp, Homo sapiens
ttgagtctcctctctgag

SEQ ID NO: 2819541 - DNA, 13 bp, Homo sapiens
ttgagtgtttaaa

SEQ ID NO: 2819542 - DNA, 17 bp, Homo sapiens
ttgagtttaagtctctg

SEQ ID NO: 2819543 - DNA, 18 bp, Homo sapiens
ttgagtttaagtctctga

SEQ ID NO: 2819544 - DNA, 18 bp, Homo sapiens
ttgagttttgactgcttg

SEQ ID NO: 2819545 - DNA, 22 bp, Homo sapiens
ttgataaagattttttaataat

SEQ ID NO: 2819546 - DNA, 14 bp, Homo sapiens
ttgatagctttatt

SEQ ID NO: 2819547 - DNA, 14 bp, Homo sapiens
tgttgaaaatgttc

SEQ ID NO: 2819548 - DNA, 13 bp, Homo sapiens
tgttgagacagag

SEQ ID NO: 2819549 - DNA, 13 bp, Homo sapiens
tgttgagctgttt

SEQ ID NO: 2819550 - DNA, 23 bp, Homo sapiens
tgttgattacataatcaaagcta

SEQ ID NO: 2819551 - DNA, 20 bp, Homo sapiens
tgttgattgcaggaataagg

SEQ ID NO: 2819552 - DNA, 17 bp, Homo sapiens
tgttgcatgatgtattt

SEQ ID NO: 2819553 - DNA, 21 bp, Homo sapiens
tgttgccacctgttaaaatgt

SEQ ID NO: 2819554 - DNA, 21 bp, Homo sapiens
tgttgccatgaggcctttccc

SEQ ID NO: 2819555 - DNA, 12 bp, Homo sapiens
tgttgcccaggc

SEQ ID NO: 2819556 - DNA, 15 bp, Homo sapiens
tgttgcccaggcagg

SEQ ID NO: 2819557 - DNA, 23 bp, Homo sapiens
tgttgcccaggctggcgtgcagt

SEQ ID NO: 2819558 - DNA, 15 bp, Homo sapiens
tgttgccttagcact

SEQ ID NO: 2819559 - DNA, 21 bp, Homo sapiens
tgttgctgagttcctgtgggt

SEQ ID NO: 2819560 - DNA, 20 bp, Homo sapiens
tgttgcttagtcacttattt

SEQ ID NO: 2819561 - DNA, 19 bp, Homo sapiens
tgttggacccgctctggac

SEQ ID NO: 2819562 - DNA, 14 bp, Homo sapiens
tgttggccaggctg

SEQ ID NO: 2819563 - DNA, 15 bp, Homo sapiens
tgttggccaggctgg

SEQ ID NO: 2819564 - DNA, 17 bp, Homo sapiens
tgttggctgggggcctc

SEQ ID NO: 2819565 - DNA, 15 bp, Homo sapiens
tgttgtcaagtataa

SEQ ID NO: 2819566 - DNA, 13 bp, Homo sapiens
tgttgtctgtgca

SEQ ID NO: 2819567 - DNA, 14 bp, Homo sapiens
tgttgtctgtgcag

SEQ ID NO: 2819568 - DNA, 20 bp, Homo sapiens
tgttgtgattttgtacagaa

SEQ ID NO: 2819569 - DNA, 17 bp, Homo sapiens
tgttgttaatgaaaatg

SEQ ID NO: 2819570 - DNA, 21 bp, Homo sapiens
tgttgttaatgaaaatgtcag

SEQ ID NO: 2819571 - DNA, 13 bp, Homo sapiens
tgttgttatttaa

SEQ ID NO: 2819572 - DNA, 21 bp, Homo sapiens
tgttgtttcttaaataagaaa

SEQ ID NO: 2819573 - DNA, 12 bp, Homo sapiens
tgtttaaagttc

SEQ ID NO: 2819574 - DNA, 13 bp, Homo sapiens
tgtttaaagttca

SEQ ID NO: 2819575 - DNA, 15 bp, Homo sapiens
tgtttaattgtaggt

SEQ ID NO: 2819576 - DNA, 21 bp, Homo sapiens
tgtttacaaaaggcagccctt

SEQ ID NO: 2819577 - DNA, 23 bp, Homo sapiens
tgtttacaaaaggcagccctttg

SEQ ID NO: 2819578 - DNA, 19 bp, Homo sapiens
tgtttacactctttgtaag

SEQ ID NO: 2819579 - DNA, 15 bp, Homo sapiens
tgtttatacagctca

SEQ ID NO: 2819580 - DNA, 21 bp, Homo sapiens
tgtttatataattttgcagca

SEQ ID NO: 2819581 - DNA, 19 bp, Homo sapiens
tgtttcaatgacctgtatt

SEQ ID NO: 2819582 - DNA, 17 bp, Homo sapiens
tgtttcactatgatttt

SEQ ID NO: 2819583 - DNA, 17 bp, Homo sapiens
tgtttccagaaaatata

SEQ ID NO: 2819584 - DNA, 18 bp, Homo sapiens
tgtttccagaaaatataa

SEQ ID NO: 2819585 - DNA, 22 bp, Homo sapiens
tgtttcccataattttcttcat

SEQ ID NO: 2819586 - DNA, 20 bp, Homo sapiens
tgtttcccgctccaagagaa

SEQ ID NO: 2819587 - DNA, 15 bp, Homo sapiens
tgtttctaaaactat

SEQ ID NO: 2819588 - DNA, 17 bp, Homo sapiens
tgtttctccccctgggc

SEQ ID NO: 2819589 - DNA, 12 bp, Homo sapiens
tgtttctgcagt

SEQ ID NO: 2819590 - DNA, 18 bp, Homo sapiens
tgtttcttccaaagcaca

SEQ ID NO: 2819591 - DNA, 19 bp, Homo sapiens
tgtttcttccaaagcacat

SEQ ID NO: 2819592 - DNA, 14 bp, Homo sapiens
tgtttcttgcctca

SEQ ID NO: 2819593 - DNA, 13 bp, Homo sapiens
tgtttgagctcag

SEQ ID NO: 2819594 - DNA, 23 bp, Homo sapiens
tgtttgagctcagacccccactc

SEQ ID NO: 2819595 - DNA, 18 bp, Homo sapiens
tgtttgcacctttctagt

SEQ ID NO: 2819596 - DNA, 20 bp, Homo sapiens
tgtttgcacctttctagttg

SEQ ID NO: 2819597 - DNA, 22 bp, Homo sapiens
tgtttgcacctttctagttgaa

SEQ ID NO: 2819598 - DNA, 17 bp, Homo sapiens
tgtttgtctgtcttcat

SEQ ID NO: 2819599 - DNA, 20 bp, Homo sapiens
tgttttaagaggcagggtct

SEQ ID NO: 2819600 - DNA, 17 bp, Homo sapiens
tgtttttaaaaatcata

SEQ ID NO: 2819601 - DNA, 17 bp, Homo sapiens
tgtttttaagctgtttc

SEQ ID NO: 2819602 - DNA, 20 bp, Homo sapiens
tgtttttaatgctttgatat

SEQ ID NO: 2819603 - DNA, 12 bp, Homo sapiens
ttaaaaaaataa

SEQ ID NO: 2819604 - DNA, 21 bp, Homo sapiens
ttaaaaaataaaaaaatacag

SEQ ID NO: 2819605 - DNA, 22 bp, Homo sapiens
ttaaaaaataaatataattggg

SEQ ID NO: 2819606 - DNA, 13 bp, Homo sapiens
ttaaaaaatgtcc

SEQ ID NO: 2819607 - DNA, 16 bp, Homo sapiens
ttaaaaaatgtccatg

SEQ ID NO: 2819608 - DNA, 14 bp, Homo sapiens
ttaaaaactgagtg

SEQ ID NO: 2819609 - DNA, 18 bp, Homo sapiens
ttaaaaagttgcacatta

SEQ ID NO: 2819610 - DNA, 17 bp, Homo sapiens
ttaaaacaacactcaca

SEQ ID NO: 2819611 - DNA, 23 bp, Homo sapiens
ttaaaaccatgcagcttcatcaa

SEQ ID NO: 2819612 - DNA, 14 bp, Homo sapiens
ttaaaagaagactg

SEQ ID NO: 2819613 - DNA, 18 bp, Homo sapiens
ttaaaagaagactggaag

SEQ ID NO: 2819614 - DNA, 21 bp, Homo sapiens
ttaaaatagcaaaagaagaag

SEQ ID NO: 2819615 - DNA, 13 bp, Homo sapiens
ttaaaatatatat

SEQ ID NO: 2819616 - DNA, 21 bp, Homo sapiens
ttaaaatatatataaatatat

SEQ ID NO: 2819617 - DNA, 12 bp, Homo sapiens
ttaaaatatatt

SEQ ID NO: 2819618 - DNA, 13 bp, Homo sapiens
ttaaaatgtacac

SEQ ID NO: 2819619 - DNA, 17 bp, Homo sapiens
ttaaaatgtaggaagaa

SEQ ID NO: 2819620 - DNA, 15 bp, Homo sapiens
ttaaaattagtgaga

SEQ ID NO: 2819621 - DNA, 12 bp, Homo sapiens
ttaaaatttatt

SEQ ID NO: 2819622 - DNA, 22 bp, Homo sapiens
ttaaacaaatgtatgattacat

SEQ ID NO: 2819623 - DNA, 11 bp, Homo sapiens
ttaaacacctg

SEQ ID NO: 2819624 - DNA, 18 bp, Homo sapiens
ttaaacacctgacacatc

SEQ ID NO: 2819625 - DNA, 18 bp, Homo sapiens
ttaaacagtgagcctgaa

SEQ ID NO: 2819626 - DNA, 17 bp, Homo sapiens
ttaaaccagcagaaaag

SEQ ID NO: 2819627 - DNA, 19 bp, Homo sapiens
ttaaaccgctaaaagaaac

SEQ ID NO: 2819628 - DNA, 16 bp, Homo sapiens
ttaaacttgtcagaat

SEQ ID NO: 2819629 - DNA, 22 bp, Homo sapiens
ttaaagagcatggaaaaatact

SEQ ID NO: 2819630 - DNA, 23 bp, Homo sapiens
ttaaagagcatggaaaaatactg

SEQ ID NO: 2819631 - DNA, 19 bp, Homo sapiens
ttaaagaggcgtcttgtat

SEQ ID NO: 2819632 - DNA, 20 bp, Homo sapiens
ttaaagcatttactttgaat

SEQ ID NO: 2819633 - DNA, 14 bp, Homo sapiens
ttaaagctgcctgt

SEQ ID NO: 2819634 - DNA, 17 bp, Homo sapiens
ttaaagctgcctgtagt

SEQ ID NO: 2819635 - DNA, 18 bp, Homo sapiens
ttaaagctgcctgtagtt

SEQ ID NO: 2819636 - DNA, 15 bp, Homo sapiens
ttaaaggaaggaaaa

SEQ ID NO: 2819637 - DNA, 19 bp, Homo sapiens
tttaaattctttttcaaaa

SEQ ID NO: 2819638 - DNA, 20 bp, Homo sapiens
tttaacaaaacaagaaagaa

SEQ ID NO: 2819639 - DNA, 15 bp, Homo sapiens
tttaacaaaagcaag

SEQ ID NO: 2819640 - DNA, 19 bp, Homo sapiens
tttaacaactaatcaagag

SEQ ID NO: 2819641 - DNA, 18 bp, Homo sapiens
tttaaccctctcttccct

SEQ ID NO: 2819642 - DNA, 16 bp, Homo sapiens
tttaaccgtttttcaa

SEQ ID NO: 2819643 - DNA, 18 bp, Homo sapiens
tttaaccgtttttcaaga

SEQ ID NO: 2819644 - DNA, 20 bp, Homo sapiens
tttaaccgtttttcaagaaa

SEQ ID NO: 2819645 - DNA, 16 bp, Homo sapiens
tttaactaatttaaac

SEQ ID NO: 2819646 - DNA, 17 bp, Homo sapiens
tttaactaatttaaacc

SEQ ID NO: 2819647 - DNA, 22 bp, Homo sapiens
tttaactaatttaaaccagcag

SEQ ID NO: 2819648 - DNA, 12 bp, Homo sapiens
tttaactacaaa

SEQ ID NO: 2819649 - DNA, 17 bp, Homo sapiens
tttaactagaatttatt

SEQ ID NO: 2819650 - DNA, 14 bp, Homo sapiens
tttaactgccttgt

SEQ ID NO: 2819651 - DNA, 22 bp, Homo sapiens
tttaagagtgaaataattaaaa

SEQ ID NO: 2819652 - DNA, 15 bp, Homo sapiens
tttaagataaattat

SEQ ID NO: 2819653 - DNA, 15 bp, Homo sapiens
tttaagataattata

SEQ ID NO: 2819654 - DNA, 21 bp, Homo sapiens
tttaagcattttactgtctgt

SEQ ID NO: 2819655 - DNA, 12 bp, Homo sapiens
tttaagccaaaa

SEQ ID NO: 2819656 - DNA, 18 bp, Homo sapiens
tttaagccaaaacaatgt

SEQ ID NO: 2819657 - DNA, 13 bp, Homo sapiens
tttaagctgtttc

SEQ ID NO: 2819658 - DNA, 18 bp, Homo sapiens
tttaagctgtttccatag

SEQ ID NO: 2819659 - DNA, 16 bp, Homo sapiens
tttaagtatatagtat

SEQ ID NO: 2819660 - DNA, 18 bp, Homo sapiens
tttaagtatttaggtttt

SEQ ID NO: 2819661 - DNA, 13 bp, Homo sapiens
tttaagtctctga

SEQ ID NO: 2819662 - DNA, 11 bp, Homo sapiens
tttaataattt

SEQ ID NO: 2819663 - DNA, 19 bp, Homo sapiens
tttaatagaatataattat

SEQ ID NO: 2819664 - DNA, 16 bp, Homo sapiens
tttaatatagctattt

SEQ ID NO: 2819665 - DNA, 14 bp, Homo sapiens
tttaatccagaatt

SEQ ID NO: 2819666 - DNA, 12 bp, Homo sapiens
tttaatgccttc

SEQ ID NO: 2819667 - DNA, 23 bp, Homo sapiens
tttaattaatatgttcattaaat

SEQ ID NO: 2819668 - DNA, 23 bp, Homo sapiens
tttaattattattcttcataaca

SEQ ID NO: 2819669 - DNA, 14 bp, Homo sapiens
tttacaaaatacta

SEQ ID NO: 2819670 - DNA, 21 bp, Homo sapiens
tttacaccagttcctttcaat

SEQ ID NO: 2819671 - DNA, 18 bp, Homo sapiens
tttacatagttcttacta

SEQ ID NO: 2819672 - DNA, 13 bp, Homo sapiens
tttacccttggct

SEQ ID NO: 2819673 - DNA, 13 bp, Homo sapiens
tttacctgagacc

SEQ ID NO: 2819674 - DNA, 21 bp, Homo sapiens
tttacctgtgcgttactaatt

SEQ ID NO: 2819675 - DNA, 13 bp, Homo sapiens
tttactaaaagaa

SEQ ID NO: 2819676 - DNA, 17 bp, Homo sapiens
tttactactattctgtt

SEQ ID NO: 2819677 - DNA, 23 bp, Homo sapiens
tttactactgtggaaaaatattt

SEQ ID NO: 2819678 - DNA, 21 bp, Homo sapiens
tttactccagtggtgaagaaa

SEQ ID NO: 2819679 - DNA, 14 bp, Homo sapiens
tttactgagcttct

SEQ ID NO: 2819680 - DNA, 17 bp, Homo sapiens
tttactgagcttctctg

SEQ ID NO: 2819681 - DNA, 18 bp, Homo sapiens
tttactgagcttctctgt

SEQ ID NO: 2819682 - DNA, 13 bp, Homo sapiens
tttactgctgtca

SEQ ID NO: 2819683 - DNA, 22 bp, Homo sapiens
tttactgctgtcattgtccatg

SEQ ID NO: 2819684 - DNA, 13 bp, Homo sapiens
tttactttgaatt

SEQ ID NO: 2819685 - DNA, 15 bp, Homo sapiens
tctcaccaggaaggg

SEQ ID NO: 2819686 - DNA, 16 bp, Homo sapiens
tctcactatgttgccc

SEQ ID NO: 2819687 - DNA, 23 bp, Homo sapiens
tctcactctgtcgcccagtctgg

SEQ ID NO: 2819688 - DNA, 19 bp, Homo sapiens
tctcactgttgcccaggct

SEQ ID NO: 2819689 - DNA, 21 bp, Homo sapiens
tctcactgttgcccaggctgg

SEQ ID NO: 2819690 - DNA, 16 bp, Homo sapiens
tctcagaatccaaaga

SEQ ID NO: 2819691 - DNA, 15 bp, Homo sapiens
tctcagataaagtga

SEQ ID NO: 2819692 - DNA, 21 bp, Homo sapiens
tctcagccgcttctgactgct

SEQ ID NO: 2819693 - DNA, 13 bp, Homo sapiens
tctcagcttcatt

SEQ ID NO: 2819694 - DNA, 16 bp, Homo sapiens
tctcagcttcatttcc

SEQ ID NO: 2819695 - DNA, 14 bp, Homo sapiens
tctcaggagcacag

SEQ ID NO: 2819696 - DNA, 16 bp, Homo sapiens
tctcaggagcacaggc

SEQ ID NO: 2819697 - DNA, 14 bp, Homo sapiens
tctcaggagcttgc

SEQ ID NO: 2819698 - DNA, 16 bp, Homo sapiens
tctcatcatattgtat

SEQ ID NO: 2819699 - DNA, 18 bp, Homo sapiens
tctcatcatattgtatgt

SEQ ID NO: 2819700 - DNA, 18 bp, Homo sapiens
tctcatctcttcttttaa

SEQ ID NO: 2819701 - DNA, 16 bp, Homo sapiens
tctcatgtgatccttt

SEQ ID NO: 2819702 - DNA, 19 bp, Homo sapiens
tctcatgtgatccttttat

SEQ ID NO: 2819703 - DNA, 23 bp, Homo sapiens
tctcatttaagggaaaaatatat

SEQ ID NO: 2819704 - DNA, 21 bp, Homo sapiens
tctcatttttccgtaaaaatg

SEQ ID NO: 2819705 - DNA, 21 bp, Homo sapiens
tctccaaacaccggcagaaaa

SEQ ID NO: 2819706 - DNA, 19 bp, Homo sapiens
tctccaaatgattttcatc

SEQ ID NO: 2819707 - DNA, 15 bp, Homo sapiens
tctccaacctggaca

SEQ ID NO: 2819708 - DNA, 14 bp, Homo sapiens
tctccaaggaccag

SEQ ID NO: 2819709 - DNA, 16 bp, Homo sapiens
tctccaaggaccaggt

SEQ ID NO: 2819710 - DNA, 16 bp, Homo sapiens
tctccaattgtaaaaa

SEQ ID NO: 2819711 - DNA, 14 bp, Homo sapiens
tctccaccctgctc

SEQ ID NO: 2819712 - DNA, 16 bp, Homo sapiens
tctccacctcagcctt

SEQ ID NO: 2819713 - DNA, 19 bp, Homo sapiens
tctccacctcagccttgga

SEQ ID NO: 2819714 - DNA, 20 bp, Homo sapiens
tctccactaaatgagctcct

SEQ ID NO: 2819715 - DNA, 21 bp, Homo sapiens
tctccactaaatgagctcctg

SEQ ID NO: 2819716 - DNA, 13 bp, Homo sapiens
tctccagccagca

SEQ ID NO: 2819717 - DNA, 22 bp, Homo sapiens
tctccagccttctctctctggt

SEQ ID NO: 2819718 - DNA, 16 bp, Homo sapiens
tctccaggattccaaa

SEQ ID NO: 2819719 - DNA, 19 bp, Homo sapiens
tctccaggattgaagagca

SEQ ID NO: 2819720 - DNA, 19 bp, Homo sapiens
tctccaggctgtttctttt

SEQ ID NO: 2819721 - DNA, 16 bp, Homo sapiens
tctccagggctgcccc

SEQ ID NO: 2819722 - DNA, 17 bp, Homo sapiens
tctccagggctgcccct

SEQ ID NO: 2819723 - DNA, 13 bp, Homo sapiens
tctcccaggcccc

SEQ ID NO: 2819724 - DNA, 17 bp, Homo sapiens
tctcccaggccccatga

SEQ ID NO: 2819725 - DNA, 14 bp, Homo sapiens
tctccccctgggct

SEQ ID NO: 2819726 - DNA, 13 bp, Homo sapiens
tctcccctccctc

SEQ ID NO: 2819727 - DNA, 22 bp, Homo sapiens
tctcccctccctcttccttccc

SEQ ID NO: 2819728 - DNA, 17 bp, Homo sapiens
tctcccctgccctgctg

SEQ ID NO: 2819729 - DNA, 15 bp, Homo sapiens
tctccctaaaataaa

SEQ ID NO: 2819730 - DNA, 15 bp, Homo sapiens
tctccctctcctgcc

SEQ ID NO: 2819731 - DNA, 18 bp, Homo sapiens
tctccctctcctgcctac

SEQ ID NO: 2819732 - DNA, 14 bp, Homo sapiens
tctccctctggccc

SEQ ID NO: 2819733 - DNA, 12 bp, Homo sapiens
tctccctgccgc

SEQ ID NO: 2819734 - DNA, 22 bp, Homo sapiens
tctcctaccccacctcatgcct

SEQ ID NO: 2819735 - DNA, 23 bp, Homo sapiens
tctcctaccccacctcatgcctg

SEQ ID NO: 2819736 - DNA, 12 bp, Homo sapiens
tctcctcccagg

SEQ ID NO: 2819737 - DNA, 14 bp, Homo sapiens
tctcctctctgaga

SEQ ID NO: 2819738 - DNA, 12 bp, Homo sapiens
tctcctcttaaa

SEQ ID NO: 2819739 - DNA, 22 bp, Homo sapiens
tctcctcttaaaaaataaaaac

SEQ ID NO: 2819740 - DNA, 13 bp, Homo sapiens
tctcctcttgcca

SEQ ID NO: 2819741 - DNA, 17 bp, Homo sapiens
tctcctcttgccactgc

SEQ ID NO: 2819742 - DNA, 17 bp, Homo sapiens
tctcctgacccagtccc

SEQ ID NO: 2819743 - DNA, 17 bp, Homo sapiens
tctcctgagaggtgctg

SEQ ID NO: 2819744 - DNA, 21 bp, Homo sapiens
tctcctgagaggtgctgcagg

SEQ ID NO: 2819745 - DNA, 18 bp, Homo sapiens
tctcctgcctacatccca

SEQ ID NO: 2819746 - DNA, 17 bp, Homo sapiens
tctcctgcctactcacg

SEQ ID NO: 2819747 - DNA, 21 bp, Homo sapiens
tctcctgggcccgctttgcct

SEQ ID NO: 2819748 - DNA, 19 bp, Homo sapiens
tctcctgtataaccccacc

SEQ ID NO: 2819749 - DNA, 22 bp, Homo sapiens
tctcctgtataaccccaccttg

SEQ ID NO: 2819750 - DNA, 15 bp, Homo sapiens
tctcctgtgcccaca

SEQ ID NO: 2819751 - DNA, 12 bp, Homo sapiens
tctccttggagg

SEQ ID NO: 2819752 - DNA, 15 bp, Homo sapiens
tctcctttattgctc

SEQ ID NO: 2819753 - DNA, 16 bp, Homo sapiens
tctcctttgcactgag

SEQ ID NO: 2819754 - DNA, 14 bp, Homo sapiens
tctcgagcgccctg

SEQ ID NO: 2819755 - DNA, 13 bp, Homo sapiens
tctcgatctcctg

SEQ ID NO: 2819756 - DNA, 12 bp, Homo sapiens
tctcgcattttc

SEQ ID NO: 2819757 - DNA, 17 bp, Homo sapiens
tctcggggcgacccctc

SEQ ID NO: 2819758 - DNA, 15 bp, Homo sapiens
tctcgtatttaatat

SEQ ID NO: 2819759 - DNA, 20 bp, Homo sapiens
tctctaaatcttccttgtga

SEQ ID NO: 2819760 - DNA, 20 bp, Homo sapiens
tctctacagacttctccaga

SEQ ID NO: 2819761 - DNA, 20 bp, Homo sapiens
tctctactcctacctcagcc

SEQ ID NO: 2819762 - DNA, 13 bp, Homo sapiens
tctctagagaaca

SEQ ID NO: 2819763 - DNA, 14 bp, Homo sapiens
tctctagagaacat

SEQ ID NO: 2819764 - DNA, 19 bp, Homo sapiens
tctctatatatacatgtat

SEQ ID NO: 2819765 - DNA, 21 bp, Homo sapiens
tctctatatatacatgtatag

SEQ ID NO: 2819766 - DNA, 13 bp, Homo sapiens
tctctcaggagca

SEQ ID NO: 2819767 - DNA, 15 bp, Homo sapiens
tctctcatgaacctc

SEQ ID NO: 2819768 - DNA, 21 bp, Homo sapiens
tctctccactgctctcagcct

SEQ ID NO: 2819769 - DNA, 24 bp, Homo sapiens
tctctccactgctctcagcctccc

SEQ ID NO: 2819770 - DNA, 21 bp, Homo sapiens
tctctccaggaaggtagccca

SEQ ID NO: 2819771 - DNA, 22 bp, Homo sapiens
tctctcggggcgacccctcagt

SEQ ID NO: 2819772 - DNA, 15 bp, Homo sapiens
tctctcggttccacg

SEQ ID NO: 2819773 - DNA, 23 bp, Homo sapiens
tctctcggttccacgtccccctg

SEQ ID NO: 2819774 - DNA, 22 bp, Homo sapiens
tctctctactcctacctcagcc

SEQ ID NO: 2819775 - DNA, 16 bp, Homo sapiens
gttctgctggcctgga

SEQ ID NO: 2819776 - DNA, 21 bp, Homo sapiens
gttctggagctgctgttccaa

SEQ ID NO: 2819777 - DNA, 11 bp, Homo sapiens
gttctgggaca

SEQ ID NO: 2819778 - DNA, 14 bp, Homo sapiens
gttctgggacacag

SEQ ID NO: 2819779 - DNA, 16 bp, Homo sapiens
gttctgggacacagtt

SEQ ID NO: 2819780 - DNA, 23 bp, Homo sapiens
gttctggtatgaacttgaggaca

SEQ ID NO: 2819781 - DNA, 12 bp, Homo sapiens
gttctgtcacca

SEQ ID NO: 2819782 - DNA, 22 bp, Homo sapiens
gttcttacctgtatgtctccag

SEQ ID NO: 2819783 - DNA, 21 bp, Homo sapiens
gttcttgcagtcatcagaagt

SEQ ID NO: 2819784 - DNA, 18 bp, Homo sapiens
gttctttaggtgcctcct

SEQ ID NO: 2819785 - DNA, 16 bp, Homo sapiens
gttctttcttcctctg

SEQ ID NO: 2819786 - DNA, 22 bp, Homo sapiens
gttgaaaataaagtgtatattt

SEQ ID NO: 2819787 - DNA, 15 bp, Homo sapiens
gttgaagaggaaggg

SEQ ID NO: 2819788 - DNA, 12 bp, Homo sapiens
gttgacagcagg

SEQ ID NO: 2819789 - DNA, 18 bp, Homo sapiens
gttgacagttcatatgta

SEQ ID NO: 2819790 - DNA, 18 bp, Homo sapiens
gttgactcaagtttttac

SEQ ID NO: 2819791 - DNA, 14 bp, Homo sapiens
gttgactttcaggt

SEQ ID NO: 2819792 - DNA, 15 bp, Homo sapiens
gttgagagtgtgacc

SEQ ID NO: 2819793 - DNA, 16 bp, Homo sapiens
gttgaggggctcctgg

SEQ ID NO: 2819794 - DNA, 18 bp, Homo sapiens
gttgaggggctcctggaa

SEQ ID NO: 2819795 - DNA, 20 bp, Homo sapiens
gttgaggtggaagccctcct

SEQ ID NO: 2819796 - DNA, 21 bp, Homo sapiens
gttgagtctcctctctgagac

SEQ ID NO: 2819797 - DNA, 20 bp, Homo sapiens
gttgatcactggcaatgaaa

SEQ ID NO: 2819798 - DNA, 14 bp, Homo sapiens
gttgatgaccaatc

SEQ ID NO: 2819799 - DNA, 16 bp, Homo sapiens
gttgatgaggcctctt

SEQ ID NO: 2819800 - DNA, 22 bp, Homo sapiens
gttgatgatctttgcagacagg

SEQ ID NO: 2819801 - DNA, 17 bp, Homo sapiens
gttgcaaggccgctgtt

SEQ ID NO: 2819802 - DNA, 23 bp, Homo sapiens
tcgtggcagataatcagcctctt

SEQ ID NO: 2819803 - DNA, 15 bp, Homo sapiens
tcgtgggtgtgtgta

SEQ ID NO: 2819804 - DNA, 15 bp, Homo sapiens
tcgtgtttacaaaag

SEQ ID NO: 2819805 - DNA, 15 bp, Homo sapiens
tcgttcaaagcatga

SEQ ID NO: 2819806 - DNA, 18 bp, Homo sapiens
tctaaaaaacagaggcca

SEQ ID NO: 2819807 - DNA, 14 bp, Homo sapiens
tctaaaaacaccaa

SEQ ID NO: 2819808 - DNA, 16 bp, Homo sapiens
tctaaaaataaaatga

SEQ ID NO: 2819809 - DNA, 15 bp, Homo sapiens
tctaacgcctgagcc

SEQ ID NO: 2819810 - DNA, 23 bp, Homo sapiens
tctaacgcctgagcccagggagg

SEQ ID NO: 2819811 - DNA, 18 bp, Homo sapiens
tctaagcctttccataag

SEQ ID NO: 2819812 - DNA, 15 bp, Homo sapiens
tctaagctgcagctt

SEQ ID NO: 2819813 - DNA, 20 bp, Homo sapiens
tctaaggaaatggagaagct

SEQ ID NO: 2819814 - DNA, 18 bp, Homo sapiens
tctaagtctccaagaata

SEQ ID NO: 2819815 - DNA, 21 bp, Homo sapiens
tctaagttaatttaaagttgt

SEQ ID NO: 2819816 - DNA, 19 bp, Homo sapiens
tctaatagaactcagtttt

SEQ ID NO: 2819817 - DNA, 22 bp, Homo sapiens
tctaatagaactcagttttaac

SEQ ID NO: 2819818 - DNA, 19 bp, Homo sapiens
tctaatcaggttgttaatg

SEQ ID NO: 2819819 - DNA, 17 bp, Homo sapiens
tctaatgtaagaaaatt

SEQ ID NO: 2819820 - DNA, 21 bp, Homo sapiens
tctaattcccattttgcaaaa

SEQ ID NO: 2819821 - DNA, 22 bp, Homo sapiens
tctaattggaagaaattcctgt

SEQ ID NO: 2819822 - DNA, 17 bp, Homo sapiens
tctaatttatacaaaat

SEQ ID NO: 2819823 - DNA, 20 bp, Homo sapiens
tctaatttatacaaaataat

SEQ ID NO: 2819824 - DNA, 16 bp, Homo sapiens
tctacacagcctggac

SEQ ID NO: 2819825 - DNA, 16 bp, Homo sapiens
tctacacagtaaaaac

SEQ ID NO: 2819826 - DNA, 17 bp, Homo sapiens
tctacacatatatgtat

SEQ ID NO: 2819827 - DNA, 16 bp, Homo sapiens
tctacagaacaaagaa

SEQ ID NO: 2819828 - DNA, 15 bp, Homo sapiens
tctacagaggccatg

SEQ ID NO: 2819829 - DNA, 21 bp, Homo sapiens
tctacagaggccatgggcctc

SEQ ID NO: 2819830 - DNA, 15 bp, Homo sapiens
tctacatattcttta

SEQ ID NO: 2819831 - DNA, 14 bp, Homo sapiens
tctaccatttcaga

SEQ ID NO: 2819832 - DNA, 15 bp, Homo sapiens
tctaccatttcagag

SEQ ID NO: 2819833 - DNA, 14 bp, Homo sapiens
tctacccagagcct

SEQ ID NO: 2819834 - DNA, 14 bp, Homo sapiens
tctacccatctccc

SEQ ID NO: 2819835 - DNA, 13 bp, Homo sapiens
tctaccctgggat

SEQ ID NO: 2819836 - DNA, 15 bp, Homo sapiens
tctacgtataaatat

SEQ ID NO: 2819837 - DNA, 22 bp, Homo sapiens
tctacgtataaatatgaaatga

SEQ ID NO: 2819838 - DNA, 14 bp, Homo sapiens
tctactcatatata

SEQ ID NO: 2819839 - DNA, 16 bp, Homo sapiens
tctactggtcttgtgg

SEQ ID NO: 2819840 - DNA, 20 bp, Homo sapiens
tctactggtcttgtggaatt

SEQ ID NO: 2819841 - DNA, 23 bp, Homo sapiens
tctactggtcttgtggaattggg

SEQ ID NO: 2819842 - DNA, 22 bp, Homo sapiens
tctactttagaatgagagtgtg

SEQ ID NO: 2819843 - DNA, 17 bp, Homo sapiens
tctagaacacaggcaaa

SEQ ID NO: 2819844 - DNA, 19 bp, Homo sapiens
tctagaattttaagtgctt

SEQ ID NO: 2819845 - DNA, 14 bp, Homo sapiens
tctagacactgcca

SEQ ID NO: 2819846 - DNA, 13 bp, Homo sapiens
tctagatcaatta

SEQ ID NO: 2819847 - DNA, 20 bp, Homo sapiens
tctagatcaattaattctta

SEQ ID NO: 2819848 - DNA, 21 bp, Homo sapiens
tctagattaccccctcattgt

SEQ ID NO: 2819849 - DNA, 23 bp, Homo sapiens
tctagattaccccctcattgttt

SEQ ID NO: 2819850 - DNA, 15 bp, Homo sapiens
tctagattgagagaa

SEQ ID NO: 2819851 - DNA, 23 bp, Homo sapiens
tctagcaactgttggataataac

SEQ ID NO: 2819852 - DNA, 11 bp, Homo sapiens
tctagctgttg

SEQ ID NO: 2819853 - DNA, 16 bp, Homo sapiens
tctaggagctgggagg

SEQ ID NO: 2819854 - DNA, 20 bp, Homo sapiens
tctaggagctgggaggaaaa

SEQ ID NO: 2819855 - DNA, 17 bp, Homo sapiens
tctagggagagaccctt

SEQ ID NO: 2819856 - DNA, 14 bp, Homo sapiens
tctaggttctaaaa

SEQ ID NO: 2819857 - DNA, 23 bp, Homo sapiens
tctaggttctaaaaattgtgatc

SEQ ID NO: 2819858 - DNA, 16 bp, Homo sapiens
tctagtcctattctat

SEQ ID NO: 2819859 - DNA, 14 bp, Homo sapiens
tctagtgccctcca

SEQ ID NO: 2819860 - DNA, 20 bp, Homo sapiens
tctagtgccctccacagccg

SEQ ID NO: 2819861 - DNA, 21 bp, Homo sapiens
tctagttagcaggaaatagtg

SEQ ID NO: 2819862 - DNA, 14 bp, Homo sapiens
tctagtttcttgtg

SEQ ID NO: 2819863 - DNA, 19 bp, Homo sapiens
tctataatggaaacattta

SEQ ID NO: 2819864 - DNA, 16 bp, Homo sapiens
tctatagactctagga

SEQ ID NO: 2819865 - DNA, 11 bp, Homo sapiens
tctatagagaa

SEQ ID NO: 2819866 - DNA, 13 bp, Homo sapiens
tctatagagaaaa

SEQ ID NO: 2819867 - DNA, 13 bp, Homo sapiens
tctatagctcttc

SEQ ID NO: 2819868 - DNA, 20 bp, Homo sapiens
tctatagctcttctatttaa

SEQ ID NO: 2819869 - DNA, 14 bp, Homo sapiens
tctatagtagtcaa

SEQ ID NO: 2819870 - DNA, 22 bp, Homo sapiens
tctatcaaccccagacactggt

SEQ ID NO: 2819871 - DNA, 15 bp, Homo sapiens
tctatcaatagtcaa

SEQ ID NO: 2819872 - DNA, 17 bp, Homo sapiens
tctatctatataatgta

SEQ ID NO: 2819873 - DNA, 17 bp, Homo sapiens
tctatctggaatttaat

SEQ ID NO: 2819874 - DNA, 13 bp, Homo sapiens
tctatctgtattt

SEQ ID NO: 2819875 - DNA, 16 bp, Homo sapiens
tctatcttatatagtt

SEQ ID NO: 2819876 - DNA, 21 bp, Homo sapiens
tctatgcaatttttaaactag

SEQ ID NO: 2819877 - DNA, 14 bp, Homo sapiens
tctatgcattttct

SEQ ID NO: 2819878 - DNA, 14 bp, Homo sapiens
tctatgccagctca

SEQ ID NO: 2819879 - DNA, 16 bp, Homo sapiens
tctatggcagtccagc

SEQ ID NO: 2819880 - DNA, 19 bp, Homo sapiens
tctattctctcctcagact

SEQ ID NO: 2819881 - DNA, 14 bp, Homo sapiens
tctattgtagcatt

SEQ ID NO: 2819882 - DNA, 14 bp, Homo sapiens
tctatttaaaaaat

SEQ ID NO: 2819883 - DNA, 20 bp, Homo sapiens
tctatttaaaaaataaaaaa

SEQ ID NO: 2819884 - DNA, 16 bp, Homo sapiens
tctatttttcttctaa

SEQ ID NO: 2819885 - DNA, 14 bp, Homo sapiens
tctcaaactggggc

SEQ ID NO: 2819886 - DNA, 19 bp, Homo sapiens
tctcaaatgctaaatgcaa

SEQ ID NO: 2819887 - DNA, 21 bp, Homo sapiens
tctcaacctaccaccccttcc

SEQ ID NO: 2819888 - DNA, 19 bp, Homo sapiens
tctcaagcactaaaaagtg

SEQ ID NO: 2819889 - DNA, 20 bp, Homo sapiens
tctcaatattcaataaagct

SEQ ID NO: 2819890 - DNA, 14 bp, Homo sapiens
tctctctatatata

SEQ ID NO: 2819891 - DNA, 18 bp, Homo sapiens
tctctctatatatacatg

SEQ ID NO: 2819892 - DNA, 13 bp, Homo sapiens
tctctctatctgg

SEQ ID NO: 2819893 - DNA, 12 bp, Homo sapiens
tctctctctggt

SEQ ID NO: 2819894 - DNA, 12 bp, Homo sapiens
tctctgagactg

SEQ ID NO: 2819895 - DNA, 14 bp, Homo sapiens
tctctgagactgct

SEQ ID NO: 2819896 - DNA, 19 bp, Homo sapiens
tctctgattttcaaagctt

SEQ ID NO: 2819897 - DNA, 17 bp, Homo sapiens
tctctgcagccagccca

SEQ ID NO: 2819898 - DNA, 21 bp, Homo sapiens
tctctgcccccagcctctgtc

SEQ ID NO: 2819899 - DNA, 13 bp, Homo sapiens
tctctgctgaagg

SEQ ID NO: 2819900 - DNA, 21 bp, Homo sapiens
tctctgggcttggggcttcct

SEQ ID NO: 2819901 - DNA, 16 bp, Homo sapiens
tctctgtccctcactg

SEQ ID NO: 2819902 - DNA, 22 bp, Homo sapiens
tctctgtgaacgatttagaaag

SEQ ID NO: 2819903 - DNA, 21 bp, Homo sapiens
tctctgtgctttgactcacct

SEQ ID NO: 2819904 - DNA, 22 bp, Homo sapiens
tctctgtgctttgactcacctg

SEQ ID NO: 2819905 - DNA, 18 bp, Homo sapiens
tctctgtgtgcacaaata

SEQ ID NO: 2819906 - DNA, 14 bp, Homo sapiens
tctctgttcatttc

SEQ ID NO: 2819907 - DNA, 17 bp, Homo sapiens
tctctgttcatttcctc

SEQ ID NO: 2819908 - DNA, 18 bp, Homo sapiens
tctcttatagaatattta

SEQ ID NO: 2819909 - DNA, 21 bp, Homo sapiens
tctcttatagaatatttatta

SEQ ID NO: 2819910 - DNA, 15 bp, Homo sapiens
tctcttcaggttctt

SEQ ID NO: 2819911 - DNA, 20 bp, Homo sapiens
tctcttccctaatcctccaa

SEQ ID NO: 2819912 - DNA, 11 bp, Homo sapiens
tctcttcctgt

SEQ ID NO: 2819913 - DNA, 12 bp, Homo sapiens
tctcttcctgta

SEQ ID NO: 2819914 - DNA, 17 bp, Homo sapiens
tctctttaatcttcagt

SEQ ID NO: 2819915 - DNA, 22 bp, Homo sapiens
tctctttaatgtcacaggcagg

SEQ ID NO: 2819916 - DNA, 21 bp, Homo sapiens
tctctttcttattttgtaata

SEQ ID NO: 2819917 - DNA, 14 bp, Homo sapiens
tctctttgcctcaa

SEQ ID NO: 2819918 - DNA, 15 bp, Homo sapiens
tctcttttcaaaaca

SEQ ID NO: 2819919 - DNA, 16 bp, Homo sapiens
tctcttttcaaaacat

SEQ ID NO: 2819920 - DNA, 13 bp, Homo sapiens
tctctttttcagt

SEQ ID NO: 2819921 - DNA, 14 bp, Homo sapiens
tctgaaacttaatt

SEQ ID NO: 2819922 - DNA, 19 bp, Homo sapiens
tctgaaacttcataaatgt

SEQ ID NO: 2819923 - DNA, 21 bp, Homo sapiens
tctgaacacatactagaaagc

SEQ ID NO: 2819924 - DNA, 15 bp, Homo sapiens
tctgaaccactttgc

SEQ ID NO: 2819925 - DNA, 17 bp, Homo sapiens
tctgaaccactttgcct

SEQ ID NO: 2819926 - DNA, 21 bp, Homo sapiens
tctgaaggacattgcggacag

SEQ ID NO: 2819927 - DNA, 16 bp, Homo sapiens
tctgaataacatttgt

SEQ ID NO: 2819928 - DNA, 15 bp, Homo sapiens
tctgaataatttctt

SEQ ID NO: 2819929 - DNA, 16 bp, Homo sapiens
tctgaataatttctta

SEQ ID NO: 2819930 - DNA, 16 bp, Homo sapiens
tctgaatttttaaaca

SEQ ID NO: 2819931 - DNA, 17 bp, Homo sapiens
tctgaatttttaaacaa

SEQ ID NO: 2819932 - DNA, 16 bp, Homo sapiens
tctgacacacagctct

SEQ ID NO: 2819933 - DNA, 19 bp, Homo sapiens
tctgacacacagctctgtc

SEQ ID NO: 2819934 - DNA, 22 bp, Homo sapiens
tctgacaggcaatgctggctgt

SEQ ID NO: 2819935 - DNA, 14 bp, Homo sapiens
tctgacccactgct

SEQ ID NO: 2819936 - DNA, 15 bp, Homo sapiens
tctgacccactgctt

SEQ ID NO: 2819937 - DNA, 14 bp, Homo sapiens
tctgacctgcaggc

SEQ ID NO: 2819938 - DNA, 17 bp, Homo sapiens
tctgacctgcaggccaa

SEQ ID NO: 2819939 - DNA, 14 bp, Homo sapiens
tctgactcacaaga

SEQ ID NO: 2819940 - DNA, 17 bp, Homo sapiens
tctgactcttgcctttc

SEQ ID NO: 2819941 - DNA, 23 bp, Homo sapiens
tctgactcttgcctttccacctg

SEQ ID NO: 2819942 - DNA, 22 bp, Homo sapiens
tctgagaaaagctttgaaccct

SEQ ID NO: 2819943 - DNA, 17 bp, Homo sapiens
tctgagaaggtccttaa

SEQ ID NO: 2819944 - DNA, 18 bp, Homo sapiens
tctgagaaggtccttaat

SEQ ID NO: 2819945 - DNA, 14 bp, Homo sapiens
tctgagaagtgtat

SEQ ID NO: 2819946 - DNA, 18 bp, Homo sapiens
tctgagaggacttttctt

SEQ ID NO: 2819947 - DNA, 17 bp, Homo sapiens
tctgagcaagagctggc

SEQ ID NO: 2819948 - DNA, 15 bp, Homo sapiens
tctgagcaccccctc

SEQ ID NO: 2819949 - DNA, 20 bp, Homo sapiens
tctgagcaccccctcattcc

SEQ ID NO: 2819950 - DNA, 21 bp, Homo sapiens
tctgagcaccccctcattccc

SEQ ID NO: 2819951 - DNA, 13 bp, Homo sapiens
tctgagctggccc

SEQ ID NO: 2819952 - DNA, 20 bp, Homo sapiens
tctgagctggccctttccag

SEQ ID NO: 2819953 - DNA, 16 bp, Homo sapiens
tctgaggaatccagac

SEQ ID NO: 2819954 - DNA, 17 bp, Homo sapiens
tctgaggaatccagacc

SEQ ID NO: 2819955 - DNA, 21 bp, Homo sapiens
tctgaggaatccagacccggc

SEQ ID NO: 2819956 - DNA, 20 bp, Homo sapiens
tctgaggacactaaccacgc

SEQ ID NO: 2819957 - DNA, 13 bp, Homo sapiens
tctgaggccagcc

SEQ ID NO: 2819958 - DNA, 21 bp, Homo sapiens
tctgaggccccttaactcatc

SEQ ID NO: 2819959 - DNA, 21 bp, Homo sapiens
tctgaggcgccccaacccgtg

SEQ ID NO: 2819960 - DNA, 16 bp, Homo sapiens
tctgagggagaggctg

SEQ ID NO: 2819961 - DNA, 24 bp, Homo sapiens
tctgagtgtttttactacagttgt

SEQ ID NO: 2819962 - DNA, 17 bp, Homo sapiens
tctgagttcctgcatgc

SEQ ID NO: 2819963 - DNA, 13 bp, Homo sapiens
tctgataaacaca

SEQ ID NO: 2819964 - DNA, 23 bp, Homo sapiens
tctgatccctcgcccccacaccc

SEQ ID NO: 2819965 - DNA, 18 bp, Homo sapiens
tctgatcgggataacaaa

SEQ ID NO: 2819966 - DNA, 19 bp, Homo sapiens
tctgatcgggataacaaaa

SEQ ID NO: 2819967 - DNA, 20 bp, Homo sapiens
tctgatcgggataacaaaat

SEQ ID NO: 2819968 - DNA, 19 bp, Homo sapiens
tctgattcccaagctctgc

SEQ ID NO: 2819969 - DNA, 21 bp, Homo sapiens
tctgattcccaagctctgctc

SEQ ID NO: 2819970 - DNA, 21 bp, Homo sapiens
tctgattggacattttcttca

SEQ ID NO: 2819971 - DNA, 17 bp, Homo sapiens
tctgattggctcaccca

SEQ ID NO: 2819972 - DNA, 18 bp, Homo sapiens
tctgattggctcacccaa

SEQ ID NO: 2819973 - DNA, 15 bp, Homo sapiens
tctgcacatgtcttg

SEQ ID NO: 2819974 - DNA, 20 bp, Homo sapiens
tctgcacatgtcttgtacat

SEQ ID NO: 2819975 - DNA, 22 bp, Homo sapiens
tctgcacatgtcttgtacatgt

SEQ ID NO: 2819976 - DNA, 13 bp, Homo sapiens
tctgcacccaggg

SEQ ID NO: 2819977 - DNA, 15 bp, Homo sapiens
tctgcacccaggggt

SEQ ID NO: 2819978 - DNA, 12 bp, Homo sapiens
tctgcagagcag

SEQ ID NO: 2819979 - DNA, 21 bp, Homo sapiens
tctgcagcactttaaccctct

SEQ ID NO: 2819980 - DNA, 20 bp, Homo sapiens
tctgcagtagtctctgtgct

SEQ ID NO: 2819981 - DNA, 14 bp, Homo sapiens
tctgccacctcccc

SEQ ID NO: 2819982 - DNA, 13 bp, Homo sapiens
tctgccagccaca

SEQ ID NO: 2819983 - DNA, 13 bp, Homo sapiens
tctgccagccagc

SEQ ID NO: 2819984 - DNA, 16 bp, Homo sapiens
tctgccagccagcagc

SEQ ID NO: 2819985 - DNA, 22 bp, Homo sapiens
tctgccatattctgttggccag

SEQ ID NO: 2819986 - DNA, 23 bp, Homo sapiens
tctgccatattctgttggccagt

SEQ ID NO: 2819987 - DNA, 22 bp, Homo sapiens
tctgcccccgtcttctctccat

SEQ ID NO: 2819988 - DNA, 12 bp, Homo sapiens
tctgcctcccta

SEQ ID NO: 2819989 - DNA, 15 bp, Homo sapiens
tctgcctctgacaca

SEQ ID NO: 2819990 - DNA, 19 bp, Homo sapiens
tctgcctgaagtcacacag

SEQ ID NO: 2819991 - DNA, 13 bp, Homo sapiens
tctgcctgcccag

SEQ ID NO: 2819992 - DNA, 18 bp, Homo sapiens
tctgcctgcccaggcccc

SEQ ID NO: 2819993 - DNA, 14 bp, Homo sapiens
tctgcctgtctccc

SEQ ID NO: 2819994 - DNA, 14 bp, Homo sapiens
tctgctaataaaac

SEQ ID NO: 2819995 - DNA, 14 bp, Homo sapiens
tctgctacctcact

SEQ ID NO: 2819996 - DNA, 22 bp, Homo sapiens
tctgctcagtaatttgaggaca

SEQ ID NO: 2819997 - DNA, 14 bp, Homo sapiens
tctgctcctcccat

SEQ ID NO: 2819998 - DNA, 20 bp, Homo sapiens
tctgctcctcccattcccct

SEQ ID NO: 2819999 - DNA, 16 bp, Homo sapiens
tctgctcctctccagg

SEQ ID NO: 2820000 - DNA, 17 bp, Homo sapiens
tctgctcctctccaggc

SEQ ID NO: 2820001 - DNA, 13 bp, Homo sapiens
tctgctctgatgc

SEQ ID NO: 2820002 - DNA, 16 bp, Homo sapiens
tctgctcttgcctgca

SEQ ID NO: 2820003 - DNA, 23 bp, Homo sapiens
tctgctgccccgcttccccacag

SEQ ID NO: 2820004 - DNA, 15 bp, Homo sapiens
tctgcttcagcctcc

SEQ ID NO: 2820005 - DNA, 19 bp, Homo sapiens
tctgcttgtattttccata

SEQ ID NO: 2820006 - DNA, 19 bp, Homo sapiens
tctggaaaactcaggattc

SEQ ID NO: 2820007 - DNA, 18 bp, Homo sapiens
tctggaaaatgtgaccca

SEQ ID NO: 2820008 - DNA, 13 bp, Homo sapiens
tctggaagagagg

SEQ ID NO: 2820009 - DNA, 14 bp, Homo sapiens
tctggaatacatga

SEQ ID NO: 2820010 - DNA, 18 bp, Homo sapiens
tctggaatgtaatcaatg

SEQ ID NO: 2820011 - DNA, 14 bp, Homo sapiens
tctggaatttaatt

SEQ ID NO: 2820012 - DNA, 23 bp, Homo sapiens
tctggacaagccaacttgtaaat

SEQ ID NO: 2820013 - DNA, 22 bp, Homo sapiens
tctggaccaaccctgtttcctg

SEQ ID NO: 2820014 - DNA, 23 bp, Homo sapiens
tctggaccaaccctgtttcctga

SEQ ID NO: 2820015 - DNA, 16 bp, Homo sapiens
tctggactcctctgtc

SEQ ID NO: 2820016 - DNA, 11 bp, Homo sapiens
tctggagaagc

SEQ ID NO: 2820017 - DNA, 16 bp, Homo sapiens
tctggagaagcagtga

SEQ ID NO: 2820018 - DNA, 13 bp, Homo sapiens
tctggagcccttg

SEQ ID NO: 2820019 - DNA, 18 bp, Homo sapiens
tctggatggcaccagagg

SEQ ID NO: 2820020 - DNA, 16 bp, Homo sapiens
tctggatttttacaaa

SEQ ID NO: 2820021 - DNA, 12 bp, Homo sapiens
tctggcacccag

SEQ ID NO: 2820022 - DNA, 15 bp, Homo sapiens
tctggcagccacact

SEQ ID NO: 2820023 - DNA, 18 bp, Homo sapiens
tctggcagccacacttct

SEQ ID NO: 2820024 - DNA, 13 bp, Homo sapiens
tctggccccaggc

SEQ ID NO: 2820025 - DNA, 13 bp, Homo sapiens
tctggccctgcct

SEQ ID NO: 2820026 - DNA, 15 bp, Homo sapiens
tctggcctcagacca

SEQ ID NO: 2820027 - DNA, 15 bp, Homo sapiens
tctggcgcaagagaa

SEQ ID NO: 2820028 - DNA, 18 bp, Homo sapiens
tctggctgaacactggca

SEQ ID NO: 2820029 - DNA, 21 bp, Homo sapiens
tctggctgagctgaacccatt

SEQ ID NO: 2820030 - DNA, 21 bp, Homo sapiens
tctggctggctaactggaagc

SEQ ID NO: 2820031 - DNA, 20 bp, Homo sapiens
tctggctgtacgtctggtgt

SEQ ID NO: 2820032 - DNA, 23 bp, Homo sapiens
tctggcttccagaaaaccccagc

SEQ ID NO: 2820033 - DNA, 13 bp, Homo sapiens
tctggcttccagg

SEQ ID NO: 2820034 - DNA, 18 bp, Homo sapiens
tctgggaaataagagaga

SEQ ID NO: 2820035 - DNA, 15 bp, Homo sapiens
tctgggaccctttcc

SEQ ID NO: 2820036 - DNA, 13 bp, Homo sapiens
tctgggacctcag

SEQ ID NO: 2820037 - DNA, 18 bp, Homo sapiens
tctgggaggtcttggccg

SEQ ID NO: 2820038 - DNA, 16 bp, Homo sapiens
tctgggccaagttcct

SEQ ID NO: 2820039 - DNA, 19 bp, Homo sapiens
tctgggccaagttcctcta

SEQ ID NO: 2820040 - DNA, 21 bp, Homo sapiens
tctgggctcctggaaccaatc

SEQ ID NO: 2820041 - DNA, 22 bp, Homo sapiens
tctgggctcctggaaccaatcc

SEQ ID NO: 2820042 - DNA, 19 bp, Homo sapiens
tctgggcttggggcttcct

SEQ ID NO: 2820043 - DNA, 21 bp, Homo sapiens
tctgggcttggggcttcctaa

SEQ ID NO: 2820044 - DNA, 22 bp, Homo sapiens
tctggtatgaacttgaggacac

SEQ ID NO: 2820045 - DNA, 23 bp, Homo sapiens
tctggtatgaacttgaggacaca

SEQ ID NO: 2820046 - DNA, 20 bp, Homo sapiens
tctgtaacgcctgcttgtcc

SEQ ID NO: 2820047 - DNA, 17 bp, Homo sapiens
tctgtaaggaactggaa

SEQ ID NO: 2820048 - DNA, 17 bp, Homo sapiens
tctgtacgtctgacagg

SEQ ID NO: 2820049 - DNA, 20 bp, Homo sapiens
tctgtattttcatttaacta

SEQ ID NO: 2820050 - DNA, 16 bp, Homo sapiens
tctgtcacgtgaaata

SEQ ID NO: 2820051 - DNA, 18 bp, Homo sapiens
tctgtcacgtgaaatatt

SEQ ID NO: 2820052 - DNA, 12 bp, Homo sapiens
tctgtcatcccg

SEQ ID NO: 2820053 - DNA, 19 bp, Homo sapiens
tctgtcatcccgctcctgc

SEQ ID NO: 2820054 - DNA, 13 bp, Homo sapiens
tctgtccaaggaa

SEQ ID NO: 2820055 - DNA, 13 bp, Homo sapiens
tctgtccaaggca

SEQ ID NO: 2820056 - DNA, 12 bp, Homo sapiens
tctgtccactct

SEQ ID NO: 2820057 - DNA, 20 bp, Homo sapiens
tctgtccagggccctgagct

SEQ ID NO: 2820058 - DNA, 16 bp, Homo sapiens
tctgtccctcactgcc

SEQ ID NO: 2820059 - DNA, 21 bp, Homo sapiens
tctgtccctcactgccttcca

SEQ ID NO: 2820060 - DNA, 20 bp, Homo sapiens
tctgtccgtttactccaagg

SEQ ID NO: 2820061 - DNA, 12 bp, Homo sapiens
tctgtcctggga

SEQ ID NO: 2820062 - DNA, 21 bp, Homo sapiens
tctgtcctgggagtgagctgg

SEQ ID NO: 2820063 - DNA, 19 bp, Homo sapiens
tctgtccttttggcactga

SEQ ID NO: 2820064 - DNA, 17 bp, Homo sapiens
tctgtcgcccagtctgg

SEQ ID NO: 2820065 - DNA, 21 bp, Homo sapiens
tctgtctcaaaaaataaaaat

SEQ ID NO: 2820066 - DNA, 22 bp, Homo sapiens
tctgtctcgagcgccctgcaga

SEQ ID NO: 2820067 - DNA, 14 bp, Homo sapiens
tctgtgaaatcaga

SEQ ID NO: 2820068 - DNA, 22 bp, Homo sapiens
tctgtgaaatcagaagtgcaaa

SEQ ID NO: 2820069 - DNA, 15 bp, Homo sapiens
tctgtgaagaatgaa

SEQ ID NO: 2820070 - DNA, 15 bp, Homo sapiens
tgacaagcactgcta

SEQ ID NO: 2820071 - DNA, 18 bp, Homo sapiens
tgacaaggattgctactg

SEQ ID NO: 2820072 - DNA, 23 bp, Homo sapiens
tgacaaggattgctactgtccta

SEQ ID NO: 2820073 - DNA, 20 bp, Homo sapiens
tgacaagtcattttaacttt

SEQ ID NO: 2820074 - DNA, 12 bp, Homo sapiens
tgacacacagca

SEQ ID NO: 2820075 - DNA, 15 bp, Homo sapiens
tgacacacagcactc

SEQ ID NO: 2820076 - DNA, 16 bp, Homo sapiens
tgacacacagcactct

SEQ ID NO: 2820077 - DNA, 14 bp, Homo sapiens
tgacacacagctct

SEQ ID NO: 2820078 - DNA, 15 bp, Homo sapiens
tgacacacagctctg

SEQ ID NO: 2820079 - DNA, 19 bp, Homo sapiens
tgacacacagctctgtcct

SEQ ID NO: 2820080 - DNA, 20 bp, Homo sapiens
tgacacacagctctgtcctg

SEQ ID NO: 2820081 - DNA, 19 bp, Homo sapiens
tgacacacgtatttatatt

SEQ ID NO: 2820082 - DNA, 22 bp, Homo sapiens
tgacacataatttgaatggtgc

SEQ ID NO: 2820083 - DNA, 21 bp, Homo sapiens
tgacacatatgcaccttgtgt

SEQ ID NO: 2820084 - DNA, 17 bp, Homo sapiens
tgacacccaagagggct

SEQ ID NO: 2820085 - DNA, 20 bp, Homo sapiens
tgacactttgccagaaagca

SEQ ID NO: 2820086 - DNA, 13 bp, Homo sapiens
tgacagaacactg

SEQ ID NO: 2820087 - DNA, 20 bp, Homo sapiens
tgacagacacaggcccggct

SEQ ID NO: 2820088 - DNA, 15 bp, Homo sapiens
tgacagagacccaga

SEQ ID NO: 2820089 - DNA, 18 bp, Homo sapiens
tgacagagacccagatct

SEQ ID NO: 2820090 - DNA, 16 bp, Homo sapiens
tgacagaggcagcccc

SEQ ID NO: 2820091 - DNA, 19 bp, Homo sapiens
tgacagatgtcagccgagc

SEQ ID NO: 2820092 - DNA, 19 bp, Homo sapiens
tgacagatgttgaatgccc

SEQ ID NO: 2820093 - DNA, 20 bp, Homo sapiens
tgacagctaggatgtgcatt

SEQ ID NO: 2820094 - DNA, 22 bp, Homo sapiens
tgacagctaggatgtgcattct

SEQ ID NO: 2820095 - DNA, 19 bp, Homo sapiens
tgacaggcaatgctggctg

SEQ ID NO: 2820096 - DNA, 19 bp, Homo sapiens
tgacagtgctctaggctgc

SEQ ID NO: 2820097 - DNA, 21 bp, Homo sapiens
tgacagtgctctaggctgccc

SEQ ID NO: 2820098 - DNA, 16 bp, Homo sapiens
tgacagtggaactaca

SEQ ID NO: 2820099 - DNA, 19 bp, Homo sapiens
tgacagtgttgaaaatgtt

SEQ ID NO: 2820100 - DNA, 21 bp, Homo sapiens
tgacagttactcttcagtttt

SEQ ID NO: 2820101 - DNA, 14 bp, Homo sapiens
tgacataaagttga

SEQ ID NO: 2820102 - DNA, 16 bp, Homo sapiens
tgacataaagttgata

SEQ ID NO: 2820103 - DNA, 19 bp, Homo sapiens
tgacatcacttgtacaaaa

SEQ ID NO: 2820104 - DNA, 20 bp, Homo sapiens
tgacatcacttgtacaaaat

SEQ ID NO: 2820105 - DNA, 21 bp, Homo sapiens
tgacatcacttgtacaaaata

SEQ ID NO: 2820106 - DNA, 23 bp, Homo sapiens
tgacatcacttgtacaaaataaa

SEQ ID NO: 2820107 - DNA, 12 bp, Homo sapiens
tgacatctcttt

SEQ ID NO: 2820108 - DNA, 14 bp, Homo sapiens
tgacatctctttga

SEQ ID NO: 2820109 - DNA, 16 bp, Homo sapiens
tgacatgggtgtgcca

SEQ ID NO: 2820110 - DNA, 18 bp, Homo sapiens
tgacattgtagagcttct

SEQ ID NO: 2820111 - DNA, 22 bp, Homo sapiens
tgacatttccttctttgtctta

SEQ ID NO: 2820112 - DNA, 18 bp, Homo sapiens
tgacattttaaaaaacaa

SEQ ID NO: 2820113 - DNA, 15 bp, Homo sapiens
tgaccaaaagttaca

SEQ ID NO: 2820114 - DNA, 17 bp, Homo sapiens
tgaccaacagttccttc

SEQ ID NO: 2820115 - DNA, 18 bp, Homo sapiens
tgaccaacatggagaaac

SEQ ID NO: 2820116 - DNA, 13 bp, Homo sapiens
tgaccaagttata

SEQ ID NO: 2820117 - DNA, 15 bp, Homo sapiens
tgaccaatctctgtg

SEQ ID NO: 2820118 - DNA, 17 bp, Homo sapiens
tgaccaatctctgtgac

SEQ ID NO: 2820119 - DNA, 19 bp, Homo sapiens
tgaccaatctctgtgactc

SEQ ID NO: 2820120 - DNA, 21 bp, Homo sapiens
tgaccacgctttctagctgtt

SEQ ID NO: 2820121 - DNA, 14 bp, Homo sapiens
tgacccacagcctc

SEQ ID NO: 2820122 - DNA, 12 bp, Homo sapiens
tgacccactgct

SEQ ID NO: 2820123 - DNA, 18 bp, Homo sapiens
tgacccagccccttgaga

SEQ ID NO: 2820124 - DNA, 19 bp, Homo sapiens
tgacccagccccttgagaa

SEQ ID NO: 2820125 - DNA, 12 bp, Homo sapiens
tgacccagtccc

SEQ ID NO: 2820126 - DNA, 14 bp, Homo sapiens
tgacccagtccctg

SEQ ID NO: 2820127 - DNA, 15 bp, Homo sapiens
tgacccagtccctgg

SEQ ID NO: 2820128 - DNA, 13 bp, Homo sapiens
tgaccccagggca

SEQ ID NO: 2820129 - DNA, 18 bp, Homo sapiens
tgaccccagggcacagga

SEQ ID NO: 2820130 - DNA, 21 bp, Homo sapiens
tgaccccagggcacaggagct

SEQ ID NO: 2820131 - DNA, 18 bp, Homo sapiens
tgacccggcaccccctgc

SEQ ID NO: 2820132 - DNA, 15 bp, Homo sapiens
tgaccctcctgtcca

SEQ ID NO: 2820133 - DNA, 16 bp, Homo sapiens
tgaccgagtctaggaa

SEQ ID NO: 2820134 - DNA, 22 bp, Homo sapiens
tgaccgagtctaggaatgcttt

SEQ ID NO: 2820135 - DNA, 23 bp, Homo sapiens
tgacctatacctgtgtttcttgc

SEQ ID NO: 2820136 - DNA, 13 bp, Homo sapiens
tgacctccagctt

SEQ ID NO: 2820137 - DNA, 11 bp, Homo sapiens
tgacctcccag

SEQ ID NO: 2820138 - DNA, 13 bp, Homo sapiens
tgacctgccccgc

SEQ ID NO: 2820139 - DNA, 19 bp, Homo sapiens
tgacctgccccgcccagct

SEQ ID NO: 2820140 - DNA, 12 bp, Homo sapiens
tgacctgctgag

SEQ ID NO: 2820141 - DNA, 15 bp, Homo sapiens
tgacctgctgagctc

SEQ ID NO: 2820142 - DNA, 20 bp, Homo sapiens
tgacctgctgagctctgaga

SEQ ID NO: 2820143 - DNA, 17 bp, Homo sapiens
tgaccttctaggaagct

SEQ ID NO: 2820144 - DNA, 14 bp, Homo sapiens
tgactaaaaatatt

SEQ ID NO: 2820145 - DNA, 17 bp, Homo sapiens
tgactagaggcagggag

SEQ ID NO: 2820146 - DNA, 15 bp, Homo sapiens
tgactataaacatta

SEQ ID NO: 2820147 - DNA, 14 bp, Homo sapiens
tgactatcacatac

SEQ ID NO: 2820148 - DNA, 22 bp, Homo sapiens
tgactatcacatacaatttgca

SEQ ID NO: 2820149 - DNA, 18 bp, Homo sapiens
tgactcaagtttttacaa

SEQ ID NO: 2820150 - DNA, 13 bp, Homo sapiens
tgactcacccaag

SEQ ID NO: 2820151 - DNA, 14 bp, Homo sapiens
tgactcacccaagc

SEQ ID NO: 2820152 - DNA, 21 bp, Homo sapiens
tgactcagcatacctgctggt

SEQ ID NO: 2820153 - DNA, 13 bp, Homo sapiens
tgactctctgtga

SEQ ID NO: 2820154 - DNA, 15 bp, Homo sapiens
tgactctctgtgacc

SEQ ID NO: 2820155 - DNA, 14 bp, Homo sapiens
tgactgatgacaaa

SEQ ID NO: 2820156 - DNA, 16 bp, Homo sapiens
tgactgcgatcttcag

SEQ ID NO: 2820157 - DNA, 21 bp, Homo sapiens
tgactgggtttctctgtatag

SEQ ID NO: 2820158 - DNA, 18 bp, Homo sapiens
tgactgtaaacatagata

SEQ ID NO: 2820159 - DNA, 19 bp, Homo sapiens
tgacttactgtttcttacc

SEQ ID NO: 2820160 - DNA, 17 bp, Homo sapiens
tgacttgacagaacact

SEQ ID NO: 2820161 - DNA, 21 bp, Homo sapiens
tgacttgcagagttcatggaa

SEQ ID NO: 2820162 - DNA, 22 bp, Homo sapiens
tgacttgggcacccccagcctg

SEQ ID NO: 2820163 - DNA, 22 bp, Homo sapiens
tgactttttataatgtggattt

SEQ ID NO: 2820164 - DNA, 16 bp, Homo sapiens
tgactttttcagagtt

SEQ ID NO: 2820165 - DNA, 19 bp, Homo sapiens
tgagaaaccagccgaccgg

SEQ ID NO: 2820166 - DNA, 13 bp, Homo sapiens
tgagaaatttaaa

SEQ ID NO: 2820167 - DNA, 12 bp, Homo sapiens
tgagaacctggc

SEQ ID NO: 2820168 - DNA, 15 bp, Homo sapiens
tgagaagagggcctg

SEQ ID NO: 2820169 - DNA, 23 bp, Homo sapiens
tgagaagagggcctgtgggagcc

SEQ ID NO: 2820170 - DNA, 19 bp, Homo sapiens
tgagaagttaagcagcctt

SEQ ID NO: 2820171 - DNA, 18 bp, Homo sapiens
tgagaataattgtgtaca

SEQ ID NO: 2820172 - DNA, 19 bp, Homo sapiens
tgagaatcgacctcactgt

SEQ ID NO: 2820173 - DNA, 15 bp, Homo sapiens
tgagaattttaaatt

SEQ ID NO: 2820174 - DNA, 12 bp, Homo sapiens
tgagaccacctc

SEQ ID NO: 2820175 - DNA, 12 bp, Homo sapiens
tgagaccctgtc

SEQ ID NO: 2820176 - DNA, 14 bp, Homo sapiens
tgagaccctgtctc

SEQ ID NO: 2820177 - DNA, 15 bp, Homo sapiens
tgagaccctgtctct

SEQ ID NO: 2820178 - DNA, 12 bp, Homo sapiens
tgagacctcagc

SEQ ID NO: 2820179 - DNA, 16 bp, Homo sapiens
tgagacctcagccatg

SEQ ID NO: 2820180 - DNA, 12 bp, Homo sapiens
tgagactctgtc

SEQ ID NO: 2820181 - DNA, 13 bp, Homo sapiens
tgagactctgtct

SEQ ID NO: 2820182 - DNA, 20 bp, Homo sapiens
tgagactctgtctcaaaaaa

SEQ ID NO: 2820183 - DNA, 16 bp, Homo sapiens
tgagactgacacctca

SEQ ID NO: 2820184 - DNA, 22 bp, Homo sapiens
tgagactgcgggatggtcctgg

SEQ ID NO: 2820185 - DNA, 15 bp, Homo sapiens
tgagacttagataat

SEQ ID NO: 2820186 - DNA, 18 bp, Homo sapiens
tgagagacattaactcat

SEQ ID NO: 2820187 - DNA, 20 bp, Homo sapiens
tgagagacccaaggaggaaa

SEQ ID NO: 2820188 - DNA, 15 bp, Homo sapiens
tgagagagtgctgag

SEQ ID NO: 2820189 - DNA, 23 bp, Homo sapiens
tgagaggacttttctttgtggct

SEQ ID NO: 2820190 - DNA, 18 bp, Homo sapiens
tgagaggcagacttccct

SEQ ID NO: 2820191 - DNA, 17 bp, Homo sapiens
tgagaggccctggatca

SEQ ID NO: 2820192 - DNA, 13 bp, Homo sapiens
tgagagtgtgacc

SEQ ID NO: 2820193 - DNA, 17 bp, Homo sapiens
tgagataatatctgtga

SEQ ID NO: 2820194 - DNA, 18 bp, Homo sapiens
tgagataatatctgtgag

SEQ ID NO: 2820195 - DNA, 19 bp, Homo sapiens
tgagataatatctgtgagg

SEQ ID NO: 2820196 - DNA, 20 bp, Homo sapiens
tgagatatacaaatatattt

SEQ ID NO: 2820197 - DNA, 15 bp, Homo sapiens
tgagatatttattgt

SEQ ID NO: 2820198 - DNA, 20 bp, Homo sapiens
tgagatatttattgtttatt

SEQ ID NO: 2820199 - DNA, 22 bp, Homo sapiens
tgagatccaagttgaaatcaga

SEQ ID NO: 2820200 - DNA, 20 bp, Homo sapiens
tgagatttgtatttatatta

SEQ ID NO: 2820201 - DNA, 15 bp, Homo sapiens
tgagcaaatgtggct

SEQ ID NO: 2820202 - DNA, 20 bp, Homo sapiens
tgagcaagatcttgtctcca

SEQ ID NO: 2820203 - DNA, 21 bp, Homo sapiens
tgagcaagatcttgtctccac

SEQ ID NO: 2820204 - DNA, 16 bp, Homo sapiens
tgagcacatctgggag

SEQ ID NO: 2820205 - DNA, 21 bp, Homo sapiens
tgagcacatctgggaggctgg

SEQ ID NO: 2820206 - DNA, 23 bp, Homo sapiens
tgagcaccccctcattcccctcg

SEQ ID NO: 2820207 - DNA, 12 bp, Homo sapiens
tgagcacctgct

SEQ ID NO: 2820208 - DNA, 21 bp, Homo sapiens
tgagcacctgcttcatgctca

SEQ ID NO: 2820209 - DNA, 20 bp, Homo sapiens
tgagcactaaggtgtgctct

SEQ ID NO: 2820210 - DNA, 17 bp, Homo sapiens
tgagcactctactgcaa

SEQ ID NO: 2820211 - DNA, 14 bp, Homo sapiens
tgagcactgccagg

SEQ ID NO: 2820212 - DNA, 15 bp, Homo sapiens
tgagcactgccagga

SEQ ID NO: 2820213 - DNA, 18 bp, Homo sapiens
tgagcactgccaggaggg

SEQ ID NO: 2820214 - DNA, 19 bp, Homo sapiens
tgagcactgccaggaggga

SEQ ID NO: 2820215 - DNA, 12 bp, Homo sapiens
tgagcagggccg

SEQ ID NO: 2820216 - DNA, 13 bp, Homo sapiens
tgagcagggctca

SEQ ID NO: 2820217 - DNA, 22 bp, Homo sapiens
tgagcagggctcagcggggaca

SEQ ID NO: 2820218 - DNA, 23 bp, Homo sapiens
tgagccaaagagaaaagattaaa

SEQ ID NO: 2820219 - DNA, 18 bp, Homo sapiens
tgagccacagaccacctg

SEQ ID NO: 2820220 - DNA, 13 bp, Homo sapiens
tgagccactgcac

SEQ ID NO: 2820221 - DNA, 17 bp, Homo sapiens
tgagcccagggaggccg

SEQ ID NO: 2820222 - DNA, 21 bp, Homo sapiens
tgagccgagatcacgccactg

SEQ ID NO: 2820223 - DNA, 21 bp, Homo sapiens
tgagccgcatcttctccatct

SEQ ID NO: 2820224 - DNA, 15 bp, Homo sapiens
tgagcctagctacct

SEQ ID NO: 2820225 - DNA, 13 bp, Homo sapiens
tgagcctcagcat

SEQ ID NO: 2820226 - DNA, 15 bp, Homo sapiens
tgagcctcagcatcc

SEQ ID NO: 2820227 - DNA, 18 bp, Homo sapiens
tgagcctcagcatcctgg

SEQ ID NO: 2820228 - DNA, 23 bp, Homo sapiens
tgagcggacagaatgatgccaaa

SEQ ID NO: 2820229 - DNA, 17 bp, Homo sapiens
tgagctcacaaggcagc

SEQ ID NO: 2820230 - DNA, 20 bp, Homo sapiens
tgagctcacaaggcagcaag

SEQ ID NO: 2820231 - DNA, 22 bp, Homo sapiens
tgagctcacaaggcagcaaggc

SEQ ID NO: 2820232 - DNA, 23 bp, Homo sapiens
tgagctcacaaggcagcaaggcc

SEQ ID NO: 2820233 - DNA, 17 bp, Homo sapiens
tgagctcagacccccac

SEQ ID NO: 2820234 - DNA, 22 bp, Homo sapiens
tgagctcagacccccactctca

SEQ ID NO: 2820235 - DNA, 16 bp, Homo sapiens
tgagctccccaaaaac

SEQ ID NO: 2820236 - DNA, 21 bp, Homo sapiens
tgagctcggtggacccaggga

SEQ ID NO: 2820237 - DNA, 12 bp, Homo sapiens
tgagctctgaga

SEQ ID NO: 2820238 - DNA, 20 bp, Homo sapiens
tgagctctgagaggccctgg

SEQ ID NO: 2820239 - DNA, 21 bp, Homo sapiens
tgagctctgagaggccctgga

SEQ ID NO: 2820240 - DNA, 12 bp, Homo sapiens
tgagctcttcat

SEQ ID NO: 2820241 - DNA, 18 bp, Homo sapiens
tgagctcttcatgtttca

SEQ ID NO: 2820242 - DNA, 17 bp, Homo sapiens
tgagctgagatcgtgcc

SEQ ID NO: 2820243 - DNA, 21 bp, Homo sapiens
tgaggaatatgactgttttta

SEQ ID NO: 2820244 - DNA, 13 bp, Homo sapiens
tgaggaattttct

SEQ ID NO: 2820245 - DNA, 13 bp, Homo sapiens
tgaggacacatgt

SEQ ID NO: 2820246 - DNA, 23 bp, Homo sapiens
tgaggacttaaaatattcctgca

SEQ ID NO: 2820247 - DNA, 20 bp, Homo sapiens
tgaggagctgttggcctggg

SEQ ID NO: 2820248 - DNA, 13 bp, Homo sapiens
tgaggagtctgag

SEQ ID NO: 2820249 - DNA, 18 bp, Homo sapiens
tgatgagtaacttaacca

SEQ ID NO: 2820250 - DNA, 21 bp, Homo sapiens
tgatgatctttgcagacaggc

SEQ ID NO: 2820251 - DNA, 23 bp, Homo sapiens
tgatgatctttgcagacaggcaa

SEQ ID NO: 2820252 - DNA, 20 bp, Homo sapiens
tgatgattaaacacctgaca

SEQ ID NO: 2820253 - DNA, 18 bp, Homo sapiens
tgatgccaaaaaaaaata

SEQ ID NO: 2820254 - DNA, 21 bp, Homo sapiens
tgatgccaaaaaaaaatacat

SEQ ID NO: 2820255 - DNA, 15 bp, Homo sapiens
tgatgctcaggcttg

SEQ ID NO: 2820256 - DNA, 15 bp, Homo sapiens
tgatggcaattttgt

SEQ ID NO: 2820257 - DNA, 21 bp, Homo sapiens
tgatgggcaacccccagcctg

SEQ ID NO: 2820258 - DNA, 15 bp, Homo sapiens
tgatggggtgggcag

SEQ ID NO: 2820259 - DNA, 17 bp, Homo sapiens
tgatggggtgggcaggg

SEQ ID NO: 2820260 - DNA, 20 bp, Homo sapiens
tgatggggtgggcagggctg

SEQ ID NO: 2820261 - DNA, 21 bp, Homo sapiens
tgatggggtgggcagggctgg

SEQ ID NO: 2820262 - DNA, 22 bp, Homo sapiens
tgatggggtgggcagggctggg

SEQ ID NO: 2820263 - DNA, 15 bp, Homo sapiens
tgatggtgctcccct

SEQ ID NO: 2820264 - DNA, 20 bp, Homo sapiens
tgatgtagggtaaggtgcct

SEQ ID NO: 2820265 - DNA, 18 bp, Homo sapiens
tgatgtgggtcaaggaat

SEQ ID NO: 2820266 - DNA, 12 bp, Homo sapiens
tgatgttaaaaa

SEQ ID NO: 2820267 - DNA, 23 bp, Homo sapiens
tgatgttaaaaaaataagaagaa

SEQ ID NO: 2820268 - DNA, 14 bp, Homo sapiens
tgatgttaaaattc

SEQ ID NO: 2820269 - DNA, 22 bp, Homo sapiens
tgatgttaaccagaataaagtt

SEQ ID NO: 2820270 - DNA, 23 bp, Homo sapiens
tgatgtttccagaaaatataaat

SEQ ID NO: 2820271 - DNA, 19 bp, Homo sapiens
tgattaaacacctgacaca

SEQ ID NO: 2820272 - DNA, 14 bp, Homo sapiens
tgattacacagttg

SEQ ID NO: 2820273 - DNA, 20 bp, Homo sapiens
tgattacataatcaaagcta

SEQ ID NO: 2820274 - DNA, 12 bp, Homo sapiens
tgattcataaca

SEQ ID NO: 2820275 - DNA, 23 bp, Homo sapiens
tgattcataacaatgtatgtgaa

SEQ ID NO: 2820276 - DNA, 17 bp, Homo sapiens
tgattcattttaacatc

SEQ ID NO: 2820277 - DNA, 22 bp, Homo sapiens
tgattcattttaacatctgaga

SEQ ID NO: 2820278 - DNA, 15 bp, Homo sapiens
tgattcccaagctct

SEQ ID NO: 2820279 - DNA, 22 bp, Homo sapiens
tgattcccaagctctgctcctc

SEQ ID NO: 2820280 - DNA, 23 bp, Homo sapiens
tgattcccaagctctgctcctct

SEQ ID NO: 2820281 - DNA, 18 bp, Homo sapiens
tgattcgaatgacactgt

SEQ ID NO: 2820282 - DNA, 19 bp, Homo sapiens
tgattctcctgcctcagcc

SEQ ID NO: 2820283 - DNA, 22 bp, Homo sapiens
tgattgaaaatagtaaatgctt

SEQ ID NO: 2820284 - DNA, 15 bp, Homo sapiens
tgattgacacacagc

SEQ ID NO: 2820285 - DNA, 20 bp, Homo sapiens
tgattgtagtaatctgcatt

SEQ ID NO: 2820286 - DNA, 13 bp, Homo sapiens
tgattgtcttaat

SEQ ID NO: 2820287 - DNA, 20 bp, Homo sapiens
tgatttaaaaaataaatata

SEQ ID NO: 2820288 - DNA, 16 bp, Homo sapiens
tgatttacgctcattg

SEQ ID NO: 2820289 - DNA, 15 bp, Homo sapiens
tgatttcaatgattg

SEQ ID NO: 2820290 - DNA, 22 bp, Homo sapiens
tgatttcagtagcacaagttat

SEQ ID NO: 2820291 - DNA, 15 bp, Homo sapiens
tgatttcattaatac

SEQ ID NO: 2820292 - DNA, 17 bp, Homo sapiens
tgatttcatttcaactg

SEQ ID NO: 2820293 - DNA, 18 bp, Homo sapiens
tgatttccaaagagaaaa

SEQ ID NO: 2820294 - DNA, 13 bp, Homo sapiens
tgattttacagag

SEQ ID NO: 2820295 - DNA, 14 bp, Homo sapiens
tgattttacagaga

SEQ ID NO: 2820296 - DNA, 13 bp, Homo sapiens
tgattttatacat

SEQ ID NO: 2820297 - DNA, 14 bp, Homo sapiens
tgattttatacata

SEQ ID NO: 2820298 - DNA, 22 bp, Homo sapiens
tgattttatacatagtcacaaa

SEQ ID NO: 2820299 - DNA, 15 bp, Homo sapiens
tgattttcatcaatt

SEQ ID NO: 2820300 - DNA, 16 bp, Homo sapiens
tgattttcatcaattt

SEQ ID NO: 2820301 - DNA, 15 bp, Homo sapiens
tgattttgtacagaa

SEQ ID NO: 2820302 - DNA, 16 bp, Homo sapiens
tgattttgtacagaat

SEQ ID NO: 2820303 - DNA, 19 bp, Homo sapiens
tgatttttgttgattaaaa

SEQ ID NO: 2820304 - DNA, 16 bp, Homo sapiens
tgatttttttttttca

SEQ ID NO: 2820305 - DNA, 15 bp, Homo sapiens
tgcaaaatttccagt

SEQ ID NO: 2820306 - DNA, 19 bp, Homo sapiens
tgcaaacactgtgtattta

SEQ ID NO: 2820307 - DNA, 19 bp, Homo sapiens
tgcaaacttgtatctgaag

SEQ ID NO: 2820308 - DNA, 15 bp, Homo sapiens
tgcaaagtgcaaata

SEQ ID NO: 2820309 - DNA, 21 bp, Homo sapiens
tgcaaatgctatgagatgcat

SEQ ID NO: 2820310 - DNA, 18 bp, Homo sapiens
tgcaacaaaatatttaat

SEQ ID NO: 2820311 - DNA, 22 bp, Homo sapiens
tgcaacaagacaaagcaaagcc

SEQ ID NO: 2820312 - DNA, 19 bp, Homo sapiens
tgcaacaggctgggcttca

SEQ ID NO: 2820313 - DNA, 20 bp, Homo sapiens
tgcaacaggctgggcttcag

SEQ ID NO: 2820314 - DNA, 11 bp, Homo sapiens
tgcaaccactg

SEQ ID NO: 2820315 - DNA, 13 bp, Homo sapiens
tgcaaccactgca

SEQ ID NO: 2820316 - DNA, 15 bp, Homo sapiens
tgcaaccactgcaac

SEQ ID NO: 2820317 - DNA, 14 bp, Homo sapiens
tgcaacctccgcct

SEQ ID NO: 2820318 - DNA, 16 bp, Homo sapiens
tgcaacggcttagact

SEQ ID NO: 2820319 - DNA, 15 bp, Homo sapiens
tgcaagaagaatata

SEQ ID NO: 2820320 - DNA, 23 bp, Homo sapiens
tgcaagagccttggtgtccacct

SEQ ID NO: 2820321 - DNA, 19 bp, Homo sapiens
tgcaaggaagccacagctg

SEQ ID NO: 2820322 - DNA, 20 bp, Homo sapiens
tgcaaggaagccacagctgg

SEQ ID NO: 2820323 - DNA, 16 bp, Homo sapiens
tgcaaggaaggaaaga

SEQ ID NO: 2820324 - DNA, 19 bp, Homo sapiens
tgcaaggaaggaaagaaag

SEQ ID NO: 2820325 - DNA, 21 bp, Homo sapiens
tgcaaggccctctatttctct

SEQ ID NO: 2820326 - DNA, 16 bp, Homo sapiens
tgctgcaaagtgcaaa

SEQ ID NO: 2820327 - DNA, 11 bp, Homo sapiens
tgctgccatcc

SEQ ID NO: 2820328 - DNA, 14 bp, Homo sapiens
tgctgccatccagg

SEQ ID NO: 2820329 - DNA, 21 bp, Homo sapiens
tgctgccccgcttccccacag

SEQ ID NO: 2820330 - DNA, 23 bp, Homo sapiens
tgctgccccgcttccccacagaa

SEQ ID NO: 2820331 - DNA, 13 bp, Homo sapiens
tgctgcccctgca

SEQ ID NO: 2820332 - DNA, 17 bp, Homo sapiens
tgctgcccgtcttcagc

SEQ ID NO: 2820333 - DNA, 16 bp, Homo sapiens
tgctgccgcctcccag

SEQ ID NO: 2820334 - DNA, 19 bp, Homo sapiens
tgctgccgcctcccagcct

SEQ ID NO: 2820335 - DNA, 16 bp, Homo sapiens
tgctgctctctgaggg

SEQ ID NO: 2820336 - DNA, 17 bp, Homo sapiens
tgctgctgagaacctgg

SEQ ID NO: 2820337 - DNA, 19 bp, Homo sapiens
tgctgctgagaacctggcc

SEQ ID NO: 2820338 - DNA, 22 bp, Homo sapiens
tgctggaagacgcaagggcctg

SEQ ID NO: 2820339 - DNA, 19 bp, Homo sapiens
tgctggactgtcatagaaa

SEQ ID NO: 2820340 - DNA, 22 bp, Homo sapiens
tgctggcctcccaataaagctg

SEQ ID NO: 2820341 - DNA, 23 bp, Homo sapiens
tgctggcctcccaataaagctgg

SEQ ID NO: 2820342 - DNA, 14 bp, Homo sapiens
tgctggcctggatc

SEQ ID NO: 2820343 - DNA, 16 bp, Homo sapiens
tgctggcctggatctc

SEQ ID NO: 2820344 - DNA, 21 bp, Homo sapiens
tgctggctgttggctgggggc

SEQ ID NO: 2820345 - DNA, 15 bp, Homo sapiens
tgctgggactggcca

SEQ ID NO: 2820346 - DNA, 17 bp, Homo sapiens
tgctgggactggccagg

SEQ ID NO: 2820347 - DNA, 19 bp, Homo sapiens
tgctgggattacaagcgtg

SEQ ID NO: 2820348 - DNA, 21 bp, Homo sapiens
tgctgggattacaagcgtgag

SEQ ID NO: 2820349 - DNA, 20 bp, Homo sapiens
tgctgggattacaggtgtga

SEQ ID NO: 2820350 - DNA, 18 bp, Homo sapiens
tgctggggcaagtccctg

SEQ ID NO: 2820351 - DNA, 23 bp, Homo sapiens
tgctggggcaagtccctgactct

SEQ ID NO: 2820352 - DNA, 14 bp, Homo sapiens
tgctggttttccta

SEQ ID NO: 2820353 - DNA, 17 bp, Homo sapiens
tgctgtcattgtccatg

SEQ ID NO: 2820354 - DNA, 16 bp, Homo sapiens
tgctgtcctaggccac

SEQ ID NO: 2820355 - DNA, 14 bp, Homo sapiens
tgctgtggccaggg

SEQ ID NO: 2820356 - DNA, 17 bp, Homo sapiens
tgctgtggccagggtga

SEQ ID NO: 2820357 - DNA, 16 bp, Homo sapiens
tgctgtggtggggaga

SEQ ID NO: 2820358 - DNA, 13 bp, Homo sapiens
tgctgttctggag

SEQ ID NO: 2820359 - DNA, 16 bp, Homo sapiens
tgctgttctggagctg

SEQ ID NO: 2820360 - DNA, 12 bp, Homo sapiens
tgctgtttcctt

SEQ ID NO: 2820361 - DNA, 13 bp, Homo sapiens
tgcttacagtgac

SEQ ID NO: 2820362 - DNA, 16 bp, Homo sapiens
tgcttagaaagttatt

SEQ ID NO: 2820363 - DNA, 21 bp, Homo sapiens
tgcttagtcacttatttcata

SEQ ID NO: 2820364 - DNA, 14 bp, Homo sapiens
tgcttatttatatt

SEQ ID NO: 2820365 - DNA, 14 bp, Homo sapiens
tgcttcagcctccc

SEQ ID NO: 2820366 - DNA, 17 bp, Homo sapiens
tgcttcatgctcagccc

SEQ ID NO: 2820367 - DNA, 15 bp, Homo sapiens
tgcttccaattttct

SEQ ID NO: 2820368 - DNA, 14 bp, Homo sapiens
tgcttctctacaga

SEQ ID NO: 2820369 - DNA, 13 bp, Homo sapiens
tgcttctctttgt

SEQ ID NO: 2820370 - DNA, 19 bp, Homo sapiens
tgcttctgaactcaagctg

SEQ ID NO: 2820371 - DNA, 20 bp, Homo sapiens
tgcttctgaactcaagctgc

SEQ ID NO: 2820372 - DNA, 22 bp, Homo sapiens
tgcttctgaactcaagctgcgt

SEQ ID NO: 2820373 - DNA, 14 bp, Homo sapiens
tgcttcttgcccct

SEQ ID NO: 2820374 - DNA, 16 bp, Homo sapiens
tgcttcttgccccttg

SEQ ID NO: 2820375 - DNA, 21 bp, Homo sapiens
tgcttcttgccccttgggcct

SEQ ID NO: 2820376 - DNA, 17 bp, Homo sapiens
tgcttgaacccaggaga

SEQ ID NO: 2820377 - DNA, 13 bp, Homo sapiens
tgcttgagcccag

SEQ ID NO: 2820378 - DNA, 23 bp, Homo sapiens
tgcttgccaccaccagatgagaa

SEQ ID NO: 2820379 - DNA, 21 bp, Homo sapiens
tgcttggggggtgatgagggc

SEQ ID NO: 2820380 - DNA, 12 bp, Homo sapiens
tgcttgttgtca

SEQ ID NO: 2820381 - DNA, 22 bp, Homo sapiens
tgcttgttgtcaagtataaagt

SEQ ID NO: 2820382 - DNA, 17 bp, Homo sapiens
tgctttaaatctatcta

SEQ ID NO: 2820383 - DNA, 23 bp, Homo sapiens
tgctttaatatagctatcatttc

SEQ ID NO: 2820384 - DNA, 23 bp, Homo sapiens
tgctttcccaccagcatgtcact

SEQ ID NO: 2820385 - DNA, 20 bp, Homo sapiens
tgctttccccgggggaggaa

SEQ ID NO: 2820386 - DNA, 14 bp, Homo sapiens
tgctttcctccctg

SEQ ID NO: 2820387 - DNA, 12 bp, Homo sapiens
tgctttctcctg

SEQ ID NO: 2820388 - DNA, 22 bp, Homo sapiens
tgctttgcccttctttctaccc

SEQ ID NO: 2820389 - DNA, 14 bp, Homo sapiens
tgcttttggtctgt

SEQ ID NO: 2820390 - DNA, 18 bp, Homo sapiens
tgcttttggtctgtgtga

SEQ ID NO: 2820391 - DNA, 15 bp, Homo sapiens
tgctttttcaccaga

SEQ ID NO: 2820392 - DNA, 13 bp, Homo sapiens
tggaaaaatccag

SEQ ID NO: 2820393 - DNA, 16 bp, Homo sapiens
tggaaaagaggagttt

SEQ ID NO: 2820394 - DNA, 21 bp, Homo sapiens
tggaaactggatgaggtcata

SEQ ID NO: 2820395 - DNA, 16 bp, Homo sapiens
tggatctgtccaagga

SEQ ID NO: 2820396 - DNA, 13 bp, Homo sapiens
tggatgaccagaa

SEQ ID NO: 2820397 - DNA, 14 bp, Homo sapiens
tggatgcctggtgg

SEQ ID NO: 2820398 - DNA, 18 bp, Homo sapiens
tggatgcctggtggcagc

SEQ ID NO: 2820399 - DNA, 23 bp, Homo sapiens
tggatgcctggtggcagctgcgg

SEQ ID NO: 2820400 - DNA, 18 bp, Homo sapiens
tggatttacgactgaaga

SEQ ID NO: 2820401 - DNA, 13 bp, Homo sapiens
tggatttgaagca

SEQ ID NO: 2820402 - DNA, 22 bp, Homo sapiens
tggatttttacaaataaagatg

SEQ ID NO: 2820403 - DNA, 22 bp, Homo sapiens
tggcaaccttgtctctatgcca

SEQ ID NO: 2820404 - DNA, 14 bp, Homo sapiens
tggcaattttgtaa

SEQ ID NO: 2820405 - DNA, 20 bp, Homo sapiens
tggcacagcccaaagaagga

SEQ ID NO: 2820406 - DNA, 14 bp, Homo sapiens
tggcaccagaggct

SEQ ID NO: 2820407 - DNA, 20 bp, Homo sapiens
tggcacggtggctcaggcct

SEQ ID NO: 2820408 - DNA, 22 bp, Homo sapiens
tggcactgagatatttattgtt

SEQ ID NO: 2820409 - DNA, 17 bp, Homo sapiens
tggcagagaaggcttcc

SEQ ID NO: 2820410 - DNA, 21 bp, Homo sapiens
tggcagataatcagcctctta

SEQ ID NO: 2820411 - DNA, 17 bp, Homo sapiens
tggcagatgtaggaggg

SEQ ID NO: 2820412 - DNA, 19 bp, Homo sapiens
tggcagatgtaggagggac

SEQ ID NO: 2820413 - DNA, 20 bp, Homo sapiens
tggcagatgtaggagggact

SEQ ID NO: 2820414 - DNA, 11 bp, Homo sapiens
tggcagccaca

SEQ ID NO: 2820415 - DNA, 18 bp, Homo sapiens
tggcagccacacttctca

SEQ ID NO: 2820416 - DNA, 21 bp, Homo sapiens
tggcagccacacttctcagga

SEQ ID NO: 2820417 - DNA, 16 bp, Homo sapiens
tggcagccaccccctc

SEQ ID NO: 2820418 - DNA, 22 bp, Homo sapiens
tgcatcagaaagggagggctct

SEQ ID NO: 2820419 - DNA, 23 bp, Homo sapiens
tgcatcagaaagggagggctctg

SEQ ID NO: 2820420 - DNA, 14 bp, Homo sapiens
tgcatccattcctc

SEQ ID NO: 2820421 - DNA, 17 bp, Homo sapiens
tgcatccattcctcagg

SEQ ID NO: 2820422 - DNA, 19 bp, Homo sapiens
tgcatccgtagttccctga

SEQ ID NO: 2820423 - DNA, 21 bp, Homo sapiens
tgcatctagaggcttccttca

SEQ ID NO: 2820424 - DNA, 19 bp, Homo sapiens
tgcatctgggattcccacc

SEQ ID NO: 2820425 - DNA, 20 bp, Homo sapiens
tgcatctgggattcccacca

SEQ ID NO: 2820426 - DNA, 19 bp, Homo sapiens
tgcatgattttatacatag

SEQ ID NO: 2820427 - DNA, 16 bp, Homo sapiens
tgcatgctctctgcag

SEQ ID NO: 2820428 - DNA, 23 bp, Homo sapiens
tgcatggtgcagttgacagcagg

SEQ ID NO: 2820429 - DNA, 17 bp, Homo sapiens
tgcatgtaaaatgcagt

SEQ ID NO: 2820430 - DNA, 20 bp, Homo sapiens
tgcatgttgccatgaggcct

SEQ ID NO: 2820431 - DNA, 21 bp, Homo sapiens
tgcatgttgccatgaggcctt

SEQ ID NO: 2820432 - DNA, 18 bp, Homo sapiens
tgcattactgcatgcact

SEQ ID NO: 2820433 - DNA, 19 bp, Homo sapiens
tgcattagaaatagacagt

SEQ ID NO: 2820434 - DNA, 22 bp, Homo sapiens
tgcattagaaatagacagtata

SEQ ID NO: 2820435 - DNA, 13 bp, Homo sapiens
tgcattagaaatt

SEQ ID NO: 2820436 - DNA, 17 bp, Homo sapiens
tgcattccatgatttta

SEQ ID NO: 2820437 - DNA, 22 bp, Homo sapiens
tgcattcggtacttacccggag

SEQ ID NO: 2820438 - DNA, 12 bp, Homo sapiens
tgcattctagta

SEQ ID NO: 2820439 - DNA, 16 bp, Homo sapiens
tgcattgaatatatta

SEQ ID NO: 2820440 - DNA, 16 bp, Homo sapiens
tgcattgtgtgagctt

SEQ ID NO: 2820441 - DNA, 20 bp, Homo sapiens
tgcatttataaatgtgtggt

SEQ ID NO: 2820442 - DNA, 19 bp, Homo sapiens
tgcatttatgagctcttca

SEQ ID NO: 2820443 - DNA, 20 bp, Homo sapiens
tgcatttatgagctcttcat

SEQ ID NO: 2820444 - DNA, 15 bp, Homo sapiens
tgcatttctgtctct

SEQ ID NO: 2820445 - DNA, 20 bp, Homo sapiens
tgccaaagcaaaagaagtaa

SEQ ID NO: 2820446 - DNA, 19 bp, Homo sapiens
tgccaacatacccttcttt

SEQ ID NO: 2820447 - DNA, 15 bp, Homo sapiens
tgccaagtccaggtc

SEQ ID NO: 2820448 - DNA, 21 bp, Homo sapiens
tgccacactcagtcccccacc

SEQ ID NO: 2820449 - DNA, 22 bp, Homo sapiens
tgccaccaccagatgagaagtt

SEQ ID NO: 2820450 - DNA, 15 bp, Homo sapiens
tgccaccatcctgct

SEQ ID NO: 2820451 - DNA, 16 bp, Homo sapiens
tgccaccgattgcagg

SEQ ID NO: 2820452 - DNA, 21 bp, Homo sapiens
tgccacctcccctatccaccc

SEQ ID NO: 2820453 - DNA, 14 bp, Homo sapiens
tgccacctgtctgt

SEQ ID NO: 2820454 - DNA, 15 bp, Homo sapiens
tgccacctgtctgtc

SEQ ID NO: 2820455 - DNA, 16 bp, Homo sapiens
tgccactcctgcttct

SEQ ID NO: 2820456 - DNA, 18 bp, Homo sapiens
tgccactgcctcttcctc

SEQ ID NO: 2820457 - DNA, 19 bp, Homo sapiens
tgccactgcctcttcctcc

SEQ ID NO: 2820458 - DNA, 23 bp, Homo sapiens
tgccactttggtacatggccagt

SEQ ID NO: 2820459 - DNA, 14 bp, Homo sapiens
tgccagaacagttt

SEQ ID NO: 2820460 - DNA, 21 bp, Homo sapiens
tgccagagacggaagcctttt

SEQ ID NO: 2820461 - DNA, 15 bp, Homo sapiens
tgccagagcctgggg

SEQ ID NO: 2820462 - DNA, 11 bp, Homo sapiens
tgccagccaga

SEQ ID NO: 2820463 - DNA, 22 bp, Homo sapiens
tgccagccagaagcctctgcct

SEQ ID NO: 2820464 - DNA, 12 bp, Homo sapiens
tgccagccagca

SEQ ID NO: 2820465 - DNA, 15 bp, Homo sapiens
tgccagccagcagcc

SEQ ID NO: 2820466 - DNA, 16 bp, Homo sapiens
tgccagccagcagcca

SEQ ID NO: 2820467 - DNA, 22 bp, Homo sapiens
tgccagccagcagccagctctc

SEQ ID NO: 2820468 - DNA, 19 bp, Homo sapiens
tgccagccgtgatgctcag

SEQ ID NO: 2820469 - DNA, 18 bp, Homo sapiens
tgccagcctggcttctgg

SEQ ID NO: 2820470 - DNA, 20 bp, Homo sapiens
tgccagcctggcttctggag

SEQ ID NO: 2820471 - DNA, 22 bp, Homo sapiens
tgccagcctggcttctggagcc

SEQ ID NO: 2820472 - DNA, 13 bp, Homo sapiens
tgccaggagggac

SEQ ID NO: 2820473 - DNA, 23 bp, Homo sapiens
tgccaggcccccgctggctcctc

SEQ ID NO: 2820474 - DNA, 14 bp, Homo sapiens
tgccaggcccgggg

SEQ ID NO: 2820475 - DNA, 16 bp, Homo sapiens
tgccaggctaattttt

SEQ ID NO: 2820476 - DNA, 17 bp, Homo sapiens
tgccaggtttttggtct

SEQ ID NO: 2820477 - DNA, 19 bp, Homo sapiens
tgccaggtttttggtctga

SEQ ID NO: 2820478 - DNA, 15 bp, Homo sapiens
tgccagtgccttacc

SEQ ID NO: 2820479 - DNA, 20 bp, Homo sapiens
tgccagtgccttacctcctg

SEQ ID NO: 2820480 - DNA, 21 bp, Homo sapiens
tgccagtgccttacctcctgc

SEQ ID NO: 2820481 - DNA, 14 bp, Homo sapiens
tgccatctccaccc

SEQ ID NO: 2820482 - DNA, 15 bp, Homo sapiens
tgccatctccaccct

SEQ ID NO: 2820483 - DNA, 23 bp, Homo sapiens
tgccatgaggcctttccccagtg

SEQ ID NO: 2820484 - DNA, 18 bp, Homo sapiens
tgccatggacagaagaag

SEQ ID NO: 2820485 - DNA, 20 bp, Homo sapiens
tgccatggacagaagaaggc

SEQ ID NO: 2820486 - DNA, 22 bp, Homo sapiens
tgccatgtagaccccttgaaga

SEQ ID NO: 2820487 - DNA, 18 bp, Homo sapiens
tgccatgtcaaacaaata

SEQ ID NO: 2820488 - DNA, 22 bp, Homo sapiens
tgccatgtcttgttcagaagac

SEQ ID NO: 2820489 - DNA, 15 bp, Homo sapiens
tgccatgttggccag

SEQ ID NO: 2820490 - DNA, 16 bp, Homo sapiens
tgccatgttggccagg

SEQ ID NO: 2820491 - DNA, 20 bp, Homo sapiens
tgccatgttggccaggctgg

SEQ ID NO: 2820492 - DNA, 17 bp, Homo sapiens
tgccatttgcaccctcc

SEQ ID NO: 2820493 - DNA, 21 bp, Homo sapiens
tgccatttgcaccctccgcct

SEQ ID NO: 2820494 - DNA, 23 bp, Homo sapiens
tgccatttgtactgaccccatca

SEQ ID NO: 2820495 - DNA, 14 bp, Homo sapiens
tgccattttaataa

SEQ ID NO: 2820496 - DNA, 16 bp, Homo sapiens
tgcccacaggatcagt

SEQ ID NO: 2820497 - DNA, 19 bp, Homo sapiens
tgcccacaggatcagtctg

SEQ ID NO: 2820498 - DNA, 17 bp, Homo sapiens
tgcccaccaacatccca

SEQ ID NO: 2820499 - DNA, 16 bp, Homo sapiens
tgcccagaattcccag

SEQ ID NO: 2820500 - DNA, 22 bp, Homo sapiens
tgcccagaattcccagctgtct

SEQ ID NO: 2820501 - DNA, 16 bp, Homo sapiens
tgcccagagatgcctc

SEQ ID NO: 2820502 - DNA, 17 bp, Homo sapiens
tgcccagagatgcctcc

SEQ ID NO: 2820503 - DNA, 18 bp, Homo sapiens
tgcccagagatgcctcca

SEQ ID NO: 2820504 - DNA, 22 bp, Homo sapiens
tgcccagagatgcctccaccgc

SEQ ID NO: 2820505 - DNA, 18 bp, Homo sapiens
tgcccagagggcccaggc

SEQ ID NO: 2820506 - DNA, 20 bp, Homo sapiens
tgcccagagggcccaggcag

SEQ ID NO: 2820507 - DNA, 18 bp, Homo sapiens
tgcccaggagagccagcc

SEQ ID NO: 2820508 - DNA, 19 bp, Homo sapiens
tgcccaggagagccagccc

SEQ ID NO: 2820509 - DNA, 23 bp, Homo sapiens
tgcccaggagagccagccctccc

SEQ ID NO: 2820510 - DNA, 15 bp, Homo sapiens
tgcccaggcaggtct

SEQ ID NO: 2820511 - DNA, 20 bp, Homo sapiens
tgcccaggcaggtcttgaac

SEQ ID NO: 2820512 - DNA, 11 bp, Homo sapiens
tgcccaggccc

SEQ ID NO: 2820513 - DNA, 12 bp, Homo sapiens
tgcccaggcccc

SEQ ID NO: 2820514 - DNA, 15 bp, Homo sapiens
tgcccaggcccctgc

SEQ ID NO: 2820515 - DNA, 18 bp, Homo sapiens
tgcccaggctggcgtgca

SEQ ID NO: 2820516 - DNA, 13 bp, Homo sapiens
tgccccaactcct

SEQ ID NO: 2820517 - DNA, 18 bp, Homo sapiens
tgccccaactccttccag

SEQ ID NO: 2820518 - DNA, 20 bp, Homo sapiens
tgccccaactccttccagct

SEQ ID NO: 2820519 - DNA, 17 bp, Homo sapiens
tgccccaaggctgctca

SEQ ID NO: 2820520 - DNA, 21 bp, Homo sapiens
tgccccaaggctgctcagagg

SEQ ID NO: 2820521 - DNA, 18 bp, Homo sapiens
tgccccaccagccacctc

SEQ ID NO: 2820522 - DNA, 16 bp, Homo sapiens
tgccccagagatgggc

SEQ ID NO: 2820523 - DNA, 20 bp, Homo sapiens
tgcccccgtcttctctccat

SEQ ID NO: 2820524 - DNA, 12 bp, Homo sapiens
tgccccctggtg

SEQ ID NO: 2820525 - DNA, 22 bp, Homo sapiens
tgccccctggtggacagtcctg

SEQ ID NO: 2820526 - DNA, 17 bp, Homo sapiens
tgccccgcttccccaca

SEQ ID NO: 2820527 - DNA, 19 bp, Homo sapiens
tgccccgcttccccacaga

SEQ ID NO: 2820528 - DNA, 18 bp, Homo sapiens
tgccccgggtccccagct

SEQ ID NO: 2820529 - DNA, 17 bp, Homo sapiens
tgcccctgtaggttgct

SEQ ID NO: 2820530 - DNA, 15 bp, Homo sapiens
tgcccggattctggg

SEQ ID NO: 2820531 - DNA, 22 bp, Homo sapiens
tgcccggattctgggaggaagc

SEQ ID NO: 2820532 - DNA, 13 bp, Homo sapiens
tgcccgtcttcag

SEQ ID NO: 2820533 - DNA, 16 bp, Homo sapiens
tgccctcaatcccagc

SEQ ID NO: 2820534 - DNA, 12 bp, Homo sapiens
tgccctcaggga

SEQ ID NO: 2820535 - DNA, 14 bp, Homo sapiens
tgccctccctggcc

SEQ ID NO: 2820536 - DNA, 16 bp, Homo sapiens
tgccctccctggcctc

SEQ ID NO: 2820537 - DNA, 12 bp, Homo sapiens
tgccctctctga

SEQ ID NO: 2820538 - DNA, 21 bp, Homo sapiens
tgccctctggattctctgggt

SEQ ID NO: 2820539 - DNA, 18 bp, Homo sapiens
tgccctgacccctgcacc

SEQ ID NO: 2820540 - DNA, 13 bp, Homo sapiens
tgccctgacctcc

SEQ ID NO: 2820541 - DNA, 21 bp, Homo sapiens
tgccctgacctcccagcccta

SEQ ID NO: 2820542 - DNA, 16 bp, Homo sapiens
tgccctgccacctgtc

SEQ ID NO: 2820543 - DNA, 19 bp, Homo sapiens
tgccctgccacctgtctgt

SEQ ID NO: 2820544 - DNA, 22 bp, Homo sapiens
tgccctgccacctgtctgtctg

SEQ ID NO: 2820545 - DNA, 13 bp, Homo sapiens
tgcccttgccctg

SEQ ID NO: 2820546 - DNA, 19 bp, Homo sapiens
tgcccttgccctgacctcc

SEQ ID NO: 2820547 - DNA, 22 bp, Homo sapiens
tgccgaccagagccccacacgg

SEQ ID NO: 2820548 - DNA, 17 bp, Homo sapiens
tgccgagcaaccgtggc

SEQ ID NO: 2820549 - DNA, 21 bp, Homo sapiens
tgccgagcaaccgtggccctt

SEQ ID NO: 2820550 - DNA, 13 bp, Homo sapiens
tgccgcaccccag

SEQ ID NO: 2820551 - DNA, 17 bp, Homo sapiens
tgccgcctcccagcctg

SEQ ID NO: 2820552 - DNA, 15 bp, Homo sapiens
tgccgctcttctgtc

SEQ ID NO: 2820553 - DNA, 16 bp, Homo sapiens
tgccgctcttctgtca

SEQ ID NO: 2820554 - DNA, 18 bp, Homo sapiens
tgccgctcttctgtcatc

SEQ ID NO: 2820555 - DNA, 19 bp, Homo sapiens
tgccgctcttctgtcatcc

SEQ ID NO: 2820556 - DNA, 14 bp, Homo sapiens
tgcctaagtggctg

SEQ ID NO: 2820557 - DNA, 17 bp, Homo sapiens
tgcctaagtggctgctg

SEQ ID NO: 2820558 - DNA, 15 bp, Homo sapiens
tgcctacagataatt

SEQ ID NO: 2820559 - DNA, 22 bp, Homo sapiens
tgcctcaaataaaaagtgcttt

SEQ ID NO: 2820560 - DNA, 23 bp, Homo sapiens
tgcctcaatgtgaatcagaccct

SEQ ID NO: 2820561 - DNA, 18 bp, Homo sapiens
tgcctcaatgtgaccagg

SEQ ID NO: 2820562 - DNA, 19 bp, Homo sapiens
tgcctcaatgtgaccaggg

SEQ ID NO: 2820563 - DNA, 23 bp, Homo sapiens
tgcctcaatgtgaccaggggtga

SEQ ID NO: 2820564 - DNA, 18 bp, Homo sapiens
tgcctcagctgctcgcac

SEQ ID NO: 2820565 - DNA, 16 bp, Homo sapiens
tgcctcatgaccctcc

SEQ ID NO: 2820566 - DNA, 20 bp, Homo sapiens
tgcctcatgaccctcctgtc

SEQ ID NO: 2820567 - DNA, 15 bp, Homo sapiens
tgcctcatgctgact

SEQ ID NO: 2820568 - DNA, 14 bp, Homo sapiens
tgcctccctagctt

SEQ ID NO: 2820569 - DNA, 11 bp, Homo sapiens
tgcctcctgtc

SEQ ID NO: 2820570 - DNA, 20 bp, Homo sapiens
tgcctcgaactggctgcaaa

SEQ ID NO: 2820571 - DNA, 12 bp, Homo sapiens
tgcctctgaggc

SEQ ID NO: 2820572 - DNA, 20 bp, Homo sapiens
tgcctctgaggccagcctgg

SEQ ID NO: 2820573 - DNA, 21 bp, Homo sapiens
tgcctctgaggccagcctggc

SEQ ID NO: 2820574 - DNA, 22 bp, Homo sapiens
tgcctctgaggccagcctggcc

SEQ ID NO: 2820575 - DNA, 13 bp, Homo sapiens
tgcctctgcctct

SEQ ID NO: 2820576 - DNA, 18 bp, Homo sapiens
tgcctctgcctctgacac

SEQ ID NO: 2820577 - DNA, 13 bp, Homo sapiens
tgcctctgcctgt

SEQ ID NO: 2820578 - DNA, 18 bp, Homo sapiens
tgcctctgcctgtctccc

SEQ ID NO: 2820579 - DNA, 13 bp, Homo sapiens
tgcctgaagaaca

SEQ ID NO: 2820580 - DNA, 17 bp, Homo sapiens
tgcctgaagtcacacag

SEQ ID NO: 2820581 - DNA, 18 bp, Homo sapiens
tgcctgaagtcacacagt

SEQ ID NO: 2820582 - DNA, 19 bp, Homo sapiens
tgcctgagtcacccatgaa

SEQ ID NO: 2820583 - DNA, 14 bp, Homo sapiens
tgcctgcagagaga

SEQ ID NO: 2820584 - DNA, 16 bp, Homo sapiens
tgcctgcagagagaag

SEQ ID NO: 2820585 - DNA, 14 bp, Homo sapiens
tgcctgccagggcc

SEQ ID NO: 2820586 - DNA, 13 bp, Homo sapiens
tgcctgcccaggc

SEQ ID NO: 2820587 - DNA, 24 bp, Homo sapiens
tgcctgcccaggcccctgccaccc

SEQ ID NO: 2820588 - DNA, 11 bp, Homo sapiens
tgcctgccctc

SEQ ID NO: 2820589 - DNA, 17 bp, Homo sapiens
tgcctgctatttgaagt

SEQ ID NO: 2820590 - DNA, 11 bp, Homo sapiens
tgcctggagga

SEQ ID NO: 2820591 - DNA, 15 bp, Homo sapiens
tgcctggaggacctg

SEQ ID NO: 2820592 - DNA, 18 bp, Homo sapiens
tgcctggaggacctgagc

SEQ ID NO: 2820593 - DNA, 22 bp, Homo sapiens
tgcctggcctggcacacatcag

SEQ ID NO: 2820594 - DNA, 21 bp, Homo sapiens
tgcctgggtggggctgctcct

SEQ ID NO: 2820595 - DNA, 15 bp, Homo sapiens
tgcctggtggcagct

SEQ ID NO: 2820596 - DNA, 17 bp, Homo sapiens
tgcctggtggcagctgc

SEQ ID NO: 2820597 - DNA, 18 bp, Homo sapiens
tgcctggtggcagctgcg

SEQ ID NO: 2820598 - DNA, 19 bp, Homo sapiens
tgcctggtggcagctgcgg

SEQ ID NO: 2820599 - DNA, 16 bp, Homo sapiens
tgcctggtgggccacg

SEQ ID NO: 2820600 - DNA, 13 bp, Homo sapiens
tgcctgtagttag

SEQ ID NO: 2820601 - DNA, 22 bp, Homo sapiens
tgcctgtagttaggaaataaaa

SEQ ID NO: 2820602 - DNA, 15 bp, Homo sapiens
tgcctgtgtgagcat

SEQ ID NO: 2820603 - DNA, 15 bp, Homo sapiens
tgcctgttcagctcc

SEQ ID NO: 2820604 - DNA, 16 bp, Homo sapiens
tgcctgttcagctcca

SEQ ID NO: 2820605 - DNA, 20 bp, Homo sapiens
tgccttacctcctgcccagg

SEQ ID NO: 2820606 - DNA, 16 bp, Homo sapiens
tgccttagcacttctt

SEQ ID NO: 2820607 - DNA, 14 bp, Homo sapiens
tgccttccataatt

SEQ ID NO: 2820608 - DNA, 21 bp, Homo sapiens
tgccttcctgtttaaaaaaag

SEQ ID NO: 2820609 - DNA, 21 bp, Homo sapiens
tgccttcttcggggaactcct

SEQ ID NO: 2820610 - DNA, 15 bp, Homo sapiens
tgccttgaagccact

SEQ ID NO: 2820611 - DNA, 15 bp, Homo sapiens
tgccttgtctgggga

SEQ ID NO: 2820612 - DNA, 15 bp, Homo sapiens
tgcctttccacctgc

SEQ ID NO: 2820613 - DNA, 23 bp, Homo sapiens
tgcctttcttatttgcaataaaa

SEQ ID NO: 2820614 - DNA, 16 bp, Homo sapiens
tgcgaaggggccctgg

SEQ ID NO: 2820615 - DNA, 21 bp, Homo sapiens
tgcgaaggggccctggtcctt

SEQ ID NO: 2820616 - DNA, 16 bp, Homo sapiens
tgcgaccatgtgtaga

SEQ ID NO: 2820617 - DNA, 22 bp, Homo sapiens
tgcgagagaggtgggcagcagc

SEQ ID NO: 2820618 - DNA, 24 bp, Homo sapiens
tgcgagagaggtgggcagcagctc

SEQ ID NO: 2820619 - DNA, 13 bp, Homo sapiens
tgcgagcatttcc

SEQ ID NO: 2820620 - DNA, 15 bp, Homo sapiens
tgcgagcatttccct

SEQ ID NO: 2820621 - DNA, 18 bp, Homo sapiens
tgcgagcatttccctccc

SEQ ID NO: 2820622 - DNA, 18 bp, Homo sapiens
tgcgatcttcagagcagg

SEQ ID NO: 2820623 - DNA, 20 bp, Homo sapiens
tgcgctctagcctgggcaac

SEQ ID NO: 2820624 - DNA, 23 bp, Homo sapiens
tgcgctggtggaccacaggcatc

SEQ ID NO: 2820625 - DNA, 18 bp, Homo sapiens
tgcggacagccacggcca

SEQ ID NO: 2820626 - DNA, 23 bp, Homo sapiens
tgcggacagccacggccaggcca

SEQ ID NO: 2820627 - DNA, 13 bp, Homo sapiens
tgcggccaccacc

SEQ ID NO: 2820628 - DNA, 17 bp, Homo sapiens
tgcgggagtagttggaa

SEQ ID NO: 2820629 - DNA, 14 bp, Homo sapiens
tgcggtccacccag

SEQ ID NO: 2820630 - DNA, 17 bp, Homo sapiens
tgcggtccacccaggag

SEQ ID NO: 2820631 - DNA, 20 bp, Homo sapiens
tgctaaatggtcgcccagga

SEQ ID NO: 2820632 - DNA, 22 bp, Homo sapiens
tgctaactagcttggaaactgg

SEQ ID NO: 2820633 - DNA, 15 bp, Homo sapiens
tgctaattaaaaagt

SEQ ID NO: 2820634 - DNA, 18 bp, Homo sapiens
tgctaatttatcctgaaa

SEQ ID NO: 2820635 - DNA, 13 bp, Homo sapiens
tgctaccaaagca

SEQ ID NO: 2820636 - DNA, 21 bp, Homo sapiens
tgctactgtcctacccaccct

SEQ ID NO: 2820637 - DNA, 22 bp, Homo sapiens
tgctactgtcctacccaccctc

SEQ ID NO: 2820638 - DNA, 17 bp, Homo sapiens
tgctaggcgagtgccag

SEQ ID NO: 2820639 - DNA, 19 bp, Homo sapiens
tgctataggctggagaagc

SEQ ID NO: 2820640 - DNA, 20 bp, Homo sapiens
tgctatctctgtgtgcacaa

SEQ ID NO: 2820641 - DNA, 13 bp, Homo sapiens
tgctatgaatgat

SEQ ID NO: 2820642 - DNA, 14 bp, Homo sapiens
tgctatggttttct

SEQ ID NO: 2820643 - DNA, 15 bp, Homo sapiens
tgctcaaaaatctgt

SEQ ID NO: 2820644 - DNA, 18 bp, Homo sapiens
tgctcaaatctattcaga

SEQ ID NO: 2820645 - DNA, 13 bp, Homo sapiens
tgctcaacctctc

SEQ ID NO: 2820646 - DNA, 23 bp, Homo sapiens
tgctcaacctctctccttctggc

SEQ ID NO: 2820647 - DNA, 13 bp, Homo sapiens
tgctcagccctga

SEQ ID NO: 2820648 - DNA, 17 bp, Homo sapiens
tgctcagccctgactgg

SEQ ID NO: 2820649 - DNA, 13 bp, Homo sapiens
tgctcccagcagc

SEQ ID NO: 2820650 - DNA, 14 bp, Homo sapiens
tgctcccagcagcc

SEQ ID NO: 2820651 - DNA, 14 bp, Homo sapiens
tgctcccccacccc

SEQ ID NO: 2820652 - DNA, 17 bp, Homo sapiens
tgctccccttcctgcca

SEQ ID NO: 2820653 - DNA, 12 bp, Homo sapiens
tgctcctccagg

SEQ ID NO: 2820654 - DNA, 18 bp, Homo sapiens
tgctcctcccattcccct

SEQ ID NO: 2820655 - DNA, 11 bp, Homo sapiens
tgctcctctcc

SEQ ID NO: 2820656 - DNA, 14 bp, Homo sapiens
tgctcctctccagg

SEQ ID NO: 2820657 - DNA, 23 bp, Homo sapiens
tgctcgattattccctgtacaat

SEQ ID NO: 2820658 - DNA, 15 bp, Homo sapiens
tgctcggggtgcaca

SEQ ID NO: 2820659 - DNA, 18 bp, Homo sapiens
tgctcggggtgcacagga

SEQ ID NO: 2820660 - DNA, 19 bp, Homo sapiens
tgctcggggtgcacaggag

SEQ ID NO: 2820661 - DNA, 21 bp, Homo sapiens
tgctctaggctgccccgggtc

SEQ ID NO: 2820662 - DNA, 14 bp, Homo sapiens
tgctctcatcagaa

SEQ ID NO: 2820663 - DNA, 12 bp, Homo sapiens
tgctctcccctg

SEQ ID NO: 2820664 - DNA, 13 bp, Homo sapiens
tgctctcccctgc

SEQ ID NO: 2820665 - DNA, 19 bp, Homo sapiens
tgctctcctaccccacctc

SEQ ID NO: 2820666 - DNA, 22 bp, Homo sapiens
tgctctcctcttgccactgcct

SEQ ID NO: 2820667 - DNA, 12 bp, Homo sapiens
tgctctcctttc

SEQ ID NO: 2820668 - DNA, 13 bp, Homo sapiens
tgctctctgcagc

SEQ ID NO: 2820669 - DNA, 14 bp, Homo sapiens
tgctctctgcagcc

SEQ ID NO: 2820670 - DNA, 15 bp, Homo sapiens
tgctctctgcagcca

SEQ ID NO: 2820671 - DNA, 20 bp, Homo sapiens
tgctctctgcagccagccca

SEQ ID NO: 2820672 - DNA, 18 bp, Homo sapiens
tgctctgaggcttccaga

SEQ ID NO: 2820673 - DNA, 20 bp, Homo sapiens
tgctctgaggcttccagaga

SEQ ID NO: 2820674 - DNA, 22 bp, Homo sapiens
tgctctgatcatccactgtgcc

SEQ ID NO: 2820675 - DNA, 16 bp, Homo sapiens
tgctctgatgcatcag

SEQ ID NO: 2820676 - DNA, 19 bp, Homo sapiens
tgctctggaaaatgtgacc

SEQ ID NO: 2820677 - DNA, 16 bp, Homo sapiens
tgctctggaagagagg

SEQ ID NO: 2820678 - DNA, 15 bp, Homo sapiens
tgctcttagctgtct

SEQ ID NO: 2820679 - DNA, 22 bp, Homo sapiens
tgctcttctcttacgctctctg

SEQ ID NO: 2820680 - DNA, 13 bp, Homo sapiens
tgctgaattattt

SEQ ID NO: 2820681 - DNA, 23 bp, Homo sapiens
tgctgaattattttgttgtgatt

SEQ ID NO: 2820682 - DNA, 22 bp, Homo sapiens
tgctgacagacacaggcccggc

SEQ ID NO: 2820683 - DNA, 15 bp, Homo sapiens
tgctgacagctgacc

SEQ ID NO: 2820684 - DNA, 20 bp, Homo sapiens
tgctgagaacctggccttca

SEQ ID NO: 2820685 - DNA, 20 bp, Homo sapiens
tgctgagattacaggtgtga

SEQ ID NO: 2820686 - DNA, 17 bp, Homo sapiens
tgctgagctctgagagg

SEQ ID NO: 2820687 - DNA, 17 bp, Homo sapiens
tgctgattctcccgttc

SEQ ID NO: 2820688 - DNA, 14 bp, Homo sapiens
tgatgaccaagaat

SEQ ID NO: 2820689 - DNA, 15 bp, Homo sapiens
tgatgaccaatctct

SEQ ID NO: 2820690 - DNA, 17 bp, Homo sapiens
tgatgaccaatctctgt

SEQ ID NO: 2820691 - DNA, 18 bp, Homo sapiens
tgatgaccaatctctgtg

SEQ ID NO: 2820692 - DNA, 15 bp, Homo sapiens
tgatgagctcctctt

SEQ ID NO: 2820693 - DNA, 17 bp, Homo sapiens
tgatgaggcctcttgga

SEQ ID NO: 2820694 - DNA, 18 bp, Homo sapiens
tgatgaggcctcttggac

SEQ ID NO: 2820695 - DNA, 17 bp, Homo sapiens
tgatgagggcagcagcc

SEQ ID NO: 2820696 - DNA, 21 bp, Homo sapiens
tgatgagggcagcagccagcc

SEQ ID NO: 2820697 - DNA, 24 bp, Homo sapiens
tgatgagggcagcagccagccctg

SEQ ID NO: 2820698 - DNA, 16 bp, Homo sapiens
tggggcagctcctctg

SEQ ID NO: 2820699 - DNA, 16 bp, Homo sapiens
tggggcagcttgaggg

SEQ ID NO: 2820700 - DNA, 12 bp, Homo sapiens
tggggcaggagt

SEQ ID NO: 2820701 - DNA, 20 bp, Homo sapiens
tggggcaggagtagctgagc

SEQ ID NO: 2820702 - DNA, 21 bp, Homo sapiens
tggggcaggagtagctgagct

SEQ ID NO: 2820703 - DNA, 20 bp, Homo sapiens
tggggcctgtactgcctgct

SEQ ID NO: 2820704 - DNA, 17 bp, Homo sapiens
tggggctctaacgcctg

SEQ ID NO: 2820705 - DNA, 13 bp, Homo sapiens
tggggctctggga

SEQ ID NO: 2820706 - DNA, 21 bp, Homo sapiens
tgggggacttacatgattcat

SEQ ID NO: 2820707 - DNA, 20 bp, Homo sapiens
tgggggaggtccctgccagt

SEQ ID NO: 2820708 - DNA, 21 bp, Homo sapiens
tgggggaggtccctgccagtg

SEQ ID NO: 2820709 - DNA, 18 bp, Homo sapiens
tgggggcagagggcagag

SEQ ID NO: 2820710 - DNA, 17 bp, Homo sapiens
tgggggcctggctggct

SEQ ID NO: 2820711 - DNA, 18 bp, Homo sapiens
tgggggcgggggagccaa

SEQ ID NO: 2820712 - DNA, 18 bp, Homo sapiens
tggggggtgatgagggca

SEQ ID NO: 2820713 - DNA, 17 bp, Homo sapiens
tgggggtggggagacct

SEQ ID NO: 2820714 - DNA, 20 bp, Homo sapiens
tgggggttctttcttcctct

SEQ ID NO: 2820715 - DNA, 14 bp, Homo sapiens
tggggtacccactg

SEQ ID NO: 2820716 - DNA, 16 bp, Homo sapiens
tggggtacccactgct

SEQ ID NO: 2820717 - DNA, 24 bp, Homo sapiens
tggggtatttaccacagcagctga

SEQ ID NO: 2820718 - DNA, 19 bp, Homo sapiens
tggggttcagcccctcctc

SEQ ID NO: 2820719 - DNA, 23 bp, Homo sapiens
tgggtaacagggagactgcatct

SEQ ID NO: 2820720 - DNA, 16 bp, Homo sapiens
tgggtacaagagccat

SEQ ID NO: 2820721 - DNA, 13 bp, Homo sapiens
tgggtcaaggaat

SEQ ID NO: 2820722 - DNA, 20 bp, Homo sapiens
tgggtcctgcaattctacag

SEQ ID NO: 2820723 - DNA, 23 bp, Homo sapiens
tgggtctaaggggttggttgagg

SEQ ID NO: 2820724 - DNA, 15 bp, Homo sapiens
tgggtctggctgagc

SEQ ID NO: 2820725 - DNA, 17 bp, Homo sapiens
tgggtctggctgagctg

SEQ ID NO: 2820726 - DNA, 15 bp, Homo sapiens
tgggtgaatgtgtga

SEQ ID NO: 2820727 - DNA, 14 bp, Homo sapiens
tgggtgacagagca

SEQ ID NO: 2820728 - DNA, 14 bp, Homo sapiens
tgggtggctactct

SEQ ID NO: 2820729 - DNA, 20 bp, Homo sapiens
tgggtggctactctgtgcca

SEQ ID NO: 2820730 - DNA, 21 bp, Homo sapiens
tgggtggggctgctcctccag

SEQ ID NO: 2820731 - DNA, 13 bp, Homo sapiens
tgggttcctcttc

SEQ ID NO: 2820732 - DNA, 24 bp, Homo sapiens
tgggttttcttcccatcactggag

SEQ ID NO: 2820733 - DNA, 21 bp, Homo sapiens
tggtaaattagtatttattta

SEQ ID NO: 2820734 - DNA, 13 bp, Homo sapiens
tggtaattgttgc

SEQ ID NO: 2820735 - DNA, 18 bp, Homo sapiens
tggtactgcacattttgt

SEQ ID NO: 2820736 - DNA, 20 bp, Homo sapiens
tggtagaattggagagtaaa

SEQ ID NO: 2820737 - DNA, 17 bp, Homo sapiens
tggtagaccaaaataaa

SEQ ID NO: 2820738 - DNA, 20 bp, Homo sapiens
tggtagcttttcccttcttt

SEQ ID NO: 2820739 - DNA, 21 bp, Homo sapiens
tggtagcttttcccttctttt

SEQ ID NO: 2820740 - DNA, 16 bp, Homo sapiens
tggtaggaaagcaccg

SEQ ID NO: 2820741 - DNA, 17 bp, Homo sapiens
tggtagggacttaaaaa

SEQ ID NO: 2820742 - DNA, 22 bp, Homo sapiens
tggtagtactcctgcaaaattt

SEQ ID NO: 2820743 - DNA, 15 bp, Homo sapiens
tggtatgagctgagg

SEQ ID NO: 2820744 - DNA, 21 bp, Homo sapiens
tggtcaaggcccggccccatc

SEQ ID NO: 2820745 - DNA, 22 bp, Homo sapiens
tggtcacaggactctgcctcct

SEQ ID NO: 2820746 - DNA, 16 bp, Homo sapiens
tggtcatctttttctc

SEQ ID NO: 2820747 - DNA, 15 bp, Homo sapiens
tggtccagctcttgg

SEQ ID NO: 2820748 - DNA, 15 bp, Homo sapiens
tggtccagcttgctc

SEQ ID NO: 2820749 - DNA, 14 bp, Homo sapiens
tggtccagggttga

SEQ ID NO: 2820750 - DNA, 20 bp, Homo sapiens
tggtcccacatccctgggcc

SEQ ID NO: 2820751 - DNA, 21 bp, Homo sapiens
tggtcccacatccctgggcct

SEQ ID NO: 2820752 - DNA, 22 bp, Homo sapiens
tggtcccacatccctgggcctg

SEQ ID NO: 2820753 - DNA, 11 bp, Homo sapiens
tggtcctgggg

SEQ ID NO: 2820754 - DNA, 19 bp, Homo sapiens
tggtcctggggctctgtgc

SEQ ID NO: 2820755 - DNA, 14 bp, Homo sapiens
tggtcgcccaggag

SEQ ID NO: 2820756 - DNA, 23 bp, Homo sapiens
tggtctcaaactcttgacctcag

SEQ ID NO: 2820757 - DNA, 22 bp, Homo sapiens
tggtctctgctgaaggttgtaa

SEQ ID NO: 2820758 - DNA, 18 bp, Homo sapiens
tggtctgacccactgctt

SEQ ID NO: 2820759 - DNA, 19 bp, Homo sapiens
tggtctgctcaggaattga

SEQ ID NO: 2820760 - DNA, 12 bp, Homo sapiens
tggtctgtgtga

SEQ ID NO: 2820761 - DNA, 19 bp, Homo sapiens
tggtcttcaaattgtcttt

SEQ ID NO: 2820762 - DNA, 17 bp, Homo sapiens
tggttcctttctcagcc

SEQ ID NO: 2820763 - DNA, 15 bp, Homo sapiens
tggttctaatagaac

SEQ ID NO: 2820764 - DNA, 15 bp, Homo sapiens
tggttgactgggttt

SEQ ID NO: 2820765 - DNA, 14 bp, Homo sapiens
tggttgatgccaaa

SEQ ID NO: 2820766 - DNA, 21 bp, Homo sapiens
tggttggccgtggtccagctc

SEQ ID NO: 2820767 - DNA, 16 bp, Homo sapiens
tggtttactgctgtca

SEQ ID NO: 2820768 - DNA, 21 bp, Homo sapiens
tggtttccacgatgaaaaact

SEQ ID NO: 2820769 - DNA, 18 bp, Homo sapiens
tggtttcccaagagctac

SEQ ID NO: 2820770 - DNA, 12 bp, Homo sapiens
tggtttctccag

SEQ ID NO: 2820771 - DNA, 20 bp, Homo sapiens
tggtttgatggtgacttcct

SEQ ID NO: 2820772 - DNA, 15 bp, Homo sapiens
tggtttgcaaggaag

SEQ ID NO: 2820773 - DNA, 22 bp, Homo sapiens
tggttttcctaaatgcagtgaa

SEQ ID NO: 2820774 - DNA, 14 bp, Homo sapiens
tgtaaaataagtat

SEQ ID NO: 2820775 - DNA, 21 bp, Homo sapiens
tgtaaaatcttggcacagaaa

SEQ ID NO: 2820776 - DNA, 13 bp, Homo sapiens
tgtaaaatgcagt

SEQ ID NO: 2820777 - DNA, 15 bp, Homo sapiens
tgtaaaatgcagtcc

SEQ ID NO: 2820778 - DNA, 18 bp, Homo sapiens
tgtaaaatgcagtccaga

SEQ ID NO: 2820779 - DNA, 15 bp, Homo sapiens
tgtaaagaataaatg

SEQ ID NO: 2820780 - DNA, 20 bp, Homo sapiens
tgtaaagaataaatgaatct

SEQ ID NO: 2820781 - DNA, 18 bp, Homo sapiens
tgtaaagccaacaccctg

SEQ ID NO: 2820782 - DNA, 19 bp, Homo sapiens
tgtaaagtaggaaaaataa

SEQ ID NO: 2820783 - DNA, 23 bp, Homo sapiens
tgtaaatacaaaataaaattatg

SEQ ID NO: 2820784 - DNA, 19 bp, Homo sapiens
tgtaaatacatgtgtggat

SEQ ID NO: 2820785 - DNA, 22 bp, Homo sapiens
tgtaaatagttttaaatatgaa

SEQ ID NO: 2820786 - DNA, 23 bp, Homo sapiens
tgtaaatagttttaaatatgaac

SEQ ID NO: 2820787 - DNA, 11 bp, Homo sapiens
tgtaaatatag

SEQ ID NO: 2820788 - DNA, 13 bp, Homo sapiens
tgtaaatatttat

SEQ ID NO: 2820789 - DNA, 14 bp, Homo sapiens
tgtaaatattttaa

SEQ ID NO: 2820790 - DNA, 19 bp, Homo sapiens
tgtaaatcctttttcttta

SEQ ID NO: 2820791 - DNA, 16 bp, Homo sapiens
tgtaaattcctgttgt

SEQ ID NO: 2820792 - DNA, 17 bp, Homo sapiens
tgtaacaagccacccca

SEQ ID NO: 2820793 - DNA, 16 bp, Homo sapiens
tgtaacacaagccaca

SEQ ID NO: 2820794 - DNA, 18 bp, Homo sapiens
tgtaacaggtctcctctt

SEQ ID NO: 2820795 - DNA, 22 bp, Homo sapiens
tgtaacaggtctcctcttaaaa

SEQ ID NO: 2820796 - DNA, 14 bp, Homo sapiens
tgtaaccagattaa

SEQ ID NO: 2820797 - DNA, 18 bp, Homo sapiens
tgtaactatatcatcctt

SEQ ID NO: 2820798 - DNA, 16 bp, Homo sapiens
tgtaacttttgtaaga

SEQ ID NO: 2820799 - DNA, 15 bp, Homo sapiens
tgtaagaaaatttga

SEQ ID NO: 2820800 - DNA, 17 bp, Homo sapiens
tgtaaggaattgaagat

SEQ ID NO: 2820801 - DNA, 14 bp, Homo sapiens
tgtaagtaattatc

SEQ ID NO: 2820802 - DNA, 13 bp, Homo sapiens
tgtaagtttattt

SEQ ID NO: 2820803 - DNA, 14 bp, Homo sapiens
tgtaatcaatgttt

SEQ ID NO: 2820804 - DNA, 15 bp, Homo sapiens
tgtaatcccagcact

SEQ ID NO: 2820805 - DNA, 15 bp, Homo sapiens
tgtaatcccagctac

SEQ ID NO: 2820806 - DNA, 20 bp, Homo sapiens
tgtaatcccagctactcagg

SEQ ID NO: 2820807 - DNA, 18 bp, Homo sapiens
tgtaatcgttatgtgtgt

SEQ ID NO: 2820808 - DNA, 19 bp, Homo sapiens
tgtaatcgttatgtgtgta

SEQ ID NO: 2820809 - DNA, 12 bp, Homo sapiens
tgtaatcttaaa

SEQ ID NO: 2820810 - DNA, 18 bp, Homo sapiens
tgtaatcttaaaagtgta

SEQ ID NO: 2820811 - DNA, 13 bp, Homo sapiens
tgtaatgcacaat

SEQ ID NO: 2820812 - DNA, 14 bp, Homo sapiens
tgtaatgcacaatt

SEQ ID NO: 2820813 - DNA, 16 bp, Homo sapiens
tgtaatgcacaattta

SEQ ID NO: 2820814 - DNA, 14 bp, Homo sapiens
tgtaatgtatctta

SEQ ID NO: 2820815 - DNA, 15 bp, Homo sapiens
tgtaatgtatcttat

SEQ ID NO: 2820816 - DNA, 17 bp, Homo sapiens
tgtaatgtatcttattt

SEQ ID NO: 2820817 - DNA, 13 bp, Homo sapiens
tgtaatgtcacca

SEQ ID NO: 2820818 - DNA, 16 bp, Homo sapiens
tgtaatgtcaccacct

SEQ ID NO: 2820819 - DNA, 13 bp, Homo sapiens
tgtaattctaaat

SEQ ID NO: 2820820 - DNA, 16 bp, Homo sapiens
tgtaattctaaatgaa

SEQ ID NO: 2820821 - DNA, 17 bp, Homo sapiens
tgtaattttgtagtagt

SEQ ID NO: 2820822 - DNA, 18 bp, Homo sapiens
tgtacaaagatatgctaa

SEQ ID NO: 2820823 - DNA, 18 bp, Homo sapiens
tgtacaaagtagagaagt

SEQ ID NO: 2820824 - DNA, 15 bp, Homo sapiens
tgtacaatatttaaa

SEQ ID NO: 2820825 - DNA, 17 bp, Homo sapiens
tgtacaatatttaaaat

SEQ ID NO: 2820826 - DNA, 16 bp, Homo sapiens
tgtacacgtgtcctgt

SEQ ID NO: 2820827 - DNA, 22 bp, Homo sapiens
tgtacactggatatgttgttaa

SEQ ID NO: 2820828 - DNA, 21 bp, Homo sapiens
tgtacagaattctgctacctc

SEQ ID NO: 2820829 - DNA, 13 bp, Homo sapiens
tgtacagaatttt

SEQ ID NO: 2820830 - DNA, 18 bp, Homo sapiens
tgtacagaatttttaatg

SEQ ID NO: 2820831 - DNA, 22 bp, Homo sapiens
tgtacagaatttttaatgactt

SEQ ID NO: 2820832 - DNA, 13 bp, Homo sapiens
tgtacagcatgca

SEQ ID NO: 2820833 - DNA, 16 bp, Homo sapiens
tgtacagtggagaaat

SEQ ID NO: 2820834 - DNA, 18 bp, Homo sapiens
tgtacatagttatttatt

SEQ ID NO: 2820835 - DNA, 22 bp, Homo sapiens
tgtacatataggagcaatacta

SEQ ID NO: 2820836 - DNA, 22 bp, Homo sapiens
tgtacatatggaaatcctgtta

SEQ ID NO: 2820837 - DNA, 11 bp, Homo sapiens
tgtacatgtgt

SEQ ID NO: 2820838 - DNA, 12 bp, Homo sapiens
tgtacatgtgta

SEQ ID NO: 2820839 - DNA, 12 bp, Homo sapiens
tgtacattcctg

SEQ ID NO: 2820840 - DNA, 16 bp, Homo sapiens
tgtacatttctgaaat

SEQ ID NO: 2820841 - DNA, 15 bp, Homo sapiens
tgtaccagtgtactg

SEQ ID NO: 2820842 - DNA, 18 bp, Homo sapiens
tgtaccagtgtactgctt

SEQ ID NO: 2820843 - DNA, 12 bp, Homo sapiens
tgtaccagtgtg

SEQ ID NO: 2820844 - DNA, 13 bp, Homo sapiens
tgtaccagtgtga

SEQ ID NO: 2820845 - DNA, 12 bp, Homo sapiens
tgtaccatcaat

SEQ ID NO: 2820846 - DNA, 13 bp, Homo sapiens
tgtaccatgttaa

SEQ ID NO: 2820847 - DNA, 12 bp, Homo sapiens
tgtacccaccgg

SEQ ID NO: 2820848 - DNA, 21 bp, Homo sapiens
tgtacccaccgggccactcct

SEQ ID NO: 2820849 - DNA, 21 bp, Homo sapiens
tgtaccgcgtctaccctggga

SEQ ID NO: 2820850 - DNA, 12 bp, Homo sapiens
tgtactatgtta

SEQ ID NO: 2820851 - DNA, 20 bp, Homo sapiens
tgtactgaaaaatggtaatt

SEQ ID NO: 2820852 - DNA, 20 bp, Homo sapiens
tgtactgagccttgtaattc

SEQ ID NO: 2820853 - DNA, 23 bp, Homo sapiens
tggcttccaggtatctccaggat

SEQ ID NO: 2820854 - DNA, 19 bp, Homo sapiens
tggcttcccatccccagcg

SEQ ID NO: 2820855 - DNA, 15 bp, Homo sapiens
tggcttcccatgtct

SEQ ID NO: 2820856 - DNA, 22 bp, Homo sapiens
tggcttcctaaaattcagtgga

SEQ ID NO: 2820857 - DNA, 21 bp, Homo sapiens
tggcttcctccgtctgcaatg

SEQ ID NO: 2820858 - DNA, 17 bp, Homo sapiens
tggctttacattttatt

SEQ ID NO: 2820859 - DNA, 20 bp, Homo sapiens
tggctttaggagcagtggga

SEQ ID NO: 2820860 - DNA, 20 bp, Homo sapiens
tgggaaaagtgttattattt

SEQ ID NO: 2820861 - DNA, 16 bp, Homo sapiens
tgggaaccatgaagct

SEQ ID NO: 2820862 - DNA, 22 bp, Homo sapiens
tgggaaccccttcatcctctga

SEQ ID NO: 2820863 - DNA, 14 bp, Homo sapiens
tgggaactggaggg

SEQ ID NO: 2820864 - DNA, 23 bp, Homo sapiens
tgggaagtcgtccttactcctgt

SEQ ID NO: 2820865 - DNA, 20 bp, Homo sapiens
tgggacccatagatcttctg

SEQ ID NO: 2820866 - DNA, 18 bp, Homo sapiens
tgggaccctttccttcct

SEQ ID NO: 2820867 - DNA, 15 bp, Homo sapiens
tgggaccgctacacc

SEQ ID NO: 2820868 - DNA, 14 bp, Homo sapiens
tgggactacaggca

SEQ ID NO: 2820869 - DNA, 21 bp, Homo sapiens
tgggagaactttgtacagtgg

SEQ ID NO: 2820870 - DNA, 14 bp, Homo sapiens
tgggagaagccgca

SEQ ID NO: 2820871 - DNA, 22 bp, Homo sapiens
tgggagcctgcaaactcactgc

SEQ ID NO: 2820872 - DNA, 12 bp, Homo sapiens
tgggagctgcct

SEQ ID NO: 2820873 - DNA, 13 bp, Homo sapiens
tgggagctgcctg

SEQ ID NO: 2820874 - DNA, 14 bp, Homo sapiens
tgggagctgcctgt

SEQ ID NO: 2820875 - DNA, 23 bp, Homo sapiens
tgggagctgcctgttcagctcca

SEQ ID NO: 2820876 - DNA, 24 bp, Homo sapiens
tgggagctgcctgttcagctccag

SEQ ID NO: 2820877 - DNA, 18 bp, Homo sapiens
tgggagctggttagaaat

SEQ ID NO: 2820878 - DNA, 19 bp, Homo sapiens
tgggagctggttagaaatg

SEQ ID NO: 2820879 - DNA, 20 bp, Homo sapiens
tgggagctggttagaaatgc

SEQ ID NO: 2820880 - DNA, 14 bp, Homo sapiens
tgggaggaacctga

SEQ ID NO: 2820881 - DNA, 11 bp, Homo sapiens
tgggaggaagc

SEQ ID NO: 2820882 - DNA, 11 bp, Homo sapiens
tgggaggctga

SEQ ID NO: 2820883 - DNA, 13 bp, Homo sapiens
tgggaggctgagg

SEQ ID NO: 2820884 - DNA, 14 bp, Homo sapiens
tgggaggctgaggc

SEQ ID NO: 2820885 - DNA, 23 bp, Homo sapiens
tgggaggtcttggccgactcagg

SEQ ID NO: 2820886 - DNA, 13 bp, Homo sapiens
tgggatggaggag

SEQ ID NO: 2820887 - DNA, 16 bp, Homo sapiens
tgggatggaggagaag

SEQ ID NO: 2820888 - DNA, 20 bp, Homo sapiens
tgggattcaggaaaaggcct

SEQ ID NO: 2820889 - DNA, 23 bp, Homo sapiens
tgggattcccaccaaggtcttca

SEQ ID NO: 2820890 - DNA, 19 bp, Homo sapiens
tgggattgtggtacaatct

SEQ ID NO: 2820891 - DNA, 14 bp, Homo sapiens
tgggattttaaaaa

SEQ ID NO: 2820892 - DNA, 17 bp, Homo sapiens
tgggcaacccccagcct

SEQ ID NO: 2820893 - DNA, 20 bp, Homo sapiens
tgggcaacccccagcctgct

SEQ ID NO: 2820894 - DNA, 21 bp, Homo sapiens
tgggcaacccccagcctgcta

SEQ ID NO: 2820895 - DNA, 16 bp, Homo sapiens
tgggcacccccagcct

SEQ ID NO: 2820896 - DNA, 17 bp, Homo sapiens
tgggcacccccagcctg

SEQ ID NO: 2820897 - DNA, 19 bp, Homo sapiens
tgggcacccccagcctggg

SEQ ID NO: 2820898 - DNA, 21 bp, Homo sapiens
tgggcacccccagcctgggcc

SEQ ID NO: 2820899 - DNA, 15 bp, Homo sapiens
tgggcagaagggaga

SEQ ID NO: 2820900 - DNA, 18 bp, Homo sapiens
tgggcagcagctcagcct

SEQ ID NO: 2820901 - DNA, 19 bp, Homo sapiens
tgggcagcttgagagggca

SEQ ID NO: 2820902 - DNA, 10 bp, Homo sapiens
tgggcagggc

SEQ ID NO: 2820903 - DNA, 13 bp, Homo sapiens
tgggcagggctgg

SEQ ID NO: 2820904 - DNA, 21 bp, Homo sapiens
tgggcagggctgggagaactt

SEQ ID NO: 2820905 - DNA, 20 bp, Homo sapiens
tgggcaggtctcctctggga

SEQ ID NO: 2820906 - DNA, 16 bp, Homo sapiens
tgggccaactcacctg

SEQ ID NO: 2820907 - DNA, 23 bp, Homo sapiens
tgggccaattaaaatatatataa

SEQ ID NO: 2820908 - DNA, 15 bp, Homo sapiens
tgggccactctcccc

SEQ ID NO: 2820909 - DNA, 14 bp, Homo sapiens
tgggccaggacagg

SEQ ID NO: 2820910 - DNA, 17 bp, Homo sapiens
tgggccaggacaggccc

SEQ ID NO: 2820911 - DNA, 13 bp, Homo sapiens
tgggccctggggc

SEQ ID NO: 2820912 - DNA, 14 bp, Homo sapiens
tgggccctggggcc

SEQ ID NO: 2820913 - DNA, 16 bp, Homo sapiens
tgggccctggggcctg

SEQ ID NO: 2820914 - DNA, 20 bp, Homo sapiens
tgggcctatggagagccctg

SEQ ID NO: 2820915 - DNA, 20 bp, Homo sapiens
tgggcctcctctccctgcac

SEQ ID NO: 2820916 - DNA, 18 bp, Homo sapiens
tgggcctcctctgtccag

SEQ ID NO: 2820917 - DNA, 20 bp, Homo sapiens
tgggcctcctctgtccaggg

SEQ ID NO: 2820918 - DNA, 22 bp, Homo sapiens
tgggcctcctgtgtgtgcgcct

SEQ ID NO: 2820919 - DNA, 12 bp, Homo sapiens
tgtttgagcgca

SEQ ID NO: 2820920 - DNA, 16 bp, Homo sapiens
tgtttgcctctgcctc

SEQ ID NO: 2820921 - DNA, 20 bp, Homo sapiens
tgtttgccttctacttttaa

SEQ ID NO: 2820922 - DNA, 16 bp, Homo sapiens
tgtttgggcagaaggg

SEQ ID NO: 2820923 - DNA, 23 bp, Homo sapiens
tgtttggggcaggagtagctgag

SEQ ID NO: 2820924 - DNA, 15 bp, Homo sapiens
tgtttggtcactgct

SEQ ID NO: 2820925 - DNA, 16 bp, Homo sapiens
tgtttgtcagatatga

SEQ ID NO: 2820926 - DNA, 14 bp, Homo sapiens
tgtttgtgtgagag

SEQ ID NO: 2820927 - DNA, 20 bp, Homo sapiens
tgttttaaacatagaaagtt

SEQ ID NO: 2820928 - DNA, 22 bp, Homo sapiens
tgttttaaatttatttcaaaaa

SEQ ID NO: 2820929 - DNA, 15 bp, Homo sapiens
tgttttcagactcag

SEQ ID NO: 2820930 - DNA, 23 bp, Homo sapiens
tgttttctaaagttgttcacata

SEQ ID NO: 2820931 - DNA, 20 bp, Homo sapiens
tgttttctgatgacataata

SEQ ID NO: 2820932 - DNA, 20 bp, Homo sapiens
tgtttttaaaaatcataaac

SEQ ID NO: 2820933 - DNA, 12 bp, Homo sapiens
tgtttttaactc

SEQ ID NO: 2820934 - DNA, 15 bp, Homo sapiens
tgtttttaagctgtt

SEQ ID NO: 2820935 - DNA, 20 bp, Homo sapiens
tgtttttaagctgtttccat

SEQ ID NO: 2820936 - DNA, 12 bp, Homo sapiens
tgttttttctaa

SEQ ID NO: 2820937 - DNA, 14 bp, Homo sapiens
tgttttttgaaaac

SEQ ID NO: 2820938 - DNA, 16 bp, Homo sapiens
tgttttttgaaaacat

SEQ ID NO: 2820939 - DNA, 18 bp, Homo sapiens
ttaaaaaaagtatatatt

SEQ ID NO: 2820940 - DNA, 11 bp, Homo sapiens
ttaaaaaacaa

SEQ ID NO: 2820941 - DNA, 12 bp, Homo sapiens
ttaaaaaagctt

SEQ ID NO: 2820942 - DNA, 19 bp, Homo sapiens
ttaaaaaagcttaaaactt

SEQ ID NO: 2820943 - DNA, 14 bp, Homo sapiens
ttaaaaaataaata

SEQ ID NO: 2820944 - DNA, 17 bp, Homo sapiens
ttaaaaaataaatataa

SEQ ID NO: 2820945 - DNA, 19 bp, Homo sapiens
ttaaaaaataaatataatt

SEQ ID NO: 2820946 - DNA, 22 bp, Homo sapiens
ttaaaaacattccccaattatc

SEQ ID NO: 2820947 - DNA, 20 bp, Homo sapiens
ttaaaaagttaatcttcatg

SEQ ID NO: 2820948 - DNA, 13 bp, Homo sapiens
ttaaaaccatgca

SEQ ID NO: 2820949 - DNA, 16 bp, Homo sapiens
ttaaaaccatgcagct

SEQ ID NO: 2820950 - DNA, 20 bp, Homo sapiens
ttaaaaccatgcagcttcat

SEQ ID NO: 2820951 - DNA, 15 bp, Homo sapiens
ttaaaactttgaagt

SEQ ID NO: 2820952 - DNA, 11 bp, Homo sapiens
ttaaaagacag

SEQ ID NO: 2820953 - DNA, 13 bp, Homo sapiens
ttaaaagacagtg

SEQ ID NO: 2820954 - DNA, 21 bp, Homo sapiens
ttaaaagttgggaaaagtgtt

SEQ ID NO: 2820955 - DNA, 16 bp, Homo sapiens
ttaaaataaaataatt

SEQ ID NO: 2820956 - DNA, 19 bp, Homo sapiens
ttaaaatagcaaaagaaga

SEQ ID NO: 2820957 - DNA, 22 bp, Homo sapiens
ttaaaatagcaaaagaagaagt

SEQ ID NO: 2820958 - DNA, 14 bp, Homo sapiens
ttaaaatatatata

SEQ ID NO: 2820959 - DNA, 18 bp, Homo sapiens
ttaaaatatatataaata

SEQ ID NO: 2820960 - DNA, 14 bp, Homo sapiens
ttaaaatattttat

SEQ ID NO: 2820961 - DNA, 16 bp, Homo sapiens
ttaaaatgtacactgg

SEQ ID NO: 2820962 - DNA, 22 bp, Homo sapiens
ttaaaattaaagtatacatttt

SEQ ID NO: 2820963 - DNA, 15 bp, Homo sapiens
ttaaacactgtaatc

SEQ ID NO: 2820964 - DNA, 19 bp, Homo sapiens
ttaaaccagcagaaaagtg

SEQ ID NO: 2820965 - DNA, 22 bp, Homo sapiens
ttaaaccagcagaaaagtgctt

SEQ ID NO: 2820966 - DNA, 13 bp, Homo sapiens
ttaaactagtaat

SEQ ID NO: 2820967 - DNA, 17 bp, Homo sapiens
ttaaacttgtcagaatt

SEQ ID NO: 2820968 - DNA, 21 bp, Homo sapiens
ttaaagcagagggactttgta

SEQ ID NO: 2820969 - DNA, 22 bp, Homo sapiens
ttaaagcagagggactttgtat

SEQ ID NO: 2820970 - DNA, 15 bp, Homo sapiens
ttaaagcatttactt

SEQ ID NO: 2820971 - DNA, 11 bp, Homo sapiens
ttaaataaaag

SEQ ID NO: 2820972 - DNA, 18 bp, Homo sapiens
ttaaataaatgtcattaa

SEQ ID NO: 2820973 - DNA, 15 bp, Homo sapiens
ttaaataagaaactt

SEQ ID NO: 2820974 - DNA, 18 bp, Homo sapiens
ttaaatacagacactaag

SEQ ID NO: 2820975 - DNA, 17 bp, Homo sapiens
ttaaatatgaacaaaga

SEQ ID NO: 2820976 - DNA, 20 bp, Homo sapiens
ttaaatattgaataagtatt

SEQ ID NO: 2820977 - DNA, 18 bp, Homo sapiens
ttaaatatttacatatga

SEQ ID NO: 2820978 - DNA, 11 bp, Homo sapiens
ttaaatcactg

SEQ ID NO: 2820979 - DNA, 20 bp, Homo sapiens
ttaaatcccattcataactt

SEQ ID NO: 2820980 - DNA, 21 bp, Homo sapiens
ttaacaaaacaagaaagaaac

SEQ ID NO: 2820981 - DNA, 17 bp, Homo sapiens
ttaacatctattataaa

SEQ ID NO: 2820982 - DNA, 14 bp, Homo sapiens
ttaacattctgtaa

SEQ ID NO: 2820983 - DNA, 19 bp, Homo sapiens
ttaacatttatctaaaaga

SEQ ID NO: 2820984 - DNA, 13 bp, Homo sapiens
ttaaccctctctt

SEQ ID NO: 2820985 - DNA, 16 bp, Homo sapiens
ttaaccgtttttcaag

SEQ ID NO: 2820986 - DNA, 19 bp, Homo sapiens
ttaacctcagtgtcattta

SEQ ID NO: 2820987 - DNA, 19 bp, Homo sapiens
ttaacctgtttatataatt

SEQ ID NO: 2820988 - DNA, 19 bp, Homo sapiens
ttaacggctccaggatttt

SEQ ID NO: 2820989 - DNA, 15 bp, Homo sapiens
ttaactaatttaaac

SEQ ID NO: 2820990 - DNA, 12 bp, Homo sapiens
ttaactagaatt

SEQ ID NO: 2820991 - DNA, 15 bp, Homo sapiens
ttaactagaatttat

SEQ ID NO: 2820992 - DNA, 17 bp, Homo sapiens
ttaactgggtaatgaaa

SEQ ID NO: 2820993 - DNA, 21 bp, Homo sapiens
ttaactgtgtgaagaaatgga

SEQ ID NO: 2820994 - DNA, 13 bp, Homo sapiens
ttaacttaaatag

SEQ ID NO: 2820995 - DNA, 18 bp, Homo sapiens
ttaactttatcacattat

SEQ ID NO: 2820996 - DNA, 17 bp, Homo sapiens
ttaagacttgacagtgg

SEQ ID NO: 2820997 - DNA, 14 bp, Homo sapiens
ttaagagatacatt

SEQ ID NO: 2820998 - DNA, 15 bp, Homo sapiens
ttaagagatacattc

SEQ ID NO: 2820999 - DNA, 18 bp, Homo sapiens
ttaagagatacattccct

SEQ ID NO: 2821000 - DNA, 14 bp, Homo sapiens
ttaagataattata

SEQ ID NO: 2821001 - DNA, 16 bp, Homo sapiens
ttaagcagcctttctg

SEQ ID NO: 2821002 - DNA, 22 bp, Homo sapiens
ttaagcattttactgtctgtaa

SEQ ID NO: 2821003 - DNA, 12 bp, Homo sapiens
ttaagcttattt

SEQ ID NO: 2821004 - DNA, 19 bp, Homo sapiens
ttaaggaggtagctcccag

SEQ ID NO: 2821005 - DNA, 17 bp, Homo sapiens
ttaagtatatagtatat

SEQ ID NO: 2821006 - DNA, 11 bp, Homo sapiens
ttaagtattta

SEQ ID NO: 2821007 - DNA, 13 bp, Homo sapiens
ttaagtcagaaca

SEQ ID NO: 2821008 - DNA, 23 bp, Homo sapiens
ttaagtctctgactcttgccttt

SEQ ID NO: 2821009 - DNA, 12 bp, Homo sapiens
ttaagttacttc

SEQ ID NO: 2821010 - DNA, 12 bp, Homo sapiens
tgtgtgaagaaa

SEQ ID NO: 2821011 - DNA, 14 bp, Homo sapiens
tgtgtgagcatctc

SEQ ID NO: 2821012 - DNA, 16 bp, Homo sapiens
tgtgtgagcatctctg

SEQ ID NO: 2821013 - DNA, 16 bp, Homo sapiens
tgtgtgattgaatctg

SEQ ID NO: 2821014 - DNA, 19 bp, Homo sapiens
tgtgtgcacgtacacacac

SEQ ID NO: 2821015 - DNA, 20 bp, Homo sapiens
tgtgtggtgggttctttgga

SEQ ID NO: 2821016 - DNA, 14 bp, Homo sapiens
tgtgtgtcccccta

SEQ ID NO: 2821017 - DNA, 18 bp, Homo sapiens
tgtgtgtcttttataaaa

SEQ ID NO: 2821018 - DNA, 14 bp, Homo sapiens
tgtgtgtgtatgct

SEQ ID NO: 2821019 - DNA, 22 bp, Homo sapiens
tgtgtgttgatcccaagacaat

SEQ ID NO: 2821020 - DNA, 13 bp, Homo sapiens
tgtgtgtttggaa

SEQ ID NO: 2821021 - DNA, 16 bp, Homo sapiens
tgtgttatttaaatga

SEQ ID NO: 2821022 - DNA, 13 bp, Homo sapiens
tgtgtttagattt

SEQ ID NO: 2821023 - DNA, 10 bp, Homo sapiens
tgtgtttcta

SEQ ID NO: 2821024 - DNA, 15 bp, Homo sapiens
tgtgtttctaaaact

SEQ ID NO: 2821025 - DNA, 19 bp, Homo sapiens
tgttaaaaaaataagaaga

SEQ ID NO: 2821026 - DNA, 21 bp, Homo sapiens
tgttaaaaatattttctgaat

SEQ ID NO: 2821027 - DNA, 15 bp, Homo sapiens
tgttaaaatattgat

SEQ ID NO: 2821028 - DNA, 18 bp, Homo sapiens
tgttaaaatgtacactgg

SEQ ID NO: 2821029 - DNA, 20 bp, Homo sapiens
tgttaaagaggcgtcttgta

SEQ ID NO: 2821030 - DNA, 16 bp, Homo sapiens
tgttaaatatttacat

SEQ ID NO: 2821031 - DNA, 14 bp, Homo sapiens
tgttaacttagctt

SEQ ID NO: 2821032 - DNA, 19 bp, Homo sapiens
tgttaataataagataatg

SEQ ID NO: 2821033 - DNA, 14 bp, Homo sapiens
tgttaatgaaaatg

SEQ ID NO: 2821034 - DNA, 17 bp, Homo sapiens
tgttaatgaaaatgtca

SEQ ID NO: 2821035 - DNA, 19 bp, Homo sapiens
tgttaatgaaaatgtcaga

SEQ ID NO: 2821036 - DNA, 19 bp, Homo sapiens
tgttaatgcatttttgatg

SEQ ID NO: 2821037 - DNA, 20 bp, Homo sapiens
tgttaatggtgcaaatccta

SEQ ID NO: 2821038 - DNA, 18 bp, Homo sapiens
tgttaattgattaaaatc

SEQ ID NO: 2821039 - DNA, 15 bp, Homo sapiens
tgttaatttagaaaa

SEQ ID NO: 2821040 - DNA, 20 bp, Homo sapiens
tgttaatttagaaaacttta

SEQ ID NO: 2821041 - DNA, 16 bp, Homo sapiens
tgttaatttttgatac

SEQ ID NO: 2821042 - DNA, 14 bp, Homo sapiens
tgttactccacagc

SEQ ID NO: 2821043 - DNA, 12 bp, Homo sapiens
tgttacttaaat

SEQ ID NO: 2821044 - DNA, 20 bp, Homo sapiens
tgttactttttagtctttta

SEQ ID NO: 2821045 - DNA, 16 bp, Homo sapiens
tgttaggaaaatttca

SEQ ID NO: 2821046 - DNA, 15 bp, Homo sapiens
tgttagtcatttgct

SEQ ID NO: 2821047 - DNA, 22 bp, Homo sapiens
tgttatcctgctagctgtagaa

SEQ ID NO: 2821048 - DNA, 20 bp, Homo sapiens
tgttattatcctgcatttta

SEQ ID NO: 2821049 - DNA, 14 bp, Homo sapiens
tgttatttatatat

SEQ ID NO: 2821050 - DNA, 16 bp, Homo sapiens
tgttatttttgtttct

SEQ ID NO: 2821051 - DNA, 23 bp, Homo sapiens
tgttcaagaccagcctgaccaac

SEQ ID NO: 2821052 - DNA, 15 bp, Homo sapiens
tgttcaccttatgta

SEQ ID NO: 2821053 - DNA, 18 bp, Homo sapiens
tgttcacgcaacttgaaa

SEQ ID NO: 2821054 - DNA, 19 bp, Homo sapiens
tgttcacttttcctccctc

SEQ ID NO: 2821055 - DNA, 22 bp, Homo sapiens
tgttcagctccagctcaccagc

SEQ ID NO: 2821056 - DNA, 11 bp, Homo sapiens
tgttcatttcc

SEQ ID NO: 2821057 - DNA, 17 bp, Homo sapiens
tgttccaaatgaatgtt

SEQ ID NO: 2821058 - DNA, 16 bp, Homo sapiens
tgttcccaagagcatc

SEQ ID NO: 2821059 - DNA, 19 bp, Homo sapiens
tgttcccccgctggcagcc

SEQ ID NO: 2821060 - DNA, 17 bp, Homo sapiens
tgttcctggctttgaca

SEQ ID NO: 2821061 - DNA, 18 bp, Homo sapiens
tgttctcaatgcttttct

SEQ ID NO: 2821062 - DNA, 13 bp, Homo sapiens
tgttctctgagga

SEQ ID NO: 2821063 - DNA, 14 bp, Homo sapiens
tgttctggagctgc

SEQ ID NO: 2821064 - DNA, 12 bp, Homo sapiens
tgttctgggaca

SEQ ID NO: 2821065 - DNA, 14 bp, Homo sapiens
tgttctgggacaca

SEQ ID NO: 2821066 - DNA, 19 bp, Homo sapiens
tgttctttttaaaaagttg

SEQ ID NO: 2821067 - DNA, 14 bp, Homo sapiens
tgttgacatgtgct

SEQ ID NO: 2821068 - DNA, 17 bp, Homo sapiens
tgttgcaagtactgctg

SEQ ID NO: 2821069 - DNA, 17 bp, Homo sapiens
tgttgccacctgttaaa

SEQ ID NO: 2821070 - DNA, 13 bp, Homo sapiens
tgttgcccaggca

SEQ ID NO: 2821071 - DNA, 17 bp, Homo sapiens
tgttgcccaggcaggtc

SEQ ID NO: 2821072 - DNA, 18 bp, Homo sapiens
tgttgcccaggcaggtct

SEQ ID NO: 2821073 - DNA, 19 bp, Homo sapiens
tgttgcccaggcaggtctt

SEQ ID NO: 2821074 - DNA, 15 bp, Homo sapiens
tgttgcccaggctgg

SEQ ID NO: 2821075 - DNA, 13 bp, Homo sapiens
tgttgccctgagt

SEQ ID NO: 2821076 - DNA, 21 bp, Homo sapiens
tgttggaaaagaatacagaaa

SEQ ID NO: 2821077 - DNA, 16 bp, Homo sapiens
tgttggaattttcaaa

SEQ ID NO: 2821078 - DNA, 15 bp, Homo sapiens
tgttggccaaagcca

SEQ ID NO: 2821079 - DNA, 13 bp, Homo sapiens
tgttgtcaagtat

SEQ ID NO: 2821080 - DNA, 17 bp, Homo sapiens
tgttgtctgtttgttct

SEQ ID NO: 2821081 - DNA, 13 bp, Homo sapiens
tgttgtgattttg

SEQ ID NO: 2821082 - DNA, 21 bp, Homo sapiens
tgttgtgattttgtacagaat

SEQ ID NO: 2821083 - DNA, 15 bp, Homo sapiens
tgttgtttcttaaat

SEQ ID NO: 2821084 - DNA, 18 bp, Homo sapiens
tgtttagtagcagtgatt

SEQ ID NO: 2821085 - DNA, 21 bp, Homo sapiens
tgtttatgcaaggaaggaaag

SEQ ID NO: 2821086 - DNA, 13 bp, Homo sapiens
tgtttattaacaa

SEQ ID NO: 2821087 - DNA, 14 bp, Homo sapiens
tgtttattaacaaa

SEQ ID NO: 2821088 - DNA, 15 bp, Homo sapiens
tgtttatttatcagt

SEQ ID NO: 2821089 - DNA, 14 bp, Homo sapiens
tgtttccagaaaat

SEQ ID NO: 2821090 - DNA, 21 bp, Homo sapiens
tgtttccagaaaatataaatg

SEQ ID NO: 2821091 - DNA, 14 bp, Homo sapiens
tgtttcccataatt

SEQ ID NO: 2821092 - DNA, 11 bp, Homo sapiens
tgtttcctgag

SEQ ID NO: 2821093 - DNA, 11 bp, Homo sapiens
tgtttcctttt

SEQ ID NO: 2821094 - DNA, 17 bp, Homo sapiens
tgtttctactttgatat

SEQ ID NO: 2821095 - DNA, 24 bp, Homo sapiens
tgtttctattctctcctcagactg

SEQ ID NO: 2821096 - DNA, 15 bp, Homo sapiens
tgtttctccccctgg

SEQ ID NO: 2821097 - DNA, 22 bp, Homo sapiens
tgtttctgcagtagtctctgtg

SEQ ID NO: 2821098 - DNA, 17 bp, Homo sapiens
tgtttcttccaaagcac

SEQ ID NO: 2821099 - DNA, 15 bp, Homo sapiens
tgtttgagatgtgat

SEQ ID NO: 2821100 - DNA, 16 bp, Homo sapiens
tgtttgagatgtgatg

SEQ ID NO: 2821101 - DNA, 23 bp, Homo sapiens
ttaagttagagaatatatttttg

SEQ ID NO: 2821102 - DNA, 22 bp, Homo sapiens
ttaataaacgaagataaatcat

SEQ ID NO: 2821103 - DNA, 19 bp, Homo sapiens
ttaatactataaataatat

SEQ ID NO: 2821104 - DNA, 22 bp, Homo sapiens
ttaatacttaacattgatttat

SEQ ID NO: 2821105 - DNA, 19 bp, Homo sapiens
ttaatagaatataattatc

SEQ ID NO: 2821106 - DNA, 18 bp, Homo sapiens
ttaatagcaaagaattga

SEQ ID NO: 2821107 - DNA, 22 bp, Homo sapiens
ttaatattcattgtataaaaat

SEQ ID NO: 2821108 - DNA, 18 bp, Homo sapiens
ttaatcgaaatgaattta

SEQ ID NO: 2821109 - DNA, 15 bp, Homo sapiens
ttaatgaaaatgtca

SEQ ID NO: 2821110 - DNA, 13 bp, Homo sapiens
ttaatgaactgtg

SEQ ID NO: 2821111 - DNA, 15 bp, Homo sapiens
ttaatgactttttat

SEQ ID NO: 2821112 - DNA, 18 bp, Homo sapiens
ttaatgactttttataat

SEQ ID NO: 2821113 - DNA, 20 bp, Homo sapiens
ttaatgcatgttaggaaaat

SEQ ID NO: 2821114 - DNA, 23 bp, Homo sapiens
ttaatgcctctcccgcaccaggc

SEQ ID NO: 2821115 - DNA, 16 bp, Homo sapiens
ttaatgccttccacat

SEQ ID NO: 2821116 - DNA, 17 bp, Homo sapiens
ttaatggtgccttcatt

SEQ ID NO: 2821117 - DNA, 22 bp, Homo sapiens
ttaatgttctgaataatttctt

SEQ ID NO: 2821118 - DNA, 20 bp, Homo sapiens
ttaattaggggttgctaaga

SEQ ID NO: 2821119 - DNA, 13 bp, Homo sapiens
ttaattatctgat

SEQ ID NO: 2821120 - DNA, 16 bp, Homo sapiens
ttaattatctgatcgg

SEQ ID NO: 2821121 - DNA, 17 bp, Homo sapiens
ttaattctcatgtgatc

SEQ ID NO: 2821122 - DNA, 11 bp, Homo sapiens
ttaattgtgtc

SEQ ID NO: 2821123 - DNA, 11 bp, Homo sapiens
ttaatttgtgt

SEQ ID NO: 2821124 - DNA, 15 bp, Homo sapiens
ttacaaaaatagtag

SEQ ID NO: 2821125 - DNA, 12 bp, Homo sapiens
ttacaaaatact

SEQ ID NO: 2821126 - DNA, 17 bp, Homo sapiens
ttacaaagaggttttat

SEQ ID NO: 2821127 - DNA, 18 bp, Homo sapiens
ttacaaagcccttttata

SEQ ID NO: 2821128 - DNA, 13 bp, Homo sapiens
ttacaaatttaat

SEQ ID NO: 2821129 - DNA, 14 bp, Homo sapiens
ttacaaatttaatt

SEQ ID NO: 2821130 - DNA, 23 bp, Homo sapiens
ttacaataaaatcttgaaaatgc

SEQ ID NO: 2821131 - DNA, 14 bp, Homo sapiens
ttacaataaatatt

SEQ ID NO: 2821132 - DNA, 16 bp, Homo sapiens
ttacaatgcagaattt

SEQ ID NO: 2821133 - DNA, 14 bp, Homo sapiens
ttacactctttgta

SEQ ID NO: 2821134 - DNA, 14 bp, Homo sapiens
ttacagctgcctgc

SEQ ID NO: 2821135 - DNA, 18 bp, Homo sapiens
ttacaggtggacacacaa

SEQ ID NO: 2821136 - DNA, 16 bp, Homo sapiens
ttacaggtgtactatg

SEQ ID NO: 2821137 - DNA, 17 bp, Homo sapiens
ttacaggtgtactatgg

SEQ ID NO: 2821138 - DNA, 14 bp, Homo sapiens
ttacaggtgtgaac

SEQ ID NO: 2821139 - DNA, 17 bp, Homo sapiens
ttacagtcaattttaca

SEQ ID NO: 2821140 - DNA, 17 bp, Homo sapiens
ttacatgattcatttta

SEQ ID NO: 2821141 - DNA, 13 bp, Homo sapiens
ttacatgtttgca

SEQ ID NO: 2821142 - DNA, 17 bp, Homo sapiens
ttacattgtttgtctgt

SEQ ID NO: 2821143 - DNA, 21 bp, Homo sapiens
ttaccaatttaactagtcctg

SEQ ID NO: 2821144 - DNA, 24 bp, Homo sapiens
ttaccagatttttacacatgtatc

SEQ ID NO: 2821145 - DNA, 20 bp, Homo sapiens
ttaccatgagaagagggcct

SEQ ID NO: 2821146 - DNA, 21 bp, Homo sapiens
ttacccggagaaggccgctgc

SEQ ID NO: 2821147 - DNA, 17 bp, Homo sapiens
ttacctaccacagtgtc

SEQ ID NO: 2821148 - DNA, 21 bp, Homo sapiens
ttacctaccacagtgtctgta

SEQ ID NO: 2821149 - DNA, 19 bp, Homo sapiens
ttacctcctgcccaggaga

SEQ ID NO: 2821150 - DNA, 21 bp, Homo sapiens
ttacctctgatacctcaaccc

SEQ ID NO: 2821151 - DNA, 15 bp, Homo sapiens
ttaccttcaataaag

SEQ ID NO: 2821152 - DNA, 17 bp, Homo sapiens
ttaccttcaataaagta

SEQ ID NO: 2821153 - DNA, 18 bp, Homo sapiens
ttaccttcaataaagtat

SEQ ID NO: 2821154 - DNA, 20 bp, Homo sapiens
ttacctttattaatgaactg

SEQ ID NO: 2821155 - DNA, 22 bp, Homo sapiens
ttacctttattaatgaactgtg

SEQ ID NO: 2821156 - DNA, 13 bp, Homo sapiens
ttacgactgaaga

SEQ ID NO: 2821157 - DNA, 20 bp, Homo sapiens
ttacgcacacgtacttaaat

SEQ ID NO: 2821158 - DNA, 18 bp, Homo sapiens
ttactaaagcagtgtttt

SEQ ID NO: 2821159 - DNA, 15 bp, Homo sapiens
ttatatatatatgta

SEQ ID NO: 2821160 - DNA, 20 bp, Homo sapiens
ttatatatcataaagtatgc

SEQ ID NO: 2821161 - DNA, 14 bp, Homo sapiens
ttatatatgtattt

SEQ ID NO: 2821162 - DNA, 15 bp, Homo sapiens
ttatatcagcctgag

SEQ ID NO: 2821163 - DNA, 23 bp, Homo sapiens
ttatatctaatttatacaaaata

SEQ ID NO: 2821164 - DNA, 22 bp, Homo sapiens
ttatatctgtggtcttcaaatt

SEQ ID NO: 2821165 - DNA, 14 bp, Homo sapiens
ttatatggaaattc

SEQ ID NO: 2821166 - DNA, 13 bp, Homo sapiens
ttatatttggaaa

SEQ ID NO: 2821167 - DNA, 18 bp, Homo sapiens
ttatcacattatttgcat

SEQ ID NO: 2821168 - DNA, 21 bp, Homo sapiens
ttatcatctcgaccacttttc

SEQ ID NO: 2821169 - DNA, 12 bp, Homo sapiens
ttatcattttca

SEQ ID NO: 2821170 - DNA, 16 bp, Homo sapiens
ttatcgggagcagtgt

SEQ ID NO: 2821171 - DNA, 14 bp, Homo sapiens
ttatctaaaagaat

SEQ ID NO: 2821172 - DNA, 20 bp, Homo sapiens
ttatctaatacctctgtgtg

SEQ ID NO: 2821173 - DNA, 11 bp, Homo sapiens
ttatctgtgtt

SEQ ID NO: 2821174 - DNA, 14 bp, Homo sapiens
ttatcttatttaat

SEQ ID NO: 2821175 - DNA, 17 bp, Homo sapiens
ttatcttatttaatttt

SEQ ID NO: 2821176 - DNA, 16 bp, Homo sapiens
ttatcttggactgaca

SEQ ID NO: 2821177 - DNA, 16 bp, Homo sapiens
ttatgacatcacttgt

SEQ ID NO: 2821178 - DNA, 18 bp, Homo sapiens
ttatgagctcttcatgtt

SEQ ID NO: 2821179 - DNA, 15 bp, Homo sapiens
ttatgagtttttgat

SEQ ID NO: 2821180 - DNA, 21 bp, Homo sapiens
ttatgagtttttgatagcttt

SEQ ID NO: 2821181 - DNA, 22 bp, Homo sapiens
ttatggaagattttaaattcac

SEQ ID NO: 2821182 - DNA, 23 bp, Homo sapiens
ttatggtattttcgtgcatttgt

SEQ ID NO: 2821183 - DNA, 11 bp, Homo sapiens
ttatggtgaaa

SEQ ID NO: 2821184 - DNA, 13 bp, Homo sapiens
ttatggtgaaatt

SEQ ID NO: 2821185 - DNA, 17 bp, Homo sapiens
ttatggtgtaatgcaca

SEQ ID NO: 2821186 - DNA, 19 bp, Homo sapiens
ttatggtgtaatgcacaat

SEQ ID NO: 2821187 - DNA, 18 bp, Homo sapiens
ttatgtgtgtatatgtat

SEQ ID NO: 2821188 - DNA, 14 bp, Homo sapiens
ttattaattcatta

SEQ ID NO: 2821189 - DNA, 15 bp, Homo sapiens
ttattaattcattaa

SEQ ID NO: 2821190 - DNA, 11 bp, Homo sapiens
ttattattaga

SEQ ID NO: 2821191 - DNA, 13 bp, Homo sapiens
ttattcactgtaa

SEQ ID NO: 2821192 - DNA, 13 bp, Homo sapiens
ttccagtgcatgt

SEQ ID NO: 2821193 - DNA, 19 bp, Homo sapiens
ttccagtggtaccagctca

SEQ ID NO: 2821194 - DNA, 21 bp, Homo sapiens
ttccagttcatctatggcagt

SEQ ID NO: 2821195 - DNA, 17 bp, Homo sapiens
ttccataaggaatgtag

SEQ ID NO: 2821196 - DNA, 16 bp, Homo sapiens
ttccataatgtataaa

SEQ ID NO: 2821197 - DNA, 18 bp, Homo sapiens
ttccataattatgacagt

SEQ ID NO: 2821198 - DNA, 22 bp, Homo sapiens
ttccataattatgacagttata

SEQ ID NO: 2821199 - DNA, 15 bp, Homo sapiens
ttccatgaaaatgca

SEQ ID NO: 2821200 - DNA, 24 bp, Homo sapiens
ttccatgaaaatgcaacaacatgt

SEQ ID NO: 2821201 - DNA, 21 bp, Homo sapiens
ttccatgattttacagagaat

SEQ ID NO: 2821202 - DNA, 22 bp, Homo sapiens
ttccatgcctgagggtggagac

SEQ ID NO: 2821203 - DNA, 23 bp, Homo sapiens
ttccatgcctgagggtggagact

SEQ ID NO: 2821204 - DNA, 13 bp, Homo sapiens
ttccattcttgtc

SEQ ID NO: 2821205 - DNA, 16 bp, Homo sapiens
ttccatttccagttca

SEQ ID NO: 2821206 - DNA, 16 bp, Homo sapiens
ttccatttcttcctca

SEQ ID NO: 2821207 - DNA, 21 bp, Homo sapiens
ttccatttttactaaagcagt

SEQ ID NO: 2821208 - DNA, 22 bp, Homo sapiens
ttcccaaaatgttgaaatatga

SEQ ID NO: 2821209 - DNA, 20 bp, Homo sapiens
ttcccaagagcatcatgcct

SEQ ID NO: 2821210 - DNA, 21 bp, Homo sapiens
ttcccaagagcatcatgcctc

SEQ ID NO: 2821211 - DNA, 16 bp, Homo sapiens
ttcccaataaaagtga

SEQ ID NO: 2821212 - DNA, 20 bp, Homo sapiens
ttcccacagcattcctccat

SEQ ID NO: 2821213 - DNA, 22 bp, Homo sapiens
ttcccaccagcatgtcactccc

SEQ ID NO: 2821214 - DNA, 21 bp, Homo sapiens
ttcccacccaattcaaaacat

SEQ ID NO: 2821215 - DNA, 19 bp, Homo sapiens
ttcccagagacaggaaaat

SEQ ID NO: 2821216 - DNA, 21 bp, Homo sapiens
ttcccagagtgtgaaacttcc

SEQ ID NO: 2821217 - DNA, 14 bp, Homo sapiens
ttcccagctctccc

SEQ ID NO: 2821218 - DNA, 16 bp, Homo sapiens
ttcccataattttctt

SEQ ID NO: 2821219 - DNA, 18 bp, Homo sapiens
ttcccataattttcttca

SEQ ID NO: 2821220 - DNA, 16 bp, Homo sapiens
ttcccatgatgccgct

SEQ ID NO: 2821221 - DNA, 18 bp, Homo sapiens
ttcccatgctgaattatt

SEQ ID NO: 2821222 - DNA, 14 bp, Homo sapiens
ttcccattcttgca

SEQ ID NO: 2821223 - DNA, 15 bp, Homo sapiens
ttcccatttgtaatg

SEQ ID NO: 2821224 - DNA, 14 bp, Homo sapiens
ttcccattttgcaa

SEQ ID NO: 2821225 - DNA, 13 bp, Homo sapiens
ttcccattttgga

SEQ ID NO: 2821226 - DNA, 21 bp, Homo sapiens
ttcacactgcaagagccttgg

SEQ ID NO: 2821227 - DNA, 22 bp, Homo sapiens
ttcacactgtgcgttttagagt

SEQ ID NO: 2821228 - DNA, 22 bp, Homo sapiens
ttcacattaatatttgctgaca

SEQ ID NO: 2821229 - DNA, 20 bp, Homo sapiens
ttcacatttgatgtacatgt

SEQ ID NO: 2821230 - DNA, 22 bp, Homo sapiens
ttcaccacatgtgcacatgcac

SEQ ID NO: 2821231 - DNA, 17 bp, Homo sapiens
ttcaccagagcccatgc

SEQ ID NO: 2821232 - DNA, 18 bp, Homo sapiens
ttcacccagctaatctgt

SEQ ID NO: 2821233 - DNA, 21 bp, Homo sapiens
ttcacctggaagcatttgttt

SEQ ID NO: 2821234 - DNA, 22 bp, Homo sapiens
ttcacctgtttttaagctgttt

SEQ ID NO: 2821235 - DNA, 14 bp, Homo sapiens
ttcactaccaaatg

SEQ ID NO: 2821236 - DNA, 21 bp, Homo sapiens
ttcactccggtgtgcctgcag

SEQ ID NO: 2821237 - DNA, 22 bp, Homo sapiens
ttcactccggtgtgcctgcagc

SEQ ID NO: 2821238 - DNA, 24 bp, Homo sapiens
ttcactccggtgtgcctgcagccc

SEQ ID NO: 2821239 - DNA, 22 bp, Homo sapiens
ttcactgtagaatgatttcatg

SEQ ID NO: 2821240 - DNA, 14 bp, Homo sapiens
ttcacttgcttaaa

SEQ ID NO: 2821241 - DNA, 22 bp, Homo sapiens
ttcactttaaagtctttccgtc

SEQ ID NO: 2821242 - DNA, 17 bp, Homo sapiens
ttcactttcaaaaacat

SEQ ID NO: 2821243 - DNA, 23 bp, Homo sapiens
ttcagaaaacccttttctacagt

SEQ ID NO: 2821244 - DNA, 13 bp, Homo sapiens
ttcagaaagcatt

SEQ ID NO: 2821245 - DNA, 20 bp, Homo sapiens
ttcagaaagcattacatttc

SEQ ID NO: 2821246 - DNA, 15 bp, Homo sapiens
ttcagacaagcaaca

SEQ ID NO: 2821247 - DNA, 15 bp, Homo sapiens
ttcagaccccagcgg

SEQ ID NO: 2821248 - DNA, 14 bp, Homo sapiens
ttcagactcagact

SEQ ID NO: 2821249 - DNA, 13 bp, Homo sapiens
ttcagagaagtca

SEQ ID NO: 2821250 - DNA, 20 bp, Homo sapiens
ttcagagactcagggcccca

SEQ ID NO: 2821251 - DNA, 15 bp, Homo sapiens
ttcagagaggccttt

SEQ ID NO: 2821252 - DNA, 22 bp, Homo sapiens
ttcagagatgtaccatgttaaa

SEQ ID NO: 2821253 - DNA, 17 bp, Homo sapiens
ttcagatcagtgcttga

SEQ ID NO: 2821254 - DNA, 18 bp, Homo sapiens
ttcagcaagacttctctt

SEQ ID NO: 2821255 - DNA, 15 bp, Homo sapiens
ttcagcccctcctct

SEQ ID NO: 2821256 - DNA, 19 bp, Homo sapiens
ttcagcccctcctctgcca

SEQ ID NO: 2821257 - DNA, 20 bp, Homo sapiens
ttcagcccctcctctgccac

SEQ ID NO: 2821258 - DNA, 22 bp, Homo sapiens
ttcagcctagccgacctcagcc

SEQ ID NO: 2821259 - DNA, 23 bp, Homo sapiens
ttcagcctagccgacctcagcct

SEQ ID NO: 2821260 - DNA, 22 bp, Homo sapiens
ttggctcacccaagcaaggcca

SEQ ID NO: 2821261 - DNA, 13 bp, Homo sapiens
ttggctgcaggga

SEQ ID NO: 2821262 - DNA, 17 bp, Homo sapiens
ttggctttaaacaccct

SEQ ID NO: 2821263 - DNA, 20 bp, Homo sapiens
ttgggaattgcatgccatct

SEQ ID NO: 2821264 - DNA, 15 bp, Homo sapiens
ttgggagcactggag

SEQ ID NO: 2821265 - DNA, 13 bp, Homo sapiens
ttgggattaatat

SEQ ID NO: 2821266 - DNA, 17 bp, Homo sapiens
ttgggatttatatctat

SEQ ID NO: 2821267 - DNA, 18 bp, Homo sapiens
ttgggcacccccagcctg

SEQ ID NO: 2821268 - DNA, 19 bp, Homo sapiens
ttgggcacccccagcctgg

SEQ ID NO: 2821269 - DNA, 21 bp, Homo sapiens
ttgggcacccccagcctgggc

SEQ ID NO: 2821270 - DNA, 19 bp, Homo sapiens
ttgggcagaagggagaagg

SEQ ID NO: 2821271 - DNA, 17 bp, Homo sapiens
ttgggccactgcactct

SEQ ID NO: 2821272 - DNA, 23 bp, Homo sapiens
ttgggccactgcactctagcctg

SEQ ID NO: 2821273 - DNA, 14 bp, Homo sapiens
ttgggccctgcaca

SEQ ID NO: 2821274 - DNA, 15 bp, Homo sapiens
ttgggccctgcacag

SEQ ID NO: 2821275 - DNA, 12 bp, Homo sapiens
ttgggcctcccc

SEQ ID NO: 2821276 - DNA, 20 bp, Homo sapiens
ttggggcaggagtagctgag

SEQ ID NO: 2821277 - DNA, 22 bp, Homo sapiens
ttggggcaggagtagctgagct

SEQ ID NO: 2821278 - DNA, 23 bp, Homo sapiens
ttggggcaggagtagctgagctc

SEQ ID NO: 2821279 - DNA, 16 bp, Homo sapiens
ttgggggctgtgggga

SEQ ID NO: 2821280 - DNA, 15 bp, Homo sapiens
ttggggtcagccagg

SEQ ID NO: 2821281 - DNA, 22 bp, Homo sapiens
ttgggtcctgcaatctccaggg

SEQ ID NO: 2821282 - DNA, 22 bp, Homo sapiens
ttgggttcaagcgattcttctg

SEQ ID NO: 2821283 - DNA, 16 bp, Homo sapiens
ttggtaacatcctttc

SEQ ID NO: 2821284 - DNA, 21 bp, Homo sapiens
ttggtaacatcctttctattg

SEQ ID NO: 2821285 - DNA, 13 bp, Homo sapiens
ttggtctgtgtga

SEQ ID NO: 2821286 - DNA, 15 bp, Homo sapiens
ttggtcttatttatt

SEQ ID NO: 2821287 - DNA, 19 bp, Homo sapiens
ttggtcttatttattattg

SEQ ID NO: 2821288 - DNA, 15 bp, Homo sapiens
ttggtgacaatgtca

SEQ ID NO: 2821289 - DNA, 15 bp, Homo sapiens
ttggtgataagtgga

SEQ ID NO: 2821290 - DNA, 12 bp, Homo sapiens
ttggtgcctggc

SEQ ID NO: 2821291 - DNA, 20 bp, Homo sapiens
ttggtgtaaagccaacaccc

SEQ ID NO: 2821292 - DNA, 16 bp, Homo sapiens
ttggtgtgtggagatg

SEQ ID NO: 2821293 - DNA, 19 bp, Homo sapiens
ttggttctaatagaactca

SEQ ID NO: 2821294 - DNA, 16 bp, Homo sapiens
ttggttctctccagga

SEQ ID NO: 2821295 - DNA, 19 bp, Homo sapiens
ttggttctctccaggaagg

SEQ ID NO: 2821296 - DNA, 12 bp, Homo sapiens
ttggttgtcaat

SEQ ID NO: 2821297 - DNA, 20 bp, Homo sapiens
ttgtaaaagaacagtaaaca

SEQ ID NO: 2821298 - DNA, 16 bp, Homo sapiens
ttgtaaactcaaaata

SEQ ID NO: 2821299 - DNA, 13 bp, Homo sapiens
ttgtaaatacacc

SEQ ID NO: 2821300 - DNA, 14 bp, Homo sapiens
ttgtaaatacacca

SEQ ID NO: 2821301 - DNA, 14 bp, Homo sapiens
ttgtaaatattgtg

SEQ ID NO: 2821302 - DNA, 13 bp, Homo sapiens
ttgtaaatattta

SEQ ID NO: 2821303 - DNA, 16 bp, Homo sapiens
ttgtaaatatttatgt

SEQ ID NO: 2821304 - DNA, 19 bp, Homo sapiens
ttgtaaatatttatgtaaa

SEQ ID NO: 2821305 - DNA, 15 bp, Homo sapiens
ttgtaaatttggatt

SEQ ID NO: 2821306 - DNA, 21 bp, Homo sapiens
ttgtaatagatgtttgataga

SEQ ID NO: 2821307 - DNA, 15 bp, Homo sapiens
ttgtaatcgttatgt

SEQ ID NO: 2821308 - DNA, 20 bp, Homo sapiens
ttgtaatcgttatgtgtgta

SEQ ID NO: 2821309 - DNA, 14 bp, Homo sapiens
ttgtaatgtatctt

SEQ ID NO: 2821310 - DNA, 18 bp, Homo sapiens
ttgtaatgtatcttattt

SEQ ID NO: 2821311 - DNA, 15 bp, Homo sapiens
ttgtacaaagatatg

SEQ ID NO: 2821312 - DNA, 16 bp, Homo sapiens
ttgtacaaagatatgc

SEQ ID NO: 2821313 - DNA, 23 bp, Homo sapiens
ttgtacaattgaacttaaataaa

SEQ ID NO: 2821314 - DNA, 15 bp, Homo sapiens
ttcctgtagcatctt

SEQ ID NO: 2821315 - DNA, 20 bp, Homo sapiens
ttcctgtatttgttcccaag

SEQ ID NO: 2821316 - DNA, 11 bp, Homo sapiens
ttcctgtgtct

SEQ ID NO: 2821317 - DNA, 14 bp, Homo sapiens
ttcctgttgtctga

SEQ ID NO: 2821318 - DNA, 20 bp, Homo sapiens
ttccttagcttagacctcag

SEQ ID NO: 2821319 - DNA, 21 bp, Homo sapiens
ttccttagcttagacctcagc

SEQ ID NO: 2821320 - DNA, 22 bp, Homo sapiens
ttccttagcttagacctcagcc

SEQ ID NO: 2821321 - DNA, 15 bp, Homo sapiens
ttccttcagcttcca

SEQ ID NO: 2821322 - DNA, 12 bp, Homo sapiens
ttccttccctgg

SEQ ID NO: 2821323 - DNA, 17 bp, Homo sapiens
ttccttgagaaaaacaa

SEQ ID NO: 2821324 - DNA, 18 bp, Homo sapiens
ttccttgctgtcctaggc

SEQ ID NO: 2821325 - DNA, 12 bp, Homo sapiens
ttccttggaggc

SEQ ID NO: 2821326 - DNA, 18 bp, Homo sapiens
ttccttgtatttaaatat

SEQ ID NO: 2821327 - DNA, 10 bp, Homo sapiens
ttcctttcct

SEQ ID NO: 2821328 - DNA, 11 bp, Homo sapiens
ttcctttcctc

SEQ ID NO: 2821329 - DNA, 21 bp, Homo sapiens
ttcgaaacctgtccataaagt

SEQ ID NO: 2821330 - DNA, 17 bp, Homo sapiens
ttcgaccctttctctga

SEQ ID NO: 2821331 - DNA, 15 bp, Homo sapiens
ttcgagaccagccca

SEQ ID NO: 2821332 - DNA, 21 bp, Homo sapiens
ttcgatgggcccaattcttac

SEQ ID NO: 2821333 - DNA, 11 bp, Homo sapiens
ttcgcagccac

SEQ ID NO: 2821334 - DNA, 16 bp, Homo sapiens
ttcgcagccaccctga

SEQ ID NO: 2821335 - DNA, 19 bp, Homo sapiens
ttcgcagccaccctgagga

SEQ ID NO: 2821336 - DNA, 17 bp, Homo sapiens
ttcgctgctagagaagg

SEQ ID NO: 2821337 - DNA, 19 bp, Homo sapiens
ttcgctgctagagaagggg

SEQ ID NO: 2821338 - DNA, 13 bp, Homo sapiens
ttcgctttcctct

SEQ ID NO: 2821339 - DNA, 18 bp, Homo sapiens
ttcggaagggaaaacagt

SEQ ID NO: 2821340 - DNA, 15 bp, Homo sapiens
ttcggatttgacaaa

SEQ ID NO: 2821341 - DNA, 14 bp, Homo sapiens
ttcgtgcatttgtg

SEQ ID NO: 2821342 - DNA, 18 bp, Homo sapiens
ttctaaaaattgtgatca

SEQ ID NO: 2821343 - DNA, 17 bp, Homo sapiens
ttctaagattgtacata

SEQ ID NO: 2821344 - DNA, 23 bp, Homo sapiens
ttctaaggaaatggagaagctct

SEQ ID NO: 2821345 - DNA, 17 bp, Homo sapiens
ttctaattggcatgaag

SEQ ID NO: 2821346 - DNA, 23 bp, Homo sapiens
ttctacaaccagagccccccaca

SEQ ID NO: 2821347 - DNA, 18 bp, Homo sapiens
ttctacccagagccttct

SEQ ID NO: 2821348 - DNA, 17 bp, Homo sapiens
ttgaatccatgcttggg

SEQ ID NO: 2821349 - DNA, 18 bp, Homo sapiens
ttgaatggcctgccttga

SEQ ID NO: 2821350 - DNA, 16 bp, Homo sapiens
ttgaatggctatgttt

SEQ ID NO: 2821351 - DNA, 19 bp, Homo sapiens
ttgacaaaataacatttga

SEQ ID NO: 2821352 - DNA, 18 bp, Homo sapiens
ttgacaacattttattac

SEQ ID NO: 2821353 - DNA, 12 bp, Homo sapiens
ttgacagggcac

SEQ ID NO: 2821354 - DNA, 15 bp, Homo sapiens
ttgacctcaggtgat

SEQ ID NO: 2821355 - DNA, 17 bp, Homo sapiens
ttgactatcaaactgaa

SEQ ID NO: 2821356 - DNA, 21 bp, Homo sapiens
ttgactatcacatacaatttg

SEQ ID NO: 2821357 - DNA, 19 bp, Homo sapiens
ttgactcacctgttacttg

SEQ ID NO: 2821358 - DNA, 20 bp, Homo sapiens
ttgacttgacagaacactgt

SEQ ID NO: 2821359 - DNA, 19 bp, Homo sapiens
ttgagaaggaaaattttag

SEQ ID NO: 2821360 - DNA, 20 bp, Homo sapiens
ttgagaaggaaaattttagc

SEQ ID NO: 2821361 - DNA, 13 bp, Homo sapiens
ttgagaattttaa

SEQ ID NO: 2821362 - DNA, 15 bp, Homo sapiens
ttgagagtgtgacca

SEQ ID NO: 2821363 - DNA, 23 bp, Homo sapiens
ttgagctcagacccccactctca

SEQ ID NO: 2821364 - DNA, 14 bp, Homo sapiens
ttgaggacacatgt

SEQ ID NO: 2821365 - DNA, 16 bp, Homo sapiens
ttgaggacacatgtcc

SEQ ID NO: 2821366 - DNA, 13 bp, Homo sapiens
ttgaggccaggag

SEQ ID NO: 2821367 - DNA, 13 bp, Homo sapiens
ttgagggttgggc

SEQ ID NO: 2821368 - DNA, 17 bp, Homo sapiens
ttgagtctcctctctga

SEQ ID NO: 2821369 - DNA, 19 bp, Homo sapiens
ttgataaattccactggac

SEQ ID NO: 2821370 - DNA, 21 bp, Homo sapiens
ttgataaattccactggactt

SEQ ID NO: 2821371 - DNA, 19 bp, Homo sapiens
ttgatagctttatttttta

SEQ ID NO: 2821372 - DNA, 20 bp, Homo sapiens
ttgatatacttttttcttat

SEQ ID NO: 2821373 - DNA, 17 bp, Homo sapiens
ttgatatatttcattct

SEQ ID NO: 2821374 - DNA, 16 bp, Homo sapiens
ttgatatgaaaaatat

SEQ ID NO: 2821375 - DNA, 22 bp, Homo sapiens
ttgatatgaaaaatatgatatt

SEQ ID NO: 2821376 - DNA, 22 bp, Homo sapiens
ttgatccacttcttaatgcttt

SEQ ID NO: 2821377 - DNA, 18 bp, Homo sapiens
ttgatgaccaatctctgt

SEQ ID NO: 2821378 - DNA, 22 bp, Homo sapiens
ttgatgaccaatctctgtgact

SEQ ID NO: 2821379 - DNA, 14 bp, Homo sapiens
ttgatgaggcctct

SEQ ID NO: 2821380 - DNA, 22 bp, Homo sapiens
ttgatgccaaaaaaaaatacat

SEQ ID NO: 2821381 - DNA, 17 bp, Homo sapiens
ttgatgtacatgtgtag

SEQ ID NO: 2821382 - DNA, 15 bp, Homo sapiens
ttgatgtttccagaa

SEQ ID NO: 2821383 - DNA, 18 bp, Homo sapiens
ttgatgtttccagaaaat

SEQ ID NO: 2821384 - DNA, 21 bp, Homo sapiens
tttccttttaaaacacttcca

SEQ ID NO: 2821385 - DNA, 21 bp, Homo sapiens
tttccttttgcaacaagacaa

SEQ ID NO: 2821386 - DNA, 15 bp, Homo sapiens
tttcgctttcctctg

SEQ ID NO: 2821387 - DNA, 14 bp, Homo sapiens
tttctaaaaaacag

SEQ ID NO: 2821388 - DNA, 22 bp, Homo sapiens
tttctaaagctctgaacaaaag

SEQ ID NO: 2821389 - DNA, 15 bp, Homo sapiens
tttctaatcttgtta

SEQ ID NO: 2821390 - DNA, 22 bp, Homo sapiens
tttctacccagcgagccctggt

SEQ ID NO: 2821391 - DNA, 23 bp, Homo sapiens
tttctacgttatgaaaacagatg

SEQ ID NO: 2821392 - DNA, 18 bp, Homo sapiens
tttctcagaatccaaaga

SEQ ID NO: 2821393 - DNA, 18 bp, Homo sapiens
tttctccagccagcaatg

SEQ ID NO: 2821394 - DNA, 13 bp, Homo sapiens
tttctccccctgg

SEQ ID NO: 2821395 - DNA, 20 bp, Homo sapiens
tttctgaaaattaacactgc

SEQ ID NO: 2821396 - DNA, 20 bp, Homo sapiens
tttctggaatacatgaaata

SEQ ID NO: 2821397 - DNA, 18 bp, Homo sapiens
tttctggaatgtaatcaa

SEQ ID NO: 2821398 - DNA, 16 bp, Homo sapiens
tttctgggataagtaa

SEQ ID NO: 2821399 - DNA, 23 bp, Homo sapiens
tttctgtccttttggcactgaga

SEQ ID NO: 2821400 - DNA, 22 bp, Homo sapiens
tttctgtggagagtgagaataa

SEQ ID NO: 2821401 - DNA, 21 bp, Homo sapiens
tttcttaaataagaaactttt

SEQ ID NO: 2821402 - DNA, 18 bp, Homo sapiens
tttcttcatgcaatgaca

SEQ ID NO: 2821403 - DNA, 12 bp, Homo sapiens
tttcttcccatt

SEQ ID NO: 2821404 - DNA, 20 bp, Homo sapiens
tttcttcccatttgtaatgt

SEQ ID NO: 2821405 - DNA, 14 bp, Homo sapiens
tttcttcctctgct

SEQ ID NO: 2821406 - DNA, 23 bp, Homo sapiens
tttcttgccaatgaggtctgaaa

SEQ ID NO: 2821407 - DNA, 22 bp, Homo sapiens
tttcttgtgctgactaactata

SEQ ID NO: 2821408 - DNA, 15 bp, Homo sapiens
tttctttaagaaagt

SEQ ID NO: 2821409 - DNA, 13 bp, Homo sapiens
tttctttgtggct

SEQ ID NO: 2821410 - DNA, 22 bp, Homo sapiens
tttcttttgcccttcacagtgt

SEQ ID NO: 2821411 - DNA, 16 bp, Homo sapiens
tttcttttgtaaatgt

SEQ ID NO: 2821412 - DNA, 15 bp, Homo sapiens
tttgaaaaagcgaaa

SEQ ID NO: 2821413 - DNA, 22 bp, Homo sapiens
tttgaacaactaggcttcagca

SEQ ID NO: 2821414 - DNA, 17 bp, Homo sapiens
tttgaagaagggaaatt

SEQ ID NO: 2821415 - DNA, 20 bp, Homo sapiens
tttgaataaaaaacatttgt

SEQ ID NO: 2821416 - DNA, 21 bp, Homo sapiens
tttgaataaaaaacatttgta

SEQ ID NO: 2821417 - DNA, 19 bp, Homo sapiens
tttgaatataaacactata

SEQ ID NO: 2821418 - DNA, 13 bp, Homo sapiens
tttgaatatcatt

SEQ ID NO: 2821419 - DNA, 17 bp, Homo sapiens
tttgaatggtgcagaaa

SEQ ID NO: 2821420 - DNA, 18 bp, Homo sapiens
tttgacagtgttgaaaat

SEQ ID NO: 2821421 - DNA, 19 bp, Homo sapiens
tttgacagtgttgaaaatg

SEQ ID NO: 2821422 - DNA, 17 bp, Homo sapiens
tttgacatgaacagaaa

SEQ ID NO: 2821423 - DNA, 19 bp, Homo sapiens
tttgacttattgtccccac

SEQ ID NO: 2821424 - DNA, 14 bp, Homo sapiens
tttgagaaagaaat

SEQ ID NO: 2821425 - DNA, 20 bp, Homo sapiens
tttgagaaagaaataattgt

SEQ ID NO: 2821426 - DNA, 13 bp, Homo sapiens
tttgagacagagt

SEQ ID NO: 2821427 - DNA, 14 bp, Homo sapiens
tttgagaccagcct

SEQ ID NO: 2821428 - DNA, 19 bp, Homo sapiens
tttgagaccagcctgggca

SEQ ID NO: 2821429 - DNA, 15 bp, Homo sapiens
tttgagcaattcatt

SEQ ID NO: 2821430 - DNA, 18 bp, Homo sapiens
tttgagcaattcatttca

SEQ ID NO: 2821431 - DNA, 14 bp, Homo sapiens
tttgaggattcctg

SEQ ID NO: 2821432 - DNA, 16 bp, Homo sapiens
ttgtgaccaagttata

SEQ ID NO: 2821433 - DNA, 12 bp, Homo sapiens
ttgtgagatggg

SEQ ID NO: 2821434 - DNA, 18 bp, Homo sapiens
ttgtgatgtgagttgcac

SEQ ID NO: 2821435 - DNA, 17 bp, Homo sapiens
ttgtgattttgtacaga

SEQ ID NO: 2821436 - DNA, 22 bp, Homo sapiens
ttgtgattttgtacagaatttt

SEQ ID NO: 2821437 - DNA, 23 bp, Homo sapiens
ttgtgcaatgtaaatattttaaa

SEQ ID NO: 2821438 - DNA, 18 bp, Homo sapiens
ttgtggcaagtgaatttg

SEQ ID NO: 2821439 - DNA, 22 bp, Homo sapiens
ttgtggcaagtgaatttgcctg

SEQ ID NO: 2821440 - DNA, 14 bp, Homo sapiens
ttgtggtttatgtc

SEQ ID NO: 2821441 - DNA, 15 bp, Homo sapiens
ttgtgtacagtgtgt

SEQ ID NO: 2821442 - DNA, 15 bp, Homo sapiens
ttgtgtatgatccaa

SEQ ID NO: 2821443 - DNA, 15 bp, Homo sapiens
ttgtgtctgtacacg

SEQ ID NO: 2821444 - DNA, 13 bp, Homo sapiens
ttgtgtgattgaa

SEQ ID NO: 2821445 - DNA, 16 bp, Homo sapiens
ttgtgtgttatttaaa

SEQ ID NO: 2821446 - DNA, 13 bp, Homo sapiens
ttgtgttcacctt

SEQ ID NO: 2821447 - DNA, 18 bp, Homo sapiens
ttgttaaaaatattttct

SEQ ID NO: 2821448 - DNA, 18 bp, Homo sapiens
ttgttaaaaccttactta

SEQ ID NO: 2821449 - DNA, 16 bp, Homo sapiens
ttgttaaaataactag

SEQ ID NO: 2821450 - DNA, 17 bp, Homo sapiens
ttgttaatgaaaatgtc

SEQ ID NO: 2821451 - DNA, 18 bp, Homo sapiens
ttgttaatgaaaatgtca

SEQ ID NO: 2821452 - DNA, 17 bp, Homo sapiens
ttgttaatggtgcaaat

SEQ ID NO: 2821453 - DNA, 19 bp, Homo sapiens
ttgttaatttagaaaactt

SEQ ID NO: 2821454 - DNA, 16 bp, Homo sapiens
ttgttacctttcccat

SEQ ID NO: 2821455 - DNA, 17 bp, Homo sapiens
ttgttatatatatcaag

SEQ ID NO: 2821456 - DNA, 19 bp, Homo sapiens
ttgttgtcaagtataaagt

SEQ ID NO: 2821457 - DNA, 12 bp, Homo sapiens
ttgtttaattgt

SEQ ID NO: 2821458 - DNA, 13 bp, Homo sapiens
ttgtttaattgta

SEQ ID NO: 2821459 - DNA, 20 bp, Homo sapiens
ttgtttcattgactatcaaa

SEQ ID NO: 2821460 - DNA, 12 bp, Homo sapiens
ttgtttcttaaa

SEQ ID NO: 2821461 - DNA, 15 bp, Homo sapiens
ttgtttcttaaataa

SEQ ID NO: 2821462 - DNA, 23 bp, Homo sapiens
ttgtttcttaaataagaaacttt

SEQ ID NO: 2821463 - DNA, 21 bp, Homo sapiens
ttgtttgtttctccccctggg

SEQ ID NO: 2821464 - DNA, 22 bp, Homo sapiens
ttgtttttaacaactaatcaag

SEQ ID NO: 2821465 - DNA, 12 bp, Homo sapiens
ttgtttttatga

SEQ ID NO: 2821466 - DNA, 22 bp, Homo sapiens
ttgtttttccttgtatttaaat

SEQ ID NO: 2821467 - DNA, 18 bp, Homo sapiens
tttaaaaaaagtatatat

SEQ ID NO: 2821468 - DNA, 20 bp, Homo sapiens
tttaaaaaataaatataatt

SEQ ID NO: 2821469 - DNA, 20 bp, Homo sapiens
tttaaaaacatgagaaatgt

SEQ ID NO: 2821470 - DNA, 23 bp, Homo sapiens
tttaaaaacatgagaaatgtgaa

SEQ ID NO: 2821471 - DNA, 17 bp, Homo sapiens
tttaaaaagttgcacat

SEQ ID NO: 2821472 - DNA, 15 bp, Homo sapiens
tttaaaaatcataaa

SEQ ID NO: 2821473 - DNA, 18 bp, Homo sapiens
tttaaaccagcagaaaag

SEQ ID NO: 2821474 - DNA, 17 bp, Homo sapiens
tttaaaccgctaaaaga

SEQ ID NO: 2821475 - DNA, 22 bp, Homo sapiens
tttaaaccgctaaaagaaactt

SEQ ID NO: 2821476 - DNA, 23 bp, Homo sapiens
tttaaaccgctaaaagaaacttt

SEQ ID NO: 2821477 - DNA, 12 bp, Homo sapiens
tttaaatatgaa

SEQ ID NO: 2821478 - DNA, 17 bp, Homo sapiens
tttaaatcaaaagctgc

SEQ ID NO: 2821479 - DNA, 12 bp, Homo sapiens
tttaaatctgtt

SEQ ID NO: 2821480 - DNA, 14 bp, Homo sapiens
tttaaatgaagaaa

SEQ ID NO: 2821481 - DNA, 20 bp, Homo sapiens
tttaaattataacttaaaat

SEQ ID NO: 2821482 - DNA, 21 bp, Homo sapiens
tttaaattcacaatagaaact

SEQ ID NO: 2821483 - DNA, 22 bp, Homo sapiens
tttaacaaaacaagaaagaaac

SEQ ID NO: 2821484 - DNA, 14 bp, Homo sapiens
tttcaaagaaggaa

SEQ ID NO: 2821485 - DNA, 16 bp, Homo sapiens
tttcaacatatcattt

SEQ ID NO: 2821486 - DNA, 17 bp, Homo sapiens
tttcaagaaaactggaa

SEQ ID NO: 2821487 - DNA, 17 bp, Homo sapiens
tttcaagaaactgagga

SEQ ID NO: 2821488 - DNA, 20 bp, Homo sapiens
tttcaagagaagaaaaaatt

SEQ ID NO: 2821489 - DNA, 22 bp, Homo sapiens
tttcaagcctgcctaggaattc

SEQ ID NO: 2821490 - DNA, 17 bp, Homo sapiens
tttcaattttgcatgct

SEQ ID NO: 2821491 - DNA, 23 bp, Homo sapiens
tttcacaattccatttccagttc

SEQ ID NO: 2821492 - DNA, 15 bp, Homo sapiens
tttcacagtttttcc

SEQ ID NO: 2821493 - DNA, 17 bp, Homo sapiens
tttcaccagatttgcta

SEQ ID NO: 2821494 - DNA, 22 bp, Homo sapiens
tttcacctgtttttaagctgtt

SEQ ID NO: 2821495 - DNA, 23 bp, Homo sapiens
tttcacctgtttttaagctgttt

SEQ ID NO: 2821496 - DNA, 20 bp, Homo sapiens
tttcagaaatatgtggtttc

SEQ ID NO: 2821497 - DNA, 15 bp, Homo sapiens
tttcagcattcagtc

SEQ ID NO: 2821498 - DNA, 21 bp, Homo sapiens
tttcagctattagcaactgtg

SEQ ID NO: 2821499 - DNA, 22 bp, Homo sapiens
tttcaggagagagttgaaccta

SEQ ID NO: 2821500 - DNA, 20 bp, Homo sapiens
tttcaggatactctgtcaga

SEQ ID NO: 2821501 - DNA, 18 bp, Homo sapiens
tttcaggttttgtaaaga

SEQ ID NO: 2821502 - DNA, 13 bp, Homo sapiens
tttcatctatttc

SEQ ID NO: 2821503 - DNA, 22 bp, Homo sapiens
tttcatgataatgaacagaaca

SEQ ID NO: 2821504 - DNA, 13 bp, Homo sapiens
tttcattaaaaat

SEQ ID NO: 2821505 - DNA, 16 bp, Homo sapiens
tttcattaaagcattt

SEQ ID NO: 2821506 - DNA, 21 bp, Homo sapiens
tttcattaatacagggcattt

SEQ ID NO: 2821507 - DNA, 22 bp, Homo sapiens
tttcattgagggaaaacataat

SEQ ID NO: 2821508 - DNA, 14 bp, Homo sapiens
tttccaagagctga

SEQ ID NO: 2821509 - DNA, 20 bp, Homo sapiens
tttccacagttgctgctcct

SEQ ID NO: 2821510 - DNA, 14 bp, Homo sapiens
tttccacataaagg

SEQ ID NO: 2821511 - DNA, 19 bp, Homo sapiens
tttccacgatgaaaaactt

SEQ ID NO: 2821512 - DNA, 19 bp, Homo sapiens
tttccagaaaatataaatg

SEQ ID NO: 2821513 - DNA, 22 bp, Homo sapiens
tttccattcatgccaaagcaaa

SEQ ID NO: 2821514 - DNA, 22 bp, Homo sapiens
tttcccaccaccttggactcct

SEQ ID NO: 2821515 - DNA, 14 bp, Homo sapiens
tttcccataatttt

SEQ ID NO: 2821516 - DNA, 21 bp, Homo sapiens
tttccccaaagtcttaaaata

SEQ ID NO: 2821517 - DNA, 20 bp, Homo sapiens
tttccccgggggaggaaggg

SEQ ID NO: 2821518 - DNA, 22 bp, Homo sapiens
tttccgtaaaaatgatttcagt

SEQ ID NO: 2821519 - DNA, 14 bp, Homo sapiens
tttcctattttaaa

SEQ ID NO: 2821520 - DNA, 22 bp, Homo sapiens
tttcctattttaaaaccatgca

SEQ ID NO: 2821521 - DNA, 12 bp, Homo sapiens
tttcctccctgg

SEQ ID NO: 2821522 - DNA, 16 bp, Homo sapiens
tttcctcctaaacaaa

SEQ ID NO: 2821523 - DNA, 16 bp, Homo sapiens
tttccttccttccctg

SEQ ID NO: 2821524 - DNA, 23 bp, Homo sapiens
tttgtacagaatttttaatgact

SEQ ID NO: 2821525 - DNA, 19 bp, Homo sapiens
tttgtacatagttatttat

SEQ ID NO: 2821526 - DNA, 13 bp, Homo sapiens
tttgtacattcct

SEQ ID NO: 2821527 - DNA, 14 bp, Homo sapiens
tttgtacattcctg

SEQ ID NO: 2821528 - DNA, 15 bp, Homo sapiens
tttgtacattcctga

SEQ ID NO: 2821529 - DNA, 23 bp, Homo sapiens
tttgtacattcctgatactgggt

SEQ ID NO: 2821530 - DNA, 15 bp, Homo sapiens
tttgtactgaaaaat

SEQ ID NO: 2821531 - DNA, 16 bp, Homo sapiens
tttgtatagtaaagtg

SEQ ID NO: 2821532 - DNA, 17 bp, Homo sapiens
tttgtatttttgaataa

SEQ ID NO: 2821533 - DNA, 23 bp, Homo sapiens
tttgtcacaatcctaacacatta

SEQ ID NO: 2821534 - DNA, 14 bp, Homo sapiens
tttgtcatatattc

SEQ ID NO: 2821535 - DNA, 24 bp, Homo sapiens
tttgtcccatttccttggaggcca

SEQ ID NO: 2821536 - DNA, 21 bp, Homo sapiens
tttgtcctttgagaaagaaat

SEQ ID NO: 2821537 - DNA, 18 bp, Homo sapiens
tttgtcgagtttacttca

SEQ ID NO: 2821538 - DNA, 22 bp, Homo sapiens
tttgtgaaatgatggtgaaagt

SEQ ID NO: 2821539 - DNA, 14 bp, Homo sapiens
tttgtgagaagaaa

SEQ ID NO: 2821540 - DNA, 23 bp, Homo sapiens
tttgtgctatcagactgtaggat

SEQ ID NO: 2821541 - DNA, 19 bp, Homo sapiens
tttgtggtaaaaagattat

SEQ ID NO: 2821542 - DNA, 21 bp, Homo sapiens
tttgttaatttagaaaacttt

SEQ ID NO: 2821543 - DNA, 15 bp, Homo sapiens
tttgtttcctttgtt

SEQ ID NO: 2821544 - DNA, 17 bp, Homo sapiens
ttttaaaaaagcttaaa

SEQ ID NO: 2821545 - DNA, 20 bp, Homo sapiens
ttttaaaaaagcttaaaact

SEQ ID NO: 2821546 - DNA, 21 bp, Homo sapiens
ttttaaaaaagcttaaaactt

SEQ ID NO: 2821547 - DNA, 23 bp, Homo sapiens
ttttaaaaaagcttaaaactttg

SEQ ID NO: 2821548 - DNA, 18 bp, Homo sapiens
ttttaaaaacatgagaaa

SEQ ID NO: 2821549 - DNA, 19 bp, Homo sapiens
ttttaaaaacatgagaaat

SEQ ID NO: 2821550 - DNA, 17 bp, Homo sapiens
ttttaaaaagttgcaca

SEQ ID NO: 2821551 - DNA, 15 bp, Homo sapiens
ttttaaaaccatgca

SEQ ID NO: 2821552 - DNA, 16 bp, Homo sapiens
ttttaaaaccatgcag

SEQ ID NO: 2821553 - DNA, 12 bp, Homo sapiens
ttttaaaagaaa

SEQ ID NO: 2821554 - DNA, 13 bp, Homo sapiens
ttttaaaagaaaa

SEQ ID NO: 2821555 - DNA, 12 bp, Homo sapiens
ttttaaagaatt

SEQ ID NO: 2821556 - DNA, 17 bp, Homo sapiens
ttttaaataaaagcagc

SEQ ID NO: 2821557 - DNA, 20 bp, Homo sapiens
ttttaacaaaagcaagactg

SEQ ID NO: 2821558 - DNA, 22 bp, Homo sapiens
ttttaacatttatctaaaagaa

SEQ ID NO: 2821559 - DNA, 23 bp, Homo sapiens
ttttaacatttatctaaaagaat

SEQ ID NO: 2821560 - DNA, 12 bp, Homo sapiens
ttttaactagaa

SEQ ID NO: 2821561 - DNA, 15 bp, Homo sapiens
ttttaagaggcaggg

SEQ ID NO: 2821562 - DNA, 23 bp, Homo sapiens
ttttaagggtttgtggaaaatga

SEQ ID NO: 2821563 - DNA, 15 bp, Homo sapiens
ttttaagtatttagg

SEQ ID NO: 2821564 - DNA, 18 bp, Homo sapiens
ttttaagtatttatatat

SEQ ID NO: 2821565 - DNA, 17 bp, Homo sapiens
ttttaagtgctttgtaa

SEQ ID NO: 2821566 - DNA, 21 bp, Homo sapiens
ttttaataaaattgacaacat

SEQ ID NO: 2821567 - DNA, 12 bp, Homo sapiens
ttttaatacagg

SEQ ID NO: 2821568 - DNA, 15 bp, Homo sapiens
ttttaatcatttaaa

SEQ ID NO: 2821569 - DNA, 17 bp, Homo sapiens
ttttaattattattctt

SEQ ID NO: 2821570 - DNA, 23 bp, Homo sapiens
ttttaattattatttatatatgt

SEQ ID NO: 2821571 - DNA, 23 bp, Homo sapiens
ttttaatttatgagtttttgata

SEQ ID NO: 2821572 - DNA, 23 bp, Homo sapiens
ttgcctgaatccatcaggacttg

SEQ ID NO: 2821573 - DNA, 19 bp, Homo sapiens
ttgcctgtaacaagccaga

SEQ ID NO: 2821574 - DNA, 17 bp, Homo sapiens
ttgccttctacttttaa

SEQ ID NO: 2821575 - DNA, 16 bp, Homo sapiens
ttgcctttccacctgc

SEQ ID NO: 2821576 - DNA, 16 bp, Homo sapiens
ttgccttttaaaagaa

SEQ ID NO: 2821577 - DNA, 17 bp, Homo sapiens
ttgcgaccatgtgtaga

SEQ ID NO: 2821578 - DNA, 19 bp, Homo sapiens
ttgctcaaatctattcaga

SEQ ID NO: 2821579 - DNA, 12 bp, Homo sapiens
ttgctgaaacac

SEQ ID NO: 2821580 - DNA, 23 bp, Homo sapiens
ttgctggactgtcatagaaatta

SEQ ID NO: 2821581 - DNA, 20 bp, Homo sapiens
ttgctggtgtctgagcttca

SEQ ID NO: 2821582 - DNA, 11 bp, Homo sapiens
ttgctgtccta

SEQ ID NO: 2821583 - DNA, 13 bp, Homo sapiens
ttgctgtttcctt

SEQ ID NO: 2821584 - DNA, 15 bp, Homo sapiens
ttgctgtttcctttt

SEQ ID NO: 2821585 - DNA, 14 bp, Homo sapiens
ttgcttaaaatttt

SEQ ID NO: 2821586 - DNA, 16 bp, Homo sapiens
ttgcttatttatattc

SEQ ID NO: 2821587 - DNA, 21 bp, Homo sapiens
ttggaaaaatccagaaagaaa

SEQ ID NO: 2821588 - DNA, 22 bp, Homo sapiens
ttggaaaagaatacagaaagat

SEQ ID NO: 2821589 - DNA, 14 bp, Homo sapiens
ttggaaagagacca

SEQ ID NO: 2821590 - DNA, 22 bp, Homo sapiens
ttggaataataattttcctcct

SEQ ID NO: 2821591 - DNA, 21 bp, Homo sapiens
ttggaatgactataaacatta

SEQ ID NO: 2821592 - DNA, 16 bp, Homo sapiens
ttggacctctgctctg

SEQ ID NO: 2821593 - DNA, 13 bp, Homo sapiens
ttggactcctccc

SEQ ID NO: 2821594 - DNA, 15 bp, Homo sapiens
ttggactgacattta

SEQ ID NO: 2821595 - DNA, 15 bp, Homo sapiens
ttggagactctgtgg

SEQ ID NO: 2821596 - DNA, 20 bp, Homo sapiens
ttggagactctgtggggcct

SEQ ID NO: 2821597 - DNA, 20 bp, Homo sapiens
ttggagagggacgaagaaag

SEQ ID NO: 2821598 - DNA, 20 bp, Homo sapiens
ttggagataatctagaacac

SEQ ID NO: 2821599 - DNA, 22 bp, Homo sapiens
ttggagggtgggagagcccagc

SEQ ID NO: 2821600 - DNA, 21 bp, Homo sapiens
ttggataataactagatctcc

SEQ ID NO: 2821601 - DNA, 14 bp, Homo sapiens
ttggatgtggagct

SEQ ID NO: 2821602 - DNA, 16 bp, Homo sapiens
ttggcacagaaacaca

SEQ ID NO: 2821603 - DNA, 16 bp, Homo sapiens
ttggcagaaaggatgt

SEQ ID NO: 2821604 - DNA, 21 bp, Homo sapiens
ttggcatcacagggcagagcc

SEQ ID NO: 2821605 - DNA, 18 bp, Homo sapiens
ttggcccctgcccggctg

SEQ ID NO: 2821606 - DNA, 14 bp, Homo sapiens
ttggcccctgtgtg

SEQ ID NO: 2821607 - DNA, 22 bp, Homo sapiens
ttggcccctgtgtgagttgagt

SEQ ID NO: 2821608 - DNA, 14 bp, Homo sapiens
ggaggatggagaga

SEQ ID NO: 2821609 - DNA, 21 bp, Homo sapiens
ggaggatgttctgggacacag

SEQ ID NO: 2821610 - DNA, 18 bp, Homo sapiens
ggaggcagggccttgccc

SEQ ID NO: 2821611 - DNA, 22 bp, Homo sapiens
ggaggccaccgggacagacctg

SEQ ID NO: 2821612 - DNA, 12 bp, Homo sapiens
ggaggccgaagc

SEQ ID NO: 2821613 - DNA, 20 bp, Homo sapiens
ggaggcggagagtacagtga

SEQ ID NO: 2821614 - DNA, 18 bp, Homo sapiens
ggaggctgagacaggaga

SEQ ID NO: 2821615 - DNA, 13 bp, Homo sapiens
ggaggctgaggcg

SEQ ID NO: 2821616 - DNA, 11 bp, Homo sapiens
ggaggctgctc

SEQ ID NO: 2821617 - DNA, 14 bp, Homo sapiens
ggaggctgctcggg

SEQ ID NO: 2821618 - DNA, 23 bp, Homo sapiens
ggaggctgctcggggtgcacagg

SEQ ID NO: 2821619 - DNA, 23 bp, Homo sapiens
ggagggcaagggccatgctgaag

SEQ ID NO: 2821620 - DNA, 17 bp, Homo sapiens
ggagggcgtgactcacc

SEQ ID NO: 2821621 - DNA, 16 bp, Homo sapiens
ggagggctctgaggcg

SEQ ID NO: 2821622 - DNA, 21 bp, Homo sapiens
ggagggctctgaggcgcccca

SEQ ID NO: 2821623 - DNA, 18 bp, Homo sapiens
ggaggggcctagggagcc

SEQ ID NO: 2821624 - DNA, 19 bp, Homo sapiens
ggagggtgggagagcccag

SEQ ID NO: 2821625 - DNA, 20 bp, Homo sapiens
ggaggtcacattcaggaaga

SEQ ID NO: 2821626 - DNA, 23 bp, Homo sapiens
ggaggtcacattcaggaagatga

SEQ ID NO: 2821627 - DNA, 22 bp, Homo sapiens
ggaggtcgaccccaaagcccct

SEQ ID NO: 2821628 - DNA, 14 bp, Homo sapiens
ggaggtgaccccag

SEQ ID NO: 2821629 - DNA, 20 bp, Homo sapiens
ggaggtggaggttgcagtga

SEQ ID NO: 2821630 - DNA, 18 bp, Homo sapiens
ggaggtggctatggccac

SEQ ID NO: 2821631 - DNA, 19 bp, Homo sapiens
ggaggttccggtgtctgga

SEQ ID NO: 2821632 - DNA, 14 bp, Homo sapiens
ggaggttgcaggga

SEQ ID NO: 2821633 - DNA, 17 bp, Homo sapiens
ggaggttgcagggagcc

SEQ ID NO: 2821634 - DNA, 20 bp, Homo sapiens
ggaggttgcagtgagctgag

SEQ ID NO: 2821635 - DNA, 21 bp, Homo sapiens
ggaggttgcagtgagctgaga

SEQ ID NO: 2821636 - DNA, 17 bp, Homo sapiens
ggagtagctgagctcac

SEQ ID NO: 2821637 - DNA, 16 bp, Homo sapiens
ggagtcccaaggaaag

SEQ ID NO: 2821638 - DNA, 21 bp, Homo sapiens
ggagtcccaccttggctgcag

SEQ ID NO: 2821639 - DNA, 16 bp, Homo sapiens
ggagtctgaggtcctg

SEQ ID NO: 2821640 - DNA, 16 bp, Homo sapiens
ggagtgacagaggcag

SEQ ID NO: 2821641 - DNA, 14 bp, Homo sapiens
ggagttataaaaat

SEQ ID NO: 2821642 - DNA, 14 bp, Homo sapiens
ggagttccatgaag

SEQ ID NO: 2821643 - DNA, 15 bp, Homo sapiens
ggagttccatgaaga

SEQ ID NO: 2821644 - DNA, 19 bp, Homo sapiens
ggagttccatgaagaccac

SEQ ID NO: 2821645 - DNA, 22 bp, Homo sapiens
ggagttccctgaacatctgtgt

SEQ ID NO: 2821646 - DNA, 18 bp, Homo sapiens
ggagttcgagaccagcct

SEQ ID NO: 2821647 - DNA, 20 bp, Homo sapiens
ggagtttgaggctgcagcga

SEQ ID NO: 2821648 - DNA, 11 bp, Homo sapiens
ggagtttgtgt

SEQ ID NO: 2821649 - DNA, 16 bp, Homo sapiens
ggataacaaaatcaca

SEQ ID NO: 2821650 - DNA, 18 bp, Homo sapiens
ggatacttatatggaaat

SEQ ID NO: 2821651 - DNA, 23 bp, Homo sapiens
ggatcaagaaggggacagcgcca

SEQ ID NO: 2821652 - DNA, 14 bp, Homo sapiens
ggatcacagggccc

SEQ ID NO: 2821653 - DNA, 17 bp, Homo sapiens
ggatcacagggccccag

SEQ ID NO: 2821654 - DNA, 17 bp, Homo sapiens
ggatcactggagcccag

SEQ ID NO: 2821655 - DNA, 15 bp, Homo sapiens
ggatcagcgtggcct

SEQ ID NO: 2821656 - DNA, 17 bp, Homo sapiens
ggatcagcgtggccttg

SEQ ID NO: 2821657 - DNA, 21 bp, Homo sapiens
ggatcagtctgattcccaagc

SEQ ID NO: 2821658 - DNA, 20 bp, Homo sapiens
ggatcctattctcaccagga

SEQ ID NO: 2821659 - DNA, 16 bp, Homo sapiens
ggacctctgctctgag

SEQ ID NO: 2821660 - DNA, 17 bp, Homo sapiens
ggacctctgctctgagg

SEQ ID NO: 2821661 - DNA, 13 bp, Homo sapiens
ggacctgagcctg

SEQ ID NO: 2821662 - DNA, 15 bp, Homo sapiens
ggacctgagcctgcc

SEQ ID NO: 2821663 - DNA, 17 bp, Homo sapiens
ggacctgagcctgccga

SEQ ID NO: 2821664 - DNA, 21 bp, Homo sapiens
ggacctgtggggccccagaga

SEQ ID NO: 2821665 - DNA, 15 bp, Homo sapiens
ggaccttcctgccac

SEQ ID NO: 2821666 - DNA, 13 bp, Homo sapiens
ggacgaacagggg

SEQ ID NO: 2821667 - DNA, 22 bp, Homo sapiens
ggactaacactcagaagcctgg

SEQ ID NO: 2821668 - DNA, 15 bp, Homo sapiens
ggactatagcccagg

SEQ ID NO: 2821669 - DNA, 14 bp, Homo sapiens
ggactattataatt

SEQ ID NO: 2821670 - DNA, 18 bp, Homo sapiens
ggactcaagccccggact

SEQ ID NO: 2821671 - DNA, 16 bp, Homo sapiens
ggactcaatgcactga

SEQ ID NO: 2821672 - DNA, 22 bp, Homo sapiens
ggactcaatgcactgacattgt

SEQ ID NO: 2821673 - DNA, 13 bp, Homo sapiens
ggactccagttca

SEQ ID NO: 2821674 - DNA, 14 bp, Homo sapiens
ggactccccaggcc

SEQ ID NO: 2821675 - DNA, 13 bp, Homo sapiens
ggactcctcccac

SEQ ID NO: 2821676 - DNA, 15 bp, Homo sapiens
ggactcctctgtcca

SEQ ID NO: 2821677 - DNA, 20 bp, Homo sapiens
ggactctgcacatgtcttgt

SEQ ID NO: 2821678 - DNA, 11 bp, Homo sapiens
ggactctgcct

SEQ ID NO: 2821679 - DNA, 19 bp, Homo sapiens
ggactgaattgtccccagt

SEQ ID NO: 2821680 - DNA, 21 bp, Homo sapiens
ggactgccagtccccctgccc

SEQ ID NO: 2821681 - DNA, 14 bp, Homo sapiens
ggactggaaccagg

SEQ ID NO: 2821682 - DNA, 17 bp, Homo sapiens
ggactggaaccagggag

SEQ ID NO: 2821683 - DNA, 22 bp, Homo sapiens
ggactggaaccagggagaccga

SEQ ID NO: 2821684 - DNA, 20 bp, Homo sapiens
ggactgtcgctgcttcgtgg

SEQ ID NO: 2821685 - DNA, 15 bp, Homo sapiens
ggacttaacggctcc

SEQ ID NO: 2821686 - DNA, 20 bp, Homo sapiens
ggacttaacggctccaggat

SEQ ID NO: 2821687 - DNA, 15 bp, Homo sapiens
ggacttggaagctcc

SEQ ID NO: 2821688 - DNA, 17 bp, Homo sapiens
ggacttggaagctccgc

SEQ ID NO: 2821689 - DNA, 16 bp, Homo sapiens
ggacttgtgtctctgt

SEQ ID NO: 2821690 - DNA, 12 bp, Homo sapiens
ggagaaaaacaa

SEQ ID NO: 2821691 - DNA, 16 bp, Homo sapiens
ggagaaaatgaagaaa

SEQ ID NO: 2821692 - DNA, 16 bp, Homo sapiens
ggagaaacagagacag

SEQ ID NO: 2821693 - DNA, 20 bp, Homo sapiens
ggagaaatgcatccattcct

SEQ ID NO: 2821694 - DNA, 12 bp, Homo sapiens
ggagaagctctg

SEQ ID NO: 2821695 - DNA, 13 bp, Homo sapiens
ggagaagctgatg

SEQ ID NO: 2821696 - DNA, 14 bp, Homo sapiens
ggagaaggatctag

SEQ ID NO: 2821697 - DNA, 14 bp, Homo sapiens
ggagaagggatgga

SEQ ID NO: 2821698 - DNA, 13 bp, Homo sapiens
ggagacagtgatc

SEQ ID NO: 2821699 - DNA, 13 bp, Homo sapiens
ggagaccagctca

SEQ ID NO: 2821700 - DNA, 15 bp, Homo sapiens
ggagactatgtgtca

SEQ ID NO: 2821701 - DNA, 13 bp, Homo sapiens
ggagactcacctc

SEQ ID NO: 2821702 - DNA, 12 bp, Homo sapiens
ggagactcctgc

SEQ ID NO: 2821703 - DNA, 17 bp, Homo sapiens
ggagactcctgccctgt

SEQ ID NO: 2821704 - DNA, 16 bp, Homo sapiens
ggagactctgtggggc

SEQ ID NO: 2821705 - DNA, 21 bp, Homo sapiens
ggagagaggggaataatagaa

SEQ ID NO: 2821706 - DNA, 20 bp, Homo sapiens
ggagagagttgaacctaaac

SEQ ID NO: 2821707 - DNA, 12 bp, Homo sapiens
ggagagccagcc

SEQ ID NO: 2821708 - DNA, 18 bp, Homo sapiens
ggagagccagccctccct

SEQ ID NO: 2821709 - DNA, 15 bp, Homo sapiens
ggagagccagctctc

SEQ ID NO: 2821710 - DNA, 20 bp, Homo sapiens
ggaaaagcactttacagatg

SEQ ID NO: 2821711 - DNA, 14 bp, Homo sapiens
ggaaaagctgctga

SEQ ID NO: 2821712 - DNA, 20 bp, Homo sapiens
ggaaaaggcagggagcgagg

SEQ ID NO: 2821713 - DNA, 16 bp, Homo sapiens
ggaaaaggcctggggt

SEQ ID NO: 2821714 - DNA, 20 bp, Homo sapiens
ggaaacagctaatgggacac

SEQ ID NO: 2821715 - DNA, 17 bp, Homo sapiens
ggaaactggatgaggtc

SEQ ID NO: 2821716 - DNA, 19 bp, Homo sapiens
ggaaagcaccgcagcatgt

SEQ ID NO: 2821717 - DNA, 23 bp, Homo sapiens
ggaaagcaccgcagcatgtgggg

SEQ ID NO: 2821718 - DNA, 16 bp, Homo sapiens
ggaaagcctctgctgc

SEQ ID NO: 2821719 - DNA, 23 bp, Homo sapiens
ggaaagttggaaccgtgtccagc

SEQ ID NO: 2821720 - DNA, 19 bp, Homo sapiens
ggaaataaaacctttcaaa

SEQ ID NO: 2821721 - DNA, 22 bp, Homo sapiens
ggaaatatcagttactcagccc

SEQ ID NO: 2821722 - DNA, 13 bp, Homo sapiens
ggaaatcctgtta

SEQ ID NO: 2821723 - DNA, 14 bp, Homo sapiens
ggaaatctggattt

SEQ ID NO: 2821724 - DNA, 17 bp, Homo sapiens
ggaacagacaggagaaa

SEQ ID NO: 2821725 - DNA, 23 bp, Homo sapiens
ggaacatgtcggagtagaaattg

SEQ ID NO: 2821726 - DNA, 13 bp, Homo sapiens
ggaaccagggaga

SEQ ID NO: 2821727 - DNA, 13 bp, Homo sapiens
ggaaccatgaagc

SEQ ID NO: 2821728 - DNA, 17 bp, Homo sapiens
ggaaccatgaagctgga

SEQ ID NO: 2821729 - DNA, 18 bp, Homo sapiens
ggaaccgtgtccagcaca

SEQ ID NO: 2821730 - DNA, 11 bp, Homo sapiens
ggaactcccag

SEQ ID NO: 2821731 - DNA, 23 bp, Homo sapiens
ggaactgcagtatggccatgggc

SEQ ID NO: 2821732 - DNA, 19 bp, Homo sapiens
ggaactggccaagctgagg

SEQ ID NO: 2821733 - DNA, 22 bp, Homo sapiens
ggaactggccaagctgaggtgc

SEQ ID NO: 2821734 - DNA, 16 bp, Homo sapiens
ggaacttgaactgatt

SEQ ID NO: 2821735 - DNA, 17 bp, Homo sapiens
ggaagaaaaggtacatg

SEQ ID NO: 2821736 - DNA, 18 bp, Homo sapiens
ggaagaaattcctgtagc

SEQ ID NO: 2821737 - DNA, 21 bp, Homo sapiens
ggaagagcaggcacatggagg

SEQ ID NO: 2821738 - DNA, 20 bp, Homo sapiens
ggaagcaagacgtcctggaa

SEQ ID NO: 2821739 - DNA, 23 bp, Homo sapiens
ggaagcaagacgtcctggaatga

SEQ ID NO: 2821740 - DNA, 13 bp, Homo sapiens
ggaagcactgctg

SEQ ID NO: 2821741 - DNA, 11 bp, Homo sapiens
ggaagcagtgc

SEQ ID NO: 2821742 - DNA, 21 bp, Homo sapiens
ggaagcagtgccttccataat

SEQ ID NO: 2821743 - DNA, 17 bp, Homo sapiens
ggaagcccaaggcagtg

SEQ ID NO: 2821744 - DNA, 15 bp, Homo sapiens
ggaagccctccttcc

SEQ ID NO: 2821745 - DNA, 11 bp, Homo sapiens
ggaagccctgg

SEQ ID NO: 2821746 - DNA, 22 bp, Homo sapiens
ggaagcggaggttgcagggagc

SEQ ID NO: 2821747 - DNA, 11 bp, Homo sapiens
ggaagctccgc

SEQ ID NO: 2821748 - DNA, 18 bp, Homo sapiens
ggaagctctgaagtcaca

SEQ ID NO: 2821749 - DNA, 17 bp, Homo sapiens
ggaagctgtgtccttgc

SEQ ID NO: 2821750 - DNA, 19 bp, Homo sapiens
ggaaggaaagaaagaagga

SEQ ID NO: 2821751 - DNA, 21 bp, Homo sapiens
ggaaggagactcacctctgcc

SEQ ID NO: 2821752 - DNA, 22 bp, Homo sapiens
ggaaggagactcacctctgcct

SEQ ID NO: 2821753 - DNA, 20 bp, Homo sapiens
ggaaggagggttagggaggg

SEQ ID NO: 2821754 - DNA, 18 bp, Homo sapiens
ggaaggctgctgtgtagc

SEQ ID NO: 2821755 - DNA, 22 bp, Homo sapiens
ggaaggtagcccagcactgtga

SEQ ID NO: 2821756 - DNA, 19 bp, Homo sapiens
ggaaggtcccttgtttcca

SEQ ID NO: 2821757 - DNA, 23 bp, Homo sapiens
ggaagtgaagagggagaagggat

SEQ ID NO: 2821758 - DNA, 21 bp, Homo sapiens
ggaataagaagcaaataaata

SEQ ID NO: 2821759 - DNA, 13 bp, Homo sapiens
ggaataagccatg

SEQ ID NO: 2821760 - DNA, 19 bp, Homo sapiens
ggaataaggtacaagaagc

SEQ ID NO: 2821761 - DNA, 13 bp, Homo sapiens
gcgcaagcctgta

SEQ ID NO: 2821762 - DNA, 18 bp, Homo sapiens
gcgcacctgccccctggt

SEQ ID NO: 2821763 - DNA, 17 bp, Homo sapiens
gcgcagagtaaaataag

SEQ ID NO: 2821764 - DNA, 21 bp, Homo sapiens
gcgcatgtaatcccagctact

SEQ ID NO: 2821765 - DNA, 21 bp, Homo sapiens
gcgccactacactccagcctg

SEQ ID NO: 2821766 - DNA, 21 bp, Homo sapiens
gcgccccaacccgtggaggct

SEQ ID NO: 2821767 - DNA, 22 bp, Homo sapiens
gcgccccaacccgtggaggctg

SEQ ID NO: 2821768 - DNA, 14 bp, Homo sapiens
gcgccctgcagacc

SEQ ID NO: 2821769 - DNA, 18 bp, Homo sapiens
gcgccctgcagaccctgc

SEQ ID NO: 2821770 - DNA, 15 bp, Homo sapiens
gcgcctacaggagtg

SEQ ID NO: 2821771 - DNA, 14 bp, Homo sapiens
gcgcctccctccac

SEQ ID NO: 2821772 - DNA, 16 bp, Homo sapiens
gcgcctccctccaccc

SEQ ID NO: 2821773 - DNA, 19 bp, Homo sapiens
gcgcctccctccaccccag

SEQ ID NO: 2821774 - DNA, 22 bp, Homo sapiens
gcgcctccctccaccccaggac

SEQ ID NO: 2821775 - DNA, 15 bp, Homo sapiens
gcgcctccttccttg

SEQ ID NO: 2821776 - DNA, 22 bp, Homo sapiens
gcgctattgcactccagtctgg

SEQ ID NO: 2821777 - DNA, 13 bp, Homo sapiens
gcgctgctcaacc

SEQ ID NO: 2821778 - DNA, 15 bp, Homo sapiens
gcgctttctggaaaa

SEQ ID NO: 2821779 - DNA, 19 bp, Homo sapiens
gcggaatgaaccacatctt

SEQ ID NO: 2821780 - DNA, 11 bp, Homo sapiens
gcggacagcca

SEQ ID NO: 2821781 - DNA, 16 bp, Homo sapiens
gcggacagccacggcc

SEQ ID NO: 2821782 - DNA, 18 bp, Homo sapiens
gcggaggagaccagctca

SEQ ID NO: 2821783 - DNA, 18 bp, Homo sapiens
gcggccgcattccctgag

SEQ ID NO: 2821784 - DNA, 23 bp, Homo sapiens
gcggcctatgacttgggcacccc

SEQ ID NO: 2821785 - DNA, 13 bp, Homo sapiens
gcggctctcctga

SEQ ID NO: 2821786 - DNA, 13 bp, Homo sapiens
gcgggaaggaggg

SEQ ID NO: 2821787 - DNA, 19 bp, Homo sapiens
gcgggaccggtacagaaag

SEQ ID NO: 2821788 - DNA, 16 bp, Homo sapiens
gcgggatggtcctggg

SEQ ID NO: 2821789 - DNA, 15 bp, Homo sapiens
gcgggcagcccagcc

SEQ ID NO: 2821790 - DNA, 21 bp, Homo sapiens
gcgggcagcccagcctctgtc

SEQ ID NO: 2821791 - DNA, 13 bp, Homo sapiens
gcggggacagctc

SEQ ID NO: 2821792 - DNA, 19 bp, Homo sapiens
gcggggacagctccttctg

SEQ ID NO: 2821793 - DNA, 14 bp, Homo sapiens
gcggggtgctgtgg

SEQ ID NO: 2821794 - DNA, 20 bp, Homo sapiens
gcggtccacccaggagcccc

SEQ ID NO: 2821795 - DNA, 12 bp, Homo sapiens
gcggttcaggaa

SEQ ID NO: 2821796 - DNA, 19 bp, Homo sapiens
gcgtagaaaacgcacctcc

SEQ ID NO: 2821797 - DNA, 16 bp, Homo sapiens
gcgtctaccctgggat

SEQ ID NO: 2821798 - DNA, 16 bp, Homo sapiens
gcgtcttgtattttct

SEQ ID NO: 2821799 - DNA, 14 bp, Homo sapiens
gcgtgactcaccca

SEQ ID NO: 2821800 - DNA, 15 bp, Homo sapiens
gcgtgagccactgca

SEQ ID NO: 2821801 - DNA, 23 bp, Homo sapiens
gcgtgagccactgcaccgggcca

SEQ ID NO: 2821802 - DNA, 14 bp, Homo sapiens
gcgtgcacacacca

SEQ ID NO: 2821803 - DNA, 20 bp, Homo sapiens
gcgtgcacacaccagagccc

SEQ ID NO: 2821804 - DNA, 16 bp, Homo sapiens
gcgtggaccccgacaa

SEQ ID NO: 2821805 - DNA, 21 bp, Homo sapiens
gcgtggccttgttctgtcacc

SEQ ID NO: 2821806 - DNA, 18 bp, Homo sapiens
gcgtgggtggaggaagat

SEQ ID NO: 2821807 - DNA, 17 bp, Homo sapiens
gcgttctgctgcccctg

SEQ ID NO: 2821808 - DNA, 15 bp, Homo sapiens
gctaaaagaaacttt

SEQ ID NO: 2821809 - DNA, 19 bp, Homo sapiens
gctaaatcctttactgtta

SEQ ID NO: 2821810 - DNA, 13 bp, Homo sapiens
gctaaatgcaaac

SEQ ID NO: 2821811 - DNA, 19 bp, Homo sapiens
gctaaatggtcgcccagga

SEQ ID NO: 2821812 - DNA, 22 bp, Homo sapiens
gctaacccccttctactgagcc

SEQ ID NO: 2821813 - DNA, 21 bp, Homo sapiens
gctaactagcttggaaactgg

SEQ ID NO: 2821814 - DNA, 12 bp, Homo sapiens
gctaactggaag

SEQ ID NO: 2821815 - DNA, 15 bp, Homo sapiens
gctaactgtatgtgt

SEQ ID NO: 2821816 - DNA, 14 bp, Homo sapiens
gctaagagaagtag

SEQ ID NO: 2821817 - DNA, 21 bp, Homo sapiens
gctaagccccctactgagaaa

SEQ ID NO: 2821818 - DNA, 15 bp, Homo sapiens
gctaagctaggaatg

SEQ ID NO: 2821819 - DNA, 15 bp, Homo sapiens
ggcatctgcaccctc

SEQ ID NO: 2821820 - DNA, 18 bp, Homo sapiens
ggcatgaccatcctgtcc

SEQ ID NO: 2821821 - DNA, 14 bp, Homo sapiens
ggcatgagggatca

SEQ ID NO: 2821822 - DNA, 19 bp, Homo sapiens
ggcatgagggatcacaggg

SEQ ID NO: 2821823 - DNA, 13 bp, Homo sapiens
ggcatgctggcct

SEQ ID NO: 2821824 - DNA, 19 bp, Homo sapiens
ggcatggtggcgcaagcct

SEQ ID NO: 2821825 - DNA, 22 bp, Homo sapiens
ggcatggtggcgcaagcctgta

SEQ ID NO: 2821826 - DNA, 15 bp, Homo sapiens
ggcattcctgcttat

SEQ ID NO: 2821827 - DNA, 18 bp, Homo sapiens
ggcatttcctgggtggct

SEQ ID NO: 2821828 - DNA, 22 bp, Homo sapiens
ggcatttttactactattctgt

SEQ ID NO: 2821829 - DNA, 15 bp, Homo sapiens
ggccaaagccaaagc

SEQ ID NO: 2821830 - DNA, 20 bp, Homo sapiens
ggccaagctgaggtgcccag

SEQ ID NO: 2821831 - DNA, 22 bp, Homo sapiens
ggccaatgcacctaaagaaaaa

SEQ ID NO: 2821832 - DNA, 23 bp, Homo sapiens
ggccacccgttctgctggcctgg

SEQ ID NO: 2821833 - DNA, 19 bp, Homo sapiens
ggccaccgggacagacctg

SEQ ID NO: 2821834 - DNA, 11 bp, Homo sapiens
ggccacgtgcc

SEQ ID NO: 2821835 - DNA, 12 bp, Homo sapiens
ggccacgtgcca

SEQ ID NO: 2821836 - DNA, 16 bp, Homo sapiens
ggccacgtgccaggcc

SEQ ID NO: 2821837 - DNA, 19 bp, Homo sapiens
ggccactccttcctgcccc

SEQ ID NO: 2821838 - DNA, 20 bp, Homo sapiens
ggccactctcccctccctct

SEQ ID NO: 2821839 - DNA, 22 bp, Homo sapiens
ggccactctcccctccctcttc

SEQ ID NO: 2821840 - DNA, 19 bp, Homo sapiens
ggccagagggagtgacaga

SEQ ID NO: 2821841 - DNA, 23 bp, Homo sapiens
ggccagagggagtgacagaggca

SEQ ID NO: 2821842 - DNA, 16 bp, Homo sapiens
ggccagatgcaccagc

SEQ ID NO: 2821843 - DNA, 22 bp, Homo sapiens
ggccagcctggcctcctgcctc

SEQ ID NO: 2821844 - DNA, 15 bp, Homo sapiens
ggccaggacaggccc

SEQ ID NO: 2821845 - DNA, 20 bp, Homo sapiens
ggccaggagtttgagaccag

SEQ ID NO: 2821846 - DNA, 17 bp, Homo sapiens
ggccaggccaccaggat

SEQ ID NO: 2821847 - DNA, 14 bp, Homo sapiens
ggccaggccagagg

SEQ ID NO: 2821848 - DNA, 20 bp, Homo sapiens
ggccaggcgcggtggctcac

SEQ ID NO: 2821849 - DNA, 12 bp, Homo sapiens
ggccaggctggt

SEQ ID NO: 2821850 - DNA, 17 bp, Homo sapiens
ggccaggggtctccctg

SEQ ID NO: 2821851 - DNA, 16 bp, Homo sapiens
ggccagggtgagagct

SEQ ID NO: 2821852 - DNA, 14 bp, Homo sapiens
ggccatcagggtgg

SEQ ID NO: 2821853 - DNA, 17 bp, Homo sapiens
ggccatgctgaagggac

SEQ ID NO: 2821854 - DNA, 21 bp, Homo sapiens
ggccatgcttcttgccccttg

SEQ ID NO: 2821855 - DNA, 22 bp, Homo sapiens
ggccatgcttcttgccccttgg

SEQ ID NO: 2821856 - DNA, 13 bp, Homo sapiens
ggccatggcagaa

SEQ ID NO: 2821857 - DNA, 15 bp, Homo sapiens
ggcccacagctccca

SEQ ID NO: 2821858 - DNA, 17 bp, Homo sapiens
ggcccacagctcccacc

SEQ ID NO: 2821859 - DNA, 19 bp, Homo sapiens
ggcccacagctcccacccc

SEQ ID NO: 2821860 - DNA, 22 bp, Homo sapiens
ggcccagagaccccttcctttc

SEQ ID NO: 2821861 - DNA, 11 bp, Homo sapiens
ggcccagagag

SEQ ID NO: 2821862 - DNA, 14 bp, Homo sapiens
ggccccagagaggg

SEQ ID NO: 2821863 - DNA, 16 bp, Homo sapiens
ggccccagcactaaag

SEQ ID NO: 2821864 - DNA, 17 bp, Homo sapiens
ggccccagggctaccct

SEQ ID NO: 2821865 - DNA, 18 bp, Homo sapiens
ggccccatgacctccagc

SEQ ID NO: 2821866 - DNA, 21 bp, Homo sapiens
ggcccccacaggccccccgca

SEQ ID NO: 2821867 - DNA, 16 bp, Homo sapiens
ggcccccacctggctc

SEQ ID NO: 2821868 - DNA, 12 bp, Homo sapiens
ggcccccctcca

SEQ ID NO: 2821869 - DNA, 14 bp, Homo sapiens
ggcccccctccagg

SEQ ID NO: 2821870 - DNA, 16 bp, Homo sapiens
ggcccccctccaggca

SEQ ID NO: 2821871 - DNA, 19 bp, Homo sapiens
ggcccccctccaggcatgc

SEQ ID NO: 2821872 - DNA, 21 bp, Homo sapiens
ggccccgcttgtccagcgcct

SEQ ID NO: 2821873 - DNA, 18 bp, Homo sapiens
ggccccgtcagccacacc

SEQ ID NO: 2821874 - DNA, 18 bp, Homo sapiens
ggcccctgccaccctggg

SEQ ID NO: 2821875 - DNA, 16 bp, Homo sapiens
ggcccctgcccggctg

SEQ ID NO: 2821876 - DNA, 20 bp, Homo sapiens
ggcccctgcccggctgcgga

SEQ ID NO: 2821877 - DNA, 23 bp, Homo sapiens
ggcccctgctggttcagggttgg

SEQ ID NO: 2821878 - DNA, 21 bp, Homo sapiens
ggccccttggcgggcagccca

SEQ ID NO: 2821879 - DNA, 23 bp, Homo sapiens
ggccccttggcgggcagcccagc

SEQ ID NO: 2821880 - DNA, 13 bp, Homo sapiens
ggcccgagcagct

SEQ ID NO: 2821881 - DNA, 15 bp, Homo sapiens
ggcccgagcagctga

SEQ ID NO: 2821882 - DNA, 17 bp, Homo sapiens
ggcccgctttgcctgct

SEQ ID NO: 2821883 - DNA, 23 bp, Homo sapiens
ggcccggcgcggtggctcacgcc

SEQ ID NO: 2821884 - DNA, 13 bp, Homo sapiens
ggcccggggctgg

SEQ ID NO: 2821885 - DNA, 19 bp, Homo sapiens
ggcccggggctggcggcta

SEQ ID NO: 2821886 - DNA, 22 bp, Homo sapiens
ggcccggggctggcggctactc

SEQ ID NO: 2821887 - DNA, 16 bp, Homo sapiens
ggccctctatttctct

SEQ ID NO: 2821888 - DNA, 14 bp, Homo sapiens
ggccctgagctcgg

SEQ ID NO: 2821889 - DNA, 20 bp, Homo sapiens
ggccctggatcagcgtggcc

SEQ ID NO: 2821890 - DNA, 22 bp, Homo sapiens
ggccctggatcagcgtggcctt

SEQ ID NO: 2821891 - DNA, 18 bp, Homo sapiens
ggccctggatgtgcccac

SEQ ID NO: 2821892 - DNA, 19 bp, Homo sapiens
ggccctggatgtgcccaca

SEQ ID NO: 2821893 - DNA, 15 bp, Homo sapiens
ggccctggcctgctg

SEQ ID NO: 2821894 - DNA, 22 bp, Homo sapiens
ggccctggcctgctgggctctc

SEQ ID NO: 2821895 - DNA, 13 bp, Homo sapiens
ggccctggggcct

SEQ ID NO: 2821896 - DNA, 14 bp, Homo sapiens
ggccctggggcctg

SEQ ID NO: 2821897 - DNA, 17 bp, Homo sapiens
ggccctggggcctgtac

SEQ ID NO: 2821898 - DNA, 14 bp, Homo sapiens
ggcccttcctggac

SEQ ID NO: 2821899 - DNA, 23 bp, Homo sapiens
ggcccttcctggacagctgtgcc

SEQ ID NO: 2821900 - DNA, 17 bp, Homo sapiens
ggccgactcagggacct

SEQ ID NO: 2821901 - DNA, 15 bp, Homo sapiens
ggccgcattccctga

SEQ ID NO: 2821902 - DNA, 13 bp, Homo sapiens
ggccgcctccagg

SEQ ID NO: 2821903 - DNA, 20 bp, Homo sapiens
ggccgggcttgggccctgca

SEQ ID NO: 2821904 - DNA, 13 bp, Homo sapiens
ggccgtgcccagg

SEQ ID NO: 2821905 - DNA, 17 bp, Homo sapiens
ggccgtggtccagctct

SEQ ID NO: 2821906 - DNA, 18 bp, Homo sapiens
ggccgtggtccagctctt

SEQ ID NO: 2821907 - DNA, 23 bp, Homo sapiens
ggcctagatccacacacagagga

SEQ ID NO: 2821908 - DNA, 19 bp, Homo sapiens
ggcctagcaggcacaggac

SEQ ID NO: 2821909 - DNA, 16 bp, Homo sapiens
ggcctatggagagccc

SEQ ID NO: 2821910 - DNA, 15 bp, Homo sapiens
ggcctcacgcccagc

SEQ ID NO: 2821911 - DNA, 13 bp, Homo sapiens
ggcctcagtgcca

SEQ ID NO: 2821912 - DNA, 17 bp, Homo sapiens
ggcctcccaataaagct

SEQ ID NO: 2821913 - DNA, 21 bp, Homo sapiens
ggcctccgtccaggagcctgg

SEQ ID NO: 2821914 - DNA, 19 bp, Homo sapiens
ggcctcctctgtccagggc

SEQ ID NO: 2821915 - DNA, 13 bp, Homo sapiens
ggcctcctgcctc

SEQ ID NO: 2821916 - DNA, 14 bp, Homo sapiens
ggcctcctgcctct

SEQ ID NO: 2821917 - DNA, 15 bp, Homo sapiens
ggcctcctgcctcta

SEQ ID NO: 2821918 - DNA, 13 bp, Homo sapiens
ggcctgcactaat

SEQ ID NO: 2821919 - DNA, 18 bp, Homo sapiens
ggcctgcctctgactcac

SEQ ID NO: 2821920 - DNA, 18 bp, Homo sapiens
ggcctgccttgaagccac

SEQ ID NO: 2821921 - DNA, 18 bp, Homo sapiens
ggcctgctcccagcagcc

SEQ ID NO: 2821922 - DNA, 21 bp, Homo sapiens
ggcctggccggcaaccccagt

SEQ ID NO: 2821923 - DNA, 12 bp, Homo sapiens
ggcctggctggc

SEQ ID NO: 2821924 - DNA, 15 bp, Homo sapiens
ggcctggctggctga

SEQ ID NO: 2821925 - DNA, 14 bp, Homo sapiens
ggcctgtactgcct

SEQ ID NO: 2821926 - DNA, 15 bp, Homo sapiens
ggcctgtactgcctg

SEQ ID NO: 2821927 - DNA, 16 bp, Homo sapiens
ggcctgtactgcctgc

SEQ ID NO: 2821928 - DNA, 17 bp, Homo sapiens
ggcctgtgtagctgtga

SEQ ID NO: 2821929 - DNA, 12 bp, Homo sapiens
ggccttctctga

SEQ ID NO: 2821930 - DNA, 14 bp, Homo sapiens
ggccttgcccagag

SEQ ID NO: 2821931 - DNA, 17 bp, Homo sapiens
ggcgaatctacagaaca

SEQ ID NO: 2821932 - DNA, 23 bp, Homo sapiens
ggcgacagagcgagagtctgtct

SEQ ID NO: 2821933 - DNA, 13 bp, Homo sapiens
ggcgacccctcag

SEQ ID NO: 2821934 - DNA, 18 bp, Homo sapiens
ggcgcctgtagtcccagc

SEQ ID NO: 2821935 - DNA, 22 bp, Homo sapiens
ggcgcgcacctgtaatcccagc

SEQ ID NO: 2821936 - DNA, 14 bp, Homo sapiens
ggcgctctgccctc

SEQ ID NO: 2821937 - DNA, 22 bp, Homo sapiens
ggcgctctgccctccctggcct

SEQ ID NO: 2821938 - DNA, 19 bp, Homo sapiens
ggcggagagtacagtgagc

SEQ ID NO: 2821939 - DNA, 20 bp, Homo sapiens
ggcggagagtacagtgagcc

SEQ ID NO: 2821940 - DNA, 21 bp, Homo sapiens
ggcggagagtacagtgagcca

SEQ ID NO: 2821941 - DNA, 22 bp, Homo sapiens
ggcggcacattggcagtgtgtc

SEQ ID NO: 2821942 - DNA, 23 bp, Homo sapiens
ggcggctactcagcagccctcct

SEQ ID NO: 2821943 - DNA, 16 bp, Homo sapiens
ggcgggagcatctctt

SEQ ID NO: 2821944 - DNA, 22 bp, Homo sapiens
ggcgggcacctatagtcccagc

SEQ ID NO: 2821945 - DNA, 18 bp, Homo sapiens
ggcgggggagccaacagc

SEQ ID NO: 2821946 - DNA, 17 bp, Homo sapiens
ggcggtttccaggaaga

SEQ ID NO: 2821947 - DNA, 17 bp, Homo sapiens
ggcgtgactcacccaag

SEQ ID NO: 2821948 - DNA, 14 bp, Homo sapiens
ggcgttctgctgcc

SEQ ID NO: 2821949 - DNA, 23 bp, Homo sapiens
ggcgttctgctgcccctgcagtt

SEQ ID NO: 2821950 - DNA, 15 bp, Homo sapiens
ggctactcagcagcc

SEQ ID NO: 2821951 - DNA, 16 bp, Homo sapiens
ggctactcagcagccc

SEQ ID NO: 2821952 - DNA, 20 bp, Homo sapiens
ggctactcagcagccctcct

SEQ ID NO: 2821953 - DNA, 19 bp, Homo sapiens
ggctactctcctcggcccc

SEQ ID NO: 2821954 - DNA, 23 bp, Homo sapiens
ggctactctgtgccagagcctgg

SEQ ID NO: 2821955 - DNA, 24 bp, Homo sapiens
ggctactctgtgccagagcctggg

SEQ ID NO: 2821956 - DNA, 18 bp, Homo sapiens
ggctacttcggggctggg

SEQ ID NO: 2821957 - DNA, 13 bp, Homo sapiens
ggctaggtacaca

SEQ ID NO: 2821958 - DNA, 14 bp, Homo sapiens
ggctagtcagagag

SEQ ID NO: 2821959 - DNA, 19 bp, Homo sapiens
ggctatgggggcactgagg

SEQ ID NO: 2821960 - DNA, 21 bp, Homo sapiens
ggctcacgcctatgatcccag

SEQ ID NO: 2821961 - DNA, 22 bp, Homo sapiens
ggctcacgcctgtaatcccagc

SEQ ID NO: 2821962 - DNA, 14 bp, Homo sapiens
ggctcactgcagcc

SEQ ID NO: 2821963 - DNA, 17 bp, Homo sapiens
ggctcactgcagcctca

SEQ ID NO: 2821964 - DNA, 11 bp, Homo sapiens
ggctcagcctg

SEQ ID NO: 2821965 - DNA, 14 bp, Homo sapiens
ggctcagtctcagg

SEQ ID NO: 2821966 - DNA, 11 bp, Homo sapiens
ggctccaggct

SEQ ID NO: 2821967 - DNA, 13 bp, Homo sapiens
ggctccaggctcc

SEQ ID NO: 2821968 - DNA, 15 bp, Homo sapiens
ggctccaggctcctt

SEQ ID NO: 2821969 - DNA, 18 bp, Homo sapiens
ggctccagtttccccatg

SEQ ID NO: 2821970 - DNA, 11 bp, Homo sapiens
ggctcctgtcc

SEQ ID NO: 2821971 - DNA, 13 bp, Homo sapiens
ggctcctttctcc

SEQ ID NO: 2821972 - DNA, 20 bp, Homo sapiens
ggctcctttctccagccagc

SEQ ID NO: 2821973 - DNA, 14 bp, Homo sapiens
ggctctaacgcctg

SEQ ID NO: 2821974 - DNA, 13 bp, Homo sapiens
ggctctccacctc

SEQ ID NO: 2821975 - DNA, 15 bp, Homo sapiens
ggctctccacctcag

SEQ ID NO: 2821976 - DNA, 21 bp, Homo sapiens
ggctctccacctcagccttgg

SEQ ID NO: 2821977 - DNA, 13 bp, Homo sapiens
ggctctccagtta

SEQ ID NO: 2821978 - DNA, 17 bp, Homo sapiens
ggctctcctggcttccc

SEQ ID NO: 2821979 - DNA, 12 bp, Homo sapiens
ggctctgaggcg

SEQ ID NO: 2821980 - DNA, 14 bp, Homo sapiens
ggctctgccccagc

SEQ ID NO: 2821981 - DNA, 20 bp, Homo sapiens
ggctctgccccagctctggc

SEQ ID NO: 2821982 - DNA, 15 bp, Homo sapiens
ggctctgtgcaggga

SEQ ID NO: 2821983 - DNA, 14 bp, Homo sapiens
ggctgaaaatcact

SEQ ID NO: 2821984 - DNA, 11 bp, Homo sapiens
ggctgaaagcc

SEQ ID NO: 2821985 - DNA, 20 bp, Homo sapiens
ggctgaaataaaagcctctg

SEQ ID NO: 2821986 - DNA, 20 bp, Homo sapiens
ggctgaacggggagaaaagg

SEQ ID NO: 2821987 - DNA, 22 bp, Homo sapiens
ggctgaccccaaagagcctgga

SEQ ID NO: 2821988 - DNA, 21 bp, Homo sapiens
ggctgagactgcgggatggtc

SEQ ID NO: 2821989 - DNA, 13 bp, Homo sapiens
ggctgagccctgg

SEQ ID NO: 2821990 - DNA, 14 bp, Homo sapiens
ggctgagccctggc

SEQ ID NO: 2821991 - DNA, 21 bp, Homo sapiens
ggctgaggaagcacagcagca

SEQ ID NO: 2821992 - DNA, 14 bp, Homo sapiens
ggctgaggcaggag

SEQ ID NO: 2821993 - DNA, 13 bp, Homo sapiens
ggctgagggcagt

SEQ ID NO: 2821994 - DNA, 23 bp, Homo sapiens
ggctgagtcatgatctccctgcc

SEQ ID NO: 2821995 - DNA, 23 bp, Homo sapiens
ggctgcaaagggtatcaggtgct

SEQ ID NO: 2821996 - DNA, 24 bp, Homo sapiens
ggctgcaaagggtatcaggtgctg

SEQ ID NO: 2821997 - DNA, 14 bp, Homo sapiens
ggctgcagagacct

SEQ ID NO: 2821998 - DNA, 12 bp, Homo sapiens
ggctgcagggag

SEQ ID NO: 2821999 - DNA, 20 bp, Homo sapiens
ggctgcgggacagaggacca

SEQ ID NO: 2822000 - DNA, 18 bp, Homo sapiens
ggctgctcctccagggcc

SEQ ID NO: 2822001 - DNA, 22 bp, Homo sapiens
ggctgctgtgtagctctgtcca

SEQ ID NO: 2822002 - DNA, 23 bp, Homo sapiens
ggctgctgtgtagctctgtccac

SEQ ID NO: 2822003 - DNA, 16 bp, Homo sapiens
ggctggacctatgtcc

SEQ ID NO: 2822004 - DNA, 13 bp, Homo sapiens
ggctggaggcagg

SEQ ID NO: 2822005 - DNA, 19 bp, Homo sapiens
ggctggaggcagggccttg

SEQ ID NO: 2822006 - DNA, 23 bp, Homo sapiens
ggctggaggcagggccttgccca

SEQ ID NO: 2822007 - DNA, 20 bp, Homo sapiens
ggctggagtgcagtggtgcg

SEQ ID NO: 2822008 - DNA, 16 bp, Homo sapiens
ggctggcgtgcagtgg

SEQ ID NO: 2822009 - DNA, 20 bp, Homo sapiens
ggctggcgtgcagtggtgcg

SEQ ID NO: 2822010 - DNA, 12 bp, Homo sapiens
ggctggctgagg

SEQ ID NO: 2822011 - DNA, 15 bp, Homo sapiens
ggctggctgagggca

SEQ ID NO: 2822012 - DNA, 22 bp, Homo sapiens
ggctgggcttcagtggcagctg

SEQ ID NO: 2822013 - DNA, 14 bp, Homo sapiens
ggctgggggcctca

SEQ ID NO: 2822014 - DNA, 15 bp, Homo sapiens
ggctgggggcctcag

SEQ ID NO: 2822015 - DNA, 22 bp, Homo sapiens
ggctgggggcgggggagccaac

SEQ ID NO: 2822016 - DNA, 19 bp, Homo sapiens
ggctggtgctgtggccagg

SEQ ID NO: 2822017 - DNA, 22 bp, Homo sapiens
ggctgtatcccatgagcctcag

SEQ ID NO: 2822018 - DNA, 13 bp, Homo sapiens
ggctgtgcctctg

SEQ ID NO: 2822019 - DNA, 16 bp, Homo sapiens
ggcttagtaatagatc

SEQ ID NO: 2822020 - DNA, 15 bp, Homo sapiens
ggcttatggccaggg

SEQ ID NO: 2822021 - DNA, 20 bp, Homo sapiens
ggcttattttttaaaataat

SEQ ID NO: 2822022 - DNA, 16 bp, Homo sapiens
ggcttcagtggcagct

SEQ ID NO: 2822023 - DNA, 17 bp, Homo sapiens
ggcttcagtggcagctg

SEQ ID NO: 2822024 - DNA, 20 bp, Homo sapiens
ggcttcagtggcagctgctt

SEQ ID NO: 2822025 - DNA, 14 bp, Homo sapiens
ggcttccagagagt

SEQ ID NO: 2822026 - DNA, 20 bp, Homo sapiens
ggcttccagagagtcctctg

SEQ ID NO: 2822027 - DNA, 21 bp, Homo sapiens
ggcttccaggtatctccagga

SEQ ID NO: 2822028 - DNA, 16 bp, Homo sapiens
ggcttcctcatagtat

SEQ ID NO: 2822029 - DNA, 23 bp, Homo sapiens
ggcttcctccagcggctgggtgg

SEQ ID NO: 2822030 - DNA, 21 bp, Homo sapiens
ggcttgggaagatcttttaaa

SEQ ID NO: 2822031 - DNA, 15 bp, Homo sapiens
ggcttgggccctgca

SEQ ID NO: 2822032 - DNA, 18 bp, Homo sapiens
ggcttgtaactccaccaa

SEQ ID NO: 2822033 - DNA, 13 bp, Homo sapiens
ggctttgtcctgg

SEQ ID NO: 2822034 - DNA, 16 bp, Homo sapiens
gggaaaacataatatc

SEQ ID NO: 2822035 - DNA, 14 bp, Homo sapiens
gggaaataagagag

SEQ ID NO: 2822036 - DNA, 14 bp, Homo sapiens
gggaacagacagga

SEQ ID NO: 2822037 - DNA, 18 bp, Homo sapiens
gggaacagacaggagaaa

SEQ ID NO: 2822038 - DNA, 14 bp, Homo sapiens
gggaacagactgga

SEQ ID NO: 2822039 - DNA, 22 bp, Homo sapiens
gggaacagactggaagcacagc

SEQ ID NO: 2822040 - DNA, 16 bp, Homo sapiens
gggaaccatgaagctg

SEQ ID NO: 2822041 - DNA, 23 bp, Homo sapiens
gggaaccatgaagctggaagcac

SEQ ID NO: 2822042 - DNA, 14 bp, Homo sapiens
gggaacgtgactgc

SEQ ID NO: 2822043 - DNA, 17 bp, Homo sapiens
gggaacgtgactgcccc

SEQ ID NO: 2822044 - DNA, 20 bp, Homo sapiens
gggaactggccaagctgagg

SEQ ID NO: 2822045 - DNA, 21 bp, Homo sapiens
gggaactggccaagctgaggt

SEQ ID NO: 2822046 - DNA, 12 bp, Homo sapiens
gggaagccctgg

SEQ ID NO: 2822047 - DNA, 14 bp, Homo sapiens
gggaagctggggga

SEQ ID NO: 2822048 - DNA, 20 bp, Homo sapiens
gggaaggagggttagggagg

SEQ ID NO: 2822049 - DNA, 16 bp, Homo sapiens
gggaagggagagcggg

SEQ ID NO: 2822050 - DNA, 16 bp, Homo sapiens
gggaatggcacagccc

SEQ ID NO: 2822051 - DNA, 22 bp, Homo sapiens
gggaatgtttgggcagaaggga

SEQ ID NO: 2822052 - DNA, 23 bp, Homo sapiens
gggaatgtttgggcagaagggag

SEQ ID NO: 2822053 - DNA, 13 bp, Homo sapiens
gggaattgcatgc

SEQ ID NO: 2822054 - DNA, 18 bp, Homo sapiens
gggacaaaggagcctgtg

SEQ ID NO: 2822055 - DNA, 15 bp, Homo sapiens
gggacagacctggac

SEQ ID NO: 2822056 - DNA, 16 bp, Homo sapiens
gggacagctccttctg

SEQ ID NO: 2822057 - DNA, 21 bp, Homo sapiens
gggacagctccttctgtccta

SEQ ID NO: 2822058 - DNA, 15 bp, Homo sapiens
gggacagtattctca

SEQ ID NO: 2822059 - DNA, 16 bp, Homo sapiens
gggactcaatgcactg

SEQ ID NO: 2822060 - DNA, 19 bp, Homo sapiens
gggactggaaccagggaga

SEQ ID NO: 2822061 - DNA, 18 bp, Homo sapiens
gggacttggaagctccgc

SEQ ID NO: 2822062 - DNA, 14 bp, Homo sapiens
gggagaacctcagg

SEQ ID NO: 2822063 - DNA, 16 bp, Homo sapiens
gggagaacctcaggct

SEQ ID NO: 2822064 - DNA, 14 bp, Homo sapiens
gggagagccagctc

SEQ ID NO: 2822065 - DNA, 14 bp, Homo sapiens
gggagcactggagt

SEQ ID NO: 2822066 - DNA, 21 bp, Homo sapiens
gggagcctcgcaacccgtgcc

SEQ ID NO: 2822067 - DNA, 21 bp, Homo sapiens
gggagctgcctgttcagctcc

SEQ ID NO: 2822068 - DNA, 19 bp, Homo sapiens
gggagctggttagaaatgc

SEQ ID NO: 2822069 - DNA, 16 bp, Homo sapiens
gggaggaaaagaaaag

SEQ ID NO: 2822070 - DNA, 11 bp, Homo sapiens
gggaggaaggg

SEQ ID NO: 2822071 - DNA, 22 bp, Homo sapiens
gggaggatgttctgggacacag

SEQ ID NO: 2822072 - DNA, 18 bp, Homo sapiens
gggaggcggagagtacag

SEQ ID NO: 2822073 - DNA, 17 bp, Homo sapiens
gggaggctgagacagga

SEQ ID NO: 2822074 - DNA, 15 bp, Homo sapiens
gggagggctctgagg

SEQ ID NO: 2822075 - DNA, 16 bp, Homo sapiens
gggaggggcctaggga

SEQ ID NO: 2822076 - DNA, 19 bp, Homo sapiens
gggaggggcctagggagcc

SEQ ID NO: 2822077 - DNA, 22 bp, Homo sapiens
gggaggggtaaaattccttagc

SEQ ID NO: 2822078 - DNA, 16 bp, Homo sapiens
gggaggtcgaggtagg

SEQ ID NO: 2822079 - DNA, 16 bp, Homo sapiens
gggaggtgaccccagg

SEQ ID NO: 2822080 - DNA, 14 bp, Homo sapiens
gggatcacagggcc

SEQ ID NO: 2822081 - DNA, 17 bp, Homo sapiens
gggatgactagaggcag

SEQ ID NO: 2822082 - DNA, 23 bp, Homo sapiens
gggatgactagaggcagggaggg

SEQ ID NO: 2822083 - DNA, 14 bp, Homo sapiens
gggatggaggagaa

SEQ ID NO: 2822084 - DNA, 18 bp, Homo sapiens
gggatggaggagaagaat

SEQ ID NO: 2822085 - DNA, 22 bp, Homo sapiens
gggatgtgaattgcctgcagag

SEQ ID NO: 2822086 - DNA, 21 bp, Homo sapiens
gggattcaggaaaaggcctgg

SEQ ID NO: 2822087 - DNA, 22 bp, Homo sapiens
gggattcaggaaaaggcctggg

SEQ ID NO: 2822088 - DNA, 22 bp, Homo sapiens
gggcaacagagcaagatcctgt

SEQ ID NO: 2822089 - DNA, 22 bp, Homo sapiens
gggcaataaatgccctctctga

SEQ ID NO: 2822090 - DNA, 14 bp, Homo sapiens
ggggaagggtggtc

SEQ ID NO: 2822091 - DNA, 12 bp, Homo sapiens
ggggacagctcc

SEQ ID NO: 2822092 - DNA, 20 bp, Homo sapiens
ggggacagctccttctgtcc

SEQ ID NO: 2822093 - DNA, 13 bp, Homo sapiens
ggggagacctggt

SEQ ID NO: 2822094 - DNA, 20 bp, Homo sapiens
ggggagacggaggttgcagt

SEQ ID NO: 2822095 - DNA, 11 bp, Homo sapiens
ggggaggaagg

SEQ ID NO: 2822096 - DNA, 12 bp, Homo sapiens
ggggaggaaggg

SEQ ID NO: 2822097 - DNA, 19 bp, Homo sapiens
ggggaggatcactggagcc

SEQ ID NO: 2822098 - DNA, 20 bp, Homo sapiens
ggggaggggcctagggagcc

SEQ ID NO: 2822099 - DNA, 15 bp, Homo sapiens
ggggagtccctgcca

SEQ ID NO: 2822100 - DNA, 18 bp, Homo sapiens
ggggcacgcctgcccagc

SEQ ID NO: 2822101 - DNA, 20 bp, Homo sapiens
ggggcaggagtagctgagct

SEQ ID NO: 2822102 - DNA, 13 bp, Homo sapiens
ggggcagtggcaa

SEQ ID NO: 2822103 - DNA, 22 bp, Homo sapiens
ggggcccacagacagatcccat

SEQ ID NO: 2822104 - DNA, 13 bp, Homo sapiens
ggggcctagggag

SEQ ID NO: 2822105 - DNA, 11 bp, Homo sapiens
ggggcctggct

SEQ ID NO: 2822106 - DNA, 14 bp, Homo sapiens
ggggcctgtactgc

SEQ ID NO: 2822107 - DNA, 15 bp, Homo sapiens
ggggcctgtactgcc

SEQ ID NO: 2822108 - DNA, 18 bp, Homo sapiens
ggggcctgtactgcctgc

SEQ ID NO: 2822109 - DNA, 17 bp, Homo sapiens
ggggcgacccctcagtg

SEQ ID NO: 2822110 - DNA, 20 bp, Homo sapiens
ggggcgacccctcagtgctc

SEQ ID NO: 2822111 - DNA, 21 bp, Homo sapiens
ggggctcctttctccagccag

SEQ ID NO: 2822112 - DNA, 20 bp, Homo sapiens
ggggctctaacgcctgagcc

SEQ ID NO: 2822113 - DNA, 12 bp, Homo sapiens
ggggctctggga

SEQ ID NO: 2822114 - DNA, 16 bp, Homo sapiens
ggggctgctcctccag

SEQ ID NO: 2822115 - DNA, 16 bp, Homo sapiens
gggggagccaacagca

SEQ ID NO: 2822116 - DNA, 15 bp, Homo sapiens
gggggcctcagtgcc

SEQ ID NO: 2822117 - DNA, 17 bp, Homo sapiens
gggggcctcagtgccac

SEQ ID NO: 2822118 - DNA, 20 bp, Homo sapiens
gggggtgatgagggcagcag

SEQ ID NO: 2822119 - DNA, 22 bp, Homo sapiens
ggggtaaaattccttagcttag

SEQ ID NO: 2822120 - DNA, 19 bp, Homo sapiens
ggggtcgtggagagctagg

SEQ ID NO: 2822121 - DNA, 19 bp, Homo sapiens
ggggtctccctctcctgcc

SEQ ID NO: 2822122 - DNA, 22 bp, Homo sapiens
ggggtgcgagagaggtgggcag

SEQ ID NO: 2822123 - DNA, 16 bp, Homo sapiens
ggggtgggcagggctg

SEQ ID NO: 2822124 - DNA, 13 bp, Homo sapiens
gggtaaggtgcct

SEQ ID NO: 2822125 - DNA, 14 bp, Homo sapiens
gggtaaggtgcctt

SEQ ID NO: 2822126 - DNA, 15 bp, Homo sapiens
gggtacccactgctc

SEQ ID NO: 2822127 - DNA, 13 bp, Homo sapiens
gggtacctcagtt

SEQ ID NO: 2822128 - DNA, 14 bp, Homo sapiens
gggtacctcagttt

SEQ ID NO: 2822129 - DNA, 22 bp, Homo sapiens
gggtacttgtggacacagctct

SEQ ID NO: 2822130 - DNA, 22 bp, Homo sapiens
gggtagcaggtaccactgattt

SEQ ID NO: 2822131 - DNA, 16 bp, Homo sapiens
gggtaggcgggaagga

SEQ ID NO: 2822132 - DNA, 20 bp, Homo sapiens
gggtatcaggtgctgccatc

SEQ ID NO: 2822133 - DNA, 12 bp, Homo sapiens
gggtcagccagg

SEQ ID NO: 2822134 - DNA, 17 bp, Homo sapiens
gggtcagccagggccag

SEQ ID NO: 2822135 - DNA, 19 bp, Homo sapiens
gggtccccagctccccagg

SEQ ID NO: 2822136 - DNA, 16 bp, Homo sapiens
gggtccccgggagcac

SEQ ID NO: 2822137 - DNA, 19 bp, Homo sapiens
gggtcctgcaatctccagg

SEQ ID NO: 2822138 - DNA, 18 bp, Homo sapiens
gggtcgtggagagctagg

SEQ ID NO: 2822139 - DNA, 14 bp, Homo sapiens
gggtctcactctgt

SEQ ID NO: 2822140 - DNA, 15 bp, Homo sapiens
gggtctccctggagt

SEQ ID NO: 2822141 - DNA, 17 bp, Homo sapiens
gggtgatgagggcagca

SEQ ID NO: 2822142 - DNA, 19 bp, Homo sapiens
gggtgatgagggcagcagc

SEQ ID NO: 2822143 - DNA, 22 bp, Homo sapiens
gggtgatttcagagagggcaga

SEQ ID NO: 2822144 - DNA, 13 bp, Homo sapiens
gggtgcacaggag

SEQ ID NO: 2822145 - DNA, 14 bp, Homo sapiens
gggtgcacaggagg

SEQ ID NO: 2822146 - DNA, 21 bp, Homo sapiens
gggtgccccccttgccagaca

SEQ ID NO: 2822147 - DNA, 21 bp, Homo sapiens
gggtggatccactgtgcagga

SEQ ID NO: 2822148 - DNA, 13 bp, Homo sapiens
gggtggatgcctg

SEQ ID NO: 2822149 - DNA, 18 bp, Homo sapiens
gggtggctactctgtgcc

SEQ ID NO: 2822150 - DNA, 20 bp, Homo sapiens
gggtggctactctgtgccag

SEQ ID NO: 2822151 - DNA, 11 bp, Homo sapiens
gggtgggcagg

SEQ ID NO: 2822152 - DNA, 21 bp, Homo sapiens
gggtggtctgagcaccccctc

SEQ ID NO: 2822153 - DNA, 18 bp, Homo sapiens
gggtgtaacaggtctcct

SEQ ID NO: 2822154 - DNA, 14 bp, Homo sapiens
gggtgtgtgtttgt

SEQ ID NO: 2822155 - DNA, 23 bp, Homo sapiens
gggttcaagcgattcttctgctt

SEQ ID NO: 2822156 - DNA, 17 bp, Homo sapiens
gggttcagcccctcctc

SEQ ID NO: 2822157 - DNA, 21 bp, Homo sapiens
gggttcagcccctcctctgcc

SEQ ID NO: 2822158 - DNA, 15 bp, Homo sapiens
gggttgtgtgtctgt

SEQ ID NO: 2822159 - DNA, 20 bp, Homo sapiens
gggtttcaccatgttggcca

SEQ ID NO: 2822160 - DNA, 14 bp, Homo sapiens
gggttttatatttt

SEQ ID NO: 2822161 - DNA, 22 bp, Homo sapiens
ggtaacatcctttctattgaaa

SEQ ID NO: 2822162 - DNA, 22 bp, Homo sapiens
ggtacagcaacaggaatctcag

SEQ ID NO: 2822163 - DNA, 15 bp, Homo sapiens
ggtaccagctcactc

SEQ ID NO: 2822164 - DNA, 13 bp, Homo sapiens
ggtacccactgct

SEQ ID NO: 2822165 - DNA, 19 bp, Homo sapiens
ggtacccctttctggctct

SEQ ID NO: 2822166 - DNA, 14 bp, Homo sapiens
ggtacctcagtttc

SEQ ID NO: 2822167 - DNA, 18 bp, Homo sapiens
ggtaccttgaacactggg

SEQ ID NO: 2822168 - DNA, 19 bp, Homo sapiens
ggtactctccaaaggccct

SEQ ID NO: 2822169 - DNA, 16 bp, Homo sapiens
ggtacttacccggaga

SEQ ID NO: 2822170 - DNA, 22 bp, Homo sapiens
ggtacttgtggacacagctctt

SEQ ID NO: 2822171 - DNA, 19 bp, Homo sapiens
ggtagaatgtaaagcttgt

SEQ ID NO: 2822172 - DNA, 16 bp, Homo sapiens
ggtagaattgggaagc

SEQ ID NO: 2822173 - DNA, 14 bp, Homo sapiens
ggtaggcagagcct

SEQ ID NO: 2822174 - DNA, 23 bp, Homo sapiens
ggtagtactcctgcaaaatttta

SEQ ID NO: 2822175 - DNA, 14 bp, Homo sapiens
ggtatcaggtgctg

SEQ ID NO: 2822176 - DNA, 23 bp, Homo sapiens
ggtatctccaggattgaagagca

SEQ ID NO: 2822177 - DNA, 19 bp, Homo sapiens
ggtatgaacttgaggacac

SEQ ID NO: 2822178 - DNA, 18 bp, Homo sapiens
ggtattccttttgtgtac

SEQ ID NO: 2822179 - DNA, 17 bp, Homo sapiens
ggtattgtaatgaatat

SEQ ID NO: 2822180 - DNA, 13 bp, Homo sapiens
gggcacaggagct

SEQ ID NO: 2822181 - DNA, 14 bp, Homo sapiens
gggcacaggagcta

SEQ ID NO: 2822182 - DNA, 18 bp, Homo sapiens
gggcacaggagctacctg

SEQ ID NO: 2822183 - DNA, 21 bp, Homo sapiens
gggcacaggagctacctgtgt

SEQ ID NO: 2822184 - DNA, 18 bp, Homo sapiens
gggcacccccagcctggg

SEQ ID NO: 2822185 - DNA, 19 bp, Homo sapiens
gggcactcagaagacactg

SEQ ID NO: 2822186 - DNA, 22 bp, Homo sapiens
gggcagaacagccgctcctgtc

SEQ ID NO: 2822187 - DNA, 18 bp, Homo sapiens
gggcagaagggagaagga

SEQ ID NO: 2822188 - DNA, 13 bp, Homo sapiens
gggcagagccggg

SEQ ID NO: 2822189 - DNA, 14 bp, Homo sapiens
gggcagaggctgga

SEQ ID NO: 2822190 - DNA, 15 bp, Homo sapiens
gggcagaggctggag

SEQ ID NO: 2822191 - DNA, 16 bp, Homo sapiens
gggcagaggctggagg

SEQ ID NO: 2822192 - DNA, 20 bp, Homo sapiens
gggcagagggcagaggctgg

SEQ ID NO: 2822193 - DNA, 15 bp, Homo sapiens
gggcagcagccagcc

SEQ ID NO: 2822194 - DNA, 18 bp, Homo sapiens
gggcagcagccagccctg

SEQ ID NO: 2822195 - DNA, 15 bp, Homo sapiens
gggcaggagtagctg

SEQ ID NO: 2822196 - DNA, 20 bp, Homo sapiens
gggcaggagtagctgagctc

SEQ ID NO: 2822197 - DNA, 14 bp, Homo sapiens
gggcagggctggga

SEQ ID NO: 2822198 - DNA, 16 bp, Homo sapiens
gggcagttcgcagcca

SEQ ID NO: 2822199 - DNA, 17 bp, Homo sapiens
gggcagttcgcagccac

SEQ ID NO: 2822200 - DNA, 15 bp, Homo sapiens
gggcatgctcagccc

SEQ ID NO: 2822201 - DNA, 14 bp, Homo sapiens
gggcatgctggggc

SEQ ID NO: 2822202 - DNA, 22 bp, Homo sapiens
gggcatggacgttcggggcatg

SEQ ID NO: 2822203 - DNA, 18 bp, Homo sapiens
gggccaattaaaatatat

SEQ ID NO: 2822204 - DNA, 21 bp, Homo sapiens
gggccaattaaaatatatata

SEQ ID NO: 2822205 - DNA, 18 bp, Homo sapiens
gggccacgtgccaggccc

SEQ ID NO: 2822206 - DNA, 16 bp, Homo sapiens
gggccactccttcctg

SEQ ID NO: 2822207 - DNA, 20 bp, Homo sapiens
gggccactccttcctgcccc

SEQ ID NO: 2822208 - DNA, 23 bp, Homo sapiens
gggccaggggtctccctggagtg

SEQ ID NO: 2822209 - DNA, 15 bp, Homo sapiens
gggccagtctgggct

SEQ ID NO: 2822210 - DNA, 14 bp, Homo sapiens
gggccatgctgaag

SEQ ID NO: 2822211 - DNA, 18 bp, Homo sapiens
gggcccaaagcccagctc

SEQ ID NO: 2822212 - DNA, 17 bp, Homo sapiens
gggcccagagagggtgg

SEQ ID NO: 2822213 - DNA, 13 bp, Homo sapiens
gggcccaggcagg

SEQ ID NO: 2822214 - DNA, 22 bp, Homo sapiens
gggccccaaacgggctgccctg

SEQ ID NO: 2822215 - DNA, 13 bp, Homo sapiens
gggcccccacagg

SEQ ID NO: 2822216 - DNA, 21 bp, Homo sapiens
gggccccttggcgggcagccc

SEQ ID NO: 2822217 - DNA, 12 bp, Homo sapiens
gggccctgagct

SEQ ID NO: 2822218 - DNA, 13 bp, Homo sapiens
gggccctgagctc

SEQ ID NO: 2822219 - DNA, 14 bp, Homo sapiens
gggccctggggcct

SEQ ID NO: 2822220 - DNA, 18 bp, Homo sapiens
gggccctggggcctgtac

SEQ ID NO: 2822221 - DNA, 20 bp, Homo sapiens
gggccctggggcctgtactg

SEQ ID NO: 2822222 - DNA, 19 bp, Homo sapiens
gggccctggtccttccagg

SEQ ID NO: 2822223 - DNA, 17 bp, Homo sapiens
gggccgtgcccaggggc

SEQ ID NO: 2822224 - DNA, 20 bp, Homo sapiens
gggcctagatccacacacag

SEQ ID NO: 2822225 - DNA, 16 bp, Homo sapiens
gggcctatggagagcc

SEQ ID NO: 2822226 - DNA, 22 bp, Homo sapiens
gggcctatggagagccctggga

SEQ ID NO: 2822227 - DNA, 13 bp, Homo sapiens
gggcctcagtgcc

SEQ ID NO: 2822228 - DNA, 15 bp, Homo sapiens
gggcctcagtgccac

SEQ ID NO: 2822229 - DNA, 16 bp, Homo sapiens
gggcctccccccagcc

SEQ ID NO: 2822230 - DNA, 21 bp, Homo sapiens
gggcctcctctccctgcacct

SEQ ID NO: 2822231 - DNA, 15 bp, Homo sapiens
gggcctcctgtgtgt

SEQ ID NO: 2822232 - DNA, 14 bp, Homo sapiens
gggcctgcccagtg

SEQ ID NO: 2822233 - DNA, 19 bp, Homo sapiens
gggcctgcctctgactcac

SEQ ID NO: 2822234 - DNA, 11 bp, Homo sapiens
gggcctgctgc

SEQ ID NO: 2822235 - DNA, 18 bp, Homo sapiens
gggcctgctgctgagaac

SEQ ID NO: 2822236 - DNA, 21 bp, Homo sapiens
gggcctggctggctgagggca

SEQ ID NO: 2822237 - DNA, 15 bp, Homo sapiens
gggccttgcccagag

SEQ ID NO: 2822238 - DNA, 22 bp, Homo sapiens
gggccttgcccagagatgcctc

SEQ ID NO: 2822239 - DNA, 17 bp, Homo sapiens
gggcgacccctcagtgc

SEQ ID NO: 2822240 - DNA, 14 bp, Homo sapiens
gggcgctctgccct

SEQ ID NO: 2822241 - DNA, 21 bp, Homo sapiens
gggcgtcgctggacaacccag

SEQ ID NO: 2822242 - DNA, 22 bp, Homo sapiens
gggcgtcgctggacaacccaga

SEQ ID NO: 2822243 - DNA, 23 bp, Homo sapiens
gggcgtcgctggacaacccagaa

SEQ ID NO: 2822244 - DNA, 14 bp, Homo sapiens
gggcgtgttgtttt

SEQ ID NO: 2822245 - DNA, 18 bp, Homo sapiens
gggctagttgggcttcct

SEQ ID NO: 2822246 - DNA, 12 bp, Homo sapiens
gggctcagcctg

SEQ ID NO: 2822247 - DNA, 13 bp, Homo sapiens
gggctcagcctgg

SEQ ID NO: 2822248 - DNA, 12 bp, Homo sapiens
gggctcctggaa

SEQ ID NO: 2822249 - DNA, 20 bp, Homo sapiens
gggctcctggaaaggctcag

SEQ ID NO: 2822250 - DNA, 22 bp, Homo sapiens
gggctcctttctccagccagca

SEQ ID NO: 2822251 - DNA, 15 bp, Homo sapiens
gggctctaacgcctg

SEQ ID NO: 2822252 - DNA, 19 bp, Homo sapiens
gggctctaacgcctgagcc

SEQ ID NO: 2822253 - DNA, 22 bp, Homo sapiens
gggctctaacgcctgagcccag

SEQ ID NO: 2822254 - DNA, 18 bp, Homo sapiens
gggctctccacctcagcc

SEQ ID NO: 2822255 - DNA, 21 bp, Homo sapiens
gggctctccacctcagccttg

SEQ ID NO: 2822256 - DNA, 13 bp, Homo sapiens
gggctctcctggc

SEQ ID NO: 2822257 - DNA, 12 bp, Homo sapiens
gggctctgaggc

SEQ ID NO: 2822258 - DNA, 12 bp, Homo sapiens
gggctctgcccc

SEQ ID NO: 2822259 - DNA, 19 bp, Homo sapiens
gggctctgccccagctctg

SEQ ID NO: 2822260 - DNA, 21 bp, Homo sapiens
gggctctgccccagctctggc

SEQ ID NO: 2822261 - DNA, 15 bp, Homo sapiens
gggctgagccctggc

SEQ ID NO: 2822262 - DNA, 21 bp, Homo sapiens
gggctgcccctgtaggttgct

SEQ ID NO: 2822263 - DNA, 13 bp, Homo sapiens
gggctgggaagtc

SEQ ID NO: 2822264 - DNA, 15 bp, Homo sapiens
gggcttcagtggcag

SEQ ID NO: 2822265 - DNA, 18 bp, Homo sapiens
gggcttcagtggcagctg

SEQ ID NO: 2822266 - DNA, 13 bp, Homo sapiens
gggcttctcctga

SEQ ID NO: 2822267 - DNA, 14 bp, Homo sapiens
gggctttctggaga

SEQ ID NO: 2822268 - DNA, 15 bp, Homo sapiens
gggctttctggagag

SEQ ID NO: 2822269 - DNA, 13 bp, Homo sapiens
ggggaactggcca

SEQ ID NO: 2822270 - DNA, 16 bp, Homo sapiens
ggggaagctggcagca

SEQ ID NO: 2822271 - DNA, 17 bp, Homo sapiens
gtagggtaaggtgcctt

SEQ ID NO: 2822272 - DNA, 12 bp, Homo sapiens
gtagtcccagcc

SEQ ID NO: 2822273 - DNA, 22 bp, Homo sapiens
gtagttaggaaataaaaccttt

SEQ ID NO: 2822274 - DNA, 17 bp, Homo sapiens
gtagttccctgaaaacc

SEQ ID NO: 2822275 - DNA, 23 bp, Homo sapiens
gtagttccctgaaaacccagaga

SEQ ID NO: 2822276 - DNA, 14 bp, Homo sapiens
gtataaaagacaaa

SEQ ID NO: 2822277 - DNA, 14 bp, Homo sapiens
gtataaagtcagga

SEQ ID NO: 2822278 - DNA, 20 bp, Homo sapiens
gtataacacaatatgaatac

SEQ ID NO: 2822279 - DNA, 20 bp, Homo sapiens
gtataaccccaccttgccaa

SEQ ID NO: 2822280 - DNA, 12 bp, Homo sapiens
gtataatatttt

SEQ ID NO: 2822281 - DNA, 15 bp, Homo sapiens
gtataatatttttaa

SEQ ID NO: 2822282 - DNA, 23 bp, Homo sapiens
gtataatggttgactgggtttct

SEQ ID NO: 2822283 - DNA, 18 bp, Homo sapiens
gtatatagtatatttata

SEQ ID NO: 2822284 - DNA, 14 bp, Homo sapiens
gtatatatagaatc

SEQ ID NO: 2822285 - DNA, 15 bp, Homo sapiens
gtatatatatatagt

SEQ ID NO: 2822286 - DNA, 23 bp, Homo sapiens
gtatatatatatagtaactactt

SEQ ID NO: 2822287 - DNA, 23 bp, Homo sapiens
gtatatatatatatatgtacagt

SEQ ID NO: 2822288 - DNA, 12 bp, Homo sapiens
gtatatatgtac

SEQ ID NO: 2822289 - DNA, 18 bp, Homo sapiens
gtatatctggacaagcca

SEQ ID NO: 2822290 - DNA, 17 bp, Homo sapiens
gtatatgtatatctata

SEQ ID NO: 2822291 - DNA, 14 bp, Homo sapiens
gtatattagtttga

SEQ ID NO: 2822292 - DNA, 21 bp, Homo sapiens
gtatattatggtgtaatgcac

SEQ ID NO: 2822293 - DNA, 23 bp, Homo sapiens
gtatattatgtatttatattttg

SEQ ID NO: 2822294 - DNA, 15 bp, Homo sapiens
gtatattccaccatt

SEQ ID NO: 2822295 - DNA, 14 bp, Homo sapiens
gtatatttatactc

SEQ ID NO: 2822296 - DNA, 15 bp, Homo sapiens
gtatatttatactct

SEQ ID NO: 2822297 - DNA, 22 bp, Homo sapiens
gtatatttatagtcacaagagc

SEQ ID NO: 2822298 - DNA, 21 bp, Homo sapiens
gtatcagagttgcttttctaa

SEQ ID NO: 2822299 - DNA, 22 bp, Homo sapiens
gtatcagagttgcttttctaat

SEQ ID NO: 2822300 - DNA, 16 bp, Homo sapiens
gtatcaggtgctgcca

SEQ ID NO: 2822301 - DNA, 18 bp, Homo sapiens
gtatcaggtgctgccatc

SEQ ID NO: 2822302 - DNA, 13 bp, Homo sapiens
gtatcatcagtgt

SEQ ID NO: 2822303 - DNA, 19 bp, Homo sapiens
gtatcccaactcctataat

SEQ ID NO: 2822304 - DNA, 21 bp, Homo sapiens
gtatcccatgagcctcagcat

SEQ ID NO: 2822305 - DNA, 13 bp, Homo sapiens
gtatctccaggat

SEQ ID NO: 2822306 - DNA, 15 bp, Homo sapiens
gtatcttatttatat

SEQ ID NO: 2822307 - DNA, 20 bp, Homo sapiens
gtatgaacttgaggacacat

SEQ ID NO: 2822308 - DNA, 12 bp, Homo sapiens
gtatgagctgag

SEQ ID NO: 2822309 - DNA, 21 bp, Homo sapiens
gtatgatcacggctcactgca

SEQ ID NO: 2822310 - DNA, 17 bp, Homo sapiens
gtatgcaagaagaatat

SEQ ID NO: 2822311 - DNA, 14 bp, Homo sapiens
gtctgtacacgtgt

SEQ ID NO: 2822312 - DNA, 19 bp, Homo sapiens
gtctgtacacgtgtcctgt

SEQ ID NO: 2822313 - DNA, 20 bp, Homo sapiens
gtctgtttcaatgacctgta

SEQ ID NO: 2822314 - DNA, 20 bp, Homo sapiens
gtcttagaagtggaccagga

SEQ ID NO: 2822315 - DNA, 14 bp, Homo sapiens
gtcttatttcctca

SEQ ID NO: 2822316 - DNA, 23 bp, Homo sapiens
gtcttcagcctagccgacctcag

SEQ ID NO: 2822317 - DNA, 20 bp, Homo sapiens
gtcttcttacttggaactga

SEQ ID NO: 2822318 - DNA, 16 bp, Homo sapiens
gtcttgaactcctggc

SEQ ID NO: 2822319 - DNA, 13 bp, Homo sapiens
gtcttgagaaaaa

SEQ ID NO: 2822320 - DNA, 16 bp, Homo sapiens
gtcttgcaatggcagc

SEQ ID NO: 2822321 - DNA, 21 bp, Homo sapiens
gtcttgcaatggcagccttgg

SEQ ID NO: 2822322 - DNA, 23 bp, Homo sapiens
gtcttgcaatggcagccttggca

SEQ ID NO: 2822323 - DNA, 18 bp, Homo sapiens
gtcttgcctgccagggcc

SEQ ID NO: 2822324 - DNA, 22 bp, Homo sapiens
gtcttggccgactcagggacct

SEQ ID NO: 2822325 - DNA, 16 bp, Homo sapiens
gtctttcagcattcag

SEQ ID NO: 2822326 - DNA, 14 bp, Homo sapiens
gtctttctccaaag

SEQ ID NO: 2822327 - DNA, 15 bp, Homo sapiens
gtctttgaataaagt

SEQ ID NO: 2822328 - DNA, 20 bp, Homo sapiens
gtctttgtaatgtcaccacc

SEQ ID NO: 2822329 - DNA, 16 bp, Homo sapiens
gtgaaacttcctaagt

SEQ ID NO: 2822330 - DNA, 22 bp, Homo sapiens
gtgaaagaattatttttgtgtt

SEQ ID NO: 2822331 - DNA, 20 bp, Homo sapiens
gtgaaagcatcacttgggat

SEQ ID NO: 2822332 - DNA, 23 bp, Homo sapiens
gtgaaagtatgtgatatctgaac

SEQ ID NO: 2822333 - DNA, 19 bp, Homo sapiens
gtgaaagtgtaaaatagaa

SEQ ID NO: 2822334 - DNA, 17 bp, Homo sapiens
gtgaaataccagtgtgg

SEQ ID NO: 2822335 - DNA, 18 bp, Homo sapiens
gtgaaatcagaagtgcaa

SEQ ID NO: 2822336 - DNA, 21 bp, Homo sapiens
gtgaacaactatttataaact

SEQ ID NO: 2822337 - DNA, 19 bp, Homo sapiens
gtgaacaccaacttttatt

SEQ ID NO: 2822338 - DNA, 19 bp, Homo sapiens
gtgaaccaccacacccagc

SEQ ID NO: 2822339 - DNA, 22 bp, Homo sapiens
gtgaaccaccacacccagccca

SEQ ID NO: 2822340 - DNA, 14 bp, Homo sapiens
gtgaacgatttaga

SEQ ID NO: 2822341 - DNA, 18 bp, Homo sapiens
gtgaactgcgtgccagtg

SEQ ID NO: 2822342 - DNA, 18 bp, Homo sapiens
gtgaacttcctttgactt

SEQ ID NO: 2822343 - DNA, 23 bp, Homo sapiens
gttacctttcccatgctgaatta

SEQ ID NO: 2822344 - DNA, 13 bp, Homo sapiens
gttactcagccct

SEQ ID NO: 2822345 - DNA, 15 bp, Homo sapiens
gttactcagccctgg

SEQ ID NO: 2822346 - DNA, 14 bp, Homo sapiens
gttactctccaacc

SEQ ID NO: 2822347 - DNA, 18 bp, Homo sapiens
gttactctccaacctgga

SEQ ID NO: 2822348 - DNA, 16 bp, Homo sapiens
gttacttcactttaat

SEQ ID NO: 2822349 - DNA, 20 bp, Homo sapiens
gttagctcaggaggcttgga

SEQ ID NO: 2822350 - DNA, 17 bp, Homo sapiens
gttaggaaataaaacct

SEQ ID NO: 2822351 - DNA, 22 bp, Homo sapiens
gttaggaaataaaacctttcaa

SEQ ID NO: 2822352 - DNA, 13 bp, Homo sapiens
gttagggaatggc

SEQ ID NO: 2822353 - DNA, 11 bp, Homo sapiens
gttagggaggg

SEQ ID NO: 2822354 - DNA, 13 bp, Homo sapiens
gttagggaggggt

SEQ ID NO: 2822355 - DNA, 16 bp, Homo sapiens
gttaggttataagaaa

SEQ ID NO: 2822356 - DNA, 17 bp, Homo sapiens
gttagtatctaacatgt

SEQ ID NO: 2822357 - DNA, 18 bp, Homo sapiens
gttagtgtgttgtctgtg

SEQ ID NO: 2822358 - DNA, 19 bp, Homo sapiens
gttagtgtgttgtctgtgc

SEQ ID NO: 2822359 - DNA, 14 bp, Homo sapiens
gttagtttttactt

SEQ ID NO: 2822360 - DNA, 19 bp, Homo sapiens
gttatagtatatctggaca

SEQ ID NO: 2822361 - DNA, 21 bp, Homo sapiens
gttatcaacacgtttgtatca

SEQ ID NO: 2822362 - DNA, 15 bp, Homo sapiens
gttatcagttaacat

SEQ ID NO: 2822363 - DNA, 17 bp, Homo sapiens
gttatcagttaacatta

SEQ ID NO: 2822364 - DNA, 13 bp, Homo sapiens
gttatcctgctag

SEQ ID NO: 2822365 - DNA, 18 bp, Homo sapiens
gttatctaagttaattta

SEQ ID NO: 2822366 - DNA, 21 bp, Homo sapiens
gttatctaagttaatttaaag

SEQ ID NO: 2822367 - DNA, 13 bp, Homo sapiens
gttattgtgttgc

SEQ ID NO: 2822368 - DNA, 17 bp, Homo sapiens
gttatttgtaatagatg

SEQ ID NO: 2822369 - DNA, 18 bp, Homo sapiens
gttattttaggagacagt

SEQ ID NO: 2822370 - DNA, 23 bp, Homo sapiens
gttattttctttgaaattgttta

SEQ ID NO: 2822371 - DNA, 16 bp, Homo sapiens
gttattttttaattat

SEQ ID NO: 2822372 - DNA, 20 bp, Homo sapiens
gttcaagcgattcttctgct

SEQ ID NO: 2822373 - DNA, 13 bp, Homo sapiens
gttcaccttatgt

SEQ ID NO: 2822374 - DNA, 16 bp, Homo sapiens
gttcaccttatgtatt

SEQ ID NO: 2822375 - DNA, 21 bp, Homo sapiens
gttcaccttatgtattatttt

SEQ ID NO: 2822376 - DNA, 16 bp, Homo sapiens
gttcacgcaacttgaa

SEQ ID NO: 2822377 - DNA, 17 bp, Homo sapiens
gttcagcccctcctctg

SEQ ID NO: 2822378 - DNA, 20 bp, Homo sapiens
gttcagcccctcctctgcca

SEQ ID NO: 2822379 - DNA, 22 bp, Homo sapiens
gttcagcccctcctctgccacc

SEQ ID NO: 2822380 - DNA, 13 bp, Homo sapiens
gttcagctccagc

SEQ ID NO: 2822381 - DNA, 16 bp, Homo sapiens
gttcagctccagctca

SEQ ID NO: 2822382 - DNA, 17 bp, Homo sapiens
gttcagctccagctcac

SEQ ID NO: 2822383 - DNA, 20 bp, Homo sapiens
gttcagggttggcccctgcc

SEQ ID NO: 2822384 - DNA, 17 bp, Homo sapiens
gttcaggtaacaggcag

SEQ ID NO: 2822385 - DNA, 20 bp, Homo sapiens
gttcatagggtctcttcagg

SEQ ID NO: 2822386 - DNA, 20 bp, Homo sapiens
gttcatctgagcaagagctg

SEQ ID NO: 2822387 - DNA, 12 bp, Homo sapiens
gttcatgagaat

SEQ ID NO: 2822388 - DNA, 14 bp, Homo sapiens
gttcatgagaatct

SEQ ID NO: 2822389 - DNA, 13 bp, Homo sapiens
gttcatttcctca

SEQ ID NO: 2822390 - DNA, 19 bp, Homo sapiens
gttccacttctctagagaa

SEQ ID NO: 2822391 - DNA, 13 bp, Homo sapiens
gttccatgttaaa

SEQ ID NO: 2822392 - DNA, 14 bp, Homo sapiens
gttcccaataaaag

SEQ ID NO: 2822393 - DNA, 15 bp, Homo sapiens
gttcccaataaaagt

SEQ ID NO: 2822394 - DNA, 14 bp, Homo sapiens
gttcccatgttaaa

SEQ ID NO: 2822395 - DNA, 22 bp, Homo sapiens
gttccctctgagaattccaagg

SEQ ID NO: 2822396 - DNA, 20 bp, Homo sapiens
gttccctgaaaacccagaga

SEQ ID NO: 2822397 - DNA, 21 bp, Homo sapiens
gttccctgaaaacccagagag

SEQ ID NO: 2822398 - DNA, 19 bp, Homo sapiens
gttcctactttagccactg

SEQ ID NO: 2822399 - DNA, 18 bp, Homo sapiens
gttcctcaccaataactt

SEQ ID NO: 2822400 - DNA, 12 bp, Homo sapiens
gttcctgcatgc

SEQ ID NO: 2822401 - DNA, 14 bp, Homo sapiens
gttctaatattttt

SEQ ID NO: 2822402 - DNA, 14 bp, Homo sapiens
gttctagtctcctt

SEQ ID NO: 2822403 - DNA, 17 bp, Homo sapiens
gttctcaatgcttttct

SEQ ID NO: 2822404 - DNA, 15 bp, Homo sapiens
gttctgctgcccctg

SEQ ID NO: 2822405 - DNA, 17 bp, Homo sapiens
gttctgctgcccctgca

SEQ ID NO: 2822406 - DNA, 11 bp, Homo sapiens
gtcagccaggg

SEQ ID NO: 2822407 - DNA, 20 bp, Homo sapiens
gtcagccgagccgggcctgg

SEQ ID NO: 2822408 - DNA, 21 bp, Homo sapiens
gtcagccgagccgggcctggg

SEQ ID NO: 2822409 - DNA, 15 bp, Homo sapiens
gtcaggaacagaagg

SEQ ID NO: 2822410 - DNA, 21 bp, Homo sapiens
gtcaggcccttattttcaaga

SEQ ID NO: 2822411 - DNA, 19 bp, Homo sapiens
gtcaggcggggtgctgtgg

SEQ ID NO: 2822412 - DNA, 21 bp, Homo sapiens
gtcaggcggggtgctgtggtg

SEQ ID NO: 2822413 - DNA, 17 bp, Homo sapiens
gtcaggctccattagga

SEQ ID NO: 2822414 - DNA, 22 bp, Homo sapiens
gtcaggtggggcagcttgaggg

SEQ ID NO: 2822415 - DNA, 19 bp, Homo sapiens
gtcagtcatgatggcacca

SEQ ID NO: 2822416 - DNA, 22 bp, Homo sapiens
gtcagtcatgatggcaccactg

SEQ ID NO: 2822417 - DNA, 22 bp, Homo sapiens
gtcagtgggaacgtgactgccc

SEQ ID NO: 2822418 - DNA, 17 bp, Homo sapiens
gtcagttggagaaaatg

SEQ ID NO: 2822419 - DNA, 15 bp, Homo sapiens
gtcatatattcatgt

SEQ ID NO: 2822420 - DNA, 17 bp, Homo sapiens
gtcatatattcatgtaa

SEQ ID NO: 2822421 - DNA, 22 bp, Homo sapiens
gtcatatattcatgtaataaat

SEQ ID NO: 2822422 - DNA, 16 bp, Homo sapiens
gtcatctggtagattt

SEQ ID NO: 2822423 - DNA, 20 bp, Homo sapiens
gtcatgatctccctgccgcc

SEQ ID NO: 2822424 - DNA, 17 bp, Homo sapiens
gtcatgcttcagttgta

SEQ ID NO: 2822425 - DNA, 16 bp, Homo sapiens
gtcatgtaccatcaat

SEQ ID NO: 2822426 - DNA, 17 bp, Homo sapiens
gtcatgtaccatcaata

SEQ ID NO: 2822427 - DNA, 16 bp, Homo sapiens
gtcattactgcctttg

SEQ ID NO: 2822428 - DNA, 15 bp, Homo sapiens
gtcatttcatttcct

SEQ ID NO: 2822429 - DNA, 17 bp, Homo sapiens
gtcatttgagcagggct

SEQ ID NO: 2822430 - DNA, 21 bp, Homo sapiens
gtcatttgctgagcatgtact

SEQ ID NO: 2822431 - DNA, 21 bp, Homo sapiens
gtcattttaactttatcacat

SEQ ID NO: 2822432 - DNA, 20 bp, Homo sapiens
gtccaacaactccaggaaaa

SEQ ID NO: 2822433 - DNA, 14 bp, Homo sapiens
gtccaacctaaccc

SEQ ID NO: 2822434 - DNA, 17 bp, Homo sapiens
gtccaacctaacccctt

SEQ ID NO: 2822435 - DNA, 20 bp, Homo sapiens
gtccaacctaacccctttcc

SEQ ID NO: 2822436 - DNA, 21 bp, Homo sapiens
gtccaacctaacccctttcct

SEQ ID NO: 2822437 - DNA, 11 bp, Homo sapiens
gtccacccagc

SEQ ID NO: 2822438 - DNA, 12 bp, Homo sapiens
gtccacccagga

SEQ ID NO: 2822439 - DNA, 21 bp, Homo sapiens
gtccagaagaatattcaggac

SEQ ID NO: 2822440 - DNA, 22 bp, Homo sapiens
gtccagaagaatattcaggact

SEQ ID NO: 2822441 - DNA, 22 bp, Homo sapiens
gtccagacgtcaaccaggaaca

SEQ ID NO: 2822442 - DNA, 15 bp, Homo sapiens
gtccagccagctcct

SEQ ID NO: 2822443 - DNA, 13 bp, Homo sapiens
gtccagctcttgg

SEQ ID NO: 2822444 - DNA, 15 bp, Homo sapiens
gtgatggggtgggca

SEQ ID NO: 2822445 - DNA, 18 bp, Homo sapiens
gtgatggggtgggcaggg

SEQ ID NO: 2822446 - DNA, 22 bp, Homo sapiens
gtgatggggtgggcagggctgg

SEQ ID NO: 2822447 - DNA, 19 bp, Homo sapiens
gtgatggttgccaggacga

SEQ ID NO: 2822448 - DNA, 22 bp, Homo sapiens
gtgattagagggaggagaatga

SEQ ID NO: 2822449 - DNA, 18 bp, Homo sapiens
gtgattctcctgcctcag

SEQ ID NO: 2822450 - DNA, 20 bp, Homo sapiens
gtgattctcctgcctcagcc

SEQ ID NO: 2822451 - DNA, 13 bp, Homo sapiens
gtgattttgtaca

SEQ ID NO: 2822452 - DNA, 14 bp, Homo sapiens
gtgattttgtacag

SEQ ID NO: 2822453 - DNA, 20 bp, Homo sapiens
gtgattttgtacagaatttt

SEQ ID NO: 2822454 - DNA, 22 bp, Homo sapiens
gtgcaaagttccctacttcctg

SEQ ID NO: 2822455 - DNA, 15 bp, Homo sapiens
gtgcacaaatattta

SEQ ID NO: 2822456 - DNA, 14 bp, Homo sapiens
gtgcacaggagggg

SEQ ID NO: 2822457 - DNA, 18 bp, Homo sapiens
gtgcacgtacacacacat

SEQ ID NO: 2822458 - DNA, 18 bp, Homo sapiens
gtgcactggccccaccct

SEQ ID NO: 2822459 - DNA, 17 bp, Homo sapiens
gtgcagaggtgagcaga

SEQ ID NO: 2822460 - DNA, 20 bp, Homo sapiens
gtgcagaggtgagcagagga

SEQ ID NO: 2822461 - DNA, 23 bp, Homo sapiens
gtgcagatgagcagtcacactgt

SEQ ID NO: 2822462 - DNA, 21 bp, Homo sapiens
gtgcaggagtggccggggaag

SEQ ID NO: 2822463 - DNA, 15 bp, Homo sapiens
gtgcagttgacagca

SEQ ID NO: 2822464 - DNA, 20 bp, Homo sapiens
gtgcagttgacagcaggtgg

SEQ ID NO: 2822465 - DNA, 16 bp, Homo sapiens
gtgcatgctctctgca

SEQ ID NO: 2822466 - DNA, 21 bp, Homo sapiens
gtgcatgctctctgcagccag

SEQ ID NO: 2822467 - DNA, 23 bp, Homo sapiens
gtgcatgtatgtcttggacactg

SEQ ID NO: 2822468 - DNA, 16 bp, Homo sapiens
gtgcatgttgccatga

SEQ ID NO: 2822469 - DNA, 17 bp, Homo sapiens
gtgcatttatgagctct

SEQ ID NO: 2822470 - DNA, 12 bp, Homo sapiens
gtgccacagaga

SEQ ID NO: 2822471 - DNA, 17 bp, Homo sapiens
gtgccaggcccggggct

SEQ ID NO: 2822472 - DNA, 19 bp, Homo sapiens
gtgccatgtcaaacaaata

SEQ ID NO: 2822473 - DNA, 20 bp, Homo sapiens
gtgcccacaggatcagtctg

SEQ ID NO: 2822474 - DNA, 14 bp, Homo sapiens
gtgggagagcccag

SEQ ID NO: 2822475 - DNA, 11 bp, Homo sapiens
gtgggagcctc

SEQ ID NO: 2822476 - DNA, 12 bp, Homo sapiens
gtgggagcctcg

SEQ ID NO: 2822477 - DNA, 15 bp, Homo sapiens
gtgggcagggctggg

SEQ ID NO: 2822478 - DNA, 20 bp, Homo sapiens
gtgggcctcctctgtccagg

SEQ ID NO: 2822479 - DNA, 15 bp, Homo sapiens
gtgggctgagccctg

SEQ ID NO: 2822480 - DNA, 14 bp, Homo sapiens
gtggggctgctcct

SEQ ID NO: 2822481 - DNA, 16 bp, Homo sapiens
gtgggtggtggatctg

SEQ ID NO: 2822482 - DNA, 13 bp, Homo sapiens
gtggtaccagctc

SEQ ID NO: 2822483 - DNA, 14 bp, Homo sapiens
gtggtaccagctca

SEQ ID NO: 2822484 - DNA, 19 bp, Homo sapiens
gtggtatgatcacggctca

SEQ ID NO: 2822485 - DNA, 16 bp, Homo sapiens
gtggtcattaagcatt

SEQ ID NO: 2822486 - DNA, 11 bp, Homo sapiens
gtggtctttga

SEQ ID NO: 2822487 - DNA, 12 bp, Homo sapiens
gtggtctttgaa

SEQ ID NO: 2822488 - DNA, 13 bp, Homo sapiens
gtggtctttgaat

SEQ ID NO: 2822489 - DNA, 16 bp, Homo sapiens
gtggtctttgaataaa

SEQ ID NO: 2822490 - DNA, 17 bp, Homo sapiens
gtggtctttgaataaag

SEQ ID NO: 2822491 - DNA, 23 bp, Homo sapiens
gtggttaatgccatggacagaag

SEQ ID NO: 2822492 - DNA, 12 bp, Homo sapiens
gtgtacagtgtg

SEQ ID NO: 2822493 - DNA, 16 bp, Homo sapiens
gtgtacccactcctca

SEQ ID NO: 2822494 - DNA, 22 bp, Homo sapiens
gtgtaccgcgtctaccctggga

SEQ ID NO: 2822495 - DNA, 14 bp, Homo sapiens
gtgtactgctttca

SEQ ID NO: 2822496 - DNA, 21 bp, Homo sapiens
gtgtagctgtgacctgctgag

SEQ ID NO: 2822497 - DNA, 14 bp, Homo sapiens
gtgtagctttgctc

SEQ ID NO: 2822498 - DNA, 12 bp, Homo sapiens
gtgtatatatat

SEQ ID NO: 2822499 - DNA, 19 bp, Homo sapiens
gtgtatgctactacaaaaa

SEQ ID NO: 2822500 - DNA, 16 bp, Homo sapiens
gtgtatgggtgtgtgt

SEQ ID NO: 2822501 - DNA, 20 bp, Homo sapiens
gtgtcaagagggtctgagga

SEQ ID NO: 2822502 - DNA, 18 bp, Homo sapiens
gtgtcacactgagctggg

SEQ ID NO: 2822503 - DNA, 22 bp, Homo sapiens
gtgtcacctgaagactcattct

SEQ ID NO: 2822504 - DNA, 20 bp, Homo sapiens
gtgtcaggtggggcagcttg

SEQ ID NO: 2822505 - DNA, 20 bp, Homo sapiens
gtgtcccaaaaagaaaggag

SEQ ID NO: 2822506 - DNA, 16 bp, Homo sapiens
gtgtccctgcacttgc

SEQ ID NO: 2822507 - DNA, 21 bp, Homo sapiens
gtgtcctgtagttgcgtggac

SEQ ID NO: 2822508 - DNA, 17 bp, Homo sapiens
gtgtccttgcacctgca

SEQ ID NO: 2822509 - DNA, 18 bp, Homo sapiens
gtgtctggaaaagcactt

SEQ ID NO: 2822510 - DNA, 16 bp, Homo sapiens
gtgtctgtacacgtgt

SEQ ID NO: 2822511 - DNA, 22 bp, Homo sapiens
gtgtctgtacacgtgtcctgta

SEQ ID NO: 2822512 - DNA, 17 bp, Homo sapiens
gtgtcttgcaatggcag

SEQ ID NO: 2822513 - DNA, 21 bp, Homo sapiens
gtgtcttgcaatggcagcctt

SEQ ID NO: 2822514 - DNA, 13 bp, Homo sapiens
gtgtctttatcag

SEQ ID NO: 2822515 - DNA, 16 bp, Homo sapiens
gtgtcttttataaaaa

SEQ ID NO: 2822516 - DNA, 18 bp, Homo sapiens
gtgtgaaggtcttgcctg

SEQ ID NO: 2822517 - DNA, 19 bp, Homo sapiens
gtgtgaaggtcttgcctga

SEQ ID NO: 2822518 - DNA, 14 bp, Homo sapiens
gtgtgaataaagtt

SEQ ID NO: 2822519 - DNA, 23 bp, Homo sapiens
gtgtgactctcttggattattta

SEQ ID NO: 2822520 - DNA, 19 bp, Homo sapiens
gtgtgagcatctctgtgta

SEQ ID NO: 2822521 - DNA, 13 bp, Homo sapiens
gtgtgagtcacca

SEQ ID NO: 2822522 - DNA, 16 bp, Homo sapiens
gtgtgattgaatctga

SEQ ID NO: 2822523 - DNA, 20 bp, Homo sapiens
gtgtgcacaaatatttattt

SEQ ID NO: 2822524 - DNA, 13 bp, Homo sapiens
gtgtgcagactgt

SEQ ID NO: 2822525 - DNA, 13 bp, Homo sapiens
gtgtgcctgcagc

SEQ ID NO: 2822526 - DNA, 15 bp, Homo sapiens
gtgtgctctgatcat

SEQ ID NO: 2822527 - DNA, 22 bp, Homo sapiens
gtgtgctctgatcatccactgt

SEQ ID NO: 2822528 - DNA, 13 bp, Homo sapiens
gtgtggacaggac

SEQ ID NO: 2822529 - DNA, 15 bp, Homo sapiens
gtgtggctgtattca

SEQ ID NO: 2822530 - DNA, 16 bp, Homo sapiens
gtgtggctgtattcag

SEQ ID NO: 2822531 - DNA, 13 bp, Homo sapiens
gtgtggctgtctg

SEQ ID NO: 2822532 - DNA, 21 bp, Homo sapiens
gtgtgtcacactgagctgggc

SEQ ID NO: 2822533 - DNA, 15 bp, Homo sapiens
gtgtgtctgctcagt

SEQ ID NO: 2822534 - DNA, 16 bp, Homo sapiens
gtgtgtctgctcagta

SEQ ID NO: 2822535 - DNA, 15 bp, Homo sapiens
gtgtgtctgttcact

SEQ ID NO: 2822536 - DNA, 20 bp, Homo sapiens
gtctcactgttgcccaggct

SEQ ID NO: 2822537 - DNA, 12 bp, Homo sapiens
gtctcagcttca

SEQ ID NO: 2822538 - DNA, 16 bp, Homo sapiens
gtctcaggtccctgca

SEQ ID NO: 2822539 - DNA, 21 bp, Homo sapiens
gtctccagtatccactttgca

SEQ ID NO: 2822540 - DNA, 15 bp, Homo sapiens
gtctccctaaaataa

SEQ ID NO: 2822541 - DNA, 19 bp, Homo sapiens
gtctccctaaaataaaaac

SEQ ID NO: 2822542 - DNA, 17 bp, Homo sapiens
gtctccctccagctgga

SEQ ID NO: 2822543 - DNA, 15 bp, Homo sapiens
gtctccctctcctgc

SEQ ID NO: 2822544 - DNA, 19 bp, Homo sapiens
gtctccctctcctgcctac

SEQ ID NO: 2822545 - DNA, 13 bp, Homo sapiens
gtctcctctctga

SEQ ID NO: 2822546 - DNA, 16 bp, Homo sapiens
gtctcctctctgagac

SEQ ID NO: 2822547 - DNA, 14 bp, Homo sapiens
gtctcctcttaaaa

SEQ ID NO: 2822548 - DNA, 21 bp, Homo sapiens
gtctcctgtgcccacatccca

SEQ ID NO: 2822549 - DNA, 22 bp, Homo sapiens
gtctcctgtgcccacatcccag

SEQ ID NO: 2822550 - DNA, 18 bp, Homo sapiens
gtctcctttgcactgagg

SEQ ID NO: 2822551 - DNA, 23 bp, Homo sapiens
gtctcctttgcactgagggccac

SEQ ID NO: 2822552 - DNA, 15 bp, Homo sapiens
gtctcgagcgccctg

SEQ ID NO: 2822553 - DNA, 20 bp, Homo sapiens
gtctcgagcgccctgcagac

SEQ ID NO: 2822554 - DNA, 23 bp, Homo sapiens
gtctcgagcgccctgcagaccct

SEQ ID NO: 2822555 - DNA, 20 bp, Homo sapiens
gtctctgactcttgcctttc

SEQ ID NO: 2822556 - DNA, 15 bp, Homo sapiens
gtctctgctcttgcc

SEQ ID NO: 2822557 - DNA, 16 bp, Homo sapiens
gtctctgctcttgcct

SEQ ID NO: 2822558 - DNA, 17 bp, Homo sapiens
gtctctgctcttgcctg

SEQ ID NO: 2822559 - DNA, 18 bp, Homo sapiens
gtctctgctcttgcctgc

SEQ ID NO: 2822560 - DNA, 22 bp, Homo sapiens
gtctctgctgcatttgtgtcat

SEQ ID NO: 2822561 - DNA, 18 bp, Homo sapiens
gtctctttaatgtcacag

SEQ ID NO: 2822562 - DNA, 19 bp, Homo sapiens
gtctctttaatgtcacagg

SEQ ID NO: 2822563 - DNA, 20 bp, Homo sapiens
gtctctttaatgtcacaggc

SEQ ID NO: 2822564 - DNA, 11 bp, Homo sapiens
gtctgaaatgg

SEQ ID NO: 2822565 - DNA, 13 bp, Homo sapiens
gtctgacaggcaa

SEQ ID NO: 2822566 - DNA, 15 bp, Homo sapiens
gtctgacaggcaatg

SEQ ID NO: 2822567 - DNA, 20 bp, Homo sapiens
gtctgacaggcaatgctggc

SEQ ID NO: 2822568 - DNA, 15 bp, Homo sapiens
gtctgacccactgct

SEQ ID NO: 2822569 - DNA, 22 bp, Homo sapiens
gtctgagcaccccctcattccc

SEQ ID NO: 2822570 - DNA, 18 bp, Homo sapiens
gtctgaggaatccagacc

SEQ ID NO: 2822571 - DNA, 21 bp, Homo sapiens
gtctgaggaatccagacccgg

SEQ ID NO: 2822572 - DNA, 16 bp, Homo sapiens
gtctgaggtcctgagc

SEQ ID NO: 2822573 - DNA, 21 bp, Homo sapiens
gtctgaggtcctgagcactgc

SEQ ID NO: 2822574 - DNA, 13 bp, Homo sapiens
gtctgagtgggcg

SEQ ID NO: 2822575 - DNA, 18 bp, Homo sapiens
gtctgattcccaagctct

SEQ ID NO: 2822576 - DNA, 19 bp, Homo sapiens
gtctgattcccaagctctg

SEQ ID NO: 2822577 - DNA, 16 bp, Homo sapiens
gtctgcaatgtccctt

SEQ ID NO: 2822578 - DNA, 19 bp, Homo sapiens
gtctgcagcccggcgccac

SEQ ID NO: 2822579 - DNA, 17 bp, Homo sapiens
gtctgccagccagcagc

SEQ ID NO: 2822580 - DNA, 18 bp, Homo sapiens
gtctgccagccagcagcc

SEQ ID NO: 2822581 - DNA, 20 bp, Homo sapiens
gtctgcccccgtcttctctc

SEQ ID NO: 2822582 - DNA, 21 bp, Homo sapiens
gtctgcccccgtcttctctcc

SEQ ID NO: 2822583 - DNA, 21 bp, Homo sapiens
gtctgctcaggaattgaagat

SEQ ID NO: 2822584 - DNA, 14 bp, Homo sapiens
gtctggagaagcag

SEQ ID NO: 2822585 - DNA, 19 bp, Homo sapiens
gtctggagaagcagtgagc

SEQ ID NO: 2822586 - DNA, 16 bp, Homo sapiens
gtctggggttcagccc

SEQ ID NO: 2822587 - DNA, 18 bp, Homo sapiens
gtctggggttcagcccct

SEQ ID NO: 2822588 - DNA, 13 bp, Homo sapiens
gtctgggtgtctc

SEQ ID NO: 2822589 - DNA, 13 bp, Homo sapiens
gtctggtttctag

SEQ ID NO: 2822590 - DNA, 14 bp, Homo sapiens
gtctggtttctaga

SEQ ID NO: 2822591 - DNA, 14 bp, Homo sapiens
gtctgtaagagaat

SEQ ID NO: 2822592 - DNA, 16 bp, Homo sapiens
ggcaaccccagttctg

SEQ ID NO: 2822593 - DNA, 18 bp, Homo sapiens
ggcaaccccagttctgct

SEQ ID NO: 2822594 - DNA, 20 bp, Homo sapiens
ggcaaccccagttctgctcc

SEQ ID NO: 2822595 - DNA, 21 bp, Homo sapiens
ggcaaccccagttctgctcct

SEQ ID NO: 2822596 - DNA, 22 bp, Homo sapiens
ggcaaccccagttctgctcctc

SEQ ID NO: 2822597 - DNA, 15 bp, Homo sapiens
ggcaaccttgtctct

SEQ ID NO: 2822598 - DNA, 19 bp, Homo sapiens
ggcaactgaggcagacagc

SEQ ID NO: 2822599 - DNA, 17 bp, Homo sapiens
ggcaagcacctcctgcc

SEQ ID NO: 2822600 - DNA, 15 bp, Homo sapiens
ggcaaggggtttcca

SEQ ID NO: 2822601 - DNA, 23 bp, Homo sapiens
ggcaagtccctgactctctgtga

SEQ ID NO: 2822602 - DNA, 17 bp, Homo sapiens
ggcaagtgagacaatca

SEQ ID NO: 2822603 - DNA, 13 bp, Homo sapiens
ggcaagtgattga

SEQ ID NO: 2822604 - DNA, 17 bp, Homo sapiens
ggcaataaatgccctct

SEQ ID NO: 2822605 - DNA, 15 bp, Homo sapiens
ggcaatgatggcaat

SEQ ID NO: 2822606 - DNA, 15 bp, Homo sapiens
ggcacaaatgcacct

SEQ ID NO: 2822607 - DNA, 20 bp, Homo sapiens
ggcacaatggctaattccca

SEQ ID NO: 2822608 - DNA, 21 bp, Homo sapiens
ggcacagaaacacaatatttt

SEQ ID NO: 2822609 - DNA, 16 bp, Homo sapiens
ggcacaggtgtaaata

SEQ ID NO: 2822610 - DNA, 14 bp, Homo sapiens
ggcacatggaggag

SEQ ID NO: 2822611 - DNA, 13 bp, Homo sapiens
ggcacccccagcc

SEQ ID NO: 2822612 - DNA, 16 bp, Homo sapiens
ggcacccccagcctgg

SEQ ID NO: 2822613 - DNA, 20 bp, Homo sapiens
ggcacccccagcctgggcct

SEQ ID NO: 2822614 - DNA, 14 bp, Homo sapiens
ggcaccccctgcag

SEQ ID NO: 2822615 - DNA, 19 bp, Homo sapiens
ggcaccccctggagagaag

SEQ ID NO: 2822616 - DNA, 20 bp, Homo sapiens
ggcacccggcccctgctggt

SEQ ID NO: 2822617 - DNA, 22 bp, Homo sapiens
ggcacccggcccctgctggttc

SEQ ID NO: 2822618 - DNA, 12 bp, Homo sapiens
ggcacccttctt

SEQ ID NO: 2822619 - DNA, 22 bp, Homo sapiens
ggcacccttctttcctcttccc

SEQ ID NO: 2822620 - DNA, 13 bp, Homo sapiens
ggcacctgggccc

SEQ ID NO: 2822621 - DNA, 22 bp, Homo sapiens
ggcacctgggccctggggcctg

SEQ ID NO: 2822622 - DNA, 17 bp, Homo sapiens
ggcacgaacccacctgc

SEQ ID NO: 2822623 - DNA, 18 bp, Homo sapiens
ggcactcagaagacactg

SEQ ID NO: 2822624 - DNA, 18 bp, Homo sapiens
ggcagaacagccgctcct

SEQ ID NO: 2822625 - DNA, 13 bp, Homo sapiens
ggcagacagcagc

SEQ ID NO: 2822626 - DNA, 14 bp, Homo sapiens
ggcagacagcagct

SEQ ID NO: 2822627 - DNA, 18 bp, Homo sapiens
ggcagacagcagctcagg

SEQ ID NO: 2822628 - DNA, 14 bp, Homo sapiens
ggcagagaaagaag

SEQ ID NO: 2822629 - DNA, 18 bp, Homo sapiens
ggcagagaaagaagagac

SEQ ID NO: 2822630 - DNA, 18 bp, Homo sapiens
ggcagagaaggcttcctc

SEQ ID NO: 2822631 - DNA, 18 bp, Homo sapiens
ggcagagacaataaaaca

SEQ ID NO: 2822632 - DNA, 19 bp, Homo sapiens
ggcagaggctggaggcagg

SEQ ID NO: 2822633 - DNA, 19 bp, Homo sapiens
ggcagagggcagaggctgg

SEQ ID NO: 2822634 - DNA, 20 bp, Homo sapiens
ggcagagggcagaggctgga

SEQ ID NO: 2822635 - DNA, 19 bp, Homo sapiens
ggcagataatcagcctctt

SEQ ID NO: 2822636 - DNA, 14 bp, Homo sapiens
ggcagatgtaggag

SEQ ID NO: 2822637 - DNA, 20 bp, Homo sapiens
ggcagcaaggcccgagcagc

SEQ ID NO: 2822638 - DNA, 23 bp, Homo sapiens
ggcagcaaggcccgagcagctga

SEQ ID NO: 2822639 - DNA, 11 bp, Homo sapiens
ggcagcagcca

SEQ ID NO: 2822640 - DNA, 17 bp, Homo sapiens
ggcagcagccagccctg

SEQ ID NO: 2822641 - DNA, 16 bp, Homo sapiens
ggcagcagctcagcct

SEQ ID NO: 2822642 - DNA, 17 bp, Homo sapiens
ggcagcatagcaagaca

SEQ ID NO: 2822643 - DNA, 18 bp, Homo sapiens
ggtattttcgtgcatttg

SEQ ID NO: 2822644 - DNA, 15 bp, Homo sapiens
ggtcaacggccctgt

SEQ ID NO: 2822645 - DNA, 16 bp, Homo sapiens
ggtcacaggactctgc

SEQ ID NO: 2822646 - DNA, 22 bp, Homo sapiens
ggtcactcttcctgcaaggact

SEQ ID NO: 2822647 - DNA, 23 bp, Homo sapiens
ggtcagagatgggctgaactgag

SEQ ID NO: 2822648 - DNA, 12 bp, Homo sapiens
ggtcagagcctg

SEQ ID NO: 2822649 - DNA, 16 bp, Homo sapiens
ggtcatagcagtgctt

SEQ ID NO: 2822650 - DNA, 21 bp, Homo sapiens
ggtcatcgattcaaactgctc

SEQ ID NO: 2822651 - DNA, 16 bp, Homo sapiens
ggtccacccagcaaag

SEQ ID NO: 2822652 - DNA, 16 bp, Homo sapiens
ggtccacccaggagcc

SEQ ID NO: 2822653 - DNA, 19 bp, Homo sapiens
ggtccacccaggagccccg

SEQ ID NO: 2822654 - DNA, 23 bp, Homo sapiens
ggtccagctcttggcccctgtgt

SEQ ID NO: 2822655 - DNA, 18 bp, Homo sapiens
ggtccagcttgctcttca

SEQ ID NO: 2822656 - DNA, 22 bp, Homo sapiens
ggtcccaagtagtagtgtcttc

SEQ ID NO: 2822657 - DNA, 19 bp, Homo sapiens
ggtcccacatccctgggcc

SEQ ID NO: 2822658 - DNA, 20 bp, Homo sapiens
ggtcccacatccctgggcct

SEQ ID NO: 2822659 - DNA, 21 bp, Homo sapiens
ggtcccacatccctgggcctg

SEQ ID NO: 2822660 - DNA, 12 bp, Homo sapiens
ggtcccactcag

SEQ ID NO: 2822661 - DNA, 19 bp, Homo sapiens
ggtcccttgagacctcagc

SEQ ID NO: 2822662 - DNA, 17 bp, Homo sapiens
ggtccggtgtccttttc

SEQ ID NO: 2822663 - DNA, 19 bp, Homo sapiens
ggtcctgagcactgccagg

SEQ ID NO: 2822664 - DNA, 20 bp, Homo sapiens
ggtcctgagcactgccagga

SEQ ID NO: 2822665 - DNA, 21 bp, Homo sapiens
ggtcctgagcactgccaggag

SEQ ID NO: 2822666 - DNA, 22 bp, Homo sapiens
ggtcctgagcactgccaggagg

SEQ ID NO: 2822667 - DNA, 12 bp, Homo sapiens
ggtcctggggcc

SEQ ID NO: 2822668 - DNA, 14 bp, Homo sapiens
ggtcctggggcctc

SEQ ID NO: 2822669 - DNA, 19 bp, Homo sapiens
ggtcctggtggggcagctc

SEQ ID NO: 2822670 - DNA, 20 bp, Homo sapiens
ggtccttggtgtgaccctct

SEQ ID NO: 2822671 - DNA, 13 bp, Homo sapiens
ggtcgccacaccc

SEQ ID NO: 2822672 - DNA, 13 bp, Homo sapiens
ggtcgcccaggag

SEQ ID NO: 2822673 - DNA, 20 bp, Homo sapiens
ggtcgtggagagctaggagc

SEQ ID NO: 2822674 - DNA, 11 bp, Homo sapiens
ggtctcagctt

SEQ ID NO: 2822675 - DNA, 18 bp, Homo sapiens
ggtctccctccagctgga

SEQ ID NO: 2822676 - DNA, 22 bp, Homo sapiens
ggtctccctctcctgcctactc

SEQ ID NO: 2822677 - DNA, 12 bp, Homo sapiens
ggtctgaaatgg

SEQ ID NO: 2822678 - DNA, 16 bp, Homo sapiens
ggtctgacccactgct

SEQ ID NO: 2822679 - DNA, 22 bp, Homo sapiens
ggtctgagcaccccctcattcc

SEQ ID NO: 2822680 - DNA, 19 bp, Homo sapiens
ggtctgaggaatccagacc

SEQ ID NO: 2822681 - DNA, 11 bp, Homo sapiens
ggtctgccctg

SEQ ID NO: 2822682 - DNA, 15 bp, Homo sapiens
ggtctgtcccaccag

SEQ ID NO: 2822683 - DNA, 14 bp, Homo sapiens
ggtcttcagccatc

SEQ ID NO: 2822684 - DNA, 20 bp, Homo sapiens
ggtcttggccgactcaggga

SEQ ID NO: 2822685 - DNA, 14 bp, Homo sapiens
ggttgcaaccactg

SEQ ID NO: 2822686 - DNA, 16 bp, Homo sapiens
ggttgcaaggccgctg

SEQ ID NO: 2822687 - DNA, 13 bp, Homo sapiens
ggttgcagggagc

SEQ ID NO: 2822688 - DNA, 14 bp, Homo sapiens
ggttgccaggacga

SEQ ID NO: 2822689 - DNA, 13 bp, Homo sapiens
ggttgtgaggcct

SEQ ID NO: 2822690 - DNA, 19 bp, Homo sapiens
ggttgttaatgttgggatt

SEQ ID NO: 2822691 - DNA, 13 bp, Homo sapiens
ggtttaatgtttt

SEQ ID NO: 2822692 - DNA, 22 bp, Homo sapiens
ggtttacattcatctcattcca

SEQ ID NO: 2822693 - DNA, 13 bp, Homo sapiens
ggtttccaggcca

SEQ ID NO: 2822694 - DNA, 13 bp, Homo sapiens
ggtttctgaaaat

SEQ ID NO: 2822695 - DNA, 21 bp, Homo sapiens
ggtttgaaagtgaataaactt

SEQ ID NO: 2822696 - DNA, 19 bp, Homo sapiens
ggtttgtgtttgagtttta

SEQ ID NO: 2822697 - DNA, 13 bp, Homo sapiens
ggttttgtacaat

SEQ ID NO: 2822698 - DNA, 19 bp, Homo sapiens
ggtttttatatttctcgta

SEQ ID NO: 2822699 - DNA, 17 bp, Homo sapiens
gtaaaaagattatatat

SEQ ID NO: 2822700 - DNA, 11 bp, Homo sapiens
gtaaaatgcag

SEQ ID NO: 2822701 - DNA, 13 bp, Homo sapiens
gtaaacagtgcct

SEQ ID NO: 2822702 - DNA, 14 bp, Homo sapiens
gtaaacagtgcctg

SEQ ID NO: 2822703 - DNA, 17 bp, Homo sapiens
gtaaacagtgcctgctg

SEQ ID NO: 2822704 - DNA, 22 bp, Homo sapiens
gtaaactatcttggtgaatttt

SEQ ID NO: 2822705 - DNA, 18 bp, Homo sapiens
gtaaagaataaatgaatc

SEQ ID NO: 2822706 - DNA, 17 bp, Homo sapiens
gtaaagtgataatttct

SEQ ID NO: 2822707 - DNA, 23 bp, Homo sapiens
gtaaagtgataatttctggaatt

SEQ ID NO: 2822708 - DNA, 14 bp, Homo sapiens
gtaaagtttaaaaa

SEQ ID NO: 2822709 - DNA, 16 bp, Homo sapiens
gtaaagtttaaaaaat

SEQ ID NO: 2822710 - DNA, 14 bp, Homo sapiens
gtaaatacaaaata

SEQ ID NO: 2822711 - DNA, 21 bp, Homo sapiens
gtaaatacaaaataaaattat

SEQ ID NO: 2822712 - DNA, 19 bp, Homo sapiens
gtaaatacacaacacacac

SEQ ID NO: 2822713 - DNA, 15 bp, Homo sapiens
gtaaatacatgtgtg

SEQ ID NO: 2822714 - DNA, 14 bp, Homo sapiens
gtaaatagttttaa

SEQ ID NO: 2822715 - DNA, 21 bp, Homo sapiens
gtaaatagttttaaatatgaa

SEQ ID NO: 2822716 - DNA, 21 bp, Homo sapiens
gtaaatcacgctttttgaaaa

SEQ ID NO: 2822717 - DNA, 16 bp, Homo sapiens
gtaaatcctttttctt

SEQ ID NO: 2822718 - DNA, 15 bp, Homo sapiens
gtaacaagccagatt

SEQ ID NO: 2822719 - DNA, 19 bp, Homo sapiens
gtaacacaagccacagaag

SEQ ID NO: 2822720 - DNA, 12 bp, Homo sapiens
gtaacaggcaga

SEQ ID NO: 2822721 - DNA, 21 bp, Homo sapiens
gtaacaggtctcctcttaaaa

SEQ ID NO: 2822722 - DNA, 13 bp, Homo sapiens
gtaacatcctttc

SEQ ID NO: 2822723 - DNA, 22 bp, Homo sapiens
gtaacatgtttacttttcaggg

SEQ ID NO: 2822724 - DNA, 15 bp, Homo sapiens
gtaaccaagagtatt

SEQ ID NO: 2822725 - DNA, 18 bp, Homo sapiens
gtaactactttttatact

SEQ ID NO: 2822726 - DNA, 17 bp, Homo sapiens
gtaactccaccaaccca

SEQ ID NO: 2822727 - DNA, 16 bp, Homo sapiens
gtaacttaaccagcac

SEQ ID NO: 2822728 - DNA, 23 bp, Homo sapiens
gtaacttaaccagcacatttctc

SEQ ID NO: 2822729 - DNA, 12 bp, Homo sapiens
gtaaggtgcctt

SEQ ID NO: 2822730 - DNA, 21 bp, Homo sapiens
gtaagtggggttgcaaccact

SEQ ID NO: 2822731 - DNA, 22 bp, Homo sapiens
gtaagttctgaaaactgtttat

SEQ ID NO: 2822732 - DNA, 12 bp, Homo sapiens
gtaagtttattt

SEQ ID NO: 2822733 - DNA, 12 bp, Homo sapiens
gacaacagaagt

SEQ ID NO: 2822734 - DNA, 21 bp, Homo sapiens
gacaacaggttttcaccatag

SEQ ID NO: 2822735 - DNA, 16 bp, Homo sapiens
gacaacctttgtgtaa

SEQ ID NO: 2822736 - DNA, 12 bp, Homo sapiens
gacaagaagctg

SEQ ID NO: 2822737 - DNA, 13 bp, Homo sapiens
gacaagaagctgc

SEQ ID NO: 2822738 - DNA, 22 bp, Homo sapiens
gacaagccaacttgtaaataca

SEQ ID NO: 2822739 - DNA, 18 bp, Homo sapiens
gaataaaaaacatttgta

SEQ ID NO: 2822740 - DNA, 14 bp, Homo sapiens
gaataaaaattgac

SEQ ID NO: 2822741 - DNA, 13 bp, Homo sapiens
gaataaacttcag

SEQ ID NO: 2822742 - DNA, 17 bp, Homo sapiens
gaataaacttcagcacc

SEQ ID NO: 2822743 - DNA, 14 bp, Homo sapiens
gaataaagaaaaac

SEQ ID NO: 2822744 - DNA, 21 bp, Homo sapiens
gaggtcacattcaggaagatg

SEQ ID NO: 2822745 - DNA, 14 bp, Homo sapiens
gaggtcctgagcac

SEQ ID NO: 2822746 - DNA, 18 bp, Homo sapiens
gaggtcctgagcactgcc

SEQ ID NO: 2822747 - DNA, 19 bp, Homo sapiens
gaggtcctgagcactgcca

SEQ ID NO: 2822748 - DNA, 20 bp, Homo sapiens
gaggtcctgagcactgccag

SEQ ID NO: 2822749 - DNA, 23 bp, Homo sapiens
gaggtgaccccagggcacaggag

SEQ ID NO: 2822750 - DNA, 23 bp, Homo sapiens
gaggtgaccccaggtttctatgt

SEQ ID NO: 2822751 - DNA, 12 bp, Homo sapiens
gaggtgagcaga

SEQ ID NO: 2822752 - DNA, 11 bp, Homo sapiens
gaggtgctgat

SEQ ID NO: 2822753 - DNA, 13 bp, Homo sapiens
gaggtgctgatga

SEQ ID NO: 2822754 - DNA, 17 bp, Homo sapiens
gaggtgctgatgagtga

SEQ ID NO: 2822755 - DNA, 20 bp, Homo sapiens
gaggtggaagccctccttcc

SEQ ID NO: 2822756 - DNA, 19 bp, Homo sapiens
gaggtggaggttgcagtga

SEQ ID NO: 2822757 - DNA, 20 bp, Homo sapiens
gaggtggaggttgcagtgag

SEQ ID NO: 2822758 - DNA, 20 bp, Homo sapiens
gaggtggatcacagaggctt

SEQ ID NO: 2822759 - DNA, 16 bp, Homo sapiens
gaggtggcagccctgt

SEQ ID NO: 2822760 - DNA, 14 bp, Homo sapiens
gaggtgggcagcag

SEQ ID NO: 2822761 - DNA, 15 bp, Homo sapiens
gaggtgggcagcagc

SEQ ID NO: 2822762 - DNA, 21 bp, Homo sapiens
gagtactagaatttgtatttt

SEQ ID NO: 2822763 - DNA, 17 bp, Homo sapiens
gagtagaaagacagagc

SEQ ID NO: 2822764 - DNA, 19 bp, Homo sapiens
gagtagaaattgttcctga

SEQ ID NO: 2822765 - DNA, 19 bp, Homo sapiens
gagtagccgagagcctgct

SEQ ID NO: 2822766 - DNA, 21 bp, Homo sapiens
gagtagccgagagcctgctcc

SEQ ID NO: 2822767 - DNA, 14 bp, Homo sapiens
gagtagctgagctc

SEQ ID NO: 2822768 - DNA, 17 bp, Homo sapiens
gagtatatatgtacagt

SEQ ID NO: 2822769 - DNA, 19 bp, Homo sapiens
gagtatgcaagaagaatat

SEQ ID NO: 2822770 - DNA, 22 bp, Homo sapiens
gagtatgcaagaagaatataaa

SEQ ID NO: 2822771 - DNA, 13 bp, Homo sapiens
gagtcaccaagcc

SEQ ID NO: 2822772 - DNA, 14 bp, Homo sapiens
gagtcaccaagccc

SEQ ID NO: 2822773 - DNA, 14 bp, Homo sapiens
gagtcaccaggaat

SEQ ID NO: 2822774 - DNA, 18 bp, Homo sapiens
gagtcatgatctccctgc

SEQ ID NO: 2822775 - DNA, 15 bp, Homo sapiens
gagtccagggcggga

SEQ ID NO: 2822776 - DNA, 12 bp, Homo sapiens
gagtcccacctt

SEQ ID NO: 2822777 - DNA, 16 bp, Homo sapiens
gagtcccaccttggct

SEQ ID NO: 2822778 - DNA, 14 bp, Homo sapiens
gagtcgaggacagg

SEQ ID NO: 2822779 - DNA, 16 bp, Homo sapiens
gagtcgaggacaggga

SEQ ID NO: 2822780 - DNA, 20 bp, Homo sapiens
gagtctaggaatgcttttat

SEQ ID NO: 2822781 - DNA, 22 bp, Homo sapiens
gagtctcactgttgcccaggct

SEQ ID NO: 2822782 - DNA, 23 bp, Homo sapiens
gagtctcactgttgcccaggctg

SEQ ID NO: 2822783 - DNA, 16 bp, Homo sapiens
gagtctcctctctgag

SEQ ID NO: 2822784 - DNA, 19 bp, Homo sapiens
gagtctcctctctgagact

SEQ ID NO: 2822785 - DNA, 19 bp, Homo sapiens
gagtgaacaactatttata

SEQ ID NO: 2822786 - DNA, 20 bp, Homo sapiens
gagtgacagaggcagcccca

SEQ ID NO: 2822787 - DNA, 22 bp, Homo sapiens
gagtgacatgggtgtgccaggc

SEQ ID NO: 2822788 - DNA, 23 bp, Homo sapiens
gagtgacatgggtgtgccaggct

SEQ ID NO: 2822789 - DNA, 15 bp, Homo sapiens
gagtgacggtcccac

SEQ ID NO: 2822790 - DNA, 18 bp, Homo sapiens
gagtgacggtcccacact

SEQ ID NO: 2822791 - DNA, 23 bp, Homo sapiens
gagtgagcagtagaagcctgcag

SEQ ID NO: 2822792 - DNA, 23 bp, Homo sapiens
gagtgagccacagaccacctgct

SEQ ID NO: 2822793 - DNA, 11 bp, Homo sapiens
gagtgcagtga

SEQ ID NO: 2822794 - DNA, 12 bp, Homo sapiens
gagtgcagtgag

SEQ ID NO: 2822795 - DNA, 13 bp, Homo sapiens
gagtgcagtgagc

SEQ ID NO: 2822796 - DNA, 19 bp, Homo sapiens
gagtgccaggactccccag

SEQ ID NO: 2822797 - DNA, 23 bp, Homo sapiens
gagtgcccttaaaataatgattt

SEQ ID NO: 2822798 - DNA, 24 bp, Homo sapiens
gagtggctgaaataaaagcctctg

SEQ ID NO: 2822799 - DNA, 20 bp, Homo sapiens
gagtgtgaccaaaagttaca

SEQ ID NO: 2822800 - DNA, 21 bp, Homo sapiens
gagtgtgaccaaaagttacat

SEQ ID NO: 2822801 - DNA, 18 bp, Homo sapiens
gagtgtgggaagggagag

SEQ ID NO: 2822802 - DNA, 20 bp, Homo sapiens
gagttacagcgagaggcaga

SEQ ID NO: 2822803 - DNA, 17 bp, Homo sapiens
gagttatagtttgcttt

SEQ ID NO: 2822804 - DNA, 15 bp, Homo sapiens
gagttccatgaagac

SEQ ID NO: 2822805 - DNA, 14 bp, Homo sapiens
gagttcctgcatgc

SEQ ID NO: 2822806 - DNA, 23 bp, Homo sapiens
gagttcctgtgggtgtgtctctc

SEQ ID NO: 2822807 - DNA, 21 bp, Homo sapiens
gagttccttgatctgtatata

SEQ ID NO: 2822808 - DNA, 19 bp, Homo sapiens
gagttcgagaccagcccag

SEQ ID NO: 2822809 - DNA, 17 bp, Homo sapiens
gagttcgagaccagcct

SEQ ID NO: 2822810 - DNA, 19 bp, Homo sapiens
gagttcgagaccagcctgg

SEQ ID NO: 2822811 - DNA, 21 bp, Homo sapiens
gagttctttaggtgcctcctg

SEQ ID NO: 2822812 - DNA, 17 bp, Homo sapiens
gagttgagtctcctctc

SEQ ID NO: 2822813 - DNA, 20 bp, Homo sapiens
gagttgtggaaagcctctgc

SEQ ID NO: 2822814 - DNA, 22 bp, Homo sapiens
gagttgttttcagactcagact

SEQ ID NO: 2822815 - DNA, 19 bp, Homo sapiens
gagtttttatggggctgaa

SEQ ID NO: 2822816 - DNA, 15 bp, Homo sapiens
gagttttttttaacc

SEQ ID NO: 2822817 - DNA, 18 bp, Homo sapiens
gataaaatgaggttcaac

SEQ ID NO: 2822818 - DNA, 23 bp, Homo sapiens
gataaacacagaggttttaaaca

SEQ ID NO: 2822819 - DNA, 13 bp, Homo sapiens
gataaacattaaa

SEQ ID NO: 2822820 - DNA, 15 bp, Homo sapiens
gataaacattaaaca

SEQ ID NO: 2822821 - DNA, 19 bp, Homo sapiens
gataaacattaaacactgt

SEQ ID NO: 2822822 - DNA, 15 bp, Homo sapiens
gataaagatatcaat

SEQ ID NO: 2822823 - DNA, 19 bp, Homo sapiens
gataaagattttttaataa

SEQ ID NO: 2822824 - DNA, 15 bp, Homo sapiens
gataaagtgaccagg

SEQ ID NO: 2822825 - DNA, 16 bp, Homo sapiens
gataacaaaatcacaa

SEQ ID NO: 2822826 - DNA, 22 bp, Homo sapiens
gataaccacaaccaggaagaac

SEQ ID NO: 2822827 - DNA, 21 bp, Homo sapiens
gataacctgtacttcaagtta

SEQ ID NO: 2822828 - DNA, 17 bp, Homo sapiens
gataagaatgctggttt

SEQ ID NO: 2822829 - DNA, 22 bp, Homo sapiens
gataagaatgctggttttccta

SEQ ID NO: 2822830 - DNA, 14 bp, Homo sapiens
gataagtggaaaaa

SEQ ID NO: 2822831 - DNA, 15 bp, Homo sapiens
gataataactagatc

SEQ ID NO: 2822832 - DNA, 17 bp, Homo sapiens
gataataactagatctc

SEQ ID NO: 2822833 - DNA, 18 bp, Homo sapiens
gataataactagatctcc

SEQ ID NO: 2822834 - DNA, 14 bp, Homo sapiens
gataatcagcctct

SEQ ID NO: 2822835 - DNA, 15 bp, Homo sapiens
gataatgctgttgcc

SEQ ID NO: 2822836 - DNA, 12 bp, Homo sapiens
gataattttaaa

SEQ ID NO: 2822837 - DNA, 22 bp, Homo sapiens
gatacactgaagttaacagaga

SEQ ID NO: 2822838 - DNA, 20 bp, Homo sapiens
gatacaggaaaagctgctga

SEQ ID NO: 2822839 - DNA, 18 bp, Homo sapiens
gatacattccctatcaaa

SEQ ID NO: 2822840 - DNA, 23 bp, Homo sapiens
gatacattccctatcaaaacata

SEQ ID NO: 2822841 - DNA, 18 bp, Homo sapiens
gataccatatacagctca

SEQ ID NO: 2822842 - DNA, 14 bp, Homo sapiens
gatactggaagttt

SEQ ID NO: 2822843 - DNA, 14 bp, Homo sapiens
gatagaatgacagt

SEQ ID NO: 2822844 - DNA, 23 bp, Homo sapiens
gatagatggtactctccaaaggc

SEQ ID NO: 2822845 - DNA, 15 bp, Homo sapiens
gatataaatggctgg

SEQ ID NO: 2822846 - DNA, 16 bp, Homo sapiens
gatataaatggctggt

SEQ ID NO: 2822847 - DNA, 21 bp, Homo sapiens
gatatacaaatatatttaatt

SEQ ID NO: 2822848 - DNA, 18 bp, Homo sapiens
gatatacttttttcttat

SEQ ID NO: 2822849 - DNA, 21 bp, Homo sapiens
gatatatatttactaaaagaa

SEQ ID NO: 2822850 - DNA, 18 bp, Homo sapiens
gatatatctgaaaactgg

SEQ ID NO: 2822851 - DNA, 15 bp, Homo sapiens
gatatatgtatttat

SEQ ID NO: 2822852 - DNA, 14 bp, Homo sapiens
gatatctcatctct

SEQ ID NO: 2822853 - DNA, 14 bp, Homo sapiens
gatatgaaaaatat

SEQ ID NO: 2822854 - DNA, 16 bp, Homo sapiens
gatattaaaggagtta

SEQ ID NO: 2822855 - DNA, 13 bp, Homo sapiens
gatatttatatat

SEQ ID NO: 2822856 - DNA, 16 bp, Homo sapiens
gatatttatatatatt

SEQ ID NO: 2822857 - DNA, 20 bp, Homo sapiens
gatatttccatttcttcctc

SEQ ID NO: 2822858 - DNA, 21 bp, Homo sapiens
gatattttttcagaaatatgt

SEQ ID NO: 2822859 - DNA, 18 bp, Homo sapiens
gatcaaagttcctgttca

SEQ ID NO: 2822860 - DNA, 14 bp, Homo sapiens
gatcaagaaagtgt

SEQ ID NO: 2822861 - DNA, 16 bp, Homo sapiens
gatcaattaaatgtag

SEQ ID NO: 2822862 - DNA, 16 bp, Homo sapiens
gatcacatattctagt

SEQ ID NO: 2822863 - DNA, 18 bp, Homo sapiens
gatcaccagcccggcctg

SEQ ID NO: 2822864 - DNA, 22 bp, Homo sapiens
gatcaccagcccggcctgctcc

SEQ ID NO: 2822865 - DNA, 14 bp, Homo sapiens
gatcacctgaggtc

SEQ ID NO: 2822866 - DNA, 14 bp, Homo sapiens
gatcacgccactgc

SEQ ID NO: 2822867 - DNA, 16 bp, Homo sapiens
gatcacgccactgcac

SEQ ID NO: 2822868 - DNA, 24 bp, Homo sapiens
gatcacgccactgcactccagcct

SEQ ID NO: 2822869 - DNA, 23 bp, Homo sapiens
gatcacggctcactgcagcctca

SEQ ID NO: 2822870 - DNA, 13 bp, Homo sapiens
gatcactggagcc

SEQ ID NO: 2822871 - DNA, 14 bp, Homo sapiens
gatcactggagccc

SEQ ID NO: 2822872 - DNA, 17 bp, Homo sapiens
gatcactggagcccagg

SEQ ID NO: 2822873 - DNA, 18 bp, Homo sapiens
gatcactggagcccagga

SEQ ID NO: 2822874 - DNA, 14 bp, Homo sapiens
gatcagaattttac

SEQ ID NO: 2822875 - DNA, 16 bp, Homo sapiens
gatcagaccataatgt

SEQ ID NO: 2822876 - DNA, 13 bp, Homo sapiens
gatcagcgtggcc

SEQ ID NO: 2822877 - DNA, 15 bp, Homo sapiens
gatcagcgtggcctt

SEQ ID NO: 2822878 - DNA, 16 bp, Homo sapiens
gatcagcgtggccttg

SEQ ID NO: 2822879 - DNA, 18 bp, Homo sapiens
gatcagctgtttgtcata

SEQ ID NO: 2822880 - DNA, 23 bp, Homo sapiens
gatcagtatgctgttttaataat

SEQ ID NO: 2822881 - DNA, 13 bp, Homo sapiens
gatcatccactgt

SEQ ID NO: 2822882 - DNA, 18 bp, Homo sapiens
gatcatttgttggaatga

SEQ ID NO: 2822883 - DNA, 23 bp, Homo sapiens
gatcattttcttatcttctgcaa

SEQ ID NO: 2822884 - DNA, 14 bp, Homo sapiens
gatccaaacagaaa

SEQ ID NO: 2822885 - DNA, 16 bp, Homo sapiens
gatccaagctggtccc

SEQ ID NO: 2822886 - DNA, 14 bp, Homo sapiens
gatccacacacaga

SEQ ID NO: 2822887 - DNA, 20 bp, Homo sapiens
gatccacccacctcagcctc

SEQ ID NO: 2822888 - DNA, 16 bp, Homo sapiens
gatccactgtgcagga

SEQ ID NO: 2822889 - DNA, 22 bp, Homo sapiens
gatccacttcttaatgctttcc

SEQ ID NO: 2822890 - DNA, 18 bp, Homo sapiens
gatcccatccatcagctc

SEQ ID NO: 2822891 - DNA, 21 bp, Homo sapiens
gatcccgcctcttcttcttca

SEQ ID NO: 2822892 - DNA, 19 bp, Homo sapiens
gatcctattctcaccagga

SEQ ID NO: 2822893 - DNA, 19 bp, Homo sapiens
gatcctcacaaccacctaa

SEQ ID NO: 2822894 - DNA, 17 bp, Homo sapiens
gatcctcccacctcagc

SEQ ID NO: 2822895 - DNA, 20 bp, Homo sapiens
gatcctcccacctcagcctc

SEQ ID NO: 2822896 - DNA, 16 bp, Homo sapiens
gatcctgtctttaagg

SEQ ID NO: 2822897 - DNA, 14 bp, Homo sapiens
gatcgctggcagag

SEQ ID NO: 2822898 - DNA, 18 bp, Homo sapiens
gatcgctggcagagaagg

SEQ ID NO: 2822899 - DNA, 18 bp, Homo sapiens
gatcgggataacaaaatc

SEQ ID NO: 2822900 - DNA, 15 bp, Homo sapiens
gatcgtgctaaattt

SEQ ID NO: 2822901 - DNA, 16 bp, Homo sapiens
gatcgttcaaagcatg

SEQ ID NO: 2822902 - DNA, 18 bp, Homo sapiens
gatctaagcctttccata

SEQ ID NO: 2822903 - DNA, 21 bp, Homo sapiens
gatctagaatgtgttttctga

SEQ ID NO: 2822904 - DNA, 22 bp, Homo sapiens
gatctagaatgtgttttctgaa

SEQ ID NO: 2822905 - DNA, 12 bp, Homo sapiens
gatctatgcaat

SEQ ID NO: 2822906 - DNA, 13 bp, Homo sapiens
gatctatgcaatt

SEQ ID NO: 2822907 - DNA, 22 bp, Homo sapiens
gatctcatggaaactggccagg

SEQ ID NO: 2822908 - DNA, 13 bp, Homo sapiens
gatctccaaggac

SEQ ID NO: 2822909 - DNA, 18 bp, Homo sapiens
gatcttctgaaatgaaac

SEQ ID NO: 2822910 - DNA, 11 bp, Homo sapiens
gatctttcagg

SEQ ID NO: 2822911 - DNA, 15 bp, Homo sapiens
gatctttcaggaaag

SEQ ID NO: 2822912 - DNA, 18 bp, Homo sapiens
gatctttgcagacaggca

SEQ ID NO: 2822913 - DNA, 15 bp, Homo sapiens
gatgaaatgaggtca

SEQ ID NO: 2822914 - DNA, 14 bp, Homo sapiens
gatgaagagtgaga

SEQ ID NO: 2822915 - DNA, 19 bp, Homo sapiens
gatgaatgaggtcccaggc

SEQ ID NO: 2822916 - DNA, 16 bp, Homo sapiens
gatgaattaaatttaa

SEQ ID NO: 2822917 - DNA, 17 bp, Homo sapiens
gatgaccaatctctgtg

SEQ ID NO: 2822918 - DNA, 23 bp, Homo sapiens
gatgaccctgcgaaggggccctg

SEQ ID NO: 2822919 - DNA, 18 bp, Homo sapiens
gatgactaaaatatttat

SEQ ID NO: 2822920 - DNA, 14 bp, Homo sapiens
gatgactgagtcct

SEQ ID NO: 2822921 - DNA, 22 bp, Homo sapiens
gatgagaaaggttgaagcacca

SEQ ID NO: 2822922 - DNA, 15 bp, Homo sapiens
gatgagattccctct

SEQ ID NO: 2822923 - DNA, 14 bp, Homo sapiens
gatgaggcctcttg

SEQ ID NO: 2822924 - DNA, 22 bp, Homo sapiens
gatgaggcctcttggacctctg

SEQ ID NO: 2822925 - DNA, 13 bp, Homo sapiens
gatgatcgtgcct

SEQ ID NO: 2822926 - DNA, 21 bp, Homo sapiens
gatgatgaaatgaggtcagag

SEQ ID NO: 2822927 - DNA, 14 bp, Homo sapiens
gatgattaaacacc

SEQ ID NO: 2822928 - DNA, 16 bp, Homo sapiens
gatgattaaacacctg

SEQ ID NO: 2822929 - DNA, 14 bp, Homo sapiens
gatgcaccagccct

SEQ ID NO: 2822930 - DNA, 15 bp, Homo sapiens
gatgcaccagccctt

SEQ ID NO: 2822931 - DNA, 23 bp, Homo sapiens
gatgcagaggtaaaagtgtgagc

SEQ ID NO: 2822932 - DNA, 19 bp, Homo sapiens
gatgcccagagggcccagg

SEQ ID NO: 2822933 - DNA, 23 bp, Homo sapiens
gatgcccagagggcccaggcagg

SEQ ID NO: 2822934 - DNA, 12 bp, Homo sapiens
gatgcctccacc

SEQ ID NO: 2822935 - DNA, 17 bp, Homo sapiens
gatgcctccaccgctgc

SEQ ID NO: 2822936 - DNA, 18 bp, Homo sapiens
gatgcctggtggcagctg

SEQ ID NO: 2822937 - DNA, 19 bp, Homo sapiens
gatgcctggtggcagctgc

SEQ ID NO: 2822938 - DNA, 20 bp, Homo sapiens
gatgcctggtggcagctgcg

SEQ ID NO: 2822939 - DNA, 14 bp, Homo sapiens
gatgctgcctgagt

SEQ ID NO: 2822940 - DNA, 19 bp, Homo sapiens
gatggacgaacaggggcca

SEQ ID NO: 2822941 - DNA, 14 bp, Homo sapiens
gatggaggagaaga

SEQ ID NO: 2822942 - DNA, 18 bp, Homo sapiens
gatggagttcttgtgcca

SEQ ID NO: 2822943 - DNA, 19 bp, Homo sapiens
gatggcgctattgcactcc

SEQ ID NO: 2822944 - DNA, 19 bp, Homo sapiens
gatggctgtgcctctgcct

SEQ ID NO: 2822945 - DNA, 19 bp, Homo sapiens
gatggcttatttgtataat

SEQ ID NO: 2822946 - DNA, 22 bp, Homo sapiens
gatgggcaacccccagcctgct

SEQ ID NO: 2822947 - DNA, 21 bp, Homo sapiens
gatggggtgggcagggctggg

SEQ ID NO: 2822948 - DNA, 15 bp, Homo sapiens
gatgggtattaaact

SEQ ID NO: 2822949 - DNA, 21 bp, Homo sapiens
gatgggtctggctgagctgaa

SEQ ID NO: 2822950 - DNA, 20 bp, Homo sapiens
gatggtccgccacgaggagc

SEQ ID NO: 2822951 - DNA, 16 bp, Homo sapiens
gatgtaaacagtgcct

SEQ ID NO: 2822952 - DNA, 21 bp, Homo sapiens
gatgtaaacagtgcctgctga

SEQ ID NO: 2822953 - DNA, 20 bp, Homo sapiens
gatgtagggtaaggtgcctt

SEQ ID NO: 2822954 - DNA, 21 bp, Homo sapiens
gatgtagggtaaggtgccttc

SEQ ID NO: 2822955 - DNA, 13 bp, Homo sapiens
gatgtattggaac

SEQ ID NO: 2822956 - DNA, 20 bp, Homo sapiens
gatgtcaaatatctcagagg

SEQ ID NO: 2822957 - DNA, 12 bp, Homo sapiens
gatgtccagaag

SEQ ID NO: 2822958 - DNA, 16 bp, Homo sapiens
gatgtcccatctgctc

SEQ ID NO: 2822959 - DNA, 18 bp, Homo sapiens
gatgtcccatctgctcct

SEQ ID NO: 2822960 - DNA, 14 bp, Homo sapiens
gatgtctaatagtt

SEQ ID NO: 2822961 - DNA, 22 bp, Homo sapiens
gatgtgaattgcctgcagagag

SEQ ID NO: 2822962 - DNA, 16 bp, Homo sapiens
gatgtgccagaacttc

SEQ ID NO: 2822963 - DNA, 14 bp, Homo sapiens
gatgtgcccacagg

SEQ ID NO: 2822964 - DNA, 16 bp, Homo sapiens
gatgtgcccacaggga

SEQ ID NO: 2822965 - DNA, 21 bp, Homo sapiens
gatgtgctttgcattcctaca

SEQ ID NO: 2822966 - DNA, 21 bp, Homo sapiens
gatgtggccctggcctgctgg

SEQ ID NO: 2822967 - DNA, 17 bp, Homo sapiens
gatgtgggtcaaggaat

SEQ ID NO: 2822968 - DNA, 15 bp, Homo sapiens
gatgtgtcatctaat

SEQ ID NO: 2822969 - DNA, 22 bp, Homo sapiens
gatgttaaaaaaataagaagaa

SEQ ID NO: 2822970 - DNA, 14 bp, Homo sapiens
gatgtttccagaaa

SEQ ID NO: 2822971 - DNA, 15 bp, Homo sapiens
gattaaacacctgac

SEQ ID NO: 2822972 - DNA, 18 bp, Homo sapiens
gattaaacacctgacaca

SEQ ID NO: 2822973 - DNA, 12 bp, Homo sapiens
gattaaaggaag

SEQ ID NO: 2822974 - DNA, 16 bp, Homo sapiens
gattaaaggaaggaaa

SEQ ID NO: 2822975 - DNA, 18 bp, Homo sapiens
gattaatatggggatgca

SEQ ID NO: 2822976 - DNA, 22 bp, Homo sapiens
gattacataatcaaagctacct

SEQ ID NO: 2822977 - DNA, 22 bp, Homo sapiens
gattagaatgaaaattgtatgt

SEQ ID NO: 2822978 - DNA, 19 bp, Homo sapiens
gattagactggacagcttg

SEQ ID NO: 2822979 - DNA, 19 bp, Homo sapiens
gattatatatcataaagta

SEQ ID NO: 2822980 - DNA, 20 bp, Homo sapiens
gattatatatcataaagtat

SEQ ID NO: 2822981 - DNA, 21 bp, Homo sapiens
gattatatatcataaagtatg

SEQ ID NO: 2822982 - DNA, 16 bp, Homo sapiens
gattatattataataa

SEQ ID NO: 2822983 - DNA, 17 bp, Homo sapiens
gattatgggtcctgcaa

SEQ ID NO: 2822984 - DNA, 21 bp, Homo sapiens
gcagcttgagggttgggctgg

SEQ ID NO: 2822985 - DNA, 15 bp, Homo sapiens
gcagcttgtagccag

SEQ ID NO: 2822986 - DNA, 19 bp, Homo sapiens
gcagcttgtagccagccgg

SEQ ID NO: 2822987 - DNA, 13 bp, Homo sapiens
gcaggaccaggac

SEQ ID NO: 2822988 - DNA, 17 bp, Homo sapiens
gcaggaccgatgccagc

SEQ ID NO: 2822989 - DNA, 23 bp, Homo sapiens
gcaggaggattgcttgagcccag

SEQ ID NO: 2822990 - DNA, 19 bp, Homo sapiens
gcaggagtagctgagctca

SEQ ID NO: 2822991 - DNA, 19 bp, Homo sapiens
gcaggagtggccggggaag

SEQ ID NO: 2822992 - DNA, 14 bp, Homo sapiens
gcaggcacaggaca

SEQ ID NO: 2822993 - DNA, 13 bp, Homo sapiens
gcaggcagggctc

SEQ ID NO: 2822994 - DNA, 20 bp, Homo sapiens
gcaggccaagagcagaggca

SEQ ID NO: 2822995 - DNA, 12 bp, Homo sapiens
gcaggctgattt

SEQ ID NO: 2822996 - DNA, 15 bp, Homo sapiens
gcaggctggctggcc

SEQ ID NO: 2822997 - DNA, 22 bp, Homo sapiens
gcagggaaacagctaatgggac

SEQ ID NO: 2822998 - DNA, 20 bp, Homo sapiens
gcagggccggggaactggcc

SEQ ID NO: 2822999 - DNA, 23 bp, Homo sapiens
gcagggccggggaactggccaag

SEQ ID NO: 2823000 - DNA, 21 bp, Homo sapiens
gcagggccttgcccagagatg

SEQ ID NO: 2823001 - DNA, 19 bp, Homo sapiens
gcagggctcagcggggaca

SEQ ID NO: 2823002 - DNA, 21 bp, Homo sapiens
gcagggctcagcggggacagc

SEQ ID NO: 2823003 - DNA, 19 bp, Homo sapiens
gagcactgccaggagggac

SEQ ID NO: 2823004 - DNA, 20 bp, Homo sapiens
gagcagaaagccagggtcct

SEQ ID NO: 2823005 - DNA, 13 bp, Homo sapiens
gagcagaggcagc

SEQ ID NO: 2823006 - DNA, 16 bp, Homo sapiens
gagcagctgagcaggg

SEQ ID NO: 2823007 - DNA, 15 bp, Homo sapiens
gagcagggccgggga

SEQ ID NO: 2823008 - DNA, 16 bp, Homo sapiens
gagcagggccggggaa

SEQ ID NO: 2823009 - DNA, 14 bp, Homo sapiens
gagcagggctcagc

SEQ ID NO: 2823010 - DNA, 21 bp, Homo sapiens
gagcagggctcagcggggaca

SEQ ID NO: 2823011 - DNA, 19 bp, Homo sapiens
gagcagtcacactgttact

SEQ ID NO: 2823012 - DNA, 21 bp, Homo sapiens
gagcagtgggagggtaccagc

SEQ ID NO: 2823013 - DNA, 16 bp, Homo sapiens
gcctcttcttcttcag

SEQ ID NO: 2823014 - DNA, 21 bp, Homo sapiens
gcctcttcttcttcagaagac

SEQ ID NO: 2823015 - DNA, 18 bp, Homo sapiens
gcctcttggacctctgct

SEQ ID NO: 2823016 - DNA, 20 bp, Homo sapiens
gcctctttctgtgcttctct

SEQ ID NO: 2823017 - DNA, 23 bp, Homo sapiens
gcctgaccctacttcttttgctc

SEQ ID NO: 2823018 - DNA, 13 bp, Homo sapiens
gcctgagcccagg

SEQ ID NO: 2823019 - DNA, 14 bp, Homo sapiens
gcctgagcccaggg

SEQ ID NO: 2823020 - DNA, 16 bp, Homo sapiens
gcctgagcccagggag

SEQ ID NO: 2823021 - DNA, 19 bp, Homo sapiens
gcctgagcccagggaggcc

SEQ ID NO: 2823022 - DNA, 13 bp, Homo sapiens
gcctgaggctggg

SEQ ID NO: 2823023 - DNA, 17 bp, Homo sapiens
gcctgagggtggagact

SEQ ID NO: 2823024 - DNA, 13 bp, Homo sapiens
gcctgagtctcct

SEQ ID NO: 2823025 - DNA, 16 bp, Homo sapiens
gcctgagtctcctgtg

SEQ ID NO: 2823026 - DNA, 17 bp, Homo sapiens
gcctgatgacagagcga

SEQ ID NO: 2823027 - DNA, 21 bp, Homo sapiens
gcctgcaaactcactgctcaa

SEQ ID NO: 2823028 - DNA, 15 bp, Homo sapiens
gcctgcacccttcct

SEQ ID NO: 2823029 - DNA, 16 bp, Homo sapiens
gcctgcagactcactg

SEQ ID NO: 2823030 - DNA, 16 bp, Homo sapiens
gcctgcagagagaagc

SEQ ID NO: 2823031 - DNA, 17 bp, Homo sapiens
gcctgcagagagaagcc

SEQ ID NO: 2823032 - DNA, 11 bp, Homo sapiens
gcctgcagccc

SEQ ID NO: 2823033 - DNA, 14 bp, Homo sapiens
gcctgccagggccc

SEQ ID NO: 2823034 - DNA, 13 bp, Homo sapiens
gcctgcccaggcc

SEQ ID NO: 2823035 - DNA, 17 bp, Homo sapiens
gcctgcccaggcccctg

SEQ ID NO: 2823036 - DNA, 19 bp, Homo sapiens
gcctgcccaggcccctgcc

SEQ ID NO: 2823037 - DNA, 23 bp, Homo sapiens
gcctgcccccagcactcctctgt

SEQ ID NO: 2823038 - DNA, 14 bp, Homo sapiens
gcctgccctcccct

SEQ ID NO: 2823039 - DNA, 12 bp, Homo sapiens
gcctgccgagca

SEQ ID NO: 2823040 - DNA, 18 bp, Homo sapiens
gccggcaaccccagttct

SEQ ID NO: 2823041 - DNA, 21 bp, Homo sapiens
gccggcacctacatccccagg

SEQ ID NO: 2823042 - DNA, 23 bp, Homo sapiens
gccggcacctacatccccaggtc

SEQ ID NO: 2823043 - DNA, 14 bp, Homo sapiens
gccggccggctggg

SEQ ID NO: 2823044 - DNA, 19 bp, Homo sapiens
gccgggacatgcagctctg

SEQ ID NO: 2823045 - DNA, 17 bp, Homo sapiens
gccgggcttgggccctg

SEQ ID NO: 2823046 - DNA, 16 bp, Homo sapiens
gccggggaactggcca

SEQ ID NO: 2823047 - DNA, 17 bp, Homo sapiens
gccggggaactggccaa

SEQ ID NO: 2823048 - DNA, 17 bp, Homo sapiens
gccggggaagctggcag

SEQ ID NO: 2823049 - DNA, 17 bp, Homo sapiens
gccggggcgagtggcac

SEQ ID NO: 2823050 - DNA, 18 bp, Homo sapiens
gccgggtacctcagtttc

SEQ ID NO: 2823051 - DNA, 14 bp, Homo sapiens
gccgtgcccagggg

SEQ ID NO: 2823052 - DNA, 20 bp, Homo sapiens
gccgtggccatcagggtggg

SEQ ID NO: 2823053 - DNA, 16 bp, Homo sapiens
gccgtggtccagctct

SEQ ID NO: 2823054 - DNA, 17 bp, Homo sapiens
gccgtggtccagctctt

SEQ ID NO: 2823055 - DNA, 19 bp, Homo sapiens
gccgtggtccagctcttgg

SEQ ID NO: 2823056 - DNA, 17 bp, Homo sapiens
gcctaaaaatgcaactt

SEQ ID NO: 2823057 - DNA, 15 bp, Homo sapiens
gcctaaatccaaaga

SEQ ID NO: 2823058 - DNA, 13 bp, Homo sapiens
gcctagcaggcac

SEQ ID NO: 2823059 - DNA, 17 bp, Homo sapiens
gcctagccgacctcagc

SEQ ID NO: 2823060 - DNA, 20 bp, Homo sapiens
gcctatcaacctaagcaaca

SEQ ID NO: 2823061 - DNA, 14 bp, Homo sapiens
gcctatccatcctg

SEQ ID NO: 2823062 - DNA, 14 bp, Homo sapiens
gcctatggagagcc

SEQ ID NO: 2823063 - DNA, 18 bp, Homo sapiens
gcctatggagagccctgg

SEQ ID NO: 2823064 - DNA, 20 bp, Homo sapiens
gcctatggagagccctggga

SEQ ID NO: 2823065 - DNA, 19 bp, Homo sapiens
ctcctgtgggagcctcgca

SEQ ID NO: 2823066 - DNA, 15 bp, Homo sapiens
ctcctgtgtcttgca

SEQ ID NO: 2823067 - DNA, 16 bp, Homo sapiens
ctcctgtgtgtgcgcc

SEQ ID NO: 2823068 - DNA, 21 bp, Homo sapiens
ctcctgtgtgtgcgcctacag

SEQ ID NO: 2823069 - DNA, 15 bp, Homo sapiens
ctccttgcctggtga

SEQ ID NO: 2823070 - DNA, 18 bp, Homo sapiens
ctccttggaggacagtgg

SEQ ID NO: 2823071 - DNA, 18 bp, Homo sapiens
ctccttgtggtttatgtc

SEQ ID NO: 2823072 - DNA, 19 bp, Homo sapiens
ctcctttattgctcctgta

SEQ ID NO: 2823073 - DNA, 14 bp, Homo sapiens
ctcctttctccagc

SEQ ID NO: 2823074 - DNA, 21 bp, Homo sapiens
ctcctttgcactgagggccac

SEQ ID NO: 2823075 - DNA, 23 bp, Homo sapiens
ctcctttgcctaggaggccttct

SEQ ID NO: 2823076 - DNA, 17 bp, Homo sapiens
ctcctttggccattcca

SEQ ID NO: 2823077 - DNA, 19 bp, Homo sapiens
ctggaacttgaactgattc

SEQ ID NO: 2823078 - DNA, 12 bp, Homo sapiens
ctggaagcacat

SEQ ID NO: 2823079 - DNA, 16 bp, Homo sapiens
ctggaagctgtgtcct

SEQ ID NO: 2823080 - DNA, 22 bp, Homo sapiens
ctggaagggaagtgagaaacca

SEQ ID NO: 2823081 - DNA, 23 bp, Homo sapiens
ctgccactttggtacatggccag

SEQ ID NO: 2823082 - DNA, 13 bp, Homo sapiens
ctgccagccagca

SEQ ID NO: 2823083 - DNA, 14 bp, Homo sapiens
ctgccagccagcag

SEQ ID NO: 2823084 - DNA, 20 bp, Homo sapiens
ctgccagtccccctgcccca

SEQ ID NO: 2823085 - DNA, 21 bp, Homo sapiens
ctgccagtccccctgccccag

SEQ ID NO: 2823086 - DNA, 22 bp, Homo sapiens
ctgccagtccccctgccccagg

SEQ ID NO: 2823087 - DNA, 12 bp, Homo sapiens
ctgccagtgcct

SEQ ID NO: 2823088 - DNA, 21 bp, Homo sapiens
ctgtggttgttttagctcctt

SEQ ID NO: 2823089 - DNA, 12 bp, Homo sapiens
cttggaatgaat

SEQ ID NO: 2823090 - DNA, 22 bp, Homo sapiens
cttggaatgaattctctctaaa

SEQ ID NO: 2823091 - DNA, 17 bp, Homo sapiens
ctattatccccatttct

SEQ ID NO: 2823092 - DNA, 13 bp, Homo sapiens
ctattcagacaag

SEQ ID NO: 2823093 - DNA, 16 bp, Homo sapiens
ctattctcaccaggaa

SEQ ID NO: 2823094 - DNA, 14 bp, Homo sapiens
ctattctctcctca

SEQ ID NO: 2823095 - DNA, 19 bp, Homo sapiens
ctattctctcctcagactg

SEQ ID NO: 2823096 - DNA, 16 bp, Homo sapiens
ctattgaacctaggac

SEQ ID NO: 2823097 - DNA, 19 bp, Homo sapiens
ctattgatgtttccagaaa

SEQ ID NO: 2823098 - DNA, 20 bp, Homo sapiens
ctattgatgtttccagaaaa

SEQ ID NO: 2823099 - DNA, 17 bp, Homo sapiens
ctattgcactccagtct

SEQ ID NO: 2823100 - DNA, 22 bp, Homo sapiens
ctattgcatgtaaaatgcagtc

SEQ ID NO: 2823101 - DNA, 16 bp, Homo sapiens
ctattgtagcatttct

SEQ ID NO: 2823102 - DNA, 21 bp, Homo sapiens
ctattgtttctttaagaaagt

SEQ ID NO: 2823103 - DNA, 15 bp, Homo sapiens
ctatttaaaaaataa

SEQ ID NO: 2823104 - DNA, 13 bp, Homo sapiens
ctatttataaact

SEQ ID NO: 2823105 - DNA, 13 bp, Homo sapiens
ctatttctgagaa

SEQ ID NO: 2823106 - DNA, 23 bp, Homo sapiens
ctatttctgagaaggtccttaat

SEQ ID NO: 2823107 - DNA, 23 bp, Homo sapiens
ctatttgttgtttttaacaacta

SEQ ID NO: 2823108 - DNA, 18 bp, Homo sapiens
ctattttaaaaccatgca

SEQ ID NO: 2823109 - DNA, 12 bp, Homo sapiens
ctattttgtaaa

SEQ ID NO: 2823110 - DNA, 17 bp, Homo sapiens
ctatttttcttctaaaa

SEQ ID NO: 2823111 - DNA, 14 bp, Homo sapiens
ctatttttgtagaa

SEQ ID NO: 2823112 - DNA, 20 bp, Homo sapiens
ctcaaactcctggactcatg

SEQ ID NO: 2823113 - DNA, 18 bp, Homo sapiens
ctcaaagagggagtgcat

SEQ ID NO: 2823114 - DNA, 22 bp, Homo sapiens
ctcaaagcccccacttctctcc

SEQ ID NO: 2823115 - DNA, 13 bp, Homo sapiens
ctcaaatctattc

SEQ ID NO: 2823116 - DNA, 17 bp, Homo sapiens
ctcaaatgacccaaaga

SEQ ID NO: 2823117 - DNA, 17 bp, Homo sapiens
ctcaaatgctaaatgca

SEQ ID NO: 2823118 - DNA, 24 bp, Homo sapiens
ctcaaatgctaaatgcaaacactg

SEQ ID NO: 2823119 - DNA, 13 bp, Homo sapiens
ctcaacctcctgg

SEQ ID NO: 2823120 - DNA, 17 bp, Homo sapiens
ctcaagaggctgaggca

SEQ ID NO: 2823121 - DNA, 15 bp, Homo sapiens
ctcaagatgacagct

SEQ ID NO: 2823122 - DNA, 18 bp, Homo sapiens
ctcaagatgacagctctt

SEQ ID NO: 2823123 - DNA, 18 bp, Homo sapiens
ctcaagattatattataa

SEQ ID NO: 2823124 - DNA, 18 bp, Homo sapiens
ctcaagtcttccctgatc

SEQ ID NO: 2823125 - DNA, 21 bp, Homo sapiens
ctcaagtgattctcctgcctc

SEQ ID NO: 2823126 - DNA, 14 bp, Homo sapiens
ctcaagttgaaaga

SEQ ID NO: 2823127 - DNA, 12 bp, Homo sapiens
ctcaagttttta

SEQ ID NO: 2823128 - DNA, 19 bp, Homo sapiens
ctcaagtttttcagaaagc

SEQ ID NO: 2823129 - DNA, 13 bp, Homo sapiens
ctcaataaaatca

SEQ ID NO: 2823130 - DNA, 22 bp, Homo sapiens
ctcaataaaatcatgtacattt

SEQ ID NO: 2823131 - DNA, 16 bp, Homo sapiens
ctcaatattcctgaat

SEQ ID NO: 2823132 - DNA, 18 bp, Homo sapiens
ctcaatattcctgaatga

SEQ ID NO: 2823133 - DNA, 16 bp, Homo sapiens
ctcaatcagtctcaga

SEQ ID NO: 2823134 - DNA, 14 bp, Homo sapiens
ctcaatgcttttct

SEQ ID NO: 2823135 - DNA, 15 bp, Homo sapiens
ctcaatgcttttcta

SEQ ID NO: 2823136 - DNA, 17 bp, Homo sapiens
ctcaatgcttttctagc

SEQ ID NO: 2823137 - DNA, 20 bp, Homo sapiens
ctcaatgtgaatcagaccct

SEQ ID NO: 2823138 - DNA, 14 bp, Homo sapiens
ctcaatgtgaccag

SEQ ID NO: 2823139 - DNA, 17 bp, Homo sapiens
ctcacaagaagaccaga

SEQ ID NO: 2823140 - DNA, 16 bp, Homo sapiens
ctcacaaggcagcaag

SEQ ID NO: 2823141 - DNA, 23 bp, Homo sapiens
ctcacacaggcatttcctgggtg

SEQ ID NO: 2823142 - DNA, 16 bp, Homo sapiens
ctcacagagccaactc

SEQ ID NO: 2823143 - DNA, 19 bp, Homo sapiens
ctcacagtctctttaatct

SEQ ID NO: 2823144 - DNA, 20 bp, Homo sapiens
ctcacagtctctttaatctt

SEQ ID NO: 2823145 - DNA, 18 bp, Homo sapiens
ctcacagttcctcgccct

SEQ ID NO: 2823146 - DNA, 19 bp, Homo sapiens
ctcacagttcctcgccctg

SEQ ID NO: 2823147 - DNA, 21 bp, Homo sapiens
ctcacagttcctcgccctggg

SEQ ID NO: 2823148 - DNA, 22 bp, Homo sapiens
ctcacagttcctcgccctgggt

SEQ ID NO: 2823149 - DNA, 15 bp, Homo sapiens
ctcacatttattctg

SEQ ID NO: 2823150 - DNA, 14 bp, Homo sapiens
ctcaccaataactt

SEQ ID NO: 2823151 - DNA, 18 bp, Homo sapiens
ctcaccaataacttcaga

SEQ ID NO: 2823152 - DNA, 20 bp, Homo sapiens
ctcaccaataacttcagaga

SEQ ID NO: 2823153 - DNA, 22 bp, Homo sapiens
ctcaccaataacttcagagaag

SEQ ID NO: 2823154 - DNA, 23 bp, Homo sapiens
ctcaccaataacttcagagaagt

SEQ ID NO: 2823155 - DNA, 14 bp, Homo sapiens
ctcaccagccccag

SEQ ID NO: 2823156 - DNA, 17 bp, Homo sapiens
ctcaccagccccagtgc

SEQ ID NO: 2823157 - DNA, 19 bp, Homo sapiens
ctcaccagccccagtgccc

SEQ ID NO: 2823158 - DNA, 13 bp, Homo sapiens
ctcaccaggaagg

SEQ ID NO: 2823159 - DNA, 16 bp, Homo sapiens
ctcacccatgtgccaa

SEQ ID NO: 2823160 - DNA, 17 bp, Homo sapiens
ctcacccccagctttgc

SEQ ID NO: 2823161 - DNA, 22 bp, Homo sapiens
ctcaccccctcccacccccagc

SEQ ID NO: 2823162 - DNA, 15 bp, Homo sapiens
ctcaccccgtctggg

SEQ ID NO: 2823163 - DNA, 14 bp, Homo sapiens
ctcacccgaggctg

SEQ ID NO: 2823164 - DNA, 15 bp, Homo sapiens
ctcaccctcatacca

SEQ ID NO: 2823165 - DNA, 16 bp, Homo sapiens
ctcaccctcataccat

SEQ ID NO: 2823166 - DNA, 16 bp, Homo sapiens
ctcacctctgcctcaa

SEQ ID NO: 2823167 - DNA, 14 bp, Homo sapiens
ctcacgcccagcct

SEQ ID NO: 2823168 - DNA, 22 bp, Homo sapiens
ctcacgcccagcctcctcccac

SEQ ID NO: 2823169 - DNA, 18 bp, Homo sapiens
ctcacgcctataatccca

SEQ ID NO: 2823170 - DNA, 20 bp, Homo sapiens
ctcacgcctgtaatcccagc

SEQ ID NO: 2823171 - DNA, 22 bp, Homo sapiens
ctcacgcctgtaatcccagcac

SEQ ID NO: 2823172 - DNA, 19 bp, Homo sapiens
ctcacgggcagtagctgtg

SEQ ID NO: 2823173 - DNA, 16 bp, Homo sapiens
ctcactatgttgccca

SEQ ID NO: 2823174 - DNA, 19 bp, Homo sapiens
ctcactatgttgcccaggc

SEQ ID NO: 2823175 - DNA, 15 bp, Homo sapiens
ctcactccacactgg

SEQ ID NO: 2823176 - DNA, 16 bp, Homo sapiens
ctcactccacactggc

SEQ ID NO: 2823177 - DNA, 20 bp, Homo sapiens
ctcactcctgttacttacct

SEQ ID NO: 2823178 - DNA, 18 bp, Homo sapiens
ctcactgaggaagggaga

SEQ ID NO: 2823179 - DNA, 12 bp, Homo sapiens
ctcactgcagcc

SEQ ID NO: 2823180 - DNA, 16 bp, Homo sapiens
ctcactgctcaagaag

SEQ ID NO: 2823181 - DNA, 17 bp, Homo sapiens
ctcactggggtcctggg

SEQ ID NO: 2823182 - DNA, 13 bp, Homo sapiens
ctaggttctaaaa

SEQ ID NO: 2823183 - DNA, 21 bp, Homo sapiens
ctagtaatgggccaattaaaa

SEQ ID NO: 2823184 - DNA, 21 bp, Homo sapiens
ctagtatattagtttgattta

SEQ ID NO: 2823185 - DNA, 13 bp, Homo sapiens
ctagtcataacct

SEQ ID NO: 2823186 - DNA, 19 bp, Homo sapiens
ctagtctatggtcagttga

SEQ ID NO: 2823187 - DNA, 20 bp, Homo sapiens
ctagtctcctttgcactgag

SEQ ID NO: 2823188 - DNA, 23 bp, Homo sapiens
ctagtctcctttgcactgagggc

SEQ ID NO: 2823189 - DNA, 17 bp, Homo sapiens
ctagtctggtgttctga

SEQ ID NO: 2823190 - DNA, 21 bp, Homo sapiens
ctagtctggtgttctgagtac

SEQ ID NO: 2823191 - DNA, 18 bp, Homo sapiens
ctagtgacccacatgcca

SEQ ID NO: 2823192 - DNA, 23 bp, Homo sapiens
ctagtgccctccacagccgcagc

SEQ ID NO: 2823193 - DNA, 16 bp, Homo sapiens
ctagtggcttcctccg

SEQ ID NO: 2823194 - DNA, 17 bp, Homo sapiens
ctagtggggtctccctc

SEQ ID NO: 2823195 - DNA, 20 bp, Homo sapiens
ctagtggggtctccctctcc

SEQ ID NO: 2823196 - DNA, 23 bp, Homo sapiens
ctagtggggtctccctctcctgc

SEQ ID NO: 2823197 - DNA, 17 bp, Homo sapiens
ctagttagcaggaaata

SEQ ID NO: 2823198 - DNA, 16 bp, Homo sapiens
ctagttttctcctccc

SEQ ID NO: 2823199 - DNA, 12 bp, Homo sapiens
ctataaacatta

SEQ ID NO: 2823200 - DNA, 18 bp, Homo sapiens
ctataaacattaaaagaa

SEQ ID NO: 2823201 - DNA, 20 bp, Homo sapiens
ctataaacattaaaagaaga

SEQ ID NO: 2823202 - DNA, 14 bp, Homo sapiens
ctataatcccagca

SEQ ID NO: 2823203 - DNA, 22 bp, Homo sapiens
ctataattccctatcttttagt

SEQ ID NO: 2823204 - DNA, 23 bp, Homo sapiens
ctatacctgtgtttcttgcctca

SEQ ID NO: 2823205 - DNA, 18 bp, Homo sapiens
ctatagcctaggtgacag

SEQ ID NO: 2823206 - DNA, 12 bp, Homo sapiens
ctatagctcttc

SEQ ID NO: 2823207 - DNA, 18 bp, Homo sapiens
ctatagctcttctattta

SEQ ID NO: 2823208 - DNA, 22 bp, Homo sapiens
ctatagctcttctatttaaaaa

SEQ ID NO: 2823209 - DNA, 19 bp, Homo sapiens
ctatatagctgatcagttt

SEQ ID NO: 2823210 - DNA, 22 bp, Homo sapiens
ctatatagtttattgacaataa

SEQ ID NO: 2823211 - DNA, 13 bp, Homo sapiens
ctatatatacatg

SEQ ID NO: 2823212 - DNA, 19 bp, Homo sapiens
ctatatatacatgtatagt

SEQ ID NO: 2823213 - DNA, 15 bp, Homo sapiens
ctatatctctaaact

SEQ ID NO: 2823214 - DNA, 21 bp, Homo sapiens
ctatatgtagtataaagaaaa

SEQ ID NO: 2823215 - DNA, 14 bp, Homo sapiens
ctatattgtacaca

SEQ ID NO: 2823216 - DNA, 23 bp, Homo sapiens
ctatatttagattgttaaaataa

SEQ ID NO: 2823217 - DNA, 18 bp, Homo sapiens
ctatcaaaacatatcaat

SEQ ID NO: 2823218 - DNA, 21 bp, Homo sapiens
ctatcaaactgaagccagaaa

SEQ ID NO: 2823219 - DNA, 19 bp, Homo sapiens
ctatcaaccccagacactg

SEQ ID NO: 2823220 - DNA, 19 bp, Homo sapiens
ctatcaacctaagcaacag

SEQ ID NO: 2823221 - DNA, 14 bp, Homo sapiens
ctatcacacagtgg

SEQ ID NO: 2823222 - DNA, 14 bp, Homo sapiens
ctatcatggagtga

SEQ ID NO: 2823223 - DNA, 14 bp, Homo sapiens
ctatccaaaggaat

SEQ ID NO: 2823224 - DNA, 13 bp, Homo sapiens
ctatccacccagc

SEQ ID NO: 2823225 - DNA, 15 bp, Homo sapiens
ctatccacccagccc

SEQ ID NO: 2823226 - DNA, 16 bp, Homo sapiens
ctatccacccagccca

SEQ ID NO: 2823227 - DNA, 14 bp, Homo sapiens
ctatccatcctgcg

SEQ ID NO: 2823228 - DNA, 19 bp, Homo sapiens
ctatcctgaaaattctgta

SEQ ID NO: 2823229 - DNA, 13 bp, Homo sapiens
ctatgaaggctgt

SEQ ID NO: 2823230 - DNA, 16 bp, Homo sapiens
ctatgacttgggcacc

SEQ ID NO: 2823231 - DNA, 23 bp, Homo sapiens
ctatgacttgggcacccccagcc

SEQ ID NO: 2823232 - DNA, 22 bp, Homo sapiens
ctatgagggtccccgggagcac

SEQ ID NO: 2823233 - DNA, 20 bp, Homo sapiens
ctatgatatggtaaaagtta

SEQ ID NO: 2823234 - DNA, 22 bp, Homo sapiens
ctatgatcccagcactttggga

SEQ ID NO: 2823235 - DNA, 14 bp, Homo sapiens
ctatgattttctat

SEQ ID NO: 2823236 - DNA, 11 bp, Homo sapiens
ctatgcaattt

SEQ ID NO: 2823237 - DNA, 13 bp, Homo sapiens
ctatgcaattttt

SEQ ID NO: 2823238 - DNA, 18 bp, Homo sapiens
ctatgcaatttttaaact

SEQ ID NO: 2823239 - DNA, 12 bp, Homo sapiens
ctatgcacatat

SEQ ID NO: 2823240 - DNA, 13 bp, Homo sapiens
ctatgcacatatg

SEQ ID NO: 2823241 - DNA, 19 bp, Homo sapiens
ctatgccttgtctggggac

SEQ ID NO: 2823242 - DNA, 11 bp, Homo sapiens
ctatggagagc

SEQ ID NO: 2823243 - DNA, 14 bp, Homo sapiens
ctatggagagccct

SEQ ID NO: 2823244 - DNA, 21 bp, Homo sapiens
ctatggagagccctgggaccg

SEQ ID NO: 2823245 - DNA, 24 bp, Homo sapiens
ctatggatgtggggtccccatcat

SEQ ID NO: 2823246 - DNA, 14 bp, Homo sapiens
cccgctctggacca

SEQ ID NO: 2823247 - DNA, 14 bp, Homo sapiens
cccgctggcagcca

SEQ ID NO: 2823248 - DNA, 15 bp, Homo sapiens
cccgcttccccacag

SEQ ID NO: 2823249 - DNA, 14 bp, Homo sapiens
cccgcttgtccagc

SEQ ID NO: 2823250 - DNA, 16 bp, Homo sapiens
cccggattctgggagg

SEQ ID NO: 2823251 - DNA, 15 bp, Homo sapiens
cgtaaccacggaaaa

SEQ ID NO: 2823252 - DNA, 19 bp, Homo sapiens
cgtaagatggcttatttgt

SEQ ID NO: 2823253 - DNA, 16 bp, Homo sapiens
cgtaattaaaagaatt

SEQ ID NO: 2823254 - DNA, 18 bp, Homo sapiens
cgtaattttattattaga

SEQ ID NO: 2823255 - DNA, 17 bp, Homo sapiens
cgtacattcaatgttta

SEQ ID NO: 2823256 - DNA, 17 bp, Homo sapiens
cgtacccccgtggtctt

SEQ ID NO: 2823257 - DNA, 22 bp, Homo sapiens
cgtacccccgtggtctttgaat

SEQ ID NO: 2823258 - DNA, 22 bp, Homo sapiens
cgtatatgtctcaggtccctgc

SEQ ID NO: 2823259 - DNA, 22 bp, Homo sapiens
cgtatgtcggcacgtcccatgt

SEQ ID NO: 2823260 - DNA, 18 bp, Homo sapiens
cgtatttatatttggaaa

SEQ ID NO: 2823261 - DNA, 19 bp, Homo sapiens
cgtatttatatttggaaag

SEQ ID NO: 2823262 - DNA, 12 bp, Homo sapiens
cgtcacctcaga

SEQ ID NO: 2823263 - DNA, 23 bp, Homo sapiens
cgtcagtagtttgagaccagcct

SEQ ID NO: 2823264 - DNA, 12 bp, Homo sapiens
cgtcatctcagg

SEQ ID NO: 2823265 - DNA, 13 bp, Homo sapiens
cgtcatctcaggg

SEQ ID NO: 2823266 - DNA, 15 bp, Homo sapiens
cgtcatgttcctcaa

SEQ ID NO: 2823267 - DNA, 16 bp, Homo sapiens
cgtccttactcctgtg

SEQ ID NO: 2823268 - DNA, 20 bp, Homo sapiens
cgtccttactcctgtgggag

SEQ ID NO: 2823269 - DNA, 22 bp, Homo sapiens
cgtccttactcctgtgggagcc

SEQ ID NO: 2823270 - DNA, 21 bp, Homo sapiens
cgtcgctggacaacccagaac

SEQ ID NO: 2823271 - DNA, 19 bp, Homo sapiens
cgtctccctaaaataaaaa

SEQ ID NO: 2823272 - DNA, 15 bp, Homo sapiens
cgtctcctttgacat

SEQ ID NO: 2823273 - DNA, 14 bp, Homo sapiens
cgtctgacaggcaa

SEQ ID NO: 2823274 - DNA, 22 bp, Homo sapiens
cgtctgacaggcaatgctggct

SEQ ID NO: 2823275 - DNA, 14 bp, Homo sapiens
cgtctggtgttctc

SEQ ID NO: 2823276 - DNA, 15 bp, Homo sapiens
cgtcttcagcctagc

SEQ ID NO: 2823277 - DNA, 12 bp, Homo sapiens
cgtcttctctcc

SEQ ID NO: 2823278 - DNA, 19 bp, Homo sapiens
cgtcttctgtatactgtgg

SEQ ID NO: 2823279 - DNA, 12 bp, Homo sapiens
cgtcttgtattt

SEQ ID NO: 2823280 - DNA, 19 bp, Homo sapiens
cgtgaaagaattatttttg

SEQ ID NO: 2823281 - DNA, 17 bp, Homo sapiens
cgtgaagggcaccgaga

SEQ ID NO: 2823282 - DNA, 18 bp, Homo sapiens
cgtgaagggcaccgagaa

SEQ ID NO: 2823283 - DNA, 15 bp, Homo sapiens
cgtgactcacccaag

SEQ ID NO: 2823284 - DNA, 17 bp, Homo sapiens
cgtgactgccccaactc

SEQ ID NO: 2823285 - DNA, 22 bp, Homo sapiens
cgtgactgccccaactcctgga

SEQ ID NO: 2823286 - DNA, 23 bp, Homo sapiens
cgtgactgccccaactcctggaa

SEQ ID NO: 2823287 - DNA, 14 bp, Homo sapiens
cgtgagccactgca

SEQ ID NO: 2823288 - DNA, 15 bp, Homo sapiens
cgtgagccactgcac

SEQ ID NO: 2823289 - DNA, 19 bp, Homo sapiens
cgtgagtgaaccatcatta

SEQ ID NO: 2823290 - DNA, 23 bp, Homo sapiens
cgtgatgtagggtaaggtgcctt

SEQ ID NO: 2823291 - DNA, 19 bp, Homo sapiens
cgtgcacacaccagagccc

SEQ ID NO: 2823292 - DNA, 22 bp, Homo sapiens
cgtgcagtggtgcgatctgggt

SEQ ID NO: 2823293 - DNA, 12 bp, Homo sapiens
cgtgcatttgtg

SEQ ID NO: 2823294 - DNA, 17 bp, Homo sapiens
cgtgccgttactctcca

SEQ ID NO: 2823295 - DNA, 19 bp, Homo sapiens
cgtgccgttactctccaac

SEQ ID NO: 2823296 - DNA, 17 bp, Homo sapiens
cgtgctcttctgttctc

SEQ ID NO: 2823297 - DNA, 18 bp, Homo sapiens
cgtgctcttctgttctca

SEQ ID NO: 2823298 - DNA, 15 bp, Homo sapiens
cgtggacacctgccc

SEQ ID NO: 2823299 - DNA, 14 bp, Homo sapiens
cgtggaccttcctg

SEQ ID NO: 2823300 - DNA, 15 bp, Homo sapiens
cgtggaccttcctgc

SEQ ID NO: 2823301 - DNA, 15 bp, Homo sapiens
cgtggaggctgctcg

SEQ ID NO: 2823302 - DNA, 22 bp, Homo sapiens
cgtggcagataatcagcctctt

SEQ ID NO: 2823303 - DNA, 15 bp, Homo sapiens
cgtggcccttcctgg

SEQ ID NO: 2823304 - DNA, 20 bp, Homo sapiens
cgtggcccttcctggacagc

SEQ ID NO: 2823305 - DNA, 13 bp, Homo sapiens
cgtggccttgttc

SEQ ID NO: 2823306 - DNA, 21 bp, Homo sapiens
cgtggtcaaggcccggcccca

SEQ ID NO: 2823307 - DNA, 13 bp, Homo sapiens
cgtggtctttgaa

SEQ ID NO: 2823308 - DNA, 15 bp, Homo sapiens
cgtggtctttgaata

SEQ ID NO: 2823309 - DNA, 16 bp, Homo sapiens
cgtggtctttgaataa

SEQ ID NO: 2823310 - DNA, 19 bp, Homo sapiens
cgtggtctttgaataaagt

SEQ ID NO: 2823311 - DNA, 20 bp, Homo sapiens
cgtggtctttgaataaagtc

SEQ ID NO: 2823312 - DNA, 22 bp, Homo sapiens
cgtggtctttgaataaagtctg

SEQ ID NO: 2823313 - DNA, 21 bp, Homo sapiens
cgtggtgatcaattaaatgta

SEQ ID NO: 2823314 - DNA, 14 bp, Homo sapiens
ccccagttctgctc

SEQ ID NO: 2823315 - DNA, 13 bp, Homo sapiens
ccccatcccccac

SEQ ID NO: 2823316 - DNA, 16 bp, Homo sapiens
ccccatcccccactgc

SEQ ID NO: 2823317 - DNA, 15 bp, Homo sapiens
ccccatgacctccag

SEQ ID NO: 2823318 - DNA, 16 bp, Homo sapiens
ccccatgacctccagc

SEQ ID NO: 2823319 - DNA, 23 bp, Homo sapiens
ccccatggggctgcgggacagag

SEQ ID NO: 2823320 - DNA, 15 bp, Homo sapiens
ccccatgtctctcag

SEQ ID NO: 2823321 - DNA, 19 bp, Homo sapiens
ccagtctgggctgccgggt

SEQ ID NO: 2823322 - DNA, 15 bp, Homo sapiens
ccagtgaaccaaaga

SEQ ID NO: 2823323 - DNA, 12 bp, Homo sapiens
ccagtgacagct

SEQ ID NO: 2823324 - DNA, 20 bp, Homo sapiens
ccagtgcatgttgccatgag

SEQ ID NO: 2823325 - DNA, 14 bp, Homo sapiens
ccagtgccacagag

SEQ ID NO: 2823326 - DNA, 23 bp, Homo sapiens
ccagtgcccacaggatcagtctg

SEQ ID NO: 2823327 - DNA, 20 bp, Homo sapiens
ccagtgccgcctgtgcccac

SEQ ID NO: 2823328 - DNA, 17 bp, Homo sapiens
ccagtggtaccagctca

SEQ ID NO: 2823329 - DNA, 18 bp, Homo sapiens
ccagtggtaccagctcac

SEQ ID NO: 2823330 - DNA, 19 bp, Homo sapiens
ccagtgtaaagaataaatg

SEQ ID NO: 2823331 - DNA, 16 bp, Homo sapiens
ccagtgtactgctttc

SEQ ID NO: 2823332 - DNA, 14 bp, Homo sapiens
ccagtgtgacaagg

SEQ ID NO: 2823333 - DNA, 17 bp, Homo sapiens
ccagtgtggctgtctgc

SEQ ID NO: 2823334 - DNA, 20 bp, Homo sapiens
ccagtgtttagaagagcctg

SEQ ID NO: 2823335 - DNA, 19 bp, Homo sapiens
cccagtctggaatgcagtg

SEQ ID NO: 2823336 - DNA, 17 bp, Homo sapiens
cccagtctgttccccat

SEQ ID NO: 2823337 - DNA, 14 bp, Homo sapiens
cccagtgacagcta

SEQ ID NO: 2823338 - DNA, 16 bp, Homo sapiens
cccagtgcacttgctg

SEQ ID NO: 2823339 - DNA, 15 bp, Homo sapiens
cccagtgccacagag

SEQ ID NO: 2823340 - DNA, 16 bp, Homo sapiens
cccagtgccacagaga

SEQ ID NO: 2823341 - DNA, 17 bp, Homo sapiens
cccagtgccacagagaa

SEQ ID NO: 2823342 - DNA, 21 bp, Homo sapiens
cccagtgcccacaggatcagt

SEQ ID NO: 2823343 - DNA, 22 bp, Homo sapiens
cccagtgtaaagaataaatgaa

SEQ ID NO: 2823344 - DNA, 22 bp, Homo sapiens
ccagcaagtgagagctgggtgt

SEQ ID NO: 2823345 - DNA, 14 bp, Homo sapiens
ccagcactcctctg

SEQ ID NO: 2823346 - DNA, 16 bp, Homo sapiens
ccagcactcctctgtc

SEQ ID NO: 2823347 - DNA, 20 bp, Homo sapiens
ccagcactcctctgtctctg

SEQ ID NO: 2823348 - DNA, 17 bp, Homo sapiens
ccagcactgtgaagacc

SEQ ID NO: 2823349 - DNA, 14 bp, Homo sapiens
ccagcactttggga

SEQ ID NO: 2823350 - DNA, 19 bp, Homo sapiens
ccagcactttgggaggcca

SEQ ID NO: 2823351 - DNA, 21 bp, Homo sapiens
ccagcactttgggaggccaag

SEQ ID NO: 2823352 - DNA, 21 bp, Homo sapiens
ccagcagccagctctcagcca

SEQ ID NO: 2823353 - DNA, 18 bp, Homo sapiens
ccagcatgtcactcccag

SEQ ID NO: 2823354 - DNA, 14 bp, Homo sapiens
ccagcattttacta

SEQ ID NO: 2823355 - DNA, 13 bp, Homo sapiens
ccagccacacaga

SEQ ID NO: 2823356 - DNA, 23 bp, Homo sapiens
ccagccacctcttgggcatgctc

SEQ ID NO: 2823357 - DNA, 15 bp, Homo sapiens
ccagccagaagcctc

SEQ ID NO: 2823358 - DNA, 22 bp, Homo sapiens
ccagccagcaatgatgtccaga

SEQ ID NO: 2823359 - DNA, 13 bp, Homo sapiens
ccagccagcagcc

SEQ ID NO: 2823360 - DNA, 15 bp, Homo sapiens
ccagccagcagccag

SEQ ID NO: 2823361 - DNA, 14 bp, Homo sapiens
ccagccagcgcctc

SEQ ID NO: 2823362 - DNA, 17 bp, Homo sapiens
ccagccagcgcctccct

SEQ ID NO: 2823363 - DNA, 13 bp, Homo sapiens
ccagccagctcct

SEQ ID NO: 2823364 - DNA, 14 bp, Homo sapiens
ccagccagctcctg

SEQ ID NO: 2823365 - DNA, 13 bp, Homo sapiens
ccagcccagctgg

SEQ ID NO: 2823366 - DNA, 21 bp, Homo sapiens
ccagcccattctctctcctgt

SEQ ID NO: 2823367 - DNA, 17 bp, Homo sapiens
ccagccccagtgcccac

SEQ ID NO: 2823368 - DNA, 23 bp, Homo sapiens
ccagcccccacctccgccccaga

SEQ ID NO: 2823369 - DNA, 16 bp, Homo sapiens
ccagccccgactccag

SEQ ID NO: 2823370 - DNA, 18 bp, Homo sapiens
ccagccccgactccagcc

SEQ ID NO: 2823371 - DNA, 20 bp, Homo sapiens
ccagcccctcctccccttcc

SEQ ID NO: 2823372 - DNA, 15 bp, Homo sapiens
ccagccctatggatg

SEQ ID NO: 2823373 - DNA, 16 bp, Homo sapiens
ccagccctatggatgt

SEQ ID NO: 2823374 - DNA, 15 bp, Homo sapiens
ccagccctccctgtc

SEQ ID NO: 2823375 - DNA, 15 bp, Homo sapiens
ccagccctgcctgga

SEQ ID NO: 2823376 - DNA, 16 bp, Homo sapiens
ccagccctgcctggag

SEQ ID NO: 2823377 - DNA, 16 bp, Homo sapiens
ccagcccttccctgct

SEQ ID NO: 2823378 - DNA, 20 bp, Homo sapiens
ccagcccttgagctccccaa

SEQ ID NO: 2823379 - DNA, 23 bp, Homo sapiens
ccagccgtgatgctcaggcttga

SEQ ID NO: 2823380 - DNA, 12 bp, Homo sapiens
ccagcctggcca

SEQ ID NO: 2823381 - DNA, 18 bp, Homo sapiens
ccagcctggcctcctgcc

SEQ ID NO: 2823382 - DNA, 22 bp, Homo sapiens
ccagcctggcctcctgcctcta

SEQ ID NO: 2823383 - DNA, 13 bp, Homo sapiens
ccagcctggcttc

SEQ ID NO: 2823384 - DNA, 20 bp, Homo sapiens
ccagcctggcttctggagcc

SEQ ID NO: 2823385 - DNA, 12 bp, Homo sapiens
ccagcctgggcc

SEQ ID NO: 2823386 - DNA, 18 bp, Homo sapiens
ccagccttctctctctgg

SEQ ID NO: 2823387 - DNA, 17 bp, Homo sapiens
ccagcgagggcgtgtct

SEQ ID NO: 2823388 - DNA, 21 bp, Homo sapiens
ccagcgattccctctcccagg

SEQ ID NO: 2823389 - DNA, 22 bp, Homo sapiens
ccagcgattccctctcccaggc

SEQ ID NO: 2823390 - DNA, 23 bp, Homo sapiens
ccagcgattccctctcccaggcc

SEQ ID NO: 2823391 - DNA, 22 bp, Homo sapiens
ccagcgcctagtggggtctccc

SEQ ID NO: 2823392 - DNA, 13 bp, Homo sapiens
ccagcgcctccct

SEQ ID NO: 2823393 - DNA, 15 bp, Homo sapiens
ccagcgcctccctcc

SEQ ID NO: 2823394 - DNA, 19 bp, Homo sapiens
ccagcgcctccctccaccc

SEQ ID NO: 2823395 - DNA, 20 bp, Homo sapiens
ccagcgcctccctccacccc

SEQ ID NO: 2823396 - DNA, 23 bp, Homo sapiens
ccagctaatctgtagggctggac

SEQ ID NO: 2823397 - DNA, 15 bp, Homo sapiens
ccagctactcaggag

SEQ ID NO: 2823398 - DNA, 17 bp, Homo sapiens
ccagctactcaggaggc

SEQ ID NO: 2823399 - DNA, 15 bp, Homo sapiens
ccagctactcgggag

SEQ ID NO: 2823400 - DNA, 16 bp, Homo sapiens
ccagctagggctggac

SEQ ID NO: 2823401 - DNA, 20 bp, Homo sapiens
ccagctagggctggactctg

SEQ ID NO: 2823402 - DNA, 21 bp, Homo sapiens
ccagctagtgacccacatgcc

SEQ ID NO: 2823403 - DNA, 22 bp, Homo sapiens
ccagctagtgacccacatgcca

SEQ ID NO: 2823404 - DNA, 15 bp, Homo sapiens
ccagctcaccagccc

SEQ ID NO: 2823405 - DNA, 14 bp, Homo sapiens
ccagctcactccct

SEQ ID NO: 2823406 - DNA, 19 bp, Homo sapiens
ccagctcagaggcccagga

SEQ ID NO: 2823407 - DNA, 22 bp, Homo sapiens
ccagctcagaggcccaggaatc

SEQ ID NO: 2823408 - DNA, 15 bp, Homo sapiens
ccagctccccaggac

SEQ ID NO: 2823409 - DNA, 12 bp, Homo sapiens
ccagctctcagc

SEQ ID NO: 2823410 - DNA, 14 bp, Homo sapiens
ccagctctcagcca

SEQ ID NO: 2823411 - DNA, 15 bp, Homo sapiens
ccagctctcagccaa

SEQ ID NO: 2823412 - DNA, 16 bp, Homo sapiens
ccagctctccctctgg

SEQ ID NO: 2823413 - DNA, 17 bp, Homo sapiens
ccagctctccctctggc

SEQ ID NO: 2823414 - DNA, 20 bp, Homo sapiens
ccagctctccctctggccct

SEQ ID NO: 2823415 - DNA, 21 bp, Homo sapiens
ccactctggcagccacacttc

SEQ ID NO: 2823416 - DNA, 16 bp, Homo sapiens
ccactgaagctgggat

SEQ ID NO: 2823417 - DNA, 17 bp, Homo sapiens
ccactgcaccgggccac

SEQ ID NO: 2823418 - DNA, 19 bp, Homo sapiens
ccactgcaccgggccacag

SEQ ID NO: 2823419 - DNA, 17 bp, Homo sapiens
ccactgcactccagcct

SEQ ID NO: 2823420 - DNA, 14 bp, Homo sapiens
ccactgcagagatg

SEQ ID NO: 2823421 - DNA, 17 bp, Homo sapiens
ccactgcagagatggtg

SEQ ID NO: 2823422 - DNA, 17 bp, Homo sapiens
ccactgcaggccccgct

SEQ ID NO: 2823423 - DNA, 17 bp, Homo sapiens
ccactgctctcagcctc

SEQ ID NO: 2823424 - DNA, 19 bp, Homo sapiens
ccactgctctcagcctccc

SEQ ID NO: 2823425 - DNA, 11 bp, Homo sapiens
ccactgctctg

SEQ ID NO: 2823426 - DNA, 15 bp, Homo sapiens
ccactggtttctcag

SEQ ID NO: 2823427 - DNA, 16 bp, Homo sapiens
ccactggtttctcaga

SEQ ID NO: 2823428 - DNA, 16 bp, Homo sapiens
ccactgtcttgcctgc

SEQ ID NO: 2823429 - DNA, 22 bp, Homo sapiens
ccactgtcttgcctgccagggc

SEQ ID NO: 2823430 - DNA, 15 bp, Homo sapiens
ccactgtgccatgtg

SEQ ID NO: 2823431 - DNA, 16 bp, Homo sapiens
ccactgtgccatgtgc

SEQ ID NO: 2823432 - DNA, 18 bp, Homo sapiens
ccactgtgcttacagtga

SEQ ID NO: 2823433 - DNA, 16 bp, Homo sapiens
ccactgtggcgttctg

SEQ ID NO: 2823434 - DNA, 12 bp, Homo sapiens
ccacttacctag

SEQ ID NO: 2823435 - DNA, 13 bp, Homo sapiens
ccacttaccttca

SEQ ID NO: 2823436 - DNA, 22 bp, Homo sapiens
ccacttaccttcaataaagtat

SEQ ID NO: 2823437 - DNA, 23 bp, Homo sapiens
ccacttcattcttgaaagctgtg

SEQ ID NO: 2823438 - DNA, 19 bp, Homo sapiens
ccacttctctactctggaa

SEQ ID NO: 2823439 - DNA, 12 bp, Homo sapiens
ccacttctctcc

SEQ ID NO: 2823440 - DNA, 14 bp, Homo sapiens
ccacttctctccag

SEQ ID NO: 2823441 - DNA, 17 bp, Homo sapiens
ccacttgaggctggcac

SEQ ID NO: 2823442 - DNA, 20 bp, Homo sapiens
ccactttgcacagctctccg

SEQ ID NO: 2823443 - DNA, 21 bp, Homo sapiens
ccactttggtacatggccagt

SEQ ID NO: 2823444 - DNA, 15 bp, Homo sapiens
ccagaaaaccccagc

SEQ ID NO: 2823445 - DNA, 18 bp, Homo sapiens
ccagaaaacctccagtag

SEQ ID NO: 2823446 - DNA, 12 bp, Homo sapiens
ccagaaaatata

SEQ ID NO: 2823447 - DNA, 16 bp, Homo sapiens
ccagaaaatataaatg

SEQ ID NO: 2823448 - DNA, 17 bp, Homo sapiens
ccagaaaatataaatgc

SEQ ID NO: 2823449 - DNA, 12 bp, Homo sapiens
ccagaaagaaaa

SEQ ID NO: 2823450 - DNA, 21 bp, Homo sapiens
ccagaaataaagttggtgaca

SEQ ID NO: 2823451 - DNA, 17 bp, Homo sapiens
ccagaagaatattcagg

SEQ ID NO: 2823452 - DNA, 16 bp, Homo sapiens
ccagaagccaaagact

SEQ ID NO: 2823453 - DNA, 20 bp, Homo sapiens
ccagaagcccatggagcagg

SEQ ID NO: 2823454 - DNA, 12 bp, Homo sapiens
ccagaagcctct

SEQ ID NO: 2823455 - DNA, 12 bp, Homo sapiens
ccagaaggcagg

SEQ ID NO: 2823456 - DNA, 22 bp, Homo sapiens
ccagaaggggcacgcctgccca

SEQ ID NO: 2823457 - DNA, 23 bp, Homo sapiens
ccagaaggggcacgcctgcccag

SEQ ID NO: 2823458 - DNA, 14 bp, Homo sapiens
ccagaataagtgct

SEQ ID NO: 2823459 - DNA, 17 bp, Homo sapiens
ccagaataagtgctgtt

SEQ ID NO: 2823460 - DNA, 21 bp, Homo sapiens
ccagaattcccagctgtctgt

SEQ ID NO: 2823461 - DNA, 14 bp, Homo sapiens
ccagaattgcattc

SEQ ID NO: 2823462 - DNA, 14 bp, Homo sapiens
ccagacacaccccc

SEQ ID NO: 2823463 - DNA, 19 bp, Homo sapiens
ccagacaccttgacagggc

SEQ ID NO: 2823464 - DNA, 21 bp, Homo sapiens
ccagacaccttgacagggcac

SEQ ID NO: 2823465 - DNA, 12 bp, Homo sapiens
ccagacactggt

SEQ ID NO: 2823466 - DNA, 19 bp, Homo sapiens
ccagacatgtggtgggaca

SEQ ID NO: 2823467 - DNA, 14 bp, Homo sapiens
ccagacccggctgc

SEQ ID NO: 2823468 - DNA, 15 bp, Homo sapiens
ccagacccggctgcg

SEQ ID NO: 2823469 - DNA, 16 bp, Homo sapiens
ccagacccggctgcgt

SEQ ID NO: 2823470 - DNA, 14 bp, Homo sapiens
ccagaccttttatc

SEQ ID NO: 2823471 - DNA, 12 bp, Homo sapiens
ccagactgtgga

SEQ ID NO: 2823472 - DNA, 12 bp, Homo sapiens
ccagagacagga

SEQ ID NO: 2823473 - DNA, 13 bp, Homo sapiens
ccagagacaggaa

SEQ ID NO: 2823474 - DNA, 14 bp, Homo sapiens
ccagagacaggaaa

SEQ ID NO: 2823475 - DNA, 19 bp, Homo sapiens
ccagagacggaagcctttt

SEQ ID NO: 2823476 - DNA, 16 bp, Homo sapiens
ccagagaggaatcaga

SEQ ID NO: 2823477 - DNA, 21 bp, Homo sapiens
ccagagaggggacatttccct

SEQ ID NO: 2823478 - DNA, 14 bp, Homo sapiens
ccagagagtcctct

SEQ ID NO: 2823479 - DNA, 18 bp, Homo sapiens
ccagagagtcctctggat

SEQ ID NO: 2823480 - DNA, 18 bp, Homo sapiens
ccagagatgcctccaccg

SEQ ID NO: 2823481 - DNA, 14 bp, Homo sapiens
ccagagcagagagc

SEQ ID NO: 2823482 - DNA, 23 bp, Homo sapiens
ccagagcattacgtgagccaggt

SEQ ID NO: 2823483 - DNA, 17 bp, Homo sapiens
ccagagcccatgctcaa

SEQ ID NO: 2823484 - DNA, 10 bp, Homo sapiens
ccagagcccc

SEQ ID NO: 2823485 - DNA, 20 bp, Homo sapiens
ccaacccgtggaggctgctc

SEQ ID NO: 2823486 - DNA, 20 bp, Homo sapiens
ccaacctccccgcagagctc

SEQ ID NO: 2823487 - DNA, 14 bp, Homo sapiens
ccaacctcctgacc

SEQ ID NO: 2823488 - DNA, 22 bp, Homo sapiens
ccaacctgaccaacatggagaa

SEQ ID NO: 2823489 - DNA, 13 bp, Homo sapiens
ccaacctggacaa

SEQ ID NO: 2823490 - DNA, 19 bp, Homo sapiens
ccaacctttccctcacccc

SEQ ID NO: 2823491 - DNA, 20 bp, Homo sapiens
ccaacctttccctcaccccc

SEQ ID NO: 2823492 - DNA, 14 bp, Homo sapiens
ccaactcacctgag

SEQ ID NO: 2823493 - DNA, 19 bp, Homo sapiens
ccaactcctggaagctgtg

SEQ ID NO: 2823494 - DNA, 16 bp, Homo sapiens
ccaactccttccagct

SEQ ID NO: 2823495 - DNA, 18 bp, Homo sapiens
ccaagagcatcatgcctc

SEQ ID NO: 2823496 - DNA, 22 bp, Homo sapiens
ccaagagctgaggcaattctaa

SEQ ID NO: 2823497 - DNA, 22 bp, Homo sapiens
ccaagccttggggattcttcca

SEQ ID NO: 2823498 - DNA, 13 bp, Homo sapiens
ccaagctcacagt

SEQ ID NO: 2823499 - DNA, 12 bp, Homo sapiens
ccaagctctgct

SEQ ID NO: 2823500 - DNA, 14 bp, Homo sapiens
ccaagctctgctcc

SEQ ID NO: 2823501 - DNA, 15 bp, Homo sapiens
ccaagctctgctcct

SEQ ID NO: 2823502 - DNA, 16 bp, Homo sapiens
ccaagctctgctcctc

SEQ ID NO: 2823503 - DNA, 13 bp, Homo sapiens
ccaagctgaggtg

SEQ ID NO: 2823504 - DNA, 15 bp, Homo sapiens
ccaagctgaggtgcc

SEQ ID NO: 2823505 - DNA, 17 bp, Homo sapiens
ccaagctgaggtgccca

SEQ ID NO: 2823506 - DNA, 20 bp, Homo sapiens
ccaagctgaggtgcccagga

SEQ ID NO: 2823507 - DNA, 21 bp, Homo sapiens
ccaagctgaggtgcccaggag

SEQ ID NO: 2823508 - DNA, 22 bp, Homo sapiens
ccaagctgaggtgcccaggaga

SEQ ID NO: 2823509 - DNA, 12 bp, Homo sapiens
ccaagctggcag

SEQ ID NO: 2823510 - DNA, 12 bp, Homo sapiens
ccaagctggtcc

SEQ ID NO: 2823511 - DNA, 20 bp, Homo sapiens
ccaagctggtcccactcagt

SEQ ID NO: 2823512 - DNA, 14 bp, Homo sapiens
ccaagctgttttct

SEQ ID NO: 2823513 - DNA, 18 bp, Homo sapiens
ccaagctgttttcttcta

SEQ ID NO: 2823514 - DNA, 22 bp, Homo sapiens
ccaagcttcaaccctcagcctt

SEQ ID NO: 2823515 - DNA, 23 bp, Homo sapiens
ccaagcttcaaccctcagccttg

SEQ ID NO: 2823516 - DNA, 15 bp, Homo sapiens
ccaagcttcaagtga

SEQ ID NO: 2823517 - DNA, 23 bp, Homo sapiens
ccaagctttcttctacaaccaga

SEQ ID NO: 2823518 - DNA, 21 bp, Homo sapiens
ccaaggagaaacagagacagg

SEQ ID NO: 2823519 - DNA, 13 bp, Homo sapiens
ccaaggaggaaaa

SEQ ID NO: 2823520 - DNA, 20 bp, Homo sapiens
ccaagggttcagagactcag

SEQ ID NO: 2823521 - DNA, 19 bp, Homo sapiens
ccaaggtcttcagccatca

SEQ ID NO: 2823522 - DNA, 15 bp, Homo sapiens
ccaagtccaggtcct

SEQ ID NO: 2823523 - DNA, 13 bp, Homo sapiens
ccaagtggctccc

SEQ ID NO: 2823524 - DNA, 18 bp, Homo sapiens
ccaagtgggggcagaggg

SEQ ID NO: 2823525 - DNA, 15 bp, Homo sapiens
ccaagttataaatca

SEQ ID NO: 2823526 - DNA, 11 bp, Homo sapiens
ccaataaaagt

SEQ ID NO: 2823527 - DNA, 21 bp, Homo sapiens
ccaataaaagtgactctcagc

SEQ ID NO: 2823528 - DNA, 13 bp, Homo sapiens
ccaataaagctgg

SEQ ID NO: 2823529 - DNA, 18 bp, Homo sapiens
ccaataacttcagagaag

SEQ ID NO: 2823530 - DNA, 20 bp, Homo sapiens
ccaataacttcagagaagtc

SEQ ID NO: 2823531 - DNA, 14 bp, Homo sapiens
ccaatatttgtaga

SEQ ID NO: 2823532 - DNA, 13 bp, Homo sapiens
ccaatctctgtga

SEQ ID NO: 2823533 - DNA, 18 bp, Homo sapiens
ccaatgcacctaaagaaa

SEQ ID NO: 2823534 - DNA, 15 bp, Homo sapiens
ccaatgtacccaccg

SEQ ID NO: 2823535 - DNA, 14 bp, Homo sapiens
ccaattaaaatata

SEQ ID NO: 2823536 - DNA, 16 bp, Homo sapiens
ccaattaaaatatata

SEQ ID NO: 2823537 - DNA, 18 bp, Homo sapiens
ccaattaaaatatatata

SEQ ID NO: 2823538 - DNA, 21 bp, Homo sapiens
ccaattaaaatatatataaat

SEQ ID NO: 2823539 - DNA, 22 bp, Homo sapiens
ccaattatgtgacaacctttgt

SEQ ID NO: 2823540 - DNA, 19 bp, Homo sapiens
ccaattccacagtctctgg

SEQ ID NO: 2823541 - DNA, 15 bp, Homo sapiens
ccaatttaattccat

SEQ ID NO: 2823542 - DNA, 14 bp, Homo sapiens
ccacaaccaggaag

SEQ ID NO: 2823543 - DNA, 16 bp, Homo sapiens
ccacaagattcccaga

SEQ ID NO: 2823544 - DNA, 20 bp, Homo sapiens
ccacaagattcccagagaca

SEQ ID NO: 2823545 - DNA, 24 bp, Homo sapiens
ccacaagattcccagagacaggaa

SEQ ID NO: 2823546 - DNA, 16 bp, Homo sapiens
ccacacacagaggaag

SEQ ID NO: 2823547 - DNA, 18 bp, Homo sapiens
ccacacacgcaggaactc

SEQ ID NO: 2823548 - DNA, 12 bp, Homo sapiens
ccacacagagcc

SEQ ID NO: 2823549 - DNA, 14 bp, Homo sapiens
ccacacagagcctg

SEQ ID NO: 2823550 - DNA, 21 bp, Homo sapiens
ccacacatgaaccatccttcc

SEQ ID NO: 2823551 - DNA, 14 bp, Homo sapiens
ccacacccagccca

SEQ ID NO: 2823552 - DNA, 20 bp, Homo sapiens
ccacacccagcccacttctg

SEQ ID NO: 2823553 - DNA, 21 bp, Homo sapiens
ccacacccagcccacttctgc

SEQ ID NO: 2823554 - DNA, 18 bp, Homo sapiens
ccacacccggctccccct

SEQ ID NO: 2823555 - DNA, 18 bp, Homo sapiens
ccacactattaccatgag

SEQ ID NO: 2823556 - DNA, 20 bp, Homo sapiens
ccacactattaccatgagaa

SEQ ID NO: 2823557 - DNA, 14 bp, Homo sapiens
ccacactggtgact

SEQ ID NO: 2823558 - DNA, 15 bp, Homo sapiens
ccacacttctcagga

SEQ ID NO: 2823559 - DNA, 18 bp, Homo sapiens
ccacacttctcaggacac

SEQ ID NO: 2823560 - DNA, 18 bp, Homo sapiens
ccacagaactgcttacta

SEQ ID NO: 2823561 - DNA, 18 bp, Homo sapiens
ccacagaagccaggagca

SEQ ID NO: 2823562 - DNA, 16 bp, Homo sapiens
ccacagaccacctgct

SEQ ID NO: 2823563 - DNA, 17 bp, Homo sapiens
ccacagcctctgcctgt

SEQ ID NO: 2823564 - DNA, 19 bp, Homo sapiens
ccacagcggaggagaccag

SEQ ID NO: 2823565 - DNA, 21 bp, Homo sapiens
ccacagcggaggagaccagct

SEQ ID NO: 2823566 - DNA, 13 bp, Homo sapiens
ccacagctcccac

SEQ ID NO: 2823567 - DNA, 19 bp, Homo sapiens
ccacaggcatctacacagc

SEQ ID NO: 2823568 - DNA, 23 bp, Homo sapiens
ccacaggcatctacacagcctgg

SEQ ID NO: 2823569 - DNA, 17 bp, Homo sapiens
ccacagggccagatgtg

SEQ ID NO: 2823570 - DNA, 14 bp, Homo sapiens
ccacagggctaaga

SEQ ID NO: 2823571 - DNA, 19 bp, Homo sapiens
ccacagtgcccagctaatt

SEQ ID NO: 2823572 - DNA, 12 bp, Homo sapiens
ccacagtgtctg

SEQ ID NO: 2823573 - DNA, 20 bp, Homo sapiens
ccacagttgctgctcctttg

SEQ ID NO: 2823574 - DNA, 22 bp, Homo sapiens
ccacatccacacacgcaggaac

SEQ ID NO: 2823575 - DNA, 16 bp, Homo sapiens
cagtaactcatctgtc

SEQ ID NO: 2823576 - DNA, 14 bp, Homo sapiens
cagtaatttagaaa

SEQ ID NO: 2823577 - DNA, 15 bp, Homo sapiens
cagtagcttaaataa

SEQ ID NO: 2823578 - DNA, 17 bp, Homo sapiens
cagtagcttaaataaat

SEQ ID NO: 2823579 - DNA, 19 bp, Homo sapiens
cagtagcttaaataaattc

SEQ ID NO: 2823580 - DNA, 21 bp, Homo sapiens
cagtagcttaaataaattcaa

SEQ ID NO: 2823581 - DNA, 17 bp, Homo sapiens
cagtagtctctgtgctt

SEQ ID NO: 2823582 - DNA, 23 bp, Homo sapiens
cagtagtctctgtgctttgactc

SEQ ID NO: 2823583 - DNA, 16 bp, Homo sapiens
cagtagtttgagacca

SEQ ID NO: 2823584 - DNA, 18 bp, Homo sapiens
cagtagtttgagaccagc

SEQ ID NO: 2823585 - DNA, 14 bp, Homo sapiens
cagtataaaagaca

SEQ ID NO: 2823586 - DNA, 13 bp, Homo sapiens
cagtatatttata

SEQ ID NO: 2823587 - DNA, 14 bp, Homo sapiens
cagtatatttatag

SEQ ID NO: 2823588 - DNA, 15 bp, Homo sapiens
cagtatgaatgatgt

SEQ ID NO: 2823589 - DNA, 18 bp, Homo sapiens
cagtcacactgttactcc

SEQ ID NO: 2823590 - DNA, 21 bp, Homo sapiens
cagtcacactgttactccaca

SEQ ID NO: 2823591 - DNA, 16 bp, Homo sapiens
cagtcagtaattgcca

SEQ ID NO: 2823592 - DNA, 16 bp, Homo sapiens
cagtccagaataagtg

SEQ ID NO: 2823593 - DNA, 14 bp, Homo sapiens
cagtccagccagct

SEQ ID NO: 2823594 - DNA, 20 bp, Homo sapiens
cagtcccccaccacactgaa

SEQ ID NO: 2823595 - DNA, 18 bp, Homo sapiens
cagtccccgtgccccgcc

SEQ ID NO: 2823596 - DNA, 12 bp, Homo sapiens
cagtccctgggg

SEQ ID NO: 2823597 - DNA, 17 bp, Homo sapiens
cagtccgtccaccacct

SEQ ID NO: 2823598 - DNA, 16 bp, Homo sapiens
cagtcctcttattcct

SEQ ID NO: 2823599 - DNA, 17 bp, Homo sapiens
cagtcctcttattccta

SEQ ID NO: 2823600 - DNA, 13 bp, Homo sapiens
cagtcctgggaga

SEQ ID NO: 2823601 - DNA, 23 bp, Homo sapiens
cagtcctgggagaacctcaggct

SEQ ID NO: 2823602 - DNA, 16 bp, Homo sapiens
cagtcgagccctgcag

SEQ ID NO: 2823603 - DNA, 18 bp, Homo sapiens
cagtcgagccctgcagcc

SEQ ID NO: 2823604 - DNA, 17 bp, Homo sapiens
cagtcgttggcaccttc

SEQ ID NO: 2823605 - DNA, 18 bp, Homo sapiens
cagtctcaagcactaaaa

SEQ ID NO: 2823606 - DNA, 18 bp, Homo sapiens
cagtctcaggagcatggg

SEQ ID NO: 2823607 - DNA, 22 bp, Homo sapiens
cagtctcgggtggctagtcaga

SEQ ID NO: 2823608 - DNA, 23 bp, Homo sapiens
cagtctctgggagactttcccta

SEQ ID NO: 2823609 - DNA, 21 bp, Homo sapiens
cagtctgattcccaagctctg

SEQ ID NO: 2823610 - DNA, 19 bp, Homo sapiens
cagtctggaatgcagtggt

SEQ ID NO: 2823611 - DNA, 13 bp, Homo sapiens
cagtgaaagcatc

SEQ ID NO: 2823612 - DNA, 14 bp, Homo sapiens
cagtgaaagcatca

SEQ ID NO: 2823613 - DNA, 21 bp, Homo sapiens
cagtgaaccaaagagactgga

SEQ ID NO: 2823614 - DNA, 18 bp, Homo sapiens
cagtgacgtgcacctgta

SEQ ID NO: 2823615 - DNA, 23 bp, Homo sapiens
cagtgactgtcgtgtttacaaaa

SEQ ID NO: 2823616 - DNA, 17 bp, Homo sapiens
cagtgagtcgaggacag

SEQ ID NO: 2823617 - DNA, 19 bp, Homo sapiens
cagtgagtcgaggacaggg

SEQ ID NO: 2823618 - DNA, 20 bp, Homo sapiens
cagtgagtcgaggacaggga

SEQ ID NO: 2823619 - DNA, 18 bp, Homo sapiens
cagtgagtctcttcagaa

SEQ ID NO: 2823620 - DNA, 21 bp, Homo sapiens
cagtgatctccatatgttaca

SEQ ID NO: 2823621 - DNA, 14 bp, Homo sapiens
cagtgccacagaga

SEQ ID NO: 2823622 - DNA, 15 bp, Homo sapiens
cagtgccacagagaa

SEQ ID NO: 2823623 - DNA, 13 bp, Homo sapiens
cagtgcccacagg

SEQ ID NO: 2823624 - DNA, 11 bp, Homo sapiens
cagtgcctgct

SEQ ID NO: 2823625 - DNA, 16 bp, Homo sapiens
cagtgcctggcaaggc

SEQ ID NO: 2823626 - DNA, 18 bp, Homo sapiens
cagtgccttacctcctgc

SEQ ID NO: 2823627 - DNA, 21 bp, Homo sapiens
cagtgccttacctcctgccca

SEQ ID NO: 2823628 - DNA, 14 bp, Homo sapiens
cagtgccttccata

SEQ ID NO: 2823629 - DNA, 15 bp, Homo sapiens
cagtgccttccataa

SEQ ID NO: 2823630 - DNA, 16 bp, Homo sapiens
cagtgccttccataat

SEQ ID NO: 2823631 - DNA, 13 bp, Homo sapiens
cagtgccttggag

SEQ ID NO: 2823632 - DNA, 23 bp, Homo sapiens
cagtgccttggagcagaaagcca

SEQ ID NO: 2823633 - DNA, 12 bp, Homo sapiens
cagtgctcggca

SEQ ID NO: 2823634 - DNA, 15 bp, Homo sapiens
cagtgctgtggcctg

SEQ ID NO: 2823635 - DNA, 20 bp, Homo sapiens
cagtgctgtggcctgggcaa

SEQ ID NO: 2823636 - DNA, 15 bp, Homo sapiens
cagtgcttcagcctg

SEQ ID NO: 2823637 - DNA, 17 bp, Homo sapiens
cagtgcttcagcctgag

SEQ ID NO: 2823638 - DNA, 20 bp, Homo sapiens
cagtgcttcagcctgaggct

SEQ ID NO: 2823639 - DNA, 15 bp, Homo sapiens
cagtggagaaatatt

SEQ ID NO: 2823640 - DNA, 14 bp, Homo sapiens
cagtggattaatta

SEQ ID NO: 2823641 - DNA, 14 bp, Homo sapiens
cagtggcagctgct

SEQ ID NO: 2823642 - DNA, 16 bp, Homo sapiens
cagtggcagctgcttt

SEQ ID NO: 2823643 - DNA, 13 bp, Homo sapiens
cagtggctgtcac

SEQ ID NO: 2823644 - DNA, 19 bp, Homo sapiens
cagtgggaacgtgactgcc

SEQ ID NO: 2823645 - DNA, 20 bp, Homo sapiens
cagtgggaacgtgactgccc

SEQ ID NO: 2823646 - DNA, 21 bp, Homo sapiens
cagtgggaacgtgactgcccc

SEQ ID NO: 2823647 - DNA, 22 bp, Homo sapiens
cagtgggaacgtgactgcccca

SEQ ID NO: 2823648 - DNA, 11 bp, Homo sapiens
cagtgggacaa

SEQ ID NO: 2823649 - DNA, 20 bp, Homo sapiens
cagtgggacaaaccagagca

SEQ ID NO: 2823650 - DNA, 14 bp, Homo sapiens
cagtgggagaaaac

SEQ ID NO: 2823651 - DNA, 22 bp, Homo sapiens
cagtgggagggtaccagcagaa

SEQ ID NO: 2823652 - DNA, 17 bp, Homo sapiens
cagtggtaccagctcac

SEQ ID NO: 2823653 - DNA, 18 bp, Homo sapiens
cagtggtaccagctcact

SEQ ID NO: 2823654 - DNA, 23 bp, Homo sapiens
cagtggtaccagctcactccctg

SEQ ID NO: 2823655 - DNA, 20 bp, Homo sapiens
cagtggtatgatcacggctc

SEQ ID NO: 2823656 - DNA, 18 bp, Homo sapiens
cagtggtcaaaccgcact

SEQ ID NO: 2823657 - DNA, 14 bp, Homo sapiens
cagtgtactgcttt

SEQ ID NO: 2823658 - DNA, 16 bp, Homo sapiens
cagtgtactgctttca

SEQ ID NO: 2823659 - DNA, 17 bp, Homo sapiens
cagtgtatggaaataaa

SEQ ID NO: 2823660 - DNA, 18 bp, Homo sapiens
cagtgtcctcttgctcaa

SEQ ID NO: 2823661 - DNA, 14 bp, Homo sapiens
cagtgtctcggagg

SEQ ID NO: 2823662 - DNA, 23 bp, Homo sapiens
cagtgtctgtatcggagacagtg

SEQ ID NO: 2823663 - DNA, 14 bp, Homo sapiens
cagtgtcttccata

SEQ ID NO: 2823664 - DNA, 15 bp, Homo sapiens
cagtgtcttccataa

SEQ ID NO: 2823665 - DNA, 17 bp, Homo sapiens
cagtgtcttccataatg

SEQ ID NO: 2823666 - DNA, 21 bp, Homo sapiens
cagccgctcctgtctgccagc

SEQ ID NO: 2823667 - DNA, 14 bp, Homo sapiens
cagccgcttctgac

SEQ ID NO: 2823668 - DNA, 18 bp, Homo sapiens
cagccgcttctgactgct

SEQ ID NO: 2823669 - DNA, 15 bp, Homo sapiens
cagccggggcgagtg

SEQ ID NO: 2823670 - DNA, 18 bp, Homo sapiens
cagccgggtacctcagtt

SEQ ID NO: 2823671 - DNA, 20 bp, Homo sapiens
cagccgggtacctcagtttc

SEQ ID NO: 2823672 - DNA, 18 bp, Homo sapiens
cagccgtcagccaaatgt

SEQ ID NO: 2823673 - DNA, 19 bp, Homo sapiens
cagcctcaacctcctgggc

SEQ ID NO: 2823674 - DNA, 20 bp, Homo sapiens
cagcctccaagctccatctc

SEQ ID NO: 2823675 - DNA, 14 bp, Homo sapiens
cagcctccatgctg

SEQ ID NO: 2823676 - DNA, 17 bp, Homo sapiens
cagcctccatgctgcct

SEQ ID NO: 2823677 - DNA, 20 bp, Homo sapiens
cagcctccatgctgcctcca

SEQ ID NO: 2823678 - DNA, 19 bp, Homo sapiens
cagcctcccaaagtgctgg

SEQ ID NO: 2823679 - DNA, 23 bp, Homo sapiens
cagcctcccaaagtgctgggatt

SEQ ID NO: 2823680 - DNA, 18 bp, Homo sapiens
cagcctcccaaccccagg

SEQ ID NO: 2823681 - DNA, 20 bp, Homo sapiens
cagcctcccgaatagctggg

SEQ ID NO: 2823682 - DNA, 21 bp, Homo sapiens
cagcctcccgaatagctggga

SEQ ID NO: 2823683 - DNA, 22 bp, Homo sapiens
cagcctcccgaatagctgggac

SEQ ID NO: 2823684 - DNA, 23 bp, Homo sapiens
cagcctcccgaatagctgggact

SEQ ID NO: 2823685 - DNA, 19 bp, Homo sapiens
cagcctcccgagtagctgg

SEQ ID NO: 2823686 - DNA, 21 bp, Homo sapiens
cagcctcccgagtagctggga

SEQ ID NO: 2823687 - DNA, 22 bp, Homo sapiens
cagcctcccgagtagctgggac

SEQ ID NO: 2823688 - DNA, 23 bp, Homo sapiens
cagcctccctctgacctgcaggc

SEQ ID NO: 2823689 - DNA, 21 bp, Homo sapiens
cagcctctgtccctctttgcc

SEQ ID NO: 2823690 - DNA, 15 bp, Homo sapiens
cagcctcttaaagct

SEQ ID NO: 2823691 - DNA, 19 bp, Homo sapiens
cagcctcttaaagctgcct

SEQ ID NO: 2823692 - DNA, 20 bp, Homo sapiens
cagcctcttaaagctgcctg

SEQ ID NO: 2823693 - DNA, 19 bp, Homo sapiens
cagcctgaggctgagactg

SEQ ID NO: 2823694 - DNA, 15 bp, Homo sapiens
cagcctgagtctcct

SEQ ID NO: 2823695 - DNA, 18 bp, Homo sapiens
cagcctgcagactcactg

SEQ ID NO: 2823696 - DNA, 16 bp, Homo sapiens
cagcctggcctcctgc

SEQ ID NO: 2823697 - DNA, 18 bp, Homo sapiens
cagcctggcctcctgcct

SEQ ID NO: 2823698 - DNA, 18 bp, Homo sapiens
cagcctgggaccagggca

SEQ ID NO: 2823699 - DNA, 13 bp, Homo sapiens
cagcctgggccta

SEQ ID NO: 2823700 - DNA, 18 bp, Homo sapiens
cagcctgggcctatggag

SEQ ID NO: 2823701 - DNA, 15 bp, Homo sapiens
cagcctgggcgacag

SEQ ID NO: 2823702 - DNA, 18 bp, Homo sapiens
cagcctggtagaattggg

SEQ ID NO: 2823703 - DNA, 15 bp, Homo sapiens
cagcctggtgggcct

SEQ ID NO: 2823704 - DNA, 16 bp, Homo sapiens
cagcctggtgggcctc

SEQ ID NO: 2823705 - DNA, 14 bp, Homo sapiens
cagcctgtgctgcc

SEQ ID NO: 2823706 - DNA, 16 bp, Homo sapiens
cagcctgtgctgcccg

SEQ ID NO: 2823707 - DNA, 12 bp, Homo sapiens
cagcctgtggcg

SEQ ID NO: 2823708 - DNA, 20 bp, Homo sapiens
cagcctgtggcggtgcctgg

SEQ ID NO: 2823709 - DNA, 21 bp, Homo sapiens
cagccttccccctcccagggc

SEQ ID NO: 2823710 - DNA, 21 bp, Homo sapiens
cagccttccccttgcccaggg

SEQ ID NO: 2823711 - DNA, 23 bp, Homo sapiens
cagccttccccttgcccagggct

SEQ ID NO: 2823712 - DNA, 16 bp, Homo sapiens
cagccttctctctctg

SEQ ID NO: 2823713 - DNA, 20 bp, Homo sapiens
cagccttctctctctggtca

SEQ ID NO: 2823714 - DNA, 12 bp, Homo sapiens
cagcctttctgt

SEQ ID NO: 2823715 - DNA, 23 bp, Homo sapiens
cagcgagacccttgcattagaaa

SEQ ID NO: 2823716 - DNA, 20 bp, Homo sapiens
cagcgagaggcagagaaaga

SEQ ID NO: 2823717 - DNA, 13 bp, Homo sapiens
cagcgagccctgg

SEQ ID NO: 2823718 - DNA, 16 bp, Homo sapiens
cagcgagccctggtgg

SEQ ID NO: 2823719 - DNA, 20 bp, Homo sapiens
cagcgattccctctcccagg

SEQ ID NO: 2823720 - DNA, 22 bp, Homo sapiens
cagcgattccctctcccaggcc

SEQ ID NO: 2823721 - DNA, 15 bp, Homo sapiens
cagcgcctccctcca

SEQ ID NO: 2823722 - DNA, 22 bp, Homo sapiens
cagcgcctccctccaccccagg

SEQ ID NO: 2823723 - DNA, 19 bp, Homo sapiens
cagcggaggagaccagctc

SEQ ID NO: 2823724 - DNA, 19 bp, Homo sapiens
cagcggggacagctccttc

SEQ ID NO: 2823725 - DNA, 18 bp, Homo sapiens
cagcggggccccagggct

SEQ ID NO: 2823726 - DNA, 18 bp, Homo sapiens
cagcgtggccttgttctg

SEQ ID NO: 2823727 - DNA, 15 bp, Homo sapiens
cagcgtttctccacc

SEQ ID NO: 2823728 - DNA, 18 bp, Homo sapiens
cagctaaagcccaacctc

SEQ ID NO: 2823729 - DNA, 22 bp, Homo sapiens
cagctaaagcccaacctcctga

SEQ ID NO: 2823730 - DNA, 16 bp, Homo sapiens
cagctaatgggacact

SEQ ID NO: 2823731 - DNA, 14 bp, Homo sapiens
cagctacacctgag

SEQ ID NO: 2823732 - DNA, 20 bp, Homo sapiens
cagctactcaagaggctgag

SEQ ID NO: 2823733 - DNA, 15 bp, Homo sapiens
cagctactcagaagc

SEQ ID NO: 2823734 - DNA, 19 bp, Homo sapiens
cagctactcagaagcctga

SEQ ID NO: 2823735 - DNA, 20 bp, Homo sapiens
cagctactcagaagcctgag

SEQ ID NO: 2823736 - DNA, 22 bp, Homo sapiens
cagctactcagaagcctgaggc

SEQ ID NO: 2823737 - DNA, 23 bp, Homo sapiens
cagctactcagaagcctgaggct

SEQ ID NO: 2823738 - DNA, 18 bp, Homo sapiens
cagctactcaggaggctg

SEQ ID NO: 2823739 - DNA, 15 bp, Homo sapiens
cagctacttgggagg

SEQ ID NO: 2823740 - DNA, 15 bp, Homo sapiens
cagctagtgacccac

SEQ ID NO: 2823741 - DNA, 18 bp, Homo sapiens
cagctagtgacccacatg

SEQ ID NO: 2823742 - DNA, 20 bp, Homo sapiens
cagctagtgacccacatgcc

SEQ ID NO: 2823743 - DNA, 22 bp, Homo sapiens
cagctagtgacccacatgccat

SEQ ID NO: 2823744 - DNA, 19 bp, Homo sapiens
cagctcaagtcttccctga

SEQ ID NO: 2823745 - DNA, 22 bp, Homo sapiens
cagctcaagtcttccctgatca

SEQ ID NO: 2823746 - DNA, 15 bp, Homo sapiens
cagctcaccagcccc

SEQ ID NO: 2823747 - DNA, 16 bp, Homo sapiens
cagctcaccagcccca

SEQ ID NO: 2823748 - DNA, 17 bp, Homo sapiens
cagctcaccagccccag

SEQ ID NO: 2823749 - DNA, 21 bp, Homo sapiens
cagctcaccagccccagtgcc

SEQ ID NO: 2823750 - DNA, 16 bp, Homo sapiens
cagctcactccctggg

SEQ ID NO: 2823751 - DNA, 17 bp, Homo sapiens
cagctcagcctcccccc

SEQ ID NO: 2823752 - DNA, 23 bp, Homo sapiens
cagctcaggcacacttcttcttg

SEQ ID NO: 2823753 - DNA, 16 bp, Homo sapiens
cagctccagctcacca

SEQ ID NO: 2823754 - DNA, 20 bp, Homo sapiens
cagctccagctcaccagccc

SEQ ID NO: 2823755 - DNA, 12 bp, Homo sapiens
cagaatttttaa

SEQ ID NO: 2823756 - DNA, 22 bp, Homo sapiens
cagaattttttgagtaattcta

SEQ ID NO: 2823757 - DNA, 18 bp, Homo sapiens
cagacaaaaacagcctca

SEQ ID NO: 2823758 - DNA, 21 bp, Homo sapiens
cagacaaaaacagcctcacag

SEQ ID NO: 2823759 - DNA, 14 bp, Homo sapiens
cagacaacagaagt

SEQ ID NO: 2823760 - DNA, 22 bp, Homo sapiens
cagacaacagaagtcatgaagc

SEQ ID NO: 2823761 - DNA, 19 bp, Homo sapiens
cagacaagcaacaggtttt

SEQ ID NO: 2823762 - DNA, 13 bp, Homo sapiens
cagacacaggccc

SEQ ID NO: 2823763 - DNA, 17 bp, Homo sapiens
cagacacaggcccggct

SEQ ID NO: 2823764 - DNA, 18 bp, Homo sapiens
cagacacaggcccggctc

SEQ ID NO: 2823765 - DNA, 18 bp, Homo sapiens
cagacacctgtgcacccc

SEQ ID NO: 2823766 - DNA, 24 bp, Homo sapiens
cagacacctgtgcaccccatgagt

SEQ ID NO: 2823767 - DNA, 20 bp, Homo sapiens
cagacaccttgacagggcac

SEQ ID NO: 2823768 - DNA, 22 bp, Homo sapiens
cagacaccttgacagggcacac

SEQ ID NO: 2823769 - DNA, 18 bp, Homo sapiens
cagacacttcatggacca

SEQ ID NO: 2823770 - DNA, 13 bp, Homo sapiens
cagacagatccca

SEQ ID NO: 2823771 - DNA, 17 bp, Homo sapiens
cagacagcagctcaggc

SEQ ID NO: 2823772 - DNA, 18 bp, Homo sapiens
cagacagcagctcaggca

SEQ ID NO: 2823773 - DNA, 19 bp, Homo sapiens
cagacagcagctcaggcac

SEQ ID NO: 2823774 - DNA, 18 bp, Homo sapiens
cagacaggcaagcacctc

SEQ ID NO: 2823775 - DNA, 20 bp, Homo sapiens
cagacaggcaagcacctcct

SEQ ID NO: 2823776 - DNA, 19 bp, Homo sapiens
cagacagtgttttctggga

SEQ ID NO: 2823777 - DNA, 15 bp, Homo sapiens
cagaccaactctctc

SEQ ID NO: 2823778 - DNA, 17 bp, Homo sapiens
cagaccacctccctgcc

SEQ ID NO: 2823779 - DNA, 17 bp, Homo sapiens
cagaccacctgcttctg

SEQ ID NO: 2823780 - DNA, 12 bp, Homo sapiens
cagacccggctg

SEQ ID NO: 2823781 - DNA, 16 bp, Homo sapiens
cagacccggctgcgtg

SEQ ID NO: 2823782 - DNA, 18 bp, Homo sapiens
cagaccctaccccaccac

SEQ ID NO: 2823783 - DNA, 13 bp, Homo sapiens
cagaccctgccct

SEQ ID NO: 2823784 - DNA, 22 bp, Homo sapiens
cagacctaggatttcatgattt

SEQ ID NO: 2823785 - DNA, 11 bp, Homo sapiens
cagacctctga

SEQ ID NO: 2823786 - DNA, 20 bp, Homo sapiens
cagacgtatgcttattttaa

SEQ ID NO: 2823787 - DNA, 19 bp, Homo sapiens
cagactacagccagaagcc

SEQ ID NO: 2823788 - DNA, 14 bp, Homo sapiens
cagactcaataaaa

SEQ ID NO: 2823789 - DNA, 16 bp, Homo sapiens
cagactcagctccaga

SEQ ID NO: 2823790 - DNA, 21 bp, Homo sapiens
cagactcctgtgcaactttcc

SEQ ID NO: 2823791 - DNA, 14 bp, Homo sapiens
cagactgcttccaa

SEQ ID NO: 2823792 - DNA, 15 bp, Homo sapiens
cagacttcacactgc

SEQ ID NO: 2823793 - DNA, 20 bp, Homo sapiens
cagacttctccagacccacc

SEQ ID NO: 2823794 - DNA, 15 bp, Homo sapiens
cagactttaaagaat

SEQ ID NO: 2823795 - DNA, 23 bp, Homo sapiens
cagagaaagaagagacaggaggg

SEQ ID NO: 2823796 - DNA, 17 bp, Homo sapiens
cagagaaggcaggaatg

SEQ ID NO: 2823797 - DNA, 13 bp, Homo sapiens
cagagaaggcttc

SEQ ID NO: 2823798 - DNA, 16 bp, Homo sapiens
cagagaaggcttcctc

SEQ ID NO: 2823799 - DNA, 23 bp, Homo sapiens
cagagaagtcagttggagaaaat

SEQ ID NO: 2823800 - DNA, 11 bp, Homo sapiens
cagagaatata

SEQ ID NO: 2823801 - DNA, 19 bp, Homo sapiens
cagagaatgaaagggccca

SEQ ID NO: 2823802 - DNA, 15 bp, Homo sapiens
cagagaatttctacc

SEQ ID NO: 2823803 - DNA, 13 bp, Homo sapiens
cagagacacctgc

SEQ ID NO: 2823804 - DNA, 14 bp, Homo sapiens
cagagacacctgca

SEQ ID NO: 2823805 - DNA, 22 bp, Homo sapiens
caggcctgtgtagctgtgacct

SEQ ID NO: 2823806 - DNA, 18 bp, Homo sapiens
caggcggggtgctgtggt

SEQ ID NO: 2823807 - DNA, 19 bp, Homo sapiens
caggctgagtgagccacag

SEQ ID NO: 2823808 - DNA, 20 bp, Homo sapiens
caggctgagtgagccacaga

SEQ ID NO: 2823809 - DNA, 17 bp, Homo sapiens
caggctgatttctaggt

SEQ ID NO: 2823810 - DNA, 19 bp, Homo sapiens
caggctgcctcatgaccct

SEQ ID NO: 2823811 - DNA, 21 bp, Homo sapiens
caggctgcctcatgaccctcc

SEQ ID NO: 2823812 - DNA, 17 bp, Homo sapiens
caggctgggcttcagtg

SEQ ID NO: 2823813 - DNA, 12 bp, Homo sapiens
caggctggtctc

SEQ ID NO: 2823814 - DNA, 15 bp, Homo sapiens
caggcttcaccctga

SEQ ID NO: 2823815 - DNA, 18 bp, Homo sapiens
caggcttgtcactagcag

SEQ ID NO: 2823816 - DNA, 16 bp, Homo sapiens
cagggaaacagctaat

SEQ ID NO: 2823817 - DNA, 22 bp, Homo sapiens
cagggaaccctgcttgcacttt

SEQ ID NO: 2823818 - DNA, 15 bp, Homo sapiens
cagggaaggcaggca

SEQ ID NO: 2823819 - DNA, 16 bp, Homo sapiens
cagggaaggcaggcag

SEQ ID NO: 2823820 - DNA, 18 bp, Homo sapiens
cagggaaggcaggcaggg

SEQ ID NO: 2823821 - DNA, 22 bp, Homo sapiens
cagggaaggcaggcagggctct

SEQ ID NO: 2823822 - DNA, 18 bp, Homo sapiens
cagggacagagacacctg

SEQ ID NO: 2823823 - DNA, 21 bp, Homo sapiens
cagggacagagacacctgcac

SEQ ID NO: 2823824 - DNA, 22 bp, Homo sapiens
cagggagaccgagcgctttctg

SEQ ID NO: 2823825 - DNA, 22 bp, Homo sapiens
cagggaggagaggggaagggcc

SEQ ID NO: 2823826 - DNA, 23 bp, Homo sapiens
cagggaggagaggggaagggcca

SEQ ID NO: 2823827 - DNA, 21 bp, Homo sapiens
cagggaggaggtggcagccct

SEQ ID NO: 2823828 - DNA, 22 bp, Homo sapiens
cagggaggaggtggcagccctg

SEQ ID NO: 2823829 - DNA, 15 bp, Homo sapiens
cagggaggccgaagc

SEQ ID NO: 2823830 - DNA, 13 bp, Homo sapiens
cagggaggggact

SEQ ID NO: 2823831 - DNA, 19 bp, Homo sapiens
cagggaggggactatttat

SEQ ID NO: 2823832 - DNA, 17 bp, Homo sapiens
cagggatcttgcattcc

SEQ ID NO: 2823833 - DNA, 14 bp, Homo sapiens
cagggcacaccggg

SEQ ID NO: 2823834 - DNA, 15 bp, Homo sapiens
cagggcacaccgggc

SEQ ID NO: 2823835 - DNA, 21 bp, Homo sapiens
cagggcacaccgggcactcag

SEQ ID NO: 2823836 - DNA, 22 bp, Homo sapiens
cagggcacaccgggcactcaga

SEQ ID NO: 2823837 - DNA, 15 bp, Homo sapiens
cagggcacaggagct

SEQ ID NO: 2823838 - DNA, 18 bp, Homo sapiens
cagggcacaggagctacc

SEQ ID NO: 2823839 - DNA, 15 bp, Homo sapiens
cagggcagagccggg

SEQ ID NO: 2823840 - DNA, 19 bp, Homo sapiens
cagggcatattaaaggctt

SEQ ID NO: 2823841 - DNA, 16 bp, Homo sapiens
cagggccacgtgccag

SEQ ID NO: 2823842 - DNA, 18 bp, Homo sapiens
cagggccacgtgccaggc

SEQ ID NO: 2823843 - DNA, 16 bp, Homo sapiens
cagggccccagcacta

SEQ ID NO: 2823844 - DNA, 22 bp, Homo sapiens
cagggccccagcactaaagcag

SEQ ID NO: 2823845 - DNA, 15 bp, Homo sapiens
cagggccctgagctc

SEQ ID NO: 2823846 - DNA, 21 bp, Homo sapiens
cagggccctgagctcggtgga

SEQ ID NO: 2823847 - DNA, 15 bp, Homo sapiens
cagggccctgcagag

SEQ ID NO: 2823848 - DNA, 12 bp, Homo sapiens
cagggccgggga

SEQ ID NO: 2823849 - DNA, 23 bp, Homo sapiens
cagggccggggaactggccaagc

SEQ ID NO: 2823850 - DNA, 15 bp, Homo sapiens
cagggccttgcccag

SEQ ID NO: 2823851 - DNA, 18 bp, Homo sapiens
cagggccttgcccagaga

SEQ ID NO: 2823852 - DNA, 19 bp, Homo sapiens
cagggccttgcccagagat

SEQ ID NO: 2823853 - DNA, 17 bp, Homo sapiens
cagggctaagagctagc

SEQ ID NO: 2823854 - DNA, 14 bp, Homo sapiens
cagggctcagcctg

SEQ ID NO: 2823855 - DNA, 21 bp, Homo sapiens
cagggctcagcggggacagct

SEQ ID NO: 2823856 - DNA, 14 bp, Homo sapiens
cagggctctcctgg

SEQ ID NO: 2823857 - DNA, 15 bp, Homo sapiens
cagggctctcctggc

SEQ ID NO: 2823858 - DNA, 17 bp, Homo sapiens
cagggctctcctggctt

SEQ ID NO: 2823859 - DNA, 18 bp, Homo sapiens
cagggctctcctggcttc

SEQ ID NO: 2823860 - DNA, 23 bp, Homo sapiens
cagggctggaaaagtcacacaga

SEQ ID NO: 2823861 - DNA, 15 bp, Homo sapiens
caggggaccacacct

SEQ ID NO: 2823862 - DNA, 17 bp, Homo sapiens
caggggaccacacctcc

SEQ ID NO: 2823863 - DNA, 20 bp, Homo sapiens
caggggagagggtctggaga

SEQ ID NO: 2823864 - DNA, 13 bp, Homo sapiens
caggggatcaaag

SEQ ID NO: 2823865 - DNA, 14 bp, Homo sapiens
caggggatcaaagt

SEQ ID NO: 2823866 - DNA, 15 bp, Homo sapiens
caggggatcaaagtt

SEQ ID NO: 2823867 - DNA, 16 bp, Homo sapiens
caggggcccacaggga

SEQ ID NO: 2823868 - DNA, 18 bp, Homo sapiens
caggggcctcaggggagc

SEQ ID NO: 2823869 - DNA, 16 bp, Homo sapiens
caggggctccacctgt

SEQ ID NO: 2823870 - DNA, 20 bp, Homo sapiens
caggggggttgtgaggcctg

SEQ ID NO: 2823871 - DNA, 16 bp, Homo sapiens
cagggtagcaggtacc

SEQ ID NO: 2823872 - DNA, 12 bp, Homo sapiens
cagggtcctgag

SEQ ID NO: 2823873 - DNA, 15 bp, Homo sapiens
cagggtcctgagtgg

SEQ ID NO: 2823874 - DNA, 22 bp, Homo sapiens
cagggtctcactatgttgccca

SEQ ID NO: 2823875 - DNA, 15 bp, Homo sapiens
cagggtctcactctg

SEQ ID NO: 2823876 - DNA, 14 bp, Homo sapiens
cagggtgagagctg

SEQ ID NO: 2823877 - DNA, 15 bp, Homo sapiens
cagggtgagagctgc

SEQ ID NO: 2823878 - DNA, 20 bp, Homo sapiens
cagggtgggatggaggagaa

SEQ ID NO: 2823879 - DNA, 15 bp, Homo sapiens
cagggtgggccactc

SEQ ID NO: 2823880 - DNA, 19 bp, Homo sapiens
cagggtgggccactctccc

SEQ ID NO: 2823881 - DNA, 12 bp, Homo sapiens
cagggttggccc

SEQ ID NO: 2823882 - DNA, 17 bp, Homo sapiens
cagggttggcccctgcc

SEQ ID NO: 2823883 - DNA, 16 bp, Homo sapiens
cagggttttgccatgt

SEQ ID NO: 2823884 - DNA, 16 bp, Homo sapiens
caggtaacaggcagat

SEQ ID NO: 2823885 - DNA, 17 bp, Homo sapiens
caggtaacaggcagata

SEQ ID NO: 2823886 - DNA, 20 bp, Homo sapiens
caggtaatgagggactggaa

SEQ ID NO: 2823887 - DNA, 23 bp, Homo sapiens
caggtaatgagggactggaacca

SEQ ID NO: 2823888 - DNA, 19 bp, Homo sapiens
caggtagaacacaaggtca

SEQ ID NO: 2823889 - DNA, 16 bp, Homo sapiens
caggtatctccaggat

SEQ ID NO: 2823890 - DNA, 19 bp, Homo sapiens
caggtcatctcctttcatc

SEQ ID NO: 2823891 - DNA, 15 bp, Homo sapiens
caggtcctcagagaa

SEQ ID NO: 2823892 - DNA, 21 bp, Homo sapiens
caggtcctctgatacccagag

SEQ ID NO: 2823893 - DNA, 13 bp, Homo sapiens
caggtcctggtgg

SEQ ID NO: 2823894 - DNA, 21 bp, Homo sapiens
caggtcctggtggggcagctc

SEQ ID NO: 2823895 - DNA, 21 bp, Homo sapiens
cagctcccaaggctctgagca

SEQ ID NO: 2823896 - DNA, 22 bp, Homo sapiens
cagctcccaccccacccccttc

SEQ ID NO: 2823897 - DNA, 11 bp, Homo sapiens
cagctccccag

SEQ ID NO: 2823898 - DNA, 14 bp, Homo sapiens
cagctccccaggac

SEQ ID NO: 2823899 - DNA, 23 bp, Homo sapiens
cagctccccaggactcaccctca

SEQ ID NO: 2823900 - DNA, 11 bp, Homo sapiens
cagctccctag

SEQ ID NO: 2823901 - DNA, 19 bp, Homo sapiens
cagctccctaggagaccaa

SEQ ID NO: 2823902 - DNA, 20 bp, Homo sapiens
cagctccctagtggcttcct

SEQ ID NO: 2823903 - DNA, 12 bp, Homo sapiens
cagctcctctgt

SEQ ID NO: 2823904 - DNA, 13 bp, Homo sapiens
cagctctcagcca

SEQ ID NO: 2823905 - DNA, 17 bp, Homo sapiens
cagctctccctctggcc

SEQ ID NO: 2823906 - DNA, 20 bp, Homo sapiens
cagctctccctctggccctg

SEQ ID NO: 2823907 - DNA, 14 bp, Homo sapiens
cagctctgacattc

SEQ ID NO: 2823908 - DNA, 20 bp, Homo sapiens
cagctctgacattctgattc

SEQ ID NO: 2823909 - DNA, 21 bp, Homo sapiens
cagctctgacattctgattcg

SEQ ID NO: 2823910 - DNA, 12 bp, Homo sapiens
cagctctgtcct

SEQ ID NO: 2823911 - DNA, 18 bp, Homo sapiens
cagctcttcccctttcct

SEQ ID NO: 2823912 - DNA, 21 bp, Homo sapiens
cagctcttcccctttcctggg

SEQ ID NO: 2823913 - DNA, 14 bp, Homo sapiens
cagctcttctccag

SEQ ID NO: 2823914 - DNA, 17 bp, Homo sapiens
cagctcttggcccctgt

SEQ ID NO: 2823915 - DNA, 19 bp, Homo sapiens
cagctcttggcccctgtgt

SEQ ID NO: 2823916 - DNA, 20 bp, Homo sapiens
cagctcttggcccctgtgtg

SEQ ID NO: 2823917 - DNA, 20 bp, Homo sapiens
cagctgacacataatttgaa

SEQ ID NO: 2823918 - DNA, 16 bp, Homo sapiens
cagctgacctttgtca

SEQ ID NO: 2823919 - DNA, 15 bp, Homo sapiens
cagctgcaggaatca

SEQ ID NO: 2823920 - DNA, 15 bp, Homo sapiens
cagctgcagtcaaca

SEQ ID NO: 2823921 - DNA, 17 bp, Homo sapiens
cagctgcatctactcag

SEQ ID NO: 2823922 - DNA, 19 bp, Homo sapiens
cagctgccgaccagagccc

SEQ ID NO: 2823923 - DNA, 20 bp, Homo sapiens
cagctgcggtccacccagga

SEQ ID NO: 2823924 - DNA, 19 bp, Homo sapiens
cagctggaattgctgctct

SEQ ID NO: 2823925 - DNA, 14 bp, Homo sapiens
cagctggaatttaa

SEQ ID NO: 2823926 - DNA, 21 bp, Homo sapiens
cagctggatgagacttccaaa

SEQ ID NO: 2823927 - DNA, 20 bp, Homo sapiens
cagctggtgggaagcgtctg

SEQ ID NO: 2823928 - DNA, 12 bp, Homo sapiens
cagctgtccctg

SEQ ID NO: 2823929 - DNA, 14 bp, Homo sapiens
cagctgtccctgtc

SEQ ID NO: 2823930 - DNA, 16 bp, Homo sapiens
cagctgtccctgtcac

SEQ ID NO: 2823931 - DNA, 14 bp, Homo sapiens
cagctgtgcctcgc

SEQ ID NO: 2823932 - DNA, 17 bp, Homo sapiens
cagctgtgcctcgctcc

SEQ ID NO: 2823933 - DNA, 16 bp, Homo sapiens
caggagtagctgagct

SEQ ID NO: 2823934 - DNA, 16 bp, Homo sapiens
caggagtcccaaggaa

SEQ ID NO: 2823935 - DNA, 18 bp, Homo sapiens
caggagttcgaggctgca

SEQ ID NO: 2823936 - DNA, 19 bp, Homo sapiens
caggagttcgaggctgcag

SEQ ID NO: 2823937 - DNA, 18 bp, Homo sapiens
caggagtttgaggctgca

SEQ ID NO: 2823938 - DNA, 20 bp, Homo sapiens
caggagtttgaggctgcagc

SEQ ID NO: 2823939 - DNA, 21 bp, Homo sapiens
caggagtttgaggctgcagcg

SEQ ID NO: 2823940 - DNA, 22 bp, Homo sapiens
caggagtttgtgtgtcttttat

SEQ ID NO: 2823941 - DNA, 13 bp, Homo sapiens
caggatcagtctg

SEQ ID NO: 2823942 - DNA, 14 bp, Homo sapiens
caggatcagtctga

SEQ ID NO: 2823943 - DNA, 19 bp, Homo sapiens
caggatcctattctcacca

SEQ ID NO: 2823944 - DNA, 23 bp, Homo sapiens
caggatggcccttcccactggag

SEQ ID NO: 2823945 - DNA, 15 bp, Homo sapiens
caggattgaagagca

SEQ ID NO: 2823946 - DNA, 18 bp, Homo sapiens
caggcaaaatccttgctt

SEQ ID NO: 2823947 - DNA, 20 bp, Homo sapiens
caggcaactgaggcagacag

SEQ ID NO: 2823948 - DNA, 15 bp, Homo sapiens
caggcaagcacctcc

SEQ ID NO: 2823949 - DNA, 18 bp, Homo sapiens
caggcaagtgaagaaaag

SEQ ID NO: 2823950 - DNA, 15 bp, Homo sapiens
caggcaatgctggct

SEQ ID NO: 2823951 - DNA, 20 bp, Homo sapiens
caggcaatgctggctgttgg

SEQ ID NO: 2823952 - DNA, 15 bp, Homo sapiens
caggcaccccctgga

SEQ ID NO: 2823953 - DNA, 16 bp, Homo sapiens
caggcaccccctggag

SEQ ID NO: 2823954 - DNA, 17 bp, Homo sapiens
caggcacgaacccacct

SEQ ID NO: 2823955 - DNA, 22 bp, Homo sapiens
caggcacgaacccacctgctga

SEQ ID NO: 2823956 - DNA, 23 bp, Homo sapiens
caggcactgctgcccagcctcca

SEQ ID NO: 2823957 - DNA, 15 bp, Homo sapiens
caggcagagaatcat

SEQ ID NO: 2823958 - DNA, 13 bp, Homo sapiens
caggcagggctct

SEQ ID NO: 2823959 - DNA, 14 bp, Homo sapiens
caggcagggctctc

SEQ ID NO: 2823960 - DNA, 15 bp, Homo sapiens
caggcagggctctcc

SEQ ID NO: 2823961 - DNA, 17 bp, Homo sapiens
caggcagggctctcctg

SEQ ID NO: 2823962 - DNA, 19 bp, Homo sapiens
caggcagggctctcctggc

SEQ ID NO: 2823963 - DNA, 23 bp, Homo sapiens
caggcagggctctcctggcttcc

SEQ ID NO: 2823964 - DNA, 19 bp, Homo sapiens
caggcaggtccagggtttg

SEQ ID NO: 2823965 - DNA, 22 bp, Homo sapiens
caggcaggtcttgaactcctgg

SEQ ID NO: 2823966 - DNA, 16 bp, Homo sapiens
caggcatctacacagc

SEQ ID NO: 2823967 - DNA, 19 bp, Homo sapiens
caggcatctacacagcctg

SEQ ID NO: 2823968 - DNA, 14 bp, Homo sapiens
caggcatgctggcc

SEQ ID NO: 2823969 - DNA, 18 bp, Homo sapiens
caggcatgttctctgagg

SEQ ID NO: 2823970 - DNA, 18 bp, Homo sapiens
caggccaagagcagaggc

SEQ ID NO: 2823971 - DNA, 21 bp, Homo sapiens
caggccaagagcagaggcagc

SEQ ID NO: 2823972 - DNA, 15 bp, Homo sapiens
caggccacttgatga

SEQ ID NO: 2823973 - DNA, 12 bp, Homo sapiens
caggccagaaaa

SEQ ID NO: 2823974 - DNA, 16 bp, Homo sapiens
caggccagagggagtg

SEQ ID NO: 2823975 - DNA, 18 bp, Homo sapiens
caggccaggccaccagga

SEQ ID NO: 2823976 - DNA, 18 bp, Homo sapiens
caggcccccacctggctc

SEQ ID NO: 2823977 - DNA, 16 bp, Homo sapiens
caggccccccgcagca

SEQ ID NO: 2823978 - DNA, 19 bp, Homo sapiens
caggccccccgcagcaccc

SEQ ID NO: 2823979 - DNA, 22 bp, Homo sapiens
caggccccccgcagcaccctgc

SEQ ID NO: 2823980 - DNA, 19 bp, Homo sapiens
caggcccctgccaccctgg

SEQ ID NO: 2823981 - DNA, 14 bp, Homo sapiens
caggcccggctcca

SEQ ID NO: 2823982 - DNA, 16 bp, Homo sapiens
caggcccggctccagg

SEQ ID NO: 2823983 - DNA, 21 bp, Homo sapiens
caggcccggctccaggctcct

SEQ ID NO: 2823984 - DNA, 22 bp, Homo sapiens
caggcccggctccaggctcctt

SEQ ID NO: 2823985 - DNA, 16 bp, Homo sapiens
caggcccggggctggc

SEQ ID NO: 2823986 - DNA, 20 bp, Homo sapiens
caggcctggcaagtgggtga

SEQ ID NO: 2823987 - DNA, 15 bp, Homo sapiens
caacagaagcttcca

SEQ ID NO: 2823988 - DNA, 22 bp, Homo sapiens
caacagaagtcatgaagcccaa

SEQ ID NO: 2823989 - DNA, 17 bp, Homo sapiens
caacagagaaggcagga

SEQ ID NO: 2823990 - DNA, 14 bp, Homo sapiens
caacagatactgga

SEQ ID NO: 2823991 - DNA, 17 bp, Homo sapiens
caacagatactggaagt

SEQ ID NO: 2823992 - DNA, 16 bp, Homo sapiens
caacaggaatctcaga

SEQ ID NO: 2823993 - DNA, 17 bp, Homo sapiens
caacaggaatctcagag

SEQ ID NO: 2823994 - DNA, 14 bp, Homo sapiens
caacaggctgggct

SEQ ID NO: 2823995 - DNA, 20 bp, Homo sapiens
caacaggctgggcttcagtg

SEQ ID NO: 2823996 - DNA, 23 bp, Homo sapiens
caacaggctgggcttcagtggca

SEQ ID NO: 2823997 - DNA, 23 bp, Homo sapiens
caacaggtggcaggaccaggact

SEQ ID NO: 2823998 - DNA, 13 bp, Homo sapiens
caacaggttttat

SEQ ID NO: 2823999 - DNA, 21 bp, Homo sapiens
caacatacccttctttaaatc

SEQ ID NO: 2824000 - DNA, 15 bp, Homo sapiens
caacatcccattgcc

SEQ ID NO: 2824001 - DNA, 17 bp, Homo sapiens
caacatcccattgccct

SEQ ID NO: 2824002 - DNA, 18 bp, Homo sapiens
caacatcccattgccctg

SEQ ID NO: 2824003 - DNA, 18 bp, Homo sapiens
caacatgtataatatttt

SEQ ID NO: 2824004 - DNA, 23 bp, Homo sapiens
caacatgttatttgtaatagatg

SEQ ID NO: 2824005 - DNA, 19 bp, Homo sapiens
caaccactgtaaaatgaaa

SEQ ID NO: 2824006 - DNA, 21 bp, Homo sapiens
caaccactgtaaaatgaaatt

SEQ ID NO: 2824007 - DNA, 14 bp, Homo sapiens
caaccactgtggcg

SEQ ID NO: 2824008 - DNA, 11 bp, Homo sapiens
caaccagagcc

SEQ ID NO: 2824009 - DNA, 12 bp, Homo sapiens
caaccagccaca

SEQ ID NO: 2824010 - DNA, 19 bp, Homo sapiens
caaccccttcgctcctgtg

SEQ ID NO: 2824011 - DNA, 21 bp, Homo sapiens
caaccccttcgctcctgtgtc

SEQ ID NO: 2824012 - DNA, 17 bp, Homo sapiens
caacccgtggaggctgc

SEQ ID NO: 2824013 - DNA, 21 bp, Homo sapiens
caacccgtggaggctgctcgg

SEQ ID NO: 2824014 - DNA, 13 bp, Homo sapiens
caaccctgtttcc

SEQ ID NO: 2824015 - DNA, 17 bp, Homo sapiens
cacggacgtttccatca

SEQ ID NO: 2824016 - DNA, 13 bp, Homo sapiens
cacggccaggcca

SEQ ID NO: 2824017 - DNA, 15 bp, Homo sapiens
cacggctcactgcag

SEQ ID NO: 2824018 - DNA, 19 bp, Homo sapiens
cacggctcactgcagcctc

SEQ ID NO: 2824019 - DNA, 19 bp, Homo sapiens
cacgtacacacacatacac

SEQ ID NO: 2824020 - DNA, 20 bp, Homo sapiens
cacgtccccctggggcttct

SEQ ID NO: 2824021 - DNA, 14 bp, Homo sapiens
cacgtgaaatattt

SEQ ID NO: 2824022 - DNA, 15 bp, Homo sapiens
cacgtgtgcagactg

SEQ ID NO: 2824023 - DNA, 16 bp, Homo sapiens
cacgtgttctcacact

SEQ ID NO: 2824024 - DNA, 22 bp, Homo sapiens
cacgttcgaggcggtttccagg

SEQ ID NO: 2824025 - DNA, 15 bp, Homo sapiens
cactaaaaagtggct

SEQ ID NO: 2824026 - DNA, 13 bp, Homo sapiens
cactaaagcagtg

SEQ ID NO: 2824027 - DNA, 17 bp, Homo sapiens
cactaaatgagctcctg

SEQ ID NO: 2824028 - DNA, 14 bp, Homo sapiens
cactaaccacgctg

SEQ ID NO: 2824029 - DNA, 23 bp, Homo sapiens
cactaagtagaataaagaaaaac

SEQ ID NO: 2824030 - DNA, 22 bp, Homo sapiens
cactaagttatagtatatctgg

SEQ ID NO: 2824031 - DNA, 17 bp, Homo sapiens
cactacactccagcctg

SEQ ID NO: 2824032 - DNA, 18 bp, Homo sapiens
cactacactccagcctga

SEQ ID NO: 2824033 - DNA, 19 bp, Homo sapiens
cactacactccagcctgag

SEQ ID NO: 2824034 - DNA, 17 bp, Homo sapiens
cactactcacagtctct

SEQ ID NO: 2824035 - DNA, 14 bp, Homo sapiens
cactagcagctgca

SEQ ID NO: 2824036 - DNA, 15 bp, Homo sapiens
cactagcagctgcag

SEQ ID NO: 2824037 - DNA, 16 bp, Homo sapiens
cactagcctctccagg

SEQ ID NO: 2824038 - DNA, 17 bp, Homo sapiens
cactagcctctccagga

SEQ ID NO: 2824039 - DNA, 17 bp, Homo sapiens
cactaggactctgaggc

SEQ ID NO: 2824040 - DNA, 14 bp, Homo sapiens
cactatagcctagg

SEQ ID NO: 2824041 - DNA, 21 bp, Homo sapiens
cactatagcctaggtgacaga

SEQ ID NO: 2824042 - DNA, 14 bp, Homo sapiens
cactatctttctga

SEQ ID NO: 2824043 - DNA, 15 bp, Homo sapiens
cactatgattttcta

SEQ ID NO: 2824044 - DNA, 16 bp, Homo sapiens
cactatgttgcccagg

SEQ ID NO: 2824045 - DNA, 15 bp, Homo sapiens
cactattcctaggag

SEQ ID NO: 2824046 - DNA, 16 bp, Homo sapiens
cactcaaattaatctt

SEQ ID NO: 2824047 - DNA, 13 bp, Homo sapiens
cactcacatgccg

SEQ ID NO: 2824048 - DNA, 12 bp, Homo sapiens
cactcagaagac

SEQ ID NO: 2824049 - DNA, 16 bp, Homo sapiens
cactcagaagacactg

SEQ ID NO: 2824050 - DNA, 19 bp, Homo sapiens
cactcagaagcctgggggc

SEQ ID NO: 2824051 - DNA, 22 bp, Homo sapiens
cactcagaagcctgggggcctg

SEQ ID NO: 2824052 - DNA, 22 bp, Homo sapiens
cactcagtgaggccgcccggca

SEQ ID NO: 2824053 - DNA, 17 bp, Homo sapiens
cactcatttcatctcat

SEQ ID NO: 2824054 - DNA, 18 bp, Homo sapiens
cactcatttcatctcatt

SEQ ID NO: 2824055 - DNA, 11 bp, Homo sapiens
cactccaccac

SEQ ID NO: 2824056 - DNA, 19 bp, Homo sapiens
cactccaccacccaaaagt

SEQ ID NO: 2824057 - DNA, 13 bp, Homo sapiens
cactccagcctgg

SEQ ID NO: 2824058 - DNA, 14 bp, Homo sapiens
cactccccaccttc

SEQ ID NO: 2824059 - DNA, 20 bp, Homo sapiens
cactccggcctgatgacaga

SEQ ID NO: 2824060 - DNA, 17 bp, Homo sapiens
cactccggtgtgcctgc

SEQ ID NO: 2824061 - DNA, 16 bp, Homo sapiens
cactcctctgtctctg

SEQ ID NO: 2824062 - DNA, 23 bp, Homo sapiens
cactcctctgtctctgctcttgc

SEQ ID NO: 2824063 - DNA, 13 bp, Homo sapiens
cactccttcctgc

SEQ ID NO: 2824064 - DNA, 17 bp, Homo sapiens
cactccttcctgcccca

SEQ ID NO: 2824065 - DNA, 21 bp, Homo sapiens
cactccttcctgccccaactc

SEQ ID NO: 2824066 - DNA, 18 bp, Homo sapiens
cactcgggaggctgagac

SEQ ID NO: 2824067 - DNA, 22 bp, Homo sapiens
cactcgggaggctgagacagga

SEQ ID NO: 2824068 - DNA, 20 bp, Homo sapiens
cactctagcctggcaacaga

SEQ ID NO: 2824069 - DNA, 17 bp, Homo sapiens
cactctcattccccagg

SEQ ID NO: 2824070 - DNA, 16 bp, Homo sapiens
cactctcccctccctc

SEQ ID NO: 2824071 - DNA, 17 bp, Homo sapiens
cactctcccctccctct

SEQ ID NO: 2824072 - DNA, 13 bp, Homo sapiens
cactctgctctga

SEQ ID NO: 2824073 - DNA, 16 bp, Homo sapiens
cactctgctctgatgc

SEQ ID NO: 2824074 - DNA, 13 bp, Homo sapiens
cactctggcagcc

SEQ ID NO: 2824075 - DNA, 19 bp, Homo sapiens
cactcttattgcccacgct

SEQ ID NO: 2824076 - DNA, 20 bp, Homo sapiens
cactcttattgcccacgctg

SEQ ID NO: 2824077 - DNA, 11 bp, Homo sapiens
cactcttccaa

SEQ ID NO: 2824078 - DNA, 12 bp, Homo sapiens
cactctttgtaa

SEQ ID NO: 2824079 - DNA, 17 bp, Homo sapiens
cactgaccctggagcgg

SEQ ID NO: 2824080 - DNA, 12 bp, Homo sapiens
cactgagctggg

SEQ ID NO: 2824081 - DNA, 10 bp, Homo sapiens
cactgagggc

SEQ ID NO: 2824082 - DNA, 24 bp, Homo sapiens
cactgatgggcaacccccagcctg

SEQ ID NO: 2824083 - DNA, 13 bp, Homo sapiens
cactgcaacctcc

SEQ ID NO: 2824084 - DNA, 20 bp, Homo sapiens
cactgcaacttctacctccg

SEQ ID NO: 2824085 - DNA, 18 bp, Homo sapiens
cactgcaagagccttggt

SEQ ID NO: 2824086 - DNA, 18 bp, Homo sapiens
cactgcactatagcctag

SEQ ID NO: 2824087 - DNA, 15 bp, Homo sapiens
cactgcactctagcc

SEQ ID NO: 2824088 - DNA, 17 bp, Homo sapiens
cactgcactctagcctg

SEQ ID NO: 2824089 - DNA, 21 bp, Homo sapiens
cactgcagcctcaacctcctg

SEQ ID NO: 2824090 - DNA, 23 bp, Homo sapiens
cactgcagcctcaacctcctggg

SEQ ID NO: 2824091 - DNA, 14 bp, Homo sapiens
cactgccacaccct

SEQ ID NO: 2824092 - DNA, 17 bp, Homo sapiens
cactgccacaccctccc

SEQ ID NO: 2824093 - DNA, 15 bp, Homo sapiens
cactgccaggaggga

SEQ ID NO: 2824094 - DNA, 14 bp, Homo sapiens
cactgccccaccag

SEQ ID NO: 2824095 - DNA, 21 bp, Homo sapiens
cactgctaggcgagtgccagg

SEQ ID NO: 2824096 - DNA, 19 bp, Homo sapiens
cactgctcaagaagacatg

SEQ ID NO: 2824097 - DNA, 17 bp, Homo sapiens
cactgctctcagcctcc

SEQ ID NO: 2824098 - DNA, 12 bp, Homo sapiens
cactgctctggt

SEQ ID NO: 2824099 - DNA, 22 bp, Homo sapiens
cactggaatcgatctgtactgt

SEQ ID NO: 2824100 - DNA, 17 bp, Homo sapiens
cactggagcaccaggca

SEQ ID NO: 2824101 - DNA, 12 bp, Homo sapiens
cactggagccca

SEQ ID NO: 2824102 - DNA, 16 bp, Homo sapiens
cactggcaatgaaaaa

SEQ ID NO: 2824103 - DNA, 19 bp, Homo sapiens
cactggcacgtttgtgaga

SEQ ID NO: 2824104 - DNA, 14 bp, Homo sapiens
cactgggggagggg

SEQ ID NO: 2824105 - DNA, 20 bp, Homo sapiens
cactggggtcctggggcctc

SEQ ID NO: 2824106 - DNA, 21 bp, Homo sapiens
cacacgcaggaactcccagca

SEQ ID NO: 2824107 - DNA, 21 bp, Homo sapiens
cacacggaggcatctgcaccc

SEQ ID NO: 2824108 - DNA, 20 bp, Homo sapiens
cacactattaccatgagaag

SEQ ID NO: 2824109 - DNA, 14 bp, Homo sapiens
cacactgagctggg

SEQ ID NO: 2824110 - DNA, 22 bp, Homo sapiens
cacactgagctgggcaccacag

SEQ ID NO: 2824111 - DNA, 16 bp, Homo sapiens
cacactgcaagagcct

SEQ ID NO: 2824112 - DNA, 19 bp, Homo sapiens
cacactgcaagagccttgg

SEQ ID NO: 2824113 - DNA, 22 bp, Homo sapiens
cacactggcacgtttgtgagaa

SEQ ID NO: 2824114 - DNA, 15 bp, Homo sapiens
cacactgttactcca

SEQ ID NO: 2824115 - DNA, 19 bp, Homo sapiens
cacacttgggcgctctgcc

SEQ ID NO: 2824116 - DNA, 21 bp, Homo sapiens
cacacttgggcgctctgccct

SEQ ID NO: 2824117 - DNA, 13 bp, Homo sapiens
cacagaaacacaa

SEQ ID NO: 2824118 - DNA, 21 bp, Homo sapiens
cacagaactgcttactagccc

SEQ ID NO: 2824119 - DNA, 14 bp, Homo sapiens
cacagaagccagga

SEQ ID NO: 2824120 - DNA, 18 bp, Homo sapiens
cacagaaggaatctgtgc

SEQ ID NO: 2824121 - DNA, 12 bp, Homo sapiens
cacagacacaca

SEQ ID NO: 2824122 - DNA, 14 bp, Homo sapiens
cacagacagatccc

SEQ ID NO: 2824123 - DNA, 21 bp, Homo sapiens
cacagactacagccagaagcc

SEQ ID NO: 2824124 - DNA, 20 bp, Homo sapiens
cacagagaaagtacttctcc

SEQ ID NO: 2824125 - DNA, 13 bp, Homo sapiens
cacagagcctgcc

SEQ ID NO: 2824126 - DNA, 21 bp, Homo sapiens
cacagagcctgcctcagctgc

SEQ ID NO: 2824127 - DNA, 19 bp, Homo sapiens
cacagaggcagctgtgtgg

SEQ ID NO: 2824128 - DNA, 19 bp, Homo sapiens
cacagattacttcagggct

SEQ ID NO: 2824129 - DNA, 16 bp, Homo sapiens
cacagcaccagaatgt

SEQ ID NO: 2824130 - DNA, 19 bp, Homo sapiens
cacagcaccagaatgtata

SEQ ID NO: 2824131 - DNA, 16 bp, Homo sapiens
cacagcagctgaacag

SEQ ID NO: 2824132 - DNA, 19 bp, Homo sapiens
cacagcccaaagaaggaaa

SEQ ID NO: 2824133 - DNA, 14 bp, Homo sapiens
cacagcctctgcct

SEQ ID NO: 2824134 - DNA, 17 bp, Homo sapiens
cacagcctgggaccagg

SEQ ID NO: 2824135 - DNA, 23 bp, Homo sapiens
cacagcggaggagaccagctcag

SEQ ID NO: 2824136 - DNA, 12 bp, Homo sapiens
cacagctatgaa

SEQ ID NO: 2824137 - DNA, 15 bp, Homo sapiens
cacagctcccacccc

SEQ ID NO: 2824138 - DNA, 15 bp, Homo sapiens
cacagctctgtcctg

SEQ ID NO: 2824139 - DNA, 18 bp, Homo sapiens
cacagctctgtcctggga

SEQ ID NO: 2824140 - DNA, 20 bp, Homo sapiens
cacagctctgtcctgggagt

SEQ ID NO: 2824141 - DNA, 14 bp, Homo sapiens
cacagctcttctcc

SEQ ID NO: 2824142 - DNA, 18 bp, Homo sapiens
cacagctcttctccaggc

SEQ ID NO: 2824143 - DNA, 19 bp, Homo sapiens
cacagctcttctccaggct

SEQ ID NO: 2824144 - DNA, 20 bp, Homo sapiens
cacagctcttctccaggctg

SEQ ID NO: 2824145 - DNA, 22 bp, Homo sapiens
cacagcttcatttcctgtgtct

SEQ ID NO: 2824146 - DNA, 16 bp, Homo sapiens
cacaggactctgcctc

SEQ ID NO: 2824147 - DNA, 15 bp, Homo sapiens
cacaggagctacctg

SEQ ID NO: 2824148 - DNA, 22 bp, Homo sapiens
cacaggagggggtcgtggagag

SEQ ID NO: 2824149 - DNA, 15 bp, Homo sapiens
cacaggatcagtctg

SEQ ID NO: 2824150 - DNA, 16 bp, Homo sapiens
cacaggatcagtctga

SEQ ID NO: 2824151 - DNA, 23 bp, Homo sapiens
cacaggatcctattctcaccagg

SEQ ID NO: 2824152 - DNA, 19 bp, Homo sapiens
cacaggcaactgaggcaga

SEQ ID NO: 2824153 - DNA, 10 bp, Homo sapiens
cacaggcagg

SEQ ID NO: 2824154 - DNA, 14 bp, Homo sapiens
cacaggcaggtcca

SEQ ID NO: 2824155 - DNA, 19 bp, Homo sapiens
cacaggcaggtccagggtt

SEQ ID NO: 2824156 - DNA, 20 bp, Homo sapiens
cacaggcatttcctgggtgg

SEQ ID NO: 2824157 - DNA, 20 bp, Homo sapiens
cacaggccccccgcagcacc

SEQ ID NO: 2824158 - DNA, 20 bp, Homo sapiens
cacaggcccggctccaggct

SEQ ID NO: 2824159 - DNA, 23 bp, Homo sapiens
cacaggcccggctccaggctcct

SEQ ID NO: 2824160 - DNA, 22 bp, Homo sapiens
cacaggcctgtgtagctgtgac

SEQ ID NO: 2824161 - DNA, 24 bp, Homo sapiens
cacaggcctgtgtagctgtgacct

SEQ ID NO: 2824162 - DNA, 14 bp, Homo sapiens
cacagggcagagcc

SEQ ID NO: 2824163 - DNA, 22 bp, Homo sapiens
cacagggccccagaaggcaggg

SEQ ID NO: 2824164 - DNA, 13 bp, Homo sapiens
cacaggtgtaaat

SEQ ID NO: 2824165 - DNA, 15 bp, Homo sapiens
cacaggtgtttatac

SEQ ID NO: 2824166 - DNA, 18 bp, Homo sapiens
cacagtattacttctgct

SEQ ID NO: 2824167 - DNA, 12 bp, Homo sapiens
cacagtctctgg

SEQ ID NO: 2824168 - DNA, 13 bp, Homo sapiens
cacagtctctggg

SEQ ID NO: 2824169 - DNA, 22 bp, Homo sapiens
cacagtctctttaatcttcagt

SEQ ID NO: 2824170 - DNA, 18 bp, Homo sapiens
cacagtgtctgtatcgga

SEQ ID NO: 2824171 - DNA, 17 bp, Homo sapiens
cacagttcaattctcat

SEQ ID NO: 2824172 - DNA, 22 bp, Homo sapiens
cacagttcctcgccctgggtct

SEQ ID NO: 2824173 - DNA, 13 bp, Homo sapiens
cacatacaatttg

SEQ ID NO: 2824174 - DNA, 19 bp, Homo sapiens
cacatactcatttttcatg

SEQ ID NO: 2824175 - DNA, 15 bp, Homo sapiens
cacatatatgtatat

SEQ ID NO: 2824176 - DNA, 18 bp, Homo sapiens
cacatatgcaccttgtgt

SEQ ID NO: 2824177 - DNA, 19 bp, Homo sapiens
cacatatgcaccttgtgtc

SEQ ID NO: 2824178 - DNA, 24 bp, Homo sapiens
cacatcagctccactttcagtgaa

SEQ ID NO: 2824179 - DNA, 21 bp, Homo sapiens
cacatccatttcatctatttc

SEQ ID NO: 2824180 - DNA, 15 bp, Homo sapiens
cacatccctgggcct

SEQ ID NO: 2824181 - DNA, 16 bp, Homo sapiens
cacatccctgggcctg

SEQ ID NO: 2824182 - DNA, 20 bp, Homo sapiens
cacatccctgggcctgctgc

SEQ ID NO: 2824183 - DNA, 16 bp, Homo sapiens
cacatcttgctctgct

SEQ ID NO: 2824184 - DNA, 20 bp, Homo sapiens
cacatcttgctctgctgaca

SEQ ID NO: 2824185 - DNA, 18 bp, Homo sapiens
cacatgcacgtgtgtgca

SEQ ID NO: 2824186 - DNA, 15 bp, Homo sapiens
cacatggcctatgca

SEQ ID NO: 2824187 - DNA, 18 bp, Homo sapiens
cacatggctatgttttag

SEQ ID NO: 2824188 - DNA, 17 bp, Homo sapiens
cacatgtatctatgcat

SEQ ID NO: 2824189 - DNA, 12 bp, Homo sapiens
cacatgtcaccg

SEQ ID NO: 2824190 - DNA, 18 bp, Homo sapiens
cacattaatatttgctga

SEQ ID NO: 2824191 - DNA, 17 bp, Homo sapiens
cacattaattagatttt

SEQ ID NO: 2824192 - DNA, 21 bp, Homo sapiens
cacattaattagattttcttg

SEQ ID NO: 2824193 - DNA, 23 bp, Homo sapiens
cacattaattagattttcttgca

SEQ ID NO: 2824194 - DNA, 13 bp, Homo sapiens
cacattatttgca

SEQ ID NO: 2824195 - DNA, 15 bp, Homo sapiens
cacattatttgcatg

SEQ ID NO: 2824196 - DNA, 15 bp, Homo sapiens
caaccctgtttcctg

SEQ ID NO: 2824197 - DNA, 16 bp, Homo sapiens
caaccctgtttcctga

SEQ ID NO: 2824198 - DNA, 17 bp, Homo sapiens
caaccctgttttatact

SEQ ID NO: 2824199 - DNA, 19 bp, Homo sapiens
caaccgtggcccttcctgg

SEQ ID NO: 2824200 - DNA, 20 bp, Homo sapiens
caaccgtggcccttcctgga

SEQ ID NO: 2824201 - DNA, 22 bp, Homo sapiens
caaccgtggcccttcctggaca

SEQ ID NO: 2824202 - DNA, 23 bp, Homo sapiens
caaccgtggcccttcctggacag

SEQ ID NO: 2824203 - DNA, 13 bp, Homo sapiens
caacctaaatttg

SEQ ID NO: 2824204 - DNA, 14 bp, Homo sapiens
caacctaagcaaca

SEQ ID NO: 2824205 - DNA, 20 bp, Homo sapiens
caacctccccgcagagctcc

SEQ ID NO: 2824206 - DNA, 21 bp, Homo sapiens
caacctgaatacccttttctg

SEQ ID NO: 2824207 - DNA, 15 bp, Homo sapiens
caacctgaccaacat

SEQ ID NO: 2824208 - DNA, 21 bp, Homo sapiens
caacctgctctcctcttgcca

SEQ ID NO: 2824209 - DNA, 15 bp, Homo sapiens
caacctttccctcac

SEQ ID NO: 2824210 - DNA, 13 bp, Homo sapiens
caacctttgtgta

SEQ ID NO: 2824211 - DNA, 18 bp, Homo sapiens
caacctttgtgtaataaa

SEQ ID NO: 2824212 - DNA, 18 bp, Homo sapiens
caactagatcaaggagcc

SEQ ID NO: 2824213 - DNA, 21 bp, Homo sapiens
caactagatcaaggagcccag

SEQ ID NO: 2824214 - DNA, 14 bp, Homo sapiens
caactatttataaa

SEQ ID NO: 2824215 - DNA, 17 bp, Homo sapiens
caactatttataaacta

SEQ ID NO: 2824216 - DNA, 19 bp, Homo sapiens
caactccaggaaaactgtt

SEQ ID NO: 2824217 - DNA, 17 bp, Homo sapiens
caactcggagagggctg

SEQ ID NO: 2824218 - DNA, 13 bp, Homo sapiens
caactgaaaagac

SEQ ID NO: 2824219 - DNA, 22 bp, Homo sapiens
caactgaaaagactcagtgttc

SEQ ID NO: 2824220 - DNA, 20 bp, Homo sapiens
caacttctttttattttctt

SEQ ID NO: 2824221 - DNA, 23 bp, Homo sapiens
caacttgaaattatatctgtggt

SEQ ID NO: 2824222 - DNA, 24 bp, Homo sapiens
caacttgaaattatatctgtggtc

SEQ ID NO: 2824223 - DNA, 22 bp, Homo sapiens
caacttgtaaatacaccacctc

SEQ ID NO: 2824224 - DNA, 18 bp, Homo sapiens
caagaaactgaggaattt

SEQ ID NO: 2824225 - DNA, 19 bp, Homo sapiens
caagaaactgaggaatttt

SEQ ID NO: 2824226 - DNA, 18 bp, Homo sapiens
caagaaataagtttttgt

SEQ ID NO: 2824227 - DNA, 13 bp, Homo sapiens
caagaagaatata

SEQ ID NO: 2824228 - DNA, 18 bp, Homo sapiens
caagaagacatggagact

SEQ ID NO: 2824229 - DNA, 12 bp, Homo sapiens
caagaagctgct

SEQ ID NO: 2824230 - DNA, 20 bp, Homo sapiens
caagaaggggacagcgccac

SEQ ID NO: 2824231 - DNA, 22 bp, Homo sapiens
caagaagggttttccaccctgg

SEQ ID NO: 2824232 - DNA, 19 bp, Homo sapiens
caagaattctagaaaattt

SEQ ID NO: 2824233 - DNA, 14 bp, Homo sapiens
caagacgtcctgga

SEQ ID NO: 2824234 - DNA, 15 bp, Homo sapiens
caagacgtcctggaa

SEQ ID NO: 2824235 - DNA, 16 bp, Homo sapiens
caagactgttgctcaa

SEQ ID NO: 2824236 - DNA, 21 bp, Homo sapiens
caagacttctctttgcctcaa

SEQ ID NO: 2824237 - DNA, 13 bp, Homo sapiens
caagagaagaaaa

SEQ ID NO: 2824238 - DNA, 14 bp, Homo sapiens
caagagaagaaaaa

SEQ ID NO: 2824239 - DNA, 15 bp, Homo sapiens
caagagaattcactt

SEQ ID NO: 2824240 - DNA, 13 bp, Homo sapiens
caagagactgagt

SEQ ID NO: 2824241 - DNA, 23 bp, Homo sapiens
caagagatgaagagtgagagggc

SEQ ID NO: 2824242 - DNA, 18 bp, Homo sapiens
caagagcatcatgcctct

SEQ ID NO: 2824243 - DNA, 13 bp, Homo sapiens
caagagccctgtc

SEQ ID NO: 2824244 - DNA, 13 bp, Homo sapiens
caagagggctgct

SEQ ID NO: 2824245 - DNA, 17 bp, Homo sapiens
caagagggctgcttccc

SEQ ID NO: 2824246 - DNA, 14 bp, Homo sapiens
caagatctttcagg

SEQ ID NO: 2824247 - DNA, 19 bp, Homo sapiens
caagatgtcctccttgttc

SEQ ID NO: 2824248 - DNA, 13 bp, Homo sapiens
caagattcccaga

SEQ ID NO: 2824249 - DNA, 16 bp, Homo sapiens
caagcaaaaggagaga

SEQ ID NO: 2824250 - DNA, 18 bp, Homo sapiens
caagcacaaagctcaaga

SEQ ID NO: 2824251 - DNA, 14 bp, Homo sapiens
caagcacctcctgc

SEQ ID NO: 2824252 - DNA, 17 bp, Homo sapiens
caagcattcagaagaaa

SEQ ID NO: 2824253 - DNA, 14 bp, Homo sapiens
caagcattctgtct

SEQ ID NO: 2824254 - DNA, 14 bp, Homo sapiens
caagccacagaagc

SEQ ID NO: 2824255 - DNA, 19 bp, Homo sapiens
caagccacagaagccagga

SEQ ID NO: 2824256 - DNA, 21 bp, Homo sapiens
caagcctgaccacgctttcta

SEQ ID NO: 2824257 - DNA, 21 bp, Homo sapiens
caagcctgtaatcccagctac

SEQ ID NO: 2824258 - DNA, 20 bp, Homo sapiens
caagctcacagttcctcgcc

SEQ ID NO: 2824259 - DNA, 13 bp, Homo sapiens
caagctctgctcc

SEQ ID NO: 2824260 - DNA, 20 bp, Homo sapiens
caagctgaggtgcccaggag

SEQ ID NO: 2824261 - DNA, 14 bp, Homo sapiens
caagctgcatctag

SEQ ID NO: 2824262 - DNA, 13 bp, Homo sapiens
caagctggaagca

SEQ ID NO: 2824263 - DNA, 18 bp, Homo sapiens
caagctggaagcacatgt

SEQ ID NO: 2824264 - DNA, 21 bp, Homo sapiens
caagctggtcccactcagtcc

SEQ ID NO: 2824265 - DNA, 22 bp, Homo sapiens
caagctggtcccactcagtcca

SEQ ID NO: 2824266 - DNA, 13 bp, Homo sapiens
caagctgttccac

SEQ ID NO: 2824267 - DNA, 14 bp, Homo sapiens
caagctgttttctt

SEQ ID NO: 2824268 - DNA, 16 bp, Homo sapiens
caagctgttttcttct

SEQ ID NO: 2824269 - DNA, 21 bp, Homo sapiens
caagcttcaagtgatatatgt

SEQ ID NO: 2824270 - DNA, 17 bp, Homo sapiens
caagcttgtatatacat

SEQ ID NO: 2824271 - DNA, 18 bp, Homo sapiens
caagcttgtatatacata

SEQ ID NO: 2824272 - DNA, 21 bp, Homo sapiens
caagcttgtatatacatatta

SEQ ID NO: 2824273 - DNA, 21 bp, Homo sapiens
caaggactacgttaagggaag

SEQ ID NO: 2824274 - DNA, 14 bp, Homo sapiens
caaggagaaacaga

SEQ ID NO: 2824275 - DNA, 16 bp, Homo sapiens
caaggagaaacagaga

SEQ ID NO: 2824276 - DNA, 18 bp, Homo sapiens
caaggagaaacagagaca

SEQ ID NO: 2824277 - DNA, 19 bp, Homo sapiens
caaggagaaacagagacag

SEQ ID NO: 2824278 - DNA, 20 bp, Homo sapiens
caaggagaaacagagacagg

SEQ ID NO: 2824279 - DNA, 14 bp, Homo sapiens
caaggagcccagaa

SEQ ID NO: 2824280 - DNA, 12 bp, Homo sapiens
caaggaggaaaa

SEQ ID NO: 2824281 - DNA, 13 bp, Homo sapiens
caaggaggaaaaa

SEQ ID NO: 2824282 - DNA, 14 bp, Homo sapiens
caaggaggaaaaac

SEQ ID NO: 2824283 - DNA, 19 bp, Homo sapiens
caaggattgctactgtcct

SEQ ID NO: 2824284 - DNA, 16 bp, Homo sapiens
caaggcagcaaggccc

SEQ ID NO: 2824285 - DNA, 17 bp, Homo sapiens
caaggcagcaaggcccg

SEQ ID NO: 2824286 - DNA, 17 bp, Homo sapiens
attttgtaaactcaaaa

SEQ ID NO: 2824287 - DNA, 15 bp, Homo sapiens
attttgtaataaact

SEQ ID NO: 2824288 - DNA, 16 bp, Homo sapiens
attttgtaataaactc

SEQ ID NO: 2824289 - DNA, 19 bp, Homo sapiens
attttgtaataaactctct

SEQ ID NO: 2824290 - DNA, 10 bp, Homo sapiens
attttgtaca

SEQ ID NO: 2824291 - DNA, 20 bp, Homo sapiens
attttgtacaaagatatgct

SEQ ID NO: 2824292 - DNA, 16 bp, Homo sapiens
attttgtacagaattt

SEQ ID NO: 2824293 - DNA, 20 bp, Homo sapiens
attttgtatttttgaataaa

SEQ ID NO: 2824294 - DNA, 20 bp, Homo sapiens
attttgtggctttctttctt

SEQ ID NO: 2824295 - DNA, 13 bp, Homo sapiens
attttgttgtgat

SEQ ID NO: 2824296 - DNA, 15 bp, Homo sapiens
attttgttgtgattt

SEQ ID NO: 2824297 - DNA, 19 bp, Homo sapiens
attttgttgtgattttgta

SEQ ID NO: 2824298 - DNA, 14 bp, Homo sapiens
attttgtttgtaat

SEQ ID NO: 2824299 - DNA, 16 bp, Homo sapiens
attttgtttgtaatcc

SEQ ID NO: 2824300 - DNA, 15 bp, Homo sapiens
atttttaaacaagta

SEQ ID NO: 2824301 - DNA, 14 bp, Homo sapiens
atttttaaactagt

SEQ ID NO: 2824302 - DNA, 16 bp, Homo sapiens
atttttaaactagtaa

SEQ ID NO: 2824303 - DNA, 17 bp, Homo sapiens
atttttaaagtatatat

SEQ ID NO: 2824304 - DNA, 13 bp, Homo sapiens
atttttaatgact

SEQ ID NO: 2824305 - DNA, 15 bp, Homo sapiens
atttttaatgacttt

SEQ ID NO: 2824306 - DNA, 18 bp, Homo sapiens
atttttacaaataaagat

SEQ ID NO: 2824307 - DNA, 14 bp, Homo sapiens
atttttactaaagc

SEQ ID NO: 2824308 - DNA, 16 bp, Homo sapiens
atttttactaaagcag

SEQ ID NO: 2824309 - DNA, 21 bp, Homo sapiens
atttttactaaagcagtgttt

SEQ ID NO: 2824310 - DNA, 21 bp, Homo sapiens
atttttactactattctgtta

SEQ ID NO: 2824311 - DNA, 16 bp, Homo sapiens
atttttagagattaat

SEQ ID NO: 2824312 - DNA, 22 bp, Homo sapiens
atttttatacatatcagaaaag

SEQ ID NO: 2824313 - DNA, 18 bp, Homo sapiens
atttttatatcagcctga

SEQ ID NO: 2824314 - DNA, 20 bp, Homo sapiens
atttttatatcagcctgagt

SEQ ID NO: 2824315 - DNA, 14 bp, Homo sapiens
atttttatggaatt

SEQ ID NO: 2824316 - DNA, 16 bp, Homo sapiens
atttttcaaccagcat

SEQ ID NO: 2824317 - DNA, 20 bp, Homo sapiens
atttttcaaccagcatttta

SEQ ID NO: 2824318 - DNA, 22 bp, Homo sapiens
atttttcaaccagcattttact

SEQ ID NO: 2824319 - DNA, 23 bp, Homo sapiens
atttttgagccaagcttcaaccc

SEQ ID NO: 2824320 - DNA, 21 bp, Homo sapiens
atttttgatactaagcattga

SEQ ID NO: 2824321 - DNA, 20 bp, Homo sapiens
atttttgtacccttcctaca

SEQ ID NO: 2824322 - DNA, 17 bp, Homo sapiens
atttttgtgtttctaaa

SEQ ID NO: 2824323 - DNA, 19 bp, Homo sapiens
attttttaaaaaagcttaa

SEQ ID NO: 2824324 - DNA, 13 bp, Homo sapiens
attttttaaaata

SEQ ID NO: 2824325 - DNA, 16 bp, Homo sapiens
attttttaagtattta

SEQ ID NO: 2824326 - DNA, 18 bp, Homo sapiens
attttttaagtatttata

SEQ ID NO: 2824327 - DNA, 19 bp, Homo sapiens
attttttaagtatttatat

SEQ ID NO: 2824328 - DNA, 20 bp, Homo sapiens
attttttaagtatttatata

SEQ ID NO: 2824329 - DNA, 15 bp, Homo sapiens
attttttaattatta

SEQ ID NO: 2824330 - DNA, 20 bp, Homo sapiens
attttttaattattatttat

SEQ ID NO: 2824331 - DNA, 23 bp, Homo sapiens
attttttccttcaaagtttaata

SEQ ID NO: 2824332 - DNA, 16 bp, Homo sapiens
atttttttgagacaga

SEQ ID NO: 2824333 - DNA, 18 bp, Homo sapiens
attttttttaagtattta

SEQ ID NO: 2824334 - DNA, 13 bp, Homo sapiens
caaaaaaacacta

SEQ ID NO: 2824335 - DNA, 12 bp, Homo sapiens
caaaaaagaaaa

SEQ ID NO: 2824336 - DNA, 14 bp, Homo sapiens
caaaaaagaaaacc

SEQ ID NO: 2824337 - DNA, 18 bp, Homo sapiens
caaaaaagtatagaaaag

SEQ ID NO: 2824338 - DNA, 19 bp, Homo sapiens
caaaaaagtatttttttaa

SEQ ID NO: 2824339 - DNA, 17 bp, Homo sapiens
caaaaacaaaaccagct

SEQ ID NO: 2824340 - DNA, 19 bp, Homo sapiens
caaaaacaaaaccagctgc

SEQ ID NO: 2824341 - DNA, 17 bp, Homo sapiens
caaaaacctcacccgag

SEQ ID NO: 2824342 - DNA, 16 bp, Homo sapiens
caaaaagtttcctttt

SEQ ID NO: 2824343 - DNA, 17 bp, Homo sapiens
caaaaattacactacaa

SEQ ID NO: 2824344 - DNA, 21 bp, Homo sapiens
caaaaattacactacaagttt

SEQ ID NO: 2824345 - DNA, 19 bp, Homo sapiens
caaaacagagatgtgataa

SEQ ID NO: 2824346 - DNA, 14 bp, Homo sapiens
caaaacatatcaat

SEQ ID NO: 2824347 - DNA, 13 bp, Homo sapiens
caaaaccagctgc

SEQ ID NO: 2824348 - DNA, 20 bp, Homo sapiens
caaaacctcatgacagccag

SEQ ID NO: 2824349 - DNA, 21 bp, Homo sapiens
caaaacctgatgttaaaattc

SEQ ID NO: 2824350 - DNA, 13 bp, Homo sapiens
caaaacggggcag

SEQ ID NO: 2824351 - DNA, 16 bp, Homo sapiens
caaaacttcctgtttg

SEQ ID NO: 2824352 - DNA, 20 bp, Homo sapiens
caaaagaagaagtttcatca

SEQ ID NO: 2824353 - DNA, 19 bp, Homo sapiens
caaaagaagtaaaagcaaa

SEQ ID NO: 2824354 - DNA, 19 bp, Homo sapiens
caaaagaatcagaaacagg

SEQ ID NO: 2824355 - DNA, 16 bp, Homo sapiens
caaaagcaagactgtt

SEQ ID NO: 2824356 - DNA, 14 bp, Homo sapiens
caaaagcacccttg

SEQ ID NO: 2824357 - DNA, 22 bp, Homo sapiens
caaaaggtgcctgtgaggcagg

SEQ ID NO: 2824358 - DNA, 20 bp, Homo sapiens
caaaagtggattttcctgaa

SEQ ID NO: 2824359 - DNA, 17 bp, Homo sapiens
caaaagttagctgagcg

SEQ ID NO: 2824360 - DNA, 14 bp, Homo sapiens
caaaagtttctctt

SEQ ID NO: 2824361 - DNA, 21 bp, Homo sapiens
caaaataaaattatggtgaaa

SEQ ID NO: 2824362 - DNA, 14 bp, Homo sapiens
caaaataaattgaa

SEQ ID NO: 2824363 - DNA, 11 bp, Homo sapiens
caaaataattt

SEQ ID NO: 2824364 - DNA, 13 bp, Homo sapiens
caaaataatttaa

SEQ ID NO: 2824365 - DNA, 18 bp, Homo sapiens
caaaataatttaactaat

SEQ ID NO: 2824366 - DNA, 19 bp, Homo sapiens
caaaataatttaactaatt
